United States Patent 11,931,406 (FLAVIVIRUS VACCINE) - sequence listing, part 73

SEQ ID NO: 25171 - RNA, 9876 nt, Artificial Sequence
  derived and/or modified CDS sequence (opt11) from DENV-2__EU529694__SS-prME
accgccggcguuuucaucaugcugaucccaaccgcaauggcguuccaccucaccacccggaauggggagccccauaugauugucggccggcaggagaaggggaagucccuuuuguucaagaccgaggacggcguaaauaugugcacccuaauggcaauggaccugggggagcuaugugaggacacgaucaccuacaagugcccgcuccucagacaaaacgagcccgaggacaucgacugcuggugcaacagcaccagcaccugggugaccuacgggacgugcacaaccacgggcgaacaccggcgcgagaagcgguccgucgcccuggugccccacguagguaugggccucgagacccgaacagagaccuggaugagcagcgagggcgccuggaagcacguccagaggauugagacauggauccuccgccacccgggcuuuaccauuauggccgcuauccuggcauacaccaucgggaccacucauuuccaacgggcgcucaucuucauacucuuaacagccguugcgccgucuaugacgaugcgcugcauaggcaucucuaacagggacuucgucgagggggucagcgggggcuccuggguggacaucguucuugaacaugggaguugcguuacuacuauggccaaaaauaagccuacccuggacuuugaacugaucaagacggaggcgaagcaacccgcaacccuccgcaaauacugcaucgaggccaaacuuacgaacaccacuacagaaagucggugcccgacccagggagagcccagucugaacgaagaacaggauaagcgauucgugugcaagcacuccaugguggaucggggaugggguaacgguugcggccuguuuggcaaagggggcaucgugacaugcgcgauguucacaugcaagaagaauauggaaggaaagguggugcuucccgagaaucuggaguacaccaucgucaucacaccccacucgggggaagaacacgccgugggcaacgacacuggaaagcacggaaaggagaucaagauuaccccgcagaguaguaucaccgaggccgagcuuacaggauauggcacggucaccauggaguguagcccccggaccggcuuagauuucaacgagaugguucugcuccagauggaggacaaagccuggcuggugcaccggcagugguuccuggaccucccccugccuuggcugccgggcgccgacacccagggcagcaauuggauccagaaggagacgcucgugaccuucaagaacccacacgcgaagaagcaagacgucgugguccuggggucccaggagggcgccaugcacaccgcccugaccggggccacggagauccagaugagcagcggcaaccuccuauucaccggccaucugaagugucgccuccgaauggacaagcugcagcugaaggggauguccuacagcaugugcaccggcaaguuuaagaucgugaaagagauagccgagacccagcacggcacgauugugaucaggguccaauacgagggugacggcuccccgugcaagauccccuucgagaucauggaucuagagaagcggcacgugcugggacgcuuaaucaccgucaacccgauuguugcggaaaaggacagcccugucaacauagaagccgagccgccuuuuggcgacagcuacauaauaaucggugucgaaccagggcaacucaagcuaaacugguuuaaaaaggggagcucaaucggccaaauguuugagaccaccaugagaggcgcaaagcgaauggcuauauugggcgauacggcaugggacuucggcagccuagggggcguguucaccucgaucgggaaggcgcugcaccagguguucggcgcgauauacggcgccgcauuuuccgggguguccuggacaaugaagauccugauaggcgucaucaucacuuggaucggaaugaacagucgcuccacuucucugucugugucccucgucuuagugggcgugguuacccuguaccucggggcgaugguucaggccgacuccggcugcguaguauccuggaaguccaaggagcucaaguguggcuccggcaucuucaucaccgacaacguucacaccuggacggaacaguacaaguuccagcccgagucccccuccaaacuggccuccgccauccagaaagcccacgaggaaggcaucugcgggauccgcuccgugacccgcuuagaaaaccucauguggaagcaaaucacccccgaacuaaaccacauccucagugaaaacgaggugaagcugacuaucaugacgggcgauaucaaggguaucaugcaagcgggcaaacggucccugcgcccacaacccacggagcucaaauauagcuggaagacuuggggcaaggcgaaaauguuauccaccgagagccacaaccaaacuuuccugaucgaugggccugagacagccgaguguccgaacaccaaccgggcguggaacucccucgagguugaagacuaugguuucgggguguucaccacaaacauuuggcuaaaauugcgcgagaaacaggauguguucugcgacagcaagcucauguccgccgcgaucaaggacaaccgggccguccacgccgacaugggcuauuggaucgaauccgcccugaacgacaccuggaagauggagaaagccuccuucauagaggugaagucuugccauuggcccaagucccauacucuguggagcaacggcgugcucgaguccgaaaugauuaucccuaagaacuucgcggggccugugagccagcacaacuaccgcccggguuaucauacccagaccgcggggccguggcaccugggcaagcuggagauggacuuugacuucugugaggggacgacuguggugguaacugaagacugcgguaaccggggccccagcuugcgcaccacgacggccucagggaagcugaucaccgaguggugcugccggaguugcacccugcccccacuccgguaucguggcgaagacgggugcugguacgggauggagauacgccccuugaaagagaaggaagaaaaccuagugaacucccucgugacggcggggcacggccaaauugacaacuucagccuugggguccugggaauggccuuauuccuggaagaaaugcugcggacccguguggggacaaaacacgccaugcucuugguagccgucuccuucguaacuuuaaucaccgggaacaugagcuuccgggaccugggucggguaauggugauggugggggccacuaugacggaugacaucggaaugggcaucacuuaccuggcucugcucgcggccuucaaggugagacccacguucgcagccggguuacugcuccggaaguugacaucuaaggaacugaugauggccaccauaggcauagcgcuccuaucgcagaguaccauccccgaaacgauauuggagcucaccgacgcccuggcgcuugggaugaugguccucaagauugugagaaacauggagaaguaccaacuugccgugacaaucauggccaucagcugcguuccaaacgccguuauccugcaaaacgcauggaaggugucaugcaccauccucgcggccgucagcgugagcccccuucuucucacaagcucccagcagaaggcagacuggauaccacuggcccuaaccaucaaggggcucaaccccacggccaucuuucugacaacgcuaagccggacauccaagaaacgcucguggccgcucaaugaggccaucauggccgucgguauggugagcauccuggcuagcucauugcuaaagaaugacauuccgaugaccggcccucuaguugccggcgggcugcucacuguuuguuacgucuuaacgggacggagcgcggaucuggagcuugagagagccgccgacguaaagugggaagaccaggcagagauuagcggcagcagccccauccugaguaucaccaucagcgaggacgguucaaugagcaucaagaaugaggaagaggagcagacacuaaccauccuaauucggacgggccugcugguuaucuccgggguguuuccagugagcauccccaucacagcagcggcgugguaccucugggaggucaagaagcagcgcgccggugugcugugggacgugccaagcccaccgcccgucggaaaggcagagcuggaggacggcgcuuaccggaucaaacagcgcgggauuuuaggguacagccagauuggugccgguguauacaaggaaggcacauuucacaccauguggcacgugacccgcggggccgucuuaaugcaccgaggcaagcggauugagccgucuugggcggacgugaagaaggaccugauaagcuaugggggcggauggaaguuggagggggaguggaaggagggcgaagaaguccaaguacuggcccuagaacccgggaagaaccccagggccgugcaaacaaagccuggccucuucaagaccaacaccgggaccauaggcgccguuagcuuagacuucagcccuggcacuucagggagcccgaucgucgaucguaaggguaaagucgugggacuguauggcaacggcguagugacacguuccggcgcuuaugugagcgcaauagcgcaaaccgagaaaucuauagaggauaacccugagaucgaagaugauauauucagaaagaagcgccucacuaucauggaccugcacccuggugccgggaaaaccaagcgguacuuacccgcgaucguccgcgaggcgaucaagcggggccugagaacccuuauucuggcgccaacccgcgugguagccgccgagauggaggaagcccugcggggccuccccauaagguaucaaacuccggccauucgggcggagcacacgggacgcgagauagucgaccugaugugccaugccaccuucaccaugcggcugcucucacccguacgcgugccuaacuauaaccucauaaucauggacgaggcacauuucacagaucccgcaucuauugccgcuagaggcuacauauccacgcggguagaaaugggggaggccgcagguaucuucaugacggcaaccccacccgggagccgugacccuuucccccaaucuaaugcgccuauaauggacgaggagagggagaucccagagcgcagcuggaacuccggccacgagugggugacagauuuuaaaggaaagacggugugguucguccccagcaucaaggcgggcaacgacaucgcggccugccugcgcaaaaauggcaagaaagugauccagcugucccguaaaacauuugacagcgaguacgugaaaacucgggcuaaugacugggauuuugucgucacuacggacaucuccgagaugggggcuaauuucaaggcggagcgagugaucgauccccgucggugcaugaagcccgucauucugaccgacggggaagaacgcgugauucuggccgggcccaugccugugacacacaguagcgcagcccagcgucgaggccgcauuggccguaaccccaagaacgagaacgaccaguauaucuauaugggcgaaccgcucgagaaugacgaggacugcgcacacuggaaagaggccaagaugcugcuugacaacauaaacacccccgaaggcauuauaccgagcauguuugagcccgagcgcgagaaaguugaugcaaucgacggggaguaccggcuccgcggggaagcacggaaaacguucguggaucuuaugcgccgcggggaucuaccaguuuggcucgccuaccgcguggcugccgaagggaucaauuacgccgaccggcgcugguguuucgacgggaucaagaacaaccagauccuggaggaaaacguggagguugagaucuggaccaaggagggcgaacggaagaagcucaagccgcgauggcuggacgcccggauuuacucagacccccuggcacugaaggaguuuaaggaguucgccgcaggucgcaagagccucacccugaaucuaauuaccgagaugggucgucugcccacguucaugacccaaaaggcccgcgaugcacuggacaaccuggccgugcuccacaccgccgaggcuggcgggagagcguacaaccacgcucugagcgagcugccagagacccucgagacgcuacugcuccugacccuguuggcgacugucacgggcggcaucuuccuguuucucaugucggggaagggcaucgggaaaaugacgcuuggaaugugcuguaucaucaccgccuccauccucuuaugguacgcccagauccagccgcacuggaucgcagccagcaucauacuagaguucuuccugaucguccuguugaucccagagccugagaaacagagaacgccacaagauaaccagcugaccuacgugguaauugccauccugacugucguggccgcaacgauggccaacgagaugggcuuucucgagaaaacaaagaaggaucuuggccugggcagcauugccacccaggaauccgagucaaauauccucgacaucgaccugcgcccggcguccgccuggacccuguacgccguugcaaccaccuuugucacgcccaugcuccgccacagcauugagaacuccagcguuaauguguccuugaccgcuaucgccaaccaagccacgguccucauggggcucggcaagggguggccccugagcaagauggacaucggcgugccccuacucgccaucggguguuacucccaagugaacccgauaacccuuacugcugcgcuacugcuguuggucgcccauuacgccaucaucggcccuggcuuacaggcuaaggccacacgggaagcgcagaaacgcgccgcugccgggaucaugaagaacccaacgguggauggcaucacagugauugaccuggagccaauuccguacgaccccaaguuugaaaagcaauuggggcaggucaugcucuuaauucugugcgugacccaggugcucaugaugcggacgacuugggcucugugcgaggcgcugacucuagcaaccggucccauaagcacgcugugggagggcaaccccgggcgguucuggaacacgaccaucgcggugagcauggccaacauauucaggggaagcuaccuggcgggggccgggcuacuuuucucaaucaugaagaacaccaccaacacucggagaggcaccggaaacaucggcgaaacccugggggagaaauggaaaucccgccucaacgccuugggcaaguccgaguuccagaucuacaagaagucggggauccaggagguggaucggacccuggccaaagagggcaucaagagaggggaaacggaccaucaugccgugucccgcggcagcgcgaagcuccguugguucgucgagcgcaacaugguaaccccggagggcaaagucgucgaccuagggugcggacgcggcgggugguccuacuacugcggcgggcugaagaacgugcgcgaggugaaggggcugaccaaagguggucccggacacgaggagccaauccccauguccaccuacggcuggaaccugguccggcugcagucggggguggacguguuuuucacgccgccggagaagugugacacccuccuuugugacaucggcgagucguccccgaacccgacuaucgaggccggccgcacccucagaguccuaaaucugguugagaacuggcugaacaauaacacgcaguucugcaucaaggugcucaacccguacaugcccagcguuaucgagaagauggagacucugcagcgcaaauauggaggagcccugguucgcaauccgcugagccgcaacucuacccaugagauguacugggugucuaacgcgaccgguaacaucgucuccucagucaacaugaucucccggaugcucaucaaccguuuuaccaugaagcacaagaaagccacguaugagccggacguggaucugggaagcgggacccgcaacauaggcaucgaaucugaaauucccaaccuagacaucaucggaaagcggauagagaagaucaagcaggagcaugagacuagcuggcacuacgaccaggaccauccuuacaagaccugggcguaccacggaucauacgaaacgaagcagacaggaucagcuaguagcaugguuaacgggguggucagacuccugaccaaacccugggacgucgugccuauggugacccagauggcgaugacugacaccacccccuucggccagcagcgggucuucaaggagaagguggauacccgcacgcaggagcccaaggagggaacgaagaaacugaugaaaaucaccgccgaguggcuuuggaaggagcucgggaaaaagaagacgccucggaugugcacacgcgaggaguucaccaggaaggugcggagcaacgccgcgcugggggccaucuucaccgacgagaacaaauggaagucugccagggaggcuguggaggacagucgcuucugggagcuaauagaccgggagcgcaaccugcacuuggaagggaagugcgagacuuguguauacaauaugaugggcaaacgagaaaagaagcucggggaguucggcaaggcaaagggcucaagggccauaugguauauguggcugggugcccgguuucuugaguuugaggcauuaggcuuccuaaaugaggaccacugguuuucacgcggcaauucccugucuggcguggaaggggaaggucuccaucgacugggcuacauacugcgcgacgucucgaagaaggaagggggcgcaauguacgcggacgacacugccgggugggacacacgcaucacccuagaggaccugaaaaacgaggagaugguuacuaaucacaugaaaggcgagcauaaaaaguuggccgaggccaucuucaagcucacuuaucaaaacaaggugguacgcgugcagcggccgacuccccggggaaccgucauggacaucaucagccgccgggaccagcgcggcuccggacaggucgggaccuauggccugaacacauucaccaacauggaggcccaacugauccggcagauggagggggagggcauauuuaagucaauccaacaccucacagugaccgaggagauugcgguccagaauuggcuugcccgcgugggccgggaacgacugucccgaauggccaucucaggggacgacugcguggucaagccccuagacgaccgauucgccuccgcucugacggcgcugaacgauaugggcaaagugaggaaggauauucaacaaugggagcccucacgcggguggaaugacuggacucaggugccuuuuugcucccaccacuuccacgagcuugucaugaaagacgggcggguacugguuguccccugccgcaaccaggacgaguugaucggccgggccagaaucucucaaggcgcaggauggagccucaaggagaccgcgugccuaggcaagagcuacgcacagauguggacccugauguacuuucaccggcgcgacuuacggcucgcugccaacgcuauauguuccgcgguucccagccacuggguccccaccucuagaacgacauggagcauccacgcgaagcacgaauggaugaccacggaggacaugcuggccguauggaaccggguguggauccaggagaacccguggauggaggacaagacgccgguagagagcugggaggagguucccuaccuuggcaagcgcgaagaccaguggugcggaagccugaucggccugaccagccgcgccaccugggccaagaauauccagaccgcgauuaaucaagugcggucccucaucgggaaugaggaguacaccgauuacaugcccagcaugaagcgcuuccggcgcgaggaggaggaggcgggcgugcugugguga

SEQ ID NO: 25172 - RNA, 9876 nt, Artificial Sequence
  derived and/or modified CDS sequence (opt11) from DENV-2__EU529695__SS-prME
accgcuggcguaauaaucaugcugauccccaccgccauggcguuccaccuaacaacccgcaacggcgagccccacaugauuguaggucggcaggagaaggggaagucucugcuguucaagaccgaagacggggucaacauguguacucucauggcgauugaccugggggagcugugcgaggacaccaucaccuacaaaugcccccuccuaagacagaacgagcccgaggauaucgacugcuggugcaacagcacaucuaccugggugaccuacggaacauguacaacuacgggagaacaccggcgggagaaacgcuccgucgcccuggucccccacguggggaugggccucgagacccgcacggagaccuggaugagcucggagggcgccuggaagcauguccagcggaucgaaaccuggauccugcgccacccggguuucaccaucauggccgcaauccuggccuacaccaucgggaccacccacuuccagcgggcccucauauuuauccugcugaccgccguggcgccgagcaugacuaugcgauguauuggaauuagcaacagggacuucguggagggugucagcgggggcuccuggguggacaucguccucgagcaugggagcugcgucaccacaauggcaaagaacaagcccacccuggacuucgagcugaucaagacggaggcaaagcaaccagccacccucagaaaguacugcaucgaggccaagcugacgaacaccaccaccgagucccggugcccaacgcaaggcgagcccagccugaacgaggagcaagacaagcgcuucaucugcaagcauuccaugguggacaggggcugggggaacggcuguggccuguucggcaagggugggaucgugaccugugcuauguucacgugcaagaagaacauggagggcaagguugugcuaccugagaaccuggaauacaccaucgugaucacgccccacucuggggaagagcacgccgucggcaaugacaccggaaagcacggcaaggagaucaagaucaccccacaaaguucaaucaccgaagccgagcucaccggguauggcacgguaaccauggagugcagcccgcggaccggccuggacuucaacgagauggugcugcuccaaauggaggacaaggcuuggcugguccaccggcaaugguuccuggaccucccccugcccuggcuuccgggggccgacacccaaggcagcaacuggauucagaaggagacgcuaguaaccuuuaagaacccccacgcgaagaagcaagacgugguggugcuggggagccaggagggcgcgaugcacaccgcccucaccggugccacggagauccagauguccagcggcaaccucuuauucaccggccaucugaagugcagacuccggauggacaagcugcaacugaagggcaugagcuacagcaugugcacgggaaaguucaagaucguaaaggagauagccgaaacccagcacgguacgaucgugauccgagugcaauacgagggcgacggcuccccuugcaaaauccccuucgagaucauggaucucgagaagcggcacguccuggggcgacugauaaccgugaacccgauugugacggagaaggacagccccgucaacaucgaggcggagccccccuucggcgacuccuacaucaucaucggaguugagcccggccagcucaaacuaaacugguuuaaaaaggggaguagcauaggccagauguucgagaccacgaugcgcggcgcaaaacggauggccauccucggggauaccgccugggacuuuggcagccucggaggcguguucacguccaucgggaaggcccugcaccaggucuucggcgcuaucuauggugccgcauucagcgggguguccuggaccaugaagauccugauuggggugaucaucacuuggauagggaugaacagccgcaguaccagccugagugucagucucgugcuggugggggucgugacccucuaccucggggugauggugcaggcggacuccggcugcguugugagcuggaagaacaaggagcugaagugcggcuccgggaucuucaucaccgauaacguccacacguggaccgagcaguacaaauuccagcccgagagccccagcaagcuggcguccgccauucagaaggcccacgaggagggaaucugcggcauccggagcgugacccgucuugaaaaccugauguggaaacagauaacuccugagcugaaucacauucucucugagaacgaggucaagcugacgaucaugacgggcgacauuaaggggaucaugcaggccggcaagagaagucugcgcccgcagcccaccgaacucaaguacagcuggaaaacauggggcaaggccaagaugcucagcacggaaucccacaaucagaccuuccugaucgacgggcccgagaccgcggaguguccgaacacgaacagggccuggaacagccuagaggucgaagauuacggcuucgggguguucaguacgaacauauggcugaaacuccgugaaaagcaagacguguuuugcgacucaaaacucaugagugccgccaucaaggacaaucgggccguccaugcggacaugggcuacuggaucgagucagccuugaaugacacguggaagauggagaaggcauccuucaucgaggugaagaguugccacuggcccaagucccacacccuguggagcaacggcgugcucgaauccgagaugaucauccccaagaauuucgccgggcccguuucucagcauaacuaccgcccgggcuaccacacccaaaccgccgggcccuggcaccuugguaagcuggagauggauuucgacuucugugaggggacgaccgugguugucacugaggacugcgguaaccggggcccaagcuuaagaaccacgacugcguccgggaagcugaucaccgagugguguugcagaagcuguaccuugccgccccuccguuaccggggagaagauggguguugguacgguauggagauccgcccguugaaggagaaggaggagaaccuugugaacucccuagugacggccgggcacggacagaucgacaacuucucacugggcguacugggcauggcccuuuuccuggaagaaaugcugcggacacgcgugggcaccaaacacgccauccuccugguggcgguuuccuuugugacccugaucacggggaacaugagcuuucgggaccucggccgcgugauggucauggucggggcaacgaugacggacgacaucggcaugggggugacguaccuggcccugcucgccgcguucaagguccgcccgacauucgcggccgggcugcugcuucggaagcugaccucuaaggaacugaugauggccaccauuggcaucgcccucuugagccaguccaccauacccgagacgauacucgagcucaccgacgcccuggcgcuugggaugaugguucucaagaucgugcgcaacauggagaaguaucagcucgccgucaccaucauggccauaagcugugugccuaacgccguaauccugcagaacgccuggaaggucaguuguaccauccucgcagccguguccgugucuccccuacugcucacgagcucccaacagaaggcggacuggauaccccucgcccugaccaucaaggggcucaaccccaccgcaaucuuccugaccacgcugagccgcaccuccaaaaagcgcucauggccgcucaacgaggccguaauggccgugggaauggucuccauucuggccagcagccugcucaagaacgacauacccaugaccgggccacugguagccggcggacugcuaaccguaugcuacguucugacgggccguuccgcggaccuggaacucgagcgugcggcugacgugaagugggaggaccaggccgaaauaagcggguccagcccuaucuuguccaucaccaucagcgaggacggcucuaugaguaucaagaacgaggaagaggagcaaacccugaccauacucauccggacgggauugcuggugaucuccggggucuucccggugagcaucccuaucaccgccgcggccugguaucucugggaagugaagaagcagcgcgccggcguuuuaugggacgugcccagcccgccgcccguggggaaggccgagcuggaagacggcgccuaccggaucaagcagcgcggcaucuucggcuacucucagaucggagccggggucuacaaggagggaacuuuccauaccauguggcacgugacccgcggugccgugcuuaugcaccgcggcaagcggauagagcccucaugggcggacgucaagaaggaccuuaucagcuaugggggcggcuggaagcuggaaggggaguggaaagagggugaagagguucagguguuagcucuggagcccgggaagaauccacgugccguacagacgaagccgggccuguucaagacaaacaccgggaccaucggcgccguguccuuggacuucucucccggaacgucagggagucccaucguggaccggaaaggaaaagucguaggccuguacggcaacggcguggucacgcgcagcggggccuacgugucugccaucgcccagaccgagaaaaguaucgaagacaaccccgagauugaggacgacauauuccggaaaaagcgauuaaccauuauggaccuccacccaggugcgggcaagacgaagagguaccugcccgccaucgugcgcgaggccauuaaacggggccugcgcaccuuaauccucgcgccgacccgcgucgucgccgcggagauggaggaggcuuuaagagggcugcccauccgcuaccagacgcccgcaauccgugcagaacacacgggacgcgaaaucguggaccuuaugugccacgcaaccuucacgaugcggcuucucucccccguccgcgugcccaacuacaaccucauuauuauggacgaggcgcacuucaccgaccccgccagcaucgccgcgcggggcuacauauccacccgcguggagaugggggaggccgcuggcaucuucaugacagccacgccgcccgguagcagagaccccuucccccagucuaacgcccccauuauggacgaggagcgagagauccccgagcggucauggaacuccggccacgaaugggucaccgacuucaaagggaagacugugugguucgucccaagcaucaaggccgggaacgacaucgcggcaugccugcgaaagaacgguaaaaaggucauccagcuuuccagaaagacguuugacucggaguacgugaagacccgggccaacgacugggacuuugucgucaccacggacaucuccgagaugggggccaacuuccgggccgagcgcguuaucgacccccggcgcugcaugaaacccgugauucucaccgacggcgaggaacgaguuaucuuagccgggcccaugccgguaacgcacagcuccgccgcucagcgucgcggccggaucgggcgaaaccccaagaaugagaaugaccaauauaucuacaugggcgagccgcuggagaacgacgaggacugcgcccauuggaaggaagccaagaugcugcuggacaacaucaacacacccgagggcaucaucccuuccauguucgagccugagcgagagaaaguagacgcaauugacggggaguaucgcuuaaggggcgaggcccgcaagacauucgucgaccucaugcgccgcggggauuugccaguguggcuugccuaucggguugcagccgaggguaucaauuacgcggaccgccgauggugcuucgauggcaucaagaauaaucagauacucgaggagaaugucgaaguggagaucuggaccaaggagggcgagagaaagaagcugaagccgcgguggcuggacgcccgcaucuacucggacccacucgcccugaaggaguucaaggaguucgccgcagggcggaaaucccucacccucaaccugauuaccgagauggggaggcugcccacguucaugacccagaaggcccgggaugcgcucgacaacuuagccguccuccacacggcugagguuggcgggcgagcguauaaccacgccuuguccgaguugcccgagacccuggagacacuccugcugcucacguuacuggccacaguuacgggcgggauauucuuauuccugaugucagggaagggcaucgggaaaaugacgcugggcauguguugcaucaucacagcgucuauccuccugugguacgcccaaauccagccacacuggaucgcugccagcaucauucuggaguucuuccucauugucuugcugauccccgagcccgagaagcagcgaacaccccaggacaaccaauugaccuacguggugaucgccauccugacaguaguagccgccacuauggcgaaugagaugggguuccuagagaaaaccaagaaggaccuaggccugggcucaaucaucacccaggaguccgagucuaacauccuagacauugaucuacgaccggccuccgccuggacgcuguacgccguggccacgacuuucguuacccccaugcuuagacacagcaucgagaacucgucaguuaacgugucccucaccgccauugccaaccaggccacugugcugauggggcugggucgcggauggccccugagcaaaauggacaucggcgugccccuguuagccauaggaugcuacucccaggugaauccgaucacccucaccgcggcccugcuacuucuggucgcccacuacgccaucaucggcccaggccugcaagccaaagcgacccgcgaagcgcagaagcgggccgccgccggcaucaugaaaaacccaacuguggacggcaucaccgugaucgaccucgagcccaucccguacgaucccaaguucgagaagcagcuggggcaggucaugcugcuaguauugugcgugacccagguuuugaugaugcggaccacgugggcgcucugcgaggccuuaacccuggccaccggcccuaucagcacccucugggaggggaaccccgguagguucuggaauacgaccaucgcaguuuccauggccaacaucuuucgcggcagcuaucuagcgggggcuggccucuuguucuccaucaugaagaacaccacaaauacgcggcgugggaccggcaacaucggagagacccuuggggagaaauggaagucccggcugaacgcccugggcaagucagaguuccaaauauauaaaaaguccgggauucaggagguggaccgcacguuggccaaggagggcaucaagcgcggugagacggaccaccacgccguaucccgcgggucugccaagcugcgcugguucgucgagcgcaacauggugaccccggagggcaaggucguggaccucgggugcggccgugggggcuggagcuacuacuguggcgggcuaaagaacguacgcgaggucaagggccugaccaagggcgggcccgggcacgaggagccgauuccaaugagcacguacggcuggaauuuggugcgucugcagagcggcguggacguauucuucaccccgcccgagaagugcgacacccugcucugugacauuggcgaguccagccccaaccccaccaucgaggccggcagaacccugcgggugcuaaaccucguugagaacuggcugaacaauaacacgcaauuuugcaucaaaguccugaacccguacaugcccuccgugauugagaagauggaaacccuccagcgcaaguacgggggcgcccuggugcguaaccccuuaucucgcaacuccacccacgaaauguacuggguaagcaaugccacagggaacaucguauccagcgugaacaugauuucccgcauguuaaucaacagauucaccaugaagcacaagaaggcgacguacgagccagacgucgaccuuggcagcgggacucgcaacauaggcauagagaacgagauacccaaucuggacaucauaggcaaacggauagagaagaucaaacaggaacacgaaaccuccuggcacuacgaccaggaccaccccuacaagaccugggcguaccacgggagcuacgagacgaagcagaccggcuccgccagcuccauggugaacggggugguccgcuugcucacuaagcccugggacguggugccgauggucacccagauggccaugacggacaccacccccuucggccagcagcggguauuuaaggagaaaguggacacccgcacacaggagcccaaggagggcaccaaaaagcugaugcggaucaccgccgaauggcuguggaaagagcucgggaagaaaaagacuccccggaugugcacgcgggaggaguucaccaggaagguccgcaguaacgcggcccugggcgccauuuucaccgaugaaaauaaguggaaauccgcccgcgaggcaguggaggacagccgguucugggagcuugucgaccgcgagcggaaccuccaccuugaggggaagugcgaaacauguguguacaacaugaugggcaagcgcgagaaaaagcugggggaguucggcaaggcgaagggcucucgggccauaugguacauguggcuuggggcccgcuuucuggaguucgaagcgcugggcuuccucaacgaggaccacugguucucucgggggaauagcuuauccggcguggagggggagggccugcauaagcucggcuacauccugagagacgucagcaagaaggagggcggcgcuauguacgccgacgacacggcagggugggauacccggaucacccucgaggacuuaaagaaugaggagaugguaaccaaccacaugaagggggagcacaagaagcuggccgaagcgaucuucaagcugaccuaccagaacaaggugguccgcgugcaaaggccgacaccccggggaaccguuauggacauuaucucccgcaaggaccagaggggcagugggcagguugggaccuacggccucaauacguuuaccaauauggaggcgcaguugauccgccagauggagggugaaggcauauucaagucgauccagcaccuuaccgucaccgaggagaucgccgugcagaacuggcucgcccggguuggacgggagcggcugagccgcauggccauuuccggggacgacugcgucgugaagccccuagacgaccgguuugccucugcgcucacggcccuaaacgauaugggcaagguacgcaaggacauccagcagugggagcccagucggggcuggaacgauuggacccagguaccguuuugcagccaccauuuccacgagcuggugaugaaagacggacgcguccucgucguccccugccgaaaccaagacgagcugaucgggcgugcccgcaucucccagggcgccggauggagccugaaagaaacagccugucucgggaagucuuacgcccagauguggacccugauguacuuccaccgcagagaucugcgccucgccgcaaaugccaucugcagcgcaguccccucccacugggucccgaccucacggaccaccugguccauccaugcgaagcacgaauggaugaccaccgaggacaugcuggccgucuggaaucgcgucuggauccaggagaaccccuggauggaggauaaaacgccggucgagagcugggaggaaguacccuaccugggcaagcgugaggaccaauggugcgggagccucaucggccugaccucccgagcaaccugggccaagaacauucaaaccgcgaucaaccagguccgcagccucauugggaacgaggaguacaccgacuacaugcccuccaugaagcgguuuagaaaggaggaagaggaagcuggcguacucugguag

SEQ ID NO: 25173 - RNA, 9876 nt, Artificial Sequence
  derived and/or modified CDS sequence (opt11) from DENV-2__EU482562__SS-prME
accgccggggugaucauaaugcugauccccaccgccauggcguuccaucuuaccacccggaacggggagccgcacaugaucguggggcggcaggagaaggguaagucccugcuguucaagaccgaagacggcgucaacaugugcacccuuauggccaucgaccugggggaacugugugaggacacaauuacauauaagugcccccuccugcgccagaacgagcccgaggacauugacuguuggugcaacagcaccuccaccugggugacguacgguaccugcaccaccacgggcgaacacagacgcgaaaagcggagcguagccuuggugccucacguuggcaugggccucgagacccggaccgagaccuggaugagcuccgagggggcuuggaaacacgugcagagaaucgaaaccuggauuuugcgccauccgggcuuuaccaucauggcggcgauccuggccuacaccauaggaacgacucacuuucaacgggcccucaucuuuauccugcugaccgccguggcgcccagcaugaccaugagaugcaucggcaucucaaacagggacuucguggagggcgucagcgguggaaguuggguggacaucgugcucgagcacggguccugcguaaccacgauggccaaaaacaagcccacacuggacuucgaacugaucaagaccgaggcuaagcagcccgccacccugcguaaguacugcaucgaggcuaaauugacgaauaccacaacggagagucgcugcccuacgcagggcgagccgucucuaaaugaggagcaggacaaacgauucgugugcaagcacaguaugguggaucgggggugggggaacggcuguggccucuucgggaagggggguaucguaaccugcgcgauguuuacgugcaagaaaaacauggagggcaagguggugcugcccgagaaccuggaguacaccauuguaauuacgccccacagcggggaggagcacgcaguaggaaaugauaccgggaagcacggcaaggaaaucaagaucacuccgcaguccagcaucacagaggcggaacucacaggguauggcacggugacuauggagugcagcccccggaccggccuggacuuuaacgagaugguucugcuccagauggaagauaaggccuggcuggugcaccggcagugguuccuggaccucccccugcccuggcugccaggggccgacacccaaggaagcaauuggauccagaaggagacgcuugucaccuucaagaacccccacgcgaagaagcaagacguuguggugcugggcucccaggagggcgccaugcacaccgcccugaccggggcgacugagauccaaaugaguagcggaaaccuccuguucacaggacaccuaaagugccgcuuacguauggacaagcugcagcuuaaggggauguccuacagcauguguacuggcaaauuuaagaucgugaaggaaaucgccgagacccagcaugggacgaucgucaucagaguccaguacgagggagacggcaguccuugcaaaauacccuucgaaaucauggaccucgagaaacgacacguguuggggcgcuuaaucaccguuaacccgaucgucacugagaaggacagccccguuaacaucgaagcagagccgcccuucggagacaguuacauaauuaucgggguggaaccgggacagcucaagcugaauugguucaagaaggggagcucuauuggacagauguucgagaccacgaugcgcggcgcuaaacggauggccauacugggcgacacagccugggacuuuggcagccucgggggcgucuucacguccaucggcaaagcccugcaccaaguguuuggcgcgaucuacggggccgccuucagcgggguguccuggacuaugaaaauccugauaggcgucaucaucacguggauagggaugaacagccguuccaccagccugucggugagccucgugcuggugggaguggucauacuguaucucggagcuaugguccaagcugauucggggugcguagugagcuggaaauccaaggagcugaagugcggcagcggcauuuucaucacggacaauguccauaccuggacugagcaguacaaauuccaacccgagagccccuccaagcuagccucugcaauccagaaggcccacgaagaagggauauguggaaucagaagcgucacaaggcucgagaaucuuauguggaagcagaucacccccgagcucaaucacauacucagcgagaacgaagugaaacucaccauuaugacgggcgacauuaaagggauaaugcaagcuggcaagcggucccugcgaccccagcccaccgaguugaaguauucauggaagaccugggguaaggcaaagaugcuuucaaccgagagccacaaccaaacuuuccugaucgauggccccgagacugccgagugcccgaauacgaaucgggccuggaacucccuugaagucgaagacuacgguuucggcguguucacaacgaacaucuggcugaagcugcgagagaagcaagauguguucugugacagcaaacucauguccgcugccauaaaggauaaccgugcgguccacgcggacaugggcuacuggaucgagagcgcgcugaacgacaccuggaagauggagaaagcgucuuucaucgaggucaagagcugccacuggcccaagucccacacguuguggucgaacggcguccucgaauccgagaugaucauucccaagaacuuugcggggcccgugagccaacacaacuaccggccgggcuaccacacccagaccgcggggcccuggcaccugggaaagcuggagauggacuucgacuuuugugaggggacgacaguagugguaaccgaggacuguggaaaccggggcccaucucugcgcacaacgacggccuccgggaagcugaucaccgaguggugcugccggucuugcacccuacccccgcuccgcuaccggggcgaggaugggugcugguauggcauggagauucguccccugaaggagaaggaggagaaccugguaaacucccuagugacggcggggcacggccagaucgacaacuucagucuugguguccucgggauggcccuguuucuggaagagaugcuacgcacacgcgugggcacgaagcacgcgauacucuugguggcggucuccuuuguaaccuugauuacggggaauaugagcuuucgagacuuaggccgcgugaugguuauggugggggccacuaugaccgacgacauuggcaugggcgugaccuaccuggcccugcucgccgcguucaaaguccgccccacguucgccgccggccugcugcuccggaagcuuacgucgaaggagcugaugauggccaccaucgguaucgcccuuuuaagccaauccaccauccccgagacaauacuggaguuaaccgacgcgcuggcguuagggaugaugguguuaaagaucguuaggaauauggagaaguaccagcuggcuguaacgaucauggccauaagcugcgucccuaacgccguaauacugcagaacgcguggaaagucuccuguaccauccuugcagccgugagcguuagcccccugcugcuaacuucgucccagcagaaggcagauuggaucccccuagcacucaccaucaaggggcucaaccccaccgcuauauuucugacaacgcugucgcguaccuccaagaaacgcuccuggccgcucaaugaggccauuauggccgucggcauggucucuauacuggccagcagucugcucaaaaacgacauccccaugaccgggccccuggucgcgggcggccugcucaccgugugcuacgugcugaccggccguuccgccgaucuggaacucgaacgagccgccgacguaaagugggaggaccaggcugagaucagcgggucaucacccauucuguccaucaccaucucagaggacgguuccaugagcauuaagaaugaagaggaggagcaaacccuuaccauccucauccggaccggccugcucgugaucaguggggucuucccggucucgauccccaucaccgcggccgccugguaucucugggaggugaaaaagcaacgcgccggagugcugugggacgugccuagcccgccgcccguggguaaggcggagcuggaggacggugcguacagaaucaagcagcgcgggaucuuaggcuauagccagaucggcgccgggguguauaaggaagggacuuuucauaccauguggcacgucacccgcggggccguacuuaugcaccgcggcaaacggauugagcccuccugggccgaugugaaaaaggacuuaaucagcuacggggggggcuggaagcucgagggugaguggaaggagggagaagaaguccaggugcuggcccuggagccugggaagaauccucgcgcggugcagacgaaaccuggccuauuuaaaaccaacaccgggacaauaggcgcuguaucacuggacuucagcccaggcacgagcgggagccccaucguggaccggaagggaaagguggucgggcuguacggcaauggcguggugacccgcuccggagccuacgucuccgccaucgcucaaaccgagaaguccaucgaagacaacccagagaucgaggacgacaucuuccggaagaaacgucucaccauaauggaccugcacccaggggcagggaagacgaaacgguaccugcccgccaucgugcgcgaagccauuaagcgggggcugcgcacucucauccucgccccuacccgcguggucgcggccgagauggaggaggcccugagggggcuccccauccgcuaccagacccccgccauacgugcggagcacaccggccgcgagauaguggaccucaugugucacgcgaccuucaccaugcggcuacuuucacccguccgcguccccaauuacaaccugauuaucauggacgaggcucauuucacagaccccgcgagcaucgccgcccggggcuacaucuccacgcgcguggagaugggggaagcggccggaaucuucaugacggccacuccuccuggaaguagagacccguucccccagagcaaugcccccaucauggaugaggagcgcgagaucccagagaggagcuggaacagcggacacgagugggugaccgauuuuaaggggaaaacgguuugguucguuccgucgauaaaggcgggcaacgauauugccgcgugccugcgcaaaaacggcaagaaagugauccagcucucccgcaagaccuucgacagugaguacgugaagacccgcgccaacgacugggacuucguagucacuacggacauuucugagaugggggccaacuucaaggcggagcgggugauugauccgcgcaggugcaugaaaccagugauccugaccgacggagaagagcgcgucauccuggccgggcccaugccagucacccacagcuccgcggcccagcggcgcggucguaucggccggaaccccaagaacgagaacgaucaguacaucuacaugggugagccccucgagaaugacgaggacugcgcucacuggaaagaggccaagaugcugcuggacaacauuaacacucccgagggcaucaucccaagcauguucgagcccgagcgcgaaaagguggacgcuaucgauggggaauaccggcuccgcggcgaagcccggaagacguucguggacuuaaugcgcaggggugaccugccagucuggcucgccuaccgcguggcagcggaaggcaucaauuacgcggaucggcgcuggugcuucgacgggauaaagaacaaccagauccuagaggagaacguggaaguggagaucuggaccaaggagggcgagcgcaagaaacugaagccgcgcugguuagacgcacggaucuauuccgacccccucgcccugaaggaguucaaggaguuugcugccgggcgcaagucccugacccuuaaccuaaucaccgagauggggcgucuaccgacguucaugacgcagaaagcccgcgacgcccuggacaaccuggccgugcuacacaccgcggaggcuggcgggagggcauacaaccacgcgcugucugagcugccagagacgcucgaaacgcuacugcuguugacgcugcucgcuaccgucaccgguggcauauuccuguuccugaugagcgggaaggguaucgggaaaaugacucucggcaugugcugcaucauaaccgcauccauccugcugugguacgcccagauacagccucacuggauugccgccagcaucauccucgaauucuuccugaucguccuucucauccccgagccagagaagcagcgaacuccccaggacaaccagcugaccuacguagucauugccauacuuaccgugguggccgcgacgauggcaaacgaaaugggguuucucgagaagaccaagaaagaccuagggcucggcagcaucaccacucaggaguccgaaagcaacauccucgauauagaccuucguccggcauccgccuggacgcuguacgcugucgccaccacguucguuacuccuaugcuacgccacagcaucgagaauuccucggugaacgucagccugacggccauagcaaaccaggcaaccguucugaugggccucggcaagggguggccccuaagcaagauggacaucggcgugccccugcucgccaucgggugcuacucccaagucaacccaauaacccucaccgccgcuuuacuccugcugguggcccacuaugcuaucaucggcccaggccuccaggccaaggcgacacgggaggcccaaaaacgcgcugcggccgggauuaugaagaacccuaccguggauggcaucaccguaaucgaccuggaaccaaucccguacgacccuaaguucgaaaagcagcuggggcaggucaugcucuugauucugugcgugacucaaguacucaugaugcgcacgaccugggcacugugcgaggcgcugacccuggccaccggccccaucagcacgcugugggaggggaaccccggcagauucuggaacaccaccaucgcgguguccauggcgaacaucuucaggggaucauaucuggccggggcaggccuauuguuuuccaucaugaagaacaccacgaacacccgacgcggaacaggcaauaucggcgagacccugggugagaaguggaagucacgguuaaaugcccuugggaagagugaguuccagaucuacaaaaaguccgggauacaggaaguggaccgcacgcuggccaaggagggcauuaaacgcggugagacugaccaccacgccgugucucgaggcagugcuaaguuacgaugguucguugagcguaauaugguaaccccugagggcaagguaguugaccuggggugcggacguggcggguggucuuacuauugcggcgggcugaaaaacgugcgggaggucaaggggcuaaccaagggcgggccggggcacgaggagccaauccccaugagcacguacggcuggaaccuggugcgcuugcagagcggggucgaugucuucuuuaccccgcccgagaaaugcgauacccuucugugcgacaucggcgaaucgagccccaaccccaccaucgaggccggcagaacgcugcggguucucaaccuaguggaaaacuggcuuaacaacaacacucaauucugcauaaaggucuugaacccguacaugccauccgugauagagaagauggaaacccugcaacgcaaguacggcggggcgcuugugcgaaacccccugagcaggaacucuacgcacgagauguacugggugagcaacgccacagggaacaucguguccagcgucaacaugaucagucggaugcucaucaaccgcuuuaccaugaagcacaagaaggccacauacgagccggauguagacuuaggcagcgggacccgcaacaucgggauugaguccgagauccccaaccuagacaucaucgggaagcgcaucgagaagauuaagcaggaacacgagaccagcuggcacuacgaccaggaucacccuuauaagacgugggccuaccacgguuccuaugagaccaaacagacaggcagcgcgagcuucauggugaacgggguuguccgcuuguuaacgaagcccugggacguggugcccauggucacgcagauggcaaugaccgacaccacccccuuuggccagcagcggguuuucaaagagaagguggacacgcgcacccaggagccuaaggaaggcaccaagaaacugaugaaaauuaccgcagaguggcuguggaaagagcugggcaagaagaagacgccaagaaugugcacgcgagaggaguucacaaggaagguacgcuccaacgcugcccugggcgccaucuucaccgacgagaauaaauggaaauccgcacgggaggcugucgaagacagucgcuucugggagcugaucgaucgggaaaggaaccugcacuuggagggaaagugcgagacuugcguguacaauaugaugggcaagcgcgaaaagaagcucggggaguucggaaaggcgaaagggucccgagccauuugguacauguggcugggggcucgguuccuggaguucgaggcccugggcuuccugaaugaggaucacugguuuucccgcgggaacagccuguccggcgucgagggugagggacuccaucggcugggcuacauccugagagacgugagcaaaaaggagggcggcgccauguacgcagacgacaccgcaggaugggauacacggaucacucucgaggaccucaagaacgaggagaugguuacgaaucacaugaaaggcgagcacaagaaacuggcggaggcaaucuucaagcucaccuaucagaacaagguggugcgcguucagaggccgacgccgcggggcacuguuauggauauuaucucgcgccgagaccaacgcggcagcggccagguagggacuuacgggcugaacaccuucaccaauauggaggcgcaguuaauucggcaaauggaaggugagggcaucuucaagucgauucagcaucugaccgugacugaggagaucgcaguacagaacuggcuggcaaggguggguagagaacgccucagccggauggcgaucuccggggacgauugcgucgugaaaccccucgaugaccgcuucgcuagcgccuugaccgcauugaacgacaugggcaaggucagaaaagacauacagcagugggagcccucccgcggguggaacgacuggacccagguaccuuuuuguagccaccacuuccacgaguuaguuaugaaggacggucguguacuggucgugcccugucgcaaccaggaugagcugaucgggcgggcacgcauaucacaaggcgcgggcuggucguugaaagagaccgccugucuggguaaguccuaugcccagauguggacguuaauguacuuccauagacgcgaccucaggcuugccgccaacgcgauaugcucggccguucccucccacuggguccccacaagcagaaccaccuggucgauacacgcgaagcaugaguggaugaccacggaggacaugcuggccguauggaacagaguguggauccaggagaauccuuggauggaggauaagacacccgucgagagcugggaggaggugcccuaccugggcaagcgcgaggaccaguggugcggcucucugaucggccugaccucccgcgcgacaugggccaagaacauccagacugccaucaaccagguccggagccucauugggaacgaggaauacaccgacuauaugccuaguaugaagcgcuuccggcgcgaggaggaggaggccggcguccugugguga

SEQ ID NO: 25174 - RNA, 9876 nt, Artificial Sequence
  derived and/or modified CDS sequence (opt11) from DENV-2__EU482565__SS-prME
accgccggagugaucaucaugcuaauccccaccgcgauggcauuccaccucaccacccggaacggggagccccacaugaucgucggcagacaggagaaagggaaguccuuacuguucaagaccgaagacgguguaaacaugugcaccuuaauggccaucgaccugggugagcugugcgaggacacuaucaccuacaagugcccccugcugcgccagaacgagcccgaggauaucgacugcuggugcaacagcacgucuaccugggugaccuacgggaccugcaccaccacgggcgagcaccggcgcgagaagcggucuguggcccuggugccccaugugggcaugggccucgagacgcggacugagaccuggaugagcagcgagggugccuggaagcacgugcaacgaaucgaaaccuggauccugaggcaccccggcuucacuaucauggccgcgauccuggcuuacaccaucgggacuacacacuuccagcgggcccucaucuucauccuccuuacggccguggcgcccucuaugaccaugcguugcauaggcauuagcaaccgcgacuucguugaaggcguuagcggggggagcuggguggauauaguucuagagcacgggagcugcgucaccacgauggccaagaacaagcccacauuggacuucgaguugauuaagaccgaggccaaacagcccgccacccuccgcaaguauugcaucgaggccaaguuaacgaauaccacuacugagucccguugccccacgcagggcgagcccucccugaacgaggagcaagacaagcgauucaucugcaagcauuccaugguggaccgaggcugggggaacggcugcggccuguuuggcaagggcgggaucgucaccugcgcgauguucacgugcaagaagaacauggagggcaagguagugcugcccgagaacuuagaguacaccaucgugauuacgccccacagcggggaggaacacgccgucggcaacgacaccgggaagcacggaaaggagaucaagaucaccccgcaguccagcaucaccgaagccgaacuuaccggguacggcaccgucaccauggaguguagcccucggacgggccuagacuucaacgagauggugcugcuucaaauggaggacaaagccuggcuggugcaccggcagugguuucuggaccucccccugcccuggcugccgggggccgacacacagggcagcaacuggauccagaaggagacgcucgugaccuucaagaacccccacgcgaagaagcaggacguggucgugcugggcucccaggagggcgccaugcacacggcccugaccggggccacggagauccaaaugucaagcggaaacuugcuauuuacaggccaccugaagugcaggcugcggauggacaagcugcagcuaaaggggauguccuacaguauguguaccggcaaauuuaagaucgucaaggagaucgccgagacccagcacgggacgaucguaauccgcguccaguaugaaggcgacggcuccccgugcaagauccccuucgagaucauggacuuggagaagcggcacauucuggggcgccugaucaccgucaacccgaucgugaccgaaaaggacucacccgugaauauugaggcugagccgcccuucggggacuccuacauuaucauuggggucgagccgggccagcucaagcugaacugguucaagaaggggagcuccaucggccagauguucgagaccacgaugcguggcgccaagcggauggccauucugggggacaccgccugggacuucggcagccucgggggcguguucacuuccauagggaaggccuuacaucagguguucggcgcgauuuacggcgccgcuuuuagcggggucucauggaccaugaagauucucaucggaguuaucauaacguggaucgggaugaacagccgcuccacuucacugucugugagccucguuuuagugggcgugguaacccuuuaccucggugugaugguucaggccgacuccggcugcgucgugagcuggaagaacaaggagcugaagugcgguagugggaucuuuaucaccgacaacgugcacaccuggaccgagcaguacaaguuccagccugagaguccgcccaagcuggcgagugccauacaaaaagcccacgaggagggcaucugcgggauccguuccguaacccgacucgagaaucugauguggaaacaaaucacccccgaacuuaaucacauccucagcgagaacgagguuaagcugacgaucaugaccggagacaucaaggggaucaugcaggccgggaaacguucucuacgcccccagcccaccgagcuuaaguacagcuggaagaccuggggcaaagccaagaugcucuccacggagagccauaaccagaccuuucugaucgacgguccggaaaccgcggagugcccgaacaccaaccgggccuggaacucccucgagguggaagacuacggcuuuggggucuuuagcacgaacaucuggcucaaacuccgagagaagcaggacguguucugcgacuccaagcucaugagcgccgccaucaaggauaauagggccgugcacgcggauaugggcuauuggaucgaguccgcacugaacgacacuuggaagauggagaaggccagcuuuaucgaggucaaguccugccacuggcccaagagccauacccuguggucaaacgguguucucgagagcgagaugaucauccccaaaaacuucgcugggccggugucccagcacaacuaccgccccggcuaccacacccagaccgccgggcccuggcaucugggcaaacuggaaauggacuucgacuucugugagggaacgaccguagucgugaccgaggauugcggcaaccggggccccagccuccggaccacgacagcgagcgggaagcugaucaccgagugguguugccgguccugcacccugcccccgcuccgcuacaggggcgaggacggaugcugguacggaauggagauccgcccacugaaggagaaagaggaaaaccuggugaauucucuagugacggccgggcacggccagaucgacaauuuuucccugggcgugcuggggauggcccucuucuuagaggagaugcugcggacccgcgucggcaccaaacacgccaucuugcugguugcggugucauucguuaccuugaucacggggaacaugucauuccgggaccucggccgcgugauggugauggucggggccacgaugaccgacgacaucggcaugggcgucacuuacuuagcccugcucgccgccuucaaggugcgcccgacguucgcggccggacugcugcuccggaaauugaccucuaaggagcugaugauggccaccauaggcaucgcccuccugucccagagcaccaucccggagacgauccuggagcucaccgacgccuuggcgcuggggaugaugguccucaagaucgugcgcaacauggagaaguaccaguuagccgucacaaucauggccaucuccugcgucccgaacgccgugauucuccagaaugccuggaaggugagcugcaccauccucgcggcagucuccgugagcccccugcuguuaacguccagccagcagaaggccgacuggaucccccuggcccugaccaucaagggccucaauccaaccgcgaucuuccugaccacgcuuucucguaccucuaagaagcguuccuggccccucaacgaggccgucauggccguggguaugguuagcauacuggccuccagucugcucaagaacgacauucccaugacugggccccuggucgccggcgggcugcucacuguuugcuacguguuaacgggccggagcgccgaccuggagcucgagcgcgccgccgacgucaagugggaagaucaggcagagauuuccggguccuccccgauccugagcaucacaauuuccgaggauggcagcaugucgaucaaaaaugaggaggaggagcacacuuuaaccauacuaaucagaacgggccugcucgugaucagcgggguuuuccccguauccauccccauaaccgccgcugccugguacuuaugggaggugaagaagcagcgcgcaggcgugcugugggacgugcccaguccgccacccguggggaaggccgagcuggaggacggcgccuaccggaucaagcagcgcgggaucuucggcuauagucagaucggcgccgggguguacaaggaggggaccuuccacacuauguggcacgucacacguggagcggugcucaugcacagggggaagcggaucgagccgagcugggccgacgugaagaaggaucugauuuccuacgguggaggcuggaaauuagagggggaguggaaggagggcgaggagguccaggugcuggcccuggagcccgguaagaacccacgcgccguucagaccaagcccgggcuguucaagaccaacaccgggaccauaggcgcggucagccucgauuucuccccaggcacgagcgggucccccaucguagaccggaagggcaaggucgucgggcuguacggcaacgguguggugacacgcucuggcgccuacgucuccgccaucgcccagaccgagaagaguauagaggauaacccagagaucgaggacgacaucuuccggaagaagcgccugacaaucauggaccuccaccccggcgcggggaagacgaagcgguaccugccggccaucgugagagaggccauuaaacggggccugcgcacacugauccucgcccccacccgcguggucgccgcggagauggaggaggcccugagagggcugcccauccgcuaccagacccccgccauccgggcggagcauacgggccgcgagaucguggaccucaugugccacgcaaccuucaccaugcggcugcugagcccggugcgcgucccuaacuacaaccuaaucauaauggacgaggcgcacuucaccgaccccgcuuccaucgccgcacggggcuacauuucuacgcgcguagagaugggugaggccgcggggaucuucaugaccgcgacgccgccagggucccgagaccccuucccccagagcaacgcccccaucauggacgaggagcgcgagaucccagagcgguccuggaacagcggccaugagugggucaccgacuuuaaggggaagacggucugguucgugcccucaauaaaagccgguaacgacaucgcagccugccuucgcaaaaacggcaagaagguuauccagcugagccggaagacguucgacuccgaguacguuaagaccagggccaacgacugggacuucguggucaccacagacaucucggaaaugggggcgaacuuccgggccgagcgggucaucgauccccgucgcuguaugaagcccgugauccugaccgacggcgaggagcgggugauuuuagcgggcccaaugcccgucacccauuccagcgccgcccagcgccgcggacgcauagggcgcaaccccaagaacgagaaugaccaguacaucuacaugggcgaaccccuggagaacgacgaagacugcgcccacuggaaagaggccaagaugcuucuggauaacauaaauacuccugagggcaucaucccgagcauguucgaacccgagcgggagaagguggacgcgaucgacggggaguaucgccugcguggagaggcccgcaagacguucguggaccucaugagacgcggggaccugccggucuggcuggccuaccggguggccgcggaggguauuaacuacgcggacagacggugguguuucgacgggauuaagaacaaccaaaucuuggaggagaacguggaagucgagaucuggaccaaggaaggagagcgcaagaagcugaagccccgguggcuggacgcccguaucuauagcgacccccucgcccugaaagaguucaaggaguucgcugcgggccggaagucccuaacgcucaaccugaucaccgagauggggcgccuccccaccuuuaugacccagaaggcccgggacgcccucgacaaccucgcagugcugcacaccgccgaagucggggggcgcgcauacaaccacgcccuuagcgagcugccggagacccuggagacccuccugcuguuaaccuugcucgccacugugaccggcggcaucuuccuauuucugauguccgggaagggcaucgggaagaugacgcuuggcaugugcugcaucaucacagccagcauccuacugugguacgcccagauccagccccacuggaucgcggccuccaucauccuggaguucuuccucaucgugcugcuuauccccgagcccgagaagcaacguaccccgcaggacaaccagcucaccuacgucgugaucgccauccugaccguggucgccgccacgauggcgaacgaaaugggcuuccuggagaagaccaagaaggaccucggucugggcagcaucacuacgcaggagcccgaaucaaauauccuggacaucgaccuccgcccggcguccgccuggacucuguacgccguggccaccacguucgugacccccaugcugcggcacagcaucgagaacuccagcgucaacgugagucucacggcgaucgccaaccaagccaccgugcugauggggcugggccgcggguggccgcucagcaagauggacaucggcgucccgcugcucgcgaucgggugcuacucccaggugaaccccaucacccucacagccgcccugcugcuccugguggcccacuacgccauaaucggccccggccugcaggccaaggcuacgcgggaggcccagaagcgggcggccgccgggauuaugaagaaccccacagucgacggaaucaccguuaucgaccucgagcccauacccuacgaucccaaguucgaaaagcagcugggccagguaaugcucuugguauugugcgugacucagguacugaugaugcggacgaccugggcacucugcgaggcgcuuacacuggccaccggcccgaucagcacgcucugggaggggaaccccgggcgguuuuggaacaccaccaucgccgucuccauggccaacaucuuccgcggcagcuaccuggcgggggccggccuccucuucuccauaaugaagaacaccacuaacacccggcgcgggaccggcaacaucggcgaaacacugggggagaaguggaagucacgccugaacgcucucggcaaguccgaguuccagaucuacaagaagagugggauccaggagguugaccgcacguuggccaaagagggcaucaagagaggggagaccgaccaccacgcggugucgcgcggcagcgcgaaguugcggugguucgucgagcgcaacauggugacacccgaagguaaaguugucgaccucgggugcggccgcggcggcuggucauacuacugcggcggguuaaagaacguucgcgaggugaaagggcugaccaagggcggucccggucaugaggagccgauccccaugucgacguacggcuggaaccugguccggcuccaguccgggguggacguguuuuucacuccccccgagaagugcgacacgcugcucugcgacaucggggaguccaguccgaaucccaccaucgaggccggccgcacgcugcggguccugaauuuaguggaaaacugguuaaacaacaacacccaguuuugcaucaaggugcugaaccccuacaugccguccgucaucgagaagauggaaacccuacagcgcaaguacgggggagcccuggugcggaacccccugagccgaaacagcacccaugagauguauugggugagcaacgccaccggcaacaucgucuccagcgucaauaugauuucccguaugcugaucaaccgcuuuacgaugaagcacaagaaagcgaccuacgagcccgaugucgaccucggcagcgggacccgcaacgucggcaucgagaacgagauccccaaucuggacaucaucgguaagaggauugagaagaucaaacaggagcacgagacaucguggcacuacgaccaggaccacccauacaagacgugggccuaccaugggagcuacgagacaaaacagaccggcuccgccagcuccauggugaacggggugguccgccugcucacgaagcccugggacgucgugcccauggucacgcagauggccaugaccgacaccacccccuucgggcagcagcggguguucaaggaaaagguggacacgcgcacccaggagccgaaagagggcaccaagaagcucaugcguaucaccgccgaguggcuguggaaggagcucggcaagaagaagacuccacgcaugugcacccgggaagaguucacccgcaagguccgaagcaacgcugccuuaggggcaaucuucacugacgaaaauaaguggaaguccgccagggaggccguugaggacucgcgguucugggagcuggucgaccgcgagcggaacuugcaccuggaggggaagugcgagacgugcguguacaacaugaugggcaagcgcgagaagaagcugggggaguucggcaaagcgaaggguucccgggcaaucugguacauguggcugggggcccgcuuccuggaauucgaggcccugggcuuccucaacgaggaccauugguucagccgggggaacucccugucuggcguggaaggggagggccugcacaagcucgguuauauccugcgugacgucagcaagaaggagggaggggcaauguaugccgacgacaccgccggcugggacacccggaucacgcuggaggaucugaagaacgaggaaauggugacgaaccacaugaagggcgagcacaagaaacuggcagaggcuaucuucaaacugaccuaccaaaacaaggugguccgcgugcagagacccacgccacgggggaccgugauggacaucauaagccgcaaggaccagcgcggcagcggccaaguagggacguacggccucaauaccuucaccaacauggaggcacagcugauccgucaaauggagggggagggaauuuucaaguccauccagcggcugaccguaacggaagagaucgccgugcaaaacuggcuggcccgcgucggccgagaacgccugucgcggauggcaaucaguggugacgacugcgucgugaaaccgcuagacgaccgcuucgcuagcgcguuaacggcccugaacgacauggggaagguccggaaggacauucagcagugggagcccucacgcggguggaacgacuggacccaggugcccuucugcagucaccacuuccacgaguuagugaugaaggauggccggguccucguggugccaugccgcaaucaggacgagcugaucgggcgggcccgcaucucucaaggcgccggguggagucugaaggagaccgccugccucgggaagucuuacgcucaaauguggacgcugauguauuuccacaggagagaccugcggcucgccgccaacgcgaucugcagcgccgucccgagccauugggugcccaccagucgcacgaccugguccauccacgcgaagcacgaguggaugaccacggaggacaugcuggccguguggaaccgcguguggauccaggagaaccccuggauggaggacaagacccccguggagagcugggaggaaguuccguaccugggcaagcgugaggaccaguggugcgggucccucaucggucugacaagccgcgcgacuugggccaagaacauccagacggcuauuaaccaaguccguucucugaucgggaacgaggaguacaccgacuacaugcccuccaugaagcgguuccggaaggaggaggaggaagccggaguucucugguga

SEQ ID NO: 25175 - RNA, 9876 nt, Artificial Sequence
  derived and/or modified CDS sequence (opt11) from DENV-2__EU529700__SS-prME
accgccggcgugaucauaauguuaauccccaccgcaauggccuuccaccucacaacccggaacggggagccccacaugaucgucggccggcaggagaaggggaagucccugcuguucaagaccgaggacggcgugaauaugugcacccucauggccaucgaccugggggaguugugugaggacaccaucacuuacaaaugcccacuccugcgccagaacgagccagaggacaucgacugcugguguaacagcaccagcaccugggugaccuacgggaccugcaccaccacgggcgagcaccggcgcgagaagcggucagucgcauuagugccccacguugggaugggcuuagagacccggacugagacuuggauguccuccgagggugcauggaagcacguccagcggaucgaaacauggauccugaggcauccgggcuucaccaucauggccgcgaucuuagccuacacuaucgguacuacgcacuuccagcgggcccucaucuuuauucuucugaccgccguggcucccagcaugaccaugcgcugcauuggcaucuccaaccgagacuucguggagggcgucuccggaggguccuggguggauauagugcuggagcacggguccugcgucaccaccauggccaagaacaagcccacccuggacuuugagcugaucaagacugaggccaagcaacccgccacccuccggaaauacugcaucgaggccaagcugaccaacacuaccaccgaguccaggugcccgacacagggggagcccucccugaacgaggagcaggacaagcgcuuuaucuguaagcacuccaugguggaucgggggugggggaacgggugcggauuauuuggcaagggcggaaucgugacgugcgccauguucacguguaagaagaauauggaggguaaggugguguuaccugagaaucuggaguauacuaucgugauuacgccccacucaggagaagaacacgccgugggcaacgacacugguaagcacggcaaggagaucaagaucaccccgcaguccagcaucacagaggccgaacucaccggcuacgguacagugacgauggagugcagcccccggaccggacuggacuucaacgaaauggugcuacuccagauggaggacaaggcauggcuggugcaccggcagugguuccuagacuugccccugccuuggcugccgggggcggacacgcagggcagcaacuggauucaaaaggaaacgcucgugacauuuaagaauccccacgcuaagaagcaagaugugguggugcuugggucccaggagggugccaugcacaccgcgcugacgggggccacggagauccagaugagcagcggcaacuuacuguucaccggccaccuuaagugcagguugcggauggauaagcuacagcugaaggggauguccuauagcaugugcaccggaaaguucaagaucgucaaggagaucgccgagacccagcacgggacuaucgugauccgcgugcaauacgagggcgauggcucccccugcaagaucccuuucgagaucauggaccucgagaagcgacauguccuggggcgccugaucaccgugaacccgauugugaccgaaaaggacagcccggugaacaucgaggcggagccgcccuucggugacucguacauuaucauugggguagagccgggccagcugaagcuaaacugguucaagaaggggagcucuaucggucaaauguuugagacaacgaugcgcggcgcuaagcggauggccauccucggugauaccgcuugggacuucggcagccucgggggcguguucaccuccaucgggaaggcccugcaucagguuuucggcgcgaucuacggcgcugccuucucgggcgugucuuggaccaugaaaaucuuaauuggaguuauaaucacuuggauagggaugaacagccgcuccacaucauuguccgucagccugguucuggugggcgucgugacccuguaucucggggugaugguccaggccgacuccggcugcguggugucuuggaagaacaaggagcugaagugcggcucggggaucuuuauaaccgacaacguccacacguggaccgagcaguacaaguuucaaccggagagcccgagcaagcuggccuccgcaauccagaaggcgcacgaggaggggaucugcggaauccggagcgucacccgcuuggagaacuugauguggaagcagaucaccccugaguuaaaccacaucuuguccgagaacgaagugaagcugacgauaaugacgggcgacaucaaagggaucaugcaggccggcaagcggagccuacgcccucagcccaccgagcucaaguacucguggaagaccuggggaaaggccaagaugcugagcacggagagccauaaccagaccuuucugauugacgggcccgaaaccgcggaaugcccuaacaccaaccgggccuggaacagccucgaagucgaggauuacggguuugggguguuuuccacuaacaucuggcugaaguuacgggagaaacaggacguuuucugcgacuccaaacucauguccgccgccauaaaggacaaucgggccguccacgcggacaugggcuacuggaucgagagcgcgcugaacgacaccuggaagauggagaaggccuccuuuaucgaggucaaguccugccauuggccuaagucccacacccuguggucuaacggggugcucgaguccgagaugaucauacccaagaacuucgcggggcccgugagccagcacaacuaccgccccggcuaccacacccagacggccgggcccuggcaccugggaaagcuagagauggacuucgacuucugcgaggggacgaccgucguggucacagaggacuguggcaaccgggggcccucccuccgcaccacgaccgcguccgguaagcugauuaccgaauggugcugccguaguugcacccugcccccgcuccgcuaccggggcgaagacgggugcugguacggcauggagauccgcccccuaaaggagaaggaggagaaccuggugaacucccucgugacagccgggcacggccagauagacaacuucagccugggcguuuuggggauggcucucuuucucgaggaaauguuaagaacccgcguuggcaccaagcacgccaucuugcuaguggcggucuccuucgugacccugaucaccggaaacaugagcuuucgggaccugggccgcgugauggugauggucggggccacaaugacugaugauaucggcaugggcgugaccuaccuggcguugcucgcggccuucaagguccgaccaacguucgcggcggggcugcugcucaggaagcugaccuccaaggagcucaugauggccaccaucggcaucgcccucuuaagccaguccaccaucccagagacgauccuggagcuaaccgacgcccuggcguuggggaugauggugcucaaaaucguucgcaaccuggagaaguaccagcuugccgucacuauuauggccaucagcugcgucccuaaugccgugauccuacaaaacgccuggaagguguccugcaccauccuggcggccgugagcguaaguccccugcugcugacgagcucgcagcagaaggccgacuggaucccccuggcccucacaauuaagggccugaacccgaccgcuaucuuccugacuacguugagccggaccuccaagaaacgcuccuggccgcugaacgaggccguaauggccgugggcauggucuccauccuggccagcagcuugcugaaaaaugacauacccaugaccgggccccugguugcgggcggacuucugacggugugcuauguccugacggguagaagugcggaucucgagcuggaacgcgccgccgauguaaaaugggaggaccaagccgaaaucagcgggucaagccccauccugagcauuacaaucuccgaagacggaucaaugagcaucaagaacgaagaagaggaacagacccucaccauccugauccggacgggccuucucgugaucuccggggucuuuccggugagcaucccgauaaccgccgcggccugguaccugugggaggugaagaagcagcgcgcaggcguccugugggacgugcccagcccgccucccguugggaaagccgaacuugaggacggcgccuaccggaucaagcagcgagggaucuucgguuauagccaaaucggcgcugggguuuacaaggagggcaccuuccauaccauguggcacgugaccagaggggccguccucaugcaccgcggaaaacgcaucgaacccuccugggcggacguaaagaaggaccugaucagcuacgggggcggcuggaagcucgagggggaguggaaggaaggcgaggagguacaggugcuggcccuggaacccggaaagaacccccgagccguccagacaaagcccggucucuucaagaccaacacaggaaccaucggcgcugugucccuugacuucucaccuggcacgucugggagccccaucguggaucguaaggggaaagucgugggucuguacggcaacgggguggucacccgcuccggggcuuacgugagcgccaucgcccagaccgagaaauccaucgaggacaaccccgagaucgaagaugacaucuuccggaagaagcgccucaccauaauggaucugcaucccggcgcggggaagacgaagcgguacuuacccgccaucguacgcgaagcuauaaagcgcggacugcgcacccucauccuggccccgacccgcgucguggccgcagaaauggaggaggcucugcggggucucccaauccgauaucagacccccgccaucagagccgagcacacgggccgagagaucguggaccugaugugucacgccaccuucacaaugcggcuacuuuccccaguaagggugccgaacuacaaccugaucauuauggacgaggcgcacuucaccgaccccgccagcaucgccgcccgggguuacaucucaacccgcguggagaugggggaggccgcgggcauauucaugaccgcaacgccgcccgguagccgggauccguuuccccagucgaacgcccccaucauggacgaggaacgcgagauccccgagcggagcuggaacuccggccacgagugggucaccgacuucaaggggaagacgguuugguucgugccgagcaucaaggcuggcaacgauaucgcggcgugucugcgcaagaacggcaagaagguuauccagcucucccggaagacguucgacagcgaguacgucaagacccgcgccaacgacugggacuucgugguuacgacggacaucuccgagaugggggcgaacuuccgggccgagaggguaaucgauccccggcgcugcaugaagccugugauacugacggauggcgaggaacgggucauacuggcagggcccaugccugucacacacagcuccgcagcgcagcgccgcggccggauugggaggaaccccaaaaacgagaacgaccaguauauuuacaugggcgagccccucgagaaugacgaggacugugcgcauuggaaggaggccaaaaugcugcuggacaacaucaacacccccgaggggaucaucccguccauguucgagcccgaacgcgagaaagucgacgcgaucgacggggaguaucgccugcggggcgaagcgcgaaaaacguuuguagaccugaugcggcguggcgaccugcccguguggcuugccuacagaguugccgcggagggcauaaacuacgcugaccggcgguggugcuucgaugggaucaaaaacaaccagauccuggaggagaacgucgagguggaaaucuggacaaaggaaggcgagaggaagaaauuaaaaccgcggugguuggacgcccgcauuuacuccgacccccuggcccugaaagaguucaaggaguucgccgcgggccggaagucccuaaccuugaacuugaucaccgagaugggccgacuccccacguucaugacgcagaaggcacgcgacgcccuggacaacuuggccgucuuacacaccgccgagguaggagggagagcguacaaccacgcccuguccgagcugccggagacucucgaaacgcugcugcucuuaacccuguuggccacaguaacaggcggcaucuuccuguuccugaugucggggaaggguaucgggaagaugacgcucggcaugugcugcauaaucaccgccucaauccugcugugguacgcucagauucagccgcacuggauugcggcaagcaucauucucgaguucuuucugaucguccugcucauccccgagcccgaaaagcagcgcacgccccaggacaaucagcuaaccuacguggugaucgcgaucuugaccgucguggcggcuacgauggcgaaugagaugggguuccucgagaaaaccaagaaggacuuaggccugggcucaauuaccacgcaggagagcgaaagcaauauucuagacaucgaccugcgcccugccucggcuuggacgcuguacgcgguggcaaccaccuucgucaccccaaugcucagacauagcaucgagaacuccagcgugaacgugucccugacggcgaucgccaaccaggccaccguccuuauggggcucggccguggguggccccugagcaaaauggacaucggcgugccgcuacuagcaaucgggugcuacagucaggugaacccgaucacccugaccgcggcucugcuccugcuagucgcacacuacgcuaucaucggccccggccuucaggccaaggccacgcgcgaggcccagaagcgugcggccgccgguaucaugaagaaccccaccguggauggcaucaccgugaucgaucuggagcccaucccguacgaccccaaguuugagaagcagcugggacaggucaugcuccucgugcucugcgucacccaaguccucaugaugcgcacgaccugggcccuaugcgaggcccugacccucgcaaccggccccaucagcacacugugggaggggaaucccggcagauucuggaacaccaccaucgcagucuccauggccaacaucuucaggggcagcuaccuggcgggggccggccuccuguucuccauaaugaagaacacgacuaacacucggagagggacaggcaacaucggcgagacacugggggagaaauggaagucccgucugaacgcccuuggcaaguccgaguuccaaauauacaagaaguccgggauacaggaaguggaccgcacucuggccaaagagggcaucaaaagaggggagacagaccaccacgcggucucccgcggauccgccaagcuccggugguucguggagcgcaacauggugacaccugaggguaaggucguggacuuagggugcggcaggggugggugguccuacuacugcggcggccugaagaacgucagggaggucaaggggcucaccaagggcgggccugggcacgaggagccgauccccauguccacguacgguuggaaccuggugagauuacagagcgggguggauguguucuucaccccgcccgagaagugcgacacccuccuuugcgauaucggagaguccagccccaacccuaccaucgaggccggccgcacgcuccggguguuaaaccucguggagaacugguuaaacaacaauacccaguucuguauuaagguacucaacccguacaugcccucgguaaucgagaagauggagacgcugcagcguaaauaugggggcgcccugguccggaacccucugagucgcaacuccacucacgagauguauuggguuucgaacgccaccgggaauaucgugucaucugugaacaugaucaguagaaugcugaucaaccgguucacgaugaagcacaagaaggcgacguacgaaccggauguugaccuggggagcgggacccgcaacaucggcaucgagaacgagauacccaaccuggacaucaucggcaagcggauagagaagaucaaacaggagcacgagaccuccuggcacuacgaucaagaccaccccuacaagacgugggccuaccacgggagcuacgagaccaaacagaccggcuccgcgagcucaauggugaacgguguggugcgccuccuaaccaaaccgugggacguggugccgauggucacgcagauggccaugaccgacaccaccccauucggacagcagcgaguuuucaaggagaagguggacaccaggacgcaggagcccaaggagggcaccaagaagcugaugcggauaaccgccgaguggcucuggaaggagcuggggaagaagaaaacgccccgcaugugcacgcgcgaggaguucacccgaaaagugcggagcaaugcggcccugggcgcuaucuucacagacgagaacaaauggaaguccgcccgcgaggccgucgaggauagccgcuucugggagcuagucgaccgcgagcggaaccugcacuuggaggguaagugcgagacgugcguguacaacaugaugggcaagcgagagaagaagcucggggaguucggcaaagcgaaggguucccgggccaucugguacauguggcugggggcgcgcuuccuggaauuugaggcgcuaggcuucuugaaugaggaccacugguucucaagagggaacucacuaagcggcguagagggugagggccuccacaaacuuggcuacauccugcgcgacguuagcaaaaaggagggcggcgcgauguaugccgacgacacagccgggugggacacacggaucaccuuggaggacuugaagaacgaggagauggugacaaaccacaugaaaggcgagcacaagaagcuagccgaagccauauucaagcucaccuaccagaacaagguugucagagugcagagaccgacgccuagggguaccgugauggacaucaucucccgcaaggaccagagaggcagcggccagguaggaacauacggccugaacaccuuuaccaacauggaagcacaacugauucgccaaauggagggggagggcaucuucaaguccauccagcaccugacggucaccgaggagaucgccgugcagaacuggcuagcccgcgucggucgcgaacgccucucuagaauggccaucuccggggacgacugcguaguaaagccccucgacgaccgguucgccagcgcgcugacugccuugaacgacaugggcaaagucagaaaggacauccagcaaugggagccgucccgcgguuggaacgacuggacccaggugcccuucugcagccaccacuuccacgagcucguaaugaaagacggccgcguccuggucgugcccugccggaaucaggaugagcucaucggacgcgcacggaucucccagggcgccggcuggagccucaaggagaccgcuuguuugggaaagucuuacgcgcagauguggacgcucauguacuuccaucgccgagaccuccgccuggccgccaacgcgaucugcagcgccgugccuucccacugggugcccaccagucggaccaccugguccauccacgcgaagcaugaguggaugacuacggaagacaugcuggccguguggaaccgcgucuggauccaagaaaacccguggauggaggacaagacccccguugagagcugggaggaggugccguaccucggcaagcgcgaggaccagugguguggcagcuuaauaggccuuaccucccgggccaccugggccaagaacauccagacggcgauaaaccagguccgaagccucaucgggaacgaggaguacaccgauuacaugcccucgaugaagcgguuccgcaaggaggaagaggaggccggcguucugugguga

SEQ ID NO: 25176 - RNA, 9876 nt, Artificial Sequence
  derived and/or modified CDS sequence (opt11) from DENV-2__EU529701__SS-prME
acugcaggcgugauaaucauguugauaccgacggcaauggcguuccaccucacaacccgcaacggcgagccacacaugaucguuggcaggcaggagaaagggaaaucccugcuguucaagaccgaagacggcgugaacaugugcaccuuaauggccauggaucuaggagaauuaugcgaggacacgauaacuuacaaguguccacuccugcgccagaacgagcccgaggacauagauugcuggugcaacagcacgagcaccugggugaccuacgggaccugcaccacaacgggcgaacaccggcgugagaaacguuccguugcccucgugccucacguggggaugggacucgaaacccgcacggagaccuggaugaguucagagggggccuggaagcacgugcagcggaucgagaccuggauccugcgccacccgggcuucaccaucauggccgcgauccuggccuauacaaucgggaccacgcacuuccagcgggcgcucaucuucauccuacuaaccgccguggcgccaagcaugaccaugcgcugcaucggcaucuccaaccgggacuucguggagggcguuagcggaggauccuggguugacaucgugcuagagcacggaagcuguguuacgacaauggcuaagaauaaaccuacccuggacuucgaacuaaucaagaccgaggcgaagcaacccgccacacucaggaaguacugcaucgaggccaagcucacgaacaccacaacggagucccggugcccgacacagggcgagcccagccugaacgaagaacaggacaagagguucuuguguaagcacucgaugguggaccggggcugggggaacggcugcgggcuguucggcaagggcgggaucgugacgugcgcgauguucacgugcaagaagaauauggaaggcaaggucgugcagcccgaaaaucuggaguacaccaucgugaucacgccccauagcggcgaggagcacgccgugggcaacgacaccggaaagcacggcaaagagaucaagaucaccccgcaguccagcaucaccgaggccgaacucacaggguacgguacgguuacgauggagugcagcccacggaccggccuggacuucaacgagauggugcugcuccagauggaggauaaggcaugguuaguucaccggcagugguuucuagaccugcccuugcccugguuaccgggggccgacacgcagggcaguaauuggauucagaaagagacacucgugaccuucaaaaacccccacgccaagaaacaggacgugguggugcuggggucgcaggagggcgccaugcacaccgcccugaccggggccacggagauccagaugucgagcgggaaccuccuguucaccggccaccugaagugccgcuuacggauggauaagcuccaguuaaaggguaugaguuacaguauguguaccggcaaguuuaagaucgucaaagagaucgcggagacacagcacgggacgaucgugauaaggguucaguaugagggcgacgggagccccugcaagauuccauuugagauuauggaccucgagaagcggcacguacuggggcggcugauaacgguaaauccgaucgugacggaaaaagauucaccagucaauaucgaggccgaaccgccauuuggggacuccuacaucaucaucgggguggaaccaggucagcucaaacugaauugguucaagaaggggucguccaucggccagauguucgagaccaccaugcgcggcgccaagcggauggccauacugggggacacggccugggacuucgggagccuugguggcguguucaccuccgucgggaaggcccugcaccagguuuuuggcgcgauuuauggcgccgccuucagcggggugucuuggaccaugaaaaucuucaucggcguaaucaucacguggaucgggaugaacagucgcuccacaagccuuuccgugagccugguucuugucggugugguuacccuguaccugggggccaugguacaggcagacuccggcugcgugguaucguggaagaauaaggagcucaagugcggcuccgggauuuucaucaccgacaacguccacacguggaccgaacaguacaaguuccagccugagagcccaucuaagcuggcguccgccauccaaaaggcccaugaggaaggcaucugcgggauccguuccgugacccgccuggagaaccugauguggaagcagaucaccccagagcugaaccacauccuguccgagaaugaagugaagcucacgauuaugaccggcgacauaaaggggaucaugcaggcagguaaacggucacuuaggccgcagcccaccgagcucaaauacaguuggaaaaccugggguaaggcgaagaugcucucuacagaaagccacaaucaaaccuuccugauagaugggccugagaccgccgaaugcccgaacaccaaccgggccuggaacagccuggagguagaggacuacgguuuuggcguguuuacaacaaauauauggcugaagcuccgcgagaaacaggacguguucugcgacucgaaguuaaugagcgcugccaucaaagacaaccgggcgguccacgccgacaugggcuacuggaucgagagcgcccucaacgacaccuggaagauggagaaggcgucauucaucgaggugaaaucgugccacuggccuaagagccacaccuugugguccaacgggguccuggagagcgagaugaucauccccaaaaacuucgcgggucccgucucccagcauaacuaccgcccgggcuaccacacccagacggccgggcccuggcacuuagggaagcuagagauggauuucgauuucugugaggggaccaccguggugguuacugaggacugcggaaaccggggccccagcuuacgcacgaccaccgccagugggaagcucaucacagaguggugcugcagguccugcacgcugccaccacugcgcuauagaggggaagacgggugcugguacgggauggaaauccgcccccucaaggagaaggaggagaaccuuguaaacagccuggugaccgccggacacggacagauugacaacuucucccucggaguccucggaauggcgcuguuccuggaggagaugcugcgcacccgggugggcaccaagcacgcgauccuccucguggccgucaguuucgugacccugaucacugggaacauguccuuucgggauuuaggccgcguaaugguaauggugggggcgaccaugaccgacgauaucggcaugggcgugaccuaccucgcacuguuagccgccuucaagguccgccccaccuucgcggccggacuccugcugagaaaguuaacgaguaaggagcugaugauggccaccaucggcaucgcccugcuaucccagagcacgaucccugagacaauccuggaguugacggacgcgcucgcccuggggaugauggugcugaagauaguaaggaacauggagaaguaccagcucgccguuacgaucauggccauauccugcguuccaaacgccgugauucugcaaaacgccuggaaggucucguguacgaucuuggcugcugucuccgucagccccuuguuauuaaccucaagccagcagaaggcugauuggaucccccucgcgcugaccaucaaaggccugaaucccacagcgaucuuuuugacuacccugucgcggaccaguaaaaagcgcucauggccgcugaacgaggccaucauggcggucgguaugguaagcauccucgcguccagccuucuuaaaaacgacauccccaugacagggccccuggucgcuggugggcugcugacggucugcuacguguugaccggccgaagcgccgaucuagaacuggagcgcgccgcggaugucaaaugggaggaccaggccgagaucagcgggagcagccccauccucagcaucaccaucuccgaggacggcucuauguccaucaaaaacgaagaggaggagcagacuuugacgaucuuaauacggaccggccuucugguuauuucugguguauuuccgguauccauccccaucaccgcugccgccugguaccugugggaggugaagaagcagcgugcaggcgugcucugggacgugcccuccccucccccaguggggaaggccgagcuggaggacggagcguaccggaucaagcagcgagggaucuuaggcuacucccagaucggcgccggcguguacaaggagggcacguuccauacuauguggcacguuacgcgcggugccguuuugaugcaccgcggcaagcggaucgagcccagcugggcagacgucaaaaaggaccugauuuccuacggcggcgguuggaagcuggagggggaguggaaggagggugaggagguccagguucucgccuuagagccggguaaaaaucccagggcgguccagaccaagcccggccuguucaagacaaacacggggacgauaggcgccgucucccucgacuucucccccgguaccucugggucccccauaguggaucgcaaagggaagguggucgguuuauacgguaacggcgucgucacccgaaguggggccuaugucuccgccaucgcucagacagagaagaguaucgaggauaaccccgagaucgaggacgacaucuuucgaaagaagagguugaccauaauggaccuccaccccggggccggaaagacgaagcgguaucugccugcaaucgugcgcgaagcgaucaaacgggguuugcgcacccugauucuagccccgacccgcgugguggcugcagagauggaggaggcucugagagggcugcccauccgcuaccaaacgccugccauccgugccgaacacaccggccgcgagauugucgaccucaugugccacgcgaccuucacaaugcggcugcucucgccaguacgugucccaaacuacaaccucauaaucauggacgaggcgcacuucacggacccggccagcaucgccgcucggggcuacaucaguacccgcguggaaaugggggaggcggccggcauauucaugacugccacgccgcccggaucccgggacccguucccccaguccaacgccccuaucauggacgaggagcgggagauucccgagaggucguggaacaguggucacgagugggucacggacuucaaggggaagaccgucugguuuguuccgucuaucaaagcggggaaugacaucgccgcaugccugcggaaaaacggcaagaaggugauccaguugucgcggaagaccuucgauuccgaguacgucaagacgcgcgccaacgacugggacuuugugguuacgacagacaucagcgagaugggugccaacuucaaggcggagcgggucauugaucccagaaggugcaugaaaccagugauucucaccgacggagaggagcgcgucauccuggcagggcccaugcccguuacccacuccagcgccgcacagcguagaggccgcaucgggcggaaccccaaaaacgagaacgaccaguacaucuacaugggugaaccccuagagaacgacgaagacugcgcgcacuggaaggaggcgaagaugcuccuggacaauauuaacacccccgagggcaucauccccucaauguucgagccagaacgggagaagguggacgccauugacggggaguaccggcugcgcggcgaggccaggaagacuuucguggaccucaugcgccguggggaccugcccgucugguuggccuacagggucgcugccgagggaaucaacuaugcagaccggcgcuggugcuucgacggaaucaagaauaaccaaaucuuggaggagaauguggaggucgaaaucuggaccaaggagggagaacgaaagaaacugaaaccuagauggcuagaugcgcgaaucuacuccgauccauuagccuugaaggaguucaaggaguuugcugccgggcgcaagucccucaccuuaaaccuaauaacggaaaugggacggcugcccacguucaugacccagaaagcccgugacgcccucgauaaccuggccgugcugcacaccgccgaggccggagggaaagccuacaaccaugcguugucugagcugcccgagacguuggagacccuucugcuccucacccugcuggcgacuguuaccggcggcauuuuccuguuccugauguccgggaagggcaucggcaagaugacccuugggaugugcuguaucaucaccgcgagcauccucuugugguacgcccagauacagccucacuggauagccgccaguaucaucuuggaguucuuccuuaucgugcugcugauccccgagcccgagaagcagcggacgccccaggacaaccagcuuaccuacgugguuaucgcaauacuaacggucguugcggccaccauggccaacgagaugggauuccuagagaagacgaagaaggaccucggccugggcuccaucaccacacaggagagcgaguccaacauacuggacauugaucuccgaccggccucagccuggacgcuguacgcggucgccacuaccuuugugacgcccaugcugcggcauuccaucgagaacagcuccgugaauguaucacuaaccgcaaucgccaaccaggcuacugugcugauggggcugggaaagggguggccgcucuccaagauggacaucggcgucccccugcuggcaaucggguguuacagccagguuaacccgauuacgcuuacagcggcccuguuguugcugguggcccacuacgcaaucaucggccccggacugcaagccaaggccacacgcgaagcccagaagcgggcagcggccgggauaaugaagaaccccacgguggacgggaucaccgucauugaccucgagcccaucccguacgaccccaaauuugagaagcagcugggccaggugaugcuccugaucuuauguguaacgcagguccucaugaugagaaccacuugggcucucugugaggcccugacccuggccacgggucccaucuccacccucugggaggggaaccccggccgcuuuuggaacaccacaauugcggugagcauggcuaacaucuuccgaggauccuaucuggccggggccggucugcuguucagcauaaugaagaacacgacuaauaccaggcgggggaccggcaacauaggcgagacgcuaggagaaaaguggaagucccgccugaacgcgcucggcaagagcgaguuccagauauauaagaagucagggauccaggagguggaccggacgcuggccaaagagggcaucaagcgcggugagacugaucaccacgcuguaucucggggaucggcgaagcuccgcugguucguggagcggaacauggucaccccagagggaaaggugguggacuuagggugcggacgcgggggaugguccuacuacugugggggccuuaaaaaugugcgggaagucaagggacugacgaagggaggucccgggcacgaagaacccauacccauguccaccuacgguuggaaccucgugcgucuacagagcggggucgacgucuucuucaccccgcccgagaaaugcgauaccuugcuuugcgacauuggcgagagcucccccaaccccacgaucgaggccggccggacccugcgcgugcugaaccucguggagaacuggcuaaacaacaacacccaguucugcauuaagguccugaacccauacaugcccagcgugaucgaaaagauggagacucuucagaggaaauacggaggggcgcuugugcgcaacccccugucccggaacagcacucacgagauguacugggucuccaacgcaacagggaacaucgugagcuccgugaacaugaucagccgcaugcuaaucaaccgauucacgaugaagcauaagaaagccaccuacgagccagaugucgaccucggcuccgggacccgcaacaucggcaucgagagugaaaucccuaacuuggacaucaucggcaagcgcaucgagaagaucaagcaggaacacgagacguccuggcauuaugaccaagaccaccccuacaagacuugggccuaccacggguccuacgagaccaagcagaccggcuccgcuagcuccauggugaacggaguggugcggcugcucaccaagcccugggacgugguaccgauggucacgcagauggcgaugaccgacaccacgcccuucggccagcagcggguguucaaggagaagguggauacccgcacccaagagcccaaagaggggaccaagaaguugaugaagauuacggccgaauggcuguggaaggagcucgguaagaagaagacgccgagaaugugcacccgugaggaguucacucgcaagguccgcuccaacgccgcccucggcgccaucuucacggacgagaacaaguggaagucagcgcgcgaggccguggaggacucacgguucugggaguuaguggaccgggaacguaaccuccaccuggaagggaaaugcgaaacgugugucuacaauaugaugggcaaacgagagaagaaacugggggaguucgggaaagccaagggcucacgggcgauuugguacauguggcucggagcgcgcuuccuagaguucgaggcacuuggcuuccucaacgaggaccacugguucucgagagggaacucacuguccgguguggaaggggagggccugcacagguugggguacauccuacgggacgucagcaagaaggagggcggggcaauguacgccgacgacaccgccggcugggauacccgcaucacgcuggaggaccucaaaaacgaggagauggugaccaaccacaugaaaggggagcacaagaagcuggcggaggccauuuucaagcugacuuaccagaacaagguuguccgugugcagaggccgacaccccgggggacggugauggacaucauaucccggcgcgaccaacggggcagcggccaggucggcacauacggccucaacacauucaccaacauggaagcccagcugauccgccagauggagggugagggcaucuucaaguccauccagcaccugacggugaccgaggagaucgccguacagaacuggcucgcucgggucggacgcgaacggcuuagcaggauggcgaucuccggggacgacugcguggugaagcccuuagaugauagauuugccucagcccucaccgcccuaaacgacaugggcaaaguucgcaaagacauccagcagugggaacccaguagaggguggaacgacuggacccaggucccguuuugcagucaucacuuccaugagcuugugaugaaggacggccgaguccucgugguucccugcaggaaccaagacgagcugaucgggcgcgcccguauaucgcagggugcaggcuggagccugaaagagacggccugucuugggaaauccuacgcccagauguggacucuaauguauuuccaccgccgggaccugcgauuggccgccaacgcgauaugcucugccguccccucccauugggugccgaccagccggacuaccugguccauucacgccaagcacgaguggaugacgaccgaggacaugcuggcagucuggaaccgcguuuggauccaggagaacccguggauggaggacaagacccccguggaaagcugggaggaggugcccuaucuuggaaagcgggaggaccaauggugcgguagccucaucgggcugaccucccgggccacgugggccaaaaauauccaaaccgccaucaaccagguucgaagccugauuggaaacgaggaguacaccgacuacaugcccagcaugaagcgguucaggcgggaggaggaggaggccggcgugcucugguga

SEQ ID NO: 25177 - RNA, 9876 nt, Artificial Sequence
  derived and/or modified CDS sequence (opt11) from DENV-2__EU569704__SS-prME
accgccggcgugaucaucaugcugaucccaaccgcgauggcauuccaccucaccacccggaauggggagccccacaugauugugggccggcaggagaaggggaagucccugcuguuuaagaccgaagacggaguuaacaugugcacccuuauggcuauagaccugggggagcugugcgaggacaccaucacguauaaaugcccccuccugcggcagaacgagccagaagacaucgacugcuggugcaauagcaccagcacuugggugaccuacgggaccugcacuaccacgggcgagcaucggcgggagaagcgguccguagcacuggugccccacguggggaugggccucgagacgcgcacagagaccuggaugagcagcgagggugccuggaaacacguacagcggauagagacauggauccuucggcacccgggcuucacgauaauggccgcgauccuggccuauaccaucgggaccacgcauuuccagcgcgcccucauuuucauccugcugacugccguggcgcccagcaugacgaugcgcugcaucggcaucuccaaccgcgacuuuguggagggcgucucugggggcaguuggguugacauugugcucgagcacgguagcugcgucaccacgauggccaaaaacaagcccacgcuggauuucgagcuaaucaagaccgaggccaagcagccagccacccuccgcaaguacugcaucgaggccaaguuaacgaacaccaccaccgagucccgguguccgacgcagggcgagcccagccugaacgaggagcaggacaagcgcuuccugugcaaacacuccaugguugaucgggguugggggaacggcugcgggcuguuuggcaagggcgggaucgugaccugcgcaauguucacaugcaagaagaauauggaggguaaggucgugcugcccgagaaccucgaguacacgauagugaucacgccccauagcggggaggagcaugccgucggcaacgacaccgggaagcacggcaaggaaauuaagauuacuccgcaguccucuaucacggaggccgagcuuaccggguacggcacggugaccauggaguguagcccgcggaccggccuggacuucaacgagauggugcuccugcagauggaggacaaggccuggcuaguccaccggcagugguuccucgaccugccccugccguggcucccgggggccgacacccaaggcagcaacuggauccaaaaggagacgcugguaaccuucaaaaacccacaugcgaagaagcaggacgugguggugcuggggucccaggagggcgccaugcacaccgcauugaccggggccacggaaauccagaugagcagcggcaaccugcuguucaccggccaccucaagugccgccugcggauggauaagcugcaacucaagggcauguccuacucuaugugcaccggcaaauucaagauagugaaggaaaucgcggagacccagcacgggacgaucgucauccguguccaguacgagggcgacggcucccccugcaagaucccuuucgagaucauggaccuugagaagcgucacguccuggggcgacucauaaccgugaacccgauugugaccgagaaggacuccccugugaacaucgaggcggagccgcccuucggggacuccuacaucaucaucgguguggagccaggccagcugaagcugaauugguucaagaagggaagcuccaucggccagauguucgagaccacgaugcgcggagccaagaggauggccauccucggggacaccgcuugggacuucggcuccuugggcgguguguuuacguccauugggaaagccuugcaccagguguuuggggcgaucuacggcgcugccuucucgggggucucauggaccaugaagauccugaucggcguaaucauaacguggaucgggaugaacagcagaucgacgucacucuccgucagccuggugcuggugggcgucgugacucuguaucugggggccauggugcaggcggacuccggcugcgucgugagcuggaagaacaaggagcugaaaugcggcucaggcaucuucauuaccgacaacgugcacacguggaccgagcaguauaaguuccagcccgagucgcccagcaaacucgcguccgccauccagaaggcccacgaggagggcaucugcgggauccggagcguaacgcgccuggagaaucugauguggaagcagaucacccccgagcucaaccacauccuguccgagaacgagguuaagcucacgaucaugaccggcgauauuaaggggaucaugcaagccggcaagcggagccuccgcccgcaacccaccgagcugaaguacuccuggaagacauggggcaaggccaagaugcugagcacggagucccacaaccagaccuucuugaucgacgggccugaaaccgccgaaugcccgaacacuaaccgggccuggaacagccuagagguggaggacuacggcuucggggucuucacuacaaacaucuggcugaagcuccgugaaaagcaagauguguucugcgacaguaaguuaaugucagccgccauuaaggauaaucgggcggugcacgcugacaugggcuacuggaucgagagcgcacugaacgauaccuggaaaauggagaaggcgucguuuaucgagguuaaguccugccacuggccaaagucccacacccucuggaguaauggcguguuggagagcgagaugaucauacccaaaaauuuugccgggcccgugucccagcauaauuacagaccgggcuaccauacccaaacagcggggcccuggcaccugggcaaguuagagauggacuucgacuucugugaggggaccaccgucguggucaccgaggacuguggcaaucgcggucccagccugaggaccaccaccgccagcgggaaguuaaucaccgaguggugcugccgguccugcacgcugccgccccugagguaccggggcgaggacgguugcugguacggcauggagauccgcccccugaaggagaaggaggagaaccucguuaacagccuggugaccgccgggcacggccaaaucgacaacuucucgcuggguauccucgggauggcccuguucuuggaggagaugcuccggacacgcgugggcaccaaacacgcgauacugcugguggccguaagcuucgugacgcucauuaccgggaacauguccuuccgcgaccugggccgcguaauggucauggugggcgcaaccaugaccgacgacaucggcaugggggucacguaccuggcccuucuggcggcguucaaggugaggcccaccuucgccgcugggcugcuccugcggaagcugaccucuaaagagcucaugauggcaaccauaggcaucgcccuccugucccaaagcacgaucccugagaccauccucgagcugaccgacgcgcuugcccuuggaaugauggugcugaagauuguacguaacauggagaaguaccagcuggccguaacaauuauggccaucuccugcgugccgaacgccgucauccuccagaacgcguggaaggugagcugcacgauccuggccgcgguguccgucucuccccuacuccugacauccagccagcagaaagcagacuggauuccccuggcguuaacuaucaagggccugaaccccaccgccaucuuccugacgacccucagucggaccagcaagaagcgcagcuggcccuugaaugaggccaucauggccgucggcaugguuagcauccuggccucaagccucuugaaaaacgacauccccaugacugggccccugguagcgggcggccuccugacggugugcuacguccugacuggccgcucugccgaccucgagcuggagcgcgccgcggacguaaagugggaggaccaggccgagaucuccgggagcucccccauucugagcaucaccaucuccgaagacggcagcauguccaucaagaacgaggaggaggagcagacccucacgauccugauccggacuggccuguuggugaucagcggugucuucccgguuuccauccccaucaccgcggccgcaugguaucugugggaagugaagaaacagcgcgccggcguucugugggaugugcccaguccgccgcccguggggaaggccgagcucgaggacggcgcguaucggaucaagcagagagggauucugggcuacagccaaaucggggccgggguauacaaggaggggacuuuccauaccauguggcauguuacgcgcggggccgugcugaugcaccgcggcaagcggauugagcccagcugggcugacgucaagaaggaccucaucuccuacgggggcggcuggaagcuggagggggaauggaaagagggcgaggagguccaggugcucgcguuagagcccgggaagaacccucgggccguccagaccaagccuggccuguuuaagaccaauaccgggacgaucggggccguaagcuuggacuuuagccccggcacuagcgggagucccaucguggaccggaagggaaaggucgucgggcucuacggcaacggcgugguaacucgcagcggggcuuacguguccgccauagcacagaccgagaagucgaucgaagacaaccccgagauugaggacgacaucuuucggaaaaagcgccugacgaucauggaccuacacccuggcgccgggaagaccaagcgguaccugcccgccaucguucgagaggccauuaagcggggcuugcgcacucugauacuggccccgacccgggucguggcggccgagauggaggaggcuuugcggggccugcccauccgcuaccagacgccggcaauucgggccgagcacaccggccgcgagaucguggaccuuaugugccacgcgacauucaccaugcgacucuuaagccccguccgcgugccgaauuacaaucugauaaucauggacgaggcccacuucacggauccggcguccauugccgcacggggcuacaucuccacacgcguggagaugggcgaggccgccgguaucuucaugaccgccacgccgcccgggagcagagaccccuucccccaaagcaacgcccccaucauggacgaggagcgcgagauccccgagcgguccuggaacagcggccacgagugggucaccgacuucaagggaaagacggucugguucgugccguccaucaaggcggggaacgacaucgccgccugcuugcgcaagaacggcaagaaggucauccagcugagucggaagaccuucgacuccgaguacgucaagacccgcgccaacgacugggacuucguagugacgacagacaucagcgagaugggggccaacuucaaggcggagcgggugaucgacccccgccgguguaugaagcccguuauccugaccgacggcgaggagcgcguaauccucgccgggccaaugccggugacccacuccagcgccgcgcagcggcgcggacgcaucgggcgaaacccaaagaacgagaacgaucaguacauuuacaugggcgagccccuggaaaacgacgaggacugcgcccacuggaaggaggcgaagaugcugcucgacaacaucaacacucccgaaggcaucaucccguccauguucgaacccgagcgcgagaagguggacgccaucgacggggaguaccggcuccggggcgaggcccggaagaccuuugucgaccugaugcgccgcggggaccuucccguguggcuagccuaccgcguggccgcggagggcaucaacuacgccgaucgucgcuggugcuuugauggaaucaagaacaaccagauccuggaggagaacguugagguggagaucuggaccaaggagggcgaacggaagaaacucaagccgcgcuggcuggacgcaagaaucuacuccgacccccuggccuuaaaggaguucaaagaguucgcagccggccguaagucccugacccugaaccuaaucacggagaugggucggcuuccuaccuucaugacucagaaggcccgagacgcccuggacaaccuagcaguacugcacaccgcugaggccggcggucgagccuacaaccacgcacuaagcgagcuccccgagacccuggagacccuacuccugcugacccuccuggccacugucacgggcggcaucuuccuauuucucaugagcgggaagggaaucgggaaaaugacacugggcaugugcugcauaaucaccgcgucuauucugcucugguacgcccagauccaaccgcacuggauagcggccucuaucauccuggaguucuuccugauugugcuccugauccccgagccugagaagcagcgcacgccgcaggauaaccaacugacauacgucguuaucgccauccucacgguggucgcagccacgauggccaacgaaaugggguucuuagagaagaccaagaaggacuuaggccucggcucuaucacuacgcaggagucggaauccaacauccuggacaucgaccugcgcccggccagcgccuggacccucuacgcgguugccaccaccuuugugacgcccaugcugcgacacuccaucgagaacuccuccgugaacguuagccugaccgccaucgccaaccaggcgaccgugcucauggggcugggcaaaggguggccccugucuaagauggacaucggcguccccuuacuggccaucgggugcuacucucaagugaacccgauuacccugacggccgcccugcugcugcucguggcgcacuacgcgaucaucggccccggccugcaggccaaggccacccgggaggcccagaagcgugccgcggccgggaucaugaagaaccccaccgucgacggcaucaccguaaucgaccuggaacccaucccguaugaccccaaguucgagaagcagcuuggccagguuaugcugcugauccucugcgucacacaggugcugaugaugcgcaccacgugggcccugugcgaggcccucacuuuagcgacgggccccaucaguacccugugggagggaaaccccggcagauuuuggaacaccaccauagcgguuagcauggccaacaucuuccgaggcuccuaccucgccggcgccggccugcuguucucaaucaugaagaacaccaccaacacccggcgcggcaccggaaacaucggcgagacccucggggagaaauggaagucccggcugaacgcgcugggcaagagcgaguuccagaucuacaagaaguccgggauccaggaggucgaccgaacccuagccaaggaggggauaaagcgcggggaaaccgaccaccacgcggugucucgcggcuccgcaaagcuucggugguucguagagcgcaacauggucaccccugagggcaaagugguggaccugggcugcggccgcgguggguggagcuacuauugcggcgggcucaagaacguccgcgagguuaaggggcugacgaagggcggcccagggcacgaggaaccaauccccaugucuaccuacggcuggaaucuggugagacuccagagcggggucgacguguuuuucaccccgcccgagaagugcgacacucugcugugugacauuggcgaaagcuccccuaaccccacgauugaagccggccgcacccuccgggugcugaaucugguugaaaacuggcucaacaauaacacccaguucugcaucaaagugcugaauccguauaugccgagcgugaucgagaagauggagaccuuacaacgcaaguacgggggcgcgcugguccggaacccccugucccgcaacagcacccaugagauguacugggucucuaacgccacgggcaacaucgugagcucagucaacaugaucagcagaaugcugaucaaccgcuucacaaugaaacacaagaaggccaccuacgaacccgauguggaccugggcuccggcacccgcaacauaggcaucgagagcgagauccccaaccucgacaucaucggcaagcguaucgagaagauuaagcaggagcacgagacuucguggcacuacgaccaggaccaucccuacaaaacgugggccuaccacgggucuuacgagacuaagcagaccgguucugcuagcuccauggucaacggggucgugcgccugcuaacgaagcccugggaugugguuccgauggugacccagauggcgaugaccgacaccacgcccuucggccagcagcgcguguucaaggagaaggucgauacccgaacucaggagcccaaggagggcaccaagaaguugaugaaaaucacagccgaguggcuguggaaggagcuggggaagaagaagacgccccgcaugugcacccgcgaggaguuuacccggaagguccgcucgaacgcagcucucggcgccaucuucacggacgaaaacaaguggaagagugcgcgggaggccguagaggacagccgcuucugggagcuaauugaucgggagcgcaaccuacaccucgaggggaagugugagacaugcguuuacaacaugaugggcaaacgggagaagaagcugggggaauucgggaaggccaagggaucccgcgccaucugguacauguggcugggugcacgguuucucgaguuugaggcccugggcuuccugaacgaggaccacugguucagccgcgggaacagccucuccggcgucgagggagaggggcuacaccggcugggcuacauccuccgcgacgucucaaagaaggaagggggcgcaauguaugcagacgacacggccgggugggacacccggaucacccuggaggaccugaagaacgaggagauggucacuaaccacaugaagggcgagcacaagaagcuagcggaggcgaucuucaagcuuacauaccagaacaaggugguaaggguacagcgaccgacgcccagagggaccgugauggacaucauaucccgccgggaccagcgcggcagcggccagguaggaaccuacgggcugaacacuuucaccaacauggaggcacagcucauaaggcagauggagggagagggcauauucaagucuauccagcaccugacaguuaccgaggaaaucgccgugcagaacuggcuggcaagaguaggacgagagcgccucagccggauggccaucuccggggacgacugcguggugaagcccuuggacgaccgcuucgccagcgcccugaccgccuugaacgacaugggcaagguucggaaggacauccagcagugggagcccucccgcggcuggaacgacuggacccaggugccguucugcucccaccacuuccaugagcucgugaugaaggacgggcggguucucguggugcccugucgcaaccaggacgagcucaucggacgggcccguauuucccagggcgcgggcuggucacuuaaggaaacagccugcuuggggaaaagcuacgcccaaauguggacccucauguacuuccaccggcgcgaccugcggcuggcugccaacgcgauuuguagcgccguccccucccauugggugcccaccagccgcacgaccugguccauccacgccaaacacgaguggaugacaaccgaggacaugcucgccguguggaaccgggucuggauacaggagaacccauggauggaggacaagaccccgguggagagcugggaggaggugccuuaccuggguaagcgagaggaucaguggugcgggagccugaucggacucacaucucgggcaacuugggccaagaacauccagaccgccauaaaccagguccggagcuugaucgguaaugaggaguacaccgacuacaugcccucuaugaagagguuccggcgggaggaggaagaagccggcgucuuaugguga

SEQ ID NO: 25178 - RNA, 9876 nt, Artificial Sequence
  derived and/or modified CDS sequence (opt11) from DENV-2__EU482568__SS-prME
acugcaggaguaaucauuaugcuaaucccaacggcaauggccuuccaccucaccacccgcaacggggaaccccacaugaucguagggagacaagaaaaaggcaaaucgcuacucuucaaaacagaagacggagugaacaugugcacgcuaauggccauagaccuaggcgaacuuugugaagacacaauaaccuauaaauguccccuacugagacagaacgaaccggaagauaucgacugcuggugcaacucgaccucgaccuggguuacauacggaaccugcacgacaacgggcgaacaccgacgagaaaaacgguccguagcccugguaccccacgucggcaugggccuugaaacacgaaccgagacauggaugucgagcgaaggcgcguggaaacacguacagagaaucgaaacauggauucuaagacacccgggauucacgaucauggcagccauacucgcauacacuauaggcacgacacacuuccagcgcgcgcucauauucauucuguugacggcaguagcuccaagcaugaccaugagaugcaucggaauuucuaaccgggacuuuguagagggaguaagcggaggcaguugggucgacaucguguuagaacacggcucaugcguaacaacgauggccaaaaauaaacccaccuuagacuuugaguuaauaaaaaccgaagcgaaacagcccgcaacccuaagaaaauauugcauagaggccaaacuaacgaauacgaccacugaaucgcguuguccaacucagggugaaccuagcuuaaaugaggagcaagacaaaagauuccuaugcaaacacucaaugguugaccgaggguggggaaacgggugcgggcuuuucggcaaaggcgggaucguaacuugcgccauguucacaugcaagaaaaacauggaagggaaaguagugcuaccggaaaaucuggaguacacgaucgucaucacaccccacuccggcgaagaacacgccguggggaacgacaccggaaaacacggaaaagaaaucaaaauaacaccacaaagcagcaucaccgaagcggaacugacuggcuacggaacagugacaauggagugcagcccccgcacaggcuuggacuucaacgagauggugcuucuccagauggaggacaaagcguggcugguacaccgucaaugguuccuagaccuaccccuaccuuggcucccaggagcugacacgcagggauccaacuggauacaaaaggaaacucucgugaccuucaaaaauccacacgcgaagaagcaggaugugguggucuugggaucacaggagggugccaugcacacagcucucacaggggccaccgaaauacagaugucgagcgggaaccuacucuucacagggcauuuaaagugccgcuuacguauggacaagcuacagcucaagggaaugucguacucgaugugcacugguaaguucaagaucguaaaggagauagcugaaacgcagcacgguacgauuguaauucgcguucaguaugaaggagacgggucgcccugcaagaucccauuugaaauaauggaucucgaaaaacgccacguacugggccggcuaauaaccgucaauccuaucguaacugagaaagacucccccgucaacauagaagcggaaccgccguuuggggacucuuauauaauaaucggaguugaacccggacaacuuaaacugaauugguucaagaaagguagcuccaucggucaaauguucgaaacaacgaugcguggggccaagaggauggcaauacugggggacacagcaugggacuuugggagccuagguggggucuuuaccagcaucgggaaagcucuccaccagguguucggggcaauauacggcgccgcauucagcggagugucuuggacaaugaaaauacuuaucgggguuauuaucaccuggauaggcaugaauaguagaucaacuucccugucggugagccucguguuaguaggugucgucacacucuaccuaggcgcuaugguccaggccgauuccggcugcguggucucguggaagaacaaggaacucaaauguggauccgggauauucauuacggacaacgugcacacuuggacggaacaauacaaguuucagcccgaauccccaagcaagcuagcgagcgcuauacaaaaggcacacgaagaagggaucugcggcauaaggagcguaacaaggcuagagaaccucauguggaagcagaucacgcccgaacuaaaccacauacuuucagaaaacgaagucaaauuaacaauaaugacaggagauauucggggcauaaugcaagccggcaagcguucccucagaccucaaccaaccgaacucaaauacaguuggaagacguggggcaaagcgaagaugcucagcacugagagucauaaccaaaccuuucuaauagacggucccgagacagcugagugcccaaacaccaaccgagcuuggaauagccucgaaguagaagacuauggcuucggagucuucacaaccaauaucuggcugaagcuacgagaaaagcaagacguauuuugcgacagcaaguuaaugucagccgccaucaaagacaaccgagcaguacaugccgauaugggauacuggaucgagagugcccucaacgacacguggaaaauggagaaagcgucauucauagaagugaaaucaugucacuggcccaagucucacacauuauggucgaacggcguccuagagucggagaugauaauacccaagaacuucgcaggacccguaucccagcacaauuacagaccagguuaccacacgcaaacggcuggaccguggcaucuagggaaauuagagauggauuucgacuuuugcgaagguacaaccguuguggucaccgaagacugcgggaacagaggaccuucacuaaggacuacaacggcuagcgguaaacuaaucaccgaauggugcugucgaaguugcacacugcccccgcugcgcuaccgaggcgaggauggauguugguacggcauggaaauccgaccgcuuaaggaaaaagaggagaaccuaguuaacucccuaguaacggccggacacggccaaaucgacaacuuuagccugggcauacuuggcauggcccucuuccucgaggaaauguugcgaacccgagucggcaccaaacaugcgauucugcucgucgcagugaguuuugugacccuaaucacgggaaacauguccuucagggaccugggacggguaauggugauggucggagccaccaugacggaugacauagggauggggguaacuuaccuugcccucuuggcggcguucaaagugaggccaacguucgccgcagggcuacuccugcgaaaacuaaccuccaaggagcuaaugauggcaaccauaggcaucgcccugcuuagucagaguacaaucccagagacuauauuggaacuuaccgaugcccuagcauuagguaugauggucuugaagauagugcgcaacauggagaaauaccaacuagcagucaccauuauggccaucuccugcgucccaaacgcuguaaucuuacaaaacgcauggaagguuagcuguacaauccuagcagcaguaucaguauccccgcuauugcuaacaaguucccagcagaaagcagauuggaucccgcuagcccuaacuauaaagggucucaaccccacugcaauauuccugaccaccuuguccagaaccucaaagaagcgaagcuggccccugaaugaagcaaucauggcagugggcauggucuccauccuggccucaucuuuacugaaaaacgacauacccaugaccgggccucucguagcaggcggacugcuaacggucugcuacguucuaaccggucgcucggcggaccucgaguuagaacgggcagcagacguuaaaugggaggaccaggcggaaauuagcggcuccagcccgauauuaucuauaaccauaucagaagacggcucgaugagcaucaaaaacgaagaagaggaacaaacacucacuauucugauaagaacaggccuccuggugauaagcggaguauucccaguaucaaucccuaucaccgcggcggcgugguaccugugggaggucaagaaacaaagggccgguguguuaugggacgugccguccccaccgccaguagagaaagccgaguuagaggacggugcauaucgcaucaagcaacgagguauccuggguuacucucaaauaggggccggugucuacaaggaaggaaccuuccacacgauguggcacguaacaagaggggcaguacugaugcaccguggcaagcgaguggaacccagcugggcagacgugaagaaagaucucaucagcuacggcgggggauggaaacuggaaggggaguggaaggaaggcgaggagguccaaguccuagcacuagagccaggcaaaaacccacgugcgguacaaacaaagcccggcuuguucaagacaaacaccggcacaauaggagcagucagccuggacuucucgcccggaaccucgggcucaccgaucguagacagaaaggggaaaguggugggucucuacgggaauggaguagucacccguagcggugcauacgugagcgccauagcucaaaccgaaaagagcaucgaagacaacccagagauagaagacgauauauuccgaaagaaacgccugaccauaauggaccuacacccgggggccggcaagacgaagcgguaccugcccgcgaucgugagggaagcaauaaaaagggggcuaagaacacucauccuggcaccgacaaggguuguugccgcagaaauggaagaggcccuucggggacucccaauacgauaccagaccccggccauacgcgcagaacacacaggccgagaaauaguugaccugaugugccacgcuaccuuuaccaugcgacugcuauccccaguacgagugcccaacuacaaucucaucaucauggaugaagcacacuucacugaucccgcgucgauagcggcccgugguuacaucagcacucguguggagaugggcgaagcggcggguauauucaugacggcuacacccccgggcaguagggauccauucccacagucgaaugcacccaucauggacgaggaacgcgaaauaccggagaggaguuggaacucggggcacgaguggguaacugacuucaaagggaaaacaguaugguucguaccgucuaucaaagcaggaaacgauauagccgcuugccuaaggaaaaacggcaagaaaguaauccaacuuagucgcaaaacauucgacucugaauaugugaaaacgcgugcuaaugacugggauuucguagugacaacugauauaucggagaugggagcuaacuucaaagcagaacgcguaaucgacccgcgaagaugcaugaagcccgucauccuuacggacggggaggagcgcgugauccuggcagggccaaugccggugacacacucauccgcugcgcaacgacggggaagaauaggcagaaauccuaaaaacgaaaacgaccaguauaucuacaugggcgagccucuagaaaacgacgaggacugcgcacacuggaaagaggcaaaaaugcuauuagacaacaucaacacaccagaagggaucauaccaagcauguucgagccagaaagagagaaaguagacgccaucgauggggaauaccgccuucguggcgaagcacgaaagacauucguugaucucaugcgcaggggagaucuaccggucuggcuggcauaccgaguggccgcagaaggaauuaacuacgcagacagaagaugguguuuugacgguauaaagaacaaccagauuuuggaggaaaacguugaaguagaaaucuggaccaaggagggggaacggaagaaauuaaagccacgcuggcucgacgcacgaauauacucagauccccucgcccugaaagaguucaaagaguucgccgccggacgaaaaagccuaacccugaaccugauaacggagaugggcagacuuccuaccuuuaugacacagaaggcaagggaugcauuggauaaucucgcgguuuuacacaccgccgaggccgggggcagggcauacaaccacgcacugagugagcuaccagaaacgcuagaaacgcugcuacuacucacgcuccucgcuaccgucacagguggaaucuuccucuuccuaaugagcggaaaaggaaucggcaagaugacccuuggaaugugcugcauaauaacggcaagcauacuccucugguacgcucaaauccaaccgcauuggaucgcugcguccaucauacuggaguucuuucuuaucguucugcugauacccgagccagaaaaacagcgcacaccucaagacaaucagcucacauacguugugaucgcgaucuugacgguaguagcggcgacgauggcgaacgaaaugggauuccuggagaaaaccaaaaaggaccugggccuaggcucuaucaccacccaagagucagaaucgaacauccucgacauagaccuccgccccgcgucagccuggaccuuguacgccgucgccaccacguucguuacgcccaugcuccggcacucgauagagaauagcucgguaaacgugucacucacggcaauugcaaaccaggccacugugcuaaugggguuaggcaagggauggccccuauccaaaauggauauaggcgucccccuucuugccaucggcugcuacagccaggucaaccccaucacacuaaccgcagccuugcugcugcuagucgcccacuacgcaaucaucgggccaggccuucaagcaaaggcgacacgagaagcgcagaagcgggccgcagcuggcauaaugaaaaacccuaccguagacggaauuacagucauagaccuugaaccgauacccuacgauccgaaauuugaaaaacaauuaggccaagucaugcuacuuauacucuguguaacacaaguuuugaugaugagaaccacaugggccuuaugugaagcauugacacuagcaacaggcccuauaagcacgcugugggaagggaaccccgggcgcuuuuggaacaccacuauagccguaaguauggcuaauauuuuccguggcucguaccucgcgggagccgggcuacuauuuagcauaaugaaaaacacgacgaauacccggagaggcaccggcaacauaggggagacauuaggcgaaaaauggaaaucucgacugaacgcacucgggaaaucagaguuccaaaucuacaagaaaucagggauccaagaaguagaccgcacacuagcaaaggagggcaucaagcgaggagaaaccgaccaccacgccguaagccgcggguccgccaagcugaggugguuuguggagcguaacaugguaacgccugaggggaagguuguagaucuaggaugcggacgaggcggcuggaguuauuacugcggagggcugaagaacgugcgggaaguaaaggggcugaccaaaggaggacccggacacgaggaaccaauacccaugucaaccuacggcuggaaccuaguaagacugcagucuggaguagacguguucuucaccccaccagagaaaugcgacacgcuucucugcgacaucggugagucaucacccaacccgacaauagaagcaggacguaccuuacgagucuuaaaccucguagagaacuggcugaauaacaauacacaauuuuguauaaagguacugaauccauacaugcccagcgucaucgagaagauggagacccuacagagaaaguacggcggagcauugguccgaaaucccuugucgcgcaacagcacgcaugaaauguacuggguaucgaacgcaacaggcaacaucgucucgucggugaacaugauaucccguaugcucauaaaucgauucacgaugaaacauaagaaagcaacauacgaaccggauguggaucuagguuccggaacccguaacauagguaucgagucagaaauacccaaccucgauaucauugguaagcgcauagagaaaaucaaacaagaacacgagacauccuggcauuacgaccaggaccauccauacaagacaugggccuaccacgguuccuaugaaacuaagcaaaccgguagcgcgucaagcauggugaaugguguaguacgcuugcucacaaaaccaugggauguugucccuaugguuacgcagauggccaugacggauaccacaccauuuggacaacaacgcguuuucaaggaaaaaguugacacgaggacccaagaacccaaagaaggaaccaagaagcuaaugaagauuacggcagaguggcuauggaaggagcuaggaaagaagaaaacuccccgaauguguacacgcgaagaguuuacucgcaagguacgcagcaaugccgcgcugggagcuauuuucacggaugaaaacaaauggaaaagcgcaagggaagcaguggaggacucucgcuucugggaacugaucgaccgcgaaaggaauuuacacuuagaaggaaaaugcgaaacgugcguauacaacaugaugggcaaacgagagaagaaacuaggcgaguucggaaaagcgaagggauccagagcaauuugguacauguggcuuggcgcaagauuucuggaguucgaagcguugggauuccuaaacgaagaucacugguuuagccgaggaaacucgcuaagcgguguagaaggcgaaggacuccaccgauuggguuauauccuacgagacgugagcaagaaagagggaggagcuauguacgcagaugacacagcuggaugggacacgagaauaacacuagaggaccucaaaaacgaggaaauggugacaaaccacaugaagggugagcacaaaaaguuggcagaggcaauauucaagcucacauaccaaaacaaggucgugaggguacaacgcccaacgccgagaggaacugugauggacaucaucuccagacgagaccagcggggcagcggucaagugggaacauaugggcuaaacaccuucaccaacauggaagcgcaacucauaaggcaaauggaaggagagggcaucuuuaaaucaauccaacaccugacaguaaccgaggaaaucgcagugcaaaacuggcucgcccgagucgggcgggagcggcuaucccggauggccauaaguggagacgacugcgucgugaaaccacuugacgaucgguucgcaagugcacugacggcccuaaacgacaugggaaaaguacggaaagacauacagcaaugggaaccgucucgaggauggaacgacuggacucaaguaccguuuuguucacaccacuuucacgaacugguaaugaaagauggacguguccugguugugccauguagaaaccaggacgagcucauagggagagcccgcaucucacaaggagcaggcuggucauugaaagaaaccgcaugccuaggaaaauccuaugcgcaaaugugggcucugauguacuuucaccggagggaccuccgguuagcggcgaacgcuauuugcuccgccgugcccucgcauuggguacccacaaguaggacaaccuggaguauccaugcaaagcaugaauggaugaccacggaggacauguuagcuguguggaacagaguuuggauucaggagaacccguggauggaagacaagacgcccguugaaucgugggaggaaguccccuaccucgguaaaagagaagaccaaugguguggaucccuaauaggacuaacuagcagagcaacaugggcaaagaacauccaaacagccauaaaccaaguaaggagccugaucggcaacgaagaauacacagauuacaugcccuccaugaaaagguuucgacgagaagaagaagaggccggagucuuaugguaa

SEQ ID NO: 25179 - RNA, 9876 nt, Artificial Sequence
  derived and/or modified CDS sequence (opt11) from DENV-2__EU482569__SS-prME
accgccggcgugaucauaaugcugaucccuaccgccauggcguuccaccucacaacccggaacggggaaccccacaugaucgucggucggcaggagaaagggaagucccugcuguucaagaccgaggacggcgugaacaugugcacccucauggccaucgaccugggugagcugugcgaggacaccaucacguacaagugccccuuacuccgccagaaugagccggaggacaucgacugcuggugcaacagcacaagcacaugggugaccuacgggaccugcaccaccacgggcgagcaccggcgcgaaaagcgguccgucgcccuggugccgcacgugggcaugggccucgagacccggaccgagaccuggaugagcagcgagggggcauggaagcacguccagcggauagagaccuggauucuucgccacccgggcuucaccaucauggccgcgauccuggccuacaccaucgguaccacgcauuuccaacgagcccucaucuucauccugcugaccgcgguggcaccgagcaugacgaugcgcugcauuggaaucagcaaccgggacuucguugagggcgucagcgggggcucuuggguggacaucgugcucgagcacggaagcugcgucaccacgauggcuaagaauaaaccuacccuggacuucgagcugaucaagacugaggccaagcagcccgcaacccuccgcaaguacugcaucgaggccaagcugacuaacaccaccaccgagucccgcugcccuacgcagggcgagccgagcuuaaacgaggagcaggacaagcgcuucgugugcaagcacuccaugguugaccggggcuggggcaauggcugcgggcucuuuggcaagggugggaucgugaccugcgcgauguucacgugcaagaagaacauggagggaaagguggugcugcccgagaaccuggaguacaccauagucauaacgccccacagcggggaagagcacgcggugggcaacgacaccgggaagcacggcaaggaaaucaagaucaccccccagucaagcaucacagaggccgagcucaccggguacggcacuguuaccauggagugcagcccccggacaggucuggacuucaacgaaaugguccuccuccagauggaggacaaggcuuggcuagugcaccggcagugguuccuggaccucccccuucccuggcugccgggggcugacacccaaggcuccaacuggauccagaaggagacgcucgugaccuucaaaaauccccacgcgaagaagcaggacguggugguccuggggucccaggagggcgccaugcacaccgcuuugaccggagcaacggagauccagaugaguucaggcaaccuacuguuuaccggccaccugaaaugccgccuccggauggacaagcugcagcugaaggguaugucuuacagcaugugcaccgguaaguucaagaucgugaaggagauagccgagacccagcacgggacgaucgugauucgcguccaguacgagggcgauggaaguccgugcaaaaucccuuuugagaucauggaccucgagaagcggcacgugcuggggcgccugaucaccgugaacccgaucgucaccgagaaggacagccccgugaacauagaggcggagccgcccuuuggcgauuccuacaucaucaucggggucgagccgggccagcucaagcugaauugguucaagaaggggucauccaucggccagauguucgagaccacgaugcgcggugcuaaacggauggcuauccugggagauaccgcgugggacuucggcagccucgggggaguguucaccuccaucgggaaggcccugcaccaaguauucggcgcgauuuauggcgccgccuucagcgggguuuccuggaccaugaaaauccugauaggcgucaucaucacguggaucgggaugaacagccgcuccaccagccugaguguaagccucgugcuggucggcguggugaccuuauaccuaggggccaugguccaggcggauuccggcugcguggugagcuggaagaacaaggaguuaaagugcggcucgggcaucuuuaucacugacaacguucauacguggacagagcaguacaaguuccagcccgagagcccaagcaaacuggccuccgccauccagaaggcccacgaggagggaauuugcgggauucggagcgugaccaggcucgaaaaucugauguggaagcagauaaccccggagcugaaccauauccucucagagaacgaggugaaacugacuauuaugaccggcgacauuaaggggaucaugcaggcgggcaagcggucucugagaccgcagccaaccgagcucaaguacuccuggaagaccuggggcaaagcuaagauguugagcacggagagucauaaccaaaccuuuuugaucgacgggcccgagaccgccgagugcccgaacacgaaccgagcguggaacucacucgaggucgaggacuauggcuuugggguguucacgaccaacauuuggcugaaacuucgcgaaaagcaggaugucuucugcgacuccaagcucaugagcgccgccaucaaagacaaucgggcgguccaugccgacaugggcuacuggaucgaguccgccuuaaaugacaccuggaagauggagaaggccucguucaucgaggugaagagcugccauuggcccaagagccacacacugugguccaacggcgugcuugagagcgaaaugaucauccccaagaauuucgccgggccagucucccagcacaacuaccgcccgggcuaccacacccagacggcggggcccuggcaccugggcaaguuagagauggacuucgacuucugcgaagggaccaccgucguggucaccgaggacugcggcaaccggggucccagccuccgcacuacgacagccucagggaaacucaucaccgaguggugcugcaggaguugcacucugccgccgcuccgcuaccggggcgaggacgggugcugguacggcauggagauccgaccccugaaagagaaggaggagaaccuggugaacagucucgugaccgcaggucacggccagaucgacaacuucucccugggaguccuggguauggcccucuuccuggaggaaaugcugagaacccgcguugggaccaagcacgcgauccucuuaguggccgucagcuucgugacucugaucaccgggaacauguccuuccgggaccucggacgcgugauggucauggugggggccaccaugaccgacgauaucggcaugggcguaacauaccucgcccugcucgccgcguucaaaguccgccccacguucgccgcgggucugcugcuccggaaguugaccagcaaagagcugaugauggcuaccaucggcaucgcccuccugucccagagcacuaucccugagaccauccuggagcucaccgaugcgcuggcacugggcaugauggugcucaagauuguacgcaauauggagaaguaccagcuugccgucaccaucauggccauuuccugcgucccgaacgccgugauccugcagaacgcguggaaggucaguugcacgaucuuagcagccgugucagugagcccacugcugcucacaucuagccagcaaaaggccgauuggaucccucuagcgcugaccaucaaaggccucaacccgaccgcuaucuuccugacgacccugucacguaccagcaaaaagcgcuccuggccgcucaacgaggccaucauggccgugggaauggugucaauccuggccucgagccuguugaagaacgauauccccaugaccgggccccuggucgcgggcgggcugcucaccgugugcuacgugcugaccggccggucggcugaccuggaacucgagcgcgccgcagacgucaagugggaagaccaagccgagauaucagggucaucccccauccugagcaucaccaucuccgaggacgggagcauguccaucaagaacgaggaggaggagcagacccugacgauccucauccggaccggccugcuggugaucagcgggguguucccgguuucgauccccaucaccgcugccgccugguaccucugggaggugaagaagcaacgcgccggcguccugugggacgucccguccccgccgcccguggggaaggccgagcuggaggacggcgcguaccggauaaagcagagggguauccucggcuacucccagaucggcgccgggguguacaaggagggcacguuccacacuauguggcacgucacgcgcggcgccgugcugaugcaccgaggcaagcgcaucgaaccaagcugggccgacgugaaaaaggaccugaucuccuacgggggcggcuggaagcucgagggggaguggaaggaaggcgaggagguacaggugcuggcccuggagcccgggaagaaccccagggccgugcagaccaagcccggccucuucaagaccaacaccggcacgaucggcgccgucucucucgacuucucucccggcaccucugggucacccaucguggaccgaaaggggaagguagucgggcuuuacggcaacggcguggugacccgcaguggggcuuacgucucggccauugcgcagaccgagaaauccaucgaggacaacccggagaucgaggacgacaucuuccggaagaagcggcucacgaucauggaccugcaccccggcgcugguaaaacaaagcgguacuuacccgccaucguacgcgaggcuaucaagcguggacuucgaacccucauccuggccccgacccgcgucgucgcggccgagauggaggaagcccugcgggggcuccccauccgcuaccagacgcccgccauccgggccgagcacaccggccgcgagaucguggacuuaaugugccacgcgaccuucaccaugcgucugcugagcccggugcgcgugccgaacuauaacuugaucauaauggacgaagcccacuucacggaccccgcauccaucgcugcccggggcuacaucagcacccgcguggaaaugggggaggcggccgggaucuucaugacugcuacuccgcccggguccagggacccguucccccagagcaacgcccccaucauggacgaagagcgcgagauccccgagcguaguuggaacagcggacacgagugggugacugacuucaagggcaagacggucugguucguuccgucaauuaaggcgggcaacgacaucgccgccugccugcgcaagaacggcaagaaggugauccaacucucucggaagaccuucgacuccgaauacgucaagacccgcgccaacgacugggacuuuguggugacgaccgacaucagcgagaugggggcaaacuucaaggcagagcgggucaucgacccccgccgcugcaugaagcccgugauccugaccgacggcgaagagcgcgugauccuggccgggcccaugccggucacccacucaagcgccgcccagaggagaggucgcaucgggcgcaaccccaagaacgagaacgaucaguauaucuacaugggagagccccuugagaacgacgaggacugcgcucacuggaaggaggcaaagauguuacuggauaacaucaauacgcccgagggcaucauuccguccauguucgagccagagcgcgagaagguggacgcaaucgacggggaauaccggcuccguggcgaagcccggaagaccuucguggaccugaugaggcgcggggaucugcccguuuggcucgccuaccgcguggccgcggaggggaucaauuaugccgaccggcgguggugcuucgacgggaucaagaacaaccagauccuagaggaaaacguggaggucgagaucuggaccaaggaaggggagcggaagaagcugaagccgcgcuggcuagacgcucggaucuacagcgauccccuggcacuaaaggaguucaaggaguucgcggcaggccguaagucccucacccugaaccugaucacagagauggggcggcuccccaccuucaugacccaaaaggcccgcgacgccuuagacaaccuggccgugcuccacaccgcggaggcuggugggagggccuacaaccaugcccugagcgagcugcccgagacgcucgagacucuacugcuccugacgcugcucgccaccgucacgggaggcauauuccuguuccuaauguccgggaaaggcaucgggaagaugacccucggcaugugcugcaucaucaccgcgagcauccuguugugguacgcccagauccaaccgcacuggauugccgccuccaucauccucgaguucuuccugauagugcugcucauccccgagccggaaaagcagcgcacuccgcaggauaaccaguugaccuacgucgugaucgccauacugacggugguggcggccaccauggcaaaugaaaugggguuucucgaaaagacgaagaaggaccugggccugggaagcaucaccacucaagagucagaaagcaauauccucgacaucgaucuccggccggccagcgccuggacccuguacgccguugcgaccaccuuugugacgccaaugcuccgacacuccaucgaaaacagcucagugaacgucagucugaccgccaucgccaaccaagcgaccguucuuaugggacucggcaagggguggccccuguccaagauggacaucggcgucccacuucucgccauugguugcuacucccaggucaacccgaucacgcugacggccgcccugcuccugcugguggcacacuacgcgaucauuggcccgggccuccaggccaaggccacacgggaagcgcagaagcgugccgcggccggcaucaugaagaaccccaccguggacggcaucacggucaucgaccuggagcccaucccguacgaccccaaguuugaaaagcagcugggacagguuaugcuccugauucugugcgugacgcagguccucaugaugcgcacgaccugggcccugugcgaggcgcugacauuggcaacgggcccgaucuccaccuugugggagggcaacccgggacgguuuuggaacacaaccaucgcggugagcauggccaacaucuuccgcgggucuuaccuggccggggccggccuccuguucagcaucaugaaaaauacgacgaacacgcggcgugggacgggcaacaucggugaaacguuaggugagaaguggaagucacgucuaaacgcgcugggcaagaacgaauuucagaucuacaagaaaagugggauccaggagguggaucgcacccuggccaaggagggcaucaagcgcggggagacggaccaccacgccgucucccgaggcagcgccaagcuccggugguucguggagaggaacaugguuauaccggagggcaaggucguggaucuggguugcgggagggggggguggucguacuauugcggcgggcuuaagaacguucgcgaagucaaggggcucacuaagggcgggcccgggcacgaggagcccauccccaugucuacuuacggcuggaacuuggugcggcugcagagugggguggacgucuucuuuaccccgccggagaaaugcgacacccuccugugcgacaucggcgaguccagccccaaccccacgaucgaggccggccgcacacugagggugcucaacuuaguggagaacuggcugaauaacaacacccaauucugcaucaagguacucaauccguacaugcccuccguaaucgagaagauggagacccugcagaggaaguacgggggcgcgcuggugcggaacccccugagcagaaacucuacccacgagauguacugggucucaaacgccaccgggaacaucguguccagcgugaacaugaucagucggaugcucaucaaucgcuucacaaugaagcauaaaaaggcgaccuacgagccggacgucgaccugggcagcgguacccgcaauaucggcaucgagucugagauccccaaccuggacaucauugggaagcggauagagaaaaucaagcaggagcaugagaccagcuggcacuacgaccaggaccaccccuacaaaacgugggcauaccacggauccuacgagacgaagcagaccgggagcgccuccagcauggugaacgggguuguucgccuacuaaccaagcccugggacguagugccuauggucacccagauggcgaugaccgacacgacaccguucgggcaacagaggguguucaaggagaaaguggacacgcgcacgcaggagcccaaggaaggcacgaagaagcuuaugaagaucaccgcugaguggcucuggaaggagcuggggaagaagaaaacgccccggauguguacccgggaggaguuuacccgaaaggugcgcuccaacgccgcccuuggcgccaucuucacugacgagaacaaguggaagucugcgagagaagcaguggaggauagccgcuucugggagcucaucgaccgggaacgcaaucugcaccuggaggggaagugcgagacgugcguguacaauaugaugggcaagcgggagaagaagcucggggaguucggcaaagccaaaggcagccgugccauuugguauauguggcugggggcaagauuccuggaguucgaggcccucggguuucugaacgaggaccacugguucucccgcgggaacagccugagcggcgucgagggggaaggccuccaccggcugggcuacauacugcgcgacguguccaagaaggaggguggggcuauguacgccgacgacacugcgggcugggacacccggauaacccucgaggaucugaaaaacgaggagaugguaacgaaucacaugaagggcgagcauaagaagcuggcggaagccaucuucaagcuaaccuaccagaacaaggugguucgcgugcagaggccgacgccucgggggaccgugauggacaucaucagccgccgggaccagcguggguccggccaaguggggacguauggcuugaacaccuucacaaacauggaggcccagcugauccggcagauggagggcgaggggauauucaaaagcauccagcaccucaccgucacugaggagaucgccgugcagaacuggcuggcccgcgugggccgggagaggcugucccggauggcaaucagcggggacgacugcgucgugaagccucucgacgaccgcuucgccucagcgcugaccgcccugaacgacaugggcaaggugcgaaaggacauacagcagugggaaccgagccguggauggaacgacuggacccaggucccguucugcucccaccauuuccacgagcucguuaugaaggauggccguguacucgucguccccugcagaaaccaggacgagcuaaucgggcgggccagaaucagucaaggcgcgggcuggucccucaaggagaccgcgugccugggaaaaagcuacgcccagauguggacacugauguacuuccaccggcgcgaccuccggcuggcggccaacgcgaucugcuccgccguccccagccacuggguccccaccucccgcaccaccuggagcauccacgccaagcacgaguggaugacuacggaggacauguuagccguguggaaccgggucuggauacaggagaacccguggauggaggacaagacccccgucgagucgugggaggaggugcccuaucucggcaaacgcgaggaccaguggugcgggucacuaaucggccugaccagccgcgcaaccugggcaaagaacauucagacggccaucaaccaggugagaucccucauugggaacgaggaguacaccgacuacaugccgagcaugaagcgcuuucggcgcgaggaggaggaggccggcguccugugguga

SEQ ID NO: 25180 - RNA, 9876 nt, Artificial Sequence
  derived and/or modified CDS sequence (opt11) from DENV-2__EU482570__SS-prME
accgcgggcgugaucaucaugcuuauccccaccgccauggcguuccauuugaccaccagaaacggggagccgcacaugaucgucggccgccaggagaaggguaaaagccugcuguucaagaccgaggacggcgugaacaugugcacccucauggcaauugaccugggggaguuaugcgaggacaccaucaccuacaagugcccgcuucugcgccagaacgagcccgaggacauugauuguuggugcaacagcaccagcaccugggugacguacgggaccugcacuaccacgggcgagcaucggcgcgagaagcgguccguugcgcuagugccccacgucgggaugggccucgagacccgcaccgagacuuggaugagcuccgagggcgccuggaagcacguccaaagaauagagacauggauccuacgccacccgggcuucaccaucauggccgcgauccuagccuacaccaucggaaccacccacuuccagcgggcccucaucuucauacugcuuacggccguagcgcccucgaugaccaugcgcugcaucggcaucuccaaucgcgacuucguggagggcgucagcgggggcagcuggguggacauagugcucgagcaugggagcugugucaccacgauggcuaagaacaagcccacucuagacuuugagcugaucaaaaccgaggcgaagcagcccgccaccuugcgcaaguauugcauugaggcuaagcugacaaacacaacgaccgaaucccgguguccgacgcagggcgagcccucacugaacgaggagcaagacaagcgauuccuaugcaagcacucgaugguggaccggggcuggggcaacgggugcgggcuguucggcaagggcggaaucgugacuugcgcgauguucacgugcaagaagaacauggaaggcaaagugguucagcccgagaauuuagaguacacgaucgugaucaccccccacagcggggaggaacacgccgucggcaacgacaccgggaagcacggaaaggagauaaagaucacuccgcagucgagcaucaccgaggccgagcucaccggauacgguacggugaccauggagugcagcccccgcaccggccuggauuucaacgagauggugcuguuacagauggaagacaaggccuggcugguccaccggcagugguuccuggaccucccucugcccuggcugccgggcgccgauacccagggcagcaacuggauccaaaaggagacacucguuaccuucaagaauccccacgcgaagaaacaggacguuguugugcuggguucccaggagggcgccaugcacaccgcccugacaggugccacggagauccagaugagcagugggaaccugcuguuuaccggccaccugaaaugccggcuccggauggacaagcuucagcugaaagggaugucguacagcaugugcaccggcaaguuuaaaaucgucaaggagauugccgagacccagcacgggacgaucgugauacgcgugcaguacgaaggcgacggcucccccugcaagauccccuucgagaucauggaccucgaaaagcggcacguccuggggcgccugauaacggugaauccaauagugaccgagaaggauagccccgucaacaucgaggcggagccgcccuucggcgacuccuacaucauaaucgguguggagccgggccagcucaaacugaacugguucaagaaagggaguucaauuggccagauguucgaaaccacgaugcguggggcgaagcggauggccauacugggggacaccgccugggacuucggcagccucggggggguguucaccuccaucgggaaggcgcugcaccaggucuuuggcgcuaucuacggcgccgccuucagcgguguguccuggaccaugaagauacugaucgggguaaucaucacauggauugggaugaacagccgaucuaccucgcugagcgucagccucguacuggugggcguaguuacccuguacuugggggccauggugcaggcagacuccgguugcgucgugucauggaagaacaaggaguuaaagugcggcucggggaucuucaucaccgacaacguacacacguggaccgagcaguacaaguuccagcccgagagccccagcaagcuggccucagcaauccagaaggcccacgaggagggcaucugugggauccggagcgugacuaggcucgagaaccugauguggaagcaagucacccccgagcugaaucacauccuauccgagaacgaggugaaguuaacgaucaugacuggcgacaucaaggggaucaugcaggccgggaagcgaagccugcgcccccagcccaccgagcucaaguacuccuggaagaccuggggcaaggcgaagaugcuuucaacggagagccacaaucagacuuuucugaucgacgggcccgagacagccgagugcccgaauaccaaccgggccuggaacagccucgaagucgaggacuacggcuucggcgucuucacgaccaauaucuggcugaaacugagagagaagcaggacgucuuuugcgauuccaagcucaugagcgcugcuaucaaggacaaccgggcgguacacgccgacaugggcuacuggaucgaguccgcucugaacgacaccuggaagauggagaaggccagcuucaucgaggugaaguccugccacuggcccaagucccauacccugugguccaauggcgugcucgagagcgagaugaucauaccuaagaacuucgccgggcccguaucccagcacaauuaccgcccaggcuaccauacccagaccgcgggccccuggcaucuugguaaacuugagauggacuucgacuucugcgaggggaccaccgugguggucaccgaggacugcggcaaucggggacccagucugcgcacuaccaccgccagcgggaagcugaucacggaguggugcugccgguccugcacgcugcccccuuuacgcuaccggggugaagacgggugcugguacggcauggagauccgcccacugaaggagaaggaggagaaccugguuaacagccucgucacagccgggcacggccaaaucgacaauuuuucgcugggcguccuggguauggcucuauuccucgaagagaugcugcggacccgcgugggcaccaagcaugcgauccuacuggucgccguuucauucgugacgcugaucaccgggaauauguccuuccgggaccuaggccgggugauggucauggugggggccacuaugaccgaugacaucgggaugggagugacguaccuggcccugcucgcagcguucaaggugcgcccuaccuucgccgccgggcugcuguugcggaagcuuaccagcaaggagcugaugauggccaccaucggcaucgcccuucugucucaguccacgauccccgagacuauccuggagcucaccgaugcgcuggcccuggggaugauggugcucaagaucgugcgcaacauggagaaguaccagcucgccgucaccaucauggccaucucaugcgucccuaacgccgugauccugcagaacgcguggaaggucggcugcacuauccucgcagccgugagcgucagcccccugcugcucaccagcucccagcagaaggccgacuggauaccucuggcgcuaacaaucaaagggcucaacccuacugccaucuucuugacgacauuaagcaggacguccaagaaacgcagcuggccgcucaacgaggccaucauggccgucgguauggugucuauacuggcgagcagucugcugaagaacgauauccccaugacuggcccgcuggucgccgggggccugcuaacggugugcuacguucugaccgggcggucagcagaccuggagcucgagcgcgccgccgacgucaagugggaagaccaggcugaaaucagcggcucuagccccauacugagcaucacaaucagcgaggacggcuccaugaguaucaaaaacgaggaggaggagcaaacccuuacgauucucauccggacggggcuguuggugaucagcggcguuuuuccagucagcaucccaaucaccgcggccgccugguaccuuugggaggugaagaagcagcgcgcaggggugcugugggauguccccagcccgccccccgugggcaaggcagagcuggaggacggggcguaccggaucaagcagcgcggcauacucggcuacagccagauaggggccggcguguauaaggaggggaccuuccacaccauguggcacgucacuagaggcgccgugcugaugcaucgcgggaaacgcaucgagcccucgugggccgacgugaagaaggaccugaucagcuacggaggcggcuggaagcuagagggcgaguggaaggagggcgaggagguucaggugcuggcccuggaacccggcaagaacccacgcgcggugcagaccaagcccggccuauucaagaccaacaccggaacgauuggcgccgucucccuggacuucagccccggaaccagcggcagccccaucguggaccggaaggggaaaguggucggccuguacgggaacgggguggugacacgcuccggagccuacgucagcgccaucgcgcagaccgaaaaguccauugaggacaacccugagaucgaggaugacaucuuccgcaagaagaggcucacgauuauggaccugcaccccggugcgggcaagaccaagcgguaucuacccgccaucgugcgggaggcuauaaagcggggccuacgcacccucauccuggccccgacccgcgugguggcggccgagauggaggaggcccuacgggguuuacccauccgcuaccagacucccgccauccgggccgagcauaccgggagagagauuguugacuugaugugccacgcgaccuuuaccaugaggcugcucucgcccgugcgcgucccgaacuacaaccugaucaucauggaugaggcccacuucacggaccccgccucuaucgcugcccgggguuacaucuccacacgcguggagaugggcgaggcggccggaauauucaugaccgccaccccgcccggcucgcgggacccguucccccagaguaacgccccuauaauggacgaggagcgcgagauccccgagcggucguggaacuccgggcaugagugggugacggauuucaaaggcaagaccgucugguucgugccguccaucaaggccggaaacgacaucgccgccugucugcggaagaacgggaaaaaggugauccaacucagucggaagaccuuugacagcgaguacgucaagacacgggccaacgacugggacuucguggugacgacagacauuuccgagaugggcgccaacuucaaggcggagcgggucauagacccccgccggugcaugaagcccgugauacugaccgacggggaggagcgcgugauccuggccggccccaugcccgucacccauagcagcgcggcccagagacgcgggcgcaucggccgcaaccccaagaacgagaacgaccaauauaucuauaugggcgagccccucgagaacgacgaggacugcgcccacuggaaagaggcgaaaaugcugcuggacaacaucaacacgcccgaaggcauuaucccgagcauguuugagccggagcgggagaagguggacgccaucgacggcgaguaccggcucagaggggaggcccggaagacuuucguggaccugaugcgccggggagaccugcccgucuggcucgccuaccgcguggcagcggaagggauuaacuacgcugaucggcgcuggugcuucgacggaauuaagaacaaccagauucuggaggagaacguggaggucgagaucuggaccaaggagggcgagagaaagaaacugaagccgcgauggcucgacgccaggaucuacuccgacccccuggccuuaaaggaauucaaggaguucgcggcugggcgcaagagccugaccuugaaccugaucacggagaugggccggcuucccaccuuuaugacccaaaaagcccgcgacgcccuggacaaccuggccgugcuccacaccgcggaggcugguggcaaagccuacaaccacgcccugucugagcugcccgagacgcucgagacguuauugcuccugacgcuauuggccaccgucacgggaggcaucuuucuguuccuaaugagcggcaagggcauaggcaagaugacccucgggauguguuguaucaucaccgcguccauccugcugugguacgcccagauccagccgcacuggauagccgccucuaucauccucgaguucuuccugaucgugcugcucauccccgagcccgagaaacagcggacgccucaggauaaccagcugaccuacgucguuaucgccauccuuacggugguggcggccaccauggccaaugagaugggcuuccucgagaaaacuaagaaggaccuuggccucggauccaucacaacgcaggagagcgagucgaacauacucgacaucgaccuacgcccggcauccgccuggacccuguacgcggucgccaccacauucguuacacccaugcuccggcacagcaucgagaacaguaguguaaacgucucguugaccgcuaucgccaaccaggccaccgugcugaugggccucgggaagggcuggccccugagcaaaauggacaucggggugccacuccucgccaucggcugcuacucccaagucaacccgaucacacugacggccgcacugcuccugcugguggcccacuaugcgaucaucggccccggcuuacaagcuaaggccacccgcgaggcgcagaagagggccgcggccggcaucaugaaaaaccccaccguggaugggaucacggucauagaccuggagcccaucccguaugaccccaaguucgagaaacagcugggccaggucaugcucuuaaucuugugcgugacgcagguccucaugaugcggaccaccugggcccugugcgaggcccugaccuuggccacggggccaaucucgacccuuugggagggcaaccccggacgcuucuggaauaccacaaucgcgguguccauggccaauaucuuccgggggagcuaucucgccggcgcugggcuuuuauucuccaucaugaagaacacgaccaacacccgccggggcaccggcaacaucggggaaacgcugggggagaaauggaagucccgccucaacgcgcugggcaaguccgaguuccagaucuacaagaaguccgggauacaggagguggacagaacccuggccaaggaagggaucaagcgcggcgagaccgaccaccacgccgucucccgcggcagugcgaagcuccgcugguucguggagcggaacauggugaccccggaggggaaggugguugaccuaggcugcgggaggggcggcugguccuacuacuguggcggccugaagaacgugcgggaggucaagggccucacgaaaggcgggcccggccacgaagagcccauccccaugagcacguacggauggaaccuggugcgccuacagaguggagucgaugucuucuucaccccgcccgagaagugcgacaccuugcugugcgacaucggcgaguccagcccaaaccccacaaucgaggccggaaggacccugcgcgugcucaaccugguagagaacuggcuaaauaacaacacccaauucuguaucaagguacucaacccguauaugcccuccgugaucgaaaagauggagacccugcagcggaaguacggcggggcgcuggugcgaaauccacugagccggaauucgacccacgagauguauugggucagcaacgccaccggcaacaucguguccagugucaacaugaucucucgcaugcucaucaaccgguucaccaugaaacauaagaaggccaccuacgaaccggacgucgaccuugggagcgguacccgcaacaucggcaucgaguccgaaaucccaaaucuggacaucauagguaagcgcaucgaaaagauuaagcaggagcacgagacgagcuggcacuaugaccaggaccacccuuauaagaccugggccuaccacggcuccuacgagaccaagcagaccgggagcgccuccucuaugguaaacggugugguccgccuccugaccaagcccugggacguggugccgauggucacccagauggcaaugaccgacaccacgcccuucggacagcagcggguauucaaggagaagguggacacccggacccaggaacccaaggaggggaccaagaagcugaugaagaucacagccgagugguuauggaaggagcugggcaagaagaaaacgccccguaugugcacccgggaggaguucacccgcaagguucguaguaaugccgccuuaggagccaucuucacggaugagaacaaguggaaguccgcgcgcgaggcagucgaggauagucgguucugggagcuuguugaccgcgagcggaaccugcaucuagagggcaagugcgagaccugcguuuacaauaugauggggaagcgcgagaaaaagcucggggaguucggcaaggccaaggggagcagagccaucugguacauguggcugggcgcgagauuccuggaguucgaggcccucggguuccugaacgaggaccacugguucagccgggggaacucacugagcgggguggagggugagggacuccaccgccugggguacauauuaaaggacgucuccaagaaggagggcggagccauguaugcggacgauaccgcaggcugggacacccggaucacgcucgaggaccugaagaaugaggagauggugaccaaccacaugaagggggagcacaagaagcuggcggaggccaucuucaagcucaccuaccagaacaaggugguccgcgugcagcggccaacgccucgcggcacggugauggauaucaucagccgucgcgaccagcgcggcuccgggcaagucggcaccuacgggcuaaacacauucaccaacauggaagcccagcugauccggcagauggaaggcgagggcaucuucaagaguauccaacaccucaccgugacagaggagaucgcuguacagaacugguuggcucgcgucgggcgggagcgccugucacggaugguuaucagcggagacgacugcguugucaagccccucgaugaccgcuucgcauccgcccugaccgcccugaacgacaugggcaaggugcggaaagauauccagcagugggagcccagccggggcuggaacgacuggacccaggugccguucugcucccaccacuuccacgagcucgucaugaaggacggccgggugcuggugguccccugccgcaaccaggacgaacugaucggcagagcacgcauaagccagggcgccgggugguccuugaaggagacugcaugucuuggcaagagcuacgcccagauguggaccuugauguacuuccaccggcgagaccuccggcuggccgccaacgccaucugcuccgcggugcccucgcacuggguucccaccucacgcacaaccuggagcauccacgccaagcacgaguggaugacgacggaagacaugcuggccguauggaaccggguguggauccaggaaaauccguggauggaagacaagaccccuguugagagcugggaggagguacccuaccucgggaagcgcgaggaccaguggugcggcagccugauagggcucaccaguagggccacaugggcgaagaacauccagaccgccaucaaccaggugcgcucgcucaucggcaacgaggaguauaccgacuauaugcccagcaugaagcgcuuccggcgcgaggaggaggaggccggcgugcuaugguga

SEQ ID NO: 25181 - RNA, 9876 nt, Artificial Sequence
  derived and/or modified CDS sequence (opt11) from DENV-2__EU482571__SS-prME
acagcgggaguuauaaucaugcuaauaccgacagcaauggcauuccaccucacaacgcgcaacggcgaaccccacaugaucguagggcgacaagaaaaagggaaaucccuacucuucaaaacggaagauggaguaaauaugugcacacucauggcuauugaucucggcgaacuuugcgaagacacuauaacauacaaauguccccuccugcgacaaaacgaacccgaagacaucgauuguuggugcaacagcacaaguaccugggugacuuacggaacuugcacgacaaccggcgaacauagaagagaaaaacggaguguggcccuaguaccgcacgucgggaugggauuagaaacacgaaccgaaacguggaugucaagcgaaggcgcauggaaacauguucagagaaucgaaaccuggauccuacgccauccggguuuuacaauaauggcugcgauucucgccuauacgaucggcaccacccacuuccagcgagcccuaaucuucauacuacuuacagcugucgcaccgagcaugacuaugagaugcauagggauaucuaacagggacuucguagagggcgugaguggcggaaguuggguagauaucguauuggagcacgggucuugcgucacuacgauggcaaagaacaagccaacgcucgauuucgaacucaucaagacggaagcuaagcaaccagcgacucuuagaaaguacugcauagaagcaaagcugaccaauacgaccacagaaagcagaugccccacacaaggcgagccaagucucaaugaggagcaggacaaacgcuuucucuguaagcacucgauggucgacaggggcugggguaacgguuguggacuuuucggaaaaggugggaucgugacaugcgcaauguuuaccugcaaaaagaauauggaagguaaagucguauuaccagaaaaucuugaauacacaauuguaauaacaccgcauaguggugaggagcacgccguagggaacgauacuggcaagcacggaaaggagauaaagauuacaccccaaaguagcauaacggaagccgaacuaaccggauacgggacaguaacaauggagugcagcccacggaccggucucgacuucaaugaaaugguccuacugcagauggaagacaaggcauggcuagugcacaggcagugguuuuuagaccuuccauuaccauggcucccaggagcagacacccaaggaagcaacuggauacaaaaagaaacccuugucaccuucaaaaauccacacgcgaagaaacaagacguugugguacucgggucgcaagagggcgcaaugcacaccgccuuaacaggagccaccgagauacaaaugaguucagggaaccugcuauucacgggacaccuaaaaugccgcuugcgcauggauaaacuucaacugaaagggaugagcuacagcaugugcacaggaaaauucaagaucgugaaagaaaucgccgaaacgcaacacgggacaaucgucauacggguccaauaugaaggcgacgggaguccaugcaaaauacccuuugagaucauggaccuagaaaagcggcauguucucgggcgucuaauaacggucaacccaaucgugacggaaaaagauuccccuguaaacauugaggccgagcccccauuuggugacagcuauauaaucauuggggucgaaccuggccagcuaaagcuaaauugguucaagaaaggcagcucuauugggcaaauguuugaaacgaccaugcggggugcgaagcggauggcgauccuaggugacaccgcaugggacuucgggucccucggagggguauucacgucuauuggcaaggcucugcaccaagucuucggggcgaucuacggggcggcauucagcggaguaucuuggacaaugaagauacuaauaggaguaauaauaacguggaucggcaugaacagccgaucaacaucauuaagcgucagccuaguacugguaggaguggugacucuauaccuaggggcaauggugcaggccgauucaggaugcgugguuucguggaagaauaaggaacucaaaugugggagugguauuuucaucacagacaacgugcacaccuggaccgaacaguacaaguuccaacccgaauccccuaguaagcucgccucagcaauccaaaaagcccaugaagaagguauaugcggaaucagaagugucacccguuuggaaaaccuaauguggaaacagauaacccccgagcucaaccacauucucagugagaacgaagucaaacuaaccauaaugacaggggauaucaaaggaauaaugcaagccggaaaacgaucacucagaccgcagccgaccgagcugaaguauucauggaagacuugggguaaagcgaagaugcuaucgaccgaaucccauaaccaaaccuuccucauagacggcccggagaccgcagaaugucccaacacgaaucgcgcuuggaacucccuggaaguggaagacuacggcuucgguguauucaccacaaacaucuggcugaaacuucgagaaaagcaggauguauuuugugacuccaaauuaaugagugcggcuauaaaagacaacagagcuguacacgcagacaugggcuacuggaucgaaagcgcccucaacgauacguggaaaauggaaaaggcuagcuucauagaggucaaaaguugccauuggccaaagucacacacucucuggaguaacggcguccuagagagugagaugauaauacccaaaaacuucgcuggucccguaucgcagcauaauuaccgccccggcuaucacacccaaaccgcaggccccuggcaucuaggaaagcucgaaauggacuucgauuucugugagggaaccacaguugucguaacggaagacugcggcaacagagggcccagccucaggacaacaacugcguccggcaagcuaaucacagaauggugcugccgcagcuguacgcuuccgccccuccgauacaggggcgaagaugguugcugguacggaauggagauacgaccucucaaggagaaggaagaaaacuuagugaacagccucguaacugccgggcacggacagauagacaacuucucacucggagugcugggaauggcgcuauucuuagaagaaaugcuccgaacucgcgugggcacaaagcacgcaauccuccuaguagccguaucauuuguaacgcuaaucacagggaauauguccuuccgggacuuggguagagucauggucaugguaggcgcuacaaugaccgaugacaucggcaugggcguaacuuaccuagcacuacuggcagcauuuaaaguaagaccaacguuugcagccgggcuccuucuccgaaaacuaacaucgaaggagcucaugauggcgacaauaggcauugcacucuugucacaaaguacgauuccugaaacgaucuuagaacugacagacgcccuggccuugggcaugaugguucuaaaaaucguccguaacauggaaaaguaccaacuagcaguaacaauaauggcaauaagcugcguaccgaaugcaguuauacuccagaaugcauggaagguuucgugcacgauccuugccgccgucuccgugagcccacuucuccucacuagcucacagcagaaagcggacuggauaccauuagcccucacgauaaagggccugaacccuacggcaauauuccucacgacccuguccagaacgagcaagaagcgaagcuggccacuuaacgaagcaauaauggccguuggaaugguguccauacuggccucgucacugcugaagaacgauauaccaaugacugguccgcucguggcaggcggauuacuuaccguaugcuacguacucacgggccgcagcgcugaccucgaguuagagcgagcagcggacguuaagugggaagaccaagcggaaauaucugguaguuccccaauccuaucaaucaccauuucggaggauggaucaauguccaucaaaaacgaggaagaggaacaaacacucacgauacuaauucgcacuggucuacucguaauaagcggaguguucccagucaguauucccauaacugcggccgcgugguaccucugggaagugaaaaagcagcgcgcuggaguauuaugggacguaccaagcccaccacccguaggaaaggcagaacuagaggacggcgcguaccguauaaaacaacgcggaauacucggcuauagccagauaggagcagggguauauaaagagggcacguuucauaccauguggcacguuacucguggcgccguacugaugcauaggggaaagcgcaucgaaccgucaugggcggacguaaagaaggaccuaauaaguuacggaggagguuggaaacucgagggagaguggaaggaaggugaagaaguacagguccuagcacucgagccagggaaaaauccccgagcaguacagaccaaacccggcuuguucaaaacuaauaccggaacuaucggagcaguaagccuagacuucagcccgggaacaucugguagccccaucguggaccgcaaggguaagguaguaggccucuauggcaacggaguggucacacgaagcggggccuacgugucggccaucgcccaaacagaaaagucuaucgaagauaacccggaaaucgaagaugacauauuccgcaagaagcgccuaacaaucauggacuuacacccgggagcaggcaagacaaagagauauuuaccagccauagugcgagaggccauaaaacgcggacuccguacacuaauacuagcgccaacgcgcgugguggcugccgaaauggaggaagcccuacgcggacugcccauccgauaccagacaccggccauacgagcugagcacaccgguagggagauaguggaccuaaugugucaugcgaccuuuacgaugaggcuucuaucacccgucaggguuccuaacuauaaucuaauaauaauggacgaggcgcacuucacagacccggcuaguauagcggcuagagguuacaucucaacgagaguagaaaugggagaggcggcgggaaucuuuaugaccgccaccccaccaggcagucgggaucccuuuccccaaucaaacgccccuaucauggacgaagagagagaaaucccagaaagaagcuggaacuccgggcacgaaugggugacggacuuuaaggggaagaccguuugguucgucccaagcauuaaggcuggaaacgacaucgcggcgugccuccgcaaaaaugguaagaaaguaauccagcucucaaggaaaaccuuugacagcgaauacguuaagacucgagcaaacgacugggacuucguggucacgacugacaucagcgaaaugggcgccaacuucaaagcagaaagagugauugauccccgccgcugcaugaaaccuguaauccuaacggacggggaagagagaguuauucuagccggaccaaugcccguaacacacucuagcgccgcccaacguagaggccggauugggagaaaccccaaaaacgagaacgaccaguacauuuacaugggagaaccucucgagaaugaugaggauugugcgcacuggaaggaagccaaaaugcuacuugauaacaucaacacgccagaaggaaucauaccgucgauguucgaaccugaacgagaaaaggucgacgccauugacggcgaguaccgacuccguggggaagcuaggaagaccuuuguagaccuaaugcgucgaggcgaccuaccagucugguuagcuuacagaguagcagcagagggaaucaacuaugcagacagaagaugguguuucgauggaaucaaaaacaaucaaauccucgaagagaacguugaaguagaaaucuggacuaaagaaggugagcguaaaaagcugaaaccgcgguggcuggacgcaaggauuuacagcgauccccuggcacuuaaagaguucaaggaguucgcggccggcagaaagagucucacgcuuaaucugauaacugaaaugggcagacugccgacguuuaugacccaaaaagcccgagacgcgcuggauaacuuagcaguacuacacaccgccgaagccggugggcgggcauacaaucaugcgcucucagagcuacccgaaacccucgagacauugcuucuucuuacccuacuggcuacggucaccgguggcauauuucuguuccucaugagcgggaagggaaucggaaaaaugacucucggaaugugcugcauaauuacagcaucgauucuacuuugguacgcgcagauucagccgcacuggauagccgcgagcauaauucuugaauuuuuccugauaguguuacuaauuccggagcccgagaaacaacgcacgccacaagacaaccagcuaacguacguaguaauagccauucugacggugguagcagcuacgauggcaaaugagauggguuuucuagagaaaacgaagaaagaccuugggcuaggaaguaucacaacacaagaaagcgaaucaaacauccucgauaucgaccuacgcccagcgucugccuggacccucuaugcagucgccacaaccuucguuaccccgaugcucaggcacagcauagaaaacagcucugucaacgucucguuaaccgccaucgcaaaccaggccaccguacuaauggggcugggcaagggcuggccgcucuccaagauggauauaggagucccacuccuggcaauuggaugcuauagccaggucaacccuaucacccuuacagcggcccuacuacugcuaguggcacacuacgcgaucaucggccccgggcuccaagcgaaagcgacaagggaggcccaaaaacgugcagcggcaggcaucaugaaaaaucccacaguggaugggauuacaguuaucgaccuugaacccauaccguacgauccuaaguucgagaaacaacucgggcaagucaugcuacucaucuuaugcgugacacaaguacuaaugaugagaacgaccugggcgcuuugcgaagcacuaacucuggcuaccggccccaucagcacacuaugggagggaaauccuggaagguuuuggaacacgacgauugcaguaagcauggcaaauaucuuccgaggguccuaccuagcgggggcggggcugcuguucagcauuaugaagaacacgacaaacacacgaaggggaacuggaaacaucggugaaacguugggggaaaaauggaaauccaggcugaacgcguuaggcaaaucagaguuccaaauauacaagaaaagcggcauccaagaagucgauagaacacuagcaaaagagggcaucaaaagaggcgaaaccgaucaccacgcaguuucacgagguucugccaagcugcgaugguucguagagcgcaacaugguaacccccgaaggcaaggucguugaucuggguugcggcagaggaggauggagcuacuacuguggcggacucaagaacguccgagaagucaaaggucuaacaaaaggcgguccugggcacgaggaacccauaccuaugucgacauacgguuggaaccucguuagacuccaaucaggaguagauguguucuucacgcccccagaaaaaugcgacacccugcuaugcgauauuggcgagucaagccccaaucccaccauagaagcaggucgcacgcuccgcguacugaaccuggucgaaaacuggcucaacaacaauacucaguucugcauuaaagugcuaaacccuuauaugccaagcgucauagaaaagauggagacauugcaaaggaaauacggcggcgcacucguacgaaacccccugucccguaacucaacgcacgagauguauugggucaguaaugcgacagggaacauagugucaagcgucaauaugauaagccgaaugcuuaucaaccguuucacaaugaaacacaagaaggcgacguaugagccagaugucgaccuaggaagcgggacgcgaaauauaggaauagaaagcgagauacccaaucuagacaucauagguaaacgaauagagaagaucaaacaggaacacgagacaaguuggcacuaugaccaggaccauccguacaaaacgugggcauaucaugggaguuacgagacgaaacaaacaggauccgccaguucuauggugaauggcgucgugagguuacucacaaagccgugggacguaguucccaugguaacccagauggcgaugacugacaccacgccauucggccagcagcgggucuuuaaagagaagguugauaccaggacacaagaaccgaaggagggcacaaagaaguuaaugaaaauaaccgcggccuggcuuuggaaggaacucggaaagaagaagacaccaaggaugugcacccgggaagaguucaccagaaagguaagaagcaacgccgcacucggggcaaucuucacugaugaaaacaaguggaaaagcgcacgcgaagcaguugaggacucucgguucugggaacucaucgacagagagcgaaaccuacaccucgaaggcaaaugcgaaacauguguauacaacaugauggggaagcgggagaagaaauugggagaauuuggaaaagccaaaggaagccgagcaauuugguacauguggcuaggagcaagauuccuugaauuugaggcacucggauuccuaaacgaggaucacugguucagccgagggaacagucuaagcgguguagagggcgaaggccuucaucgacuaggauacauacuacgcgacguuagcaagaaagagggaggggccauguacgcagacgacaccgccggaugggauacaaggaucacccuagaagaccuuaaaaacgaagaaauggucaccaaucacaugaaaggcgaacacaagaaacucgcggaggccaucuuuaaauuaacuuaccaaaauaaagugguucgaguacagagacccacaccacgaggaaccgugauggacaucaucagccgccgcgaccaacgcgguucaggacaaguaggaaccuacggccucaauacauucaccaacauggaggcccaauuaauccgccagauggaaggagagggcaucuucaagucaauacaacaccugacaguaacagaagagaucgccgugcaaaauuggcuggcccgagugggccgagagagacugucgaggauggcgaucaguggugacgauugcguuguaaaaccacuagacgaccgcuucgccagcgcccugacggcacugaacgacaugggaaagguucgaaaggauauccaacaaugggaaccaagcaggggcuggaaugacuggacacaggugccguucuguagccaccauuuccacgagcucgugaugaaagacggccggguuuuaguggucccaugccggaaccaagacgaacuuauagggcgagcucgaauaagccagggagcgggguggucccugaaagagaccgcaugccucgggaaauccuacgcccagauguggacccuaauguauuuccacagaagagaccuccgccuugcggcaaacgcgauauguucggcaguaccuagccacuggguaccuaccucccguacaacguggagcauacacgcgaaacacgaauggaugacaacugaagacauguuagcagucuggaacagaguguggauacaagaaaacccguggauggaggacaagaccccagucgagucaugggaggaggugccauaccuaggcaagcgggaggaucaguggugcggcagcuuaauaggacuaaccucccgcgcaacuugggccaaaaacauccaaaccgcgauaaaccagguuaggucucuaauugguaaugaagaguauacagacuacaugccaucaaugaaaagauuccggcgagaggaggaggaagccggaguacuaugguaa

SEQ ID NO: 25182 - RNA, 9876 nt, Artificial Sequence
  derived and/or modified CDS sequence (opt11) from DENV-2__EU482572__SS-prME
acggcuggcguaaucaucaugcuuauuccaaccgcaauggcguuccaccucacaaccaggaacggggaaccccacaugaucguuggcaggcaggaaaaggguaaaucccugcuguucaagaccgaggacggcguaaacaugugcaccuugauggccaucgaccugggggagcugugugaggacaccaucacauacaagugcccccuccuccgccaaaacgagcccgaggacauagacugcuggugcaauagcaccagcacuugggucacguacgggacgugcaccaccacgggggaacaccggcgcgagaagcggagugucgcgcuggugccccacgugggaaugggguuggagacacguaccgagaccuggaugagcucagagggggccuggaagcacguccagcggaucgagacguggaucuuaagacacccaggauucaccauuauggccgcuaucuuagcguacacgaucgggacuacacacuuccagcgggccuuaaucuucauccugcugaccgcaguugcgcccucgaugaccaugcgcugcaucgguaucuccaaccgggacuucgucgagggcguaagcggcggguccuggguggauauagugcucgagcacggguccugcgucacgacgauggccaaaaacaagccaacgcuggauuucgagcugaucaagaccgaggccaagcaacccgccacacuccgcaaauacugcaucgaggcaaaguugacaaacacaacaacugagucgcggugcccgacgcagggcgagcccagccugaacgaagagcaggacaagagauucuuaugcaagcacuccauggucgaucggggcugggggaacggcugcgggcuguuuggcaagggcgggaucgugacuugcgcgauguucaccugcaagaagaacauggaagguaaggucgugcagcccgagaacuuggaguacaccaucgucaucacaccccacucaggggaagagcaugccgucgguaacgauaccgggaagcacggcaaagagauaaagaucaccccccaaucuuccaucacagaggccgagcugaccggguacggcacggugacaauggagugcuccccccggaccggucuggacuuuaacgagaugguacugcuccagauggaggacaaggccuggcugguccaccgccaaugguucuuggaucucccccuccccugguugccgggugcggacacccagggcucaaacuggauccagaaagagacgcucgugacuuucaaaaauccccacgcgaagaagcaggacguggucguccuggggucccaggaaggggcuaugcacacagcccugaccggagcaacggagauacaaaugagcagcggcaaccuacuguuuaccggucaccugaagugccgccuaagaauggacaagcugcaacugaaggggauguccuacagcauguguaccggcaaguucaagauagucaaggagaucgcugagacccagcacgggacaaucguuauacgcguccaguacgagggcgacggcucccccugcaagauccccuucgagaucauggaccucgagaagcgccacguccuggggcgccugauuaccgugaacccaaucgugaccgagaaggacagccccgugaacauugaggcggagccgcccuuuggcgacuccuacaucaucauagggguggagcccggccagcucaagcucaacugguucaaaaaggggagcuccaucggccagauguucgagaccacgaugagaggggccaagcggauggccauccuuggggacaccgccugggacuuuggcagccucgggggcguguucacgaguaucggcaaggcauugcaccaggucuuuggagcgauauauggcgccgccuuuuccgggguguccuggacaaugaagauacugaucgguguuaucaucacguggauaggcaugaacagccgcuccaccagucuguccgucagccuaguguuggugggcguaguuacccuguaccucggggccaugguccaggcggacuccggcugcgucgugagcuggaagaacaaggagcugaagugcggguccgggaucuucaucacagacaacgugcacacguggaccgaacaguacaaauuccagccggagagccccagcaagcuggccuccgccauccagaaagcccacgaagaggggaucugugguauccggucagucacccgccucgagaacuugauguggaagcaggucacuccggaacugaaccacauccucuccgagaacgaggugaagcugacgaucaugaccggcgacaucaaggggaucaugcaggccgggaagcggagccugagaccgcaacccacagagcuaaaguacuccuggaagaccuggggcaaggccaagaugcucuccacggagucccacaaccagaccuuccugaucgacggcccggaaaccgccgagugcccgaacacaaaccgagccuggaacagccucgaaguagaggauuacggcuucgguguuuucacgaccaacaucuggcugaagcuccgcgagaagcaggauguauucugcgacuccaaacuaaugucggccgccaucaaggacaaccgggcgguccacgccgacaugggguacuggaucgaauccgcccugaacgacaccuggaaaauggagaaggccucguucaucgagguuaagagcugccauuggcccaagagccauacccugugguccaacggcgugcucgagagcgagaugauaauccccaaaaacuucgcagggcccguuucccagcacaacuaccgcccgggcuaccauacgcaaacggcagggccauggcaucugggcaaacuggagauggacuucgacuucugcgaggggaccaccgucguggucaccggcgauugcggcaaccgggggcccagccuccgcacaacuaccgccagcggcaagcugauaaccgaguggugcugucgcuccugcacguuacccccgcuccgcuaucguggggaggacggcugcugguacgggauggagauccggcccuuaaaagaaaaggaggaaaaccuggugaacagcuuagugaccgccggccaugggcagaucgauaacuucucccuggggguccuaggcauggcccucuuccuggaggaaaugcuccggacccgcguuggcacuaagcacgcgauccuccuuguggccgucagcuucgugacguugaucaccggcaacaugucguuccgugaucucgggcgagugauggucauggugggcgcaacuaugacagacgacaucggcaugggggugaccuaccuggccuuguuggccgcguucaagguccgacccaccuucgcggccggccugcuccuccggaaauugaccucuaaggaacuuaugauggcuaccauagggaucgcccuccugucccagagcacaaucccugagacaauccuggagcucaccgaugcgcucgcccugggcaugauggugcuuaagaucguccggaauauggagaaguaccagcuggccgucaccaucauggccaucuccugcgugccgaacgcggugauucugcaaaacgcguggaaggucagcugcacuauccucgccgugguguccgugagcccuuuacugcucaccucaucgcaacagaaggccgacuggauaccauuggcccugaccaucaagggccucaaccccaccgcgaucuuccugacaacccugucccgcaccagcaaaaagcgcuccuggccgcucaacgaggcaaucauggccguggggauggucagcauccuggcaucaagccugcucaagaacgacaucccaaugaccggaccccugguggccgggggccuccucacugugugcuacguucugaccgggcggagugcagaccuggagcucgaacgcgcugccgacgugaaaugggaggaccaggccgagauuuccggcagcucccccauucugagcaucaccauauccgaagacgggagcauguccaucaagaacgaggaggaggagcaaacccugacgauccucauccggaccgggcuguuggugauuagcggcgucuucccggugaguauccccaucacugccgcagcaugguaccugugggagguaaaaaagcagcgcgccgggguccuaugggacguacccagcccgccgccggugggcaaggccgagcuggaggacggggcauaccgaaucaagcagcgcggcauccucggcuacucccagaucggagcgggcgucuacaaggaaggaaccuuccacaccauguggcacgugacgcggggggccgugcucaugcaccgcggaaagaggaucgagcccagcugggccgacguaaagaaggacuugaucuccuauggcgggggcuggaagcucgagggagaguggaaggaaggggaggaaguccagguacuggcccuggaaccgggcaagaauccccgcgcuguccagaccaagccuggccuguuuaagaccaauaccggaacgaucggcgcggucagccuggacuucucacccgggaccagcggaucucccaucguggaccggaaggguaaggucgugggccuuuacgggaacggaguagucacccgcagcggcgccuacguguccgccauagcacagacugagaagucuaucgaagacaacccggagaucgaggacgacaucuuccggaagaagcgcuugacgaucauggaccugcaucccggggcaggcaaaaccaagcgguaccuaccggccaucguucgcgaggcgaucaagcgggggcugcgcacccucauacuggccccgacucgcgucguggccgcggagauggaggaggccuugaggggcuugcccauccgcuaucagacgccagcaauacgggcagagcacacuggccgcgagaucguggaccugaugugucaugccacuuucacaaugcggcugcucagcccuguccgcgugccgaauuauaaucugaucaucauggacgaggcucacuucacggacccggccuccaucgccgccaggggguacaucagcacccgcguagagaugggcgaggccgcaggcauuuucaugaccgcuacgccgcccggcuccagggacccuuucccacaaagcaacgcccccaucauggacgaggagcgcgagauccccgagcggucuuggaacagcggacacgagugggucacggauuucaaggguaagaccgugugguucguaccguccaucaaggccggcaacgacaucgcggccugccugcggaagaacgggaagaaagucauacagcucagucggaagaccuucgacuccgaauaugugaagacccgcgcuaacgacugggauuucguggucacgaccgacaucagcgaaaugggcgccaacuucaaggccgagcgggugauugauccccgccggugcaugaagcccguaauccugaccgacggggaggagcgcgucauccuggcgggucccaugccggugacccacucgucagccgcccagcggcgcgggcgcaucggcagaaacccuaagaacgagaacgaccaguacaucuacaugggcgagcccuuggagaacgacgaggacugugcccacuggaaggaggccaaaaugcuccuagauaacauuaacacgcccgagggaaucaucccguccauguucgagccggaacgcgagaagguggacgcuaucgacggagaguaucggcuccguggggaggcccggaagaccuuugucgacuuaaugcgccggggcgaucugccgguguggcucgccuaucgcguggccgcugaggggauaaacuacgcggaccggagauggugcuucgacggcauaaaaaacaaucagauccuggaggagaacguggagguggagaucuggacaaaagagggcgaacguaagaagcugaagccgcguuggcucgacgcccggauauacuccgacccgcuugcccugaaggaguucaaggaguuugcagcgggacgcaagucccucacccugaaccugaucacggagaugggccggcuccccaccuucaugacccagaaggcacgcgaugcccuggacaaccuggcaguccuccacaccgccgaagccggcggcaaggccuacaaccacgcccugucugagcugcccgagacgcucgagacucugcuguugcugacccuguuggccaccguuacgggcgggaucuuccuguuccugauguccgggaagggaaucggcaagaugacccuugggaugugcugcaucaucaccgccaguauccuccuaugguaugcgcaaauccagccgcacuggaucgcugccucaaucauccucgaguucuuccugaucguucugcuaauccccgaacccgagaagcagcggacuccgcaggacaaccagcugaccuacguugugaucgcgauccugacgguggucgccgcgacaauggccaacgagaugggguuccucgagaagacuaagaaggaccuagggcuggggagcaucacgacgcaggagagcgaaagcaacauucucgacaucgacuugcgcccggccagcgccuggacccuguacgccgucgcuacgaccuuuguuacgccaaugcuccggcacuccauagagaacagcuccgucaacgugagccugaccgcaauugccaaccaggccaccguguuaaugggcuuagggaagggauggccccuguccaagauggacaucggggucccccuucucgcgauuggaugcuacagccaggucaacccgaucacccugacggccgcccuacuccuguuaguagcccacuacgccaucaucggcccugggcuccaagcgaaggccacccgcgaggcccagaagcgggcugccgcgggcaucaugaagaaccccaccgucgacgggaucacagugaucgaccuggagcccaucccguacgauccgaaauucgagaaacagcugggccaggugaugcugcugaucuuaugugucacccaggugaugaugaugcgaaccaccugggcucuaugcgaggcccugacccuggccacggggcccauauccacccucugggagggaaaucccggccgcuuuuggaacacuaccauugccgugagcauggcgaacaucuuccgcggguccuaccuggccggagccgggcuccucuuuagcaucaugaaaaauacuaccaacacccgccggggcaccggcaacaucggcgagacguuaggcgagaaguggaagucccgccugaacgccuuaggaaagucagaguuccaaauuuacaaaaagagcgguauccaggagguagaccggacccuggcuaaggaagggaucaagcgcggcgagaccgaccaucacgccgugagccggggcagugcgaagcuucgcugguucgucgagcggaacauggugaccccggaagggaaggugguggaccucggcugugggcgcggcgguuggagcuacuacugcggugggcucaagaacguccgggaggugaagggguuaacgaagggcgggcccggccacgaggagccgauccccauguccaccuacggguggaaccucguucgccuccaaagcggagucgacguguucuucacccccccugagaaaugcgacaccuuguugugugacaucggcgaaagcucccccaaucccacgauugaagccggaaggacccugcgcgucuugaaccucgucgaaaauuggcuaaacaacaacacccaguucuguaucaaaguguuaaacccauacaugccgagcgugauagaaaaaauggagacccuccagcggaaguacggaggggccuuaguccgcaauccucugucccggaauagcacccaugagauguacugggugaguaaugcaacgggcaauaucguaagcucugugaauaugauaucccgcauguugauuaacagguuuaccaugaaacacaagaaggcuaccuacgagccggacguggaccucggguccggcacacgcaacaucggcaucgagagcgagauacccaaccucgacauuaucgggaagcgcaucgagaagaucaagcaggagcaugagacgaguuggcacuacgaucaggaucaucccuacaagaccugggccuaccacggcagcuacgaggcgaagcagacugggucugcguccuccauggugaacggggucgugcggcugcucacaaagcccugggacguggucccgauggugacgcagauggcgaugaccgauaccacucccuucgggcagcagcgcguguucaaagagaaagucgauacgcggacccaggagcccaaggaggggaccaagaaacugaugaagaucacggccgaguggcuauggaaggagcucgggaaaaagaagacgcccaggaugugcacccgggaggaguucacccgcaagguuagauccaacgcugcccugggcgcaauauucacggaugagaacaaguggaaaagcgcgcgcgaggcaguggaggacagccguuucugggagcuggucgaucgcgagcggaaccuccacuuagagggcaagugcgagacgugcguguacaauaugaugggcaagagggagaagaagcugggcgaguucggcaaggccaagggaucucgggccaucugguauauguggcucggcgccagguuucuggaguucgaggcccucggguuccucaacgaggaucacugguucagcagaggcaacagccuaaguggggucgagggcgagggccugcaccgcuuaggcuacauccucagagaugugagcaagaaagagggcggggccauguacgccgaugacacagccggcugggacacccguauuacccuggaggaccucaagaacgaggagauggugacgaaccacaugaaaggggagcacaagaaguuggcggaggccauuuucaaacucaccuaccagaacaagguggugagggugcagcgcccgacgccccggggcacagucauggacaucaucagucgccgcgaccagcggggcagcggccagguggggacguacgggcucaacacguucacaaacauggaggcccaacugauccgccaaauggaaggcgagggcauauucaagucaauccagcaccugaccgugacggaggagaucgccgugcagaacuggcucgcgcguguggggcgcgagcggcugucgcguaugguaaucuccggagacgacuguguugugaagcccuuggacgaucgcuucgcgagcgcccugaccgcccugaacgacaugggaaaggugcgcaaggacauccagcaaugggagccaaguagaggcuggaacgacuggacccaagucccguucugcagccaccacuuucaugaguugguaaugaaggauggccgcguucucgucgugcccugccggaaccaggacgaacugaucggcagggcccggaucucccaaggcgcugguuggucccuuaaagagaccgcgugccugggcaaguccuacgcccagauguggacguugauguauuuccaucgcagggaucugcgacuugccgccaacgcgaucuguagcgcggugccaucccacugggucccaaccagccggacgaccugguccauacacgccaaacacgaguggaugaccacggaagauaugcuggccguguggaaucgcguuuggauacaggagaacccguggauggaagacaagacccccgucgagagcugggaggaggugcccuaccuggguaagcgggaagaucaguggugcggcucccucaucgggcugaccucacgcgcgaccugggcgaagaacauacagacggccaucaaucaggugcgcaguuuaaucggcaaugaggaauacaccgacuauaugccgucaaugaagcgguuccgucgggaggaggaggaggccggcguccucugguag

SEQ ID NO: 25183 - RNA, 9876 nt, Artificial Sequence
  derived and/or modified CDS sequence (opt11) from DENV-2__EU482573__SS-prME
accgccggcgugauaauuaugcuuauccccaccgcuauggccuuccaccuuacaacgagaaacggggaaccccacaugaucgugggccgacaggaaaaagggaaaucgcugcuguucaaaaccgaagauggcgugaacaugugcacccucauggccaucgaccuuggggaacugugcgaggacacuaucaccuacaagugcccccuccugcgacagaacgagccagaggacauugacugcuggugcaacuccaccagcaccugggugaccuaugggaccugcacaaccacaggcgagcaccgucgcgagaagcggucgguggcgcuggucccccacguagggaugggauuagagacccgcacggagaccuggaugagcagcgagggcgccuggaagcacguccagcggaucgagacguggauccugcgacaccccggcuucaccauuauggcagccauccuggcuuacaccaucgguaccacgcacuuccagcgggcccucaucuucauacuucuaacagccguggcgccuuccaugacgaugcgcugcauuggaaucaguaaccgagacuucguggaaggcgucagcggggguucguggguggacaucgugcucgaacaugggucgugcgucaccaccauggccaaaaacaagcccacacuggacuucgagcuuaucaaaaccgaggccaagcagccggcgacccuccgcaaguacugcauagaggccaagcucacgaacacgacuaccgaaucccgaugcccgacgcagggagagcccagccuuaaugaggagcaggacaagcgcuuccucuguaagcacuccaugguggacaggggcugggggaauggcugcgggcuguuuggaaaaggcggaauuguuaccugcgcuauguucacgugcaagaaaaauauggaaggcaaggucgugcugcccgaaaaccucgaguacaccauugugaucacgccgcacagcggugaggaacacgccguugggaacgacacagggaagcacggcaaggaaauuaagauuacgccgcaguccaguaucaccgaggcugagcuuaccggguacgggacggugaccauggaguguucgcccagaacaggacuagacuucaacgagauggugcucuuacagauggaggacaaggccuggcucguacaucgacagugguucuuggaccugccccugccauggcugccgggagccgacacccagggcucaaacuggauccagaaagagacgcucgugacauuuaagaauccacacgccaagaaacaggacgugguuguguuagguucccaggaaggcgcgaugcacacggcccucaccggggcgacggagauccaaaugagcucuggcaaccugcuguucaccgggcauuugaagugccgccugcggauggauaaacuacagcucaaggggaugagcuacaguaugugcaccggcaaauucaagaucguaaaggagaucgccgagacccaacaugggacgaucgugauacgcgugcaguaugagggcgacggcuccccguguaagaucccguucgagauuauggaucuggagaagcggcacguccuggggcgccucaucaccgugaacccgaucguuacugaaaaagacagcccugucaacaucgaggcagaaccgcccuucggcgacaguuauauuaucaucggcguggagccgggccagcuuaaacuuaacugguucaagaaggggucuuccaucggccaaauguucgagaccacuaugcgcggggccaagcgcauggccauacucggggacacggcuugggacuuuggaucgcuuggcggcgucuucaccucgauugggaaggcccugcaccaagucuucggagcaaucuacggugccgccuuuuccggcguuuccuggaccaugaagauacugauaggcgugaucaucacguggaucgggaugaacagcagauccaccagucuguccgucagccuggugcugguuggcgucgugacauuauaccugggggccaugguccaggcggacaguggcugcguugucagcuggaagaauaaggagcucaagugcgguucaggcauuuucaucacggacaacgugcauacguggacugagcaguacaaguuccagcccgagagcccgucgaagcucgccucugccauucagaaagcccacgaggagggcaucugcgggauccguagcguuacccgacuggagaaucugauguggaaacagaucacccccgaacucaaucacauccugucagagaacgaggucaagcuaaccaucaugaccggagacaucaaggggaucaugcaagccggcaagaggagccugcgcccucagccuaccgaguuaaaguauuccuggaagaccuggggcaaggcgaaaauguugucuacggaaagccacaaucagaccuuccugaucgauggccccgagacagccgaaugcccgaacaccaaucgggccuggaacucucucgagguggaggacuacggcuucggggucuucacgaccaacauauggcugaagcuccgcgaaaagcaggacguuuucugcgauuccaagcucaugucggccgcaaucaaggacaaccgggcggugcacgcugacaugggcuacuggaucgaguccgcccugaacgacacauggaaaauggagaaggcuagcuucaucgaaguaaaguccugccauuggcccaagagccacacccuguggaguaacggcgugcuugagagcgagaugaucauucccaagaacuuugccgggcccguaagucagcacaacuaccgcccgggguaucacacccagacugcugguccauggcaccucggcaaacucgagauggacuucgacuuuugugagggaacaaccguugucgugaccgaggacugcggcaaccgcggacccagccugcguacgacaaccgcuuccgggaagcucauuacagaguggugcugccgguccuguacccugccaccccugcgcuaccggggcgaggacggguguugguacgguauggagauccgcccccugaaggagaaggaggaaaaucuaguuaacagccugguaacugccgggcacggccagaucgauaauuucucccugggcgugcucgggauggcccuguuccuggaagaaaugcuccggacacgcguaggcacgaagcacgccauucuccugguugcaguuucauucgucacacucaucacagggaauaugucauuccgugaccuuggccgcgugauggugauggucggggccacuaugaccgacgacauuggcaugggcguuacguauuuagccuuacuggccgcguucaaggugcgacccaccuucgccgccggguugcuccuacggaaacuuacaagcaaagaacucaugauggcaacaaucggcaucgcccuccugucccagucaacgauucccgagacaauccucgagcuaacugacgcccuggcccucggaaugaugguacugaagaucgugagaaacauggagaaguaccagcuugccgugaccaucauggccauaagcugugucccaaacgccgugauccugcagaaugccuggaaggugagcugcacgauucuggcggccgucuccguuucaccgcugcuccugacauccagccagcagaaggcugacuggaucccgcuggcgcucaccaucaagggccuuaauccaaccgccauauuccugacgacccuauccagaaccagcaagaagcgguccuggccguugaacgaggccaucauggccgugggcauggugucgauccuggcauccagccuccugaaaaacgacauccccaugaccggaccccugguugcgggcggguugcucaccgucugcuacgugcugaccggccgcucggccgaccucgagcuggagcgcgccgccgaugucaagugggaagaucaagcggagauuuccgggucaucucccauccugagcaucaccauauccgaagacggcucgaugucuaucaaaaacgaagaagaggaacaaacucucacgauucugauccggacggggcugcuggucauuagcgggguguucccggugucgauccccaucaccgcggccgccugguaccugugggaagucaagaagcagcgggccggcguucugugggacguacccagcccuccacccgucgggaaagccgagcuugaggauggcgcguaccguaucaagcaaagagggauccugggcuacucccagaucggcgcaggggucuauaaggaaggcacuuuccacaccauguggcauguaacccgcggggccguccuaaugcaccgcggcaagaggaucgagcccaguugggccgacgugaagaaggaccucaucagcuacgggggcggcuggaaacuggaaggugaguggaaggagggcgaggaggugcagguccuagcccucgagcccggcaagaacccccgcgcgguacaaaccaagccgggccuguucaagaccaacacggggacuaucggugccgugagcuuggacuuuucucccgggaccagugggucccccauuguggaccggaagggcaagguugucgggcucuauggcaacggggucgugacucgcagcggggcuuacgucagcgccaucgcgcagacugagaaauccauugaagacaaccccgagaucgaagacgacaucuuccgaaagaagcgccugacgaucauggacuugcaccccggagccggaaagacgaagcgguaucugccugcaaucguucgcgaggccauaaagcggggccucaggacccuaauacuggccccgacgcgcgugguggcggccgagauggaggaggcacuuaggggacugcccauccgcuaccaaacuccugcuauucgcgcugagcacaccggccgcgaaaucgucgaccugaugugucaugcgacauucacgaugagacuccuaucaccgguucgcgucccaaacuacaaccugaucaucauggaugaagcccauuucacggaccccgccuccaucgccgcucggggcuauaucuccacccgcguugagaugggggaagcggccgguauuuucaugacugcgacgccacccgggucccgcgauccguucccgcagagcaacgcacccauaauggaugaggagagggagauacccgagcgauccuggaacagcgggcaugagugggugacggacuucaaggggaagacuguaugguucgucccgucuaucaaagcggguaacgacaucgccgccugccuccgcaaaaaugguaagaaagugauacagcugagcaggaaaaccuuugacuccgaauaugugaagacucgcgcaaacgacugggacuucgucgugacgaccgauauuuccgaaaugggggccaacuucaaagcggaacgagugauagacccccgcagaugcaugaagcccgucauccucaccgacggugaggaacgcguaauucuugccgggcccaugccggucacccauuccuccgcggcacaaagacgcggccgcaucggccguaacccuaagaacgagaaugaccaguacaucuacaugggagagccgcuggagaacgaugaggacugcgcccacuggaaggaagccaagaugcuguuggacaacauaaacacgcccgaggguauaaucccuuccauguuugagccagaacgcgagaaggucgaugccaucgacggggaguaccggcugcguggcgaggccaggaagaccuucguggaucuuaugcgccgcggugaccuccccguauggcuggccuaccguguugccgcggagggcaucaacuaugcagaccggcgcuggugcuuugacgggaucaagaacaaccaaauccuggaggagaacguggagguggaaauauggaccaaggagggugagcggaaaaagcucaagccacgcuggcuggacgcccggaucuacagcgacccucuggcccuuaaggaguucaaagaguucgcggccggccgaaagucgcugacccugaaucucauuacggagauggggcggcugcccaccuucaugacccagaaagcccgcgacgcucuugacaacuuagcgguccugcauaccgcggaggccggcgggcgggccuacaaccacgcucucagcgaacucccagagacgcuggagacccuccuccugcugacguuauuggcuaccguaacgggcggcaucuuccuguuccucauguccggcaaaggcaucgggaaaaugacccugggaaugugcuguaucaucacugcgagcaucuugcucugguacgcgcagauacaaccgcacuggaucgccgccuccaucauccuggaguucuuccugauagugcuacugauccccgagccugagaagcaacgaacuccccaggacaaucagcugaccuacgucguaaucgccauucucacggucguggcggccacuauggccaacgaaaugggguuucuggagaagaccaagaaggaccugggcuuaggcucgaucaccacgcaagagucagaaucgaacauuuuagauaucgaucugcggccggccagcgccuggacucucuacgcgguggcaaccaccuucgucacgccaaugcugcgccacuccaucgaaaauucuuccguuaacgugagcuugaccgcuaucgccaaccaagcuacgguccucauggggcugggcaagggauggccacugucaaaaauggacauuggggugccccuacuggccaucgggugcuacagccagguaaacccgauaaccuugacggcagccuuacuucugcucguggcccacuacgcgaucaucgguccgggccugcaggccaaggccacaagagaggcccagaagcgcgccgcggccgggaucaugaagaaucccacaguggauggcaucaccguaaucgaccuggagccaauucccuacgaucccaaguuugagaagcaauugggacaagugaugcuacugauccucugcgugacccagguacuaaugaugcgaaccacgugggccuuaugcgaggcccuaacccuggccacaggacccaucuccacccugugggagggcaacccuggucgguucuggaacacaaccauugccguaaguauggccaacaucuuccgaggauccuaucuagcuggggcgggccuauuguucagcaucaugaaaaauacgaccaauacucgccgcgggaccggcaacauaggggaaacguugggcgagaaguggaagucccgcuuaaaugcgcugggaaagucagaguuccagaucuacaagaaauccggcauccaggaggucgaucguacccucgcuaaggaaggaaucaaacgcggugagacagaccaccaugcggugucacgcggauccgccaagcugcggugguucgucgaaaggaauauggugaccccugaagggaaggugguggaccuggggugcggccgcggggguuggagcuacuacugugggggccucaagaacguucgcgaaguaaagggcuuaaccaagggcggccccggucacgaggagcccaucccgaugucgaccuacggcuggaaucugguccggcuccaguccgguguggacguguucuucaccccgcccgagaagugcgacaccuuacuuugugacaucggcgagagcaguccgaaucccacgaucgaagccggccgcacccuccggguccugaaccugguggagaacuggcucaacaacaacacccaguucugcauuaaggugcuaaacccguacaugcccagcgucauugagaagauggagacccuucaacgcaaguacggaggggcucugguucggaauccgcuuagucgcaacaguacccacgagauguacuggguaaguaacgcuacggggaacaucguaucauccgugaauaugauaagcagaaugcuuaucaaccgcuucaccaugaagcacaagaaggccacuuacgagccagacgucgaccucggcuccggcacacgcaacaucggcaucgaaagcgaaauccccaaccucgacaucaucggcaagcggauagagaaaaucaaacaagaacacgagacguccuggcacuacgaccaggaccaucccuacaagacuugggccuaccaugguagcuacgagaccaagcaaacaggcucagcgagcagcauggucaacggagugguucgccuauugacgaagccuugggacgucgucccgauggucacccagauggccaugaccgacaccacgcccuuugggcagcagcguguuuucaaggagaaagucgauacacgcacccaggagcccaaggagggaaccaagaaguugaugaaaaucacggcggagugguuguggaaggaacuagggaagaagaaaacuccccgcaugugcacccgagaggaguuuacucgaaagguucgcuccaacgcugccuugggcgccaucuucacggaugagaacaaauggaaguccgcgcgugaagccgucgaggacagccgcuucugggagcuuauugacagagagcgcaaccugcaucucgaggguaaaugugagacguguguguauaacaugauggggaagagggagaagaaacucggggaauuugguaaggcgaaaggcagcagggccaucugguauauguggcugggggcgcgguuucucgaguuugaagcccugggauuucuaaaugaggaccacugguucucacgugggaauagcuuguccggcguggagggugagggccuucaccgccugggguacauccuccgcgauguaaguaagaaggagggcggcgccauguaugcagaugacaccgccgggugggacaccagaauaacgcuggaggaccugaagaacgaagaaaugguuaccaaccauaugaaaggugagcacaagaagcucgcggaggccauauucaagcuaacauaucaaaauaaagucguucgcgugcaacggccuacgccgcgcgggaccgugauggacaucauaucccgccgggaccagcguggcucaggccagguugggacauauggccugaacacuuuuacaaacauggaggcccaacucauucggcaaauggagggggagggcaucuucaaauccauccagcaucugacugugaccgaggagaucgccguccaaaacuggcuggcuagggugggccgggagaggcucagccggauggcgaucuccggggacgacuguguagucaagccccuggacgaccgcuuugcuucagcccugaccgcucucaacgauaugggcaaggugcgaaaagacauccagcagugggagcccucccgaggauggaacgacuggacgcagguucccuuuuguucacaccacuuucacgagcuggucaugaaggacggccggguccuggugguccccugccgcaaccaggacgaacucauaggcagagcccgcaucucacagggugccggcuggucucucaaggagacagccugccuugggaagaguuacgcccagauguggacccucauguauuuucaccggcgcgaccugcggcuggcagcuaacgcgaucuguagcgccguucccucccacugggugccuacgucgcggaccacgugguccauccacgccaagcacgaguggaugacuaccgaggacaugcucgcuguauggaacagagucuggauacaagagaacccguggauggaggacaagaccccgguugagagcugggaggagguucccuacuugggcaagcgcgaggaucaguggugcgggagccugaucggccucaccucccgcgcgacaugggcgaagaacauucagaccgcuaucaaucaaguacggucucugaucggcaacgaggaguacaccgauuacaugcccuccaugaagagauuucggcgcgaggaggaggaagcgggagucuugugguaa

SEQ ID NO: 25184 - RNA, 9876 nt, Artificial Sequence
  derived and/or modified CDS sequence (opt11) from DENV-2__EU482574__SS-prME
accgccggcgugauuaucaugcugauuccgaccgccauggcguuucaucucaccaccaggaacggcgaaccgcacaugaucgucgggcggcaggagaaaggcaagucccugcuguucaagacugaagauggcgucaacaugugcaccuugauggcuauugaccugggggagcugugcgaagacaccaucaccuauaagugcccccuauuaaggcagaacgagccagaggacauugacugcugguguaacagcaccucuacgugggugaccuacggcaccugcaccacaacuggcgagcaucggagggaaaaacggagugucgcccuggugccccacgugggcaugggucucgagacccgcaccgagacuuggaugagcagcgagggggccuggaagcauguccaacggauugaaacguggaucuugcggcacccgggcuucaccaucauggccgcgauccuugccuacaccaucgggaccacgcacuuccaacgggcccuuauuuucauccugcugacugccguggcuccgagcaugaccaugcgaugcaucggcauuuccaaccgggacuucguugagggagugagcgggggcuccuggguggacauaguacuggagcacgggucgugcgucaccacgauggccaagaacaaacccacuuuagacuucgagcuaaucaagaccgaggcuaagcaacccgccacccugagaaaauacugcauugaggccaagcugacgaauaccaccacugagucccggugcccaacucagggugagccaagucucaacgaggagcaggacaagcgcuuccucuguaagcacuccaugguggaccgugguugggggaacgggugcgggcuguucgggaaaggggggauugugaccugcgccauguucacgugcaagaaaaauauggaggggaaagucguguuaccugaaaaucucgaguacaccaucguuaucacgccacauagcggcgaggagcacgccgucggcaacgacaccggcaagcacgguaaggagaucaagaucaccccgcaaagcagcaucaccgaggcggaacugacgggguacggcacggucaccauggagugcagcccccggaccggacuggacuucaaugagauggugcuccugcacauggaggacaaagcauggcugguccaccgccagugguucuuagaccugccccugccauggcugccgggggccgacacucagggaucaaauuggauccagaaggagacccuggugaccuucaagaacccccaugcgaagaagcaggauguagucguacuggggagucaggagggcgccaugcacacggcccucacgggugccacugagauccagaugagcagcggcaaccugcuguuuacuggccacuuaaaaugucggcugcggauggauaagcugcagcucaaggggauguccuacagcaugugcaccggaaaguuuaagauugucaaggagaucgccgaaacacagcacgggacgaucgugauccgcgugcaguaugagggagacggcucccccuguaagauccccuucgagauuauggaccuggagaagcggcauguguuagggcgccucaucaccgugaacccaaucgugaccgagaaggacagccccgucaacauagaggcggagccgcccuucggcgauuccuacaucaucaucgggguggagccgggccaacugaagcugaacugguucaaaaaggggagcuccaucggucaaauguucgagaccacgaugcgcggggcaaagaggauggccauacuuggagacacagcgugggauuucggcagccucggcgggguguucacauccaucgggaaggcacugcaccaggucuucggggcgaucuacggcgcagccuucagcggagugagcuggaccaugaagauccugaucggcgugauuauuacguggaucgggaugaacagccguucaaccagccuguccgucagccuggugcuggugggcgucgugacccuuuaccugggagccauggugcaggcggauaguggcugugucgucagcuggaaaaacaaggagcugaagugcggcuccgguaucuucaucacugacaacguacacacguggaccgagcaguacaaguuccaacccgagagccccagcaagcucgcuuccgcaauucaaaaagcccacgaggaaggcaucuguggaauccggagcgucacccgccuggagaauuugauguggaagcaaaucacccccgagcucaaccacauccugucagaaaacgaggugaagcugaccaucaugaccggggacaucaaggggaucaugcaagccggcaagcggagccuccgcccgcagcccaccgaguuaaaauacuccuggaagacguggggcaaggccaagaugcugaguacagagucccacaaccagaccuucuuaaucgacgggcccgagaccgcugaguguccgaacaccaaccgggcuuggaacagccuagaaguggaggauuacggcuucggggucuucacgacgaacaucuggcugaagcugcgcgagaagcaggauguguucugcgacuccaagcuaaugagcgccgccaucaaggauaaucgugcggugcacgccgacaugggcuacuggaucgaaucggcccugaacgauacguggaagauggagaaggccagcuucaucgaggucaaguccugccacuggccuaagagccacacccuaugguccaacggcgugcuggagagcgagaugaucauacccaagaacuucgccgggcccgugucccaacacaacuaccgcccgggcuaccacacacagaccgcagggccauggcaccuggguaagcuagagauggacuuugauuucugugagggaaccacugucguugugacagaggacugcggaaaccggggcccaagccugcgcacgacaaccgccagcgggaagcugaucacggaauggugcugccgguccuguacgcucccgccacugagguaccggggcgaagacgggugcugguacggcauggagauccgcccacugaaggagaaggaggagaaccucguaaacucgcuggugacagccgggcacggacaaaucgacaauuucuccuugggcgugcucgggauggccuuauuccuggaggaaaugcuacggacccgggugggcacaaagcacgcgauucugcuuguggccgugagcuucgucacccucauuacggggaacaugagcuuccgggaccugggccgcgucauggugauggucggggccaccaugaccgacgacaucggcaugggcguuacuuaucuggcccugcuggccgcguucaaagugagacccacuuucgccgccggacugcuccugcggaaauuaacuagcaaggagcucaugauggccacgaucggcaucgcgcuacuuucgcagagcacgaucccagagaccauccucgagcugacggacgcacuugcccuagggaugaugguccucaagaucgugcgaaacauggagaaguaccagcuggcugugaccaucauggccaucuccugcguccccaacgccguaauccuccaaaaugcguggaaggugucaugcacgauccuggcggccgucuccgugucuccccuucuccugaccuccucgcagcagaaagccgacuggaucccccuggcgcucaccaucaagggccuuaacccuaccgcuaucuuccugaccacccucuccagaacuagcaagaagcgcuccuggccgcugaacgaggcgaucauggccgugggcaugguaaguauccuagccuccagccuucuaaagaacgacaucccgaugaccgggccacugguggcaggcgggcuccugacggugugcuacgugcugacuggcaggagcgccgaccuugaacuggagcgcgccgcugacgugaagugggaggaccaggccgagauuuccgggagcucacccauccuguccauuaccauuagcgaagacggcagcaugagcaucaagaacgaagaggaggagcagacccugacgauccugauccggaccggcuuguuagucauaagcggggucuucccgguguccauccccaucaccgcggccgccugguaccugugggaagucaagaagcagcgggcuggcgugcugugggacguucccuccccgccgcccgucgggaaggccgagcucgaagacggcgcguaucggauaaagcagcguggcauccugggcuauucccagaucggggccgggguuuauaaagaagggaccuuccacaccauguggcacguuacgcgcggggccgucuuaaugcaccgcggcaagcggaucgagcccagcugggccgacguuaaaaaagaccugaucuccuacgggggcggcuggaagcuggagggggaguggaaggagggcgaggagguccaaguccuggcucucgagcccgggaagaauccccgcgcggugcagaccaagccggggcuguucaagaccaacaccgguacgaucggcgccguaucacuggacuuuucccccggcaccagcgggucccccaucguggaccggaagggcaagguuguggggcucuacggaaacggcgucgugacccgcaguggagccuauguguccgccaucgcgcagaccgagaaguccaucgaagacaaccccgagauugaggacgacaucuuccggaagaagcgccugacgaucauggaccugcaccccggcgccgggaagaccaaacgcuaccugcccgcgaucguucgcgaggccaucaagcgaggccugcguacccuuauccuggcaccgacccgcgugguggcagccgagauggaggaggccuuacgagggcuucccauccgauaucagacgcccgccauucgggccgaacacaccggacgcgagaucgucgaccugaugugccaugcuaccuucacgaugcggcuccugagccccgugcgcgugccgaacuacaaucugaucaucauggacgaagcccauuucacggaccccgcguccaucgcugcccgaggcuacaucagcacccgcgucgagaugggggaggcggccggcaucuucaugacugcgacgccgcccggaucacgggacccauuuccccaaagcaacgcccccauaauggacgaggaacgcgagauccccgagcgguccuggaacagcggccaugaaugggugacggacuucaaggggaagaccgugugguuugucccaaguaucaaggcgggcaacgacaucgccgccugucuacgcaagaacggcaaaaaggugauccagcucucacggaagacguucgauagugaguacgugaagacccgggcuaacgacugggacuucguagugacgaccgacaucagcgagaugggggccaacuucaaggccgagagggucaucgaccccagacggugcaugaagcccgucauccugacugacggcgaggagcgcgugauacucgcugggcccaugccggugacccacuccagcgccgcucagcgcagaggccgcaucgggcggaaucccaagaacgagaacgaccaguacaucuacaugggcgagccccuugagaaugacgaggacugcgcacacuggaaagaagcuaagaugcuccuugauaacaucaacacacccgagggcaucauuccgucuauguuugagccggaaagggaaaaggucgacgccaucgacggggaguaccgacugcgcggugaggcucggaagacauucguggaccugaugagaaggggggaccugcccgucuggcuggccuaccgcgucgccgcggaaggcaucaacuacgccgaccgacgcugguguuuugacgggauaaagaacaaccagauucuggaggagaacgucgagguugagaucuggaccaaagagggugagcggaaaaaguugaagccgcgcuggcuggacgcccgcauuuacagcgauccccucgcccucaaggaguucaaggaauucgcagccggccgcaagucccugacccucaaccucaucacggagauggggcgacugcccacuuuuaugacccagaaggccagggacgcccuggacaaccucgccguucugcacaccgcggaagccggcgggagagccuacaaucacgcccugagcgaacuccccgagacccuggagacccugcuccugcugacccuccuggccaccgugacgggcggcaucuuccucuuccucaugucugggaagggcaucgggaagaugacgcuggggaugugcuguaucaucaccgcgucaauccugcucugguaugcacagauacagccacacuggauagccgcgucuaucauccuggaguucuuccuuaucguccucuuaauccccgagccggagaagcagaggacgccccaggacaaccagcucaccuauguggugaucgccauccuaacggucguggcggccacaauggccaacgagauggguuuucuggagaagacgaagaaggaccugggacucggcagcaucaccacgcaagagucagaguccaacauacuagacaucgacuuaaggccggcgucggccuggacccuauacgccguugccaccaccuucgucacgccuaugcuaaggcacuccaucgagaacagcuccgugaacguauccuugaccgccauugccaaccaggccaccguccucauggggcugggcaaggguuggccccugaguaagauggacaucggcgugccucuccuggccaucggcuguuacagccaggugaacccgauaacguuaacggccgcgcuccugcugcucguagcucacuaugcgaucaucggccccggccuccaagccaaggcaacccgggaagcccagaagcgcgcggcggcggggaucaugaagaaccccaccguggacggaaucaccgugaucgaucuggagcccaucccguacgacccuaaguucgagaagcagcucggucaggugaugcuacugauacucugcguaacucaggugcugaugaugcgcaccacuugggcccugugcgaggcccucacccuggcuacgggcccgaucaguacccugugggaggggaaccccggccgauucuggaacacgaccaucgcgguaagcauggcgaacaucuuucgcggguccuaccucgccggggccggccugcuguucagcauuaugaagaacacgaccaacacccgucgcgguacuggcaacaucggcgaaacgcucggugagaaauggaagucccggcugaacgcucucggcaagagcgaguuccagauauacaagaaguccgggauccaagaggucgaccgcacuuuggccaaggagggcaucaagcgcggggagacagaccaucacgccgugagccgcggguccgcaaagcuacggugguuugucgagaggaacauggugacgccggaggguaagguagucgacuuagguuguggccgcgggggcuggucguacuacuguggaggcuugaagaacgugcgugaaguaaaaggccugacgaaggguggccccggacacgaggagcccauccccaugagcacguauggguggaaccugguccggcugcaguccgggguagacguguucuucaccccgcccgagaagugugacacccugcugugugauaucggcgaguccucccccaaccccacgauugaggcaggcaggacccuccgggucuuaaaccuuguggagaacuggcucaacaacaacacccaguucugcaucaaaguccugaacccguacaugcccagcgucaucgagaagauggaaacacugcagcgcaaguacgguggcgcgcuggugcggaaccccuuauccaggaauucgacccaugagauguacuggguuuccaacgccacggggaauaucgucagcuccgugaacaugauuagccgaauguugaucaaccgcuuuaccaugaagcacaagaaagccaccuacgaaccggacguggaccugggauccgguacccgcaacaucggcaucgagucugagauccccaaucuagacaucaucggcaagcgcaucgagaaaaucaaacaggagcacgaaacguccuggcacuacgaccaggaccacccauauaagaccugggcguaccacgggagcuacgaaaccaagcaaaccggcuccgccagcuccauggugaacggcguggugcgccuucugacgaaacccugggacgucgugccgauggugacccagauggcgaugaccgacaccacucccuucggucagcaacgggucuucaaggagaagguggauacccgcacccaggagccuaaggagggaacuaagaagcucaugaagaucaccgccgaauggcuguggaaggagcuggggaaaaagaagacgccccgcaugugcacgcgcgaggaguucacccggaaggugaggagcaacgccgcccucggcgccaucuucacugaugagaacaaauggaaguccgcgcgggaagccgucgaggacucucgcuucugggaacugaucgaucgggagcgcaacuuacaccucgaggggaagugcgagaccugcguuuacaacaugaugggcaagcgggagaagaaauuaggagaguuugguaaggccaagggcucccgggccaucugguacauguggcugggggcgcgguuccuggaauucgaggcccugggcuuccugaaugaggaccacugguucagucgcgggaauagccucuccggcguggagggggagggccugcaccggcucggcuacauccuucgggacgucagcaagaaggaaggaggagccauguacgccgacgauacagcaggcugggacacccggaucacucuggaggaccugaagaacgaggagauggugaccaaccacaugaagggcgagcacaagaaacuugcggaggcuauuuuuaagcuaaccuaccagaacaaggucgugcgcgugcagcgaccgacgccccgcgggaccgucauggacaucaucucccgccgggaccagcgcggauccggccagguugggacauacggcuugaacacuuucaccaauauggaagcacagcucauccggcagauggagggggagggcaucuucaaguccauccagcacuugacggugacugaggagauagccguccagaacuggcuggcccgggucggacgugagcgcuugagccguauggcgaucaguggggaugacugugucgugaagccucuugaugacagauucgccagcgcccugacugcccuuaacgauaugggcaaggugcggaaggacauacagcagugggagcccucucgcggguggaacgauuggacccaggugccguucugcagccaucacuuccacgagcuggucaugaaggauggccggguccugguggugcccugucgcaaccaggacgagcucauugggcgggcccgcaucucccaaggcgccggcuggagccugaaagagacggcgugucuggggaagucguacgcccagauguggaccuugauguacuuucaccggcgagaccugcggcuggccgccaacgcgaucugcagcgccgugcccucacacuggguccccaccagccggaccaccugguccauccacgccaagcacgaguggaugacaacagaggacaugcucgccgucuggaaccggguguggauccaagagaacccguggauggaagacaaaacccccguggaaucuugggaagaagugcccuaccuagguaaacgcgaggaccaauggugcgggucacugaucggcuugacuucccgcgcaacgugggccaagaacauccagacggcaaucaaccaggugcggagccuaauagggaacgaagaguacaccgacuacaugccauccaugaagcgguucaggcgggaagaagaagaggcgggcgugcugugguga

SEQ ID NO: 25185 - RNA, 9876 nt, Artificial Sequence
  derived and/or modified CDS sequence (opt11) from DENV-2__EU482575__SS-prME
accgccggcgugauaaucaugcugauacccaccgccauggcguuccaucucaccacucguaacggggaaccccauaugauugucggccggcaagaaaaggguaagucccugcuguuuaaaaccgaggauggcgucaacaugugcacccucauggccaucgaccugggagaacugugcgaagauaccauaaccuacaaaugcccccuccugcgacagaacgagccugaagacaucgacugcuggugcaacagcaccagcaccugggugaccuacgggaccugcacaaccacgggcgagcggcgccgggagaagcguuccgucgcucuggugccccacguggggaugggccucgagacccggaccgagaccuggaugagcagcgagggggccuggaagcacguucagaggaucgagacauggauccugcggcauccuggguucaccaucauggcggcgauacuggcguacaccaucgggacgacgcauuuccaacgcgcccucaucuucaucuugcuaaccgcgguggcucccagcaugaccaugcggugcaucgguaucuccaaccgggacuuuguggagggcgugagcgggggcucauggguggacaucgugcuagaacacgggagcuguguaacgacgauggccaaaaauaagcccacccuggauuucgaacuaaucaagaccgaggccaagcaaccggccacucuccggaaguauugcauugaggcaaagcugacaaacaccacuaccgagucccgcuguccgacgcagggcgagcccagccugaacgaggagcaggacaagcgguuucucuguaaacacuccauggucgaccgcggcugggggaacggcuguggguuguuuggcaagggcggcaucgugaccugugcgauguuuacgugcaagaaaaacauggaggggaaggucgugcugcccgagaaccuagaguacaccaucgugaucacgccccauagcggggaggagcaugccgucggcaacgacacggguaagcacggcaaggaaaucaagauaaccccgcagucuucuaucaccgaggccgagcugaccggguauggcacgguaacaauggagugcagcccccggacaggccuagacuuuaacgagauggugcucuuacaaauggaggacaaggccuggcugguucaccgccagugguuucuggaccugccucugccguggcucccgggggccgacacccagggcucuaacuggauucagaaggaaacacuggugaccuucaagaacccccaugcgaagaagcaggacguggucguucuggguucccaggaaggcgccaugcacacggcccucaccggggccacggagauccagauguccucugggaaccugcuguuuacgggccaccucaagugccggcugcgcauggacaagcugcagcucaaggggaugaguuauagcaugugcaccggcaaguucaagaucgucaaggaaaucgccgagacccagcacgguacgaucgugauccgggugcaguaugagggcgacggcucccccugcaagaucccuuucgagaucauggaccuggagaagcgccacguccuggggagguuaaucaccgugaacccaaucgugaccgagaaggacagcccggucaacaucgaggcggagccgcccuucggcgacagcuacauuaucauuggggucgagccgggccaacugaaauuaaacugguucaagaaggggagcucgauagggcaaauguucgagaccacgaugaggggcgccaagaggauggccauccucggggacaccgcuugggacuucggcagccucggcggcguauucaccuccauagggaaagcccugcaccaggucuucggggcgauuuacggcgccgccuucagcgggguguccuggacaaugaagauccugaucggagugaucaucacguggaucggcaugaacagccgguccacaagccucuccgucagccugguacuggugggcguuguuacccuauaccucggggccauggugcaggcggacuccggcugcguagugucauggaagaauaaggaacugaaaugcggcuccgggaucuucauaacugacaacgugcacacauggaccgagcaguacaaguuccagccugagucaccgagcaagcuggcauccgccauccagaaggcccacgaggagggcaucugugggauccgcagcgucacacggcuggagaaccugauguggaagcagaucacccccgagcucaaucauauccuguccgagaaugagguuaagcugaccaucaugaccggcgacaucaaagggaucaugcaggccggcaagcgcagcuuacggccacaacccacagagcugaaguacuccuggaagaccuggggcaaagcuaaaaugcugagcacggaaucgcacaaucagacuuuccuuaucgacgggccggagaccgcugaguguccgaacacgaaccgagccuggaacagcuuggagguagaggacuacggcuucggagucuucuccacgaacaucuggcugaaguugagggagaagcaggauguguucugcgauuccaagcuuauguccgcggccaucaaggauaaucgcgcggugcacgcugacaugggcuauuggauagaguccgcucugaacgacaccuggaagauggagaaggcuuccuucaucgaggucaagagcugccauuggcccaagucccacacccuauggucgaacggcgugcuggaguccgagaugaucauucccaagaauuucgccgggccggugagccagcacaacuaccgaccgggcuaccacacccagacagcggggccuuggcaccugggcaagcuagagauggacuucgacuucugugaagggacuacaguaguggugaccgaagauugcggcaaucgcggcccuagccugcggacuacgaccgcuuccgggaagcugauaaccgagugguguuguagaagcugcacucugccaccccugcgguacagaggcgaggaugguugcugguacggcauggagaucagaccucugaaggaaaaggaggaaaaccucgucaacucccuggugacggcugggcacgggcagaucgauaacuucagccugggagugcucgggauggcccuguucuuagaggagauguugcgcacucgggucgguaccaagcacgcaauccugcuggucgccgugucguucgucacauugauuacggggaacaugaguuuccgcgaccugggccgcgugaugguaauggucggggccaccaugaccgaugauauaggaaugggcgugacauaccuagcucuccuggccgcguucaagguccgaccgacguucgccgccgggcugcuccuccggaaacuaacgagcaaggagcucaugauggccaccauuggcauagcccuguuaagccaauccacaauccccgaaacgauacucgagcugaccgaugcgcuggcccuugggaugaugguccugaagaucgugcggaauauggagaaguaccaauuggcgguaaccaucauggccaucagcuguguuccuaacgcgguaauccuccagaacgcguggaagguguccugcaccauccuggccgcuguuagcguuagcccccuacuccuaacgucgucccagcagaaagccgacuggauccccuuagcgcucaccaucaagggcuuaaaccccacugccaucuuccucaccacgcucagccgcaccuccaaaaagaggagcuggccgcugaacgaggccaucauggccguuggcaugguguccauccuugccucuagccuccugaagaacgacauccccaugaccggaccccugguagcgggggggcuccugaccgucugcuacgugcugacgggacgcuccgcagaccucgagcuugagcgggcugccgacgugaagugggaggaccaggccgaaaucagcggguccucuccuauucugagcaucaccaucagugaggacggcuccaugucaaucaagaacgaggaggaggagcagacucucaccauccuuauccgcacgggccuccuagucaucucugguguguuuccagugagcaucccuaucaccgcggcggccugguacuugugggaggucaaaaagcagcgugcaggggugcugugggaugugccgaguccgccgcccgucgggaaggccgagcucgaggacggcgcguaccgcauaaagcagcggggaauacucggauacagccagaucggcgccgggguguauaaggagggcaccuuccacaccauguggcacgugacgaggggugccguccugaugcaccggggcaagcgcauugagcccuccugggccgaugugaaaaaggaccucauaagcuaugguggaggcuggaaguuggagggggaguggaaagagggcgaagaggugcagguccuggcccucgagcccggcaagaacccccgugcggugcagacgaagcccggccuguucaaaacaaacaccgggaccaucggcgcaguguccuuagacuucagcccggggacaucggguagucccaucgucgaccguaagggcaaggugguagggcucuacgggaacggcgucgugacccgcuccggggccuacguuagugcuaucgcgcagaccgagaaguccaucgaggacaaccccgagaucgaggaugacauuuuccgcaagaagcgguugacaaucauggaccuacaccccggagccgggaagacuaagcgcuacuugccugccaucguccgggaagcgauuaagcgcggccugcgcacuuugauccuggcgccgacccggguaguggcugcggagauggaggaggcccuccgcggacuccccauccgguaccagacccccgccauccgcgcagaacauacgggccgcgaaaucgucgaucugaugugccacgcgaccuucaccaugcgccucuugucccccgugcggguaccgaacuacaaccugaucaucauggacgaggcccacuuuacggaccccgccucaaucgccgcccgcggcuacaucaguacgcgcgucgagaugggggaggcggcgggcaucuucaugacagccaccccgcccgggagccgcgacccauucccgcagagcaacgcucccaucauggaugaggagcgggagauccccgagcggagcuggaauuccggccacgaaugggugaccgacuucaaggggaagacggugugguuugucccgagcaucaaggcgggcaacgacauugccgccugccuacggaaaaacggcaagaaagugauccagcugucucgcaaaaccuucgacagcgaguacgugaagacacgggccaacgacugggacuuuguaguuaccacggauaucuccgagaugggggccaacuucaaggcggagcgcgugauugacccucggcgcuguaugaaaccugucauccugaccgacggugaggagcgggugauccucgccgggcccaugccagugacccacagcucggccgcucagcgccgcggccgcauagggcgcaaccccaagaacgagaacgaccaguacaucuauaugggcgagccccuggagaaugacgaggacugcgcccauuggaaggaggcgaaaaugcugcucgauaacaucaacaccccggagggcaucauuccgagcauguucgagcccgaacgggagaaggucgacgcuaucgacggggaguaccgccugcggggcgaagcacgcaagacguucguggaccugaugcgucgcggagaccucccaguguggcuggcauaccguguagccgcggaaggcaucaacuaugccgaccgccgguggugcuucgacggaaucaagaacaaucagauacuggaggagaacguggagguggagauauggaccaaggagggugagcgaaaaaaacucaagccgcguuggcuugacgcccgcaucuacuccgaccccuuggcccucaaagaguucaaggaguucgcggcaggccgcaagagccugacgcuaaacuugaucaccgagauggggcggcuacccaccuucaugacccagaaggcccgggacgcacuggacaaccucgccguccugcacacugcagaggccggcgggagggcauacaaucacgccuugucagagcuucccgagacacuggaaacgcuguugcugcugacccuacuagcuaccgugaccggcgguauuuuccuauuccucaugagcgguaagggcauagggaagaugacgcugggcaugugcugcaucaucaccgcguccauucuucugugguacgcccagauucagccgcacuggaucgccgccagcaucauucuggaauuuuuccugaucguccuccugaucccugagcccgagaagcagcggacgccccaggacaaccagcucaccuacgucguuaucgcuauccuaacagucguggcggcuacgauggccaacgagaugggguuucuugaaaagacuaagaaggacuuaggccucggcucuaucacuacccaggaguccgaaagcaauauccuggacaucgaccugcguccugcuuccgcuuggacgcuuuacgcgguggccaccaccuucgucacacccaugcugaggcacagcaucgagaauuccagcgugaacguaucucugacggccaucgccaaucaggcgacgguccuaaugggacugggcaagggguggccccugagcaagauggacauaggcgugccccugcucgccauuggguguuacagccaggugaaccccauaacccugaccgccgcccuccugcugcuugucgcccacuacgcgauuauaggaccaggucugcaggccaaggcuacgcgcgaggcccagaagcgcgccgcggccgggauaaugaagaaccccaccguagacggaaucaccgugaucgaccuugagccgaucccguacgaccccaaguucgagaagcaacucgggcaagucaugcugcugauccucugcgugacacagguucugaugaugagaacgaccugggcccugugcgaggccuuaacccuggccacuggcccuauaagcacgcugugggaggggaaccccgggcgcuuuuggaacacaaccaucgcggugucuauggcaaauaucuucaggggcagcuacuuagcuggggcaggccugcuguucuccaucaugaagaacaccacgaacacccgcagagggacaggcaacaucggagaaacccuaggggaaaaauggaagucgcgccuuaaugcucucggcaagucggaguuccagaucuacaagaaguccggaauccaagaaguggacaggacgcucgccaaggagggcaucaaacgcggggagaccgaccaccacgccgugucccgggguagcgccaagcugcgcugguucgucgagcggaauaugguuacccccgaaggcaagguggucgaccuugggugcggccgcgggggguggagcuauuacuguggcggccuuaagaaugugcgggaagugaagggccugaccaagggcgggcccgggcaugaggagcccauaccaauguccacuuacggcuggaacuuggucaggcuccagagcgguguggacguauucuucaccccgcccgagaagugcgacacgcugcugugcgacaucggcgaguccagccccaauccuaccaucgaggcugggcggacguuacgcguucugaaccuuguggagaacuggcucaauaacaacacucaguucugcauaaagguguugaacccguacaugcccuccgucaucgaaaaaauggagacccugcagcggaaguacggcggagcguuggugaggaacccacucagccggaacuccacccacgagauguacuggguaagcaacgccaccggcaauaucguuuccagcgucaacaugauuucccgcauguuaaucaaucgauucaccaugaaacacaagaaggccaccuacgagccggacguggaccuggguagcgggacgcggaauauaggcaucgaauccgagauccccaacuuggacaucaucggcaagcgcaucgagaagaucaagcaggagcacgagaccagcuggcacuacgaccaagaucaccccuauaagacgugggccuaccacgggagcuacgagacuaagcagaccggcagcgccuccucgauggucaacggcgucgugcggcugcugacgaagccuugggaugucgugccgauggugacucaaauggccaugaccgauacgacuccuuucgggcagcagagggucuucaaggagaaaguugacacccggacccaggaaccaaaggagggcaccaaaaagcucaugaagaucaccgccgaguggcucuggaaggagcuggggaagaagaagaccccgcgcaugugcacucgugaggaguuuacccgcaaggugcggucgaacgccgcccuaggcgccaucuuuacagacgagaacaaguggaaguccgcgcgcgaggccguugaggacucacgguuuugggaacugauugacagagagcggaaccuucaucucgaggggaagugcgagacgugcguguacaacaugaugggcaagagagagaagaagcucggggaguuuggcaaagcaaagggcagccgagccaucugguacauguggcugggugcacgauuccucgaguucgaagcccuggguuuccugaacgaggaccacugguucagccgggggaacuccuuaagcggcguugagggggagggccuucaucgccuggguuacauuuuacgagacgucuccaagaaggagggcggcgccauguacgcagaugacacugccggaugggacaccagaaucacucuggaggaccugaagaacgaggagauggugacgaaccacaugaaaggggagcacaagaagcucgcggaagcaauauucaaacugaccuaccagaacaagguagugcggguccaacgcccgacgccucgcgggacggucauggacauaaucucucgacgggaccagcggggcucgggccagguggggaccuacggucugaacacguucacaaacauggaggcacaacucauccgccagauggagggggagggcaucuuuaagagcauccagcaucuuacaguaacggaagaaaucgccguucagaacuggcuugcccggguggggagagagcggcucucccgcauggcgaucagcggggacgacuguguggucaaaccucuagaugaccgguucgccuccgcccugaccgcgcucaacgacaugggcaagguacggaaggacauccagcaaugggagccgagccgcggguggaaugacuggacccaagugccguucugcucccaccauuuccacgagcuggucaugaaggacggacgcgugcuggugguccccugccggaaccaggacgaacugaucgggcgcgcccggaucagccagggcgcgggcugguccuuaaaggagaccgcgugccucggcaagagcuacgcccagauguggacucucauguacuuccaccgccgggaccugcgacuggcugccaacgcgaucugcagcgcaguacccagccacugggugccgaccucccggaccacuuggagcauccaugccaagcacgaguggaugaccacugaggacaugcucgccgucuggaaccguguguggauucaagagaaccccuggauggaagacaaaacccccguggagagcugggaggagguccccuaccugggcaagcgcgaggaccaauggugcggguccuugaucggccuaacaagccgggcgaccugggccaagaacauccagacggccaucaaucagguucgcucccugaucgggaaugaggaguacaccgacuacaugcccagcaugaagcgguuuagacgcgaggaggaggaggccggcgugcucugguga

SEQ ID NO: 25186 - RNA, 9876 nt, Artificial Sequence
  derived and/or modified CDS sequence (opt11) from DENV-2__EU482578__SS-prME
acggccggcgugaucaucaugcugauccccaccgccauggcguuccaccucacgacccggaauggggagccacacaugaucgucggccggcaggagaaggggaagucccugcucuucaagaccgaggauggcgugaauaugugcacccucauggccaucgaucugggggagcugugcgaggacacaaucaccuacaaguguccccuccuccgccagaacgagcccgaggacaucgacugcuggugcaacagcacuagcaccugggugaccuacgggaccugcacaaccacgggcgagcaucggcgugagaagcgguccguggcccuggugccccacgucgggaugggucucgagacccgaaccgagaccuggaugagcucugagggggccuggaagcaugugcagcggaucgagacguggauccugagacauccgggcuucaccaucauggccgcgauccuggcuuacaccaucgggaccacccacuuccagcgagcccucaucuucauccugcugaccgcuguagcgcccagcaugacuaugcgcuguaucggcaucuccaaccgggacuucguggagggcgucaguggcggcuccuggguggacaucgugcucgagcacgggagcugcgucacuacgauggccaagaacaagcccacccuggacuucgaguuaaucaagacugaggccaagcagcccgcuacccuccggaaguacugcauagaggcaaagcugacaaacaccaccaccgagagccggugcccgacgcagggcgagcccagccugaacgaggagcaggacaagcgcuuugucugcaagcauuccaugguugaccggggcugggggaacggaugcggccucuucggcaagggcgggaucgugaccugcgccauguucacgugcaagaagaacauggagggcaaggugguguugccagagaaucuggaguacaccaucgucaucacgccccacuccggggaagagcacgccgugggcaacgacaccgggaagcacggcaaagagauaaagauaacgccgcaguccaguaucacagaagcggagcucaccggguacggcacgguaaccauggagugcagcccccggaccggccuugacuucaacgagaugguccugcuccagauggaggacaaggccuggcuggugcaccggcagugguuccuagaccuccccuugcccuggcugccgggggccgacacucagggcagcaacuggauccagaaggagacacucguaaccuucaagaacccccacgcgaagaagcaggacgucgugguccuggggucccaggagggcgccaugcacaccgcccucacuggugcgacagagauucaaaugagcucagguaaccuccucuucaccggccacuuaaagugccgccuccggauggauaagcugcagcugaaagggauguccuacagcaugugcaccggcaaauucaagaucgugaaagagaucgccgaaacacaacaugguacgaucgugauacgcguccaguacgagggggacggcucccccugcaagauccccuucgagaucauggacuuagaaaagcggcacgugcuggggcgccugaucaccgugaacccgaucgucaccgagaaggacagccccgugaacaucgaggcggagccgcccuuuggcgacuccuacaucaucaucgggguggagccuggccagcucaagcugaauugguucaagaagggcagcuccaucggccagauguucgagaccacgaugcgcggcgccaaacggauggccauccugggggacaccgccugggacuucggcagccucgggggcgucuuuaccuccaucgggaaagcccugcaccaaguguuuggcgcgaucuacggcgccgccuucagcgggguguccuggaccaugaagauccugauaggcgucaucaucacguggaucgguaugaacagccgcucaacaagccuguccgugagccucgugcuggucggcgucgugacccuuuaccucggcgccaugguccaggcggauuccggcugugucgugagcuggaaguccaaagagcugaaaugcgggagcgggaucuucaucacugacaacgugcacacguggaccgagcaguacaaauuucagcccgagagccccuccaaacucgccuccgccauccagaaggcccacgaggagggcaucugcgggauccgguccgugacccgccucgagaaucugauguggaagcagauaacgccagagcugaaccacauccucagcgagaacgaggugaaguuaacgaucaugaccggcgacaucaaggggaucaugcaggccggcaagcggucccugcgcccgcagcccacggagcucaaguacagcuggaagaccuggggaaaggcgaagaugcuguccacggagagccacaaccagaccuuccugaucgaugggcccgagaccgcagagugcccgaacaccaaccgggccuggaauucccucgaggucgaagacuacggcuucgggguguucaccaccaacaucuggcugaaacuacgugagaagcaggauguuuucugcgacucgaagcucauguccgccgccauaaaggacaaccgggcgguccaugccgauaugggauacuggaucgagagcgccuuaaacgacaccuggaaaauggagaaggccuccuucaucgaagugaagagcugccacuggcccaagucccacacccuguggagcaauggcgugcucgaguccgagaugauaauccccaagaacuucgccgggcccgugagccagcacaacuacaggcccggcuaccauacccagacggcggggcccuggcaucugggcaagcucgagauggacuucgauuucugugaggggaccaccgugguggucaccgaggacugcggcaacagggguccaagccuccgcacgaccaccgccuccgggaagcugaucacugaguggugcugccgaagcugcacucuccccccgcuacgcuaccggggcgaggacgggugcugguacggcauggaaauucgcccccugaaagagaaggaggagaaccuggugaacucccucguaaccgccgggcacggccagaucgacaacuucagccugggcguccuggggauggcccucuuccuggaggagauguuacggacccgcguggggacgaaacaugcgauccuccuggucgccgucuccuucgugacccugaucaccgggaacaugucauuccgggaccucggccgcgugauggucauggucggugcgaccaugaccgacgacaucggcaugggcgugacguaccuggcgcugcucgccgcguucaagguccgccccaccuucgccgcagggcugcugcuccggaagcugacauccaaagagcugaugauggccaccauuggaaucgcccuccugagccaguccacgauccccgagacuauccuggagcucaccgacgcucuggccuugggcaugauggugcucaagaucguucgcaacauggaaaaauaccagcuggccgucaccauaauggccaucagcugcgugccgaacgccgugauccugcagaacgcguggaaggucucuugcacgauccucgcggcggugagcgucagcccgcuucuccucaccucuucccagcagaaggccgacuggauuccccuggcgcugaccaucaagggccucaacccgaccgccauuuuccugacgacccugagccggaccuccaagaagcgcagcuggccguuaaacgaggcaaucauggccgugggcaugguguccauccuggccagcagucuacucaaaaacgacaucccaaugaccgggccccuugucgcuggcgggcugcucacggucugcuacgugcugaccggacguuccgccgaccuagagcucgagcgcgccgccgacgucaagugggaagaccaggccgagaucagcggguccagccccauacuguccaucaccaucagcgaggacggcuccaugagcaucaaaaacgaggaggaggagcagacccugacgauccucauccggaccggacugcuggugaucagugggguguucccggucagcaucccgaucaccgcugccgccugguaccucugggaggugaagaagcagagggccggcgugcugugggacguccccagcccgccaccaguggggaaggccgagcuggaagacggagcguaccgaaucaagcagcgcgggauccucggcuacagccagauuggcgccgggguguacaaggagggaacguuccacacaauguggcacgucacgcgcggggccgugcuuaugcaucgcggcaaacggaucgagcccuccugggccgacgugaaaaaggaccugaucagcuacgggggaggauggaagcucgagggggaguggaaggagggcgaagagguucaggugcuggcccuggagcccgggaagaauccccgagccgugcagaccaagcccggccucuucaagacuaauaccgggacgaucggcgccgugucgcuggacuucagccccggcaccuccgggucacccaucguggaucgaaaaggaaaaguggucggguuauacggcaacggcguggugacccgcuccggggcauacgucagcgccaucgcgcagaccgagaaauccaucgaggauaaccccgagaucgaggacgacaucuuccggaaaaagcgccugacgaucauggaccuacaccccggagccgggaagaccaagcguuaccugcccgccauugugcgcgaggccaucaagcggggccugcgcacccucauccuggccccgaccagaguggucgcggccgagauggaggaggcccugagaggucuccccaucagauaccaaacacccgccauccgggccgaacacaccgggcgugagaucguggaccugaugugccacgcgaccuucaccaugcggcugcucuccccagugcgcguaccaaacuacaaccugaucauuauggaugaggcccauuucacggaccccgccagcaucgccgcccggggcuacaucuccacccgcguggagaugggggaggcggccggcaucuucaugaccgccacaccgcccgggagccgggacccuuuuccccaguccaacgcccccaucauggacgaggagcgcgagauccccgagcggagcuggaauuccggccacgagugggugacggacuucaagggcaagaccgucugguucgugccgagcaucaaggcgggaaacgauaucgccgccugcuugcgcaagaacggcaagaaggugauucagcucucccggaagaccuucgacagcgaguaugucaagacucgcgccaacgacugggacuucguggugacgaccgacaucuccgagaugggggccaacuucaaagcggagcgagucauugacccccgccggugcaugaaaccagugauucugaccgacggcgaggagcgcgugauccuggccgggcccaugccggucacccacagcuccgccgcccagaggcgcggccgcauaggucggaacccgaagaacgagaacgaccaguacaucuauaugggcgaaccacucgagaacgacgaggacugcgcccacuggaaggaggcgaagaugcugcuggacaacaucaacacacccgagggcauaaucccgucgauguucgagccugagcgggagaagguggacgcaaucgacggggaguaccggcuccgcggcgaggcccggaagaccuucguggaucuaaugcgccguggggaccuccccguauggcucgcuuaccgugucgccgcggagggaauaaacuacgcagaccggagauggugcuucgaugggaucaagaacaaccagauccuggaggagaacguggagguagagaucuggaccaaggagggagagaggaagaagcugaagccgcgcuggcucgacgcccggaucuacuccgacccccuggcccugaaggaguucaaggaguuugcugccggaaggaagagccucacccugaaccugaucacggagauggggcggcuccccaccuucaugacccagaaggcccgcgacgcucuggacaaccuggccguguugcacacggccgaggcuggugggcgggccuacaaucacgcucuguccgagcugcccgagacgcuggagacccugcuccuccugacccugcucgccaccguaacuggcggcaucuuccuguuccugaugagcgggaagggcauagggaagaugacccucggcaugugcugcaucaucacggcgaguauccugcugugguacgcccagauccagccacacuggaucgcggccagcaucauccucgaguucuuccugauugugcugcucauccccgagcccgagaagcaacgcacgccccaggauaaccagcugaccuacguggucaucgccauucugaccgugguggcggccaccauggcaaacgagaugggguuccucgagaaaacgaagaaggaccugggccugggcagcauuacaacccaggaguccgaaagcaacauucucgacauagaucugagaccggccuccgccuggacccuguacgcuguggcuaccaccuucgugacacccaugcuccgacacagcaucgaaaacuccagcgugaacguaucccugaccgcuaucgccaaccaggcgaccgugcugaugggucugggcaagggguggccacugagcaagauggacaucggcgugccccugcucgccaucgggugcuacucccaggucaauccgaucacccugacggcugcccugcuccugcuaguggcccacuaugcgaucaucggccccggccuccaggccaaggccacucgugaggcccagaagcgcgccgccgccgguaucaugaagaaccccacggucgacggcaucaccguuaucgaccuggagcccauaccguacgaccccaaguucgagaagcagcuggggcaggucaugcuccugauccugugcgugacucagguccucaugaugcgaaccacgugggcccugugcgaggcccugacccucgccacgggccccaucagcacccuaugggaggggaaccccggcagguucuggaacacuaccaucgcagugucaauggccaacaucuuccgaggcagcuacuuagcgggggccggccucuuguucuccaucaugaagaacacgaccaacacccgacgcgggaccggcaacaucggcgagacgcugggggagaaguggaagucccggcucaacgcgcuggggaaguccgaguuucaaauauacaagaaguccgggauccaggagguggaccgcacccuggccaaagagggcaucaaacgcggggagaccgaccaccacgcugucagucgcggcagcgccaagcuccggugguucguggagcggaacaugguaaccccggagggcaaggucguggaccuggggugcggccgcggagggugguccuauuacuguggcgggcugaaaaacgucagagaggucaaggggcucacgaagggcgggcccgggcacgaggagcccauucccaugagcaccuacggcuggaaccuggugcggcugcagagcgggguggacgucuuuuucaccccgcccgagaagugcgacacccuccugugcgacaucggcgaguccagucccaacccgacgaucgaggccggccgcacccugcgggugcucaaccugguggaaaauuggcugaacaacaacacccaguucugcaucaagguacucaacccguauaugcccuccgucaucgagaagauggagacccugcagcgcaaguacgggggcgcgcuggugcgaaacccccugagccgcaacuccacccacgagauguacugggucagcaacgccacggggaacauugugagcagcgugaacaugauaucccggaugcucaucaaccgcuuuaccaugaagcacaagaaggccaccuacgagccggacguagaccugggcagcggcacucgcaauauaggcaucgaguccgagaucccaaaccuggacaucauuggcaaacggaucgagaagaucaagcaggagcacgagacgagcuggcacuacgaccaggaccaccccuacaagaccugggccuaccacggguccuacgagaccaagcagaccggcagcgccagcagcauggugaacgggguaguccgccuucugacgaagcccugggacguggugccuauggucacccagauggcgaugaccgacaccacgcccuucggccagcagcgggucuucaaggagaagguagacacccgcacccaggaaccuaaggaaggcacgaagaagcugaugaagaucacggccgagugguuauggaaggagcuggggaagaagaaaaccccccggaugugcacccgugaggaguucacccggaagguccguucuaacgcggcccucggcgccaucuucacggacgagaacaaguggaaguccgcgcgggaggcgguagaggacagucgcuucugggagcucaucgaccgagagcgcaaccugcaccuggaggggaagugugagaccugcguguacaauaugaugggcaagcgugagaagaagcucggggaauucggcaaggccaagggcagccgcgccaucugguauauguggcugggggcgcgguuccuggaguuugaagcccucgguuuccucaacgaggaccacugguucagccgcgggaacucccuuagcggcgucgagggggagggccuccaccggcugggcuacauccugagggacguguccaagaaggagggaggggccauguaugccgacgacaccgccgggugggauacgaggauaacucucgaggaccucaagaacgaggagaugguuaccaaccacaugaaaggcgaacacaagaaguuggcggaggcgauuuucaagcucaccuaccagaacaaaguggugcgcguccagaggcccacgccccguggaacgguaauggacaucaucagccgccgggaccagcgcggauccgggcagguggggaccuacggccucaacaccuucaccaacauggaggcucagcugauccggcagauggagggggagggcaucuucaagagcauucagcaccucacggucacugaggaaaucgccgugcagaacuggcuggcccgcgugggccgggagcgccugucccggauggcgaucucgggggacgacugcgucgugaagccccucgacgaccgcuucgccucagcccuaaccgcccugaacgauaugggcaaggugcggaaagacauccagcagugggagcccagccggggguggaacgacuggacccagguaccauucugcucccaccacuuccacgagcucguuaugaaagacggccgcgugcuggucguccccugccggaaccaggaugagcugaucgggcgagcccggauuagccagggcgccggcuggucccuaaaggaaacggcaugccugggcaagagcuaugcccagauguggacccuaauguacuuucaucggcgcgaccuccggcuggccgccaacgcaaucugcuccgccgugcccagccacuggguccccacuagucggacuaccuggagcauccacgccaagcacgaguggaugacuaccgaggacauguuagcgguguggaaccggguguggauccaggagaauccguggauggaggacaagacccccguggagaguugggaggaggugccguaucucggcaagcgcgaggaccaguggugcgggagucugaucggccucaccucucgcgcgacgugggccaagaacauccagaccgcuaucaaccaggugaggucccucaucgggaacgaagaguacaccgacuacaugcccagcaugaagcgauuucggcgcgaggaggaagaggccggcguccugugguga

SEQ ID NO: 25187 - RNA, 9876 nt, Artificial Sequence
  derived and/or modified CDS sequence (opt11) from DENV-2__EU482580__SS-prME
accgccggcgugaucaucaugcuuaucccuaccgcgauggcauuucacuuaaccacccggaacggcgaaccccauaugauuguagggcggcaggaaaaggguaagucucuacucuucaagaccgaggauggcguaaacaugugcacccugauggccauggaccugggggaguuaugcgaggacacgaucaccuauaagugcccacugcugagacagaaugagcccgaggauaucgacuguuggugcaacagcaccucaaccugggugaccuacgggacuuguacaacaacaggagagcaccggcgggaaaaacggagcgucgccuuagugccccauguagggaugggccucgagaccaggaccgagaccuggauguccuccgagggcgccuggaagcacguccagcggaucgagacuuggauccugcgccaccccggguuuacgaucauggcagcgauccuggcguacaccaucggaaccacgcauuuccaacgagcccucauuuucauccuucugaccgccguggcgcccucgaugaccaugcgguguauuggcaucuccaaccgagacuucguggagggcgugagcgggggcucauggguggacauagugcucgagcaugggucuugcgucacaacgauggccaagaacaagcccacccuggacuucgaacugaucaagaccgaggccaagcagccggccacccuccgcaaauacugcaucgaggcuaaacugacgaacaccaccaccgaaagucggugcccgacgcaaggggagcccagucugaacgaggaacaagacaaacgguuccucugcaaacacucgaugguggaccgcggcuggggcaauggcuguggguuguucgggaagggagguauaguaaccugcgcgauguuuacgugcaagaagaacauggagggaaaggucgugcagcccgaaaaccucgaguacaccaucgugaucacgccccacagcggggaagaacacgccguuggcaacgacacugggaagcacggcaaggagaucaagaucacgccgcaauccucaaucaccgaggccgaauuaacgggcuacggcacggugacaauggaguguucuccccggaccggccuggacuuuaacgagauggugcuucugcagauggaggacaaggccuggcuuguccaucggcagugguuccuggaccucccgcuucccuggcugccgggggccgacacucagggcagcaacuggauccagaaggagacgcucgugaccuucaagaauccccacgccaagaagcaggaugucgucguccuggggucccaagagggagccaugcauaccgcucugacuggggccaccgagauucaaaugagcagcgguaaccuccuguucaccggccacuuaaaguguaggcuucgaauggauaagcugcaguugaaggggauguccuacucaaugugcaccgggaaguucaagauugugaaggagauugcagaaacccagcauggaacgaucgugaucaggguacaauacgagggcgacgguucccccugcaagauaccguucgagaucauggaccucgaaaagcggcauguccugggucgucugaucacugugaaucccauugugaccgagaaggacagcccggucaacaucgaggcggagccgcccuucggugauuccuauauuaucaucgggguggagccgggccagcucaagcugaauugguucaagaaagggagcucuaucggccaaauguucgagaccacaaugagaggcgccaaacggauggccaucuugggggacaccgccugggacuucgguagccuaggggguguguuuaccuccaucggcaaggcccugcaccaggucuucggcgcaauuuauggcgccgccuucagcggggugucuuggaccaugaaaaucuuuauaggcguuaucauaacuuggaucggcaugaacagccgcuccacuagccuguccgucagccuggugcucgugggcgucgucacgcuguaccucggcgccauggugcaggccgacuccggcugcguagugucauggaagaacaaggagcucaaguguggauccgggaucuucauaacggacaacguucauacguggacugagcaguacaaguuccagcccgaaagccccagcaagcucgccuccgcuauccaaaaggcccaugaggagggcaucuguggcauccgaagcguaacgcgcuuggagaaccucauguggaagcaaauuaccccugagcugaaccacauccugucugaaaaugaggugaagcugacuaucaugaccggagacaucaaagguaucaugcaggccgguaagcggucucugcgcccccagcccaccgagcugaaguauuccuggaaaacguggggaaaggcgaagaugcucagcacggagucccacaaccaaaccuuccugaucgacggacccgagacggccgagugucccaauacaaaucgggccuggaauagccuggagguggaggacuacggcuucggggucuucacgaccaauauauggcucaaauuacgcgagaagcaagauguuuucugcgacuccaaacugaugagcgccgccaucaaggacaaccgggcgguccacgcggacaugggguacuggaucgaguccgcccucaacgacacauggaagauggagaaggccagcuucaucgaagucaaguccugccacuggcccaagagccauacccuguggucaaacggcgugcuggagagcgaaaugaucauccccaaaaauuucgccgggccggugucacaacacaacuaccgcccgggcuaccauacccagacggcggggccauggcaccucggcaagcuagagauggacuucgacuuuugugaggggaccaccgucgucgugaccgaggacugcggcaaccggggccccagccuuagaaccaccacggccagcggaaagcucaucaccgaguggugcugccgguccuguacgcugccaccacugcgcuaucgcggcgaggacgggugcugguacggcauggagauccgcccccucaaggagaaggaagagaaucuggucaacagccugguuaccgccgggcacggccagauagacaacuucucgcugggcgugcuggguauggccuuauuccuggaagagaugcugcggacccgcguugguaccaagcacgcgauccugcucguggccgugagcuucguuacgcugauaaccgguaacauguccuuccgggaccugggccgcgugauggugauggucggggccaccaugacugacgacaucggcauggguguuacguaccuagcccuucuggcggcguucaaggugcguccaaccuucgccgcuggacuucuucugaggaagcucaccagcaaggagcuaaugauggcaaccauaggcauagcccugcucucccagagcaccauccccgagaccauccuugagcugaccgacgcgcucgcccuggggaugaugguccugaaaaucgugagaaauauggagaaguaccagcuagccguuaccaucauggccaucucaugcgucccgaacgcugugauccuucagaacgcguggaaggugagcugcacaauccuggccgccgucucaguaaguccccuacuguuaaccagcucucagcagaaggccgacuggaucccauuggcccugacgauuaagggacugaaccccacagcaaucuuccucaccacccugagccggaccagcaaaaagcgcuccuggccgcugaacgaggcgauuauggccgucggcauggugagcauccucgcgucuagccugcugaagaacgacauccccaugaccgggccccucguggcuggaggguuacugacggugugcuauguccuuacaggaagaagcgccgaccuggaacuggaacgcgccgcagaugugaaaugggaagaccaagccgagauauccgggagcucccccaucuuaucaaucacuaucuccgaggacggaucgaugaguaucaagaacgaggaggaggagcagacccugacgauccugauccggacagggcuccuagucauuucggggguguucccaguguccauacccaucacagcggccgcaugguaccugugggagguaaagaaacagcgcgcaggagugcucugggacgugcccucaccgccgcccgucgguaaagccgagcuggaagacggugccuaccggaucaaacagcgcgggaucuuggguuacucccagaucggcgccggaguguauaaggaaggaaccuuccauaccauguggcacgugacacgcggugccguacucaugcaccgcggcaagcggaucgagccuagcugggccgacgucaagaaagaccuuaucuccuaugggggcggguggaagcuggagggggaguggaaggagggcgaggaggugcaagugcucgcccuggagcccggaaagaacccucgagcagugcagaccaagcccgggcuguucaaaaccaauaccgggacgauaggagccgucagccucgacuucuccccagggaccagcgggucccccaucguagaucggaaggguaagguugucggguuauacgguaacggcgucgugacacgcagcggagcguacguuuccgccaucgcgcaaaccgaaaagagcaucgaggacaaccccgagaucgaggacgacauuuuccggaagaaacgccugacgaucauggacuuacauccaggugccgggaagaccaagagauaccugccggcaaucguccgcgaggccauaaagcgggggcugcgcacccugauacucgcaccuacacgcguuguggcggccgagauggaggaggcucugcgggggcugcccauccguuaccaaacgcccgccauccgggcugagcacaccggacgcgagaucgucgaccucaugugccaugcgacauuuacgaugagacugcugagccccgugaggguuccgaacuacaaccucaucauaauggaugaggcacacuuuacggaucccgccagcaucgccgcccggggcuacaucagcacgcgcguugagaugggggaagcugccggcaucuucaugaccgccaccccgcccgguucucgggauccguuuccccagucgaacgcuccaaucauggacgaagaacgcgagauucccgaacgguccuggaacagcggccacgaguggguaaccgacuucaaggguaaaaccgugugguucgucccgucuaucaaggcaggaaacgacaucgcugcaugcuuacgcaagaacgggaagaagguuauccagcugucccggaaaaccuucgacucugaguacgugaagacacgggccaacgacugggacuuugucguaacgaccgauaucagugaaaugggggccaacuucaaagcggagcgggugauagacccccgccguuguaugaaaccggucauucucaccgauggcgaggagcggguuauccuggcuggucccaugccgguuacccacagcagcgccgcccagcggagggggcggaucgggcguaaucccaagaacgagaacgaucaguauaucuacaugggagagccacuggagaaugaugaagacugcgcacacuggaaggaggcuaagaugcuccuggacaacaucaacacacccgagggcauaaucccgucgauguucgagcccgagagagagaaggucgacgcaauagacggggaguaucgauugagaggagaggccaggaagaccuucguggacuuaaugcgccgcggggaucucccaguuuggcuggccuauagaguagcagcggagggcauuaacuacgcggaccggagauggugcuucgacgggaucaaaaacaaccagauacuagaggagaauguagaaguggagaucuggaccaaggagggcgagcggaagaagcugaagccucguuggcuggaugcccggaucuacagcgacccccucgcucuaaaagaguucaaagaguucgcggcaggccgcaagucccugacccucaaccugaucacggagauggggcggcugcccaccuucaugacccagaaggcccgcgacgcauuggacaaccuagcuguacugcauaccgcggaagcaggagggaaggccuacaaccacgcccuuagcgagcuacccgagacgcuggagacacuucuccuacucacccuguuggccaccgugaccggcggcaucuuucucuuccugauguccggaaaaggcaucgguaagaugacccugggcaugugcugcaucaucacugcgagcauucuacugugguacgcacaaauccaaccucacuggaucgcggcauccaucauccuagaguucuuucugauaguccugcuaaucccggagcccgaaaagcagcggacgccccaagacaaucaacucacauacguggugaucgccauuuugacgguaguggcggcaaccauggcaaaugaaaugggguuccuggagaagacuaagaaggacuuggggcugggcagcaucaccacucaggaaucugaaagcaauauccuagacaucgacuugaggcccgccagugcguggacccuguacgcgguggccacuaccuucguaacgccaaugcugcggcacagcauugagaauagcuccgugaacguaagucucacugcgaucgccaaucaggcuaccguacugauggggcugggcaaggguuggccccucuccaagauggacauaggcgugccucugcuggcaaucggaugcuacagccaggugaacccgaucacccucacggccgcacugcugcuccugguagcccacuacgcuaucauuggccccggacuccaggccaaggccacucgugaggcucagaaacgggccgcggccggaaucaugaagaacccgacggucgacggcaucacagucaucgaccucgagcccaucccguacgaccccaaguucgaaaagcaguuagggcaggucaugcugcucauucugugcgugacccaaguccugaugaugcguaccaccugggcauugugugaggcccugacccuggccacuggccccaucucaacccucugggaagggaaccccggccgcuucuggaacaccaccaucgccgugagcauggccaacauuuuccgggguuccuaccuugccggggcaggccuccuguucaguaucaugaagaacacaacaaacacccgccggggaaccggcaacaucggcgagacgcuuggggagaaguggaagucccgccugaacgcgcuaggcaagagcgaguuucagaucuacaagaagucggggauccaggagguggaccgcacccuggccaaggaaggcaucaagcgcggggaaaccgaccaccacgccgugagccggggcucggcuaagcugaggugguucgucgagcguaacauggucacaccggagggcaaggugguagaccucgggugcggccgcggaggcuggucguacuacuguggcggcuugaaaaaugugcgagagguuaagggccugacgaaaggcggacccggacacgaggagcccauccccaugaguaccuacggcuggaaccucgugcgccugcagagcgggguggacguguuuuucacaccgcccgagaaaugcgacacccugcucugcgacaucggcgagucuucccccaacccgacuaucgaagcaggacggacccugcgcguccuaaacuugguugagaacuggcugaacaacaacacccaguucugcaucaagguccugaaccccuacaugcccucagucauagagaagauggagacacuccagcggaaauacggcggcgcgcuggugagaaacccacugucgcguaacucaacgcaugagauguacuggguuaguaaugccacugggaacaucgucagcucaguuaacaugaucagccgcaugcucaucaaccgguucaccaugaagcacaagaaggccaccuacgagccggauguggacuuggguagugggacccgcaacaucggcaucgagucagagauccccaaccuggacauaauaggcaagcgcaucgaaaagauaaagcaggagcacgagacauccuggcacuacgaccaggaucaucccuacaagacgugggcuuaccacgggagcuacgaaacaaagcagaccggcuccgccaguuccaugguaaacggggugguacggcugcuuacaaaacccugggacgucgugccaaugguaacacagauggcuaugacggauaccacgcccuucgggcaacaacgcguuuuuaaggagaagguggacacccgaacccaggaacccaaggagggcaccaagaagcugaugaagaucacagcugaguggcuguggaaggagcuugggaagaagaagacgccucggaugugcacccgggaagaguucacccgcaaaguacguagcaacgccgccuuaggugccaucuuuacggacgaaaauaaauggaaguccgcgcgcgaggcagucgaagacuccagauucugggagcucguggaccgcgagcguaaccuccaccuggaggggaagugcgagaccuguguguacaacaugaugggcaaacgcgagaagaagcugggugaguucggaaaggccaaaggcuccagagccauuugguacauguggcucggcgcgcgcuuccuggaguucgaggcacucggcuuucucaaugaggaccauugguucuccagagggaauagccucuccggcgucgagggggagggucugcaccgacucggauacaucuugcgggaugucuccaagaaggagggcggcgcuauguacgccgacgacaccgccgggugggacacccguaucacgcuggaggaucuaaagaacgaggagauggucaccaaccacaugaagggcgagcacaagaagcuggcggaggcuaucuucaagcuaacguaucagaacaagguggugcgggugcagcgaccgacgccccggggcacaguuauggauaucaucucucgacgcgaccagcggggcagcggccagguggggacuuauggccuaaacaccuucaccaacauggaggcccagcugauccgccagauggagggggagggcaucuucaaauccauccagcaucugacugucaccgaggagaucgccgugcagaacuggcuagcccggguggggcgcgagcggcuuucucgcauggcaaucucaggagacgacugcguagugaaaccccuggacgaccgcuucgccagcgcccucaccgcccugaaugacaugggcaaagugaggaaggacauccagcagugggagcccucccgggguuggaaugacuggacccaggucccguuuuguagccaccacuuccaugagcuggucaugaaggaugggaggguguuggucguaccgugccgaaaccaggaugagcugaucgggcgggcucggaucucccagggcgcgggauggagccugaaggaaacggccugcuuggggaaguccuacgcccaaauguggacuuugauguacuuccaccgacgcgaccugcgccucgcagccaacgccauuugcuccgcaguuccaucacacuggguucccaccucucggaccaccugguccauccaugccaagcaugaguggaugacuacagaagacaugcuggccguguggaacagaguguggauccaggagaaccccuggauggaggacaagaccccaguugaaucaugggaggaagugccguaccucgguaagcgggaggaccaguggugugggagccucaucggccucacaucccgcgcaacgugggccaagaacauucagaccgccaucaaccaggugcgcagccugaucgggaacgaggaauauaccgacuacaugccgucuaugaagagguuccgacgggaggaagaggaggccggggugcucugguaa

SEQ ID NO: 25188 - RNA, 9876 nt, Artificial Sequence
  derived and/or modified CDS sequence (opt11) from DENV-2__EU482581__SS-prME
acggcggggguuaucauaaugcugauaccgaccgcgauggcauuucacuuaaccacacgcaacggagaaccccacaugauaguugggcgccaggaaaaaggaaagagcuuacuauucaaaaccgaagacggagugaacaugugcacucugauggcaauagaccuaggcgaacugugugaagacacgauuacauacaaaugcccccuacuaaggcaaaaugaacccgaagacauagacugcugguguaauaguacauccaccugggugacguauggaaccuguacgacaacaggcgaacaccggcgggaaaagcgaagcguggcuuuaguaccucacgugggcaugggacuagaaacgcguacugaaacauggauguccagugagggggcauggaaacacguucagcggauugagacauggauacuaaggcaucccggguuuacgaucauggcagcuauuuuagcauacacgauugggacaacacacuuccaacgggcacugaucuucaucuuacuuacagccguagcucccaguaugaccaugcgcuguauuggcauaucgaaucgcgacuuuguagaagguguaagcggagggucuuggguugacaucguacuggaacacggcucaugcguaacuacaauggcgaaaaacaaacccacacuggacuucgaacuaauaaaaacggaagcaaaacagccagccacauuacgaaaauacugcauagaagccaaacuuacgaauacaacuacagaaucccggugccccacucaaggagaaccuagccuaaacgaagaacaggauaaaagguucgugugcaaacauagcaugguagaccgcggaugggguaacggaugcggacuauuugguaaaggaggcauagugacaugcgcaauguuuaccugcaagaaaaauauggaaggcaaagucguccuaccagaaaaccuggaauacaccauuguuauuacaccccacaguggcgaggaacaugcaguaggcaaugacacaggaaaacauggaaaagaaauaaagaucacaccgcaguccaguauaaccgaggcagaguuaacuggauacggcacaguaaccauggaaugcagcccacguaccgggcuagauuuuaacgagaugguucugcuucaaauggaagauaaggccugguuagugcaccgacaaugguuuuuagaccugccauuaccauggcuaccaggugcagauacccaggggucaaauuggauccagaaagaaacgcuggucacguuuaaaaacccacacgcaaagaaacaagacguagucguucucggaucucaggaaggcgcaaugcacacagcccucaccggagcaacugaaauccaaaugucauccggaaaccuucuuuuuaccggacaccuaaagugccgauuacgaauggauaaacuccagcugaaagggaugagcuacuccaugugcacgggcaaguucaagaucgucaaggaaaucgccgaaacacagcacggaacgauuguuauuaggguacaguaugaaggugacggcucacccugcaagauuccauucgagaucauggaucucgaaaagcggcauguacugggcagacugauuaccgugaacccgauaguaaccggaaaggacucuccagucaacauugaggcggagccacccuucggcgacagcuauauaaucauaggcguagagccagggcaauuaaagcuaaacugguucaagaaagguagcucuauagggcaaauguucgaaacaaccaugcggggagccaagcgaauggcgaucuugggcgacacagcuugggacuuugggucccucggcggcguauucaccucgauaggaaaagcgcuacaccaaguauucggcgcgauauacggggccgcguucagcgggguaagcuggaccaugaagauacuaauugguguuauaaucaccuggauaggaaugaacucaaggucgacgucauugagcgugagccuaguccuaguaggaguugucacgcuauacuuaggcgccauggugcaagcggacucggguugcgugguaagcuggaaaagcaaagaacugaagugcggaucaggaaucuucaucaccgacaacguacacacauggacagagcaauacaaguuccaacccgaauccccgucgaaacuagccucggccauacaaaaagcacacgaggaaggaauaugcggaauccggucuguaacacgccucgagaaucugauguggaagcagaucacacccgagcuaaaccacauccucagcgagaacgaaguaaagcugaccauaaugacgggugauauaaaaggcauaaugcaggcaggcaagcggagcuuacgcccgcaaccaaccgaacugaaguacuccuggaaaacguggggaaaagcaaaaaugcuaucaacggagucccacaaucagacuuuccucaucgacggcccugagaccgccgaauguccaaacacuaaucgggcuuggaacagccucgaggucgaggacuacggcuuuggcguuuucacgaccaacauauggcucaaacuaagggaaaagcaagacgucuucugcgacuccaaacuaaugucagccgcaaucaaggauaaucgagccguacacgcggacaugggguacuggauagaaucggcccuaaaugacacguggaaaauggaaaaggcgagcuuuauagaaguaaagaguugucauuggccaaaaagccacacacuauggagcaauggaguacuggagagcgaaaugaucauuccaaagaauuucgcuggaccgguaucccagcacaacuaucgaccaggauaccacacacaaacggccggcccauggcaucuaggaaaacucgaaauggauuucgacuuuugcgaagguaccaccguaguaguaaccgaagacugcggaaaccgcggccccucacugcggaccaccacggccucagguaaauuaaucaccgaauggugcuguagaucaugcacacucccacccuugcgauaucgaggagaagacgggugcugguacgggauggagauacggccacugaaagaaaaggaagaaaaccucgugaacagccugguuacggcaggacacggccagauagacaauuucucacugggcguccuaggaauggcgcuguuccucgaggaaauguugcgaacuagaguaggcacgaaacacgcaauucucuuaguagcaguuucguucgucacgcuuaucaccggaaauaugaguuuucgagaccuuggccgcgucauggucauggugggugcaacuaugacggaugacaucggaauggguguaaccuaccuagcucuccucgccgccuuuaagguaagacccacauucgccgccggccuucuguuaagaaagcuaaccagcaaagagcucaugauggcaacgauaggcauagcgcuauuaagucaaagcaccauccccgaaacgauccuagaacucaccgacgcccuagcgcugggaaugaugguccuaaaaaucgugcggaacauggaaaaauaccaacuagcggucacgaucauggcaaucuccuguguacccaacgcagucauacuccaaaacgcuuggaagguaucuugcacaauccuagccgcggucaguguaucgccgcuccuucuaacguccucacaacaaaaggccgacuggaucccccuagcccuaaccauaaaaggccuaaauccaaccgcaaucuuucucaccacacuuagucgaacaagcaagaaacggagcuggccccucaaugaagccauaauggcagugggaaugguuagcauacucgcaucaucgcuccucaaaaaugauaucccgaugaccggaccccugguagcgggcgggcuccuaaccguaugcuacgugcugacaggacgaucugcggaccuggaguuagaacgugccgcagacgugaagugggaggaccaagcagaaauaucggggaguucccccauacuaucaaucacgauauccgaagacggaucuaugagcaucaaaaacgaagaagaggagcagacccuuacaauacuaauacguacuggacuccuggucauaucggggguauuucccgucagcauacccaucacugcagccgccugguacuuaugggaagugaagaaacaacgcgccggcguccuuugggacguccccagcccgccacccguggggaaagccgaguuagaggacggugcauaccggauaaagcaacgcggcauccuaggcuacucacagauaggagccgguguuuacaaggaaggcaccuuccacacgauguggcacgugacccgaggugcgguccucaugcaccgggggaagagaaucgagccauccugggcagacgucaagaaagaucuaauaagcuacggcggcggguggaaguuagaaggggaauggaaagaaggcgaagaagugcaaguccuagcacuagaaccagggaaaaauccccgagcaguacagacaaaaccgggacucuuuaaaacgaacaccggaacaauaggggcagucucucuagacuuuagccccggcacuucgggcuccccaaucguugaccgaaaagggaaaguaguaggccucuacgguaacggagucgucacgcgaagcggcgcauacgucucugccauagcacaaacagaaaagagcaucgaggacaaucccgaaauagaagaugacaucuuuaggaagaaacgccugacaaucauggaccuucauccaggagcagggaaaacgaaaagauaccuaccggcuaucgugagagaggcuaucaaacgaggacuccgcacccugauccuggcaccuacccgcguaguggcugcugagauggaagaagcguuacgaggauugccuauucgguaucagacuccagccauccgggccgagcacacaggcagagaaaucguagacuuaaugugccacgcaacguucaccaugcgccuccucuccccugugcgggugccgaacuacaaccucaucauaauggacgaagcucacuucaccgacccggccaguaucgcggcacgaggcuacauaucaacccgcgucgaaaugggugaggcugcgggcaucuucaugacagccacgccacccggcuccagagauccauucccacaaagcaacgcaccgaucauggacgaggaaagggaaauuccggagcgcagcuggaacucaggccacgagugggugaccgacuucaaagggaagacggugugguuugugcccucaauuaaggccggaaaugacaucgcggcgugccucaggaaaaacggcaagaaagucauacaauuaucacgaaaaacauucgacagcgaauacgucaaaacccgagcaaacgacugggauuuugucgucaccacagacaucagugagaugggugccaacuuuaaggccgaacgcgucaucgauccgcgccggugcaugaaaccaguuauccugacggauggagaagaaaggguaauacucgccggcccaaugccuguaacgcauuccucagcagcccagcgccgcgggagaaucggacgcaaccccaaaaacgaaaacgaccaauacaucuacaugggcgagccccucgaaaacgaugaagacugcgcccacuggaaagaggcaaaaaugcugcuagacaauauaaacaccccagaagggauaaucccuucaauguucgagccagagcgcgagaaaguagacgcgauagacggagaauaccgacuccguggagaagcccgcaagacauucguggacuuaaugcgcagaggggaccucccuguauggcuagccuacagaguagcagcugaagggauaaacuacgcagaccggcgguggugcuucgacggcaucaaaaacaaccaaauacuugaagaaaacgucgaagucgaaauauggacaaaagaaggggagaggaagaaacuuaaaccgcguuggcucgacgcacgcauuuauagcgauccccucgcccucaaggaguucaaggaauuugcugccggaaggaagucccuaacauugaaccuuaucacugagaugggacgccucccaaccuucaugacacaaaaggcacgcgacgcgcuagacaaucuggcuguacugcacacggcagaagccgggggccgagcguacaaucacgcccuauccgagcucccggagacacuagagacacuguuacuguugacccuauuagccacuguuaccgggggcauauuccuguuccuaaugucuggcaagggcaucgggaaaaugacccuugggaugugcugcauuaucacagcauccauacuacucugguacgcacagauacaaccucauuggauagcggccucgaucauacuggaguucuuccugauuguacuuuugaucccagaacccgaaaaacagcgcacuccacaggacaaucaguuaaccuacgucgucauugcgauacugacagucgucgcggcaaccauggccaacgagaugggguuucuggaaaagaccaagaaagaccuaggucuuggcaguauaacaacgcaagaauccgagucaaacauacuagacaucgacuuacggccggccucggcguggacucuauacgccguagccaccaccuucguaacaccaaugcugcgucacuccauagagaauagcaguguaaacgucucacuaaccgcaauagcgaaccaagcaacagugcugaugggacuggggaaaggcuggccgcuguccaaaauggacauagggguacccuuacuagccauagguugcuacagccaaguaaauccuauaacacuaaccgcagcucuccuacuccuaguggcccauuacgccaucauugggcccggacuccaagccaaagcuacacgggaagcgcaaaaacgcgccgcagcugguauuaugaaaaacccgacuguggacggcauuaccgucaucgacuuagaaccuauaccguacgauccgaaauucgagaaacagcuuggccagguaaugcuccuaauccucugcgugacacaagugcucaugaugcgcacaacaugggcccuuugcgaggcccuaacauuagcuacgggucccauauccacauugugggaaggaaaccccgguagauuuuggaacacaacuauagcagucagcauggcuaacaucuuccgaggaagcuaucucgcgggggcggggcucuuguuuagcauuaugaaaaauacuaccaacacacggagggggacaggcaacauaggggaaacgcuuggagaaaaauggaagucacgccucaacgcauuaggcaaauccgaguuccaaaucuauaagaaauccgguauacaggaagucgacaggacccuugccaaagaggggauuaaaagaggggaaacggaccaccaugccguuucgagaggcagcgccaaacuacgcugguucguagaaaggaacauggucaccccagaaggaaaagugguagaccuaggaugcggacgcggcggaugguccuacuacugcggaggacugaagaacguaagggaaguaaagggccugacuaagggaggccccggccacgaagaacccaucccuaugucgacguacggguggaaccucguuaggcuacaaucgggcguagauguguucuuuacuccacccgaaaaaugugacacccuacucugugacauuggcgaaagcagcccaaauccgaccauagaagcaggacgaacccuacggguccuaaaucuuguagaaaauuggcugaacaacaacacgcaauucuguauaaagguacugaaucccuacaugccaagcguuauagagaaaauggaaacgcugcaacggaaguacggcggcgcauuaguucgaaacccccuaagcagaaacagcacccacgagauguacugggucucgaaugccacuggcaacaucguuucgagcguaaauaugaucucccgcaugcucauaaacagguucaccaugaagcacaagaaagccaccuacgaacccgauguagaccuaggauccggcacacgaaacaucggaaucgaaagcgaaauuccuaaucuugacauaauaggcaagcgcauagaaaagaucaaacaagagcaugaaacguccuggcacuacgaucaggaccacccuuacaaaaccugggcauaccaugggagcuaugaaacaaagcaaacgggcucggccuccucuauggucaacggaguuguacgacuacugacgaaacccugggacguaguccccaugguuacccagauggcuaugaccgacaccacccccuuuggacaacaaagaguauuuaaagagaaggucgacacucgaacccaggaaccgaaagagggaacuaaaaagcucaugaagauaacagccgaauggcucuggaaggaacuggggaagaagaaaacaccucgcaugugcaccagagaggaguucacacgcaaagucagaagcaaugcggcuuuaggugccauuuucacggaugaaaacaaguggaaaagugcacgagaggccguggaagacagcagauuuugggaacuaauagaccgggagcgcaaucuucaccucgagggaaagugcgaaacgugcguguauaacaugauggggaaacgggagaagaaacugggagaguuuggaaaagcaaaagggucucgggcgaucugguacauguggcuuggcgcgcgcuuccuagaguuugaagcccuaggauuccucaacgaagaccauugguuuucacggggaaacagucugucaggcgucgaaggagagggacuacaccgacucggauacauacuccgugaugucagcaagaaagaaggaggggccauguacgcggacgauaccgcugggugggacacaaggauuacacucgaggaccucaaaaacgaagaaauggucacgaaccacaugaaaggagagcacaagaagcuagccgaggcgauauuuaaguugaccuaccaaaacaagguuguacgaguccagcgaccgacaccccgggguaccgucauggacauaauauccagacgugaccaaagaggcucaggccaagugggaacuuacgggcuaaacaccuucaccaacauggaagcgcagcuaauccgacagauggaaggagaagguaucuucaaaagcauccaacaccuaaccguaacagaagaaaucgccguccagaauuggcuggcaagagucgggagggagaggcugagccgaauggccauaagcggggaugacugcgucgucaaaccuuuagaugauagauucgccagcgccuugacagcucucaaugacaugggaaaagugaggaaggacauccaacaaugggagcccagccgcgguuggaaugauuggacacaagugcccuuuugcagccaccacuuccacgaauuagugaugaaagacggucgagugcuaguugugcccugcagaaaucaggacgaguugaucggccgcgcuaggauaagccagggagcaggauggucccugaaggagacggcgugcuuaggaaaaagcuaugcccagauguggacccucauguauuuccacagaagggaccucaggcuagcagcaaacgccauuugcucagcggugccgucacacugggugccuacaagccguacaacgugguccauccaugccaagcaugaguggaugacgacugaggacaugcuagcaguauggaaccgaguguggauacaggaaaacccauggauggaggacaaaaccccaguagaaucaugggaggaaguccccuaucuuggaaagcgggaagaccaguggugcggcagccugaucggccuaacaucuagagcaaccugggcgaagaacauucagaccgccauaaaccagguucgcagccucaucgguaacgaagaguacacugauuacaugccaagcaugaaaagauucagacgagaagaggaagaagcgggaguccucugguag

SEQ ID NO: 25189 - RNA, 9876 nt, Artificial Sequence
  derived and/or modified CDS sequence (opt11) from DENV-2__EU482582__SS-prME
accgccggggugaucaucaugcucauacccaccgcaauggcguuucaccucaccacccggaacggggaaccccacaugaucgugggccgacaggagaagggaaagucccuccuguucaagaccgaggacggcgugaacaugugcacguugauggccaucgaccugggggaacugugcgaagacacaaucaccuacaaaugcccccuccugcggcagaacgagcccgaggacaucgauugcuggugcaacucgacuagcacaugggugacuuacgguaccugcaccaccacuggcgagcaccggcgcgagaaaagaagcgucgcccuggugccccacguggggaugggccucgagacgcgcaccgagaccuggaugagcuccgaaggggccuggaaacacguacagagaauugagacauggaucuugagacacccgggcuucaccauaauggccgcgauccuggccuauaccaucgggacgaaccacuuucagcgggccuugaucuucauucuucugacggccguugcgcccuccaugaccaugagaugcaucggcaucuccaaucgggacuucguggagggcgucucugggggcuccuggguggauauugugcucgagcacgggagcugcguuaccaccauggcgaagaacaagcccaccuuggacuucgagcugaucaaaaccgaggccaagcagcccgccacacuccgcaaguacuguaucgaggccaagcugaccaacacgaccaccgagucccggugucccacccagggcgagcccagccugaacgaggagcaggacaaacgcuucguuugcaagcacuccaugguggaccggggcugggggaaugggugcggauuguucggcaagggcggcaucgucacgugcgcuauguucacguguaagaaaaacauggaggggaagguggugcugcccgagaaucuggaguacaccaucguuaucacgccccacagcggggaggagcaugcaguggggaacgacacggggaagcacggcaaggaaaucaagaucaccccgcaguccagcaucaccgaagcggaacucaccggauauggcaccgugacgauggaaugcagcccgcggaccggucuggacuuuaacgagaugguccugcuccagauggaggacaaggccugguugguucaccggcagugguuccuggaccuccccuugccguggcugccgggggccgauacccagggcagcaacuggauccagaaggagacccucguaacguucaagaacccccacgcaaagaagcaggacgucgugguccucgggucccaagagggcgccaugcacaccgcccugaccggggcaaccgaaauccagaugagcagcggcaaucuccucuuuacuggccaccucaagugucgccuccggauggauaaacugcagcuuaaggggauguccuacucaaugugcaccggcaaauucaagaucgugaaggagaucgccgagacccagcacggaaccaucgugauccggguccaguacgagggcgacggcucccccuguaagauccccuucgagaucauggaccucgagaagcggcacgugcugggucgccugaucacggugaacccgaucgucaccgagaaggacagccccguaaacaucgaggcugaaccgcccuucggcgacuccuacaucaucaucggggucgagccgggccagcucaagcuuaacugguucaagaaggggagcuccaucggccaaauguucgagacuaccaugcgcggcgcgaaacggauggccauacugggggacacggccugggacuucgguagcuuagggggcgucuucaccuccaucgguaaggcccugcaccagguguucggagcaaucuacggugccguguucagcggagucuccuggaccaugaagauccugaucggcgugaucaucaccuggaucgggaugaacagucgcuccacgucccuguccgugagccucguccuggugggcguggucacccuuuaccucggagccauggugcaggcugacuccggcugcguaguuucuuggaaguccaaggagcugaaguguggcucugggaucuucauaaccgacaacgugcacaccuggacggagcaauacaaguuccagccggaaagccccagcaagcuggcgagcgccauccagaaggcccaugaggagggaaucugcggcauccgguccgugacccgcuuagaaaaccugauguggaagcagaucacccccgagcucaaucacaucuuaagcgagaacgaggucaagcugaccaucaugacgggcgacaucaaggggaucaugcaagccggcaagcggucccugcgcccgcagcccaccgaauuaaaguacagcuggaagaccuggggcaaggccaagaugcugucgaccgagucucacaaccagacguuccugaucgacggucccgagaccgcugaaugcccgaacaccaaccgggccuggaacucccuugagguggaggacuauggguucgggguguucaccacgaacaucuggcugaagcugcgagaaaagcaggacguuuucugcgacagcaagcucaugucggccgccauuaaggacaaccgggccguacacgcugacaugggcuauuggaucgagagcgcccugaacgacaccuggaagauggaaaaggccucuuucauugaggucaaaagcugccacuggcccaaaucgcacacccuguggagcaacggcguucuagaguccgagaugaucauccccaagaacuucgccgggccagugagucagcauaacuaccgcccgggcuaccacacccagaccgcagggccauggcaccugggcaagcuggagauggacuuugacuucugcgaagggaccaccguggucgugacagaggacugcgggaaccggggccccagccucagaaccacgaccgcuuccggcaaacugauuaccgaaugguguugucggagcugcacccugcccccgcuccgcuaccggggugaggacggguguugguacggcauggaaauccggccccugaaggagaaggaggagaacuuagugaauagucucgucacagccggacacggccagauagacaacuucagccugggcgugcuagggauggcccucuuccuggaggagaugcugcggacccgcguaggcacgaagcacgccauccuccuggucgcgguguccuucgugacccugauaacagggaacaugagcuuccgggaccugggucgcgucauggugauggucggggcgacaaugaccgacgacauaggaaugggggucaccuaucuggccuuauuagccgcuuuuaagguccgccccacguuugcggccgggcugcuccuccggaagcugacauccaaggaacugaugauggccaccaucggcauagcccuacucucgcagaguaccauccccgagacgauucuggagcucaccgaugccuuggcccuggggaugauggugcucaagauaguccgcaacauggagaaguaccaguuagccguaaccauaauggccaucucuugcgugccgaacgccgucauccuccagaacgccuggaaaguguccugcacaauccucgccgccguuagcguuagcccccugcuccugacgagcucccagcagaaggccgauuggaucccucuggcgcugaccaucaaggggcucaauccaaccgcgaucuuccugaccacgcugagccgaaccuccaagaagcgcagcuggccgcucaacgaggcuaucauggccgugggcauggucucaauccuggcuuccucacuccuuaagaacgacaucccaaugaccggcccgcuggucgccggcgggcugcucaccguguguuauguccugacggggcgguccgcggaccucgagcucgagcgcgccgccgacgugaagugggaggaccaggccgaaaucagcggguccagccccauccuguccaucaccaucuccgaggacggcuccaugagcauaaagaacgaggaggaggagcagacccugaccauccucaucaggacuggccugcuggugauauccggggucuucccggucagcauuccaaucaccgccgcggccugguaccucugggaggucaaaaagcagcgcgccggcguccuaugggaugugccuucgccgccaccgguugggaaggccgagcuggaggacggcgccuaccggaucaagcagcgcgggauccucggcuacagccaaaucggcgcggggguuuacaaggagggcacuuuccacaccauguggcacgugacccgcggggccgugcugaugcaccgcggcaagcgcaucgagcccuccugggccgacgucaaaaaagaccugaucagcuaugggggcggcuggaaacuagagggggaguggaaggagggcgaggagguccagguguuggcucuggagcccgggaagaauccccgggccguccaaacgaagcccggccucuucaagacaaacacugggaccaucggcgcggugucccuggacuucucccccggcacgucugggagcccgauuguggaucggaagggcaaggucguggggcuguacggcaacggcguggugacacgcuccggggccuacgugagugcgauugcccaaaccgagaaguccaucgaggacaaccccgagaucgaggaugauauuuuccggaagaagaggcucaccaucauggaccugcacccuggagcgggcaaaacgaagcgguauuugccugccaucgugcgcgaggccaucaagcggggccuacgcacccuaauccuggccccaaccagagucguggcugcggagauggaggaggcccugaggggacucccuauacgcuaccaaacccccgccaucagggccgaacacacuggccgggagaucguagacuugaugugucacgccacguuuacuaugagacugcucucccccguccgcguuccaaacuacaaccugaucaucauggacgaggcgcacuucaccgaccccgcuagcaucgccgcccggggguacaucuccacgagaguggagaugggagaggccgcaggcaucuucaugaccgcaacgccucccggcagccgggauccguucccccaauccaacgcaccaauaauggacgaggagcgcgagauacccgagcggagcuggaacaguggccaugagugggucaccgacuucaaagggaagacggugugguucgugccgagcaucaaggccggcaacgacaucgcagccugccugcggaagaacggcaagaaggucauacagcugucccggaagaccuucgacagcgaauacgugaaaacccgcgccaacgacugggacuucgugguaacgacggacaucuccgagaugggcgccaacuucaaggccgagcgcgugaucgacccccgccggugcaugaagccugugauccugaccgacggggaagagcgcgucauccuggcggggcccaugccgguuacgcauucaucagccgcccagcggcgaggccgcauugggcggaaccccaaaaacgagaacgaccaguauaucuacaugggugagccccucgagaacgacgaggacugcgcccacuggaaggaggccaaaaugcugcuggacaacaucaacacgcccgagggcaucaucccgagcauguucgagccggagcgcgagaagguggacgcgaucgacggagaguaccgguugcgcggcgaagcucggaagacguucguggaccuaaugcgccgaggagaucuccccguguggcucgccuaccgcgucgccgcugaggguaucaacuacgcggaccggcgcuggugcuucgacgguauaaagaacaaccagauccuagaggagaacguugaggucgagauuuggaccaaagagggcgagcgcaagaaacugaagccgcgauggcucgacgcccgaaucuacucggauccacuugcccucaaggaguucaaggaguucgcggcuggccgcaagagcuuaacccugaaccugaucaccgaaaugggucggcuccccacguucaugacccagaaagcccgcgacgcccuugacaaccuggccguccuccacacggccgaggcuggcggacgcgccuacaaccacgccuuguccgaguuaccggaaacccucgagacucugcugcugcugaccuugcucgccaccgugaccggcggcaucuuuuuguuccugaugagcgggaagggcaucgguaagaugacgcucggcaugugcugcaucaucaccgcauccauucugcucugguacgcgcagauccagccgcacuggaucgcagccagcaucaucuuagaguucuuccugaucguccugcuuaucccagagcccgagaagcaacgcacgccacaggacaaccagcugaccuacgucgugaucgccauucugaccguugucgccgcgacgauggcaaaugagaugggguuccucgagaagacuaagaaggauuuggggcugggcagcaccaccacucaggaauccgagagcaacauccucgacaucgaccugagaccggccuccgccuggacccucuacgccguggcgacuaccuucgucacgccaaugcuccgacacagcaucgagaauuccucggucaacgucucccuuaccgccaucgccaaccaggcaaccgugcugauggggcuugguaaggguuggccccucagcaagauggauaucggggucccccugcucgcgaucggcugcuacucccaagugaacccgaucacccugacggccgcccugcuccuucugguggcccacuacgccaucauaggccccggccuacaggcgaaggcuacccgagaggcccagaagcgcgccgccgcagggaucaugaagaaucccaccgucgacgggaucacuguaaucgaccuggagcccaucccguaugaccccaaguucgagaagcagcucggccagguaaugcuccucauccugugugucacccaggugcuaaugaugaggaccacaugggcccugugcgaagcucugacccucgcaacaggccccaucagcaccuuaugggaaggaaaccccggccgcuucuggaacaccaccaucgccguguccauggcgaacauuuuccgcggcucguaucuggcgggggccggauugcuguucuccaucaugaagaauacgaccaacacccggcgcgggaccggcaacauuggcgaaacguugggcgagaaguggaagucccgacucaacgccuuaggcaaguccgaguuccagaucuacaagaaauccgggauccaggaaguagacaggacacuggcgaaggagggcaucaagcgcggugagacugaccaccaugcagucucccgcggcagcgccaaguugcggugguucguggagcgcaauauggucaccccggaggguaaaguaguggaccuggggugcggccgcggcgggugguccuauuacugcggcgggcugaagaacguccgagaggugaaggggcucacgaagggcggcccagggcacgaagagcccauccccaugagcacuuacggcuggaaccugguccgccugcaguccggggucgacguguuuuucacaccgcccgagaagugcgacacacucuugugugacauaggcgaauccagccccaaucccacgaucgaggccggcagaacacugcggguucucaacuuagucgagaacuggcugaacaauaacacccaguucugcaucaaagugcucaacccuuacaugcccuccguaauagagaagauggagacacugcagagaaaguacgggggcgcccugguucggaacccccuuucacgcaacuccacucacgagauguacugggugucgaacgcgacgggcaacaucgugucuaccgucaacaugaucagccggaugcucaucaaccgcuucacuaugaagcacaagaaggccaccuacgagccggacguggacuuaggcuccgggacgcgcaauaucggcaucgagagcgagauccccaaccuggacaucaucggcaaacggaucgaaaagauuaagcaggagcacgagaccuccuggcacuacgaccaggaccacccguacaagacgugggccuaccaugggagcuacgagaccaagcagacuggcuccgccucuucuauggugaauggaguugugaggcuccugaccaagcccugggacgugguaccgauggugacccaaauggccaugaccgacacgacccccuucggccagcagcgcguguucaaagaaaagguggacaccaggacccaagagcccaaagagggcacgaagaaacugaugaagaucaccgcggaguggcuauggaaggaacuggggaagaagaagacgccccggaugugcacacgcgaagaguucacgcggaaggugcgcagcaacgccgcccugggcgcaaucuucaccgacgagaauaaguggaaguccgcucgggaggcgguggaagacagccgcuucugggagcucaucgaucgggagcgcaaccugcaccuggaggggaagugcgagaccugcgucuacaacaugaugggcaagagggagaagaagcuaggggaguucggcaaggccaaaggcucccgcgccaucugguauaugugguugggggcucgcuuccuggaguucgaggcgcuaggauuccugaacgaagaucacugguucagccgcggcaacagccuguccggcguggagggggagggccuccaccggcucggauacauccucagggacgucagcaagaaagagggcggggccauguacgccgacgacaccgccgggugggacacgcggauuacccuggaggaucugaagaaugaggagaugguuacgaaucacaugaagggcgagcacaaaaaguuagccgaggcgauauucaagcucaccuaccaaaacaaggugguccgcgugcaacggccgacgccacgcgggaccguuauggauaucaucucccgccgggaccagcgcggcucgggucaggucgggaccuacggacugaacaccuuuacuaauauggaggcacagcugauccggcagauggagggcgagggcauuuucaaguccauccagcaucucaccgugaccgaggagaucgccgugcagaacuggcuggcccgcguggggcgggagcgcuuaagcagaauggccaucuccggcgacgauugcguggugaagccccucgacgaucgcuucgcgagcgcccugaccgcccuuaacgacaugggcaagguccggaaggauauccagcagugggagccgagcaggggguggaacgacuggacccaaguuccguucugcagccaccacuuccacgaacuugugaugaaggacggccggguccugguagugcccugccgcaaccaggacgagcugauuggacgugcccgcaucucgcagggcgccggcuggagcuugaaggagaccgcgugccuggggaaaucauacgcccagauguggacacugauguacuuccaccggcgugaccuccggcuggccgccaacgccaucugcagcgcgguacccucacacugggugcccaccagccgcaccacgugguccauucacgccaagcacgaguggaugaccacugaggacaugcucgccguguggaaccggguuuggauccaggaaaacccguggauggaggacaagacccccguggagagcugggaggaggugcccuaccucggcaagcgcgaggaccaguggugcgggagccugaucggccugaccagucgcgccaccugggcgaagaacauccaaaccgccauaaaccaggugcguagccucauaggaaaugaggaauacaccgacuacaugccaucuaugaagcgcuuccggcgcgaagaggaggaggccggcguccugugguaa

SEQ ID NO: 25190 - RNA, 9876 nt, Artificial Sequence
  derived and/or modified CDS sequence (opt11) from DENV-2__EU482583__SS-prME
accgccggggugauuaucauguugauuccaaccgccauggccuuucaucucacaacccgaaauggagagccccauaugaucgucggccgacaggagaagggcaaauccuugcuguucaagaccgaggacgggguaaauaugugcacccucauggccauugaccugggcgagcugugugaggacaccaucaccuauaagugcccccuucugcgccaaaaugaacccgaggacaucgauugcugguguaauagcaccucaaccuggguuaccuacggaaccugcaccacuacgggcgagcaccggcgcgaaaaacgcucuguugcucuagucccccacguggggaugggccucgagacccgaacggagacauggauguccucagagggugccuggaagcacguacagcguauugaaaccuggaucuuacgccacccggguuucaccaucauggcggcgauccuggcguauacaaucgggacgacccacuuccagcgggcccucaucuuuauauugcugacagccguagcucccucaaugaccaugagaugcaucgguaucaguaaccgggacuucguggaaggagugagcgguggaucauggguggacauugugcucgagcacgggaguugcgucacaacgauggcgaagaacaaacccacccuggacuucgaacugaucaagaccgaggccaagcaaccugccaccuuacgcaaguauuguauugaagccaagcugacaaauaccaccaccgagucccggugcccgacgcagggcgaacccagccuaaacgaggagcaagacaaaagauucgugugcaagcacuccaugguggaccggggcuggggcaacggcugcggguuauucggaaagggcgggaucgugacgugcgcgauguucaccugcaagaagaacauggagggcaagguggugcugcccgagaaucuggaguauaccauagucaucacgccccacagcggggaggagcacgccgugggaaacgacaccgguaagcaugguaaagagauuaagaucacaccgcagucuagcauuaccgaggcggaguugaccggguaugggacagugaccauggaguguagcccgcggacaggccuggauuuuaacgagaugguucugcuccaaauggaggacaaagcguggcuggugcaucggcaaugguuccuugaccucccccugcccuggcucccgggggcugacacacagggcuccaacuggauccaaaaggagacguuggucaccuuuaaaaacccccacgcgaagaagcaggacgucgugguccuggggucccaggaaggcgccaugcacaccgcgcugacaggggcuacggagauacaaaugagcagcggcaacuuacuguucaccggccaccugaaauguaggcuucgcauggacaaacugcagcugaaggguaugucuuauagcauguguaccgguaaguucaaaauugugaaggagauagccgaaacgcagcacggcacgaucguuauacgugugcaguacgagggcgacggcucccccugcaagauccccuucgagauaauggaccucgagaagcgacacgugcuggggcgauuaaucacaguaaauccuaucgucacggagaaggacagccccgugaacauagaagcggaaccaccguucggagauuccuacaucaucauuggugucgaaccggggcaacucaagcugaacugguucaagaaagguagcucaaucggccagauguucgagaccacgaugaggggugcuaagcggauggccauccugggggacaccgcaugggacuuuggcagccucgggggagucuucaccuccauagggaaagcccugcaccagguguucggcgccaucuacggagcagcguuuagcgggguguccuggacaaugaaaauucugaucggggucauaaucacguggaucggcaugaauagccgcucaacaagccuuagcgucagccucgugcugguugguguggugacccuguaucucggggccaugguccaggcggacuccggaugcguugugagcuggaagaacaaagagcugaagugcggcagcgggaucuucaucaccgacaacguccacacguggaccgagcaguacaaguuucagcccgagagccccagcaagcuggcauccgccauucaaaaggcccaugaggaggguauaugcggaauccguaguguaacccggcucgaaaaccugauguggaagcagaucaccccagaacugaaccacauccucuccgagaacgaagugaagcugacgauaaugaccggcgacaucaaggguaucaugcaggccggcaagcguucucuucgcccccagccgaccgaguugaaguauuccuggaagacguggggcaaggcuaagaugcugagcacggagucccacaaucagacauuccucaucgacggacccgagaccgcagagugcccgaacacgaaucgggcauggaacagccucgaggucgaggacuauggcuuuggcguguucacgacuaacauuuggcugaaacugcgagagaaacaagauguguucugcgacuccaagcuaaugagcgccgcgaucaaggacaaccgggcaguccacgcggacaugggcuauuggaucgagucugcgcucaacgacaccuggaaaauggaaaaggccaguuucaucgaagugaaauccugccacuggcccaagucucauacccuguggaguaacgguguccucgagagcgaaaugaucauccccaagaacuucgccggaccgguaucccagcauaauuaucgcccgggguaucacacccaaacggcggggcccuggcaccugggcaagcuggaaauggacuuugacuucugcgaggggacgacugugguggucacugaggauugcggcaaccggggacccucacuccguacgaccacggccagcgguaagcugaucacagaguggugcugccgguccugcacgcugcccccguugcgcuaucggggcgaagacgggugcugguauggcauggaaauccgcccauugaaggaaaaagaggagaaccuugugaacucccucgucaccgccggccacgggcagaucgacaacuuuucccugggcguucuggggauggcccuauuccuggaggaaaugcugcguacccgggugggcaccaagcacgcgauccuccuuguggcaguaagcuucguuacgcugaucaccggaaacaugucuuuucgggaccucggccgcguuauggugaugguaggugcuacaaugaccgacgacaucggaaugggagugaccuaccuggcccuauuggcagcuuucaagguucgccccaccuucgcggcggggcuacuguuacggaagcuaacuagcaaggagcuaaugauggccacaaucggcaucgcgcugcucucccaaucaacgauccccgaaaccauccuugagcugaccgaugcacuggcccuggggaugaugguucucaaaaucguucgcaacauggaaaaguaucaacuugccguaaccaucauggccaucaguugcguuccgaacgccgucauccuacagaaugccuggaagguguccuguacaauccucgccgccgugucagucucgccccuucuguugacaaguucccagcagaaagcagacuggaucccauuggcgcuaaccaucaagggucucaacccaaccgccaucuuccucacaacuuugucucggacuagcaagaagcgcuccuggccgcucaacgaagccaucauggcgguuggcauggugagcauccuugcauccagccugcucaagaacgacauccccaugacggggcccuugguagccggcgggcucuugacggugugcuacgugcugaccggaagaagcgccgaccuggagcucgaacgcgcggccgacgucaagugggaagaccaggcggagauaucugggagcucccccauccucagcaucacuaucagugaagacggcucaauguccaucaagaacgaggaggaggaacaaacccugacuauccucauccgaaccggccugcuggugauuagcgggguuuucccaguuucuauccccaucacggcggccgccugguaccucugggagguaaagaagcaacgcgccggcgugcugugggauguccccagcccgccgccgguagggaaggccgaguuggaagacggggcguaccggaucaaacagcgaggaauacuagguuacucccagauaggcgccgggguguacaaggagggcacuuuccacaccauguggcacguaacacgcggggccguuuuaaugcaccgcggcaagcggaucgagcccaguugggccgacgugaagaaggaccuuaucuccuacggcggcggcuggaagcucgagggggaauggaaagagggcgaggagguccagguccuggcccuggagccggggaagaacccccgagcgguccagacaaagcccggccucuuuaagaccaacaccggaacgaucggcgcugucucacuagacuucuccccggggaccucuggauccccgaucguggaccggaaaggcaagguaguggggcucuauggaaacggcgugguaaccagaucuggggcauacgucucagccaucgcacagaccgagaaguccaucgaagacaaccccgaaaucgaagacgacaucuuccgaaagaaacgccuuacgauaauggacuuacacccgggcgcgggaaagaccaagagauacuugcccgccaucgugcgggaggcgaucaagcgaggccuuagaacacugaucuuggcacccacgaggguuguggcugccgaaauggaggaggcccugagggggcuaccgauccgcuaccagacgcccgccauccgggcggaacacaccggccgcgaaauaguggaccugaugugccaugcuaccuucaccaugcgucugcucagccccgugcgcgucccgaacuauaaccugauuauuauggacgaggcccacuucacggaccccgcauccauugccgcacggggcuacaucagcacccgcguggagaugggugaggcggccggcaucuucaugaccgccacgccacccgggagucgggacccguucccgcagagcaaugcccccauuauggacgaggaaagggagauaccggagcggucuuggaacucgggccaugaguggguaacggacuucaagggcaagacugucugguucgugccgagcaucaaagcggguaacgacaucgccgcgugccuacgcaagaauggcaagaaagugauacagcucagccggaagaccuuugacgccgaguacgucaagacccgcgccaaugauugggacuuugugguaacgaccgacaucuccgagaugggagccaacuucaaggccgaacgaguaaucgauccucgaaggugcaugaagcccgucauccuuacggacggugaagagcgaguaauccuggcaggaccgaugccggucacgcacagcuccgccgcucagcggcggggcaggaucggucggaaucccaagaacgagaaugaccaguacaucuauaugggcgagccccucgagaacgacgaggacugcgcgcacuggaaggaagccaaaaugcuucuggauaacaucaacacgcccgagggcaucauuccgagcauguucgagcccgaacgggagaaaguugacgccaucgacggggaguaccggcuccgcggcgaggcccggaagacuuucguggaccugaugcgccgcggggaccugcccgucuggcucgccuaccgcguggcggcugagggcaucaacuaugccgaccggcgauggugcuucgacgggauaaaaaauaaccagauccuggaggagaacguugaggucgaaauauggaccaaggaaggcgagcggaagaaacuaaagccgcgcuggcucgacgcccggaucuauuccgauccacuugcuuugaaagaguucaaagaguucgccgccggccgaaagagccuuacucucaaucuaaucacggaaauggggcggcuucccaccuucaugacccagaaggcacgcgacgccuuagacaacuuggcuguucugcauaccgccgaggccggcgggcgggccuacaaucaugcucuguccgaguuacccgagacguuggagacacuacugcucuugacccuccucgcgaccgugacgggcggaaucuuccuauuucugauguccgguaaagggaucgggaagaugacccucgggaugugcugcaucauaacagcgucuauccuuuuaugguaugcgcagauccagccacacuggauagcagccucgaucauccucgaguucuuccugaucguacugcuaauccccgagccagaaaaacagagaacgccccaggacaaccagcugaccuacguggucaucgcgauucugacgguuguggcugcgaccauggcaaacgagaugggguuccucgagaagaccaagaaggaccucggacugggguccauaaccacccaggagagcgagagcaacauuuuagacaucgaccugcggcccgcauccgcguggaccuuguaugccguggcaacuacuuuuguuacucccaugcuccgccacagcaucgaaaauuccucgguaaacguguccuuaacagccaucgcgaaucaggccacuguacuaaugggacugggcaaggguuggccccuaucaaagauggacauaggcgugccccugcuagccaucgguuguuacagccaagucaauccaaucacccugacggccgcacuucuccuguugguugcgcacuacgccaucaucggcccaggccuacaggccaaggccacccgggaggcccagaagagagcggcugcagggaucaugaaaaaucccaccguggacggcaucacggucaucgaccuggaacccauuccguacgaucccaaauucgagaagcagcuggggcaagucaugcuccucauccugugugucacgcagguccucaugaugcgcaccacaugggcacuaugcgaagcgcucacccuggcuacgggccccaucuccacacucugggaggggaacccaggcagguuuuggaacaccaccauagcggugucuauggcgaauauuuuccgcggcagcuaccuggccggcgcagggcucuuauucuccauuaugaagaacacaaccaauacccggaggggcaccggcaacaucggcgaaacgcugggugagaaguggaagagucgguuaaacgcccucgggaaguccgaguuucagauauauaagaaguccggaauccaggaaguggacagaacccuggcaaaggagggcauuaagcgcggggagacagaucaccacgccguauccagaggcagcgccaaacuccggugguucguugagcgcaacauggugacuccugagggcaaagucguggaccuggggugcggccgcggcggguggucuuacuacugcggggggcugaaaaacgugcgcgaggugaaagggcucacuaagggcggacccggucacgaggaacccauccccaugucuacauacggauggaaccugguaagguuacagagcgggguugaugucuucuucaccccgcccgaaaagugugacacccuccugugcgacaucggcgagagcucacccaacccgacgaucgaagcggggcgcacccugcguguccucaacuuaguggagaauugguuaaacaacaauacgcaauucugcaucaaaguuuugaacccguacaugcccucugugauagagaagauggagaccuuacagcgcaaguacgggggggcucuggugcggaauccccugagcagaaacuccacgcaugagauguauuggguuagcaacgccacgggcaacaucguguccagcgucaacaugaucucucggaugcucaucaaccgcuucaccaugaagcauaagaaggccaccuacgagccagacgucgaccuuggcagcggcacccgcaacaucgguaucgaguccgagauacccaaccuggacaucaucggaaagcggaucgaaaagaucaagcaggagcacgagacgagcuggcauuacgaucaggaccaccccuacaagacaugggccuaccacggcagcuacgaaaccaagcagaccgggagcgcguccagcaugguaaacggagugguccgccugcucacgaagcccugggacgugguaccgaugguuacacagauggccaugaccgacaccacgccauucggucaacagaggguguucaaggagaaaguagacacacguacccaggaacccaaagaagggacuaaaaaacugaugaagauuaccgcagaauggcuuuggaaagagcuggguaagaagaagacgccacggaugugcacccgcgaggaauucacccggaagguacgcagcaacgcggcccugggagccaucuucacugacgagaacaaguggaaauccgcccgggaagccguagaagacuccagguucugggaguugauugacagagagcguaacuugcaccuggaagggaagugcgagacuugcguuuacaauaugauggggaagcgggaaaagaaacucggggaauucggcaaagccaaaggcucacgcgcgaucugguauauguggcugggggcccgauuccuggaguucgaggccuugggcuuccuuaacgaggaccacugguucucccgugggaacucacugagcggagucgagggggagggccuccaucggcugggauacauacucagagacgugucuaaaaaagagggcggagcgauguacgccgacgauacugcggggugggacacacggaucaccuuggaggaccuaaagaacgaggagauggucacaaaccauaugaagggggagcacaaaaagcuggcggaggcgaucuuuaagcugaccuaccagaacaagguggugcgcguccaacggccgacgccacgcgggacgguuauggacaucaucagccgaagggaucagcgcggcucaggccaaguagggacauacggccuaaauaccuucaccaacauggaagcgcagcuuauccgccagauggagggugaaggcaucuucaagucuauccagcaucucacgguuacggaggagaucgccguccagaacuggcuggcgcgcguaggccgggagcgccuuuccagaauggccaucagcggagacgacugcgucguuaagccccuagacgaccgcuucgcguccgcccuaaccgcacugaacgacaugggcaaagugcggaaggacauccaacaaugggagccgagucgcggguggaaugacuggacccaggucccguucugcucccaucacuuucacgaacucgugaugaaggacggccgugugcuggucguacccugccgcaaccaggacgaauuaaucgggcgggcgcgcauaagccagggggccggcuggucccucaaagagacggccugccuagguaagaguuacgcgcagauguggacccugauguacuuccaccggcgcgaccucaggcuagcagcgaacgccauaugcagugcugugcccucccacuggguccccacuagucgcaccacauggagcauacacgcgaagcacgaauggaugacgaccgaggacaugcuagcgguuuggaaccgggucuggauucaggaaaacccauggauggaggacaaaaccccuguggagucgugggaggaagugcccuaccucggcaagagggaagaccaguggugugggagccugaucggauugaccagccgggcgacuugggcuaaaaacauccaaaccgccauuaaccaggugcggucccucauagggaacgaggaguacacggacuauaugccgagcaugaagcguuuccggagggaggaggaagaggcgggcguccucugguga

SEQ ID NO: 25191 - RNA, 9876 nt, Artificial Sequence
  derived and/or modified CDS sequence (opt11) from DENV-2__EU482585__SS-prME
acugcgggcguaaucaucaugcuaauaccaaccgcgaucgcguuccaccucaccacccgcaauggcgagccccacaugaucgucggacgucaggagaagggaaaauccuugcuguucaagaccgaggacggcgucaacaugugcacccuaauggccauugacuuaggggagcugugcgaggacaccaucacauacaagugcccacuccugcgacagaacgagccggaggacaucgauugcuggugcaacagcaccagcaccuggguaaccuacggaacuuguaccaccacgggcgagcaccggcgcgagaagagauccgucgcucuggugccccacgugggcauggggcucgagaccagaaccgaaaccuggaugaguagcgaaggagccuggaagcacguccaacggaucgagacauggaucuuaaggcaccccggcuucacuauaauggccgcuauccuggccuacaccauagguaccacacauuuccagcgcgcacucaucuucaucuugcugacugcagucgcgccuagcaugacaaugcgcugcaucggcaucagcaaccgggacuucguggagggggucagcggcggcucguggguggauaucgugcucgagcacgggagcugcguaaccacgauggccaagaacaagcccacgcuggauuucgaguuaaucaagacugaggccaagcagcccgccacacuccgcaaguacugcaucgaggcaaagcugacuaacacuacgacagagucccgcuguccgacccagggcgaaccaagccuuaaugaagaacaggacaagagauucgugugcaagcacuccaugguggaccggggcugggggaacggcugcggcuuguucgguaaaggagguaucgugaccugcgccauguucacgugcaagaagaacauggaaggcaagguugugcuuccugaaaaccuagaguacacgauuguaaucacuccgcauagcggcgaggagcacgcuguggggaaugauaccgggaagcacggaaaggagauuaaaaucaccccacaaagcucaaucaccgaggccgaauugacuggauauggaacggugaccauggagugcucucccaggacuggccuggacuucaacgagaugguacugcuucagauggaggauaaagccugguugguacaccggcaaugguuccuugaccucccccugcccugguugccgggggccgauacucagggaagcaauuggauacagaaggagacguuagugacauucaaaaacccccaugcgaaaaagcaggacgucgugguccuagggucccaggagggugccaugcacacggcccugaccggggccacggagauccagaugucuagcgggaaccuccuguuuacaggccaucugaagugccgccuccggauggacaagcugcagcucaagggcaugagcuacagcaugugcacugguaaguuuaagaucgugaaggagaucgccgagacucaacaugggacgaucgugauccggguacaguacgagggagacggcucccccuguaagauucccuucgaaaucauggaccuggagaagcggcacgugcuggggcgccugaucacagugaaccccauagucacugagaaagauagcccugugaacaucgaggccgagccgcccuucggggacuccuacaucaucaucgggguggagccgggccagcucaagcuuaauugguucaaaaagggcucauccaucgggcagauguucgaaaccacgaugcgcggugcaaagcggauggccaucuuaggugauacugccugggauuucggcucgcuggggggcguauucaccuccaucggcaaggcccuccaccagguguucggggcgauauacggagccgccuucuccggggugaguuggacaaugaagauacuaauuggcgucaucauuaccuggaucggaaugaacucccgcuccaccucucugagcgugagcuuagugcuagucggcguggucacccuguaccuuggggccaugguccaagcggauuccggcuguguugugagcuggaaauccaaggagcugaagugcggcucggguauuuucaucacggauaacguucacacguggaccgagcaguacaaguuccagccggagagcccaaguaaacuggccagcgccauacagaaggcccacgaggaagguauaugcggcaucagguccguaaccaggcuggagaaccugauguggaagcagaucaccccagaacuuaaccacauccucagcgagaaugaagugaaacugacuaucaugacuggcggcaucaagggcauaaugcaggccggcaagcgguccuuacgcccgcaacccacagagcucaaguacucguggaaaaccugggggaaggcgaaaaugcuguccacagagucccacaaucagaccuuccucaucgacgggccggagaccgcagagugcccgaauaccaaucgggccuggaacucacucgagguggaggacuaugguuucggcguguucaccacuaauauuuggcugaagcugcgcgagaagcaggacguguucugugacagcaagcucauguccgccgcgaucaaggacaaccgggcggugcacgccgauaugggauacuggaucgagagcgcacugaaugacaccuggaagauggagaaggccuccuucaucgaggucaagagcugccauuggccaaaaucccacacccuguggucgaacggggugcucgagucagagauggucaucccaaagaacuuugccgguccugugagccagcauaacuacagaccuggguaucauacgcagacggcgggucccuggcaccucgggaagcuggagauggauuuugacuucugcgagggcaccaccguugucguuaccgaggauugcggcaaucgugggcccucccuccgcacgaccacugccuccggcaagcugaucaccgaguggugcugccggucauguacguugcccccgcuccgcuaucgcggggaggacggcugcugguacggcauggaaauucguccccuuaaagagaaagaggagaaucuggugaauucccuggucacugcgggacacggacaaauagauaacuuuagccugggggugcuggguauggcccuuuucuuggaggaaaugcugcguacgcgcguugguaccaagcacgcgauucugcuggucgccguguccuucgugacacugauaaccgguaacaugagcuucagagaccucgggcgcguuauggugauggugggcgccacuaugaccgacgacauugggaugggggucacguaccuggcacugcucgcugcguucaaggugcgaccaacuuucgccgcuggacuacucuuacggaagcugaccuccaaggagcucaugauggccacaaucgggauugcccuccugagccaguccacgauccccgagaccauccuggaguuaaccgacgcguuggcccugggcaugaugguacucaaaaucguccgcaacauggagaaguaccaguuagccguuacgauuauggccaucagcugcgugccuaacgccgucauccuucagaacgcguggaagguauccuguacgauacucgccgcuguaagcgugagcccucugcugcucaccucaucacaacagaaagcagacuggauuccccuagcgcugaccauuaagggccucaacccuacggccaucuuccugacgacuuuaagccggaccucuaagaagaggucuuggccgcucaacgaggccaucauggcgguagggauggucuccauccuggcgagcucgcugcucaagaacgacauccccaugaccggcccccuuguggccggagggcugcucacuguuugcuauguccugacgggccggagcgcugaccuggagcuugagcgcgccgccgacgugaagugggaggaccaggcugagaucucagguuccucaccaaucuuguccaucaccauaagcgaagaugguuccaugucgaucaagaacgaggaggaggagcagacccuaaccauccucauccggaccgggcugcuggugaucucugguguauucccggugagcaucccgauaacugcggccgccugguaccucugggagguuaaaaagcagagagcaggcguguugugggacguacccagcccgccgcccgucgguaaggccgagcuggaggauggggccuaccggaucaagcagcguggcauccucggguacagccagauaggugcaggcgucuauaaagaaggcacauuucacacgauguggcacgugacgcggggggccgucuugaugcaccgcgggaagcgaaucgagccguccugggccgacgucaagaaggaccuaaucagcuauggcggaggguggaagcuagaaggggaauggaaagagggggaggagguccaggugcuugcgcuggagcccggcaagaacccccgagcgguacagacgaagcccggccuuuucaaaacuaacacagguacaauuggagcuguguccuuagacuucagccccgggacguccgggagccccaucguggaucggaaggggaaagucgugggccuguacggcaacgggguggucacccgcagcggcgcguacguaagcgccaucgcgcagaccgagaaguccaucgaggauaaccccgaaaucgaggacgacaucuuccggaagaagcgccucacaaucauggaccugcaccccggggccggcaaaaccaaacgguaucugcccgccauagugcgcgaggccaucaagcgcgggcugagaacgcucauccuggcaccuacccgcgucguggcugccgaaauggaggaggcacugcggggacuccccauacgguaccagacgcccgccauccgcgccgagcacaccggucgcgagaucguggaccugaugugccacgcgaccuucaccaugcggcugcuuagccccgugcgcgugccgaacuacaaccuuauuaucauggacgaagcccacuucacggacccggcgagcauugcugcccguggguauaucuccaccagaguugagaugggcgaagccgcaggaaucuucaugaccgcuacgccgccaggcucccgggacccguucccucaguccaacgccccaaucauggacgaggaacgcgaaauccccgagcggagcuggaacuccgggcacgagugggucacggacuucaaaggcaagaccgugugguucgugccgucgaucaaggcgggcaacgacaucgccgccugccugcgcaaaaacgggaagaaggucauccagcucagucgcaagaccuucgauagcgaauacgugaaaacccgcgccaaugauugggacuucgugguuacgacagacauaucggagaugggcgccaacuuuaaggcugagcgcgugauugacccccgccggugcaugaagccaguaaucuuaaccgacggggaggagcgggucauacuagccgggcccaugcccgugacccacucguccgccgcucagcggcgugggcgcaucggacggaaccccaagaacgagaacgaccaguauauuuacaugggcgagccccucgagaacgacgaggacugugcucauuggaaggaggcgaagaugcuucuggacaauaucaacacgccagaggggauuaucccgagcauguucgagcccgagcgggaaaagguggaugcgaucgacggcgaguaccgguuacgcggugaggcgaggaagaccuuugucgaccuuaugcguagaggcgaccugcccguguggcucgccuaccgcguggccgcggaggggaucaacuacgccgaccggcgcuggugcuucgacggcaucaagaacaaccagauacuggaggagaacgucgagguggagaucuggaccaaggagggugagcggaagaagcugaagccccgcuggcucgacgccagaaucuacuccgauccacuggcccugaaggaguucaaagaauucgcggccggucggaagagcuuaacguugaaccucaucacagagaugggccggcuucccacuuucaugacgcagaaggcccgugacgcccuggacaaucuagcaguccuccacaccgcggaggccggaggccgggcauacaaccacgccuuaagcgagcugcccgaaacucucgagacccugcugcuccugacccugcucgccaccgugaccggaggaaucuuccucuuucugaugagcggcaaggguauaggcaagaugacccucgggauguguugcaucaucaccgcgucuauccugcugugguacgcgcagauccagccacacuggaucgccgccucuaucauccuugaguucuuccugaucgugcugcucauccccgaaccggagaagcagcgcacgccgcaggacaaccaacugaccuacguugucauagccauucugacgguggucgcggccaccauggccaacgagauggguuuccucgagaaaaccaagaaggaccugggccuggggucuaucaccacgcaggaauccgagagcaacauccucgauauugaccugagaccggcguccgcauggacccuguacgcgguggccacgaccuucgugacacccauguugcgccacucaauugagaacuccagcgucaaugugucccugaccgccauugcgaaccaggcuacgguauuaaugggacucgggaaaggauggccguuaucgaagauggacaucggggucccccuguuggcuauugggugcuacucccaggucaauccgauuacucugacagccgccuugcuccugcugguggcccacuaugcgaucaucggcccagggcuccaggccaaagcuaccagggaggcccagaagcgugcugcugcuggaaucaugaagaaucccacagucgacgguauaacugugauugaccuagagcccaucccguacgacccuaaguucgagaagcagcucggccaggugaugcuccugauccucugcgucacacaagugcucaugaugcgcaccaccugggcgcuuugcgaggcacucacccucgccacggggcccauuaguacccucugggaaggcaaccccggccgguucuggaacaccaccauugcggugucaauggccaacaucuuccgcgggagcuaccuagcuggugcggggcuccuguucucaaucaugaagaacaccacgaacacccggcgcggcaccggcaacaucggggagacgcugggcgagaaguggaaaucccgucucaacgcucuggggaaauccgaguuccaaaucuacaagaagaguggcauccaggagguagacagaacccuggccaaggaggggaucaagcggggcgagacagaccaccaugcuguaaguagggguucggcuaagcuucgcugguucguggaacgcaacauggucacaccugaggggaaggucguugacuugggcugcgggcggggcgggugguccuacuacugcggcggccugaagaacgugagggaggugaaggggcucacaaagggcgggcccgggcaugaggagccaauccccaugagcaccuacggguggaacuuagugcggcugcaaagcggcgucgacguauucuuuaccccgcccgaaaagugcgauacccucuuaugcgacaucggcgagagcucccccaacccaacaaucgaggcagggcgcacccugcggguauuaaauuuggucgaaaacuggcuaaacuccaacacacaguucugcaucaagguccucaauccuuacaugccgagcgugaucgaaaagauggagacucugcagaggaaguacggcggugcacucguccggaacccccugagccgcaacuccacccacgagauguacuggguuaguaacgccacggguaacaucgugagcucggucaacaugaucucgcggaugcucaucaaccguuucacgaugaaacacaagaaagccaccuacgagccggacguggaccuggggucugguacacgcaacaucggcaucgagucugagauccccaaccuagacaucaucgggaaacgcauugagaagaucaagcaggagcacgagaccucguggcacuaugaccaggaccacccuuauaagaccugggccuaccacggcagcuaugagacaaagcaaaccggguccgcuucgucuauggugaauggcguggugaggcuccugaccaagcccugggacguagucccgauggugacccagauggcgaugacugauaccacgcccuuuggccagcagcguguguuuaaggagaaagucgacacccgcacccaggagcccaaggaagggaccaagaaacugaugaagauuacggcugaauggcucuggaaggaacuugggaagaagaaaacgccgcggaugugcacccgugaggaguucacccggaaggugcgcagcaacgcggcucugggcgccaucuucaccgacgagaacaaguggaaauccgcacgggaggcaguggaggacagccgcuucugggagcucaucgaccgggagcgcaaucugcaccuggaggggaaaugcgaaacaugcguuuacaacaugauggggaagagggagaagaagcuaggcgaguucggcaaagccaaaggaagccgggccauuugguauaugugguuaggugcucgcuuucuggaauuugaggcccucgguuuccugaaugaggaccacugguucagucgcggcaacagccuguccgggguggagggcgagggucuccaccgacugggguacauacugcgcgacgucagcaagaaagaggggggcgcuauguacgccgacgacaccgccggaugggacacccggauaacgcucgaggaccugaagaacgaagagauggugacaaaccauaugaagggcgagcacaagaagcucgcagaggccaucuucaagcucacuuaucaaaacaagguggugaggguacagcggccaacgccccgugggacaguaauggacauuaucucacgccgcgaccaacgcggcucaggucaggucgguaccuacggacugaacaccuuuaccaacauggaggcucagcugauccgucagauggagggcgaggguaucuucaaguccauucagcaccuuacggugaccgaggagaucgccgugcagaacuggcuggcucgcgucgggcgggagcgcuugagcagaauggcgauuuccggcgacgauugcgugguuaagccccucgacgaccguuucgccucggccuugaccgccuugaacgacaugggcaagguccggaaggauauccagcagugggagccuagucgcggcuggaacgauuggacccaggugcccuucugcagccaccacuuccaugagcucgugaugaaggacgggcggguacugguggugcccugccgaaaccaggacgaacugauuggccgggcccgcaucucccaaggcgcgggguggagcuuaaaggagacggccugucugggcaaaucauacgcacaaauguggacgcugauguauuuccacaggcgcgaccuccgacuggccgccaacgcgaucuguagcgccguccccucacacugggugcccacaucccgaaccaccuggagcauccacgccaagcacgaauggaugacgaccgaggacaugcuggccguguggaaccgagucuggauccaggagaacccguggauggaggacaagaccccgguggagaguugggaggagauucccuaccucgguaagcgcgaagaucaguggugcggcagccugaucgggcuuaccucccgcgcgacuugggccaaaaacauccagacggccaucaaccaggugcggucacucaucggcaacgaggaguacaccgacuauaugcccuccaugaagcgauuccgccgcgaggaagaggaggccggcgugcugugguaa

SEQ ID NO: 25192 - RNA, 9876 nt, Artificial Sequence
  derived and/or modified CDS sequence (opt11) from DENV-2__EU482587__SS-prME
acugccggggucaucauaaugcucauaccaacagccauggcuuuccaucuaacaacccgaaauggcgaaccgcacaugauagucggccggcaagaaaaaggaaaaagccuacuauucaaaacagaagacggcguuaacaugugcacacuuauggcgaucgauuugggcgaacuaugugaagauacuaucaccuauaaaugcccacuccugagacaaaacgaaccagaagacauagacugcuggugcaauuccacgaguacuugggucacauauggcacuugcaccacuacaggggaacaucgucgagagaaaagaaguguagcccucgugccacacgucgggaugggccuggaaacuagaaccgaaacauggaugucuuccgaaggggcguggaagcaugugcagcggaucgaaaccuggauucucagacaccccgguuucacaaucauggccgcaauacuggccuacacaauaggaacaacacauuuccagagagcacuuaucuucauccugcucaccgccgucgcacccagcaugaccaugcguuguauagggauaucgaaccgcgauuucguggagggaguaaguggcgggucgugggucgacauuguucucgagcacggcagcugcgucacuaccauggcgaagaacaaaccaacgcuagauuuugagcugauuaagaccgaggcaaagcaacccgcaacacuccggaaauauugcaucgaagcuaaacuaacaaauacaacaacagaaagccgcugcccaacgcaaggugagcccucacuaaacgaggaacaagacaagcgguucguaugcaaacacucgaugguggauagaggguggggcaacggaugcggacuguuuggaaagggagguauaguuacaugcgcaauguucacuugcaaaaagaacauggaaggcaaaguuguccucccagagaacuuggaauacaccauagucauuacaccgcacuccggagaagaacaugcaguagggaacgauacuggaaaacacgggaaggaaauuaagaucaccccacagagcuccauaacagaaguggagcucacaggguaugguaccguaaccauggaguguagcccucgcaccggccuggacuucaacgagaugguacuucuucagauggaagacaaagcguggcuaguccaucgucaaugguucuuagacuugccguugccguggcugccaggagcagacacacagggauccaauuggauucagaaagagacccucgugacuuuuaagaacccucacgccaagaaacaagacgucguuguccucggaucacaggaaggcgccaugcacacagccuuaacaggagcgaccgagauacagaugaguagcgggaacuuacuguuuacaggacaucuaaaaugucgacuccguauggacaaauugcaauugaaaggcaugagcuacagcauguguacagggaaguucaaaauaguaaaggaaaucgccgaaacucaacacgggaccauagugauacgagugcaguaugaaggagacgggucuccaugcaaaauacccuucgagaucauggaccuagaaaagcgacacgugcucgguagauugaucacggucaauccaauagucacggagaaagauuccccagugaacaucgaagcggagccgccuuucggagauucauacaucaucaucggcgucgaaccagggcagcuuaaacucaauugguucaagaaaggaucaagcaucggccaaauguucgagacgacaaugagaggggcgaaaaggauggcaauacuaggcgacacagcaugggauuucggaagccucggcgggguauucacguccauuggcaaagcccuccaccaaguguuuggagccauauacggagccgccuuuaguggaguaucauggacuaugaaaauccuaauuggggucauaaucacauggauaggcaugaauaguagaucaaccaguuuaagcgugagccuuguccugguggggguagugacacucuaccuaggcgccaugguccaagcugacucuggaugcguagugucauggaaaucccgcgagcucaaaugcggcagcgggaucuucaucaccgacaacgugcauaccuggacagagcaauacaaauuccagccagaaucaccaagcaaguuggcauccgccauacaaaaggcacacgaggagggcauuugcggaauacgcagugucacccggcucgaaaaccucauguggaaacaaaucacacccgagcucaaucacauacucucagagaaugaggucaaacugacaauaaugacuggcgauaucaagggaaucaugcaagcggggaagcggucguugcgaccccagcccacagaacuaaaauacucguggaagacauggggaaaggcgaagaugcuaaguaccgagagccacaaucggaccuuccucauagauggccccgaaaccgcggaaugccccaauacgaaccgagcguggaacagccuagagguagaagauuacgguuucggcguguuuacaacgaauauauggcucaaguuacgagaaaagcaagacguauuuugcgacuccaaacucaugucagcggccauuaaagacaaccgagcgguccacgccgauaugggguauuggauugaaucugccuugaacgauacauggaagauggaaaaagcaucguucauagaagugaaauccugccacuggccgaaaagccacacucuauggagcaauggcguacuggagagugagaugaucauccccaaaaacuucgccggacccguaagccaacacaacuaccgccccggauaucacacacagacggcagggccuuggcaccugggaaaauuagaaauggacuuugacuucugcgaaggcacuacgguaguggucacagaggacuguggcaaccgaggcccuagcuugcgaacuacgacagccagcgggaaacuaauaacagaguggugcugcagaucuugcacccuaccgccccugagauacagaggugaagacggaugcugguacgggauggagaucagaccccugaaagaaaaagaagaaaaccuaguaaauucauuaguaacggcuggacacgggcagauagauaacuucucccuagguguguuagggauggcccuauuucuugaagaaauguuacgcacuagagucgggacaaaacacgcgauccugcuaguagcaguaaguuucgucacgcuaauaacagggaauaugucuuucagagaccugggccgcgugauggucauggucggagcaacaaugacggaugauauagggaugggcguaacguaccuagcccuccuggccgccuucaaaguaaggccgaccuucgccgcagggcuucuccuacggaaacucacaagcaaggagcucaugauggccacaaucggaaucgcgcucuuaucccaaucuacuaucccugaaacaauacuagaacuaacagacgcccuugcucugggaaugauggugcucaaaaucguccgcaacauggagaaguaucaacuggccgucacaauuauggccauuucgugcguaccaaacgccguaauccuacagaaugcguggaaggugagcugcacaauccucgcagccgucucaguuagcccacuacugcuaacgucaagucaacaaaaggcggacuggauaccacuggcgcuaacgauaaaagggcugaaucccacagcgauauuccugacuacccucucccggaccagcaagaaacggucauggccguuaaacgaggccauaauggccgucgggauggugucuauccucgcaagcagucugcucaaaaacgacauacccaugacgggacccuuaguugcgggcggacuguuaaccgucugcuauguacugacaggucgguccgccgaccuggagcuagagagagccgccgacguaaaaugggaagaccaagccgaaauaucgggcagcucacccauucucagcaucaccauuucagaagacgguaguaugagcaucaaaaaugaagaagaagaacagacacugacuaucuugauccggaccggccuccuggucauaagcggaguauuuccagucagcauacccauaacugcagcggccugguaccuaugggagguuaagaagcaaagagccggggugcuuugggaugucccgucaccacccccgguaggcaaggcggaacucgaggacggagcauaucggaucaaacagcggggaauccuaggguacucccaaauuggagcgggagucuauaaggaggguacguuccacacaauguggcacgugaccagaggcgcuguauuaaugcaccgcgguaaaaggauagaaccauccugggcagacgugaagaaagaucucaucaguuacggcggaggguggaaacuggagggggaauggaaagagggagaagagguccagguccucgcacuagaaccgggcaagaacccgcgggcagugcagacgaagccaggacuauucaaaacuaacacaggaacaaucggcgcagucuccuuagacuucagccccgggacgagcggcuccccaaucguugacagaaaagggaaaguggucggucuauacggcaacggaguugucacccgcucaggagccuacgucagugcaauagcucaaacagaaaagagcaucgaagacaacccagaaauagaggaugauauuuuucggaaaaagcgccucacgauaauggaccuacacccgggagccggaaaaacgaaacgcuacuuaccugcaaucgucagggaagcaaucaagcgcggucuuagaacacuuaucuuggcaccaacgagagucguugcagccgaaauggaagaagcacuacgggggcuccccauuagguaucagacgcccgccauacgcgcagaacauacagggcgcgagaucguagaccuaaugugccaugcgacuuucacaaugcgucuauugagcccuguacgcguaccaaauuacaauuuaaucauaauggacgaagcccacuucacagauccggcgagcauugcagcucggggcuacauuagcacacggguugagaugggcgaagcagccggaaucuucaugaccgcgacgccucccggcuccagagauccguucccccaaucuaaugcacccauuauggacgaagaaagagaaaucccagaacgguccuggaacuccggccacgagugggucaccgacuuuaaagggaaaacggucugguucguuccaucaauaaaggcuggcaaugacauugccgcgugccuaaggaagaacggaaagaaagucauucaauugucaagaaaaacauucgacuccgaguacguaaaaacacgggcgaacgacugggacuucgugguuacaaccgacaucucagagaugggggcaaacuucaaagcugaacgcgucaucgacccccggcgaugcaugaagccaguaauacucaccgacggagaggaacgggucauccuagcgggaccaaugccggugacucacuccagugcggcccagcgucgcgggcggauuggcaggaaccccaaaaacgagaaugaccaguacaucuauaugggagaaccacucgagaacgacgaagacugcgcacacuggaaggaggcaaagaugcuacuggacaauauaaacaccccggaggguaucaucccuuccauguucgagccagagcgagaaaaaguagacgcgauagacggggaguaccguuugaggggcgaggcccgaaaaacauuuguagaccuaaugcgaagaggggaccucccgguuuggcuugcauacagggucgcggcagaaggcauaaacuaugccgaccgacgauggugcuuugacggcaucaagaacaaccagauacuugaggaaaacguagaagucgagauauggaccaaagaaggggagcggaagaagcuaaagccacgguggcucgacgcgcgaauuuacucugacccacuggcccuuaaagaguucaaagaguucgcggcgggacguaagagccuaacccuaaaccucauaacggaaaugggccgacuacccacauuuaugacacagaaagcccgagaugcucuagacaaucuagcgguguugcacacugcggaggcaggcggacgcgcauauaaccacgcucugucggaacuacccgaaacccucgaaacacuacuccuccugacacuccuagcaacugugaccgguggaauauuucuguuccucaugucugggaagggaauagggaaaaugacauuggguaugugcugcauaauaacggcaaguauccuacugugguacgcgcaaauccagccucacuggaucgcggccucgauaaucuuagaguucuuuuuaaucguucuacucaucccugaaccagaaaaacaacggacuccucaggacaaccaacuaacguauguuguaauagccauucuaacggucguugccgccacgauggcaaacgaaaugggcuuccucgagaagaccaagaaagaccuaggacuagggucgauaaccacgcaggagucugagaguaauauccuagacaucgaccuaagaccagccuccgcauggacccucuacgcaguagcgaccacuuucguaacaccgaugcuccgucacuccauugagaacagcucaguaaacguuucucuaacggcaaucgcaaaccaggcuacuguacuaauggggcucggaaaaggauggccacucagcaagauggacaucggcguaccacuccuugccauuggcuguuacagccagguaaacccgauaacccuaacagcggcccugcucuugcuagucgcccacuaugccauaaucgguccagggcuacaggccaaggccacacgagaagcucagaaacgggcggcggcgggaauaaugaaaaacccaaccgucgacggcauaacgguaauagaccuugagccaauaccguacgacccaaaauucgaaaaacagcuugggcagguaaugcuacuaauacuaugcgugacccaaguccuaaugaugcgcacuaccugggcguugugugaagcacuaacccuugcgacgggccccaucagcacccuaugggagggcaauccgggcagguucuggaacacaacgaucgcaguaagcauggcaaacauauuccgaggauccuaccuagccggcgcaggacuucuguucaguauaaugaagaacacaacuaacacccggcgcggcacgggaaacauuggugaaacucugggggagaaguggaaaagcaggcucaaugcacucggcaaauccgaguuccagaucuacaagaaaagcgguauccaagaaguagacagaacccuagccaaagaggggauuaagcgaggagagacugaucaucaugccgucucgaggggauccgcuaaacuacgaugguucgucgagaggaacaugguaacaccugaagggaaaguagucgaccugggcugcgggcgugggggcuggagcuauuauuguggcgggcugaagaauguacgagaagugaagggcuugacaaaagggggaccaggacacgaagaacccauuccaaugaguacguacggauggaacuuggugaggcuacaaucgggugucgacguuuucuucacuccaccagagaaaugcgauacccuacugugcgacaucggcgagucuuccccgaaccccacgauagaggcaggaagaacacuccgcguccuaaaucuaguggaaaauuggcugaacaacaacacacaguucugcaucaaaguccugaauccguacaugccauccgucauagagaaaauggaaacacuucaaagaaaguacggaggcgccuuggugagaaacccacugucacgcaauagcacacacgagauguacugggugucuaacgcgacagguaauauugucagcuccgucaacaugaucagccgcaugcuaauaaacagguuuaccaugaaacacaagaaagccaccuacgaaccagacguagaucucgggucgggaacacggaauauaggaaucgagagcgaaauaccaaaccuagacaucaucggcaagagaauugagaaaauaaagcaggaacaugaaaccagcuggcacuacgaccaagaucacccauacaaaacaugggcauaccacggaagcuacgagacgaaacaaacagggagcgcgagcucgaugguaaacgggguuguacgucuauugaccaaaccgugggauguagugcccaugguaacucaaauggccaugaccgacacaacucccuuuggccagcaacggguauuuaaagagaagguagacacacguacccaagaacccaaagaagggacaaagaaacuaaugaagaucaccgcugaauggcucuggaaggagcuagggaagaagaaaacccccagaaugugcacgcgcgaagaguucacgcgcaaaguccgcaguaacgccgcacuaggggcaauauucacagaugagaacaaauggaaaagcgcccgcgaagcaguagaagauucuagauuuugggaacuaaucgaccgcgaacgaaaccuccaucucgagggaaaaugugagacaugcguguacaauaugaugggaaaacgggagaagaaauuaggagaguucgggaaagcuaaggggagcagagccauaugguacauguggcuaggcgcgagauuccuggaguucgaagcccuaggauuccuaaacgaagaccacugguuuagucgaggcaacagccucaguggggucgaaggcgaagggcuccauagacugggauacauacugagagacgucagcaaaaaggaagggggcgccauguacgcagacgauacugcaggcugggacacuagaauaacccuagaagaccucaaaaacgaggaaaugguaacgaaucacaugaaaggagaacauaagaaguuagccgaagcaauuuucaaacugaccuaccagaacaaaguugugcgcguccaaaggccgacgccgagggggacaguaauggauaucauuucgaggcgagaccagcgagggagcggccagguaggcaccuauggucucaacacauucacgaauauggaggcccaacuuauucgacaaauggagggggaggguaucuucaagucaauacagcaccuaacgguuaccgaagaaaucgcagugcagaacugguuagcaagggugggaagagaaaggcuaucgcgaauggcaaucucgggagaugacugcgugguaaaaccgcucgacgauagguuugcuucagcgcucaccgcguuaaacgauaugggcaaagucaggaaagacauccaacagugggagccaucuagaggauggaaugacuggacccaggucccuuucugcucacaccauuuccacgagaucgucaugaaagacggcaggguacugguuguuccaugccgcaaccaagaugaacugaucgggcgcgcucggauaucacaaggagcaggcuggucacugaaggaaacagcgugccucggcaaauccuacgcccaaauguggacucugauguacuuccaccgccgagaucuaagacuagccgcgaaugcaaucugcagcgccgugccuagccacugggucccgaccucacggaccaccuggagcauacacgcgaagcacgaauggaugacaacggaagacaugcuggccguguggaauagaguauggauacaggaaaacccuuggauggaagacaagacgccggucgagagcugggaagaagucccguaucuuggcaaaagggaggaccaauggugcgggucacucauuggacucacgucgagggccacgugggcuaaaaauauacaaacagcgaucaaucagguccgcagccuuauaggaaacgaggaguacacagauuacaugccaucgaugaaacgguucaggcgcgaggaagaagaggcugggguccucugguaa

SEQ ID NO: 25193 - RNA, 9876 nt, Artificial Sequence
  derived and/or modified CDS sequence (opt11) from DENV-2__EU482588__SS-prME
accgccggcguuaucauuaugcugauccccacggccauggcguuccaccucacaacacggaacggggagccccacaugaucguggggcggcaggaaaaggggaagucccugcuguucaagaccgaggacggcgugaacaugugcacccucauggcaauugaccugggggagcugugcgaggacaccaucaccuacaagugcccccuccugcgccaaaacgagcccgaggacaucgacugcuggugcaauagcaccagcacuugggugaccuacgggaccugcaccaccacgggagagcaccggcgugaaaagcgguccgucgcccuggugccccauguagggaugggccucgagacccggaccgaaaccuggaugagcucugagggagccuggaagcacguccagcgcauugagaccuggaucuugcgccacccgggcuucaccaucauggccgcgauccuggcauacaccaucgggaccacgcacuuucagcgggcccuuauauucauccugcugaccgccguggcgcccagcaugaccaugcgcugcaucggcaucaguaaccgggacuuuguggagggcgucagcgggggcuccuggguggacaucguucucgaacacgggagcugugucaccacgauggcaaagaauaagcccacccuggacuucgaauuaaucaagaccgaggccaagcagcccgccacgcuucgcaaguacugcaucgaggccaagcugacgaacaccaccaccgagucccggugcccgacgcagggcgaacccagccuaaacgaggagcaggacaagcgauucguguguaagcacuccaugguggacaggggcugggggaacggcugcggccucuucgguaaggguggcaucgugacgugcgcgauguuuacgugcaagaagaacauggaaggcaagguggugcugcccgagaaucuagaguacaccaucgucaucacgccccacucgggggaggagcacgcugugggcaacgacaccgggaagcacggcaaggaaauaaagaucacaccgcagagcagcaucaccgaggccgagcucaccggguacggcacgguuacuauggagugcagcccccggaccggacuugacuucaacgagaugguccugcuccagauggaggacaaggcgugguuaguucaccggcagugguuccuggaccucccccuacccuggcugccgggugccgauacccagggcagcaacuggauccagaaggaaacgcucguuaccuucaagaauccccaugcgaagaagcaagauguagugguccuugggucccaggagggcgccaugcacacagcgcucacgggggccacggagauccagaugagcagcggcaaccuccuguucacaggccaccugaagugccgcuuacgcauggacaagcugcagcugaaggggauguccuacagcaugugcaccggcaaguucaagaucgugaaggaaaucgccgagacccaacacgggacgaucgucauccgcguccaguacgagggcgacggcucccccugcaaagugcccuucgagaucauggaccucgagaagcggcacguguuagggcgccugauaaccgucaauccgauagugaccgagaaggacagccccgugaacaucgaggcggagccgccauucggcgacucguauaucaucaucggggucgagccgggccagcugaagcugaacugguucaaaaaagggagcuccaucgggcagauguucgagaccacaaugcgcggcgccaagcggauggccauccugggggacaccgcuugggacuuuggcagccucgggggcguguucaccucaaucgggaaggcccugcaccagguguucggcgcgaucuauggcgcggccuuuaguggggucucuuggaccaugaagauccuuaucggcgucaucaucacguggaucgguaugaacucgcgcuccaccucccuguccguuagccucguacuggugggcguggucacccuguaccucggggcgauggugcaggcggacuccgggugcguggucagcuggaagagcaaggagcugaagugcgggucagggaucuucgugaccgacaacgugcacacguggaccgagcaauacaaguuccagcccgagagccccuccaagcuggccucggccauccagaaggcccacgaggaaggcauuugcgggauccgguccguuacccgccucgagaaccugauguggaagcagaucacccccgagcugaaccacauccucagcgagaacgaagugaagcugacuauuaugaccggcgacaucaaagggaucaugcaggccggcaagcggucccugcgcccgcagccaaccgagcucaaguacaguuggaagaccuggggcaaggcgaagaugcuguccacugagagccacaaccagaccuuccugaucgacgggcccgagacugccgagugcccgaacaccaaucgggccuggaacucccucgagguggaggacuacggcuucgggguguucaccaccaacaucuggcugaaacugcgcgagaagcaggacguguucugcgacagcaagcucauguccgccgccaucaaggauaaccgggcagugcacgccgauaugggcuacuggaucgaaagcgcccugaacgauaccuggaagauggagaaagccuccuuuaucgaggucaagagcugccacuggcccaagagucacacccuguggagcaacggcgugcucgaguccgagaugaucauacccaagaacuucgccgggcccgugagucagcauaauuaccgcccuggcuaucacacccagacggcagggcccuggcaccugggcaaguuagagauggauuucgacuucugcgaggggaccaccgucguggugaccgaggacuguggcaaccgaggcccaagccuccgcacgaccaccgcguccgguaaguugaucacggaguggugcuguagaagcugcacgcugcccccgcuccgcuaccggggcgaggacggguguugguacggcauggagauacgcccccugaaggagaaggaggagaaccuggucaacucccucguuaccgccgggcacggccagaucgacaacuucagccuuggcgugcuggggauggcauuguuccuggaggagaugcugcggacacgcgucggcaccaagcacgcgauccuccugguggccguguccuucgugacgcugaucaccgggaacauguccuuccgggaccuaggucgcgugauggugauggucggcgccaccaugacagacgauaucggcaugggcguuacguaucuggcgcugcucgccgcguucaaggugcgccccacguucgccgccgggcugcugcuccggaaacugaccuccaaggagcugaugauggccacgaucggcaucgcccugcuuagccagagcacuauccccgagaccauccuggagcucacggacgcgcuugcccuggggaugaugguccuaaagaucgugcgcaacauggaaaaguaccagcuggccguaaccaucauggccaucagcugcguuccgaacgcggugauacugcagaacgcguggaaggucucgugcacgauucucgccgccgugucggugagcccccuucugcucaccagcucccagcagaaagccgacuggauaccccuggcgcugaccauuaaaggccucaaccccaccgccaucuuccugacgaccuuaagccggaccuccaagaagcgcagcuggccccucaacgaagccaucauggccgucggcaugguguccauacuggcuagcagccugcucaagaacgacauccccaugaccgggcccuuaguggcuggcgggcuucucacggucugcuacgugcugaccggccgguccgcggaccuggagcucgagcgcgcagcugacguuaagugggaggaccaggccgagaucagcgggucgagccccauccugagcaucaccaucagcgaagaugguuccaugaguaucaagaacgaggaggaggagcagacccugacaaucuuaauccgaaccggccugcuuguaaucuccgggguguucccgguuagcauccccauuaccgcggccgccugguauuugugggaggucaagaagcaacgcgccggcgugcugugggaugugcccagcccgccacccguaggcaaggccgagcuggaggacggcgcguaucggaucaagcaacgcgggauccugggcuacagccagaucggcgccgggguguauaaggagggcaccuuccacaccauguggcacguaacccgcggggccguccuaaugcaucgcggcaagcggaucgagccauccugggccgacgugaagaaggaccuuaucagcuacggaggcggcuggaagcucgagggggaguggaaggagggcgaggaggugcagguccuugcccuggagcccggaaagaacccccgcgcggugcagaccaagccagggcuuuucaagaccaacaccgggacgaucggcgccguuucccuggacuucagcccggguaccucaggaagcccuaucgucgaccggaagggcaaggugguggggcuguacggcaacggaguugugacccgcuccggcgccuacgugucggccaucgcgcagaccgagaagucaaucgaggacaaccccgagaucgaggaugacaucuuccggaagaagcgucucacgaucauggaccugcaccccggggcugggaagaccaagcgguaccugcccgcgauaguccgcgaggccaucaagcggggccugcgcacccucauucuggccccgacccgcgugguugcggccgagauggaggaggcccugcgggggcuccccauccgcuaccagacgcccgccauccgagccgagcacacaggccgcgagaucgucgaccugaugugccacgcgaccuucaccaugcggcugcuuucacccgugcgugugccgaacuacaaccugaucaucauggacgaggcccacuuuacggaucccgccagcaucgccgcucggggauacaucuccacucgcgucgagaugggggaggcggcuggcaucuucaugaccgccacgccccccgggagccgggacccguucccccaguccaacgcccccaucauggacgaggaacgcgagauccccgagcggagcuggaacuccggucacgagugggugaccgacuucaaggggaagaccgugugguucgucccgagcaucaaggcuggcaacgacaucgccgccugucugcgcaagaacggcaagaaggugauccagcucucccggaagaccuuugacuccgaguacgugaagacgcgcgcuaacgacugggacuucgucguaacgaccgacaucucugagaugggggccaacuucaaggcggaacgggugaucgacccccgccggugcaugaagcccgucauccugaccgacggcgaggagcgcgugauccuggccgggcccaugccggugacccacagcuccgccgcccagcggcggggccgcauuggcagaaaccccaagaacgagaacgaccaguacaucuauaugggagagccccucgagaacgacgaggacugcgcccacuggaaggaggcgaagaugcugcucgacaacaucaacacgcccgaggguaucaucccgagcauguucgagcccgagcgcgagaaagucgacgccauagacggggaguaccggcuccgcggcgaggcccggaagaccuucguggaccugaugcgccgcggggaucuacccguguggcucgcguacagagucgccgcggagggcaucaacuacgccgaucggcgcuggugcuucgacgggaucaagaacaaccagauccuagaggagaacguggaggucgagaucuggaccaaggaaggcgagcguaaaaagcugaaaccgcgcuggcucgacgcccgaauauacuccgacccccuggccuugaaggaguucaaggaguucgccgccggccgcaagagccugacccucaaccugaucaccgagauggggaggcugcccaccuucaugacccagaaggcccgcgacgcccuggacaaccuggccguguugcacaccgcugaggcaggcgggcgggccuacaaccacgcgcuguccgagcugcccgagacgcucgagacccugcugcuccugacccugcucgcgaccgugacgggcggcaucuuucuguuccuuaugagcgggaaaggcauugggaaaaugacacucggcaugugcugcaucaucaccgcauccauccuguugugguacgcccagauccagccgcacuggauagccgccaguaucauccuagaauucuuccugaucguucugcucauccccgagccggagaagcaacguacgccccaggauaaccaguuaaccuacguggugaucgcuauccugacagucguggcugccaccauggccaacgagaugggguuucucgaaaagaccaaaaaggaccugggcuugggcagcaucaccacacaggagagcgagagcaacauccucgauaucgaccugcggccggccuccgcguggacccuguaugcgguggccaccacauucgucacgcccaugcucaggcacagcaucgagaacagcagcgugaacgugucccugacugccaucgccaaccaggcgacuguccugauggggcuuggcaagggguggcccuugagcaagauggacauuggcgugccgcuccucgccaucgggugcuacucccaggugaacccgaucacccugacggccgcccuucuccugcugguagcccacuacgcuaucaucggccccgguuugcaggccaaggccacccgcgaggcccagaagcgcgcagcggccgggaucaugaaaaaccccaccgucgacgggaucaccgugaucgacuuggagcccaucccguacgaucccaaguucgagaagcagcuggggcaagugaugcuccugauccucugcguaacccagguucucaugaugcgcaccaccugggcgcugugcgaagcccugacccucgcaacgggccccaucagcacccugugggaggggaacccuggccgguucuggaacaccaccaucgccgucuccauggccaacaucuuccgcggcagcuacuuggccggggccggccuccucuuuuccaucaugaagaauacgaccaacacccggcgcgguaccggcaacaucggcgagacacugggggagaaguggaagucacgauuaaacgcucuggggaaguccgaguuccagaucuacaagaaguccgggauacaagagguggaccgcacccuggccaaggaggguaucaagcgcggggagacagaucaccacgccgugucccgcggcagcgccaagcuccgaugguucgucgagcgaaauauggugaccccggagggcaagguggucgaccugggcugcggccgaggcggaugguccuacuacugcggcggccugaagaacgugcgugaagugaagggccucacgaagggagggcccgggcacgaggagcccauccccaugagcaccuacggcuggaaccugguccgccugcagucggggguggacguguucuucaccccgcccgagaaaugcgacacgcuacugugcgacaucggcgaguccucacccaaccccacgauugaggccggccgcacccugcguguccugaaccugguggagaacugguugaacaacaacacccaguuuugcaucaagguccucaacccguacaugcccuccgucaucgagaagauggagacccugcagcgcaaguacgggggagcgcucgugaggaacccccuguccaggaacuccacccacgagauguacugggugagcaacgccacgggaaacaucgucuccagcgucaacaugauuucacggaugcugauaaaccgcuucaccaugaaacauaagaaggcgaccuacgagccggacguggaucugggaagugggaccagaaacaucggcaucgaguccgagauccccaaccuggauaucaucgggaagcggaucgagaaaaucaagcaggagcacgagacgagcuggcacuacgaccaggaccaccccuacaagaccugggcauaccacggcuccuacgagaccaagcagaccggcagcgcuuccucaauggucaacgguguggugcgccuccugacgaagcccugggaugucgugccgauggugacccagauggcgaugaccgacacgacgcccuucggucagcagcggguguuuaaggaaaagguggacacccgaacccaggagcccaaggagggcaccaaaaagcugaugaagaucacugccgaguggcucuggaaggagcuggguaaaaagaagacgccccggauguguacccgcgaggaguucacccggaaggugcgcuccaacgccgcccugggcgcaaucuucacugacgagaacaaguggaaguccgcacgggaagccgucgaggacagccgcuucugggagcucaucgaccgggagcgcaaccuucaucuggaggggaagugcgagaccugcguguacaacaugaugggcaagcgcgagaagaaacucggggaguucggaaaggccaaagguucgcgcgccaucugguacauguggcugggggcgcgguuccuggaauucgaggcccucggcuuccugaacgaggaccacugguucagccgcgguaacucccugagcggcgucgagggggagggccuccaccgguuaggguacauacugcgcgacguguccaaaaaggagggcggcgccauguacgcggacgauaccgccgggugggauacccggaucacguuagaggaccugaagaaugaggagauggugaccaaccacaugaagggcgagcauaagaagcuggcggaggccauauucaagcugaccuaccagaacaaggucguccgcgugcagcggcccacgcccagagggacgguaauggacaucaucagccgccgggaccagcgaggcucgggccagguggguaccuauggccugaacaccuucaccaacauggaggcccagcugauccggcagauggaaggggaggguaucuucaagagcauccagcaccucacggugaccgaggagaucgccguccagaacuggcuggccagggugggccgggagcgccugucccggauggcgaucaguggggacgacugcguugucaagccccucgacgaccgcuucgccuccgcccucaccgcccugaacgacaugggcaaggugcggaaggacauccagcagugggagcccagccgcggguggaacgacuggacccagguaccauucugcucccaccauuuucaugaacuagucaugaaggacggacggguacuagugguucccugccgcaaccaggacgagcugaucggucgggcccgcaucucacagggagcugguuggucccucaaggagacggccugccugggcaagagcuacgcccagauguggacccugauguacuuccaccgucgcgaucuccggcuggccgccaacgcaaucugcuccgccgugcccucacacugggugcccacauccaggaccaccuggagcauccacgcaaagcacgaguggaugacgaccgaagacaugcuggcaguuuggaaccgugucuggauccaggagaacccauggauggaagauaagacccccguggagagcugggaggagguccccuaccucggcaagcgcgaggaccaauggugcgggucccuuaucggccuuaccagccgcgccacgugggccaaaaauauccagaccgccaucaaccaggugcggucccucaucgguaacgaggaguacaccgacuacaugcccagcaugaagcgcuuucggcgcgaggaggaggaggccggcgugcugugguga

SEQ ID NO: 25194 - RNA, 9876 nt, Artificial Sequence
  derived and/or modified CDS sequence (opt11) from DENV-2__EU569705__SS-prME
acugccggcgucaucaucaugcucauccccaccgccauggcauuccaccugaccacucggaacggggagccccacaugaucguuggccgacaggagaaggggaagucccugcuguucaaaaccgaggacggagugaacaugugcacgcucauggcaaucgaucugggcgaauugugcgaggauacuauuacguacaaaugcccgcuccugcgccaaaacgaacccgaggacauugacugcuggugcaacagcaccagcacgugggugaccuacggcacaugcacuacgacaggcgagcaccggcgugagaagcgauccguugcccuggugccccauguggggaugggccuggagacccgaaccgaaacguggaugaguagcgagggggccuggaagcauguccagcggaucgaaaccuggauccuacggcacccaggcuucaccaucauggccgcgauccuggccuacaccauuggcaccacccacuuccagcgagcccucaucuucauccugcugacggccguggcgcccaguaugaccaugcggugcaucggcaucuccaaccgcgauuucguggagggcguaucugggggauccuggguggauauagugcucgagcacgggagcugcgugacgaccauggcaaagaauaagccuacccuggacuucgaacuuauaaagacugaggccaagcagcccgcuacccuccgcaaguacugcaucgaagcaaaacugacuaauaccaccacagaaucccggugcccaacgcagggcgagccaagccugaacgaggagcaggacaagagguucguaugcaagcacuccaugguagaucggggcugggggaacggaugcggccucuucggcaaaggugggauaguuacuugcgcgauguucaccugcaagaagaacauggagggaaagguagugcuacccgagaaccucgaguauaccaucgucaucacgccccacuccggggaggagcacgcgguaggaaaugacaccgguaaacauggcaaggagauaaagaucaccccgcaaucuagcaucaccgaggccgaguuaacuggguacggcacggugacgauggaaugcagcccccggaccggccuggauuucaacgaaaugguccugcuccagauggaggacaaggccuggcuggugcaccggcagugguuccuggaucuaccccugcccuggcugccgggcgccgauacccagggcagcaacuggauccagaaggagacgcucgucaccuucaaaaacccccacgcgaagaaacaggacgucgugguucuggggucccaagagggcgcuaugcacaccgccuuaaccggggccaccgagauccagaugagcagcgggaaccuccuauucaccggccaccugaagugccgccugcggauggacaaguuacagcugaaggggauguccuacagcauguguaccggcaaguuuaagaucguaaaagagauugccgagacccagcacgggacgauagucauccgcguccaguacgagggcgacggcucccccugcaagauccccuucgagauaauggaccuugagaagcggcacgugcuggggcgccuuaucaccguuaaccccaucgucgcggagaaagacagccccgugaacaucgaagcggagccgcccuuuggcgacuccuacaucaucauugggguugaacccggccagcucaagcugaauugguucaagaaggggagcuccaucggacagauguucgaaaccacgaugcgcggcgcaaagcggauggcaauacugggggacacggccugggauuucggcagccucgggggcgucuucaccucuaucgggaaagcgcugcaccagguuuucggcgccaucuauggcgccgccuucagcggggugaguuggaccaugaaaauccucaucgggguaaucauuaccuggaucgggaugaacagccgaagcacgagccucuccgugucguuagugcuggucggggugguaacccuguaccuaggggcgaugguccaggcagauuccgguuguguggugagcuggaaaaguaaggaacugaagugcggcagcgggaucuucaucaccgacaauguccacacguggacggagcaguauaaguuccagcccgagagccccuccaagcuggccagcgcuauacagaaagcccacgaggagggcaucugcgggauccgguccgugacacgccuugaaaaccucauguggaagcagaucacccccgaguuaaaccacauucucagcgagaaugaagugaaacugaccauaaugacgggcgacaucaaggguaucaugcaggcuggcaagcggucacugcgcccgcagccuacggagcucaaguauagcuggaagaccuggggaaaggccaagaugcugucuaccgagagccacaaccagacuuuccugaucgaugggcccgagaccgccgagugcccgaacacuaaccgggccuggaacucccuggagguggaggauuacggcuucgggguguuuaccacgaacaucuggcugaagcugcgggagaagcaggacguguuuugcgacagcaagcuaauguccgccgcgaucaaggacaaucgggccguccacgccgauaugggcuacuggaucgagagcgccuuaaacgauaccuggaagauggaaaaggcguccuucaucgagguaaagagcugucacuggcccaagagccacacccuguggagcaacggcgugcucgagucggaaaugaucauaccaaagaacuucgcggggccagugagccagcacaauuacagaccuggcuaucauacccagaccgccgggcccuggcaccugggcaaacuggagauggacuucgacuucugcgaagggacgaccgugguggucacugaggacugcggcaacaggggccccucucucagaacgacgacugccuccgggaagcugaucaccgaguggugcuguaggagcugcacccuucccccucuccgcuaccggggcgaggacggguguugguacggcauggagauucgcccgcugaaggagaaggaggagaaccuggugaacucgcucgugacggccgggcauggccagauugacaacuucucacugggcguucugggcauggcucucuuccucgaggagaugcugagaacacgcguuggcaccaagcacgccaugcuacucguggccgucaguuucguaacucugaucacaggcaacaugagcuuccgugaccucggccgcgugauggucauggugggcgccacuaugaccgacgacauuggaaugggcaucaccuaccuggcauugcuggcggcguucaaggugcgccccacguucgcagccggccuguugcuccggaagcuuacuucaaaggaacugaugauggccaccaucggcaucgcacuccugagccagucgaccauacccgagacgauccuggaacucaccgaugcccuggcacuggggaugaugguucucaagaucgugcgcaacauggagaaguaccagcuagcugugacgaucauggccauuuccugcgucccuaaugcgguaauccugcagaacgccuggaagguguccugcaccauccuggccgccgugagcgugucaccccugcugcucacguccucccagcagaaggcggauuggaucccccuggcacugaccaucaagggccuaaauccaaccgcuaucuucuugaccacgcugagccggacauccaaaaaacggagcuggccgcuaaacgaggccauaauggccgucggcaugguguccauccuggcgaguagccuucuaaagaacgacauccccaugacagggccccucguggcuggcgggcugcucaccgucugcuacgugcugacgggccgguccgcagaccuggaacuugaaagagccgccgacgugaagugggaggaccaggcugaaaucaguggguccagccccauucuguccaucaccaucagcgaggacgguaguaugagcauuaagaacgaggaggaggagcagacccuuacaauacucauccggacgggcuuacuggucauaucagggguguuuccggugagcauccccaucacugccgccgccugguaucucugggaaguuaagaaacagcgcgcgggcgugcugugggacgugccgagcccgccgcccgucgguaaagccgagcuggaggacggcgcuuaccggauuaagcagcgcgguauccuaggcuacucgcagauuggcgccggaguguacaaggaggguacguuccacacgauguggcaugugacccgcggggcgguccugaugcaccgcggcaagcggaucgagccuagcugggcagacgugaagaaggaucugaucagcuacgggggcggcuggaagcucgagggggaguggaaggaaggcgaggaagugcagguacuggcgcuggagccagggaagaacccccgcgccgugcagaccaagcccggucucuucaagacaaacaccgggacaaucggcgcgguaagucuggacuucagccccgggacguccggaagccccauuguugaccggaagggcaagguggugggacuguauggcaauggcgucgugacccgcuccggggccuacgugagcgcgaucgcucagaccgaaaaguccauagaagacaaccccgagaucgaggacgacaucuucaggaaaaagcgccucacuaucauggacuuacacccaggcgccgggaagacaaagcgguacuugcccgccaucguccgcgaggcuaucaagcguggccugcgcacccugauucuggcgccgacgcgcguaguugcugcggagauggaggaggcccugcgggggcuuccgauccgcuaccagacacccgccauccgggcggagcacacgggccgggagaucguagaccugaugugccaugcaaccuucaccaugcgacuucucagccccgugcgcgugccgaacuauaaucugaucauaauggacgaggcccacuucaccgaucccgcuagcaucgccgcgcggggcuauauuuccacgcgcgucgagaugggggaagccgcuggcaucuucaugacggccacgccgccggggucacgggacccguucccccaguccaacgcgcccaucauggacgaggagcgcgagaucccggagcgcagcuggaacagcggacacgagugggugaccgacuucaaggggaaaacggugugguucgucccgagcaucaaagccggcaacgauaucgccgcuugccugcggaagaacggcaagaagguuauacagcuauccagaaagaccuucgauagcgaguacgugaagacccgcgccaacgacugggacuucgucgugaccacggauauuuccgagaugggggcuaacuucaaagcagagagagugaucgacccacgcaggugcaugaagcccgucauccuuaccgacggcgaggagcgcgucauccuggccgggcccaugccgguuacgcacuccucggccgcacaacggcgcggccgcauaggacggaaucccaagaacgagaacgaccaguacauauacaugggcgaaccccucgagaacgaugaggacugcgcgcacuggaaggaggcgaagaugcuacuggauaacaucaacacccccgagggcauaaucccgagcauguuugaaccugaacgcgagaaagucgacgcuauugacggggaguauagacuccgcggcgaggcccggaagacauuuguggaucugaugcgccgcggggaccuacccguguggcucgccuaccgggucgcggccgagggcauaaauuaugcggaccggcgcuggugcuucgaugggaucaagaacaaccagauucuagaagaaaacguggaaguggagaucuggaccaaggagggcgaacgaaagaaacugaagccgcgcugguuagacgcgcggaucuacuccgacccccuggcgcugaaagaguucaaggaguucgcugccggccgcaagagcuugacccuaaaccucaucaccgagauggggcgguuacccacguucaugacccagaaggcccgcgacgcccuggacaaccuggcgguccuccacaccgccgaggccggggggcgggccuacaaccacgcccuguccgagcugccggagacucuagagacgcugcuacuucugacccugcucgcgacuguuaccggcggcaucuuccuguuccugaugagcgggaagggaaucgggaagaugacgcuaggcaugugcugcaucaucaccgccucuauccugcugugguacgcccaaauucagccccacuggauugccgcuagcauaauacucgaguuuuuccugaucguccuucucauccccgagcccgagaagcagcgcacgccccaagacaaccagcugacuuacguggugaucgcgauccugaccgucguugccgccacgauggccaacgagaugggguucuuggagaagaccaagaaggaccugggccuggggagcauugcuacccaggaauccgagagcaacauucuggacaucgaucuacggccggcguccgccuggacccuguacgccgucgcuacgaccuucguuacccccaugcuccgccacagcaucgaaaacaguucuguaaacgugucccugacggcaauugccaaucaggccacgguccuuaugggauuaggcaaggguuggcccuuaucaaagauggacaucggcgugccccugcucgcaaucgggugcuacucccaggugaauccgaucacccugaccgccgcgcugcuacugcugguagcccacuacgccaucaucggccccggccuacaagccaaagccacucgcgaggcgcaaaagcgcgccgcagccggcaucaugaagaaccccacgguggacgguaucaccgugauugaccuggagcccaucccguacgaccccaaguucgagaagcagcuugggcaggucaugcuccugauccugugcgugacccagguccucaugaugcgcaccacgugggccuugugcgaggcguugacccucgcgaccggccccaucagcacccugugggaggguaaucccggccgcuuuuggaacacgacaaucgcagucaguauggccaacauuuuucgcggcagcuaccuggcgggugccggguuacuguuuuccaucaugaagaauaccaccaauacgagacgcggaaccgguaacauuggcgagacccugggugagaaguggaagucccggcuuaacgcccugggcaagagugaguuccaaaucuacaagaaguccgggauccaggagguggaccgcacccuugcgaaggagggcaucaagcgcggugagaccgaucaccacgccguguccagagggagcgcgaagcucagaugguuugucgagcgcaauauggugacccccgaaggcaaagugguugaccuggggugcggacgcggcggguggucuuauuacugcggcgggcugaaaaacgucagggagguaaagggacucacgaagggagggcccgggcaugaagagcccauacccaugucaaccuacggcuggaauuuaguccggcugcaaucagggguugacguauucuucacgccacccgagaagugcgacaccuugcuaugcgacaucggugaauccagccccaaccccaccaucgaagccggccgcacccugcggguccucaaccugguggagaauuggcuuaacaacaauacgcaauuuugcauaaaggugcucaacccuuacaugcccuccgucaucgaaaagauggagacccugcagcgcaaguacgguggugcccuggugcggaacccccuaagcagaaacuccacccacgagauguacuggguuagcaacgccaccgggaacauugucuccagcgugaacaugauuucccggauguugauuaaccgcuucaccaugaaacacaagaaagcuacguaugagccggacguggaccugggaagcggaacccgcaacaucguuauugaguccgagauccccaaccuggauaucauugguaagcggaucgagaagaucaagcaggaacacgaaacgagcuggcacuacgaccaagaucaccccuacaagacgugggcguaccaugguuccuacgaaacgaagcagaccgggagcgccuccagcauggucaacggggugguacgucuccugaccaagccaugggacgucgugccgauggucacucagauggccaugacggacaccacccccuucgggcagcaacggguauucaaagagaagguagacacccgcacgcaggagcccaaagagggcaccaagaagcugaugaagauuaccgcagagugguuauggaaggagcugggaaagaagaagacaccccggaugugcacgcgcgaggaguucacacggaagguccgcucaaaugcggcccugggggccaucuuuacugacgagaacaaguggaaguccgccagggaggccguggaagacuccagguucugggagcugaucgaccgcgagcgcaaccugcacuuagagggcaagugcgaaacuugcgucuacaacaugauggggaagagagagaaaaaacucggcgaguucgggaaggcgaaggggagucgcgccaucugguacauguggcuaggcgcucgguuccuggaguuugaggcccuaggguuccucaacgaagaccacugguucagccgcggcaauucccugaguggcguagagggcgaaggucuucaucggcugggauauauucuucgggacguguccaagaaagaggguggggcaauguacgcagacgauacggcuggcugggacacccggaucaccuuggaggaucuaaagaacgaggagauggucacuaaccacaugaagggggagcacaagaagcuggccgaagccauuuucaaguuaacuuaucagaacaaaguggugcgcguccagcgaccgacgccccggggcaccgucauggacaucaucucccgccgggaccagcgcgguuccggccaggugggcacguacgggcuaaacacguucaccaacauggaagcgcagcugauacgacagauggaaggcgaggggaucuucaaaagcauccagcaccucaccguuaccgaggagaucgcggugcaaaacuggcuagcccgcgugggccgugagcgccugucccggauggcgauaagcggcgacgauugcgucgugaagccccuagacgaucgcuucgcguccgcccuuacggcgcucaacgacauggggaaggugcgcaaggacauccagcagugggaacccagccguggcuggaacgacuggacccagguaccguucugcagccaccacuuccacgagcucgugaugaaggacgggcggguccugguggugccuugccggaaucaggaugagcugaucggccgggcccgcauuagccagggugccggcuggucccucaaggagaccgccugccugggaaagagcuacgcccagauguggaccuugauguauuuucaccggcgcgaccuccggcuggcugccaacgccauaugcuccgcagugccgagccacugggucccaacgucccguaccaccuggagcauccacgcgaagcaugaguggaugaccaccgaggacauguuggccgucuggaaccggguguggauccaggaaaauccuuggauggaagacaagacgcccgucgagagcugggaagaagugcccuaccucggcaaacgcgaggaucaguggugcgguagccugaucgggcugacaagccgcgcgaccugggcaaagaacauucagacggccauaaaucagguuaggucccucaucggaaaugaagaauacacggauuacaugcccagcaugaagcgcuuucggcgggaggaggaagaggcggggguccugugguaa

SEQ ID NO: 25195 - RNA, 9876 nt, Artificial Sequence
  derived and/or modified CDS sequence (opt11) from DENV-2__EU482589__SS-prME
accgccggcgucauaaucaugcugauacccaccgccauggcguuccaccucaccacccgcaacggcgaaccgcacaugaucgucggcaggcaggaaaaggggaagucccuccuguuuaagaccgaagacgggguuaacaugugcacccucauggccaucgaucugggggaacugugcgaagacaccaucacguauaagugucccuuacuccggcagaacgagcccgaggacaucgacugcuggugcaacagcaccuccacauggguuaccuacggaaccugcacgaccacaggcgagcaccggcgagagaagcgcagcgucgcgcugguaccccacguggggaugggccucgagacccgaaccgagaccuggaugagcagcgagggggcauggaagcacguccagcggaucgaaacguggaucuugcgccacccgggcuucacaaucauggcggcaauacuggccuacaccaucggcacaacccacuuccagcgggcgcucauauucauccugcugaccgccgucgcgcccucaaugaccaugaggugcaucgguaucuccaauagggauuucgucgagggugucucgggcggcuccuggguggacaucguucuagagcaugggagcugugucacgacaauggccaagaacaagccaacccuggauuucgaguugaucaagaccgaagccaagcagcccgcgacccuucgcaaauauuguaucgaggccaagcuaacgaauaccacuaccgagagucgcugcccgacccagggcgagcccagccugaacgaggagcaagacaagagauucguuugcaaacacagcaugguggaccgggguuggggaaacggcugcggccuuuucgggaaggguggaaucguaacgugcgcgauguucaccuguaagaagaacauggagggaaagguggugcuccccgaaaaccuggaguacacgauagucauaacaccccacagcggggaggagcacgccguugguaacgacaccgguaaacaugguaaggagaucaagaucacgccgcaaucaagcaucaccgaggccgaguuaacuggauacgguacggugaccauggaguguagcccccggaugggccucgacuucaaugagaugguccugcuucagauggaggacaaggccuggcuggugcaccggcaaugguuccuggaccucccccugccuuggcugccgggggcugauacgcagggcagcaacuggauucagaaggagacccuggugacguucaagaacccgcacgcaaagaaacaggacguugugguucuggggucgcaagaaggcgccaugcacaccgcccugaccggggccaccgagauccagaugagcucaggcaaccuacuguucacuggucacuuaaagugccgcuuacggauggacaagcugcagcuaaaagggauguccuacagcaugugcaccggaaaauucaaaauaguuaaggagaucgccgaaacccagcacggcacgauagugauccgcguccaguacgaaggugacgggucccccugcaaaauucccuuugagauaauggaccucgaaaaacggcaugugcugggucgccuaauaacgguuaaccccaucgucaccgagaaggacagccccgugaacaucgaggcggagccgccauuuggugacuccuacaucauuauagggguugagccuggccagcucaagcugaauugguucaaaaaggguagcuccaucggccaaauguuugagaccaccaugcguggcgccaagcggauggccauccugggugacacggccugggacuuugguucucucgggggcgucuucaccuccauagggaaggcccugcaccagguauucggcgcgaucuacggugccgccuuuagcgggguguccuggaccaugaagauacugaucggcgugauaaucacauggaucgggaugaacagccgcucuacuagccugagcgucucccucguguuggucggcgucguuaccuuguaccucggggccaugguucaggcggacucuggaugcguggugucuuggaaguccaaggagcugaagugcggaagcgguaucuucauuacugacaacguccacacguggacggagcaguacaaguuucagcccgagucacccagcaagcuggccagugcaauccagaaggcucacgaggaggggaucugcggcauccgguccgucacccgccucgagaaccugauguggaagcagauaacgccagagcugaaccauauccuuucagagaacgagguuaaacuuacuauaaugacgggcgacaucaaggggauuaugcaagcuggcaaacgaucccugcgcccacagccuaccgaacuuaaauacagcuggaagaccuggggcaaggcuaagaugcuuucuaccgaaagccauaaccagacguuuuuaauagacggucccgagaccgccgagugcccgaacacgaaccgggccuggaacucccucgaaguggaagacuacggguucgggguguucaccacgaauaucuggcugaaguuacgcgagaagcaggacguguucugugauagcaaacuuauguccgccgccauuaaagacaauagggcgguucacgcugauaugggcuacuggauugagagugcacuaaacgacaccuggaagauggagaaggccuccuucaucgagguuaagucgugccauuggccgaaaucccacacccuguggucuaacggcguccuggaauccgagaugaucaucccgaagaaccuggccgggccuguuagccaacacaauuaccgaccgggguaccacacgcagacagcggggcccuggcaccugggcaagcucgagauggacuuugacuucugcgagggaacaaccguugucguuaccgaggauugcggcaaucggggacccagccugcgaacuacgacggccuccgggaaacucgugaccgaguggugcugccggagcugcacgcuaccacccuugcgguaccggggcgaagaugggugcugguacgguauggagaucaggccgcuuaaggagaaggaggagaaccucgugaacucccuggucacggcagggcacggucaaaucgauaacuuuagucugggcgugcucgggauggcgcuguuccuugaggagaugcuccggacacgugugggcaccaaacacgcgauccuucuggucgccguuuccuucgugacccugaucacugggaauaugucguuucgcgaucucggacgugucauggugaugguaggcgccacuaugacugaugacaucggcaugggcguuacauaucuagcauuauuagccgcguucaaggugcgccccacguucgccgccgggcugcuccuacggaaguugaccuccaaagagcucaugauggccacgaucgggaucgccuuacugucacaauccacaaucccagagacgauucuggaacugaccgacgcguuggcccucgggaugauggugcugaaaaucguacgcaauauggagaaguaccagcuggccgugacaaucauggccauuuccugcgucccaaacgccguuauccuccagaacgccuggaagguaucguguacaauacucgccgccguaagcgugagcccccuguuauuaacgagcucgcagcaaaaggccgacuggaucccucuggcacucaccaucaagggucugaaccccaccgcuaucuuccugaccacgcucagccguaccagcaagaagcguagcuggccgcucaaugaggccaucauggccguaggcauggucaguauccucgcaucuagccuccugaagaacgauauccccaugaccgggccccugguagccggagggcuccuuacuguauguuacguacugacuggccgguccgccgaucuagagcuggagcgcgcugccgacgucaagugggaagaccaagccgagaucagcgguuccagcccuauacugucaaucacaauuucggaggauggcuccaugucgaucaagaacgaagaggaagaacagacacuuaccauucucauccgaacuggccugcucgugaucuccggcgucuuuccggugaguauccccaucaccgcggcagccugguauuugugggaggucaagaagcagcgcgcaggaguccugugggacguuccgagcccgccgccagucggcaaagccgaacucgaggauggggcauacagaaucaagcagagggggauccugggcuacagccagaucggagcagggguauacaaagagggcacguuucacaccauguggcaugugacccggggugcugugcugaugcaucgcggcaagcguaucgaacccuccugggcagacgucaagaaggaucucaucucauaugggggcgguuggaaacuggagggggaguggaaggagggcgaggagguccaggugcucgcccuugagccagggaagaauccccgggcaguccagacgaaacccggucuguucaaaacgaacaccgggaccaucggcgccgugucccuggauuucagcccgggcaccuccggcagccccaucguagaccgcaaggggaagguugugggacuuuacggcaacggaguggucacccgcuccggggcauacguuagugccauagcgcagaccgaaaaguccauugaggacaaccccgaaaucgaggacgacauauuccgcaagaagagacucaccauuauggacuuacaccccggcgccggcaagacgaagcgauaucugcccgccauugugcgggaggccaucaagcggggccuccgcacacugauacuggccccgacccgugugguggcagcggagauggaagaagcccuuaggggacugcccauucguuaucagacgccggcuauaagagcugaacacaccggccgcgaaauuguggaucugaugugccacgccacguucaccaugcgguuacugaguccgguccgagugcccaacuacaaccugaucaucauggaugaggcccacuuuacagauccagcaagcaucgcggcccggggcuacaucuccacacgaguggagaugggggaagcggcuggcaucuucaugaccgccacgccgcccgggagccgggacccguuuccccaguccaacgcccccaucauggaugaggaacgcgagauucccgagcggagcuggaacuccggucacgagugggucacagacuucaaggguaaaacgguuugguucguuccaagcaucaaggcgggcaaugacaucgccgcgugucuacgaaagaacggcaaaaagguaauccaacugucccggaaaaccuucgacagcgaauaugugaagaccagggccaacgacugggacuucguggucaccacggauaucuccgagaugggugccaacuucaaggcggagcggguaaucgacccccgccgguguaugaagccggugauacucacggacggcgaggagcgcgucauccucgcuggacccaugccgguaacccacaguagcgccgcgcagcgucgcggccgcaucggucgaaaucccaagaacgagaaugaccaauacauauacaugggagagccccuggagaaugacgaggacugugcccacuggaaggaggcgaagaugcugcucgacaacaucaacacucccgaaggcaucauuccgucgauguucgaacccgagcgcgagaagguggaugcaaucgacggcgaguaucgccugcgcggcgaggcacggaagacguuugucgaucugaugcgcagaggggaucuccccgugugguuggccuaccgaguggccgcugaagggaucaacuacgcugacagaagguggugcuucgacgguaucaagaauaaccagauccuggaggagaacgucgagguggagauuuggaccaaggagggcgagcggaagaaguugaaaccgcgguggcuugacgcccggaucuacuccgacccucuggcucugaaggaguucaaggaguuugcggcuggacgcaaaucccucacccucaaccucaucaccgagauggggcggcugcccacguuuaugacccagaaagcccguaacgcuuuggacaaucucgccguccugcacaccgcggaggccggcggccgugccuacaaccaugcccugucugaauugcccgagaccuuagagacgcuccuccugcuuacccuccucgccaccgugaccgguggcauauuccuauuccucaugucugggaagggcauugggaagaugacucucggcaugugcugcauaaucaccgcgucuauccugcucugguacgcccagauccagccucauuggauugccgccagcaucauccuggaguucuuucugaucguguugcugauccccgagccugagaagcagcgaacaccacaagacaaccagcugaccuacgucgugaucgcaauccucaccguggucgccgccacgauggcuaacgagaugggauuccucgagaagaccaagaaagaccugggccucgggagcauaaccacucaggaauccgagucuaacauccuggacaucgaccuccgaccggcguccgccuggacucuauaugcgguagccacgaccuuugucaccccuaugcuccgccacucgaucgaaaacuccagcgucaacgucuccuuaacagccaucgccaaucaggcgaccgugcucaugggccugggcaagggguggccccugagcaaaauggacauuggcguccccuuguuagcaaucgggugcuacucccaggucaacccgauaacccugaccgcugcccuccugcugcuuguggcccacuacgcgaucauaggccccggccugcaggccaaagccacgcgggaggcccaaaagcgcgccgcggccgguauuaugaagaaccccaccgucgacggcaucaccguaaucgaccuggagcccaucccguaugauccgaaguuugagaagcagcuuggacaggugaugcugcuuauccucugcguaacccaggugcugaugaugcgcacaaccugggccuuaugugaagccuugacacuggccacagggccuaucagcacgcuaugggaagggaacccuggcagguuuuggaacaccacuaucgccgugucuauggccaacaucuuucgcggguccuacuuagcgggcgccggguuacuguuuuccaucaugaaaaauaccacgaauacuagacgcgggaccgguaacaucggcgagacucuaggugagaaguggaagucaagacuuaacgcucugggcaagagcgaguuucagaucuacaagaaguccgguauccaggagguugaucgcacucucgcgaaggagggaaucaagcgcggggaaacagaccaccacgcuguuuccaggggcuccgcuaagcuacggugguucguggagcgcaacauggugacccccgaaggcaaggugguggaccucggguguggacgcggagggugguccuacuacuguggcgggcucaagaaugugcgugaggugaaggggcuuacaaaaggcgggccugggcacgaggagcccauccccaugucgacguacggcuggaaccuaguucgccuccaaaguggggucgauguguucuucacaccgcccgaaaagugcgacacacugcugugcgauaucggcgaguccagccccaaucccaccaucgaagccggacgcacccucaggguguugaaccuuguggagaauugguuaaacaauaacacccaguucugcaucaagguauugaacccauauaugccauccgugaucgagaagauggagacccugcaaaggaaguacgggggcgcgcuaguucgaaauccccucagccgaaauuccacccacgagauguacuggguaagcaacgcgacggggaacaucgucucaagcgucaacaugauuucccggauguuaaucaauagauucacuaugaagcacaaaaaggccacauacgaaccugauguggaucuugggucugggacccggaacaucggaauugaaagugagauacccaaccuagacaucaucggcaagcggaucgaaaagaucaagcaggagcaugagaccagcuggcacuacgaucaagaccacccuuauaagacgugggccuaccacgggucauacgagaccaagcagaccggcucugccaguagcauggugaacggaguagugcgacuguugaccaagcccugggauguagucccgauggugacacagauggccaugaccgacaccaccccuuucggccagcaacgggucuuuaaggagaaggucgacacucgcacccaggagccgaaagaaggcaccaagaagcuaaugaagauaaccgcugaauggcuguggaaagagcugggaaaggagaagacaccccggauguguacgcgcgaggaguucacccggaaggugcgguccaacgccgcucucggcgccaucuucaccgacgagaacaaauggaaauccgcgcgugaggccgucgaggacagucgcuucugggagcucauugaccgcgaacgcaaucugcaucucgaggggaagugcgagacuugcgucuacaauaugaugggcaagcgggaaaagaagcugggggaguucggcaaagccaaaggcucgcgggccaucugguacauguggcugggggcgcgauuccucgaguucgaggccuuaggcuuucuaaaugaagaccacugguucucacgcgaaaauucgcuuagcgggguugaaggcgaggggcuccaccggcuaggcuacauuuuacgagaugucuccaagaaggaaggcggggccauguacgccgacgacacagcgggcugggauacccggauaacccucgaggaccucaaaaacgaggagauggugacgaaccacaugaagggggaacauaagaagcuagcggaggccaucuuuaaacuuacuuaccagaauaaggugguccgcgugcagcggccgacgccccgcggcaccgugauggacauuaucagccgccgggaccagcgcgguaguggucaaguaggcaccuacggacucaacacauuuaccaacauggaagcccagcucaucaggcagauggagggcgaagggaucuucaagagcauccaacaccugacagccacugaggagaucgcuguccagaauuggcuggcucgcguagggagagagaggcucucacggauggcaaucagcggugacgauugcgucgucaaaccccuggacgaccgguuugccagcgcacugaccgcccucaacgacauggggaaggugcggaaggauauacaacagugggagcccagccgaggguggaacgacuggacgcagguuccguucugcucccaucauuuccaugagcuggugaugaaggacgggcgggugcucgucguacccugccgcaaccaagacgagcucauaggccgagcgagaauuagccagggggccggcuggucauuaaaggagaccgccugucucggcaaauccuacgcccaaauguggacucucauguacuuccacaggcgugaucugagacuagcagccaacgccaucuguuccgcaguacccucgcauuggguuccuacaucccggaccaccuggucgauccacgcgaagcaugaguggaugacgacggaggacaugcucgcgguguggaaccgugucuggauacaggagaacccuuggauggaagacaagacacccgucgaguccugggaggagguuccauaccuugggaagagagaggaccaguggugcggcucccugaucgggcucaccagccgcgccaccugggcaaagaacauccaaacggcuauuaaccaggugcgcagucucaucggcaacgaggaauauaccgacuauaugccuagcaugaaacgcuuccggcgcgaagaggaagaggccgggguucugugguag

SEQ ID NO: 25196 - RNA, 9876 nt, Artificial Sequence
  derived and/or modified CDS sequence (opt11) from DENV-2__EU569706__SS-prME
accgccggugugaucaucaugcugauacccaccgccauggcguuccaccuuaccacccgcaacggggagccgcacaugaucgugggcagacaggaaaaggggaaaucccugcuauuuaagaccgaggacggcgugaacaugugcacccucauggcuauagacuuaggggagcuuugcgaggacacgauuaccuauaaguguccccuccugcggcagaacgaacccgaggacaucgacugcuggugcaacagcaccagcaccugggugacauacgggaccugcaccacgacgggcgaacaccggcgcgagaagcgguccgucgccuuagugccccacguggggaugggccucgagaccagaaccgagacauggaugagcagcgaaggggccuggaaacacguccaacggaucgaaacuuggaucuuacgccaccccggcuucacuaucauggccgcuauccucgcguacaccaucgggaccacccacuuucagcgggcacucaucuuuauucuguuaacagccguggcgccaucuaugacgaugcgcugcaucggcauuuccaaccgggauuucguggaggggguuagcgggggcuccuggguggauaucguucucgagcacgggagcugcgucaccacgauggccaaaaacaaacccacgcuggacuuugagcugauaaagacggaggccaaacagcccgccacauuacgcaaguauugcauugaggccaaguuaacgaacaccaccaccgaaagucggugcccgacucagggggagcccagccuaaacgaggagcaggacaagcgcuucaucugcaaacacucuaugguggaucggggcugggggaaugguugcggccucuucggaaagggcgggaucgugaccugugccauguucacauguaagaagaacauggagggcaagguuguacuacccgaaaaccuagaguacaccaucgugaucacgccgcacagcggcgaggagcacgccgucggaaacgacaccggcaagcacggcaaagagaucaaaaucaccccccaaucgagcauuaccgaggccgaauugaccggguauggcacagugaccauggagugcucaccccggaccggucuggauuuuaacgagaugguguuacuccagauggaagacaaggccuggcugguccaccggcagugguuccuggaucucccgcugcccuggcugccuggggccgacacucaggggucuaacuggauccagaaggaaacgcuagugaccuucaagaauccccacgcgaagaagcaagauguggucguacuggggucccaggagggcgcuaugcacacggcacuuacgggggccacggagauccagaugagcagcggcaaucuccuguucacuggccaccugaagugccggcuccggauggacaagcugcaacugaaggguauguccuacagcaugugcaccggcaaguucaagaucgucaaggaaaucgccgagacccagcacgggaccaucguuauccgcguucaguacgagggcgaugguucccccugcaaaauccccuucgagauuauggaccucgagaagcggcacguacuggggcgccugauaacuguaaaccccaucguggccgagaaggauucgcccguuaacaucgaggccgagccgcccuucggcgacuccuacauuaucaucggcguggagccgggccagcucaagcuaaacugguucaagaaggggaguuccaucggccagauguucgagaccaccaugcgcggcgcuaaacggauggcaauacugggcgauacggcuugggacuuuggcucgcucgggggcgucuucacaucaaucgggaaggccuugcaccaggucuucggcgccaucuauggcgcggccuucagcgggguguccuggacgaugaagauccuuaucggagugaucauuaccuggauuggaaugaacagccgcuccacgagccugaguguaagccucgugcugguaggcguaguaaccuuguaccuggggguaaugguccaggcggacuccggcuguguggugucauggaaaaacaaagagcugaagugcggcuccggaaucuucauuacagacaacguccauaccuggacggaacaguacaaguuucagccugagucccccagcaagcuugccuccgccauucagaaagcacacgaagagggaaucugcgggauacggagugucacccgccucgagaacuugauguggaagcagauaacaccagaacuuaaccauauucuguccgagaacgaagugaagcugacuaucaugacgggcgacaucaaggggaucaugcaggcgggcaaacggagccugcgcccgcaacccacggagcuaaaguauucuuggaaaaccuggggcaaagcgaagaugcugagcaccgagagccauaaucagacguuccuuaucgaugggcccgagacugccgagugcccaaauacaaaucgggccuggaacucucucgagguagaggauuacggcuucgggguguucuccaccaacaucuggcucaagcugcgcgaaaagcaggacguguucugcgacagcaaguugaugucagcggcaaucaaggauaaccgggcgguccacgccgacaugggcuacuggaucgaauccgcacugaaugacaccuggaagauggagaaggccuccuucauugaaguaaaaucgugucauuggcccaagagccauacccuguggagcaacggcguccuugaguccgagaugaucauccccaagaauuucgccgggccgguaagucagcacaauuaccgcccaggcuaucacacccaaaccgcgggucccuggcaccugggcaagcuggagauggacuucgacuucugcgagggaaccacugucgugguaaccgaagacugcggcaaccggggcccuagccuccgcacaaccacggcuuccgguaaguuaauuaccgaauggugcugccggagcugcacccugccuccgcuccgcuaccggggugaggacggguguugguacggaauggagauccgcccgcugaaggagaaggaagagaacuuaguuaacucccuagugacugccggccacggccagaucgacaacuuuagucugggcguucuggggauggcguuauuucuggaggagaugcugcgaacgcgcguggguaccaagcacgcgauccuccuggucgccgucuccuucgugacacugaucaccgguaauaugucauuucgggaccuuggccgggugaugguuauggugggggcuacgaugaccgacgacaucggaaugggcguuaccuaucuggcccuucucgcggcauuuaaaguccgccccacauuugcugccggguuacugcucagaaaacugacuucuaaagagcugaugauggccaccaucggcaucgcccugcugucccaauccacgauucccgagaccauacuggaguuaacggacgcgcuggcccuggggaugaugguccugaagauagugaggaacuuagaaaaauaccaacuugccgucaccaucauggccauaagcugcgugcccaacgcggugauacugcaaaacgcguggaaggucagcugcaccauacuggcagccgugagugucagccccuuacucuugacaagcucccagcagaaggccgauuggaucccgcuggcgcugacaaucaagggccugaauccaaccgccaucuuccugacgacccuuagccguacguccaagaagagaagcuggccgcugaacgaggcgguuauggccgugggaauggucuccauucuggccagcucucugcugaagaaugacauccccaugaccgguccgcugguagcaggcggguugcugacaguguguuacguccuuaccggccgguccgccgaccuggaguuggagagggcggccgacgugaagugggaggaccaagccgagaucagcggguccagcccaauccucuccaucacaauuucagaagaugguuccauguccaucaagaacgaggaagaggagcaaacccucacgauucuuauccguacggguuuguuggugaucuccggggucuucccugucagcauccccaucacugcggcggccugguaucugugggaggugaagaaacagcgcgccggcguacucugggacguaccuucaccgccgcccgucgggaaggccgagcucgaggauggcgcguaucgaaucaagcagcgcgguaucuucggcuacagccagauuggggccggggucuacaaggagggaaccuuccacaccauguggcacgugacccgcggggccgugcugaugcaccgcggcaaacggauagagcccucaugggccgacgucaaaaaggaccugaucagcuaugggggcggguggaagcucgagggagaauggaaggaaggcgaagaagugcaggugcucgcccucgagcccgggaagaacccucgggccguucagacgaaacccgggcuuuucaagacgaacacugggaccaucggcgcugugagccuggacuucagccccggcacaagcgggagcccaaucguagacagaaagggcaaggucgugggacuguacggaaacgggguggucacgcgcuccggggccuauguuucggccaucgcgcagacugagaaguccaucgaggacaaccccgagaucgaggacgacaucuuucggaagaagcgccuaacgaucauggaccugcaccccggcgccgggaagacuaagcgguaccugcccgccaucgugcgcgaggccaucaagcggggauuacgcacgcucauccuagccccgaccagagucguagcggccgagauggaggaggcgcuccgggggcucccgauucguuaccagacccccgccaucagagccgagcacaccggccgcgaaaucguggaccugaugugucacgcgacguucaccaugcggcuguugucccccguccgcgugccuaacuacaaccugauuaucauggaugaggcccauuucaccgacccagccaguauagccgcccgcgguuacaucuccaccaggguggaaaugggggaggcagccggcaucuucaugacggcuacgccgcccgggagcagagaccccuucccccaaucuaacgcccccaucauggacgaggagcgcgagauccccgagaggucuuggaauuccggccacgagugggucaccgacuucaaggggaagacaguuugguuugugccgucaaucaaggcgggcaacgauaucgccgccugccuucggaaaaacgguaagaaggucauccagcucucccggaagacguuugacucugaguacgugaaaacccgcgccaacgacugggauuucguggucaccaccgacaucuccgaaaugggggcuaauuuccgggcagaacggguuaucgaccccaggcguuguaugaaacccgugauccugacggacggcgaggagcgggucaucuuagcagggcccaugccgguuacacacucaagugccgcccaaagaagaggccggaucgggcgcaaccccaaaaacgagaacgaccaguacauuuacaugggcgaaccccuggagaaugacgaagauugcgcgcacuggaaggaggcgaagaugcuucuggacaauauuaacaccccggagggcaucaucccgagcauguucgagccagagcgggagaagguggacgcuauugacggggaguauagacuccggggagaagcaaggaaaaccuuugucgacuugaugcgacgcggcgacuugcccguguggcucgcuuauagagucgccgcggagggcaucaacuacgccgaucgccggugguguuucgacgggaucaagaacaaccagauccuggaggagaacguggagguggagaucuggacgaaggagggcgagcggaagaaacuaaagccacgguggcuugacgccagaauauacuccgacccgcuggcccugaaagaguucaaggaguucgcggcuggccgcaagucccuuacuuuaaaucugauuacggaaauggggcgccugcccaccuucaugacgcaaaaggcacgggacgcacuggacaaucuagccgugcuacacaccgcggaagugggagggcgcgccuacaaucacgcccuguccgagcugcccgaaacccuagaaacccugcuucugcugacgcuucucgccacagugaccggcggcauuuuccucuuucugauguccggaaagggaaucgggaaaaugacccucggcaugugcugcauuaucacggccucaauccugcuuugguacgcacagauccagccccacuggaucgccgccagcaucauacucgaguucuuccugaucguccugcucauucccgagcccgagaagcagaggacgccccaagauaaccagcugacguauguggugaucgccauacuuaccguaguugcagcuaccauggccaacgaaaugggguuucucgagaagaccaagaaggacuugggacugggcaguaucaccacccaggagucagagagcaauauacucgacaucgaccugagaccugccagcgccuggacccuguacgccguggcgacgaccuucgucacgcccaugcuccggcacucuaucgagaacucuagcguaaacguuucccucaccgcuaucgcgaaccaagccacgguccugauggggcuuggccgaggguggccgcucaguaagauggacaucggcguuccccugcuagcgauuggcugcuacucccaggucaauccgaucacccugacugcggcgcuacuccugcuggucgcccauuacgcgaucaucgggccaggccuccaggcgaaagccacuagggaggcccagaagcgggcagcugcugggaucaugaagaacccgacggucgauggcaucaccgucaucgaccuggaacccaucccguacgauccaaaguucgagaagcagcuggggcaggucaugcuacugguacuaugugugacucaaguacucaugaugaggaccaccugggcccugugcgaggcccucacucucgccaccggucccauaagcacccugugggaggggaacccuggccgauucuggaacacgaccaucgccguguccauggcgaacaucuucagaggcagcuaccuggccggugccggacuccuguucucgaucaugaagaacacuacgaacacccgacgcggaacuggaaacaucggcgaaacacuuggggagaaguggaaaucaagacucaacgcccugggaaaauccgaguuccagauuuacaaaaaguccgggauccaagagguggaccgcacccuggcgaaagagggcaucaaacgcggggaaacagaccaccacgcggucucacgcggcagugccaagcucagaugguucguggagcgcaauauggugaccccugagggcaagguugucgaccuagggugcggucgcggggggugguccuacuacugcggugggcugaaaaauguaagagaagucaagggucucaccaagggagggccggggcacgaggagccgauccccaugagcaccuacggauggaaccuggugaggcugcaguccggaguggaugucuucuuuacuccgcccgagaagugugacacccucuuaugugacaucggcgaguccucgcccaaccccacgaucgaagccggccgcacccugcgggucuuaaaccugguggagaacuggcucaacaacaacacccaguucugcaucaaaguuuugaauccauacaugcccuccgugaucgagaagauggaaacucugcaacgcaaauacgggggcgcgcuggugcggaauccucugagccguaacuccacucacgagauguauugggucaguaacgcuaccgggaacaucguguccaguguuaacaugaucucccguaugcugaucaaccgguuuaccaugaaacacaagaaggccaccuacgaaccggauguugaucugggcagcgggacccgaaacaucgguauagagaacgagauacccaaccuggacaucaucggcaagagaauugagaaaaucaagcaagagcacgagaccagcuggcacuaugaucaggaccacccguacaagaccugggccuaccacgggagcuacgagacgaagcagaccggauccgcgagcuccauggugaacggggugguucggcuuuuaaccaagcccugggacguggugccgauggucacccagauggccaugacggacaccacaccauucggccaacaacggguguucaaagagaagguggauaccaggacgcaggagcccaaagagggcacgaagaagcugaugcggaucaccgcggaaugguuauggaaggaacuggggaagaagaagacgccccggaugugcacgcgugaggaguucacccgcaaaguccgcagcaacgccgcccugggagcgaucuuuaccgacgagaacaaguggaaguccgcgcgcgaggcggucgaggacagccgguucugggagcucguggaucgcgaacggaaccugcaucuagaggggaaaugcgaaaccugcgucuacaacaugaugggcaagcgcgagaagaagcugggcgaguucggcaaggccaagggcucgcgggccaucugguacauguggcugggugcacgauuucuggaauucgaggcguugggcuuccugaacgaagaccacugguucagccgggggaacagcuuauccggaguggagggggaggggcuccauaagcugggcuacauauuacgagacguauccaagaaagagggcggcgccauguacgcugacgacacggcaggcugggacacccggaucacgcucgaggaccuuaagaacgaggagauggugaccaaccacaugaaaggagagcacaagaagcuggcugaggcaauuuucaagcuuaccuaccagaacaaaguagucaggguucagcgcccgacgccgcgcgggacggugauggacaucaucucccguaaggaucagcggggaucuggccaggucgggaccuauggucugaacacguucaccaacauggaggcccaacugauccgacagauggagggugagggcaucuucaaguccauccagcaccucacggugaccgaggagaucgccgugcaaaacuggcuggcaagggucggucgcgaaaggcugagcagaauggccauuuccggggacgacugcgucguuaagccccucgacgaccgguuugcgagcgcccugacggcccucaaugacaugggaaagguccgcaaagacauccagcagugggagcccagucggggguggaacgacuggacccaagugcccuucuguagccaccacuuccacgaacucgucaugaaggacggacgcguccugguagugccuugcaggaaccaagacgagcuuaucgggagagcccggauaucccagggcgccggguggagccucaaggagacggcaugccuggggaaaucguacgcccagauguggacacugauguacuuccacagacgggaccuccgcuuagccgccaacgccaucugcagcgcaguccccagucacuggguccccacgagccgaaccaccuggucaauccacgccaagcacgaguggaugaccaccgaggacaugcuagcgguguggaacagggucuggauccaggagaacccauggauggaggacaagacgccaguggagagcugggaagaggugccauaccucggcaagcgcgaggaucaauggugcggcucacugauaggccugacuagccgggccacuugggcaaagaacauccaaacagcuaucaaccaggugcgcagccucaucgggaaugaggaauacacggacuacaugcccuccaugaagcgguuccguaaggaggaggaggaggccggaguccugugguga

SEQ ID NO: 25197 - RNA, 9876 nt, Artificial Sequence
  derived and/or modified CDS sequence (opt11) from DENV-2__EU569707__SS-prME
accgcggggguaaucaucaugcucauccccacagccauggcuuuccaccucaccacccgcaacggggaaccccacaugaucguaggucggcaagagaaggggaagucccugcuguucaagaccgaagacggagugaacauguguacccucauggccaucgacuuaggggagcugugcgaagauaccaucaccuacaagugcccccuccugaggcagaaugagcccgaggacaucgacugcuggugcaacagcacgagcaccugggugacguacgggaccugcaccacaacaggugagcaucggcgcgagaagcggucaguugcccuggugccccacguggggaugggccuugagacccgcacugagaccuggaugagcagcgagggggcuuggaagcacguccagcggaucgagaccuggauucugcgucacccgggcuuuaccauaauggccgcgauccuugccuacaccaucggaacuacccauuuucagcgugcuuuaaucuucauccugcugaccgccguggcgcccagcaugacaaugcgcugcauagggaucagcaaccgggacuuuguggagggcgucagcgguggcuccuggguagacaucguacucgagcacgggagcugcgugaccacuauggcaaagaacaagcccacccuggacuucgagcugaucaagaccgaagccaagcagcccgccacccuccguaaguacugcguugaggcgaagcugacgaacaccaccaccgagucccggugcccgacgcagggcgagccaagccugaacgaggagcaggacaagcgcuucgugugcaagcacuccauggucgaccggggcugggggaauggcugcggacucuucggcaagggagggaucgugaccugcgcgauguucacuugcaagaagaacauggagggaaaggugguccugcccgaaaaccucgaguacaccaucgugaucacgccccacagcggugaggagcaugccguggguaacgacaccgggaagcacggcaaggagaucaagaucaccccgcaguccagcauaacugaggccgagcucaccggauacgguacggucaccauggaaugcagcccccgcaccggccucgauuucaacgagaugguguugcuccggauggaggacaaggccuggcuggugcaucgccagugguucuuagaccucccccugccauggcucccgggggcggacacccagggcagcaacuggauccagaaggagacgcucgucaccuucaagaacccccacgcgaagaagcaggacgugguggugcuggggucccaagagggugccaugcacaccgcccugaccggggcgacggagauccagaugagcucuggcaaccuccuguuuaccggccaccugaaaugccggcuccgcauggacaaacuucagcugaaggggauguccuacagcaugugcacagggaaguucaagaucgugaaagagaucgccgagacgcagcacggaacgauugucaucaggguacaauacgagggcgacggcucccccugcaagauucccuucgagauaauggaccucgagaagaggcacgugcuggggcgucugaucacugucaacccgaucguggcagagaaggacagccccgucaauaucgaggccgagccgcccuucggcgacuccuacaucaucauaggcgucgagccgggccagcucaaacuuaacugguucaagaaggggucguccauaggccagauguucgagaccacgaugcggggcgccaagcgcauggccauccugggggacacggcaugggacuucggcagccucgggggcguguuuaccucgauagggaaagcguuacaccagguguucggggccauauauggcgcugccuucagcggggucuccuggaccaugaagauccugaucggcgugauaaucacauggaucggaaugaacagccgguccacgagccucuccgugagccucguccuggugggcguugucacccuguaccucggcgcgauggugcaggccgauuccggcugcguggucagcuggaaguccaaggagcugaaaugcggcagcgguaucuucaucaccgauaacguacacaccuggacagagcaguacaaguuccagccggagagccccuccaagcuggccagcgccauccagaaggcucacgaggagggaaucugcggcauccgcagcgugacacggcucgaaaaucugauguggaagcagauaacccccgagcugaaccacauccucagcgaaaacgaagugaagcugaccaucaugaccggggauaucaagggcaucaugcaagcaggcaagcgcucccugcggccccagccgacagagcucaaauacagcuggaagaccuggggcaaagccaagaugcugucuaccgagagccacaaccaaacguuccugaucgacgggccggagaccgccgagugcccgaacacuaaccgcgccuggaacucccucgaaguggaagacuacggcuucgggguguucacuacgaacaucuggcugaagcugcgggagaagcaggacgucuucugcgacagcaagcucauguccgccgcgaucaaggacaaccgcgccgugcacgccgauauggguuauuggaucgagucugcccugaacgacaccuggaagauggagaaggccagcuucauagaggucaagagcugccacuggcccaagucacacacucugugguccaacggugugcucgagagugagaugaucauccccaagaacuucgcgggucccguaucacagcacaacuaccggccgggcuaccauacccagaccgccgggcccuggcaucugggcaaacuggagauggacuucgacuucugcgaagguacgaccguaguggugaccgaggauugcggcaaucgcggccccagccuccggaccacgacagcuuccgggaagcugaucaccgaguggugcugucgcagcugcacccugccaccccuccgguaccgcggcgaagacgggugcugguacggcauggagauccggccccugaaggagaaggaggagaaccuggugaacuccuuggucacggcagggcacggccaaaucgacaacuucagccugggcgugcuggggauggcccucuuccuugaggaaaugcugcgcacccggguuggcaccaagcacgccaugcuucugguugccgugucauuugugacacucaucacggggaauaugaguuuccgcgaccucggccgcgucauggucauggugggagccacuaugaccgacgacaucgggaugggcaucacauaccuugcccugcucgcggccuucaagguccggccgacguucgccgcugggcugcugcuccguaagcugaccucaaaggagcugaugauggcgaccaucgguaucgcacugcugagccaauccacuauccccgagacgauccuggaguuaaccgacgcccuggcccugggcaugaugguguuaaagaucgugcggaauauggagaaguaccaguuggccgucaccaucauggcaauaaguugcguaccgaacgcggugauccugcagaacgccuggaaagucucaugcaccauccucgccgccguaagcgucucuccccugcugcucacgagcucccagcagaaggcugacuggaucccccuggcccugaccaucaaaggccugaaccccaccgcgaucuuccuaaccacguugagccgcacguccaagaagcguucguggccgcucaacgaggccaucauggccgugggcaugguaaguauucuggcgagcagccuguuaaagaacgacauccccaugacugguccccuggucgccggagggcugcucaccgugugcuacgugcugacgggccgcuccgccgaccuggagcucgagcgggccgccgacgugaaaugggaggaccaagcggagauuagcgguuccagccccauccuuuccauuaccaucagcgaagauggcuccaugaguauuaagaacgaggaggaggagcagacccugacaauucucauacgcacgggccugcuggugaucuccgguguguucccggugagcauuccgaucaccgcggcggcaugguaccucugggaggugaagaagcagcgggcuggcgugcugugggacguccccagucccccgccuguggggaaggcggagcuagaagacggcgccuaccguaucaagcaacggggcauucucggauacagccagauuggcgcugggguguacaaggagggcaccuuccacaccauguggcacguaacccgcggggccguccuaaugcaccggggcaagcgcaucgagccuucuugggccgacgugaagaaggaccugaucagcuacggggguggcuggaagcucgaaggggaauggaaggagggcgaagagguccaggugcuggcccuggagcccggaaagaacccucgggccgugcagacgaagcccggccucuucaagaccaacaccgguacaaucggcgccgucagucuggacuucagcccgggcacgucagggucgcccaucguggaccgcaaggggaagguggucgggcucuauggcaauggcguggugacccgauccggggcuuacgugagcgcgaucgcgcagaccgagaaauccauugaggacaaccccgagaucgaggacgacauuuuccgcaagaaacggcucaccaucauggaccuccacccgggcgcgggaaagacgaagcgcuaccugcccgcaaucgugcgggaagcaaucaagcgcggacugcgcacucucauccuggcgccgacacggguggucgccgccgaaauggaggaggcgcugagggggcucccuauccgauaccagacgccagccauccgcgcggagcacacgggccgggagaucguggaccugaugugccacgccacuuucaccaugcgcuuacucucgcccguccgagucccgaacuacaaccugaucaucauggacgaggcccauuucaccgaccccgccagcaucgccgcgaggggguacaucuccacacgggucgagaugggggaggcggccggaaucuucaugaccgccacgccgccggggagccgugacccguucccccaguccaacgcgcccaucauggacgaggagcgggagaucccggaacgcagcuggaacaguggccacgagugggugaccgacuucaaggggaagacgguuugguuugugccguccaucaaggccgguaacgacaucgccgccuguuugcggaaaaacggcaagaagguaauccagcucucccgcaagaccuucgacagcgaguacgucaagacccgggccaacgacugggacuucguggugaccacggacaucuccgagaugggggcgaauuucaaggccgaaagggucaucgacccccggcgcugcaugaaacccgugauccugacagauggagaggagcggguaauccuggcugggcccaugccggugacccauagcuccgccgcccagcgccgcggccggaucgggcgcaaccccaagaacgagaacgaccaauacaucuacaugggcgagccccucgaaaacgacgaggacugugcccacuggaaggaggcaaagauguugcuggacaauaucaacacacccgagggcaucaucccgagcauguucgagccggagcgggagaagguggacgccauagauggggaauaccgccuccgcggggaggcccgaaaaacguuuguggaccugaugcggcgcggggacuugcccgucugguuggccuaccggguggcggcagaaggcauuaacuacgccgacagaagguggugcuuugacgggaucaagaacaaccagauccuggaggagaacguugaggucgagaucuggaccaaggagggcgagcgaaagaaacugaagccgcgauggcuggaugcccgcaucuacuccgacccccuagcguugaaagaguucaaggaguucgccgcuggccggaagucccugacgcugaaccugaucaccgagauggggcgccuccccacguucaugacgcagaaggcccgggacgcacuggacaaucuggcggugcuccacaccgccgaggccgggggacgcgccuacaaccacgcccuguccgagcugcccgagacccucgagacgcugcugcuacugacccugcucgcuaccgucaccggcggcauuuuccuguuccugaugagcgggaagggcauaggcaagaugacacucggcaugugcugcaucaucaccgccuccauucugcuaugguaugcccagauccagccgcacuggaucgccgcgagcaucauccucgaguucuuccuaaucgugcuccucauccccgaacccgaaaagcagcggacuccgcaggauaaccagcugacuuacguugucaucgcaauccugaccgugguggcugcuacuauggccaaugagaugggguuuuuggagaagaccaaaaaggaccugggcuuggguagcaucgccacccaggaauccgagaguaacauccucgacaucgaccugcgcccggcgucagccuggacccuguacgccgucgccacaaccuuugugaccccuaugcuccgccacucaauagagaacuccagcgucaaugucucccugaccgcgaucgccaaccaagccacggugcugauggggcucggcaagggguggccacugagcaagauggacaucggcgugccgcugcucgcuaucggaugcuacucacagguaaacccgauuacccuuaccgccgcccugcuccugcugguggcccacuacgcuaucaucggcccuggccuccaggccaaggccacccgggaggcgcagaagcgagcugccgccggaaucaugaagaaccccacaguggacggcaucaccgucaucgaucuggagcccaucccguacgaccccaaguucgagaagcagcugggccagguaaugcuccuaaucuuaugcgugacucaagugcugaugaugcggaccacaugggcucuuugcgaggcucugacccuggcuaccggucccaucagcacacugugggaggggaacccgggccgcuucuggaauacgacuaucgccguguccauggccaacaucuuccggggcuccuaccuggcgggggcugggcuacuauuuuccaucaugaagaacaccaccaauacgcgccgggggacuggcaacauaggugagacccugggagaaaaauggaaguccagacucaaugcccuggggaaauccgaguuccagaucuacaaaaagagcgggauccaggagguggaccggacccuagccaaggagggcaucaagcgcggggagacggaccaccacgccgucucccggggaagcgcgaaacuucgcugguucguggagcggaacaugguuaccccggagggcaaggucguugaccuagggugcggccgcgguggcugguccuacuacugcgggggacugaaaaauguaagggagguuaagggccucaccaagggcgggccagggcacgaggagcccauccccaugagcacauacggcuggaaucuggugcgccugcagagugguguggacgucuucuucacgccgcccgagaagugcgacacccuucugugcgacaucggagaguccagccccaaccccaccauagaggccggccggaccuugcgcguacucaaccugguugagaacuggcugaacaacaacacgcaguucuguaucaagguccuaaacccguacaugcccuccgugaucgagaagauggagacccugcagcggaaguacgggggagcccugguucgcaacccccugagccggaacuccacccacgagauguacuggguaagcaacgccacggguaacauagucuccagcgucaacaugaucucccgcauguugaucaaccgcuucaccaugaagcacaagaaggcaacguacgagccggacguugaccugggcagcggaacccggaauaucggcaucgagagugagauccccaaccuggacauuaucggaaagaggaucgaaaagaucaagcaggagcacgaaacaagcuggcauuacgaccaggaccaccccuacaagacaugggcguaucacgggucauacgagacgaaacagaccggcagugccuccucgauggugaacggggugguccggcucuuaacuaagcccugggacgugguucccauggucacacagauggccaugacggacaccacccccuucggccagcagcguguguucaaggaaaaaguggacacacggacgcaagagcccaaagagggcaccaaaaagcugaugaagaucacugccgaauggcuauggaaagaacugggcaagaagaagacgccucgcaugugcacccgggaggaguucacgcgcaaggucagauccaacgccgcgcugggcgccaucuucaccgacgagaacaaguggaaaagcgcccgggaggcgguagaggacucccgguuuugggagcucaucgaccgggagcggaaccuccaccuggaggggaagugcgagaccugcguauacaacaugaugggcaaacgcgagaaaaagcucggagaguucggcaaggcgaagggcagccgggccaucugguacauguggcugggggcccgcuuccuggaguucgaggcauuaggcuuccugaacgaggaccacugguuuagcagggggaacucccugagcggcgucgagggggagggccugcaccgccugggguacauccuucgcgacguguccaagaaggagggcggggccauguacgcggaugacacagccgguugggacacccggaucaccuuggaggaccuuaagaacgaggagauggugaccaaccauaugaagggcgagcacaaaaagcuggcggaggcgaucuucaagcucacguaccagaacaaaguuguccggguccagcgcccaacgccccgcggaaccgugauggacaucaucagccggcgcgaccagcggggcucgggccagguggggaccuacggccugaauaccuuuacaaacauggaggcgcagcugauccgccagauggagggagagggcaucuuuaagucuauccagcaccucaccguuaccgaggagaucgcggugcagaauuggcuggcccgggugggccgcgagcgacugucccgcauggccaucagcggggacgacugcguugugaagccgcucgacgaccgguucgccuccgcccugaccgcccugaacgacaugggcaagguacguaaggacauccagcagugggagcccucacggggguggaacgacuggacccaggucccauucugcucccaccacuuccacgagcucgugaugaaggacggcaggguccuugucgugccgugcaggaaccaggacgaguuaaucgggcgcgcucggauuagccagggcgcuggauggucucugaaagagaccgccugccugggcaagagcuacgcgcagauguggacccugauguacuuccaccgccgugaccuccgccuggcggcgaacgccaucugcuccgccgugcccucucacuggguccccacgagucgcaccaccuggagcauccacgccaagcacgaguggaugacaacugaggacaugcuggccgucuggaaccgcguguggauccaagagaacccguggauggaagacaagacgcccgucgagagcugggaggaggugcccuaccucggcaagagggaggaccaguggugcgggucccucaucgggcugaccagccgagccaccugggcuaagaacauccagaccgccaucaaccaggugcgcucucuaaucgggaacgaagaguacaccgacuacaugccaagcaugaagcguuuccgccgggaagaagaggaggcgggcguccugugguag

SEQ ID NO: 25198 - RNA, 9876 nt, Artificial Sequence
  derived and/or modified CDS sequence (opt11) from DENV-2__EU660399__SS-prME
accgccggggucauaauaaugcugaucccgaccgccauggcguuccaccucaccacacgcaauggggaaccacacaugaucgucgggcggcaggaaaaagggaagucccugcuguucaagaccgaagauggcgugaacauguguaccuuaauggcuaucgaucugggugagcugugcgaagacaccaucaccuacaagugcccccuccugcgccagaaugagcccgaagacaucgacugcuggugcaacagcaccagcacgugggugaccuaugguacaugcaccaccacgggggagcaccgccgcgagaaacgguccguugcccuggucccccacguggggaugggcuuggagacacgaacugaaacguggaugagcagugaaggggccuggaagcacguccagcggaucgaaaccuggauccugcgucacccgggguucacgauaauggcggcgauccuggcguacacuaucgggaccacccauuuccagcgugcacuuaucuucauccugcugaccgccguagcgcccagcaugacaaugcgcugcaucggcauuagcaacagagacuucguggaggggguuucaggaggaucaugggucgacaucgugcucgaacacgggagcugcgucacgacgauggccaagaauaaacccacccuggauuucgaacugaucaagaccgaagcgaagcagcccgcaacccuccgcaaauacugcaucgaggcuaagcugaccaauacaacaaccgagucccgaugcccuacgcaaggcgagccuucccugaacgaggaacaggacaaacgcuuuguuugcaagcacuccaugguggaccggggcugggguaauggauguggauuauucggcaagggcggaauugugacaugcgcuauguucacgugcaagaagaacauggagggcaagguagugcugcccgagaaccuggaguauacuaucgucauuacgccccauagcggggaggaacacgccgugggcaacgauacagggaagcacgguaaggagaucaagaucacgccgcagaguaguauuacugaggcagagcucaccggguacggcacggucacgauggaaugcagcccacggaccggccuggacuucaacgagaugguccugcuccagauggaggacaaggcauggcugguucaucggcagugguuccuggaccuaccccugccuuggcuaccaggggcugacacacagggcagcaacuggauccagaaggaaacgcuuguuaccuuuaaaaacccucacgcuaagaagcaggacgucgugguccuugggucccaggagggcgcgaugcacaccgcucugaccggggccacggagauccagaugagcagcggcaaccugcuguucaccggccaccugaagugccgccuccggauggacaagcugcagcugaaggggauguccuacuccauguguacaggaaaauuuaagaucguaaaggagaucgcggagacccaacaugggacgauaguuauccggguccaguacgaaggcgacggcucccccugcaagauucccuucgagaucauggaccucgagaaacggcacguccuggggaggcugaucacagugaacccgauuguggcugagaaagauagccccgugaauaucgaagccgaaccgccuuucggagacucguauaucaucaucgggguggagccuggacagcuuaaacuuaauugguuuaagaaggggagcucuaucggccagauguucgaaaccacaaugcgcggcgccaagcggauggccauccuaggggacacugccugggauuucggcagccucgggggcgucuucaccuccauagggaaggcacugcaucagguguuuggcgccaucuacggggccgccuucagcggagucuccuggacaaugaagauucugauuggagucaucaucacauggaucggaaugaacucucgcuccacgagccugucagucagccucgugcuggucggcguggugacccuguaccucggggcgaugguccaggccgauuccggcuguguggugucuuggaaauccaaagagcuaaagugcggcagcgggaucuucaucacggacaaugugcacacuuggacugagcaauacaaguuccagcccgaaagccccuccaagcuagccagcgccauccagaaagcccacgaggaaggcaucugcgggaucagguccgugacacgccuugagaaccugauguggaagcaaaucacuccagaacugaaccacauucucuccgagaaugaggugaagcugaccauuaugacgggcgacaucaaggggaucaugcaggcgggcaagcggucccugcgcccgcagcccacugagcucaaguacucguggaagacuuggggcaaggccaaaaugcuguccaccgagagccauaaucagacuuuccugaucgacgggccggagaccgccgaaugcccgaacaccaaucgggccuggaacaguuuggagguugaggacuacggcuuuggcgucuuuaccacuaacaucuggcuaaagcugcgcgagaaacaagacguguucugcgacagcaagcucauguccgccgcgaucaaggacaaccgggccguacacgccgacaugggcuacuggauugaaagcgcccuuaaugacacuuggaagauggagaaggccucuuuuauagaggucaagucuugccacuggcccaagucccacacccuguggucuaauggcguguuggaguccgaaaugaucaucccgaagaacuucgcagggcccgucagccaacacaacuaucgcccuggcuaccacacgcagacagcggggcccuggcaccuggguaagcuggagauggauuucgauuucugcgaggguacgaccguuguggugaccgaagacugcggcaaucgugggcccagccucaggacaacgacagccuccgggaaacuaauuacagaguggugcugccgguccugcacccugcccccacugcgauaccggggugaggacgggugcugguauggcauggagauucgcccccugaaagagaaagaggagaaccugguaaacucccuggugacggcgggacacggccagaucgauaacuucagccuaggcguacuggggauggcccucuuccuggaggagaugcuacggaccagagugggcaccaaacaugccaugcuccugguggccguauccuucgugacacugaucacggggaacaugagcuuccgggaccuugggcgggugauggucauggugggggcaaccaugaccgacgacaucggcaugggcauaacguaucuggcgcugcuagcggccuucaaagugcgccccaccuucgcugccggucugcugcugcggaaacugaccuccaaggagcugaugauggcuaccaucggcaucgcgcuccugagucaguccaccauaccugagacgauacuagagcuuaccgacgcccuggcccuggggaugaugguacugaaaaucgugcgcaacauggaaaaauaccagcuggccguaaccauaauggcuauuucuugcgucccaaacgcggugauucuccagaacgcauggaagguauccugcaccauacucgccgccgucaguguuagcccccuacugcucacguccucccagcagaaggcggacuggauaccccuggcccugacaaucaaaggccuuaacccuaccgccauuuuucugacgacgcugagccguaccuccaaaaagcgcaguuggccgcucaacgaggccgucauggccguugggaugguguccaucuuggccucgaguuuacuaaagaacgacauacccaugaccgggccccuggucgcaggcgggcugcucaccgugugcuacgugcugacggggcgguccgcagaccuggagcucgagcgugccgccgacgugaagugggaggaccaagcggaaaucagcggcucuagccccauuuuguccaucaccaucucugaggacggcuccaugagcaucaaaaaugaggaggaggagcagaccuuaaccaucuuaauuaggacgggacugcugguaaucucggguguauuccccgucaguauacccaucaccgccgcagcaugguaccuuugggaggugaagaagcaacgcgccggcgugcugugggacguuccaagcccgccgcccguggggaaagcggaguuagaggauggcgccuaccggauaaagcagcgcgggauacucggcuauagccagaucggcgcagggguguacaaggagggcacguuccacaccauguggcauguuacccgcggggcggugcugaugcacagagguaaaagaaucgagccgucgugggcugaugugaagaaggaccugauaucguaugggggcggcuggaagcucgagggggaauggaaggagggcgaggaaguccagguauuagcgcuggagcccgggaagaacccccgcgccguacagacaaagcccggacucuuuaagaccaacacagguaccaucggugccguaucccuggauuucagcccagguacguccgggagucccauuguggaccgacaggggaaagugguugggcuuuacggcaacgggguugugacucgcuccggggccuacgucagcgcgaucgcccagacggagaaaaguaucgaggacaaucccgagaucgaggaugauaucuuccgcaagaagcgccuuacaauuauggaccugcacccuggcgcggggaagacgaagaaguaccugcccgccauagugcgggaagcgauaaagcgcggccugcggacccucauccuggcuccgacccgcguggucgccgccgagauggaggaggcccugcgcggacucccuauccgcuaccagacccccgcuauccgcgcugaacacacgggaagggaaaucguggaccugaugugucaugccaccuucaccaugcgauugcucucccccgucaggguaccuaauuacaaucugauuaucauggacgaggcgcacuucacagaccccgcgucaaucgcugcccgcggauauaucuccacgcggguggagaugggggaagccgccgggaucuucaugacggcgacgccgccagggagccgcgacccauucccucagucuaacgcgccgauaauggacgaggagcgcgagauccccgagcgcagcuggaacucuggccacgagugggucacagacuuuaaggguaagaccgucugguucgugccgagcauuaaggccggcaaugacaucgccgccugccugaggaagaacggaaagaaggugauucagcugucccgcaagacuuuugacagcgaguaugucaagacucgggccaacgacugggacuuuguggugacaacggauaucucugagaugggcgcgaauuucaaggccgaaagaguuaucgacccucggcgguguaugaaaccggugauacugaccgacggcgaggagcgggugauuuuagccggaccgaugccggucacccacagcagcgccgcccaacgccggggccgcaucgggagaaacccaaagaacgagaacgaucaguacauauauaugggcgagccccucgagaacgacgaggacugcgcacacuggaaggaggccaagaugcuucuggacaacauaaacacccccgagggcaucauuccuagcauguucgagccggaacgagagaagguggacgccaucgacggugaauaucgacuccggggugaagccaggaagacuuuuguugacuugaugcggcgaggggaucugccagucuggcucgccuaccggguggcggccgagggcaucaacuacgcugaucgcagauggugcuucgacgggaucaagaacaaucagauacuggaagaaaacguugaaguagagaucuggacuaaggagggggagaggaagaaacugaaaccacgauggcucgacgcccgcauauacagugacccguuggcgcugaaagaguucaaggaguucgccgcuggccgaaagucccucacccugaaucugaucaccgagauggggcgccucccuacuuucaugacucagaaagcccgggacgcuuuagacaaccuggcggugcuccacacggccgaggcugguggacgcgcauacaaccaugcccuguccgagcugccggagacccucgagacgcugcuucucuugacccugcucgcgacggugaccggcggcaucuuucuguuccugaugucugggaaggguaucggcaagaugacccucggcaugugcugcaucaucaccgccuccauccuguugugguacgcccagauucagccacacuggaucgcagccagcauaauccucgaguucuuucugauuguauuguugaucccugaaccggaaaagcagcggacuccccaggacaaccagcuaacuuacguggucauagcgauccugaccgugguagcugcaacgauggccaaugagauggguuuccucgagaagaccaaaaaggaccugggcuugggcagcaucgccacccaagaguccgagucaaacauccucgacaucgacuuaaggcccgcuuccgcauggacucuguacgccgucgccacaaccuucgugacccccaugcuccggcacagcaucgagaacuccagcguaaacgugucccugaccgcgaucgccaaccaggcuacggugcugaugggccucggcaagggguggccccuuagcaagauggacaucggcgugccccugcuagccauagggugcuacucccaagucaacccgauaaccuugaccgccgcgcugcuccuauuaguggcccauuaugcuaucaucgggcccggccuccaagccaaggcaaccagagaagcgcagaagcgggccgccgcugguaucaugaagaaccccacaguggacggcauaacugucaucgaccuagagccgaucccauacgaccccaaguuugagaagcaacuggggcaagucaugcuucuuauccugugcgugacccaggugcucaugaugcgcaccacgugggcccugugcgaagcgcugacccucgccaccggccccaucucaacccugugggaggggaaucccggacgcuucuggaacacgaccaucgcgguuuccauggccaacauauuucggggcagcuaucuggccggggccgguuugcuauucuccauaaugaagaauacuaccaacacgcgccgggggaccggaaacaucggugagacguugggagagaaauggaaguccaggcuaaacgcgcuggggaaguccgaguuccagaucuacaagaaguccgguauacaagagguggaccggacgcuggccaaggagggcaucaagcgcggggagacugaucaccacgccgugucccgaggcuccgcgaagcuccggugguucguggaaaggaacauggugaccccggagggcaaggucguggaccucgggugcggcaggggaggcuggucauacuacugcggaggccugaaaaacguacgugaggucaaggggcucaccaaaggagggcccgggcacgaggagccgauccccaugagcaccuacggcuggaaccuggugcguuugcaaagcggagucgacguauucuucacgccgcccgagaagugcgacacuuuacugugugacaucggcgaaucuucgcccaaucccaccaucgaggcaggccggacucuccgcgugcucaaccugguggagaacuggcucaacaacaacacgcaauucugcauuaagguccucaaccccuacaugccaagcgugaucgagaagauggagacacugcagcggaaguacgggggcgcacuggugcgcaaucccuugagccggaacuccacucacgaaauguacugggucucuaacgcuacugguaacauaguauccagcguuaacaugaucucuaggaugcucaucaacagauucaccaugaagcauaagaaggccacguacgagccugacgucgaccuggguagcggcacgcgcaacaucggaauugaguccgagauccccaaccucgauaucaucggcaagcguaucgagaagauaaagcaggagcacgagaccagcuggcacuacgaccaggaccaccccuacaagaccugggcguaccacggguccuaugaaacuaagcagaccggcucggccuccagcauggucaacggggugguccguuugcugaccaagccaugggacguggugccgaugguuacccaaauggcaaugacagacaccacccccuucggccagcagcgcguguuuaaggagaaagucgacacccggacucaggagcccaaggagggcacaaagaagcugaugaagaucaccgccgaguggcucuggaaggagcuggggaagaagaaaacgccccgaaugugcacgagagaggaguucacacgcaagguucggucaaacgccgcgcuaggcgcuauuuucaccgacgagaauaaguggaaguccgcccgcgaggccguggaggacuccagauucugggagcuuaucgaccgcgagcggaaucugcaccuggaggggaagugcgaaaccuguguguauaacaugauggggaagcgcgagaagaagcucggggaguucgggaaggcgaagggcagccgggccauuugguauauguggcugggggcccgcuucuuagaguucgaggcacucggcuuccugaacgaggaccacugguucucgcgggggaacagucuuagcggugucgagggggagggccuccaccggcugggcuacauccugcgggacguguccaagaaagaaggaggggccauguacgcugacgacacugccgggugggacacuagaaucacccuugaggaucugaaaaacgaggaaauggucaccaaucauaugaaaggcgagcacaagaaguuagccgaggcaaucuucaagcucacuuaccagaauaagguggugagaguccagcguccgacgccccgggggaccgugauggacaucauaagccggcgagaucagcguggaucgggccagguggggacguacggacugaacacauucaccaacauggaggcccagcucauccgccagauggagggggaaggcaucuucaagagcauacagcacuugacagucaccgaggaaaucgcgguucagaacuggcuagcccgcgugggccgcgagcggcuuucccgcauggcaauuagcggggaugacugcguggugaagccccucgacgacagguucgccuccgcacugacggcgcucaacgacaugggcaaagugcggaaggacauccagcagugggagcccagccggggguggaacgauuggacccaagucccguuuugcagccaccacuuccacgaguuggugaugaaggacgggcgcguccuggucgugcccugcagaaaccaggacgagcugaucgggcgcgcccguaucucacagggcgccggcuggagucuaaaagagaccgcuugccugggaaagucuuacgcccaaauguggacccucauguacuuccaccgccgggaucuccgccuggcugccaacgccaucuguuccgccgugccgagccacugggucccaacaucccggacgaccuggagcauccacgcgaagcacgaauggaugacuaccgaggauaugcuagcuguauggaaucggguguggauucaggaaaauccuuggauggaagacaaaacgccugucgagagcugggaggaggugccuuaccucgguaagcgcgaggaucaauggugcggguccuugauuggccuuaccagccgcgcuaccugggccaaaaacauccagacagccaucaaucaaguccggagucuaauugguaacgaagaguacacagacuauaugcccagcaugaaacgguucaggcgggaggaagaggaggcuggcgucuugugguaa

SEQ ID NO: 25199 - RNA, 9876 nt, Artificial Sequence
  derived and/or modified CDS sequence (opt11) from DENV-2__EU569708__SS-prME
accgccggggugaucaucaugcugaucccgaccgcgauggcauuccaccucaccacucgcaacggugagccgcacaugaucgugggacggcaagaaaaggggaagucccugcuguucaagaccgaggacggcgugaauaugugcacgcucauggcgauagaccugggggagcuaugcgaggacaccaucaccuacaaaugcccccugcuacgccaaaacgagccugaggacaucgauugcuggugcaacagcaccucgaccugggugaccuacgggaccugcaccaccacgggcgagcaccggcgcgagaagcgguccgucgcccuggugccccacgugggcaugggccucgagacccgcaccgagaccuggaugagcucugagggggccuggaagcacguacagcggaucgagaccuggauccugcgccaccccggcuucgcuaucauggcggccauccuggccuacaccaucgggaccacccacuuccagcgggcauugauuuucauccuguuaaccgcgguggcaccgucuaugaccaugcgcugcaucggcaucuccaaccgugacuucguggagggcgucagcgggggcaguuggguggauaucguguuagagcacgggagcugcgucaccaccauggccaagaauaagccgacgcuggacuucgagcugaucaagaccgaggccaagcagccugccacccuccgcaaguacugcaucgaggccaagcugaccaacacaaccaccgagucccggugcccgacccagggcgagcccagccugaacgaggagcaggauaaacgcuuuaucugcaagcacuccaugguggaccggggcugggggaacggcuguggcuuguucggcaagggugggaucgugacuugcgcaauguucacguguaagaagaacauggagggaaaggucgugcuucccgagaaccuggaguacaccaucgugaucaccccccacagcggagaggagcaugccgucgggaacgacacggggaagcacggcaaggaaauuaagaucaccccgcaguccagcaucacagaggcagagcucaccggcuauggcaccgugacgauggaaugcagcccccggaccggccuggacuuuaacgagauggugcugcuacagauggaggagaaggccuggcugguccaucggcagugguuccuugaccucccucugcccuggcugccaggggcugacacccagggcagcaacuggauccagaaggagacccucgugacguucaagaacccacacgccaagaagcaggacguaguugugcuggggucgcaagagggugccaugcacacagcccuaacgggggccacugagauccagaugagcagcggcaacuuacuauucaccggccaccugaagugccgccuccggauggacaagcuucagcuaaaggggauguccuacuccaugugcacuggcaaguucaagaucguuaaggagaucgcggagacccagcacgggacuaucgugauccgcgugcaauacgagggcgacggcucccccugcaagauccccuucgagaucauggaccucgaaaaacggcacguccuggggcgccugaucacggugaacccgaucgucaccgaaaaggacagccccgucaacaucgaggccgagccaccguucggcgauuccuacauaaucaucgggguggagccgggccaacucaagcugaacugguucaaaaaaggaagcuccaucggccagauguucgagacaaccaugcgcggcgccaagcggauggccauccugggggacacggccugggacuuuggcagccucgggggcguguucaccuccaucgggaaggcgcugcaccaagucuucggcgccaucuauggcgccgccuuuagcggcguauccuggaccaugaaaauccugaucggggugaucaucaccuggaucgggaugaacagccgauccacgagucugucagucagccuagugcuggugggggucguaacccuguauuugggcgcgaugguccaagccgacuccggcugcgucguaagcuggaaaaacaaggaacugaaguguggcucggggaucuucaucacggacaacguucauaccuggacggagcaguacaaguuucaacccgaaucacccucgaagcucgccuccgccauccagaaggcucacgaggagggcauuugcgggaucagaagcguaacccgccucgagaacuugauguggaagcagaucacccccgaacugaaucacaucuuaucggaaaacgaagugaagcucaccaucaucaccggcgacaucaaggggaucaugcaggcaggcaagcggagcuuaaggccgcaaccgaccgagcucaaguacuccuggaagaccuggggcaaggccaagaugcugagcaccgagucccacaaucagacuuuccuuaucgaugggcccgagaccgccgagugcccgaauaccaaccgggcauggaauagccuagaggucgaggacuacggcuucggggucuucacgacgaacaucuggcugaagcugcgggagaaacaggacguguucugcgacaguaagcucaugagcgccgcgaucaaggacaaccgggccgugcacgccgacaugggcuacuggaucgaguccgcccuaaaugacacuuggaagauggagaaggccagcuucaucgagguaaaguccugccacuggcccaagagccacacucugugguccaacggcguacucgagagcgagaugaucauccccaaaaacuucgcggggcccgugucccagcacaacuaccgcccugguuaccacacccagaccgccggaccauggcaccuaggcaaacuggagauggacuucgacuucugcgaggggacgaccgucguggugaccgaggacugcggcaaccgugggcccagccuucgcaccacgaccgccagcgggaaacuuaucacggagugguguugccggaguugcacccugcccccgcuccgcuaccgcggcgaggaugggugcugguacggcauggagauccgcccacugaaggagaaagaggagaacuuaguaaacagccucguuacugccgggcacggccagauagauaacuucuccuugggaguacuagggauggcgcucuuccuggaggagaugcugcggacccgcgucggcaccaagcacgccauccuccugguugccgugagcuuugucacccuaauuacggggaacauguccuuccgcgaccucggacgcgugaugguuauggugggggccaccaugaccgacgacaucggcaugggcgugaccuaccuggcgcuguuagcggccuuuaaagugcggcccacguuugccgcggggcugcuacuccggaagcugacuagcaaggagcuuaugauggcuaccaucgguaucgcguuacugucccaguccaccauccccgagacgaucuuggaacucaccgacgcucuggcccucgggaugaugguccucaagauugugcgcaauauggagaaauaucagcuggccgugacgaucauggccaucuccugugugccgaacgcagugauucugcugaacgccuggaagguuagcugcaccauccuggccgccguauccgugucgccgcugcuccugacaaguagccaacagaagaccgacuggaucccccuggcgcugaccaucaagggccugaaucccacagccaucuuccugacgacccucucccggaccagcaagaagcguucguggccgcuaaaugaggcagucauggccguaggcauggugagcauccucgccuccagccuccugaaaaaugauauccccaugaccgggccuuuggucgcggguggccuccugacgguuugcuacguucugaccggccggagcgccgaccucgagcuagagcgggccgccgaugucaaaugggaagaccaggccgagaucaguggcagcucccccauccugucugugaccaucuccgaggacggcucuauguccauaaagaacgaggaggaggagcagacucucacgauccugauccggacgggccuccucgugaucagcggggucuuuccgguguccauacccaucaccgcggccgccugguaccugugggaggugaaaaagcagcgcgccgggguccugugggacgugcccucaccgccucccguggggaaggccgagcuugaggacggcgcuuaccgaauaaaacagcgcgggauacugggcuauucccagauuggugccgggguguacaaggagggcaccuuccacaccauguggcacgugacgcgcggggcuguacugaugcaccgcggcaaacggaucgagcccagcugggcugacgucaagaaagaccucaucuccuacgggggaggcuggaagcuugagggggaauggaaggagggcgaggagguccagguacuggcccuggagcccgggaaaaacccacgugcgguucagaccaaacccgggcuguuuaaaaccaauaccgggacgaucggcgcggucagccuggacuucucccccggcaccucgggguccccgaucguggacagaaagggcaaggucguggggcucuacggcaacggcguggucacccgcagcggggccuacgugagcgccaucgcgcagaccgagaaguccaucgaggauaaccccgagaucgaggaugacaucuuccggaagaagcgccugacgaucauggaccugcaccccggcgccgggaagaccaagagguaccugccggccaucgugcgcgaggccaucaagcggggccuccguacccugauccuggccccuacccgcgucguggcagccgagauggaggaggcccuacggggccugcccauccguuaccagacgccugcuauucgagcugagcacaccggccgcgagaucguggaccugaugugccacgcaaccuucacaaugcggcuccugagccccguccgcguuccgaacuacaaccugaucaucauggacgaggcccacuucacagaccccgccuccaucgccgcgcggggcuacaucagcacccgaguggagaugggggaggcggcggggaucuucaugacagccacgccgccaggguccagggacccguucccgcagucgaaugcccccaucauggaugaggagcgcgagauccccgagcgguccuggaauagcggucacgaauggguaacggacuucaaggguaagaccguaugguucgugccguccaucaaggcgggcaacgacauugccgccugccuccgcaagaacgggaagaaggucauccagcugagccgcaaaacuuucgacuccgaguacguuaagacccgcgccaacgacugggacuucgucgucaccaccgacaucagcgagaugggggccaacuuucgggcggagaggguuaucgacccccgccgcugcaugaagcccgugauucuaaccgacggcgaagaacgcgucauacucgcagggcccaugccgguaacccacuccuccgccgcacagcggcgcggccguauugggcgcaaccccaagaacgaaaacgaucaguacaucuauaugggcgagccacuggagaacgacgaggacugcgcccauuggaaggaggcgaagaugcuucucgacaacauuaauacgcccgagggaauaaucccguccauguucgagcccgagcgggagaagguugacgcuaucgauggggaauaccgccugcggggagaagcccgcaagacuuucgucgaucuuaugcggcgcggggaucugcccguguggcuggccuaccggguggcagcggaggggauuaacuacgccgaccgccgcuggugcuucgacggaaucaagaacaaccagauccucgaagagaacguggagguggagaucuggaccaaagagggcgagcgaaaaaagcucaagccgcgcuggcuggacgcaaggaucuacagcgacccccuggcccucaaggaguucaaggaguucgcggccggccggaaaucccucacccugaaucugaucacggaaauggggcgccugccgacauucaugacccaaaaggcccgggacgcccuggacaaucucgccguccugcacaccgcggaggccggcgggcgcgcguacaaccaugcccugagcgagcuccccgagacccuggagacacugcuucuccugacgcuacuggccacugugacgggcggaaucuuccuguuccucaugucaggcaagggcaucgggaagaugacccuggguaugugcugcaucaucaccgcgagcauccugcucugguacgcucagauccagccgcacuggaucgccgccuccaucauccuggaguuuuuccugaucgugcuucugauuccagagcccgagaagcaacgcacgccccaggacaaccagcugaccuacguggugauugccauccucacaguggucgcggccacaauggccaacgagaugggguucuuagagaagaccaagaaggaccugggucucggcaguaucaccacccaggagagcgaguccaacauacuggauaucgaccugaggccggcaagcgccuggacgcuauacgcgguggccaccaccuucgucacgcccaugcugcggcacuccaucgaaaacaguuccgucaacguaagucugaccgccauagccaaccaggcgaccgugcucauggggcuuggaaaaggguggccccuguccaagauggauaucggcgucccguugcuggccaucggaugcuacagccaggugaauccgauuacccugacggccgcccuccugcuacucguggcccacuaugcgaucaucggccccggccuacaggccaaggccacccgcgaggcccagaaacgcgccgcggccgggaucaugaagaaucccaccgucgacggaaucaccgugaucgaccuggagcccauccccuacgaucccaaguucgaaaaacagcucggccagguuaugcugcugauccucugcgucacccaggugcugaugaugcguaccacaugggcccugugcgaggcgcucacccuggccaccggccccaucuccacucugugggaggggaacccuggccgcuucuggaacaccacaauagcgguaagcauggccaacaucuuccggggauccuaccucgccggggccggccugcuguucagcaucaugaagaacaccaccaauacccgccgggggaccggcaacaucggcgagacgcuuggggagaaguggaagucccgccucaacgcgcugggcaaaagcgaguuccagaucuauaagaaguccgggauccaggaggucgaccggacccucgccaaggaggggaucaagcgcggggagaccgaccaccacgcggugagccggggcuccgccaagcuccggugguucgucgagcggaacauggucacccccgagggcaaagugguggaccucgggugcggucgagggggcuggucguacuacugcgggggacuuaaaaacgugagggaggugaagggacugacgaagggggggccagggcacgaggagcccauacccauguccaccuacggcuggaaccugguacgccuccagagcggaguggacguuuuuuucaccccuccugagaagugcgacacccugcucugcgacaucggcgaaagcuccccaaaccccacgaucgaagcuggucggacguuacgagugcugaaccuggucgagaacuggcucaacaacaacacccaguuuugcaucaaggugcugaacccguauaugcccucggugaucgagaagauggagacccuccaacggaaauacgggggcgcguugguccgcaacccccugucccggaacagcacccacgaaauguacugggugucgaaugcgaccgggaauaucgugucaagcgucaacaugaucuccaggaugcugaucaaccgcuucaccaugaagcacaagaaggcgacauacgagccggacguggaccugggaucagggacccggaacaucggcaucgagagcgagauaccgaacuuagauaucaucggcaagcggaucgagcgaauaaagcaggagcacgagaccuccuggcauuacgaccaggaccaccccuacaagaccugggcguaucacgggucguacgaaacaaagcagaccggcucggcaagcuccauggugaacgggguugugcgccugcuaacgaagccgugggacgugguaccgauggugacccagauggcgaugaccgacaccacgccguucggccagcagcggguguucaaggagaaggucgacacacgcacccaggagccuaaggagggcacgaagaagcugaugcggaucacggccgaguggcuguggaaggaguuagggaaaaagaagacgccccguaugugcacucgggaggaguucacgcgaaaggugcguagcaacgcagcccucggugccguguucaccgaugagaacaaguggaaguccgcgcgggaggccgucgaggauucccguuucugggagcugguugaccgcgagcggaaucugcacuuggaggguaaaugcgagaccugugucuacaacaugaugggaaagagggagaagaagcugggggaguucggcaaggccaaaggaucccgcgccaucugguacauguggcugggggcacgauuucuugaauucgaggcccuuggcuuccugaacgaagaucacugguucagccggcguaauagccucucuggggucgagggggaggggcugcaccggcugggcuacauccuccgcgacgugaguaagaaggagggcggggccauguacgcggacgauaccgccgggugggacacccgcaucacacuggaggaccugaaaaacgaggagauggucaccaaccacaugaaaggggagcacaagaagcuggcggaggccauauuuaagcugaccuaccagaacaagguggugcggguccagcgcccgacgccccggggcacggugauggacaucaucucccgccgugaucagcgcgggucaggccaggugggcaccuacggguugaauaccuucaccaacauggaggcccagcucauccgacagauggagggcgaggggaucuucaagucgauccaacaccugacagucacugaggagaucgccgugcaaaacuggcuggcccgcgugggccgggagcgccucagccggauggcuaucucaggcgacgacugcgucgugaagccccuggacgaucgcuucgcgucggcacugaccgccuugaacgacauggguaaagugcggaaggacauccagcagugggagcccucccgcggcuggaacgauuggacccaaguaccuuucugcagccaccacuuucacgagcuggucaugaaagacgggcgggugcugguagugcccugccgcaaccaggacgagcucauuggccgggcccgaaucucccagggagcgggcuggagucugaaagagacggcuugccuggggaaguccuacgcccagauguggacccucauguacuuccaccggcgggaccugcgccuggccgccaacgccaucugcagcgcagugcccucccacuggguccccaccucacggaccaccugguccauccacgccaaacacgaguggaugacgaccgaggacauguuagccguguggaacagaguguggauccaggagaacccguggauggaggacaagacccccgucgagagcugggaggaggugcccuaucuggggaagcgggaggaccaauggugcggcagccugaucgggcucaccucgcgcgcgaccugggccaaaaacauucagaccgccaucaaccaagugcggagucugaucggcaaugaagaguacaccgacuacaugcccuccaugaaacguuuccggcgggaggaggaggaggcagggguccugugguaa

SEQ ID NO: 25200 - RNA, 9876 nt, Artificial Sequence
  derived and/or modified CDS sequence (opt11) from DENV-2__EU569709__SS-prME
acugccggcguuauaaucaugcugaucccgacggcuauggcauuccaccucacuacccgcaacggugagccccacaugauuguuggacggcaggagaaggggaagucccugcuguucaagacggaggacggcgugaacaugugcacccuuauggccaucgaccugggagagcugugcgaggacaccaucaccuauaagugccccuugcugagacagaacgaaccagaagacaucgacugcuggugcaacagcacuagcacgugggugaccuacgggacuugcacaacaacgggcgagcaccggcgagagaagagauccgucgcgcucgugccacacguagggaugggacucgagacccgcaccgagaccuggaugagcagcgaaggggcuuggaaacauguccagcggaucgagacuuggauccugcgccacccggguuuuaccaucauggcagcgauccuagcauacaccaucggaaccacccacuuccaacgagcucugaucuucauacugcugaccgccguggcuccgagcaugaccaugcgcugcaucggcaucuccaaucgcgauuucguggagggggucagcggcgggucgugggucgacauagugcucgaacacggcucgugcgugaccacgauggccaaaaacaagcccacccuugacuucgagcugauaaaaaccgaggccaagcagcccgccacccuccgcaaguauugcaucgaagccaagcugacgaacacaacuaccgagucccggugcccgacgcagggcgaacccagccugaaugaggagcaggacaagcguuucauaugcaagcacucgaugguggaccgggguugggggaacggaugcggccucuucggcaagggcgggaucgugaccugcgcgauguucacaugcaagaagaauauggaaggaaaggucgugcugcccgagaaccuugaauacacuauagugaucacgccccacucgggggaggagcacgccgucggcaaugacaccgggaaacacggcaaggagaucaagaucaccccgcaauccagcaucaccgaggccgagcucaccggguacggcacggucacuauggagugcagucccaggaccggccuagacuuuaaugagaugguacugcuccagauggaggacaaggccuggcuggugcauaggcagugguuucuggaccucccauuacccuggcucccgggggcagauacccaagguucuaacuggauccagaaggagacgcucguaaccuucaagaacccucaugcgaaaaagcaggacgucguugugcuggggucccaggagggcgccaugcauaccgcccugaccggggccacggagauucaaaugagcagcggaaaccuccuauucaccggccaccuaaagugucgccuccggauggacaaacugcagcugaaagggauguccuacucgaugugcacagguaaguuuaagaucgucaaggagaucgccgagacgcagcauggaaccaucguaauccgugugcaguaugagggcgacggaucccccugcaagauccccuucgagauaauggaccuggagaagcgauacguccuggggcgccugaucaccgugaacccuaucgugaccgagaaggacagcccagucaacaucgaggcagagccgccuuuuggcgacaguuacaucaucaucgggguggaaccgggccagcucaagcugaacugguucaagaaggggucguccauaggccagauguucgaaacuaccaugcgcggugccaagcggauggccauccugggcgacaccgcgugggacuuuggcucuuuggggggcguguucacuucuaucggcaaggcccugcaccagguuuucggcgcuaucuacggcgccgccuuuagcggagugaguuggacgaugaagauccugaucggcgucaucaucacguggaucgggaugaacagucgcuccaccagccuauccgucagccuagugcuggugggagucgugacccuguaccucggggucaugguccaggccgacucaggcugcguugugaguuggaagaacaaggagcucaagugcggauccgggaucuuuaucaccgacaauguccacacguggacggagcaauacaaguuccaaccggaaagccccagcaagcuugcgagcgcuauccagaaggcccaugaggagggcaucugcgggaucaggagcgugacccgcuuggaaaaccugauguggaagcaaauuacaccugagcugaaccacaucuuguccgagaaugaggugaaauugacgaucaugaccggcgacaucaaggggaucaugcaggccggcaaacguagccugcgaccgcagcccaccgagcucaaguauaguuggaagaccuggggcaaagccaagaugcuaagcacggagucacauaaucagaccuuucugauagacgggcccgaaaccgcggagugcccgaacaccaaccgggccuggaauagccuggaggucgaggacuacggguuuggcguguucuccacgaauaucuggcugaagcugcgagagaaacaggacguguucugugacagcaagcucauguccgccgcgaucaaagauaaccgggccguacaugcggauaugggcuacuggaucgagucggcgcugaaugacaccuggaagauggaaaaggcuucuuucaucgaggucaagucgugccacuggcccaagucacauacccuuuggagcaacggagugcucgaguccgagaugaucauucccaagaacuucgccggucccgugucacaacacaacuaucgccccggcuaccacacccagacggcagggccauggcacuugggcaagcuggagauggacuucgauuuuugugaagggaccaccgugguggucaccgaggacugcggcaaccggggucccagccuccgcacuacaacggcgucgggcaaauuaauaaccgaguggugcugccggucaugcacccuccccccgcuacgcuaucggggcgaggaugggugcugguacgggauggagauccgcccucugaaggagaaggaggagaaccuggugaauagucuugugaccgcaggucauggccagaucgacaacuucagccugggcguccuugguauggcccucuuccuggaagagaugcugcggacccgaguuggaaccaagcacgccauccuccugguggcggucucauucguaacacugaucacggggaacaugagcuucagggaccugggccgcgugaugguaauggugggggccacaaugaccgaugacaucgggaugggugugacguaccuggcgcugcucgccgccuuuaaaguccgccccaccuucgcggccggucugcugcucaggaagcugacguccaaggaacugaugauggcaaccaucggcaucgcgcuccugagccaauccaccauccccgagacgauacuagaguuaacggacgcccuggcccuggggaugauggugcuaaagauugugaggaacauggagaaguaucaguuagcggucacaauuauggcgaucuugugcgugccgaacgccgugaucuugcagaaugccuggaagguaucguguaccauccuggccgccgucucugucucgccuuugcuccuaacauccagccagcagaaggccgacuggaucccacuugcccucaccauaaaaggccugaacccgaccgcuaucuuucucaccacgcucagucguacaagcaagaagcgcucauggccgcugaacgaagccgugauggcagugggcauggucucaaucuuggccuccucucuccugaaaaacgacauccccaugaccgggccgcugguggccggcgggcucuuaaccgugugcuacguacugacggguaggagcgcggaccucgaacuggagagagccgcugacgugaaaugggaggaccaggcggagaucuccgggagcucccccauccugagcaucacgaucuccgaagacggcagcauguccauuaagaacgaggaggaagagcagacccugaccauucugauccguacaggcuuauuggugaucagcgggguauucccggugucaaucccaaucaccgccgcggccugguaccugugggaggugaagaagcaacgcgcgggcguccucugggacguacccagcccgcccccuguugggaaggccgagcucgaggacggcgccuaucggauaaagcaacgcgggaucuuugguuacucacagaucggcgcggggguuuauaaggagggcaccuuucacaccauguggcacgugacucgaggagccgugcugaugcaucggggcaagcggaucgaacccagcugggcugaugucaagaaggaccugaucagcuaugggggaggcuggaagcucgaaggggaguggaaggaaggcgaggaaguccaggugcuggccuuggagccagggaagaacccgcgcgccgugcagacgaaacccggccucuucaagaccaacaccgggaccaucggggcggugucccucgacuucucccccggcacgagcggguccccaaucgucgaccggaaaggcaagguggugggucuguauggcaacggcguagucacccgcagcggggccuacgucuccgcuaucgcccagacugagaaauccaucgaggacaaccccgaaaucgaggacgacaucuuucgcaagaagcgccucaccaucauggaccugcaccccggcgcgggcaagaccaagagguaccugcccgccaucguucgcgaggccaucaagcggggccuuaggaccuuaauccuggccccgacccgcgucguggccgcugagauggaagaagccuuacgggggcuccccauccguuaccagacucccgcuauacgggcagagcacacgggccgcgaaaucguggaccugaugugccacgccaccuucaccaugaggcuccucagccccguucgagugcccaauuacaacuuaauaaucauggacgaagcgcacuucaccgauccugccuccauugccgcccggggcuacaucuccacacgcguagagaugggcgaagccgcuggcaucuucaugacugccacgccgcccggaucccgggauccauuuccccaaaguaacgcccccaucauggacgaggagcgcgagauccccgagcggaguuggaacaguggccacgaauggguaacagacuucaagggcaagacggucugguucguaccguccaucaaggcggggaaugauaucgcggcgugccugcgcaagaauggcaagaaggucauccaguugagccggaagaccuucgacuccgaguacgugaagacucgggccaacgacugggacuucguuguuaccacagauauuagcgagaugggagccaacuuccgggccgagcgcgugaucgacccacgccgcugcaugaagcccguaaucuugaccgacggcgaggagcgugugauccuggcggggccaaugccgguuacccacuccagcgcggcucagcgccggggccguauugggcgaaaccccaagaacgagaaugaucaauauauauacaugggcgagccccucgagaacgacgaggauugugcccauuggaaggaagcaaagaugcuccuggacaauaucaacacgccggaagguauaauuccguccauguuugaacccgagcgggagaaaguggacgcgaucgauggggaguaccggcuccggggcgaagcacguaagacguuugucgaccugaugcggcgcggggaccugcccguguggcucgccuaccggguagcugccgagggaaucaacuacgcggaucgcagauggugcuucgauggaaucaagaacaaccaaauccuggaggaaaacgucgagguggagaucuggaccaaagagggcgagcguaagaaauuaaagccgcggugguuagacgcccgaauuuacucggacccccuggccuuaaaggaguucaaggaguucgcugcgggccgcaaguccuugacccugaaccucauuaccgagauggggaggcuuccaacauucaugacccaaaaggcccgggacgcccuggauaaccuggccguccuccacaccgccgagguuggcgggcgcgcauauaaucacgcccugagcgagcugcccgaaacgcuggagacgcugcuacuucuuacccuccucgccaccgugacaggcgggauuuuccucuuucuaauguccgggaaaggcaucggaaaaaugacgcucggaaugugcugcaucaucaccgccagcauccuucugugguacgcccagauucagccgcauuggauagcugccaguaucauccucgaguucuuucugaucguccugcucaucccugaaccagaaaagcagagaacgccccaggauaaucagcugacauacguggugauugccauccuuaccgucguggccgccacgauggcaaaugaaaugggguuccuagaaaagaccaagaaggacuugggacugggguccauaaucacccaagagagcgagaguaauauccucgacauagaccugcgcccggccagcgcauggacacuuuacgccguggcuacgaccuucguaacccccaugcuccggcacuccaucgagaacagcuccgugaacguuucacugaccgcuaucgccaaucaggcgacgguccugauggggcucggaagaggauggccccuauccaagauggacaucggcgugccucugcucgccaucggcugcuacucgcaagugaacccgauaacccugaccgccgcccugcuucugcuggucgcccacuaugccaucaucggccccggucuacaagccaaggcgacccgcgaggcccagaagagggcagccgccgggauaaugaagaauccgacgguggauggcaucacuguaauagacuuggagcccauaccuuacgaccccaaguucgaaaagcaacucggacagguaaugcuccugguucugugcgugacccaggucuugaugaugcgcacuacaugggcgcugugcgaggccuuaacccucgcuaccggacccauuucaacccugugggaagggaauccaggucgguuuuggaacacaacgaucgccgugagcauggcgaacauuuuccgcgguuccuaucuggcgggggccgggcuccuguucagcaucaugaagaacaccaccaacacacgcagggggaccggcaauauuggcgagacacugggggagaaguggaagucacggcucaaugccuugggcaagagcgaguuccagaucuacaagaagucaggaauccaggagguagaccgcacguuggcgaaggagggcaucaaacgcggcgagacggaucaccaugcggucagcaggggcuccgccaaacuccgaugguuuguggagcgcaauauggugacuccugaggggaagguaguggaccucggcugcggccgaggcggguggagcuacuacugcggcggguuaaagaaugugcgcgagguuaagggccugaccaaaggcggacccggacacgaggagccgauccccauguccaccuacggcuggaaccuggugcgccugcagagcgggguggacguguucuucacgccgccagagaagugcgacacacuccugugcgacaucggggagagcagccccaaucccaccauugaggcuggccgcaccuuacggguucucaaucugguggagaacuggcugaacaacaacacgcaauucugcaucaagguccuuaacccguacaugccuagcguaaucgaaaaaauggaaaccuugcaaaggaaauauggcggcgcgcuagugcguaauccccuuucccgcaacagcacucacgagauguacugggugucaaacgcaaccgggaacaucgugaguucagugaauaugauaagcaggaugcucauaaaccgguucacaaugaaacauaagaaggcgacauacgagccagaugucgaccugggcuccggcacccggaacaucgguaucgagaacgagauccccaaccuugacauaaucggcaagcgaaucgagaagaucaagcaggagcacgagaccagcuggcacuacgaccaggaccaccccuacaagacaugggccuaccacgguucguacgagacaaaacagacaggcagcgccucgucgaugguaaacgggguaguacgccugcugaccaagccuugggacguugugcccauggucacucagauggccaugacggacacaacacccuucggacagcagcgaguguucaaggagaaagucgacacccgcacgcaggagccuaaggaaggcaccaagaagcugaugcggaucaccgcugaguggcuguggaaggagcuagggaagaagaagacgccccggaugugcacgcgggaggaauucacccgcaagguccgauccaacgcggcccugggcgccaucuucaccgacgagaacaaguggaaguccgcacgugaggccguggaggacucccgguucugggagcuaguagaucgcgagagaaaccugcaccuggagggcaagugcgaaacgugcguguacaacaugaugggcaaacgcgaaaagaagcucggggaguucgggaaggccaaaggaagccgggcuaucugguacauguggcugggggcccgcuuccuggaguuugaggcccucggcuucuugaacgaggaccacugguucucacgggguaacucccugagcggcguggagggggagggccuucacaagcugggauacaucuugcgcgaugucucuaaaaaagaggggggggcgauguacgccgacgacacugccgggugggacacaaggauuacccucgaagaucucaagaacgaggagaugguuaccaaccacaugaagggugagcauaaaaaacuggccgaagccaucuuuaagcucacuuaccagaacaaggugguccgcguccaacgcccaaccccacgggggaccguuauggacaucaucagccgcaaggaccagcggggcucaggccagguuggaaccuacggucucaauacguucacgaacauggaggcgcagcugauccgacagauggagggcgagggcauuuucaagucuauccagcaccucaccgugaccgaagagaucgccgugcaaaacuggcuggcacggguggggcgugagcggcuauccagaauggccaucaguggagacgauugugugguuaaaccccucgacgaccgcuuugccucagcgcugacggccuuaaacgacaugggcaagguacgcaaggacauacagcagugggaacccagucguggguggaacgacuggacccaggugccguucugcucccaccacuuccaugagcucgugaugaaggacggccgcguucuagugguacccugccguaaccaggacgagcugauagggcgcgccagaaucagccagggcgccggcuggucucucaaggagaccgccugucucggcaagucuuacgcgcaaauguggacccuuauguauuuucaccgcagagaccuccggcuggccgccaaugcaauauguucagcgguccccucgcacugggugcccacaucccggaccaccuggagcauccacgcaaagcaugaguggaugacuaccgaggacaugcuggccgucuggaaccgcgucuggauacaggagaacccguggauggaagacaagacgccgguggagaguugggaagaggugccauaccuagggaagcgcgaggaccagugguguggaucucugaucggccuuaccaguagagcuaccugggccaagaacauccaaaccgcaaucaaccaggugcguagcuuaaucgggaacgaggaguauacggacuauaugcccaguaugaagcgguuucggaaagaagaggaggaggccggcgugcugugguga

SEQ ID NO: 25201 - RNA, 9876 nt, Artificial Sequence
  derived and/or modified CDS sequence (opt11) from DENV-2__EU596485__SS-prME
acggcgggaguaauuauuaugcuaauaccaaccgcaauggcauuccaucuaacaacgagaaacggcgaaccgcacaugaucgugggacgucaggaaaaaggcaaaucucuguuauucaaaacggaagauggagugaacaugugcacccuaauggcaaucgacuuaggggaacugugcgaagauaccauuacuuacaaaugcccgcuccuccggcagaaugagccagaagacaucgacugcugguguaauaguacaucaacauggguaaccuauggcacaugcacgacaaccggugaacaccggcgagagaaacgguccguggcgcuaguaccccacguagguauggggcuugaaacgcgaacugagaccuggaugagcucagaaggcgcauggaaacacguccaacgcaucgagacauggauauugcgccauccgggcuucaccauaauggcagccauucuagcauauacgauagggacaacacacuuccagagggcccucaucuucauccuacucacugcagucgcaccguccaugaccaugcgcuguaucggaaucaguaaccgggacuuuguugaagguguuucgggaggcucguggguagacauaguccuagagcacggcagcugcgucaccacgauggcuaaaaauaaaccaacacuagacuucgaauugaucaaaaccgaagcgaaacaaccagcuacccugagaaaauacugcauagaagcgaaacugacuaacacaacuaccgaaucccgcuguccaacccagggggagccgucuuuaaacgaggaacaagauaaaagguucaucuguaaacauaguaugguggaucgaggauggggcaauggcugcggguuauucggcaaaggaggcaucgucacgugcgccauguucacaugcaagaaaaauauggaaggaaaaguuguacugccagaaaaccuagaguacaccaucgucaucaccccacacucaggggaagaacacgcuguaggcaacgacacuggaaaacacgggaaagaaauaaaaauaacaccucagucaucgauaaccgaagcggagcuaaccggcuacgggaccguaacgauggaaugcucgccgcgaacaggacucgacuuuaacgaaaugguacuccuccagauggaggacaaagcguggcuaguccaucgccaaugguuucucgaucugccacuccccugguugccaggagcggacacucaagggaguaacuggauccaaaaagagacgcuagucacuuucaaaaauccccacgccaagaaacaggacguagucguacugggaucacaagaaggggccaugcacacagcucugacaggagcuacagaaauccagauguccaguggcaaucugcuguucacuggacacuuaaaaugccgauuacgaauggauaaacuucagcucaaggggauguccuauagcaugugcaccggaaaauuuaaaauaguuaaagaaauagccgaaacgcaacauggaacaauaguaaucagggugcaguacgaaggcgauggaucacccugcaaaaucccauucgaaauuauggaccuggaaaagagacacguccuaggccgauugauuacggucaaccccaucgugacugagaaggacagcccagucaacauagaagcagaaccacccuuuggcgacucauacaucauaaucgggguagaaccagggcaacucaaguugaacugguucaagaaagguucauccauagggcaaauguucgagacgaccaugaggggcgcaaaacggauggcaauccugggagauaccgcaugggacuuugggagcuuaggcgggguauuuacuucaauaggaaaggcacugcaucagguguucggggccaucuacggcgcggcauucagcggcguuaguuggacgaugaaaauucucaucggggugauuauaacauggauugggaugaacagcaggagcacgagccuaagcgucaguuuagugcucgucggagucguaacgcucuaucuuggaguuaugguucaagccgacagcggcuguguaguaucauggaagaacaaagaacugaaaugcgguucgggaauauucaucaccgauaacgugcacaccuggaccgagcaauacaaguuccagcccgaaucgcccuccaagcuagccagcgcaauccaaaaggcucacgaagaagggauuugcggcaucagauccgucacgcgacuagagaaucugauguggaagcaaaucacgcccgaguuaaaccacauccuauccgaaaacgaggucaaacucacaaucaugacuggcgacaucaaagguaucaugcaggccggcaaacgaagccuacgcccacagccuacagagcucaaauacucauggaaaacaugggggaaggccaagaugcugagcaccgacucgcacaaccaaacguuccuaauagacgggcccgagaccgcugagugcccaaacacgaaccgagcguggaacucucucgaagucgaggacuauggauucggaguauucagcacuaacauuuggcucaaacugcgagaaaagcaggauguauucugugauagcaagcucauguccgcggcgaucaaagacaaccgggcggugcacgcugauaugggguacuggaucgagucggcacucaacgacacuuggaagauggaaaaagcgagcuucaucgaagugaaaucaugccacuggccgaagucgcacaccuuaugguccaauggcguacucgaguccgagaugauaaucccuaaaaacuucgcugggccaguaucacaacacaauuaccgaccggguuaccauacccaaaccgcaggaccguggcaccugggcaaacuagaaauggacuucgauuucugugaaggcaccaccgucguagugacugaggacugcgggaaccgcgguccaagccucagaacgaccaccgcgaguggaaaguugauaacggaauggugcugcaggagcugcaccuuaccgccuuuaagauauaggggcgaagacgggugcugguaugguauggaaauaaggccauuaaaggaaaaggaggagaaucuagugaacagccuaguuacagcaggucauggacaaaucgacaacuucucccucgggguucuaggaauggcacucuuucuagaagaaaugcuccgaacacgaguaggcacaaagcacgcaauacugcuggucgccguaucauucguaacucucaucacuggaaacaugagcuucagggaccuggggcgcguaauggugaugguaggugccaccaugacagaugacaucggaaugggagucacauaucuagcguuauuggcggcuuucaaagucaggccgacguuugcagccggccuguugcugcgaaaacuaacgucgaaagagcugaugauggcaaccaucgggauagcguugcuaucgcaaagcacuauacccgagacaauuuuggaacuaacagacgcgcucgcgcucgguaugaugguacucaaaaucguccgcaacauggaaaaauaccagcuagccguaaccaucauggcaauaaguugugugcccaacgcgguaauacuccagaacgcguggaaagucucgugcacaauccucgcggccguaagcgucuccccgcugcugcucacuagcucccagcagaaagcggauuggauaccauuagcccugacaauaaaaggacugaacccuacggcaauauuccucacaacccuaagccggacuucuaagaaaagaaguuggccccuaaacgaagcggucauggcggucggcauggugaguauacuggccuccagucugcucaagaacgacauuccaaugaccggcccccugguggcuggcggguuacuaaccguguguuauguacuuacugggagaagcgcagaucuugaacuagagcgagcggcggacgucaaaugggaggaccaagcggagauaagcggcagcagcccaauccuaucgaucaccaucucggaggacggauccaugucuaucaaaaacgaagaggaagaacagacccugaccauauuaaucagaacagggcugcugguaaucucaggggucuuuccaguuuccauacccaucaccgccgcggcaugguaccucugggaagucaaaaagcaaagggcgggaguuuuaugggacguccccagcccgccuccaguggguaaggcggaguuagaggauggcgcuuaccgaauuaaacaaagaggaauuuucgguuacagccagauaggcgcgggcguauacaaggaaggcacuuuccacacaauguggcauguaacuagaggagcggugcuaaugcacagggguaaacgaaucgaacccucaugggcagacgucaagaaagaccuaauaagcuacggagggggcuggaaguuggagggcgaguggaaagaaggcgaggaaguccaagugcuggcacuagaaccgggcaagaacccaagagccgugcaaacgaaaccaggucuguuuaagacuaacacaggaacaaucggcgccgucucgcuagacuucaguccgggaaccagcgggagcccgaucguagacagaaagggaaaggucguaggguuguacgggaacggcgucguuacgcgaucgggagcguauguauccgcaauugcgcaaacggagaaaagcauagaagacaauccugaaaucgaggaugacaucuucaggaagaaacgccuuaccaucauggaccugcacccaggggccgggaagacgaagcgauaucuccccgccauaguucgcgaagcgaucaagcgaggccuuagaacacucauacuagcccccacucgaguaguggcugcggagauggaggaggcccuuagaggucuaccgauccgguaucaaacacccgcgauaagggcugaacauacaggacgagagauuguugaccugaugugccacgcaacauuuaccaugcgacuccuaucccccguuagagucccgaacuauaaccugauaauaauggacgaagcccacuucaccgaccccgcaagcauagcagccagaggcuacaucagcacgcgaguagaaaugggugaggcggcuggaaucuucaugacugcaacgccaccaggcucccgggaccccuuuccccagagcaacgcgccaaucauggacgaagaacgagagauuccagaaagaucauggaacucgggacacgagugggucacggacuucaaaggcaaaacugugugguucguacccucuauaaaagccggcaacgacauugcggcaugccuacgcaagaacggaaagaaggugauccaauuaucccgcaagaccuucgacucugaguacgugaaaacgagagcaaaugacugggacuucguggucacuacagacaucagcgagaugggggcaaauuuccgugcggaacgggugauagauccccgacgcuguaugaaacccguaauacuuacagacggugaggaaagaguaauccucgcgggacccaugccgguaacgcacagcuccgcagcccaacggaggggccgaaucgggagaaaucccaaaaaugaaaacgaccaauauauauacaugggcgagccgcuugagaacgacgaggacugcgcacacuggaaagaggcuaaaaugcuccuagauaacauaaacacaccagaggguauaauacccagcauguucgaacccgagcgagaaaaaguagacgcgauugacggcgaguaccgauuacgaggagaagccaggaaaacauucguagaucucaugagaagaggcgaccuacccgucugguuggcauaucgaguggcugcagagggaaucaacuacgcagacagacgcuggugcuucgacgguaucaaaaauaaucagauacuggaagaaaacgucgagguugaaaucuggacgaaggaaggcgaacgaaagaaauugaagccaagauggcuagacgcgcgcaucuacagcgacccgcuugcacuaaaggaguucaaggaauuugccgccgggcgcaagagccugacucugaaucucaucaccgagauggggcgguuaccaaccuucaugacucaaaaagcgcgcgacgcacucgacaauuuggccguacuacauaccgcggaaguagguggccgcgcuuacaaccaugcacuuagcgaacugccggagacgcuagagacacugcuacuguuaacacuacuagccgccgucaccggaggcauuuuucuauuccuaaugucgggcaaggguauagggaagaugacacuaggaauguguugcaucaucacggcauccauccuccugugguacgcacaaauucaaccccauuggaucgccgcaucgauaauuuuggaguucuuccugauagucuuacucaucccggagccggaaaaacaaaggacaccacaggacaaccaacucacguauguaguuauagccauacuaacuguaguggcggccacgauggccaacgaaaugggcuuccuggagaagaccaagaaagaccucggacucgggagcauaauaacgcaagaaucugaaucaaauauccucgacaucgaccuucgcccagcgagcgcauggacccuauaugccguagcgacaacauucgugacgccgaugcuaaggcauagcauagagaauaguucaguaaacgucucauugacagcaaucgcgaaccaggcgaccgugcugauggguuuagggcgaggcuggccacugagcaagauggauauaggggucccccugcuggcuaucggcugcuauucccaggugaauccuauuacgcucacggcugcacugcucuuauuagucgcgcacuacgcuaucauaggccccgggcuucaagcaaaggcaacccgcgaggcgcagaagcgcgcagcagccggaauaaugaagaauccaacgguggacgggaucacggucauugaccucgaacccauacccuaugacccgaaauuugaaaaacaacugggccagguaaugcuccuagugcucugcguuacgcagguucugaugaugaggacaacaugggcucuuugcgaggcauugacccucgcgacugggccaaucuccacgcuuugggaagggaauccaggccgcuuuuggaacacgaccauagcugucagcauggcgaacauauuccgaggcucauaccucgccggugccgggcuucuguuuucgauaaugaaaaacacaaccaauacacggagggguacugggaauaucggggaaacucugggagaaaaauggaaaagcagacuuaacgcucuagguaagagcgaguuccaaaucuacaagaaaagcggaauccaggaaguggaccgaacucucgccaaggaagggaucaaaagaggggaaaccgaucaccacgcaguaagccgcggaagcgcgaaguuacggugguuuguagagcgaaacauggucacgccggaaggaaaaguaguggaucuggggugcggaaggggaggauggucguacuauugcggcgggcucaaaaacgugagggaggucaaaggcuuaaccaaagggggccccgggcacgaagaacccauuccaaugagcaccuacggguggaaccuaguucgccuccaaucaggaguagacgucuucuucacgcccccagaaaagugcgacacccugcuaugcgacauaggcgaaagcucuccgaacccgaccaucgaagcugggagaacccuucgaguucucaaccucgucgagaauuggcucaauaacaauacgcaauucugcauaaaaguccugaacccguauaugccgucaguaaucgagaaaauggaaacacugcaaagaaaauauggcggcgcacugguccgaaacccccuaaguagaaacagcacucacgaaauguacugggucucgaacgcaaccggcaauauagucagcucgguaaacaugauuagccgcauguugauaaaccgauucacuaugaagcauaagaaggcaaccuacgaacccgauguagaccuaggcuccggaaccaggaacaucggcauagaaaacgagauaccgaaucuggacauaauaggaaagaggauagaaaagauaaaacaggaacaugaaaccuccuggcacuacgaccaagaucaccccuacaagaccugggcauaccacgguucauaugagacgaaacaaaccgguucugcgucaucgaugguaaaugggguggucagacuccuaacaaaaccaugggacgucguacccaugguaacccagauggccaugacggacacaacgccuuucggacaacaaagaguguuuaaagaaaaagucgauacacgaacccaggaacccaaggaggguaccaagaaacucaugagaaucacugcagaauggcucuggaaagaauuggggaaaaagaaaacacccagaauguguaccagggaagaguuugccaggaaagucagaagcaacgcagcccucggagccaucuucaccgaugagaacaaauggaaaagugccagagaagcaguagaggacucuagauucugggagcugguagacagagaacgcaaccugcaucucgagggaaagugcgaaacgugcguauacaauaugaugggaaagcgggagaagaaauugggggaauuugggaaagcgaaaggaucucgggcgaucugguacaugugguugggagcccgauuucucgaguucgaagcguugggcuuccuaaacgaagaccauugguucagccgcgguaacagucucucaggggucgaaggcgagggccuccacaaacucggguacauacuucgagacguguccaagaaagaagggggagccauguacgcggaugacacagcaggaugggacacuaggaucacgcucgaggauuuaaagaacgaagaaauggugaccaaccauaugaagggugaacacaagaaguuggcggaagccaucuucaaacucacuuaucagaacaaggucguuagaguacaacgacccacgccacgcggaacagucauggacaucauuagcaggaaagaccagcgugggagcggacaggugggcacauauggccucaacacguucacaaacauggaggcgcaacucauucggcaaauggagggggaagguaucuuuaagagcauacaacaccuaacgguuacggaagagaucgcgguccagaacuggcuggcccgagugggccgggagagacucagucgaauggcgauaagcggggacgacugugucguaaaaccacuggaugaccguuucgcaagcgcgcuaacagcucuaaacgacauggggaaaguaagaaaagacauccaacagugggaaccaucacgaggauggaaugacuggacccaggugcccuuuugcucacaccauuuccaugaacuggugaugaaagacgggagaguccuagugguacccugccgaaaucaagacgaacugaucgggcgcgcccgcauaagccagggcgcaggcuggagccuaaaggaaaccgcgugcuuagggaaaagcuacgcucagauguggacacuaauguacuuccauagacgagaccuaagguuggccgcaaacgcgauaugcucagcaguacccucacacuggguuccuacaaguaggacgaccuggagcauccaugcuaagcaugaauggaugacaaccgaagacaugcucgcgguauggaacagggucuggauacaagaaaauccauggauggaggacaaaacccccgucgaaaguugggaggagguacccuaucuuggcaaacgggaggaccagugguguggcagcuuaaucggauuaacaagccgggccaccugggccaaaaacauccagacggccauaaaccagguucggucguuaauagggaacgaggaauacacugacuacaugccuucgaugaagcgauuccgaaaagaagaagaagaagcgggcgugcuaugguga

SEQ ID NO: 25202 - RNA, 9876 nt, Artificial Sequence
  derived and/or modified CDS sequence (opt11) from DENV-2__EU569710__SS-prME
accgccggcgugauaaucaugcugauccccaccgcgauggcguuccaucucaccacgcgcaacggggagccccacaugauagugggucggcaagagaaggggaagucccugcuguucaagacugaagacggcgugaacaugugcaccuuaauggcaaucgaccugggggagcugugcgaggacaccaucaccuacaagugcccccuucugcggcaaaacgagcccgaagacaucgacugcugguguaacagcaccagcacaugggugaccuacgggacaugcacuacaacgggcgagcauaggcgcgagaagcgguccguugcccugguuccccaugucgggaugggccucgagacucgcacagagacguggaugagcagugagggggcguggaagcaugugcagcgaaucgagaccuggauccugcgccacccgggcuucacuaucauggccgcuauccucgccuacaccauagggaccacccacuuccagcgggcauugacguucauccuacuaaccgccgucgcccccagcaugacuaugcgcugcauagggauaaguaaccgggacuucguggagggcgucagcggggguucuugggucgacaucgugcuugagcacgggagcugcgucaccaccauggcaaaaaacaagcccacccuggacuucgagcugauaaagaccgaggccaagcagcccgcaauccucagaaaguacugcaucgaggccaagcugacgaacaccaccaccgagucuaggugcccgacgcagggcgagccuagccugaacgaagagcaggacaagcgcuucaucugcaaacacagcaugguggaccgcgguugggggaacggcugcggccucuucgggaagggcggaauaguaaccugcgcgauguucacgugcaagaagaacauggagggcaaggucgugcuccccgagaaccuggaauacacuaucguuaucacgccccacagcggggaggagcaugccgucggcaacgauaccgggaagcacggcaaggagaucaagaucaccccgcaguccagcaucacagaagccgagcuaacaggcuacggcacgguuacgauggagugcagcccccggaccggcuuggacuucaacgagaugguuuugcuccagauggaggacaaggccugguugguccacaggcagugguucuuagaccucccccugccauggcugcccggggccgauacccagggcagcaacuggauccagaaggagacgcucgucaccuucaagaacccccacgccaagaagcaggauguggucgugcuggggucccaggagggcgccaugcauaccgcccugaccggcgccacggaaauccagauguccagcggcaaccuccuguucaccggccaccuaaaaugccgccuccgaauggacaagcugcagcugaaggggauguccuacagcauguguaccgguaaguucaagaucgucaaggagaucgccgaaacccaacacgggaccaucgugauccgcgugcaguaugagggcgacgggagucccugcaagauccccuucgaaauuauggaccucgagaagcgguacguccuggggcgccugaucaccguaaacccgaucgugacggaaaaggacagccccgucaacaucgaggcggagccgccuuucggagacuccuacauuaucaucgggguggagccgggccagcucaagcugaacugguucaagaaagggagcuccaucggccaaauguucgaaacaacgaugcgcggggccaaacggauggccauacugggggacaccgccugggacuucggcucauuagggggaguguucaccuccaucgggaaggcucugcaccaggucuucggugcgauuuacggagccgccuucucaggggucuccuggaccaugaagauccugaucggcgugaucaucacguggaucgggaugaacagcagauccaccagccuguccguaucccucguccuggugggggucgugacccuguaccucggggucaugguccaggccgacucaggcugcgucgugucauggaagaacaaagagcugaagugcgguucuggaaucuucauaaccgauaacguccacacauggaccgagcaguacaaguuccagcccgagagccccucgaagcuggcgagugccauucagaaggcacacgaagagggcauaugcgggauacggagcgugacccgucuugagaaucugauguggaagcagauaacccccgaacugaaccacauccugucggagaacgaggucaagcugacuaucaugacgggcgacaucaaggggauaaugcaggccggcaagcggagccugcggccgcagcccacggagcucaaguacuccuggaaaaccuggggcaaggccaagaugcugagcacggagucucacaaccagaccuuccugaucgacgggcccgagaccgcggagugcccaaacaccaaccgggccuggaauucccucgaagucgaggacuacgguuucggaguguucuccacuaacaucuggcugaagcugcgcgagaagcaggacguguucugcgauagcaagcucauguccgccgccaucaaggacaaccgggccguccacgcggacaugggcuauuggaucgagucggcccugaacgacacguggaagauggaaaaagcuuccuucaucgaagucaagagcugccacuggcccaagucucacacccucuggagcaauggcgugcucgaguccgagaugaucauucccaagaacuucgccgggcccgugucucagcacaacuaccggccgggcuaccacacucagaccgccggacccuggcaccuggguaagcuugagauggauuucgacuuuugcgaggggacgacugugguggucaccgaggacugcgguaaccggggccccucucuacgcaccacgacggcguccggaaagcugaucaccgaguggugcugcagaagcugcacccugcccccacuccgcuaccggggcgaggauggcugcugguacggcauggagauccgcccccugaaggagaaagaggagaaccuggugaacucucucgugacggccgggcacgggcagaucgauaacuucagccuuggaguccugggcauggcccucuuucuggaagagaugcuaagaacccgcguuggcaccaagcacgcaauccuccuaguggcggugucauuugucacccuuauuacggggaacaugagcuuccgugaccucggucgcgugaugguaaugguuggggccacuaugaccgacgacaucggcaugggagugaccuaccuggcccugcucgccgccuucaaggucaggccuacuuucgcggccgggcugcugcuccggaagcugaccuccaaagaacugaugauggccacuaucggcaucgcucuucugagccaguccaccauccccgaaacgauccuggagcucaccgacgcccuggcacucgggaugauggugcucaaaaucgugcgcaauauggagaaguaccagcuggccgucaccauaauggccauccugugcgugccuaacgcugugauccuccagaacgccuggaaggucagcuguaccauccuggcggccguguccgucagcccauugcuccugacguccucucagcagaaggcggacuggaucccccuggcccucaccauaaagggccugaaccccacggccaucuuccugacgacgcuaagccggaccucaaagaagcgcuccuggccccugaacgaagccgugauggccgugggcaugguuucuauccucgccuccagcuugcugaagaacgacauccccaugaccgguccucugguggccggcgggcuccugaccgugugcuauguccugacaggccggagcgcggacuuagagcuggagcgcgccgccgaugugaagugggaagaccaagccgagauauccgggagcuccccgauccugagcaucaccauauccgaggacggcagcauguccaucaagaaugaggaggaggagcagacgcucaccauccucaucaggacgggccuacucgugauuagcgggguguuccccgugaguauccccaucaccgcugcagccugguaccugugggaggugaaaaagcagagggccggaguccugugggacgugcccucgccuccgcccgugggaaaggccgagcucgaggacggcgccuauaggaucaagcagcgcgguaucuucggcuacucccagaucggcgcgggggucuacaaagaaggcaccuuccacaccauguggcacgugacccgcggggccgugcugaugcaccgcggcaagcgcaucgagcccagcugggccgacgucaaaaaggacuugaucagcuacgggggcggcuggaagcucgagggggaguggaaggagggcgaggaaguccaggugcuggcccucgagccugguaagaacccccgcgccguccagacgaagccgggccucuucaagacuaacaccgggaccaucggcgccguaagccuggacuucuccccaggcacgagcggcucccccauaguggaccggaagggcaaagucguggggcuguacgggaacggcguggucacccgcagcggggccuacguguccgccaucgcccagaccgaaaaguccaucgaggacaacccugagaucgaagacgacauauuccggaagaaacgucucaccaucauggaucugcaccccggcgcggggaagacgaagcgguaccugcccgccaucguucgggaggccaucaagcggggccuucgcacccucaucuuggccccgacccgcguuguggccgccgagauggaggaggcucuucggggccuccccauccgcuaccagacucccgcgauccgggccgagcacacaggcagagagaucguggaccuuaugugccacgcgaccuuuaccaugcggcugcucagcccuguccgugugccgaacuacaaucugauuaucauggacgaggcgcacuucaccgaucccgcauccaucgccgcccggggcuacaucagcacgcgaguugagaugggggaggcugcagguaucuucaugaccgcaacgccgcccgggucccgggauccguuuccccaaagcaacgcccccauuauggacgaggagcgcgagauucccgagcgguccuggaacagcggacacgagugggucaccgacuucaaggggaagacggugugguucguuccguccaucaaggccggcaacgacaucgcggccugccugcgcaagaacggcaagaaggucauccaacucucucggaagaccuucgacuccgaguacgugaagacccgcgcuaacgacugggauuucguggucaccacggacaucagcgagaugggagccaacuuccgggcagagcgagugaucgaccccagacgcugcaugaagccggugauacugaccgacggcgaggagcgggucauccuggccggacccaugccggugacccacucaagcgcggcccagcgccgcggccggaucgggcgcaaccccaagaacgagaacgaccaguacauuuacaugggcgagccccucgagaacgacgaggacugcgcccacuggaaggaggcuaagaugcugcuggacaacaucaacacucccgagggcaucaucccguccauguucgagcccgagcgagagaagguggacgcgauagacggggaauaucgccuccggggcgaggcccgcaagacguucgucgaccugaugcgucggggcgaccugcccguguggcucgccuaccgcguggccgcagaaggcauaaacuacgcugaccgccgcuggugcuuugacgggauuaagaacaaccagauucuggaggagaacgucgaggucgagaucuggaccaaggagggcgagcggaagaagcugaagccgcgguggcucgacgccagaaucuacagcgacccccuggcccugaaagaauucaaagaguucgccgccggucggaagucccuuacccugaaccuuaucaccgagauggggcgccuccccacguucaugacccagaaggcgcgggacgcacuggauaaccuggcaguccuccauaccgccgaggucggagggcgggcguauaaccacgcgcugagcgaguugcccgagacguuggagacgcugcugcuccucacccugcucgccaccgugaccgguggcaucuuccuguuccugauguccggaaaaggaaucggaaagaugacgcucgggaugugcugcaucaucacugccucgaucuuacugugguacgcccagauucagccgcacuggaucgcggccuccaucaucuuagaguucuuccuaauaguccugcuaauccccgagccugagaaacaacggaccccccaggauaaccagcugacuuacguggugaucgccauucugacugucguggccgcuacgauggcuaacgagaugggcuuccucgagaagaccaagaaggacuuaggacugggcaguaucauuacccaggagagcgaguccaacauucucgacaucgaccugcgcccggccagcgccuggacccuguaugccguggcgacgaccuucgucacccccaugcuccggcacuccauugagaacagcucagugaacgugagccugacagcgaucgcuaaccaggccacgguacugauggggcucggccgcggguggccgcugucuaagauggacaucggcgugccccugcucgccaucgggugcuacucucaggugaacccaaucacgcugacggcggcccuacuccuacuggucgcccacuaugccaucaucggccccggccuccaggccaaggcgacucgcgaggcccagaagagggccgccgccgggaucaugaagaacccgacggucgacggcaucaccguuaucgacuuggagcccaucccuuacgaccccaaguucgagaagcagcuggggcaggucaugcuccuugugcugugcgucacccagguccucaugaugcgcaccacgugggcccugugugaggcccugacccucgccaccggccccaucucaacccugugggaggguaaccccggcagauucuggaacaccacuauugccgugagcauggcgaacaucuuccgcggcuccuaccuggcgggggcagggcuccuuuucucgaucaugaagaauacaaccaacacgcggcgcgggaccggcaacaucggcgagacccucggggaaaaguggaagucccggcucaacgcguuagggaagagcgaguuccagauuuacaagaaguccggaauccaggaggucgaccgcacccuggccaaggagggcaucaagcgcggggagacggaccaccacgcgguuagcagaggguccgccaagcuccggugguucguagagcgcaacauggugaccccggagggcaaggucguggaccuggggugcgggcgcgguggcuggucguacuauugcggcgggcugaagaacgugcgcgaggucaaggggcugaccaaaggcgggccugggcacgaggaacccaucccgauguccaccuacggcuggaaccuggugcggcugcagagcgggguggacguguucuucacgccgcccgagaagugcgauacucucuuaugcgacaucggcgagagcucccccaaccccacaaucgaggccggccgcacccugcgggugcucaaccugguggagaacuggcuaaacaauaacacgcaguucugcaucaagguccucaaccccuacaugccaagcguaauugaaaaaauggagacacugcagcgcaaguacgggggcgcccuggugcggaacccccugucccgcaacagcacccacgagauguauuggguuucgaacgccaccgggaacauaguaagcuccgugaacaugauaucacguaugcucaucaaccgguucacgaugaagcacaagaaggcgacauacgagccggaugucgaccugggguccgggacccgcaacaucggcauagagaacgagauccccaaucuggauauuaucggcaagaggauagagaagaucaagcaggaacaugagacaucguggcacuacgaccaggaccaccccuacaaaaccugggccuaccacgggucauaugagacgaagcaaaccggcucagccuccagcauggugaacggugugguacgccuccugacaaagcccugggacgucguaccgauggucacacagauggccaugacugacaccacccccuuuggccagcagaggguguuuaaggagaagguggacacccgcacgcaggagcccaaggagggcaccaaaaagcugaugcggaucacugccgaauggcucuggaaggaacuggggaagaagaagacgccccgaaugugcacccgggaggaguucacgaggaagguccgguccaacgcggcccugggcgccauuuucaccgacgagaacaaguggaagucagcccgcgaggccguggaggacucccguuuuugggagcucgucgaccgggagcggaaccuccaucuagaggggaaaugugaaacuugcguauacaacaugaugggcaagcgcgaaaagaagcucggggaguucgguaaggcgaaaggcagccgggccauaugguauauguggcucggggcucgcuuucuggaguucgaggcgcucggauuccugaacgaagaucacugguucucccggggcaacagccugucaggcguggagggggagggccuccacaagcugggcuauauccugcgcgaugucuccaagaaggagggcggagcgauguacgccgacgacacggcugggugggacacccggaucaccuuagaagaccugaaaaacgaggagauggugaccaaccacaugaagggugaacauaagaaauuagcggaggcuaucuucaaacucacuuaccagaacaaggugguccgcgugcagcgcccgacuccccgggggaccgugauggauaucaucucacgcaaggaccagcggggaagugggcaggucgggaccuacggacucaacacauucacgaauauggaggcucagcugauccgucagauggagggggagggcaucuucaaaucuauccagcaccugaccguuaccgaggagaucgccgugcagaacuggcuggcucgggucggcagagagagacugucccgcauggcgaucucuggggacgauugcguggugaagccccucgacgaucgguucgccucagcgcugacggcccugaacgauaugggcaagguccgcaaggauauccagcagugggaacccagccggggguggaacgacuggacccaggugccuuucuguucccaccacuuccacgagcucgugaugaaggacggccgcguccuagugguucccugccggaaucaggacgagcugaucgggcgcgcccgaaucagccagggugccggcuggagucucaaagagaccgcaugccugggcaagagcuacgcgcagauguggacccucauguauuuccaccgcagggaccuccgccucgcggccaacgcaaucugcuccgccguacccagccacugggugcccacaucccgaaccaccuggagcauccacgcgaagcacgaauggaugaccaccgaggauaugcuggccguguggaaccgcgucuggauccaggagaacccguggauggaggacaagacgcccguggaguccugggaagaggugcccuaccucgggaagcgcgaggaucaguggugcgggagccugauuggcuuaaccagccgggcuacaugggccaagaacauccagaccgccauuaaccagguccgcucccucauagggaacgaagaguacacggacuacaugccuucgaugaagcgguuccgcaaagaggaagaggaagccggcgugcugugguga

SEQ ID NO: 25203 - RNA, 9876 nt, Artificial Sequence
  derived and/or modified CDS sequence (opt11) from DENV-2__EU596486__SS-prME
accgccggcgugaucaucaugcugauccccaccgcuauggccuuccaccuuacuacacgaaacggggagccccauaugauagugggccggcaggaaaaggggaagucccugcuguucaagaccgaagacggcgugaacaugugcaccuugauggccaucgaucugggggaacuuugugaggacacuaucacuuacaaguguccccuccuucgacagaaugagcccgaggacaucgacugcugguguaacucgaccuccaccugggugaccuacgggaccugcacaacuacgggugagcaccggcgcgagaaacggagcgucgcucugguaccccacguaggaaugggccucgagaccaggacugagaccuggaugagcagcgaaggugcauggaagcauguccaacggaucgaaaccuggaucuuacgccacccgggcuucaccauaauggcggcgauauuggccuacacaaucgggacuacccacuuucagcgggcccucaucuucauccuacugaccgcgguggcgcccaguaugacgaugagguguauaggcaucuccaaccgggacuucguggagggcgucagcgggggcuccugggucgacaucgugcucgagcacgggagcugcgucacuacuauggccaagaacaaacccacccuggacuuugagcugauuaagacagaagccaagcagcccgccacccuccgcaaguacugcauagaggccaagcugaccaacaccaccaccgagucccgcuguccgacgcaaggggagcccucgcugaacgaggagcaggacaaacgcuuuaucugcaagcauuccaugguggaucggggcugggggaacggcugcggcuuguucggcaagggcgggaucgugacgugcgcgauguucacgugcaagaagaacauggaaggcaaggucguucuaccagagaaccuugaguauacuauagugauuaccccccacagcggggaggagcacgcuguuggcaaugacacugggaaacacggcaaggaaaucaagaucaccccgcaguccagcauuacagaggccgaacuaaccgguuacgggacggugaccauggagugcagcccaaggaccggccuggauuucaacgagauggugcuccuccaaauggaggacaaggcguggcugguccaccggcagugguuucuggaucucccucugcccuggcugccgggggcagacacccaaggcucuaauuggauccagaaggagacgcuagugaccuucaagaacccccacgcgaagaagcaggacgucgucgugcuggggagccaggagggugccaugcacaccgcacuuaccggggcaacggagauccagaugagcagcggcaaccuccucuucacuggccaccugaagugccgacuccgcauggacaaguugcaacugaaggggauguccuacaguaugugcaccggcaaauuuaaaaucgucaaggagaucgccgagacucagcacgggacgaucgugauccgcgugcaguacgagggcgacgguucuccaugcaagauccccuucgagaucauggaccucgagaagagguacguccuggggcgccugaucacagugaacccaaucgugacggagaaggauagcccggucaacaucgaggcagagccgccauucggcgacuccuauaucaucauugggguggagccgggccagcucaagcugaauugguucaagaaggggagcuccauuggucaaauguucgaaacuacgaugcgcggcgccaagcggauggcaauccugggggacaccgccugggauuucggcagcuugggggguguguucaccucaaucgguaaggccuuacaccaggucuucggggcaaucuacggagcggccuucagcggggugucguggacaaugaagauccugaucggcgugaucauaacguggauuggcaugaacagccgcuccaccagccuguccgucagccuugugcuggugggggucgucacccuguaccugggggugaugguccaagcggacuccggcugcguggugagcuggaaaaacaaggagcugaagugcggcagcggaaucuucaucaccgacaacguccacacguggaccgagcaguacaaauuccagcccgagagccccagcaagcuggcgagcgccauccagaaagcgcacgaggaaggcaucugcgggauccggagcgugacacgccucgagaacuugauguggaagcagaucacucccgagcucaaccauauccucagcgagaacgaggugaagcugacgaucaugaccggcgacaucaaggggaucaugcaagccggcaaacggucccugcgcccgcagcccaccgaguuaaaguauucauggaagaccuggggcaaggccaagauguugagcacggagucccacaaccagacauuucucaucgaugggcccgagaccgcggagugcccgaacaccaaccgggccuggaacucauuagagguugaagacuacggcuucggcguauucucaacgaauauuuggcugaagcugcgcgagaaacaggauguguucugcgacagcaagcucaugucagccgccaucaaggacaaccgggcuguccacgcggacaugggcuacuggauugagagcgcccugaacgacaccuggaagauggagaaagccuccuucaucgagguuaagagcugucacuggcccaagucccauacacuguggagcaacggcguacucgaguccgagaugaucauucccaagaauuucgcgggacccgugagccaacacaacuaucgaccgggcuaccacacccaaaccgcgggaccguggcaccuuggcaagcuggaaauggacuucgacuucugcgaggggacgacugugguuguaaccgaggacugcggcaaucggggccccagucucagaaccacuacugcauccgggaaacucaucacagaauggugcugucgcagcugcacccugcccccgcuccgcuaccggggcgaggacggaugcugguacggcauggagauccgcccccugaaggagaaggaagagaaccuggugaacuccuuggugaccgccggccacggccaaaucgacaacuucucgcugggugucuuggggauggcccucuuuuuggaggaaauguuacggacgcgugugggcacuaagcacgccauccuccuuguugccguuagcuuugugacccugaucacggggaacauguccuuucgugaccucgggcgggucaugguaauggugggggccacuaugacggacgauauuggcauggguguuacguaccuugcccugcuggcugccuucaagguccgccccacguucgcugccggcuugcugcuccggaagcugacuuccaaggagcuaaugauggccaccauugggaucgcccuccugagccaauccaccaucccagaaacgauccuggagcucaccgacgccuuggcacuggggaugauggugcucaaaauagugcggaacauggaaaaguaccagcucgccgucacgaucauggccauccugugcgugccgaacgccgugauccuccagaaugccuggaagguaagcugcacgauccuagcugccguguccgucagcccccugcuacuaacuuccucccagcagaaggccgauuggauuccccuggcgcucaccaucaagggccugaaccccacggcgaucuuccuaaccacuuuguccagaaccaguaagaagcgcuccuggccguugaaugaagccgucauggccgugggcauggucagcaucuuggcguccagccuccugaagaacgacaucccaaugaccgggccucucgucgccggcgggcuccugaccguguguuacguccugacuggucggucugcggaucuagagcuggaacgcgccgcugacgucaagugggaagaccaggccgagauauccgggucuagccccauauugagcaucaccaucagugaggauggcaguauguccaucaagaacgaggaggaggagcagacccucaccauccugauccggacgggccugcucguuaucagcgggguauucccgguguccauccccaucaccgcugcggccugguaccugugggaggugaagaagcagagggccggaguacugugggaugugcccagucccccgcccguggggaaagccgagcuugaggacggcgcguaccggaucaaacaacgugguaucuucggcuauucgcagaucggcgcaggcguguacaaagagggcaccuuccacacgauguggcacguuacccgcggggccguucugaugcaccgcgguaagcggaucgaacccagcugggccgacgucaaaaaggaccugaucucauacgggggcggcuggaagcucgaaggggaguggaaggagggagaggaaguccaggugcuggccuuagaacccggaaagaacccccgcgccguccagacgaaacccggucuguucaagaccaacaccgggaccauaggcgcgguuagccuugauuucucccccggcacgagcgggucgccgauaguggaucggaagggcaaagucgucggucuguacggcaacggcguggucacccgcucgggagccuacguguccgcaaucgcccaaacugagaaguccauugaggacaaccccgagaucgaggacgacaucuuccggaagaagcgccucacuauaauggaccuccaccccggcgcagggaagaccaaacgguaccugcccgccaucgucagagaggccauuaagcggggccugcggaccuugauccuugccccuacccgcgucguggccgcggaaauggaggaggcucugcgggggcucccgauccgguaccagacccccgccauccgggccgagcauacgggccgcgagaucguggacuugaugugccacgccacguucacaaugcgguuacucagcccuguacgcgugccgaacuacaacuuaaucaucauggacgaggcgcacuuuaccgacccugccuccaucgccgcucggggcuacaucagcacgagaguagagaugggggaggccgcgggcaucuucaugaccgccacgcccccugggucccgggacccguucccucagagcaacgcgccaaucauggaugaggaacgcgaaauccccgaacgguccuggaacagugggcacgagugggucacugacuucaaaggcaagacggucugguuugucccguccaucaaggccggcaacgacaucgccgccugccugcgcaagaacggcaagaaggugauccagcucucccggaagacauucgacuccgaguacgugaaaacucgcgcgaacgacugggacuucguaguaaccacggauaucagcgaaaugggggccaauuuucgggccgagcgagugaucgacccacggcgcugcaugaagcccguuauauugaccgacggcgaggagcgggucauccuggcggggcccaugccggugacccacuccagcgcggcccagcgucgcggcaggaucgggcgcaauccgaagaacgagaacgaucaguauaucuacaugggcgagccgcucgagaacgaugaggauugcgcccacuggaaggaggccaagaugcugcuagacaacaucaauacccccgaggggauaaucccuuccauguuugagccggagcgggagaagguugacgcgaucgacggagaguaccgccuccggggcgaggccagaaagacguucgucgauuuaaugcgacgcggugacuuacccguauggcuagcguaccgaguugccgccgaagguaucaacuacgcggaucgccgguggugcuucgacgggaucaagaacaaucagauccuggaggagaacguugagguggagaucuggacaaaggagggcgagcgcaagaagcugaagcccagauggcucgaugccaggaucuauagcgacccccuugcccuuaaggaauuuaaggaauucgcugccggcagaaagucacucacccuaaaccugauuacggagaugggccgccuccccacguucaugacgcagaaggcgcgggacgcccuggacaaccuggccguacuucacacggccgaggugggagggcgcgcguacaaccacgccuuaagcgagcugcccgagacguuggagacgcuucugcuucucacccugcucgccaccgucaccggggggauuuuccuguuccugauguccgggaaagggaucgggaagaugacgcucggaaugugcugcaucauuaccgccagcauccuucuaugguacgcccagauccagccgcacuggaucgcggccuccaucauccucgaguucuucuuaaucguccuacucauccccgagccagagaagcagcggacgccccaagacaaccagcuaacauacguggugaucgcgauacugaccguaguggccgcuacgauggccaacgagaugggcuuccucgagaagaccaagaaggauuuaggccugggcucaaucaucacccaggagagugaguccaacauccucgacaucgaccugcgcccggccagcgccuggacccuguacgcgguagcaacaaccuucgucacccccaugcuccgucauucaaucgagaacagcagcguuaacgugagcuugaccgcaaucgccaaccaggccacagugcuuauggggcucggccgcggguggccccuguccaagauggacaucggcgugccccugcucgccaucgggugcuacucgcaggugaauccgaucaccuuaaccgcggccuuguuacuucugguugcccauuacgcuaucaucgggccuggccuccaggccaaggcgacccgugaggcccagaagcgggccgcugccgggauuaugaagaaccccacaguggacggcaucacaguuaucgaccuggagcccauaccguacgacccuaaguucgagaagcagcugggucaggucaugcuccuggugcugugcgucacccaaguccucaugaugcgcacaacgugggcgcucugugaagcacucacccucgccaccggacccaucagcaccuugugggaggggaaccccggacgguuuuggaacacgaccauagccgugucuauggccaacaucuuccgcggcuccuaccucgcgggggccggacuccuguuuagcaucaugaaaaacaccaccaacaccaggcgcgggaccggcaacauuggcgagacccugggagaaaaauggaagucccggcucaacgcucugggcaagagcgaauuccagauuuacaagaaauccggaauucaggagguggaccgcacccuagccaaggaggggaucaagcgcggggagacagaccaccaugcgguuucgcgcggcucggccaagcuccggugguuuguggagagaaacauggugaccccggagggcaaggucguggaccuggggugcggccgcggcggguggagcuacuacugcggcgggcugaagaaugugcgcgaagucaaggggcucaccaagggcgggccugggcacgaagagcccaucccuauguccaccuacggcuggaaccuggugcggcuccagagcgggguggacguuuucuuuaccccacccgaaaagugcgacaccuuacugugcgauauuggggaguccagucccaaccccaccaucgaggccggccgaacccugcgagugcucaaccugguagagaacuggcugaauaacaauacgcaguucugcauaaaaguccuuaacccuuacaugccgucgguaauagagaagauggaaacacugcaaaggaaauacgggggcgcccugguaagaaacccgcuguccagaaacagcacccaugagauguacugggucaguaacgccaccgggaacaucgugucuucagugaacaugaucagucggaugcucaucaaccguuucacuaugaagcacaagaaggcgacuuacgagccggacgucgacuuaggcagcgggacacgcaacaucggaaucgagaaugagauccccaaccuggacaucaucggcaagcggaucgagaaaaucaagcaagagcacgaaacgagcuggcacuacgaucaggaccaccccuacaagaccugggccuaccacggauccuaugagacgaagcagacggggagcgccuccagcaugguuaauggggugguaagacuccugaccaagcccugggauguaauucccauggucacccaaauggccaugacggacaccacccccuucggccaacagcggguauucaaggagaagguggacacacgaacucaggagccuaaggaaggcaccaagaagcucaugcggaucaccgccgaauggcuguggaaggaacuggguaagaagaagacgccuagaaugugcacgagggaggaguucacccgcaagguccgguccaacgcggcacugggcgccaucuucacagacgaaaacaaguggaaguccgcccgagaggccgucgaggacucccguuucugggagcucguggaccgugagcgcaaccugcaucucgaaggcaagugcgagaccugcgucuacaacaugaugggcaagagagaaaaaaagcucggagaguucgguaaggcgaaaggcagccgcgccaucugguacauguggcugggggcccgcuuucucgaguucgaggcucucggcuuucugaacgaagaccacugguucucacgggggaauaguuugagcggcguggaaggggagggucuccacaaguuaggcuauauccugcgcgacgucuccaagaaggagggcggcgcgauguaugcagacgacaccgcagguugggacacgcggauuacccucgaggaccuaaagaacgaggagauggucaccaaccacaugaagggugagcacaagaagcuugcugaggccaucuucaagcuaacguaccagaauaaggugguccgcguccagcgcccgacgcccaggggcaccguaauggauaucaucagccgcaaggaccaacggggguccggccagguagggaccuacggccugaacacguucacaaauauggaagcgcaguugauccgccagauggagggggaggggaucuucaaaagcauccagcaccucaccgucacugaggagaucgccgugcagaauuggcuggcacgaguuggccgcgagcggcucucccgcauggccaucagcggggacgacugugucgugaagccacucgacgaccgguucgcgagugcgcugacugcucugaacgacaugggaaagguaaggaaggacauccagcagugggagccaagccggggcuggaaugacuggacccaggucccguucugcagucaccacuuucaugaguuaguuaugaaggacggccgcguguuagucgugcccugccggagccaagacgagcugaucgggagggcccgaaucucccagggggccggguggagucucaaagagaccgcuugccuggggaaguccuaugcgcagauguggacccugauguacuuccaccgccgggaccuccgccuagccgccaaugccaucugcucugccgugcccucccacugggucccuacgagccggaccacguggucgauccacgccaagcacgaguggaugacuaccgaggacaugcuggcuguguggaacagaguguggauccaggagaacccguggauggaagacaaaacgccagucgagagcugggaggagguucccuaccucggcaagcgcgaggaucaguggugcgggagccugauaggccucaccucccgggcaaccugggccaagaauauccagaccgcgauuaaucaggugcgcagccucaucgggaacgaggaguauaucgacuacaugcccagcaugaagcguuuccgcaaggaagaggaggaggcuggcguccugugguga

SEQ ID NO: 25204 - RNA, 9876 nt, Artificial Sequence
  derived and/or modified CDS sequence (opt11) from DENV-2__EU687212__SS-prME
acggccggcgucaucgucaugcuuauccccaccgccauggcguuucaccucaccacacgcaacggggaaccgcauaugaucguuggccggcaggagaagggaaagucccuguuauuuaagacugaggacggcguaaacaugugcacucucauggccaucgaccugggggaguuaugcgaggacacgauuacguacaagugcccacuacugcggcagaaugagccggaggacauugacugcuggugcaacagcaccagcaccuggguuaccuauggaaccugcaccacgacgggcgagcaccggagggaaaagcggucaguggcccuggucccccacgucgggaugggccucgagacgagaacggagacauggaugagcagcgagggggccuggaagcacguucaacgaaucgagaccuggauccugcgccacccgggcuucacuaucauggccgcgauucuagcauauacaauagggacgacucauuuucagcgggccuuaauauuuauccuucugacugccguugcgcccaguaugacgaugcgcuguaucgguauuucaaaccgggauuuugucgagggcgugagcggggguucuuggguagacaucgucuuggagcacgguagcugcgugacaacaauggccaagaacaaacccacccuagacuucgagcuuaucaaaacagaggccaaacaacccgccacccuccgcaaguacuguaucgaagcaaagcugacaaacacgacuaccgaaagccggugcccgacucagggcgagccaagucuaaacgaggaacaggacaaacgcuuuaucuguaaacacuccaugguggaccggggcugggggaacgguugcgggcuguucggcaaaggcgguauagugaccugugcgauguuuacuuguaagaagaauauggaagggaagguugugcagcccgagaaccuggaguauaccaucguaaucacgccgcacucgggggaggagcaugcagugggaaacgacacgggaaagcacggaaaggagauaaaaaucaccccccagaguagcaucaccgaagccgagcucaccggauacggcacggugacgauggagugcagcccccguacaggccuagacuuuaacgaaaugguucugcuccagauggaagauaaggccuggcuggugcaucggcagugguucuuggaucugccccuccccuggcugccgggggccgacacccagggaagcaauuggauccagaaggagacguugguaacuuuuaagaacccucacgcgaagaagcaagacgucgugguacuggggagucaggaaggggcaaugcacacggcgcugaccggggcaacggagauccaaaugagcuccggcaauuuacuguucacgggccaccuuaagugucgccugcggauggacaaacuucagcugaaagguaugagcuacagcaugugcaccggcaaauucaagauagucaaggagauugccgaaacacagcacgguacuaucgugaucagaguccaguacgagggugacggcagccccugcaagauuccauucgagauaaccgacuuggaaaaacggcacguucuggggagacugaucaccgucaauccuaucaucaccgagaaggauagcccagucaacaucgaagcugagccuccguucggagauuccuacauaauuaucgggguugaaccgggccaacugaaacucaacugguucaagaagggcagcuccauugggcaaauguucgaaacuaccaugcgcggcgccaaacgaauggcaaucuuaggugacaccgcgugggauuucggcagccucggggggguguucaccuccaucgggaaggcucuucaccaggucuucggcgccaucuacggugccgcuuucuccgggguaucauggacaaugaaaauccugaucggugugauaauaacguggauagguaugaacagccgguccaccagucugucugucagcuuaguguuagucggcgugguuacacuguaccugggggcaaugguccaggcggacucgggcugcgucgugucauggaagaauaaagagcucaaguguggcuccgggaucuucauaacggacaacgugcacaccuggacugagcaguacaaguuccagcccgagagccccagcaaguuagccagugcaauacagaaggcgcaugaggaggguaucugcgggauccggagcgucacgcgccuggagaaccucauguggaagcaaaucacucccgaacugaaucauauccugucagagaacgaggugaaacuuaccaucaugacgggugacaucaaggggaucaugcaggcgggcaagcggagccugcgcccucagcccaccgaguuaaaauacucguggaagacauggggcaaggcgaagaugcucaguaccgagucccacaaccagaccuuccugaucgacgggcccgagaccgccgagugcccgaacacuaaucgggccuggaacucucuggaaguggaggacuacggcuucggggucuucacgaccaacaucuggcugaaguuacgcgagaagcaagacgucuuuugcgacagcaagcugaugagcgcggcaaucaaggacaaccgggcgguucacgccgauauggguuauuggauagaguccgcuuuaaacgacaccuggaaaauggagaaagccagcuucaucgaaguaaagucuugccacuggccuaaaagccacaccuuauggucgaacggugugcuggagagcgagaugaucaucccaaaauccuucgccggcccaguuucgcagcacaauuacagaccggguuaccacacgcaaaccgcagggcccuggcaucugggcaaacuagagauggacuucgauuucugcgaggguaccacagucgucgugacggaagacugcggcaaccggggcccaucccugcgcaccacuaccgccagcgggaagcucaucacggaguggugcugucggagcugcacgcuccccccucugcgcuaccggggugaggaugggugcugguacggcauggaaauucgcccucucaaggagaaggaggagaaucucgucaacucauuaguuaccgccggacauggccagaucgacaacuuuagccuugguguguuggggauggccuuguucuuggaggagaugcuacggacccgcgucggcacuaagcacgccaucuuacucguggcgguguccuucgucacccucaucacaggcaacaugucguucagggaccugggacgugugauggugauggucggggccacuaugacugacgacaucggaaugggcgugacguaccucgcccugcuggccgcauucaaggugcgccccacuuucgccgccggguugcugcucaggaaacucaccaguaaggaacuuaugauggcuaccauuggcaucgcucugcucagccaguccacaaugcccgagacaauccuggaguuaaccgacgcccuagcccuggguaugaugguccugaaaauuguacguaauauggagaaguaucaacucgccguaacaauuauggccaucucgugcgucccgaacgccguaauccugcaaaacgcguggaaggugucuuguaccauccuggcaaccgucagugugucuccccuccuucuuaccagcucccagcagaaggccgacuggaucccccucgcacugacaauuaaggggcugaacccaaccgcgaucuucuugaccacuuuaucccggacguccaagaagcgcucuuggccgcugaaugaggcgaucauggcagugggcaugguguccauccucgcgucuagcuuacugaaaaacgacauaccaaugaccgggccccuaguggccggcgggcuccugaccgucugcuauguccugacaggacgcucagcggaucuagaacucgagcgggccgcggacgugaagugggaggaccaggccgagaucuccggguccucgcccauccucuccaucacuaucagugaggacggcagcaugucgaucaagaacgaagaagaggagcagacgcugaccauccuuauccggaccggccuccuggucaucucaggcguguucccgguaucuaucccgaucacugccgcggccugguacuuaugggaggucaagaaacagagggccggugugcuuugggacgugcccagcccgccgccgguugaaaaggccgagcucgaggauggggcauaccgaaucaaacaacgcggcauccuggguuacagccagauuggcgcgggcguuuauaaggaggggacguuucacacaauguggcacgugacccgaggcgccguucuaaugcaucgcggcaaacgaauugaacccaguugggccgacguuaagaaggaccugaucagcuacggcgggggguggaagcuggaaggcgaguggaaggagggggaggaagugcagguccuugcauuggagcccgguaagaacccaagggccgugcaaacaaagcccgggaucuucaagacuaacaccggcaccauaggggcggugucucuggacuucucucccgggaccucgggcucacccaucguugauagaaaggggaaggugguggggcucuacgguaauggcguugucacgcgcagcggggccuacgugagcgcaauugcccagaccgaaaaguccauugaggauaacccggagaucgaggacgacauuuuccggaagaagcgucugacgaucauggaccugcaccccggggcgggcaagacgaagcgguaucuccccgccaucguccgugaggccauaaagcgcggucuacggacgcugauccuggccccgacccgcguagucgccgcggagauggaggaggcucuccggggucuccccaucagguaccagacccccgccaucagagccgagcacacagggcgggagauuguugaccugaugugucacgccacguucacuaugagacuacugucucccgugcgugugccgaacuauaaccugaucauaauggacgaagcgcauuucaccgaccccgcuagcaucgccgcccgcggcuacaucucgacccgcgucgagaugggcgaggcggccgggaucuucaugacggcgacgccacccggcagucgggacccuuuuccgcaguccaacgcccccaucauggacgaggagcgagagauccccgaacgguccuggaacagugggcacgaguggguaaccgacuuuaagggcaagacagucugguucguaccgagcaucaaggccgggaacgacauagcggcgugccuccgcaaaaacggcaagaaggugauccaacugucccggaagaccuuugauucggaguacgugaagacccgugccaacgauugggacuucgucgugacaaccgauauauccgagaugggcgccaacuucaaggccgagcggguaauagacccccgucggugcaugaaacccgugauacugacggacggggaggagcguguaauucucgcgggacccaugccgguuacccacagcuccgcugcccaacggcgcggaagaaucgggcgcaaucccaagaaugagaacgaccaguacaucuacaugggugagccccuagagaacgaugaagacugcgcccacuggaaggaggccaaaaugcugcucgacaauauuaauacucccgaggggaucauuccgagcauguucgaacccgagcgcgaaaaggucgacgcgaucgauggcgaguaccggcugcguggggaggcccggaagacguuuguggaccuaaugcgccggggggaccucccugugugguuagccuacaagguugccgccgaagguaucaacuacgcagaccgcaaguggugcuucgacggaaucaagaacaaccagauccuggaagagaauguggagguggaaaucuggaccaaggagggggagcggaagaagcucaagccgaggugguuggacgcccggauuuacagugaccccuuagccuugaaggaguuuaaggaguucgcagcgggccgaaaaucccugacacugaaccuaaucaccgagaugggccggcugcccacguuuaugacucagaaggcccgcaacgccuuggacaauuuagccguccugcauaccgccgaagccggggggcgggccuacaaccacgcgcugagcgaacuuccagagaccuuagagacccugcucuuacugacacuacuggccaccgucacagggggaauauuccucuuccucaugagcggcaaagggaucggcaagaugacccuggggaugugcugcaucauuaccgccuccauccuacucugguaugcgcagauucagccccacuggaucgcggcuagcaucaucuuagaguucuuccuaaucguccuccugauccccgagcccgagaaacagcgcacgccccaggauaaccagcugacguacguggugaucgccauccucaccgucguggccgcuaccauggcuaacgagaugggcuuccuugaaaagacgaagaaggaccugggucuuggcuccaucacgacccaagaauccgagagcaacauacuggauaucgaccugagaccggccucagccuggacccuuuacgcagucgcgacgaccuucgucacccccauguuacgccacagcaucgagaacucgucagugaacgugucccugaccgccauagccaaccaggcaacuguccucaugggccuggggaaaggcuggccccugagcaaaauggacaucggggugccccugcuagcgaucggcugcuacucccaaguaaacccgaucacccugacggccgcccucuuacuucucgucgcgcauuacgccaucaucgguccaggccuccaggcgaaagccacacgagaggcucagaagagagccgcggcggggaucaugaaaaaccccacgguggacggaaucacggugauagaccucgaacccaucccguaugaccccaaauucgagaagcaacucggccaggucaugcugcucauccucugcgugacccaggugcugaugaugcggacuacgugggcccucugcgaggcucucacccuggcuacaggacccauaagcacccugugggagggcaaccccgggcgcuuuuggaacacgaccaucgccgucuccauggcgaacauuuuccgcggcagcuaucucgcuggcgccgggcugcuauucuccaucaugaagaauaccaccaauacgcggcgcggcacugggaauauaggcgaaacgcucggcgagaaauggaagucccggcugaaugcccuggguaaguccgaguuccagaucuacaagaagaguggaauccaggagguggaccguaccuuagcaaaagaggguaucaagcggggcgagacggaccaccacgcggucucccgugggagcgccaagcugcggugguucgucgagcgcaauaugguaaccccggagggcaagguggucgaucugggcugugggcggggcggcuggagcuacuacuguggcgggcucaagaacguucgcgaggugaaaggguugaccaagggcggccccgggcacgaagagcccguuccuauguccaccuauggguggaaccugguccgguugcagagcggcgucgacgucuucuucacgccccccgaaaagugcgacacgcugcugugcgacaucggcgaauccucacccaacccaaccaucgaggcaggccgcacucuccgggugcugaacuuggucgaaaacuggcucaauaauaauacccaguucuguaucaaaguccuuaauccguauaugccguccgugauugaaaagauggagacgcuucagcgcaaguacggcggugcccucgugcggaauccccuuagccgcaacaguacccacgagauguacugggucagcaacgcuaccggcaauaucguguccucugucaacaugaucucccggaugcucaucaaccgauucaccaugaaacauaagaaagcgacauacgaacccgacgucgaccuggggagcggcaccagaaacaucggcaucgagagcgagauccccaaccucgacaucaucgggaagcguaucgagaagauuaagcaagagcaugaaacuuccuggcacuacgaccaggaucaccccuacaagacuugggccuaucacggauccuacgagacgaagcagacagggucggcauccagcauggugaacggugugguccgccugcugaccaaaccgugggacguggugccaaugguaacccaaauggccaugacggacacgaccccauuugggcagcagcguguauucaaggagaagguugacacucgcacucaggagccaaaggaagguaccaagaagcucaugaagaucacggcggaguggcuguggaaggaacugggcaagaaaaagacuccccggaugugcacacgcgaagaguuuacuaagaaagucaggucgaacgcggcacucggcgcaauuuuuaccgacgagaauaaauggaaaucugcgagggaagcgguagaggacggccgguuuugggagcugguagacagggaacggaacuuacaccuagagggcaaaugcgagaccuguguuuauaacaugauggggaagcgcgaaaagaagcugggggaguucgggaaggccaaaggaagcagagccaucugguacauguggcuuggggcgcgguuccucgaguuugaggcccuagguuuccucaacgaggaucacugguucagccgggguaacagcuuguccggagucgaaggggagggccugcaccgccuuggguauauuuugagagaggucggaaagaaggagggcggggcuauguacgcagacgacacggcgggcugggacacucgcauuacguuggaggaccugaaaaaugaggagaugguuacuaaccacaugaagggggagcacaagaaacucgcggaggcgaucuucaagcugacuuaucagaacaagguugugcgugugcagcgcccgacgcccagaggaacagugauggacaucaucagcagaagggaucagaggggaagcgggcaggucggaacguacggccuaaauacauucaccaacauggaggcccagcucauacgccagauggagggugaaggcaucuucaaaagcauccaacacuuaaccgcgaccgaggagaucgccgugcaaaacuggcuggcgcgcgucgggcgcgaacgucuaucccgcauggcuauaagcggcgacgauuguguggugaagcccaucgacgaccgguucgcgucagcccugacggcccugaacgacauggggaagguuaggaaggacauccagcagugggagcccagccggggauggaaugauuggacacaaguaccauucugcucccaccauuuccacgagcuuguaaugaaagacgggcgcgugcuagucgugcccugccgcaaucaggaugagcugaucggcagagcacggaucucccagggagcgggguggucacucaaggagaccgccuguuuagggaagagcuacgcacagauguggaccuuaauguacuuccaccgccgggaccuccgccucgcagccaaugcgaucuguucagccgugcccagccacugggugccgacgucacggacgaccuggagcauccacgcgaagcacgaauggaugaccaccgaggacaugcuggccguuuggaaucgcguguggauccaggagaauccguggauggaagauaagacaccugucgagagcugggaggaaguccccuaccucgguaagcgugaggaccaguggugcggcagccugaucgggcugaccagcagagcgaccugggcuaaaaacauacagaccgccaucaaccaggugcggucccuuauuggcaacgaggaguacacggacuauaugccaucaaugaagcgcuuucgccgggaggaagaggaagcggggguuuuaugguga

SEQ ID NO: 25205 - RNA, 9876 nt, Artificial Sequence
  derived and/or modified CDS sequence (opt11) from DENV-2__EU660400__SS-prME
accgccggcgugaucaucaugcuaaucccaacugccauggcguuucaucucaccacccguaacggggaaccacacaugaucguggggcgacaggagaaaggcaaauccuuacuguucaagacugaggauggcgugaacaugugcacuuugauggccaucgaccugggggagcugugcgaggauacaaucaccuacaaaugcccacuccugcgccagaaugagcccgaggacaucgacugcuggugcaacagcaccaguaccugggugacguacgggacuugcaccacuacgggcgaacacaggcgcgagaagcguuccgucgcccuaguaccccacguggggaugggccucgagacccgcacggagaccuggaugucauccgaaggggccuggaagcacguccagcggauugagaccuggauccugcgccacccgggcuucaccauuauggcugcgaucuuagccuacacuaucgggaccacucacuuccagcgggcccucaucuucauccugcugaccaccguugcccccagcaugaccaugcgcugcaucgguaucucgaaccgggacuucguggagggagucucggggggguccuggguggacauuguguuggagcacgggagcugugucaccaccauggcuaagaauaagccuaccuuggacuucgagcuaauuaagaccgaggccaagcagcccgccacgcugcgcaaauacugcaucgaggccaagcugaccaacaccacaacggagagccggugcccgacccagggagagcccagccugaacgaggagcaggacaagcgcuucaucuguaagcacagcauggucgaccggggcugggggaacggcugcggccuguucggcaaaggcgggaucgugaccugcgcaauguuuacgugcaagaaaaacauggaggguaaggucguucuaccugagaaccuggaguacacgauagugauuacaccccauagcggggaggagcacgcggugggcaacgacaccgggaaacacggcaaggagaucaagauaaccccgcaauccagcauuaccgaagccgaguuaacgggguacggcacggugaccauggagugcagcccccgaaccggccuggacuucaacgagauggugcuuuuacaaauggaagacaaggccugguuaguacaccggcagugguuccuggaccucccccugcccuggcugccgggggccgacacgcagggcagcaauuggauccagaaggagacucucgugaccuuuaagaacccccaugccaagaagcaggacguagucgugcuggggucccaggagggagcgaugcacacggcccuaacgggggccacugagauccaaaugucgucgggcaaccuccuguucacgggccaccucaagugccgccucaggauggacaaauugcagcugaaggggaugaguuauagcaugugcaccggcaaauucaagauagucaaagagaucgcagagacacaacacgggacuaucgugauacgcgugcaguaugagggugacggaagccccuguaagauuccuuucgagaucauggaccucgagaagcgccacgugcuggggcgcuuaaucaccgugaacccgaucgugaccgagaaagacagcccgguaaacaucgaagccgagccgcccuucggcgauuccuacauaaucaucgggguggaaccgggucagcucaaguuaaacugguuuaagaaggggagcuccaucggucagauguucgagacgaccaugcgcggcgcgaaacggauggccauccugggggacaccgccugggacuucggcagccuagguggcguguucaccaguaucgggaaagcccuucaucaggucuuuggcgcgauauacggugcagccuuuagcgggguuagcuggacgaugaagaucuuaauaggcgugaucaucaccuggauugggaugaacagccgcucgaccagccugucaguuucucucgugcuggugggcguagugacucuguaccuaggggugaugguucaggccgacuccggcugcguggugucuuggaaaaacaaagaguugaagugcggcucagggauuuucauaacagacaacguucacaccuggaccgagcaguacaaguuccagcccgagagcccgagcaagcuggccucugcgauccagaaggcccacgaggagggcaucugcgggauccggucggugacccgccuggaaaaucugauguggaagcagaucacgcccgagcugaaucauauccucuccgagaacgaggugaaacugaccauaaugacaggggacaucaaggggaucaugcaagccgguaagcggagcuugcgcccgcagcccaccgagcucaaauacucguggaaaacgugggguaaggccaaaauguuaagcacugagucccacaaccagacuuuccugaucgacgggcccgagacagccgagugcccgaacacgaaucgagcauggaauucgcucgaggucgaagacuacggcuuugggguauucuccaccaacaucuggcucaaguugcgcgagaagcaggacguguucugcgacagcaagcucauguccgcugcuaucaaggacaaccgggcaguccaugccgacauggguuacuggaucgagagcgcgcugaacgacaccuggaagauggagaaggccuccuucaucgaggucaaaagcugccacuggcccaagucccacacccuguggagcaacgggguacucgaguccgagaugauaauucccaagaauuucgcagggccagucagccagcacaacuaccgcccgggcuaccacacccagacggccgggcccuggcaccugggcaaauuggagauggacuucgacuucugcgaggggaccaccguuguugucaccgaggacugcggcaacaggggccccagcuuacguacgaccaccgccuccgggaagcugaucaccgaguggugcugccggagcugcacuuugcccccgcuccgcuaccgcggcgaggacgggugcugguacggcauggagauacgcccccugaaggaaaaggaggagaaccugguaaacucccucgugaccgcggggcauggccaaaucgacaauuucagccugggcgugcuggggauggcccuauuccuggaggagaugcugcggacccgcgugggcaccaagcacgccauccuccugguggccgucagcuucgugacgcugauuaccgggaauaugagcuuccgcgaccucggucgcgugauggucauggugggggcaaccaugacugacgacauaggcaugggggugacguacuuagcccuucucgccgccuucaaggucaggcccaccuucgccgcgggccugcugcucagaaagcugaccucuaaggagcugaugauggccaccaucggcaucgcccuccugagccaauccacaauccccgaaaccaucuuggagcuaacagacgccuuggcccuggggaugauggugcucaagaucgugcguaacauggaaaaguaccagcuugcggucaccauuauggcuaucagcugcgugccuaacgcggugauccugcagaaugccuggaaggucuccugcacgauccuagccgcggugagcgucucgccgcugcuucugaccucgucacgucagaaggccgacuggaucccucuggcccugaccaucaagggccuuaaccccaccgccaucuuccugacgacccugagccgaaccucgaagaagcggagcuggccgcucaacgaggcggugauggccgugggcauggucucaaucuuagccagcagucugcucaagaacgacaucccgaugaccggaccacuuguugccggcgggcugcucacagugugcuacguccugacgggccgcuccgcagaucuagagcucgagagggccgcggacgugaagugggaagaccaggcagagauaagcggguccagcccuauccuguccaucaccaucagcgaggacggcuccaugagcaucaagaacgaagaggaagaacacacccugacgauccucauccgcaccggacuguuagugauauccggggucuucccagucagcauucccauaaccgccgccgcgugguaccucugggaggugaaaaagcaacgugccggcguucuaugggacgugcccucaccgccgcccguggggaaggcagaacuggaggauggcgccuacaggaucaaacagcgggggauuuuuggcuacagucaaaucggcgcaggggucuacaaggagggcaccuuccacaccauguggcacgugacgcgcggggcuguccucaugcaccggggcaagcgcaucgagcccuccugggcagacgucaagaaggaccugaucagcuacgggggcgguuggaagcuggagggggaguggaaggagggcgaggagguccaggugcuagcccuagagccuggcaagaacccucgggcggugcaaaccaagcccggccuguucaagaccaacacugggacuaucggcgccgugucccucgacuucagucccggaaccuccgggagcccgaucguggaccgcaagggcaaggugguggggcuguacggcaacggaguggucacccgguccggagcguacgugagugccaucgcccaaaccgagaaguccaucgaggacaaccccgagaucgaggacgacaucuuccgcaagaaacggcugacgaucauggacuugcacccgggugccgggaagacuaagcgcuaccuaccagccaucgugcgcgaggccaucaagcgcggacuaagaacccugaucuuggccccgacccgggucguggcugcggaaauggaggaggcucugcgagggcugcccauccgguaucagacacccgccaucagagccgagcacaccggccgggagaucguagaccucaugugccacgcuacguucaccaugcgccugcugucccccgucagggugccgaacuacaaccuuaucaucauggacgaggcucacuuuacugaucccgcaagcauagccgcccgcggcuacaucuccacucggguagagaugggggaggcagccggcauuuucaugaccgcgacgccgcccgggagccgcgacccguucccucaauccaacgcccccaucauggacgaggagagagagauccccgagcgcuccuggaacucaggccacgagugggucacggacuucaaggggaagaccgugugguucgugccgagcaucaaggccggcaacgacaucgcagcaugccuacggaagaauggcaagaaggucauccagcuauccagaaagaccuucgauucagaguacgugaagaccagagccaacgacugggacuucguggucacgaccgacaucuccgagaugggggcaaacuuccgcgccgaacgggugaucgacccccgccggugcaugaaacccgugauccucacagauggcgaggagcgagucauccuggccgggcccaugccggugacccacagcuccgcggcccagaggcggggccgcaucgggcggaaccccaaaaacgagaacgaccaguacaucuacaugggcgagccccuggaaaaugacgaggacugcgcccacuggaaggaggccaagaugcuccuggacaacaucaacacgcccgagggcaucaucccgucgauguucgagcccgaacgcgagaagguggacgcuaucgacggggaguaccggcugcgcggcgaagcgagaaaaaccuucgucgaccugaugcgccggggggaccugcccguguggcucgcauaccgcguggccgccgaggguaucaacuacgccgaccggcgguggugcuucgacgggauuaaaaacaaccagauccucgaggagaacguugagguggagaucuggaccaaggaaggcgaacggaagaagcugaaaccgcgauggcuggacgcccgaauuuacuccgacccccucgcccugaaggaguucaaggaguucgccgcgggccgcaagagccugacccucaaccugauaacggagauggggcggcugcccaccuucaugacccagaaggcgcgcgacgcccucgacaacuuggccguccugcacacagccgagguuggcggccgggccuacaaccacgcgcuauccgagcucccggagacgcuggagacucucuugcugcucacccugcucgccaccgugacgggcgggaucuucuuguuccugaugucagggaagggcaucgggaagaugacccugggaauguguugcaucaucaccgccuccauccuccugugguacgcccagauacagccgcacuggaucgccgcgagcaucauccuggaguucuuucucaucguccugcuaauccccgagcccgagaagcagcgcacgccccaggacaaccagcucaccuacgucguuaucgccauccuaaccguugucgcagccaccauggccaacgagaugggguuccuggagaagaccaagaaggacuugggccugggaagcaucacaacucaggaauccgagagcaacauccuggacaucgaccuucggccggccuccgcuuggacccuauacgccgucgcuaccacauucgucacgcccaugcugcgccacagcaucgagaacuccagcgugaaugugucacucaccgccaucgcuaaccaggccaccguucuuauggggcugggcaggggguggccucucagcaagauggacaucggcgugccccuccuggccaucgggugcuacucccagguuaacccgaucacauuaacggcagcgcugcuguugcugguggcccacuacgcgaucauagggcccggccuacaagcaaaggccacccgugaggcgcagaagcgcgccgccgccgguaucaugaagaaucccaccguggacggaaucaccgugaucgaucucgagcccaucccguacgacccaaaauucgagaagcagcuggggcaggucaugcuacucguacugugcgugacucagguccugaugaugcggaccacgugggcucucugugaggcacugacgcuggccacgggccccaucagcacccucugggaagguaaccccggacgcuucuggaacaccaccaucgccgugucgauggccaacaucuuccggggcuccuacuuggccggugcgggccugcucuuuuccaucaugaagaacacuaccaacacccguagggggaccggcaauaucggcgaaacguuaggugagaaguggaaaucccgccugaacgcccucggcaaguccgaguuccagauuuacaagaagucugggauccaggagguggaucguacccuggccaaagaggguaucaagcgcggggagaccgaccaccacgccgucuccagaggcagcgcgaagcuacgcugguuugucgagcgcaauauggugaccccggaaggcaaggucguggaccucgggugcggccgcgggggcugguccuacuacugcgggggccuaaagaaugugcgggaggucaaaggccuaacgaaaggcggucccgggcacgaggaacccauccccaugagcacuuacggcuggaaccucgugcgccugcaaagcgggguggacguauucuucaccccgcccgagaaaugugacacccugcucugcgacaucggcgagucuucgcccaacccuacgaucgaggccggccggacccugcgcgugcugaaccucguggagaacugguuaaauaacaacacccaguucugcaucaagguccuuaacccguacaugccuuccgugauagaaaagauggagacccuccaacgcaaguacgggggcgcacuggugcgcaacccauuaagccggaacucuacccacgagauguacugggucagcaacgccacggggaacaucguguccagcgugaauaugaucucccggaugcuuaucaacagauucaccaugaagcacaagaaggccacguacgagccggacguagaccucggcagcgggacccggaacaucgggaucgagaacgagauucccaaccuggacauuaucggcaagcgcaucgagaagauuaagcaagaacacgagacguccuggcacuacgaccaggaccaucccuacaagaccugggcuuaccacgggagcuaugagaccaagcaaacgggcuccgccucuuccaugguuaacggcguggucaagcugcucacgaagcccugggacguggugccgauggucacccaaauggccaugacugacacgacgcccuucggccaacagcgggucuucaaggagaagguggacaccaggacccaggagcccaaggagggcaccaagaagcugaugcggaucacggccgaguggcuguggaaggagcucgggaagaagaaaacgcccagaauguguacccgugaggaguuuacccgcaaaguccggagcaacgcagcgcugggcgccaucuucaccgacgagaacaaguggaaguccgcccgcgaggccguggaggacagccgguucugggagcuggucgaccgcgagcggaaccugcaccuggaggggaagugcgagaccugcguguacaacaugaugggcaagcgcgagaagaagcugggggaguucggcaaagccaagggcucgagagcgauaugguacauguggcucggggccagauuccuggaguucgaggcccugggcuuccucaacgaggaccacugguucagccgggggaacagccugucagguguggagggggaaggccugcauaagcucgguuacauccugcgcgaugucucaaaaaaggagggcggagccauguacgcggacgacaccgccgggugggacacccggaucacgcuggaggaccugaagaacgaagagauggugaccaaccacaugaagggcgagcacaagaaacuggcugaggccaucuucaagcugaccuaccagaacaagguuguccgcguacagcgcccaacgccccgggggacggugauggacauaaucucccgaaaagaucagcgggguucugggcaggucgggaccuacggcuuaaacaccuuuaccaacauggaggcccagcugauacgccaaauggagggggagggcaucuucaagucgauacagcggcugacggugaccgaggagaucgcgguucaaaauuggcucgccagagucggccgagagcggcucagccggauggcgaucuccggggacgacugcgugguaaagccucuggacgaccgcuucgccagcgcccucaccgcucugaacgacaugggcaagguccggaaggacauacagcaaugggagcccucccggggcuggaacgacuggacccagguuccguucugcagccaccacuuccacgagcuggugaugaaggacggccggguccucguagugcccugccgaaaccaggacgaacugaucgggcgggcccgcaucucccagggcgccggcuggagccugaaggagacggcuuguuuagggaaguccuacgcccagauguggacccugauguacuuucaccggcgcgaccuucggcucgcggccaacgcaaucugcucagccguccccucccacugggugcccaccagccgcaccaccuggaguauccacgccaagcacgaguggaugacgaccgaggacaugcuggcugucuggaaucgagucuggauccaggagaacccguggauggaggacaagacccccguggagagcugggaagaagugcccuaccuggguaagagagaggaccaguggugugggagccucaucggccugaccucccgcgccacgugggccaagaacauucaaaccgcaaucaaccagguccggagccugaucggcaacgaggaguacaccgacuauaugcccuccaugaagagauuucggaaggaggaggaggaggcgggcguucuuugguag

SEQ ID NO: 25206 - RNA, 9876 nt, Artificial Sequence
  derived and/or modified CDS sequence (opt11) from DENV-2__EU569711__SS-prME
acggccggcgugauuauaaugcugaucccuacggcgauggcguuucaccucaccacucggaacggagaaccacacaugauagucggacgacaggagaaggggaagucccuccuguucaagaccgaggacggugugaacauguguacccugauggccaucgaucugggggagcugugcgaagacaccaucacuuauaagugcccccuccugcgccagaacgagcccgaggacauagacugcugguguaacagcaccagcaccugggugaccuacgggaccugcaccaccacgggcgagcaccggcgcgaaaaacgcuccgucgcucuggugccccacguggggaugggccuugaaacccggaccgagacguggaugagcuccgagggggcguggaagcacguacagcggaucgagacguggauccucaggcacccggguuucaccaucauggcagcgauccuggccuacaccaucgggacuacgcauuuccagcgggcacucauuuucauccugcugacugccguugcgccuucaaugacgaugcgcugcaucggcaucucgaaccgggacuucguggagggcgucucagggggcuccugggucgacaucguccucgagcacggcagcugcgucacgacgauggccaagaacaagcccacccuggacuucgagcugauuaagaccgaggccaaacagcccgccacccuccguaaauacugcaucgaggccaaacugacgaauacuaccaccgagucccggugcccgacccaaggcgagcccagcuugaacgaggagcaggauaagcguuuuaucuguaagcacaguaugguagaccgcggcugggggaacggcugcggccuuuucggcaagggcggcauagugaccugugcgauguucacgugcaagaaaaacauggagggcaaagucguacugcccgagaaccuggaguacaccaucguaaucacgccccacagcggggaggaacacgcggucggaaacgacaccgggaagcacgggaaggagaucaagaucaccccacaguccagcaucaccgaggccgaguugaccggguacggaacggugaccauggaaugcagcccccggaccggccuggacuucaacgagauggugcugcuccaaauggaggacaaggcauggcuggugcaccgacagugguucuuagaccucccacugcccuggcugccgggggccgacacccagggauccaacuggauccagaaggagacgcucgugaccuucaaaaauccacacgcgaaaaagcaagacguuguaguuuuagggucccaggaaggcgcaaugcacaccgcccugaccggugccacggagauccagaugucuaguggcaaccuccuguucaccgggcaucuuaaaugccggcugcguauggauaagcugcagcugaaggggauguccuacagcaugugcacaggaaaguucaagaucgucaaggagaucgccgagacccagcacgggacgaucgugauuagagugcaguaugagggcgacggcuccccaugcaaaauaccguucgaaaucauggaccucgagaagcggcauauucuagggcgccugaucaccgucaauccaauagugacggagaaggacucgcccgucaacauagaggcggagcccccauucggcgauuccuacaucaucaucggggucgagccgggccagcuuaaacugaacugguucaagaagggaaguagcaucggacagauguucgagacuacgaugcgcggcgccaagcggauggccauccugggggacaccgcgugggacuucggcagccucggaggcguguucacguccauaggcaaagcccugcaucagguguucggcgcaaucuauggggcggccuuuuccggggucucuuggaccaugaaaaucuugauuggggugauaauuacuuggaucgggaugaauagccgcucuaccucucugagcgugagcuugguccugguaggcguuguaacccuguaccucgggguuauggugcaggccgacuccggcugcguuguaagcuggaagaacaaagaacugaagugcggcucagggaucuuuaucaccgacaauguccacacguggaccgagcaguacaaguuccagcccgagucacccaguaaguuggcgucugccauccagaaagcgcacgaggagggaauuugcgguauccggagcgugacgcgacucgagaaucugauguggaagcagauuacgcccgagcugaaucacauucuaagcgagaacgaggugaaacugacgaucaugacaggggauaucaaggggaucaugcaggcugguaagcggucacugcggccccagcccaccgagcuaaaauacuccuggaagacguggggcaaggccaagauguugagcaccgagucccacaaccagaccuuccugaucgacgggccugagaccgcggagugcccgaauaccaaccgggccuggaacucccucgagguggaggacuacggguuuggggucuucuccacaaacaucuggcugaagcugcgggagaagcaagacguguucugugauagcaagcuuauguccgccgcaauaaaggacaaccgagcugugcacgcggauaugggguacuggaucgagucggcgcucaacgacacguggaagauggagaaggccuccuucaucgaagucaaaagcugccacuggccaaagagccacacacucuggaguaacgguguucucgagucagagaugauuaucccgaagaacuucgccgggcccgucucgcagcacaauuauagaccgggcuaccauacccagaccgccggucccuggcaucuggguaagcuggagauggacuucgauuuuugcgagggaacgaccguuguggugacagaggacugcggcaaccgcggcccgucccuccgcacuacgaccgcgucagggaagcugaucacagaguggugcugucgcagcugcacucugcccccguugcgcuaccggggcgaggacggguguugguacggcauggagauccguccacugaaagagaaggaggagaaccugguaaacucucucgucacggccgggcacggacagaucgacaacuucagccucggcgugcuugggauggcccucuuccucgaggaaaugcugcggacacgggucggaacgaagcacgccauccucuuaguugcagucuccuucgucacccugaucacgggcaacaugagcuucagggacuuaggccgcgugauggugauggugggagccacgaugaccgacgauauugguauggggguaaccuaccuggcgcugcucgccgccuucaagguucgccccacauuugcggccggccugcugcuccggaagcugaccuccaaggaacuaaugauggccaccaucgggauagcguugcugagccaguccaccauccccgagacgaucuuagagcucaccgaugcccuggcguuagggaugaugguccuuaagaucgugcgcaacauggagaaguaccagcuggccgugaccauuauggccaucagcugcgucccgaaugccgugauucugcagaaugccuggaagguuucuugcaccauccucgcggccgucagcguaagcccccuccuucugacgagcucccagcagaaggccgacuggauaccccuggcacugacaaucaaaggccugaacccaaccgcgaucuuccugaccacgcugucgcggaccuccaaaaagcggaguuggccgcucaaugaggccguuauggccguuggaaugguguccauccuggccucaucccugcuuaagaacgacauacccaugacagggccgcuggucgccggagggcuccuaaccgugugcuacgugcugacgggccggucagcagaccuugaguuagaacgcgccgcggacgucaagugggaggaucaagccgagauaucaggguccucgcccauccugucaauuacaaucagcgaagacggcuccaugucuaucaagaacgaggaggaagagcacacccucaccauccucaucagaacgggccugcuggugaucuccggcguguuccccgucagcauacccaucaccgccgcagccugguaccucugggaagugaaaaaacagcgcgcgggggugcugugggacguaccaagcccgccgccuguggggaaggccgaacuggaggacggcgccuaccggaucaaacagagagggaucuucggcuauagccagaucggcgcuggggucuacaaggaaggcaccuuccacaccauguggcacgucacccgcggggccgugcucaugcaucgcggcaagcggaucgagcccuccugggccgacgugaagaaagaccugaucucauacgggggcggcuggaaacuggagggggaguggaaggagggcgaggagguccaggugcucgcucuggaaccugggaagaacccucgugccgugcagacgaagccaggccuguuuaagaccaacaccgguaccaucggcgcggucucccuggacuucagcccgggcacguccgggucgcccaucgucgaccgaaaaggaaaagugguagggcuguacggcaacggggucgugacccgaucuggggcuuacgucagcgccaucgcccagaccgagaaaaguaucgaagacaacccugagaucgaagaugacaucuucaggaagaagcgcuuaaccauaauggaccuacacccuggcgcgggaaaaacaaagagguacuugcccgccaucguccgggaggccaucaagcggggccuaaggacccuuauccucgccccgaccaggguggucgccgcggaaauggaagaggcccugagggggcugccaauacgcuaccagaccccagccauccgggccgaacauacgggccgugagaucguggaccucaugugccacgcgaccuucaccaugcgguugcugucccccgugcgcgucccgaacuacaaccucauaaucauggacgaggcgcauuucaccgacccggcaagcaucgccgcgcgcggcuacauuuccacccguguagagaugggggaggccgcgggaaucuucaugacggccaccccccccgggagccgggacccuuucccacagagcaacgcccccauaauggacgaggagcgcgagauccccgagcggagcuggaacuccgggcacgaguggguaacggauuucaaagggaagacgguuugguucguccccagcaucaaggccgggaacgacaucgcggccugccugcgaaaaaacggcaagaaaguuauccaguugucccggaaaaccuucgauuccgaguacgugaagacccgcgcuaaugacugggacuuuguggugaccacggauaucuccgaaaugggggccaacuucagagcugaacguguuaucgacccgaggagaugcaugaagcccgugauccucacagauggugaggagagggugauccuggcaggccccaugccggucacccauucaucagccgcccaacgccgcggccgaauaggucgcaacccgaagaacgagaacgaccaguauaucuacaugggcgagccgcuggaaaaugacgaggacugcgcacacuggaaggaagccaagaugcuccuugauaacaucaacacgccugaaggcaucaucccaagcauguucgagccggagcgggagaaaguggacgcgaucgacggggaguaccgccuacggggcgaagcccgcaaaacguucguagaccucaugcggaggggggaucugccuguguggcuggcauaucggguggccgccgaggguaucaacuacgcggaccgccgaugguguuucgacgggauuaagaacaaccagauccucgaggagaauguggaggucgagaucuggaccaaggagggugagaggaaaaagcugaagccgcgcugguuggacgcccgcaucuacuccgacccccuggcccucaaagaguucaaggaauucgccgcgggccgaaagucucugacccucaaucucaucacggagauggggcggcugcccacguucaugacccagaaggcccgggacgcccuugacaaccuggccgugcugcacaccgccgagguaggcgggcgcgcguauaaccacgcccucuccgagcucccugagacccuggagacgcuccuacuguugacccuacuggccaccgugaccggcggcauauuccucuuccugaugucagggaagggcaucgggaagaugacgcugggcaugugcugcaucauuaccgcgucuauacuccuaugguacgcccagauccaaccgcacuggaucgccgcgucuaucauccuggaguucuuccucaucguacugcucauccccgagccugagaagcagcggacgccgcaggauaaucagcuaacuuaugucgugauugccauccugaccguggucgcagcgacgauggcgaacgagaugggguuccuggaaaaaaccaaaaaagaccucggccugggcucgaucacgacccaggaauccgagagcaacauccuggacaucgacuugcguccggcaucugccuggacgcuguacgccguggccaccaccuucgugacccccauguuacgucacuccaucgagaacucgagcgucaacguaucccucacggccauugccaaucaagcuaccgugcucauggggcugggucgcggguggccccucagcaagauggacauuggcguuccacuacuagccaucgggugcuauucgcagguuaacccgaucacccuaaccgcggcgcugcugcuccugguggcccacuaugccauuauaggccccggccugcaggccaaggcgacgcgcgaagcccagaaacgugcagccgcugggaucaugaagaacccuaccguugauggcaucaccguuauugaucucgagccaaucccauacgacccgaaguucgagaagcaguugggccagguuauguuguugguccugugcgugacccaggugcugaugaugcgcacgacaugggcccucugcgaagcguuaacgcuggccaccggucccaucucuacgcucugggaggggaaccccggccgguucuggaacaccaccauagccgucucgauggccaauauuuuucgcggguccuaccucgcaggcgccggccucuuauuuuccaucaugaagaauacgacgaauacccggcgcgggaccgggaacauaggcgaaacucugggggagaaauggaagagccggcugaacgcccucggcaaguccgaguuccagaucuacaaaaagaguggcauucaggagguggaucggacgcuggcaaaggaaggaaucaagcgaggggaaaccgaucaccacgcgguuucccgcggcagcgccaaacuacggugguucgucgaacggaauauggugacuccugagggcaaggugguagaccucgggugcggcaggggcgggugguccuacuacuguggcggacugaagaacguucgcgaggucaaggggcugaccaagggcgggcccgggcacgaagagcccauacccaugaguaccuacggcuggaaccucguucggcuccagagcgggguagauguguucuucaccccgccggaaaagugugauacccugcucugugacauaggugagucaucaccuaaccccaccaucgaggcgggccgaacgcugcgggucuuaaauuuaguugagaacuggcugaauaacaauacccaguucugcaucaagguacuaaacccuuacaugcccucugucaucgagaagauggagacccuccagaggaaauacgggggcgcccuugugcggaauccuuugagccggaacagcacccaugagauguacugggugagcaacgccaccgggaacaucgucuccuccgugaacaugaucucacgaaugcuuaucaaccgauuuacgaugaagcauaagaaagcgacauacgagccggacgucgaucucggcagcgggaccagaaacauaggcaucgagaacgagaucccgaaccucgacaucaucggcaagcggauugagaagauaaaacaagaacacgagaccuccuggcacuacgaccaggaccaucccuacaagacaugggcuuaucacgguucguacgagaccaaacaaaccggcuccgccagcuccaugguuaacggggucgugagacuguugaccaagcccugggacgucgugccgaugguaacgcagauggccaugaccgacaccacuccguucgggcaacaacgggucuucaaggaaaagguggacaccagaacgcaggaacccaaggagggcaccaagaaacugaugcgcaucaccgcggaguggcuguggaaggagcucgggaagaagaagaccccuagaaugugcacccgggaggaguucaccagaaagguucgaagcaaugcagcucugggcgccaucuucaccgacgagaacaaguggaaauccgcccgcgaggccguugaggacagccgguuuugggagcugguggaucgcgaaagaaacuuacaccuggaggguaaaugcgagacaugugucuacaacaugauggguaaacgugagaagaagcugggggaguucggcaaggcgaagggcagccgggccaucugguacaugugguugggcgcccgguuccuggaguucgaggcgcugggcuuccuaaaugaagaccauugguucagcagggggaacagccuuuccggcguggagggggagggacuacacaaacuaggauauauccugcgcgacgugucuaagaaagagggcggggcgauguacgcagacgacacagccggcugggacacacggaucacacucgaggaccucaaaaacgaggagaugguuaccaaccacaugaagggcgagcacaagaagcuugccgaggcaaucuuuaagcuuaccuaccagaacaagguggugcgcguccaacgcccaaccccacgugggaccgucauggacauuaucucccguaaagaccagcggggcagcggccaggugggaacuuacggauugaacaccuuuaccaacauggaggcccaguugaucagacagauggaaggagagggaauauucaaaagcauucagcggcugaccgugacggaggagaucgccgugcagaacuggcucgccagggugggcagggagcgccugucucgcauggccaucucgggggaugacugcgucgugaagccacucgacgaccguuucgccagcgcgcucaccgcgcugaaugacaugggaaaggugcggaaggauauccagcagugggagcccucccgcgguuggaacgacuggacccaggugccguucuguucacaccacuuccacgagcuggugaugaaggacggccgggugcucgucgugcccugccgcaaccaggaugagcugaucggccgggcccgcaucucccagggggccggcuggucucugaaagaaacagcgugccucgggaaauccuaugcgcagauguggacacugauguacuuucaccggcgcgaccugcggcucgccgcgaacgcgaucuguucggccgugcccucccacugggucccaaccagccgcaccaccugguccauccacgcuaagcaugaguggaugaccacggaggacaugcuggcaguguggaaccgcguguggauacaagagaacccuuggauggaggacaagacccccgucgaaagcugggaggaaguucccuaccugggcaagagggaggaccaguggugcgggagccucaucggcuugaccucgcgcgcgaccugggccaagaacauucaaacagcuauuaaucaggugagaagccucauagguaacgaggaguacacugauuacaugccaucuaugaagcgcuuucggaaggaggaggaggaagccggcguccucugguaa

SEQ ID NO: 25207 - RNA, 9876 nt, Artificial Sequence
  derived and/or modified CDS sequence (opt11) from DENV-2__EU569712__SS-prME
acagccgggaugaucauaaugcugauccccaccgccauggcguuucaccucaccacccgcaacggggaaccccacaugaucguggggcggcaagagaaagggaagucccugcuguucaaaaccgaggacggggucaacaugugcacccuuauggccaucgaccugggggagcugugcgaagacacaauuaccuauaagugcccccugcuccgccagaacgaacccgaggauauugacugcuggugcaacagcaccagcaccugggugaccuacgggaccugcaccacgacgggcgagcaccggagggagaaacggucuguggcccuagucccccacgugggaaugggucuggagacacgcacggagaccuggaugucuagcgagggugccuggaagcacguccagagaaucgaaaccuggauacugcgccacccgggcuucaccaucauggccgcgauccuggccuauaccaucgggacuacgcauuuccagagggcccucaucuucauccugcugaccgcgguugcgcccagcaugacuaugcgcuguauuggaauuucgaaccgggacuuugucgagggggugagcgguggcuccugggucgacaucguccucgagcauggguccuguguaaccacaauggccaaaaacaagcccaccuuggacuucgaacugaucaagaccgaggccaagcagcccgccacccuccgcaaguacugcaucgaagcaaaacugacaaacacaaccaccgaaucccggugcccaacgcaaggcgagcccagccugaacgaggaacaggauaagcgcuuuaucugcaagcacucgauggucgaccgcggcugggggaacggcugcggccuuuucgguaaaggcgggauuguaaccugcgcgauguuuacguguaagaagaacauggagggcaaggugguccugccggagaaccuggaguacaccauaguaaucacaccacacagcggggaggagcacgcggugggaaacgauaccgggaagcacggaaaagagauuaagaucaccccgcaguccagcaucacugaggccgagcucacgggguacggcacggucaccauggaguguagcccccggacaggccuggacuucaacgagaugguucuucuccaaauggaggacaaggccuggcuggugcaccgacaaugguuucuggaccucccccugcccugguuaccuggggcagauacccagggcagcaacuggauccagaaagaaacacucgucaccuucaaaaacccccacgcgaagaagcaagacguggucguccuggggucacaggaaggcgcaaugcacacugcacugaccggggccacugaaauucagaugagcucaggcaauuugcuguucaccgggcaucuaaagugccgucuuagaauggacaagcugcaacugaaggggauguccuauagcauguguacggguaaguucaaaauagugaaagagaucgccgagacccagcacggaacgaucgugauccgagugcaguaugagggugacggguccccuugcaaaauccccuucgagauaauggacuuagagaagcgguacguauugggaagguuaaucaccgugaacccgaucgugacggagaaggacuccccggugaacaucgaggcggagccacccuucggcgacaguuauaucaucauaggggucgagccgggacagcucaagcucaacugguuuaaaaaggggagcuccaucggucagauguucgagacuacuaugcgcggcgcuaagcggauggcaauccuuggggacaccgccugggacuuugggagccucgggggaguguuuaccuccaucgguaaggccuugcaccagguguucggagcuaucuacggcgccgcguucuccggggucucguggaccaugaagaucuuaaucggcgugaucaucacguggaucggaaugaacagcagguccacuagccuguccgugagccuuguucuggugggagucgucacccuguaccucggggugauggugcaagccgacuccggcugcgucguuaguuggaagaacaaggaguuaaagugcggcuccgguaucuucauuaccgacaacguccauaccuggacggagcaguauaaguuccagcccgagagccccagcaaguuggcguccgcgauccagaaggcacacgaggagggcaucugcgggaucaggagcguaacccggcucgagaaccugauguggaagcagauaaccccagagcugaaccacauccucuccgagaaugaggugaagcugacgaucaugaccggggacaucaaggggauaaugcaggcagggaagcggagcuuacggccacagccuaccgagcuuaaguacaguuggaagaccuggggcaaagcaaagaugcugucgacugagucccacaaccagaccuuccugaucgaugggcccgaaacagcggaguguccaaacacgaaccgggccuggaacagccucgaaguggaggacuacggcuucggugucuucucuacgaacaucuggcugaagcugcgugagaaacaggauguguuuugcgacucuaagcucaugucggcagccaucaaggauaaccgggccgugcacgcugacaugggcuacuggauugagagcgcgcugaacgacacuuggaagauggagaaggccagcuucauagaagucaaaucaugccacuggccuaagucccacacccuguggagcaacggcgugcucgaguccgagaugaucauucccaaaaacuucgccgggcccgugagccaacauaauuaucgcccuggcuaucacacccagacagccgggccguggcaccugggcaagcuggagauggacuucgauuuuugcgaggggacgaccgucguugugaccgaggacugcggcaacagaggacccagcuuacgcaccacgaccgcguccgguaagcugaucacugagugguguugccggucuugcacccucccuccucuccgcuaucgcggcgaagacgggugcugguacggcauggaaauucgcccccugaaggaaaaagaggaaaaccuuguaaacucccucgugaccgccggccacggccagauagacaacuucucacuaggcgugcuggggauggcgcuguuccuagaggaaaugcugcggacccgggugggcacaaaacacgcuauccuccuugucgcgguguccuucgucacacugaucacgggaaacaugagcuuccgcgacuuaggccgcgugauggugauggugggggccaccaugaccgacgacauuggcaugggugucacguaucucgcccugcucgccgccuucaagguccgccccacguucgcggcuggucuacugcuccggaagcuaaccuccaaagaacugaugauggcuacaaucggcauagcguugcugagccaguccaccaucccagagaccauccuggaguuaaccgacgcguuggcguuggguaugauggugcuaaagaucguccgcaacauggagaaguaucaacuagccgugaccaucauggcgauacugugcguccccaaugccguaauacuccagaacgccuggaagguaagcugcaccauacuggcugccgucaguguuucaccccuguuguuaacgucuucgcagcagaaggccgacuggaucccccuggcgcucaccaucaagggucucaauccaacugcgaucuuccugaccacguuaucccguaccagcaagaaacgcaguuggccacugaacgaggcggugauggccgugggaaugguuagcauccuggcgaguagccuccugaagaacgacauccccaugacagggccccuggucgccggcggccuccugacgguaugcuacguccugacgggccguagcgcggaccucgagcuggagcgggccgccgacgucaagugggaggaucaggccgagaucuccgggagcucccccauccugucaauaacgaucagugaggacgggagcauguccaucaaaaacgaggaggaggagcagacccucacuauucugauccggacgggacugcuugugaucuccggggucuucccggucaguauacccaucacugccgcagcuugguaucugugggaggugaagaagcaacgcgccggagugcugugggacgucccauccccgccucccgucgagaaggccgaacucgaggauggugcauacagaauuaagcagcgcggcaucuucggguauucgcagaucggcgcgggcguguacaaggaagguaccuuccacaccauguggcacgucacccggggagccgugcuaaugcaccgcgggaagcgaaucgagccaagcugggccgacgugaagaaggaccugaucagcuacggcgggggcuggaagcucgagggugaguggaaggaaggggaagaggugcagguucuggcccuagaacccggcaaaaacccccgcgcgguucagacgaaaccgggucuuuucaaaaccaacaccgguacuaucggggccgucagccuugacuucucccccggcacuagcgggagccccaucguagaucggaagggaaagguugucggccucuacggaaacgguguugugacucgcagcggcgcuuacgucuccgccauugcccagaccgagaaaucaaucgaggacaacccagagaucgaggacgacaucuuccggaaaaagcgacuaacaaucauggaccugcauccgggggcgggcaagacaaagcgguaccugcccgcaaucgugcgcgaggcaauaaaacgugggcugcgcacccucauccuggccccaacccgcguugucgcggcugagauggaggaggcccugcggggacuccccauccgguaccagacccccgccauccgggcugagcauacgggucgcgagaucguggaccugaugugccacgcgaccuuuaccaugcggcugcucucgcccguccgcgucccgaacuauaacuugaucauuauggacgaggcgcacuucaccgaccccgccaguaucgccgcccggggcuacaucagcacgcggguggagaugggcgaagcagcggggaucuuuaugaccgcuacgccucccggcucccgagauccuuucccccagucgaacgcaccaaucauggacgaggagcgagagauucccgaacgguccuggaacagcgggcacgagugggugaccgauuuuaagggcaagacugucugguuuguuccuagcaucaaggccgggaaugacaucgcggcgugccugcgcaagaacggcaagaaggugauccagcucagcaggaagaccuucgacucggaguaugugaaaacccgcgccaacgacugggacuucguggucaccacggacaucagcgagaugggugcaaacuuccgggccgagcgcgucaucgaucccagacgcuguaugaaacccguuauccugaccgacggggaggagcgggugauacuggcgggaccgaugccggucacgcacuccagcgcggcgcagcgccgcggucggaucggucgcaaccccaagaacgaaaaugaccaguauaucuacaugggggagccccucgaaaacgaugaggacugcgcacacuggaaggaggccaaaaugcugcuugacaacauaaacacccccgagggcauaaucccgucuauguucgagcccgagcgggagaaaguggacgcgaucgacggcgaauaccgccuaagaggggaagcccgcaaaaccuucguggaccugaugcggaggggcgaccugccugucuggcuagccuacagaguugccgccgaggggauuaacuacgcggaccgccgguggugcuucgauggcaucaagaauaaccaaauucuggaggagaauguugaggucgaaauauggaccaaagaaggggagcggaagaaacuaaagccgcgguggcucgaugcccgaaucuacucggacccccuggcuuuaaaggaguucaaggaguucgcggccgggcggaaaucccucacccuaaaccucaucacggagaugggcagacucccuacguucaugacgcagaaggcccgagacgcccuggacaaucuggccgugcuccacaccgcugaggucgggggaagggcguacaaccacgcacugagcgaacugcccgaaacccuugagacgcuucugcuccuuacccugcucgccacgguuaccgggggcaucuuccuguuccugaugagcggcaagggaaucgggaagaugacccuagggaugugcuguaucaucaccgccaguauucugcuaugguacgcgcagauccagccgcacuggauugcggccuccauaauccucgaguucuuccucauuguauugcuaauccccgagcccgagaagcagcggacgccccaagacaaccagcugaccuacgucgucauugcaauccugacaguugucgcggccacgauggcgaaugagaugggcuuccucgagaagacaaagaaggacuuagggcugggguccauaaucacccaagagagcgaguccaacauccucgauauugacuugcgcccggccagcgccuggacccuauacgccguggccaccacauucgugacacccaugcugcggcacucgaucgagaacagcagcgucaacgucagccugaccgcgaucgccaaccaagccacagugcuaaugggucuggggcgaggcuggccacuguccaagauggauaucggggucccgcugcucgccauuggcugcuacucacaggugaacccgaucacucucaccgcagcccugcuacugcucguggcacacuaugccaucaucgggccaggccuccaagccaaagcgacccgcgaggcccagaaaagggcagcggccgggauaaugaagaaccccacggucgacgggauuaccgugaucgaccuggagcccaucccguacgaccccaaauuugagaagcagcugggccaggucaugcugcuagugcugugcguuacacagguucuaaugaugcgcaccacgugggccuuaugcgaggcuuuaaccuuggccaccggucccaucuccacccuuugggagggcaaccccgggcgguuuuggaacacaacgaucgccgugagcauggccaacaucuuccgcggcagcuaccuggcuggggcagggcucuuguuuagcauuaugaaaaacaccaccaacacgcgacgcggcacggggaacaucggggagacccuuggcgaaaaguggaagucccguuuaaacgcccugggcaagagugaguuccagaucuacaagaaguccggcauccaggagguugauagaacccuagccaaggagggaaucaagcggggcgagacugaccaucacgcggugagcagaggcucggccaaacuccgaugguucgucgaacgcaacauggugacgccugagggcaagguggucgaccucgggugcggucgcggcggguggucauacuacuguggagggcugaagaacgugcgcgagguuaagggccucaccaagggagguccgggccacgaggagcccaucccgauguccacguacgguuggaaccugguccgacugcagagcggaguugacguguuuuucacgccgccugagaagugcgacacacuauugugcgacaucggagaaagcucccccaacccgaccauugaggccggccgcacacugcgcguccucaaccuaguugagaauuggcugaauaacaacacgcaauucuguaucaaggugcucaacccauacaugcccagcguuauugagaaaauggagaccuugcagcgcaaguacggcggggcacuggugcggaacccccugucccgcaacagcacccacgagauguauuggguguccaacgcgaccggcaacaucgugucauccgugaauaugaucagccggaugcucaucaaucgguuuaccaugaagcacaaaaaggccacguaugagccggacguugaccuggggucaggcacccgcaauaucgguaucgaaaacgagauccccaaccuggacaucaucggcaagcggaucgagaagauuaagcaagagcacgaaaccagcuggcacuacgaccaggaucaccccuauaagaccugggccuaccacggguccuacgagacgaagcagacagguagcgccuccaguaugguaaacggcguggugcgccucuugacaaagccuugggauguggugccgauggugacccagauggccaugacagauaccacccccuucggacaacagcgggucuuuaaggagaaaguggacacucgcacacaggaacccaaggaggggacaaagaagcugaugcggaucacagcagaguggcucuggaaggagcuggggaagaagaaaacgccgcgcaugugcacgcgagaggaguucacacgcaaaguccgguccaacgcggcccugggggcuaucuucacagaugaaaauaaauggaagucugcacgcgaggccgucgaggauagcagguuuugggagcucguggaccgcgagcggaaccugcaccuugagggcaagugugagaccugcguuuacaacaugaugggcaagagggagaagaagcugggcgaguuugggaaggccaagggcucucgggccauaugguacauguggcugggcgcgcgcuuucuggaguucgaggcccucggguuccugaacgaggaccacugguucucccgggguaacagccucagcgggguggagggcgaagggcuacacaaguuaggcuacauccucagagacguauccaagaaagagggcggggcgauguacgcugacgacaccgccgguugggacacgaggaucacgcuagaggaccugaaaaacgaggagauggucaccaaccacaugaagggggagcacaagaagcucgccgaagcgaucuuuaaacuuacguaucagaacaaggugguacgcguccagcgcccgacgccccgggguaccguuauggacaucaucucccgcaaggaccaacggggcagcggucaggugggcaccuauggguuaaacacguucacuaauauggaggcacagcugauaaggcagauggagggcgagggcaucuuuaagagcauccagcaccucacagucaccgaggagauugccgugcggaacuggcuggcccgagugggcagggagcgcuugucccggauggccaucagcggcgaugauugcguagugaagccacuagaugaccgguucgcuuccgcccugacggcccugaacgauaugggaaaggucaggaaggacauccagcagugggagcccucucgcggcuggaacgauuggacccaggucccguucugcucccaccauuuccaugaacucguaaugaaggaugggcgggugcuagucgugcccugcaggaaccaggacgagcugaucggccgugcucgcaucucccaaggcgccggcuggucgcucaaagagaccgccugccuaggaaagagcuacgcgcagauguggacgcugauguacuuccaccggcgcgaucuacggcuggccgccaacgccauaugcagugccgugcccucacacuggguccccaccucccgcacgaccuggucgauucacgcgaagcaugaauggaugacgaccgaggacauguuagcagucuggaaccgcguguggauccaggaaaacccguggauggaggacaagacgcccgucgagucaugggaggagguccccuaccucgggaagcgggaggaccaguggugcggcucucuaaucggccugaccagccgcgccaccugggccaagaauauccaaacagccaucaaucaggugcgguccuugaucggaaaugaggaguacacagacuacaugcccagcaugaaacgcuucagaaaagaggaggaggaggcugggguccugugguag

SEQ ID NO: 25208 - RNA, 9876 nt, Artificial Sequence
  derived and/or modified CDS sequence (opt11) from DENV-2__EU596487__SS-prME
acagccggagugaucaucauguuaaucccuacugcuauggcguuccaccucaccacccguaacggagagccccacaugaucgugggccggcaggagaaggggaagucccuguuauucaaaaccgaggacggcgugaacaugugcacccucauggcgaucgaucugggggagcuuugugaggacacaaucaccuacaagugcccccuccugcggcagaacgagcccgaggacaucgacugcuggugcaacucaaccagcacgugggugaccuaugggaccugcaccacgacaggcgaacaucggcgcgagaagcguuccgucgcccugguuccccacguggggaugggccucgagacccgcacagagaccuggaugagcagcgagggggccuggaagcacgugcagaggaucgaaaccuggauccugcgacacccgggcuucaccaucauggccgcgauccuggccuacaccaucgggaccacgcauuuucagcgggcucucaucuucauccuguuaacugccguugcgcccuccaugaccaugcgcugcauugguaucuccaaccgggauuucguugagggugucagcgggggcuccuggguggacauugugcucgagcacgggucuugcgucacgacgauggccaaaaacaagcccacccuggacuucgagcugauuaagaccgaggccaaacaacccgccacauugcgcaaauacugcaucgaggcaaagcugacuaacaccaccaccgagucccggugcccgacgcaaggcgagccgucgcugaaugaggagcaggacaagcguuucaucuguaagcacuccaugguggaccgggguugggggaacgggugcggccucuucggcaaaggcgggaucgugaccugcgcgauguucacaugcaaaaagaacauggagggcaaaguagugcugccugagaaccuggaguacacaaucgugaucacuccccacucaggggaggaacacgccgucggcaacgacaccgggaagcauggaaaggagaucaagaucaccccgcaguccagcaucacagaggccgaacucaccggcuacggaacggugacuauggaguguagcccccguacgggguuagacuuuaacgagauggugcugcuccagauggaggacaaggccuggcugguacaccggcagugguuccuggaucucccacugcccugguugccgggggcagauacccaggggagcaacuggauccaaaaggaaacgcuagucaccuucaagaacccccacgccaagaagcaagacguggucguccugggaucccaggagggggccaugcauaccgcccugaccggugcuaccgaaauccaaaugucuagcggcaaccuccucuucacgggccaccugaagugccgccuccggauggacaagcugcagcugaaggggauguccuacagcaugugcacgggcaaauucaaaaucguaaaggagaucgccgagacccagcacgggacuauugugauucgcgugcaguacgagggcgacggcucccccugcaaaauuccauucgagaucauggaccucgaaaaacggcacguccuagggcgccugauaacggucaacccgauaguaaccgagaaagacagccccguaaacauagaggcugagccgcccuucggcgacucguacaucaucaucgggguggagccuggccaguuaaagcugaacugguucaagaaggggagcuccaucggccagauguucgaaacuacgaugcgcggggcaaaacggauggccauccugggggacacggccugggacuucgggagccucgggggcguguucaccuccaucgggaaagccuuacaccaggucuucggcgcgaucuacggggccgccuucagcgggguguccuggacuaugaagauccugaucggagugaucaucaccuggaucgggaugaauucacgcuccaccagccuguccgucucccucgugcuggugggagucgugaccuuguaucucggugucaugguccaggccgacuccggaugcguagugagcuggaagaacaaggagcuaaaguguggcuccggcaucuucauaaccgauaacgugcacacguggaccgagcaguacaaguuccagcccgaaagccccagcaagcuagcguccgcgauacagaaggcacacgaggagggcaucugcgggauucgcagcgucacaaggcucgagaaccugauguggaaacagauuacuccagaacucaaccauauccucuccgagaacgaagugaaacugacgaucaugacuggcgacaucaaggggaucaugcaagccgguaagcgcucacuacggccgcagcccaccgagcuuaaguacuccuggaagaccuggggcaaggcuaagaugcugaguacggagagccacaaccagacguuccugaucgacgggccagagaccgcggagugcccuaacacaaaccgggccuggaacagccucgaggucgaggacuacggcuucgguguauucuccacgaacaucuggcugaagcugcgggaaaaacaggacguguuuugcgacagcaagcuaauguccgcagccaucaaggacaaccgggccguccacgcagacaugggcuacuggauagagagcgcccugaacgacaccuggaaaauggaaaaggcgaguuucaucgaagucaagagcugucacuggccuaagucccacacgcuuuggagcaacggcgugcucgaguccgagaugauaauccccaagaacuucgccgggcccguuagccagcacaauuaucguccgggcuaucacacccaaaccgccgggcccuggcacuuaggcaaacuggagauggacuuugacuucugcgagggcacgacaguuguggucaccgaggacugcggaaaccggggcccgagccuccgcaccacgacggcguccgggaagcuuaucaccgaguggugcugucggagcugcacccugccuccgcuccgcuaccguggggaagacggcugcugguacgggauggagauacgcccccugaaggagaaggaggagaaccugguaaauucccucgugacggccgggcacggccagaucgacaauuucucacugggaguccuggggauggcccucuuccuggaggagaugcugcggacccgcgugggcaccaagcacgccauccuacuagucgcggucuccuuugugacccugaucacgggcaacaugagcuuucgggaccucggccgcgucauggucauggugggggcuaccaugaccgacgauauuggcaugggcguaacguaccuggcccugcucgccgccuucaagguccgccccacguucgcggccgggcuguuauugcggaaacugacuuccaaggagcugaugauggccaccauaggaaucgcccucuuaagccagucaaccauccccgagacgauccuugagcucacggacgcgcuggcucuugggaugauggugcucaagaucguucgcaauauggagaaguaccagcuggcugucaccaucauggccaucagcugugucccgaacgcuguaauccuacagaaugcuuggaaggucuccugcaccauccuagcggcugugagcgugagcccgcugcugcuuacguccagccagcagaaggccgacuggaucccccuggcccugacuaucaagggccucaaccccaccgcgaucuuccugaccacgcugagcagaacuuccaagaaacgcucuuggccgcucaacgaggccgugauggcugugggcauggugaguauccuggcuucaagcuugcucaagaacgacaucccuaugacggggccccugguggccggggggcugcucaccgugugcuauguccugacgggccgguccgcggaccuggagcuggagcgcgccgccgacgugaaaugggaggaccaagccgagaucucaggguccucccccaucuuguccaucacgaucucagaggacggcucaaugucgaucaagaaugaggaagaggagcacacccugacaauccucauccggacgggacuccugguaaucaguggagucuucccggugucaauccccauaaccgccgccgccugguaucugugggagguuaagaagcaacgcgccggcgucuugugggacguucccagcccgccgccaguugggaaagcagagcuagaggauggcgccuacaggaucaagcagcgcgggauauucggcuacagccagaucggcgcgggggucuauaaggagggcaccuuccacaccauguggcacgugacccggggugccgugcucaugcaccgcggcaagaggaucgagccuuccugggccgacguaaagaaggaccugaucagcuacgggggcggguggaagcuggagggggaguggaaagagggcgaagagguccaggugcuggcccuggagccagggaagaacccccgagccguccaaacuaagccagggcuguucaagaccaacaccgggacuauuggcgccguguccuuagacuucuccccagggacgucagguucacccaucguagaccggaagggcaaagugguggggcuguauggcaacggcguugucaccagguccggggccuacgugagcgcaaucgcccagaccgaaaaguccaucgaggauaaccccgagaucgaggacgauaucuuccggaagaagcgccuuaccaucauggacuugcacccaggcgcagggaagaccaagcgguacuugcccgcgauugugcgcgaagccaucaagaggggguuacgcacucucauccuugcucccacacgcgucguggccgcugagauggaagaagcccugagagggcuucccauacgcuaucagaccccagccauccgugccgagcauacaggccgcgagaucguggaccucaugugccacgccacguucaccaugcggcugcuaucgccgguccguguaccgaacuauaaccugauaaucauggacgaggcccacuuuaccgaucccgccagcaucgcggcucggggcuacauauccacucgcguggagaugggggaggccgcgggcauuuucaugaccgccacgccaccggggagccgcgacccguucccccaguccaaugcccccaucauggacgaggaaagagaaauucccgagcggagcuggaacagcggucacgaauggguaaccgacuucaaggggaagacggugugguucgugccgucgaucaaggccgguaacgacaucgccgccugccugcgcaagaaugguaagaagguuauucagcugucgcgaaagacauucgacucggaauacguaaagacucgcgccaaugacugggauuucgugguuaccacugacaucuccgagaugggagccaacuuccgggccgagaggguuaucgacccccggcgcugcaugaagcccgugauccucaccgacggcgaggaacgggucauccucgcggggcccaugccagugacccacagcuccgccgcccaacgccgcggacgaaucggccgcaaccccaagaaugagaacgaccaguacaucuacaugggugaaccgcuggagaacgaugaggacugcgcucacuggaaggaggccaagaugcuccuggacaacaucaauacccccgagggcaucaucccgaguauguucgagcccgaacgggagaagguugacgccaucgacggggaauacaggcugaggggcgaagcacgcaagacguuugucgaccucaugcggcgcggggaccuaccuguuuggcuggccuaccggguggccgccgaaggcauuaacuaugcagaucggcgguggugcuucgaugggaucaagaacaaccagauccucgaggagaacgucgagguagagauuuggaccaaggagggcgagcgcaagaaacugaagccgcgguggcuggacgcccgcaucuauuccgacccccucgcccuuaaggaguuuaaggaguucgccgcuggccguaaaucucugaccuuaaaccugaucaccgagauggggcgacugcccacguucaugacccaaaaggcccgggacgcgcucgacaaccuggccgugcugcacaccgccgaagugggcgggagagcguacaaucaugcccucuccgaauugcccgagacccuggagacguuauuacugcucacucugcuggcuaccguaacuggcggcaucuuccuuuuucugaugucggggaagggcauaggcaaaaugacguuaggcauguguugcaucaucaccgccuccauucuccuuugguacgcccagauucagccccauuggaucgcggccagcaucauacuggaguucuuccucauaguccugcugauccccgagccugagaagcagcggacuccccaagacaaccaacucaccuacguggugaucgccauccugacugucguggccgcaacgauggcgaaugagaugggguuucuggaaaagacuaagaaggaccucggccugggcagcauuaccacccaggaguccgagagcaacauccuggacaucgaccuacgcccagccuccgccuggacgcuguacgccguggccaccaccuucgucacgccaauguugcggcacagcauugagaacagcagcguuaaugugagccucacugcgaucgccaaccaggccaccguccucauggggcugggccguggguggccccucucaaagauggacauuggggugccucugcuggccaucgggugcuauucccaggucaacccgaucacgcucaccgcggcccugcugcuccucgucgcgcauuacgccaucaucgggcccggacugcaggcaaaggccacgcgagaagcccagaagcgggccgccgcugggaucaugaagaaccccacuguggacggcaucacaguaauugaccucgaacccaucccuuaugaccccaaguucgagaagcaauuagggcaggucaugcugcucgugcugugugugacccagguccugaugaugagaacgaccugggcgcucugcgaggcccuuacccuggccaccggccccaucagcacgcucugggaagggaacccgggccgguucuggaacaccaccaucgccgugaguauggccaauauauucagaggauccuacuuggcgggggccggucuccucuuuuccaucaugaaaaacacaacgaauacucggcgcggaaccggcaacaucggcgagacacugggggagaaguggaaguccagguugaacgcucuaggcaaguccgaguuccaaaucuacaagaaguccgggauccaggaaguggaccgcacgcuggccaaggagggcaucaaacggggggagaccgaccaucacgcggucucucgcggcuccgcgaagcugcggugguucguggagcgcaauaugguaaccccggaggguaaagucguggaccucgggugcggccggggggggugguccuacuacuguggcgggcugaagaacgugcgcgaagucaaggggcuuaccaaaggggggccugggcacgaggagccuauccccaugagcacguauggcuggaaccucguacggcuucagagcgggguggacgucuucuucaccccgcccgagaagugcgacacccugcucugcgauaucggcgaauccagucccaaccccaccaucgaggcaggucguacccuacgugugcuaaaccucguggaaaacuggcugaauaacaacacucaguucugcauaaagguccuuaacccguacaugcccuccgugaucgagaagauggagacccuccagcgcaaguacgggggcgcccuagugcggaaccccuugucacgcaacuccacccacgagauguauugggucagcaaugccacagggaacaucguguccagcgugaauaugaucucccgcauguugauaaaccgguucacgaugaaacacaagaaggccaccuacgagccugacgucgacuuaggcagcgguacccgcaauaucggcaucgaaaaugagauacccaaccuggauaucaucggcaaacggauagagaagauuaagcaggagcaugagaccuccuggcacuaugaccaggaccauccauauaaaacgugggccuaccauggauccuaugagacaaagcagacuggcucggccaguuccaugguuaacggggugguaaaguuacucaccaaacccugggacguggugccgauggucacgcagauggccaugaccgacaccacccccuucggccagcagcgaguguucaaggagaagguggacacccgaacccaagaacccaaggagggcacaaagaagcugaugcgcaucaccgcagaguggcucuggaaagagcuugguaagaagaagacgccccgaaugugcacccgagaggaauucacccggaagguccgcagcaacgcggcccugggcgccaucuucaccgaugagaacaaguggaaguccgcccgggaggccgucgaggacagcagauucugggaacuggucgaucgggagcgcaaccuccaccuggagggcaagugcgagacgugcguguacaacaugaugggcaagcgggagaaaaagcugggggaguuuggcaaagcuaaaggcucacgcgcuaucugguacauguggcucggggccagguuucuugaguucgaggcccucgguuuucucaaugaggaccacugguucagccgagggaacagccuuuccggcguggagggagagggccugcacaaguuggguuauauccugcgagacguaagcaagaaggaaggcggugcgauguacgccgaugacacggcggggugggacacccgcaucacccuggaggaucuuaagaacgaggaaauggugacgaaccauaugaagggcgaacacaagaaguuagccgaagccaucuucaagcucaccuaccagaacaaggucguccgggugcagcgcccgacgccccggggaaccgugauggacaucaucucccggaaggaucagagagguagcggccaggucgggacguacggccugaacaccuucaccaacauggaggcgcagcugauccggcaaauggagggggagggcaucuucaaguccauccagcgccugaccguuacggaagagaucgccguucagaauuggcucgcccgggucggacgcgagcggcugagccgcauggcaauuuccggggacgauugcguggugaagccgcuggacgaccgguucgccagugcgcucaccgcgcucaacgacaugggcaagguccgcaaggacauccaacagugggagcccucacggggguggaacgacuggacccaggugccguucugcucgcaucauuuccaugagcuggucaugaaggacgggcgcguucucguggugcccugccggaaccaagacgagcugaucgggcgugcccggauuucccagggcgccggcuggagcuugaaggaaaccgccugccucgggaaguccuacgcgcagauguggacgcugauguauuuucaccgccgagacuuaagacucgcggccaacgccaucugcucugccguccccucccacugggugcccaccucucggaccaccuggucaauccacgcgaagcaugaguggaugaccacggaggacaugcuggccguguggaaccgcgucuggauacaggagaacccguggauggaggacaaaacccccguggagagcugggaggaggucccuuaccugggcaagcgcgaggaccaauggugcgggagccucauugggcugaccucccgggccaccugggccaagaacauccagacggcgaucaaucagguccggucguugauagggaacgaggaguacacagauuauaugccaaguaugaagcgguuccguaaggaggaggaggaggccggcgugcuaugguga

SEQ ID NO: 25209 - RNA, 9876 nt, Artificial Sequence
  derived and/or modified CDS sequence (opt11) from DENV-2__EU569713__SS-prME
accgccggcguuaucaucaugcugaucccgaccgccauggcguuccaucucacgacccguaacggggagccccacaugauagucggccggcaggaaaaggggaagucguuguuguucaagaccgaagacggagucaacaugugcaccuuaauggccaucgaccuuggagagcuuugugaggauaccaucacauacaagugcccccuacugcggcagaacgagcccgaggauaucgauugcuggugcaacucaaccagcaccugggugaccuacggaaccugcaccacaacgggcgagcacagacgcgagaagcgguccgucgcccucgucccccacguggggaugggccucgagaccagaacagagaccuggaugagcagcgagggugccuggaagcacguccagaggaucgagaccuggauccugcgccacccgggcuucacgaucauggccgcgauccuggccuauacaaucgggaccacucacuuucagcgcgccuuaaucuucauacugcugaccgccguggcgccaucgaugaccaugcgcugcauuggcaucuccaaccgugauuucgucgagggcgucagcgggggcuccuggguggacaucgugcucgagcacgggagcugcgugaccacgauggcgaagaacaaaccgacccuggacuucgagcugaucaagaccgaggccaagcagcccgcuacccuccgcaaguacugcaucgaggccaagcugacaaacaccacuaccgagucccggugcccaacucagggcgagcccagccugaacgaggagcaggacaagcguuucaucugcaaacauuccauggucgaccggggcugggggaacggcugcggccucuucggcaagggugggaucguaaccugcgcgauguucacuuguaagaaaaacauggagggcaaggucgugcugcccgagaaccuggaguacacgaucgugaucacgccccacagcggggaagagcacgcgguuggcuccgauaccgggaagcacggcaaggagaucaagauuacgccgcagagcagcaucaccgaggccgaguuaaccggguauggcaccgugaccauggagugcagcccacgcaccggccuggacuucaacgagaugguucuacuccagauggaggacaaggccuggcugguccacagacagugguuccuggaccucccccugcccuggcugccgggggccgacacccagggguccaacuggauccagaaggaaacgcuggugaccuucaagaauccacacgcuaagaagcaggacguggucgugcuggggucacaggagggcgccaugcacaccgcccugaccggggccacggagauccagaugagcucgggcaaccuccuauucaccggccaccugaagugccguuuacggauggacaagcuccagcucaaggggaugagcuauuccaugugcaccgggaaguucaagaucgucaaagaaaucgccgaaacccagcacgggacgaucguaauaagagugcaguacgagggcgacggcagucccugcaagauccccuucgagaucauggaccucgagaagcgauacguccucgggcgccugaucaccgugaacccgaucgugaccgagaaggacucccccgucaacaucgaggcggaaccgcccuucggcgacagcuacauaauuaucgggguggaaccgggccagcucaaguuaaauugguucaagaagggguccagcaucggccagauguuugagaccaccaugcguggcgcgaagcggauggccauacugggggacaccgcuugggacuucggcucccucggcggcguguucaccagcaucgggaaggcgcuccaccagguauucggcgcgaucuauggcgcggccuucuccggggugagcuggaccaugaagauccugaucggcgugauaaucacuuggaucgggaugaacagucgcagcaccucccugagcguaucccucgugcuggugggcguggugacccuguaucugggagugaugguccaggcugacagcggcuguguaguauccuggaagaacaaggagcugaagugcggcucaggaaucuucaucaccgacaacguucacacguggacagagcaguacaaguuccaacccgagagcccguccaagcucgcgagcgccauccagaaggcccacgaggagggcaucugcgggauacgcuccgugacccgccucgagaacuuaauguggaagcagauuacccccgagcugaaucacauccucagcgagaacgaagcuaaguugacgaucaugaccggcgacaucaaggggaucaugcaggccggcaagaggucccugcgcccccagcccaccgagcucaaauacagcuggaagaccuggggaaaagcgaagaugcugagcacggagagccacaaccaaaccuucuuaaucgacggacccgaaaccgccgaaugcccgaauaccaaccgggccuggaacucccucgagguggaggacuauggcuucggggucuuuaguacaaacaucuggcugaaacugcgcgagaagcaggacguguucugcgauaguaaauugauguccgcugccaucaaggauaaccgugcggugcacgccgauauggguuacuggaucgaguccgcccugaacgacacguggaagauggagaaggccagcuucaucgaggucaaguccugccacuggcccaagagucacacccugugguccaacggggugcucgagagcgagaugaucauacccaagaacuucgcagggccggugagccagcacaacuacagaccggguuaccacacgcagaccgcagggccauggcaccugggcaaguuggagauggacuucgacuuuugcgaggggacaaccgucguagugaccgaggacugcggaaaccgggggcccagucucagaacuacgaccgccagcgggaaacugauuaccgaguggugcugccgguccuguacccugccgccguugcgcuaccggggcgaggacgggugcugguacggcauggagauccgcccccugaaggagaaggaggagaaccuggucaacagccucgugacggcugggcacggccagaucgacaacuucucccugggcgugcuggggauggcccucuuccuggaggagaugcugcggacccgggucggaaccaagcaugcgauccucuuaguggccguguccuucgucacacugaucacggggaacauguccuucagggaccucggcagagugauggugauggucggggccaccaugacagacgauaucggcaugggcgucaccuaccuggcccugcucgccgcguucaagguucgccccaccuucgccgccgggcugcugcuccggaagcugaccagcaaggaacugaugauggcuacgauuggcaucgcccuccugucccagucuacuauccccgagacgaucuuggagcucaccgacgcgcuggccuuggggaugaugguccucaagaucgugcgcaacauggagaaguaccagcuggccgugaccauuauggccauccugugcgucccgaacgccgugauccugcagaacgcguggaagguauccugcacaauccuggccgcugucagcgugagcccccuucuccugacgagcucccagcagaaggccgacuggaucccccucgcgcucaccauaaagggccugaaucccaccgcuaucuuccugaccacgcucucgaggaccuccaaaaagcgcagcuggccgcugaacgaggcugucauggcugugggcaugguguccauccuggccaguagccuccugaagaacgacauccccaugaccgggcccuuagucgccggggggcuccugaccgucugcuacgugcugacggggagguccgccgaccuagagcuggaacgcgccgcggacgucaagugggaggaccaggcagagaucucaggguccagccccaucuuaaguaucaccaucagcgaggacggcaguaugagcauuaagaacgaggaggaggagcagacucucaccauccuuauccggacgggccugcucgugaucuccgggguguucccggucagcauucccaucacugcggcggccugguaccuuugggaggugaagaagcaacgcgccggugucuugugggacguucccagcccuccgcccgucgguaaggccgagcucgaggacggcgcuuaccgcaucaaacagcgcgggaucuuuggcuacagccagauaggcgccgggguguacaaggagggcaccuuccacaccauguggcacgucacccgaggugccgugcugaugcacaggggcaagcgcaucgagcccucgugggccgacgugaagaaagaccuaaucaguuacgguggcggcuggaaacucgagggggaauggaaggaaggggaggagguccaggugcuggcccuggagcccgggaaaaaccccagggcuguucagacgaagcccggccucuucaagaccaacaccgggaccaucggcgccgucucccuggacuucucgcccggcacgagugggagccccauuguggaccggaaggguaagguggucgggcuguacggcaacggcguggucacccgcucgggggccuacgucucggcaaucgcgcagaccgagaagucgauugaggacaaccccgagaucgaggacgacauuuuccggaagaagcgccucaccaucauggaccugcaccccggcgcggggaagacgaagcgguaccuucccgccaucgugcgcgaggcuauuaaacgggggcuacgcacccucauacuggcaccgacucgcguggucgccgcggaaauggaggaagcccugagggggcuacccauccgauaccagacccccgccauccgggccgagcacacgggccgcgagaucguggaccugaugugccacgcgaccuucaccaugcggcugcuaucuccagugcgcgucccgaacuacaaccugaucaucauggacgaggcacacuucaccgaccccgcgagcaucgccgcaagagguuauauauccacacgcguggagaugggggaggcggccggcaucuucaugacugcaacaccgcccgggagucgugacccguuuccccagucgaacgcccccaucauggacgaggagcgcgagauccccgagcguagcuggaacuccggccacgagugggugaccgacuucaaggggaagaccgucugguucgugccgagcaucaaggcuggcaacgacaucgccgcgugccugcgcaagaacggaaagaaggugauccagcugucccggaaaaccuucgacagcgaguacgucaagacccgggcaaaugacugggacuuuguggugaccacggacaucuccgagaugggggccaacuuccgggcggagcgcgucaucgacccccggcgaugcaugaagcccguuaucuuaacggauggggaggagcgggucauccuggcgggucccaugccggugacccacagcuccgcggcccagcgcagaggccggaucgggcgcaaccccaagaacgaaaaugaccaguauaucuacaugggggagccccucgaaaacgacgaggacugcgcucacuggaaggaggcgaagauguugcuggacaacaucaacacccccgaggggaucaucccgagcauguuugagcccgagcgagagaagguggacgccaucgacggggaguaccgccuccggggggaggcccgcaagacauuuguggaccugaugcggcggggcgaucugcccgucuggcucgcuuaccggguugcggcggaaggaaucaacuacgccgaccgccguuggugcuuugacgguaucaagaacaaccagauccuggaggagaacguggaagucgagaucuggaccaaggagggugagcgcaagaagcugaagccgcgcuggcucgaugcccgcauuuacuccgacccccuggcccugaaggaguucaaagaauucgcggcgggccgcaagagcuugacacugaaccugaucacagaaauggggcgccugcccacguuuaugacccagaaggcccgggacgcccuggacaaccuggccgugcugcacaccgcggaggucggcggccgcgccuacaaccacgccuugucagagcugcccgagacccucgaaacguugcugcuacugacucuuuuagccaccgugaccggcggcaucuuucuguuccugaugagcgggaagggcaucggaaagaugacgcuuggcaugugcugcaucaucacagccagcauucuccucugguacgcgcaaauccaaccgcacuggaucgccgccagcaucauccucgaguucuuccugaucgugcuccucaucccugagccagagaagcagcgcacgccacaggacaaccagcugaccuacgucgugaucgccauucugaccguggucgccgcaaccauggccaaugagaugggguuucucgagaagaccaagaaggaccugggacugggcagcaucauuacccaggaaucagagagcaacauccucgacauagaucugcgcccggccuccgcguggacccuguacgcuguggcaacaaccuucguuacccccaugcuccggcauagcaucgaaaauaguagcgucaacguguccuuaaccgccaucgccaaccaggcgacgguacuuauggggcucggacgcggcuggccccugagcaagauggacaucggcguacccuuacuagcgaucgggugcuacucccaaguaaacccuauuacccugaccgccgcccuucuccuguuaguggcacauuacgcgaucauaggccccggccuucaagcgaaggccacccgcgaggcccagaagcgggcggccgcgggcaucaugaagaacccuaccgucgauggcaucaccguuaucgaccuggagcccaucccguacgaccccaaguuugagaagcagcuugggcaggugaugcuccugguccugugcgugacucaggugcucaugaugcgaaccacgugggcccugugcgaggcccugacgcucgccacuggccccaucagcacccugugggagggaaaccccggccgguucuggaacacgaccauagccgugagcauggcgaacaucuuccgcggcagcuaccuggccggggccggccuccuguucaguaucaugaagaauaccaccaauacgcggcgggggacaggcaacaucggcgagacccugggggagaaguggaaguccagacuuaacgcccugggcaaguccgaguuccagauauacaagaaguccgggauccaagagguggaucgcacccuggcgaaggaggguaucaagcgcggggagaccgaccaccacgccgugucccgggggagcgccaagcugcggugguucgucgagcgcaacauggugaccccggagggcaaggucguugauuugggguguggcaggggcggguggucauacuacugcggcgggcugaagaacguacgcgaagugaagggguuaacuaagggcgggcccggacacgaggagcccaucccaaugagcaccuacggcuggaacuuaguccggcugcagagcgguguggacguguucuacacaccgcccgagaagugcgacacccucuuaugugacauuggcgagucaagccccaacccaaccaucgaggcaggccgaacccugcgggucuuaaacuugguggagaauuggcugaacaacaacacccaguucugcauaaaggugcucaacccguacaugcccuccgucaucgagaagauggagacgcugcagcgcaaguauggaggcgcauuggugcggaaccccuuaagccgcaauuccacccacgaaauguauugggugagcaacgcgacggggaacaucgucuccagcgugaacaugaucucacgcaugcucaucaaucgcuucaccaugaagcauaaaaaggccacguacgagccggacguggaccuuggcagcgggacccgaaacaucgguaucgagaacgagaucccaaacuuagacaucaucggcaagcggaucgagaagaucaagcaggagcacgagaccuccuggcauuacgaccaggaccaucccuacaagaccugggccuaccacgggucguacgaaacgaagcagaccgguucagccagcuccauggucaacggugucgugcgccuuuugaccaagcccugggacgucgugccaauggugacacaaauggccaugacggauaccaccccuuuugggcagcagcgggucuucaaggagaagguggacacgcgcacacaggagcccaaagagggcaccaagaagcugaugcggaucaccgcggaguggcucuggaaggagcuggggaagaagaagacgccccggaugugcacccgggaggaguucaccagaaagguaagaagcaacgcggcccugggcgcaaucuucaccgacgagaacaaguggaagagugcccgcgaggcagucgaggacagccgguucugggagcugguggaccgcgagcgaaaccugcaucuggaggggaagugcgagaccugcguguacaauaugaugggcaagcgcgaaaagaagcuuggggaguucggcaaggcaaagggcagucgggccaucugguauaugugguuaggggcccgcuuccuggaguucgaggcccucggcuuccugaaugaggaccacugguuuagucgagggaauucucuguccggcgucgagggggaaggucuccacaagcugggcuacauccugcgcgacgugagcaagaaggagggcggggccauguacgcggaugauacggccgggugggacacccgaaucacgcucgaagaccugaagaacgaggagaugguuaccaaccacaugaagggggagcacaagaagcuugccgaggcgaucuuuaaguuaacguaccagaauaagguugugcgcguccagcgcccgacgccccgggggacggugauggacaucaucucccggaaggaccagcggggcagcggccagguggggaccuacggccugaacacguucaccaacauggaggcccagcugauccgccagauggaaggggagggcauauucaaguccauccaacaucucaccguuaccgaggagaucgccgugcagaacuggcuggcccgggucggccgcgagcgucugagccgcauggcuaucucuggggaugacugcgucgugaaacccuuggaugauagguucgcaagcgcccugacggcccuuaaugacaugggcaaggugcgcaaggacauccagcagugggagcccucacgggguuggaacgacuggacccaggucccguuuugcagccaccacuuccacgaguuggugaugaaggacggccgcgugcuggucgugcccugccggaaccaggacgagcugaucgggcgcgcccggaucucccagggcgcgggcuggagccuaaaggaaaccgccugcuuagggaaguccuacgcccagauguggacccugauguacuuccaucgccgcgaccuccgccuggccgccaacgccauuugcagcgcgguucccagucauugggugcccacgagccggaccaccuggucaauccacgccaaacacgaauggaugaccaccgaggacaugcuggccguguggaaccgcguguggauucaggaaaacccauggauggaggacaagacaccggucgaaagcugggaggaggugcccuaucuugguaagcgcgaggaccaguggugcgguagccuuaucggccugaccucccgcgccaccugggcuaagaacauccagaccgccaucaaccaggugcgcagccucauuggcaacgaagaguauacggacuacaugcccuccaugaaacgguuccgaaaggaggaggagaaagccggaguccugugguga

SEQ ID NO: 25210 - RNA, 9876 nt, Artificial Sequence
  derived and/or modified CDS sequence (opt11) from DENV-2__EU569714__SS-prME
accgcuggcgugauaaucaugcugauccccaccgccauggcuuuccaccuaacgacccggaacggggaaccgcacaugauugucggccggcaggagaaggggaagucucugcuguucaagaccgaggauggcgugaacaugugcacccucauggccaucgaccuuggggaguugugcgaggacaccauuaccuacaaauguccccuccugaggcaaaaugagcccgaggacaucgacugcuggugcaacagcacuagcaccugggugaccuacgggacuugcacgaccacgggcgagcaucggcgcgagaagcggucggucgcacugguuccccacguggggaugggccuagagacgcgaaccgagacuuggaugagcagugagggcgcauggaagcacguccagcggauugagaccuggauccuacgccacccgggcuucacgaucauggcggcaaucuuggcauacaccaucggcaccacgcacuuucagcgugcucuaaucuucauccugcugacugccguggcgcccagcaugaccaugcgcugcaucgggaucuccaaccgagacuucguggagggugugucaggugggaguuggguggauaucgugcucgaacacgggagcugcguaaccacgauggccaaaaacaagcccacccuggauuucgagcugaucaagaccgaggccaagcagcccgccacucucagaaaguauuguaucgaggccaaguugacuaacaccaccacggagucccggugcccgacgcaaggcgagcccucgcugaacgaggagcaggacaagcguuucaucugcaagcacuccaugguagaucgggggugggguaacggaugcggacuguuuggcaagggcgggauugucacgugcgccauguucacgugcaaaaagaauauggagggaaaggucgugcuacccgagaacuuggaguacacaaucgugaucacgccccacagcggugaggagcaugccgucggaaacgacaccgggaagcacgggaaggagaucaagaucacaccgcaauccagcaucacugaagcggagcucaccggguacggcacagugaccauggaaugcucaccccgaaccggccuggacuuuaacgagaugguccugcuccagauggaggacaaggcguggcuaguccaucgucagugguuccuggaccucccgcugccaugguugccgggggcugacacgcaaggcagcaacuggauccagaaggagacguuggugacguucaagaacccgcaugcgaagaaacaggacguugucgugcugggcucccaggagggcgcuaugcacaccgcccugaccggggcgaccgaaauucagaugagcagcggcaaccuccucuuuaccggccaccuaaagugcaggcuccggauggacaaacugcaguugaaggggauguccuacagcaugugcaccggcaaguucaagaucgucaaggagaucgcugagacacagcaugggacgaucguuauacguguucaguacgagggcgacggcucccccugcaagauaccauucgagaucauggaccuagagaagcgccacguccugggucgccugaucacgguuaacccgaucgugacugagaaagauagccccgugaacaucgaagcggaaccgcccuucggggacuccuacaucaucaucgggguggagccgggccagcucaagcugaacugguucaagaaagggagcuccaucggccagauguucgagacuacgaugaggggcgccaagcggauggccaucuuaggggacacugccugggauuuuggcagccucggugggguguucaccucaauagggaaggcucugcaucaggucuuuggagcuaucuacggcgccgcuuucuccgggguguccuggacuaugaagauccugauaggcgugaucauaacguggaucgggaugaacagcagaucuaccagccuauccgucagccuggugcuagugggggucgugacgcuuuaccucggugugaugguacaagccgacuccggaugcguugugagcuggaagaauaaagagcugaaaugcggaagugggauauucaucaccgacaacguccacacuuggacugaacaguacaaguuccagcccgagucacccucaaaacuggcguccgccauccagaaggcccacgaagaggggaucugcgggauucggagcgugacacgccucgagaaucucauguggaagcagaucacuccagaacugaaccacauacucuccgagaacgaggugaagcugacgauaaugacgggcgauauaaaaggaaucaugcaggccggaaagcgaagccugcggccgcagcccaccgagcuuaaguacagcuggaagaccuggggcaaggccaaaaugcuguccacggaaucucacaaucagaccuuccugauagacggccccgaaaccgcugagugcccaaauaccaaucgggccuggaacagccucgaggucgaggacuacggcuucgggguauucucaacuaacaucuggcuaaaguugcgagagaagcaggacguguucugcgacuccaagcuaaugucugccgccauaaaggauaaucgggccguccacgccgauaugggcuauuggaucgaaagcgccuuaaacgacaccuggaagauggagaaggcaucguuuaucgaaguaaaauccugccauuggcccaagucccacacccuguggagcaacgggguucucgaguccgagaugaucauccccaagaacuucgccgggccuguuagccagcacaacuaucggcccggcuaccauacccagaccgcagggcccuggcaccucggcaaacuggagauggauuucgacuucugcgagggcacuaccguuguugucaccgaggacugcggcaacagagggcccucacuucggaccacgaccgcgagcggaaaacugauaaccgagugguguugccgcagcugcacgcuacccccgcuucgauacaggggcgaggacgguuguugguacggcauggagauucgcccccugaaggagaaggaggagaaccugguuaacucuuuggugaccgcggggcacggccagaucgauaacuucucccugggcguccuggggauggcccuauuccuggaggaaauguuacggaccagggugggcaccaagcacgugauccugcuggucgccgugucguucguuacccugaucacggggaacaugaguuuccgugaucuaggccgcgucauggugauggugggcgcgacuaugaccgacgacaucggaaugggcgucaccuaccuggccuuacucgccgcguucaagguacgcccuacguucgccgcggggcugcuacucagaaagcugaccuccaaggagcuaaugauggccacaauaggcaucgcccuucugagccaguccaccauccccgagacgaucuuagagcucaccgacgcccuggcccuggguaugaugguccucaagaucguccgcaacauggagaaguaccaacuagcggucaccauuauggccaucaguugugugccgaacgccgucauccugcagaacgcuuggaaggucuccugcaccauccucgcagugguaaguguaagcccguuauuacucacgagcucccagcagaaggcggacuggaucccccuggcgcugacuaucaagggccucaaccccaccgcuaucuuucugacaacacuaagcaggacguccaagaagcggagcuggccgcucaaugaggccgucauggcaguagggauggugucuauacuggccaguucgcuccucaagaacgacauaccgaugacugggccccuggucgccggcggacuacucacagugugcuacguccugacggggcgauccgcagaucuagagcucgagcgcgccgcugacgucaagugggaggaucaggccgagaucucaggguccucgccuaucuuaucaaucaccaucagcgaggacggcagcaugagcaucaaaaacgaggaggaagaacagacccugaccauccuuauacggacagggcuguuagugaucuccgguguguucccggucagcauacccaucaccgcagccgccugguaccuuugggagguuaagaagcagcgugcgggcguauugugggacgucccuagcccaccgcccgugggcaaggccgagcuugaggacggcgcguaccggaucaagcagcgcgggauauucgguuacagccagaucggcgcugguguuuacaaggaggggacauuucacaccauguggcaugucacgcgcggggccguccucaugcaccgcggcaagcgaaucgagcccuccugggcagauguuaagaaagaccugauuagcuacggaggaggcuggaagcuggaaggagaguggaaggagggagaggagguccaggugcucgcucuggagccugggaagaacccccgcgcgguccagacgaagccgggucuuuucaagaccaacacagggacuaucggcgcugucucccucgauuuuucucccggcacguccgggagucccaucguggaccggaagggcaaaguagugggucuuuacggcaacggcguggugacccgcuccggggccuacgucagcgcgaucgcccagaccgagaagaguauugaggacaacccggagauugaggacgacaucuuucguaagaaacgccugacuaucauggaucuccauccgggagcggggaagacgaagagauaccugccugcaaucguuagggaagcgaucaagcgggggcugcgcacccugauucucgcacccacccgaguugucgccgccgagauggaagaggcccugcgagggcugcccauccgauaccagacacccgcgauccgggccgagcacacgggucgagagauaguggacuugaugugccacgccaccuucacgaugcggcuucucagccccgucagagucccuaacuacaauuuaaucauaauggacgaagcccacuucacagaccccgcuagcaucgcggcccggggcuacauauccacgcgcguggagaugggggaggccgccggcauauucaugaccgccacaccgccggggucccgugacccguucccccaaucuaaugcgcccaucauggacgaggagcgcgaaauacccgaaagaaguuggaacaguggccacgagugggugaccgacuucaaggguaagaccguuugguucgugccgucgaucaaggcuggcaacgacauugccgcuugccugcggaagaacggcaagaagguaauccagcugucccggaagaccuucgauagcgaauacgucaagacccgcgcgaaugacugggacuucguugucaccacggauaucuccgagaugggagccaacuuccgggccgagcgcgucaucgacccccggcgcugcaugaagcccgugauccucacagauggcgaggagcgggugauccuggcggggcccaugccggucacgcacaguuccgccgcgcagcgccgcggccggauaggacgcaauccaaagaacgagaacgaccaguacaucuacaugggcgagccucuggagaacgacgaagauugcgcucacuggaaggaggcuaagaugcuccuggacaacauaaacaccccagagggcaucaucccgagcauguucgaaccugagagagagaagguugacgccaucgacggggaguaccgucugcguggcgaggcgcguaagacguucguggaccucaugcggagaggggaccugcccgucuggcuggccuaccggguggccgccgagggcauuaacuaugccgaccgccggugguguuucgaugggaucaagaacaaccagauccucgaagagaacgucgagguggaaauauggacgaaggagggcgagcggaagaagcugaagccgcgguggcuugacgccaggauauacuccgaccccuuagcccugaaggaguucaaggaguucgccgccggccggaagucccugacucucaauuugaucacagaaaugggucgacuccccacguuuaugacucagaaagcccgggacgccuuggacaacuuagcaguguugcacaccgcagagguaggagggcgcgccuauaaucacgcgcuauccgaacugcccgaaacacuggagacgcugcugcuccucacccugcuggcugccguuacuggcggcauuuuucucuuucugaugucggggaaaggcauagggaagaugacgcugggcauguguugcaucaucacggcgucgauccuacugugguaugcccagauccagccgcauuggauugccgcgagcaucauucuagaguucuuccucaucgugcuccuaauccccgagccagagaagcagcggacgccccaggauaaccagcugaccuacgucguaaucgcgauucugaccguagucgcagcaaccauggccaaugagaugggauuccuggaaaagacaaagaaggaccucggccugggcagcaucauuacgcaggaaagugaaagcaacaucuuggauauugaccuacgcccggcauccgccuggacacuguacgcgguggccaccacguucguaacccccauguuacggcacucgaucgagaacuccucuguuaaugugucucucaccgccauugcgaaccaggccaccguucugauggggcugggcagaggguggccccucagcaagauggauaucgggguaccccugcuggccaucgggugcuacucccaggugaaccccaucacguuaaccgcagcgcugcugcuccugguugcccacuacgcuauuaucggaccuggccugcaggccaaggccacgcgcgaggcccaaaagcgggccgccgccgggaucaugaaaaacccuaccguagacggcaucacggugaucgaucucgagccuaucccguacgaucccaaauucgagaaacagcugggacaggugaugcugcucguccuaugugugacccaggugcugaugaugcgcaccaccugggcccucugcgaggcgcugacccuggccaccggccccauuuccacacuaugggaggguaacccuggcagauucuggaauacgacgaucgcugucuccauggccaacauuuuccgcggcucuuaccuggccggcgcggggcuccuuuucuccauaaugaagaacaccaccaacacccggcgcgggaccggcaacaucggcgaaacccugggugagaaguggaagucccggcugaacgcccucgguaagucagaguuucagaucuacaagaaguccgggauccaggagguggaccguacccuggccaaggaggggauaaagcgcggggagaccgaccaucacgccguguccagaggcagcgcgaagcugcggugguuugucgaacgaaacauggugacaccagagggcaaggugguugacuuagggugcggccgcggagggugguccuacuauugcggcggccugaagaauguacgcgaggugaagggcuuaaccaagggcgggcccgggcacgaggagcccauaccaaugagcaccuauggcuggaaccucgugcgccuacagucaggaguggacguauucuucaccccaccggaaaagugugacacguuacuuugcgacauuggcgagaguagccccaacccgaccauugaagccgggcggacccuucggguacugaaccucgucgagaacugguuaaacaacaacacccaguucugcauuaagguacugaacccuuacaugcccuccguuaucgagaagauggagacauuacagcgcaaguacgggggcgcgcuggugcgcaacccgcugagucguaacuccacucacgaaauguacuggguuucgaaugccaccgggaacaucgucucuucugugaacaugauaagcaggaugcugauaaaccgguucaccaugaagcacaagaaggccaccuacgaaccugacguggaucucgggagcgggacccgcaacaucggcaucgagaacgagaucccuaaucuggauaucauaggcaagcggaucgagaagaucaagcaggagcacgagacauccuggcacuaugaccaagaccaucccuacaagaccugggcguaccaugggagcuaugagaccaagcagacuggauccgccagcucaauggucaacggcguagugcgccugcucaccaagcccugggauguuguucccauggugacucaaauggccaugacggauacgacacccuuuggucagcagcggguguucaaggagaagguggauacgcgcacccaggagccaaaggagggcacgaaaaaguuaaugcggauuaccgcagaauggcuauggaaggagcucgggaagaagaagacaccccguaugugcacccgagaggaguucacgcgcaaaguucggagcaacgcagcgcugggugccaucuuuacugacgagaauaaauggaaguccgcccgcgaagccguagaggacagccgguucugggaguuagucgaccgcgaacggaaccugcaccuggaggggaaaugcgagacuugcguauauaacaugaugggcaagcgcgagaagaagcugggggaguucggcaaagcaaaggggucccgggcgaucugguacaugugguugggggcccgcuuucuggaguucgaggcccugggcuuucucaacgaagaccacugguucagucgcgggaacagccuguccggcguggaaggggaaggccuacacaaauuaggguauauccuucgggaugugucgaaaaaggagggcggagccauguacgcggaugacacagccggaugggauacgcguaucacgcuggaagaccucaagaacgaggagauggucaccaaccacaugaagggcgagcacaagaaacuugcggaggccaucuuuaaacucaccuaccagaacaaagugguacguguacagagaccgacgccccgagggacuguaauggacauaaucucccgcaaggaccagcggggcagcggacagguggggacguacggccucaacaccuucacgaacauggaggcacagcugauucgccaaauggagggggagggcaucuucaaguccauccaacaccugaccgucacagaggaaaucgcaguacagaacuggcucgcccgaguaggccgcgagcgacugagccgcauggccaucaguggggaugacugcgucgugaagcccuuggacgaccgguucgccagcgcccucaccgcgcugaaugacaugggcaagguccgcaaggauauccagcagugggaacccucccggggguggaacgacuggacgcaggucccuuucugcagccaucauuuccaugagcuggugaugaaggauggccgcguguuagucgugcccugucguaaccaggaugaacuaaucgggcgagcgcggauaucgcagggcgccggcuggagucugaaggaaacagccugccucgguaagaguuaugcccagauguggacccugauguacuuucaccgccgugaccugcggcucgcugccaacgcgaucuguucugccgugcccagucauuggguacccaccuccaggacuacaugguccauccacgccaagcaugaguggaugaccacggaggacaugcuagcuguuuggaacagaguguggauccaggagaacccguggauggaggacaaaacucccguggaaagcugggaggagguccccuaccugggcaaacgcgaagaccaguggugcgggagucucaucggccugaccucccgugccaccugggcaaagaacauccagaccgcgaucaaccaggugcgcagcuugauagggaacgaggaguacacggacuacaugccgucuaugaaacgguuccguaaagaggaggaggaggccggcgucuuaugguga

SEQ ID NO: 25211 - RNA, 9876 nt, Artificial Sequence
  derived and/or modified CDS sequence (opt11) from DENV-2__EU569715__SS-prME
accgccggcgucaucauuaugcugauccccaccgccauggcauuccaucucaccacccggaacggugaaccccauaugauagugggccggcaggagaaagggaaaucccugcuguucaagacugaagacggcgugaacaugugcacauuaauggccaucgaccuaggggagcugugcgaagacaccauaacguacaaguguccccuccuacgccagaacgaacccgaagauaucgacuguuggugcaacucgacaagcaccugggucaccuacgggacauguaccaccacgggggagcaccgacgcgagaagcgguccgucgcucuggucccccacgugggaaugggccucgaaaccaggaccgagaccuggaugagcuccgagggcgccuggaagcacguccaacggaucgagacguggauucugagacacccgggcuucaccaucauggccgcgauccuggcguacaccauugggaccacccacuuccagcgggcccucaucuucauccuucugaccgccguugcgcccucuaugaccaugaggugcaucggcaucuccaaccgggacuuuguggagggcgucagcggaggauccuggguggacaucguucuggagcacgggagcugcguaaccacuauggccaagaacaagcccacacuggacuucgagcugaucaagaccgaggccaagcagcccgccacccuccggaaauacugcauagaggcaaaguuaacgaauaccacgaccgaaucccggugcccgacccagggcgagcccagccugaacgaggagcaggauaaacguuucauaugcaaacacagcaugguugaucggggcugggggaacggcugcggccuuuuugggaaaggcgggaucguaaccugcgccauguuuaccugcaagaagaacauggagggaaaggucgugcugccugagaacuuggaauacaccaucgugauaacgccccacagcggugaggagcaugccgugggcaacgauaccgggaagcacggcaaagaaaucaagaucaccccucaguccagcauuaccgaagcugagcucaccggguauggcaccguaaccauggagugcagcccccggaccggccuggacuucaacgagauggugcugcuccaaauggaagacaaggccuggcugguccaccggcagugguuccuggaccuuccccugccauggcucccgggggccgacacgcaaggcagcaacuggauccagaaggagacguuagugaccuucaaaaauccccacgcgaaaaagcaagacguggucgugcucgggagccaggagggcgccaugcacaccgcccugaccggggccacggagauacaaaugaguucgggcaaccuacuguucacuggucauuugaagugccgccuccggauggacaagcuccagcugaaggggauguccuauagcaugugcacgggcaaguuuaaaaucgucaaggagaucgcugagacacaacaugggacuaucgugauacgcgugcaguacgaaggcgacgguucccccugcaaaaucccuuucgaaaucauggaccucgagaagcggcaugucuuagggcgccugaucaccgugaacccgaucgugaccgagaaggacagcccgguuaacaucgaagcggagccgcccuucggugauucguauaucaucaucgggguagagccgggccagcucaagcucaacugguucaagaaggggagcuccauaggccagauguucgagaccacgaugcgcggcgccaagcggauggccauccugggggacacugccugggauuuuggcagccuuggcggcguauucaccuccauagggaaggcccugcaccagguguucggggcaaucuacggcgccgccuuuagcggggugagcuggaccaugaagauccucaucggugugaucaucacguggaucgggaugaacucgcgcuccaccucgcuguccguuagccucgugcuggugggcgucgugacccuguaccuuggggugaugguccaggccgacucaggcugcguugugagcuggaagaacaaggagcugaaauguggcagugguaucuuuaucaccgacaauguucacacguggaccgagcaauacaaauuccaacccgagucucccagcaagcuggcaucagcuauccagaaggcacaugaggaaggcauaugcgggaucagaagcguaacccgccucgaaaaccugauguggaagcagaucacccccgagcugaaccacauccucucugagaacgaggugaagcugacgaucaugacaggcgacaucaagggaauuaugcaggccggaaaacggucgcugcgcccccaacccaccgaguuaaaguacuccuggaagaccuggggcaaggccaagaugcuuagcacggagucccauaaccagaccuuccugaucgacggucccgagaccgccgagugcccaaacacgaaccgggcguggaauagccucgagguagaggacuacggauucgguguguucuccacgaacaucuggcugaagcugcgcgagaagcaagacguguucugcgacagcaaacucauguccgccgccaucaaggacaaccgagccguccaugcggacaugggcuacuggaucgagagcgcccucaacgauaccuggaagauggagaaagccaguuucaucgaggucaagagcugccacuggcccaaaagccacacccuguggagcaacggcgugcucgaguccgaaaugaucauccccaagaauuucgccgguccugugagucagcacaauuaccgcccggguuaccacacccagaccgccgggccauggcaccugggaaaacuugagauggacuucgauuucugcgaggggacgaccgucgugguuacggaggacugcggcaaucggggccccagcuuacgcacgacgacagcauccgguaaauuaaucaccgaguggugcugccgcagcugcaccuugcccccgcuccgcuaucggggugaagacgggugcugguacggcauggaaauucgcccccugaaggagaaagaggagaaccuggugaacucccuggugacggccgggcacggccaaaucgacaacuucucccugggcguccugggaauggcccucuuccuggaggagaugcugcggacccgcgugggcaccaagcacgccauccucuuaguggcggucuccuucgugacccugaucacugggaacaugucguuccgggaucucggccgcguaauggugauggugggggccaccaugaccgacgacaucgggaugggggugaccuaccuggcccuucucgccgccuuuaagguccgcccuacuuuugcggcugggcuccugcuccggaagcugaccaguaaggagcugaugauggccaccaucggcaucgcccuccugagccaguccacaauccccgaaacuauccuggaacugaccgaugccuuggcgcuggguaugauggugcuaaagaucguccgcaacauggagaaauaccaguuagccgucaccaucauggcuauaucgugugucccgaaugccgucauccuacagaaugccuggaaagucuccugcaccauccuugcugccgugucugucagcccguugcugcucacgagcucccagcagaaggccgacuggaucccccuggcccugacaaucaagggcuugaaccccacggcgaucuuccuuaccacccugagccgaaccaguaagaagcggagcuggccguugaacgaggccgugauggcgguuggcauggucagcaucuuagcuagcagucuguugaagaaugacauccccaugaccgggccauugguggcuggcgggcugcucaccgucuguuauguucugacgggccggagcgcggaucuggagcucgagcgcgcagccgacgugaaaugggaagaccaggcagaaauaucaggguccagccccauccuguccaucacaaucagugaggacggcuccaugucuaucaagaacgaagaggaggaacacacccugaccauacucauccggacgggucugcugguaauauccggggucuucccggucagcauaccaaucaccgccgcggccugguaccuaugggaggugaagaagcagagagccggcgucuuaugggacguacccagcccacccccuguggggaaggccgaguuagaggauggugcauaccggaucaagcagcgcggaaucuucggcuacagccagaucggcgcggguguauauaaggagggcaccuuccauacuauguggcacgucacucggggagccgugcucaugcaccguggaaagagaaucgagcccuccugggcagacgugaagaaggacuugaucagcuacggaggggguuggaagcuggagggugaguggaaggagggcgaggagguccagguucuugcccuggagcccgggaagaauccgcgcgccguccagaccaagcccggccuguucaagaccaacaccggaacgauaggcgcggugucccucgacuucaguccagggacguccgggagucccauugucgaucggaaggguaaggucguggggcuguauggcaauggaguggucacccgcuccggugccuacgugagcgccauagcccagaccgaaaaguccauugaggacaaccccgagauagaggacgauaucuuccggaaaaagaggcuuaccauaauggaccuccaucccggcgcggggaagacaaagcgguaucugcccgccaucgugcgcgaggccaucaagcggggucugcgcacccucauauuggccccgacccgcgucguggccgcugaaauggaggaggcuuugcgaggacugccuauacgguaccagaccccugcuauccgugccgagcacacaggucgcgagauuguggaccucaugugccacgccaccuucaccaugcggcugcuaucgcccgugcgcguaccgaacuauaaucucaucaucauggacgaggcccacuucaccgacccggcgagcaucgcggcccggggcuacaucuccacucgcguggaaaugggggaggccgcgggcauauucaugaccgccacgccgccgggaagccgggacccguuuccccaaaguaacgcccccauaauggacgaggagcgagaaaucccugaacggagcuggaacucuggucacgaaugggugacagacuucaagggcaagaccgugugguucgugccaagcaucaaagccggcaacgacaucgccgccugccuccgcaagaacggcaagaaggucauccaguuaagucggaagaccuucgacagcgaauaugucaagacccgggcaaacgacugggacuucgugguaaccaccgacaucuccgagaugggggccaacuuccgggccgagcgcgugaucgacccccggcgcugcaugaagcccgugauccucaccgacggagaagaacgggucaucuuggcggggcccaugccagugacccacagcuccgcagcgcagcgccguggcaggaucgggaggaaccccaagaacgagaacgaccaauacaucuacaugggggagccucuggagaacgacgaggacugcgcccacuggaaagaggccaagaugcuucuggacaacaucaauacacccgagggcaucaucccaagcauguuugagcccgagagggagaagguggaugcgaucgacggggaauaccgccugcggggcgaggcccgcaagaccuucguagaccucaugcgccgcggggaccugcccguuuggcuggccuaccgggucgccgcggaaggcaucaacuacgcggaccgacgguggugcuucgacgggaucaaaaauaaccagauacucgaggagaacguggagguggaaaucuggacaaaggaaggcgagagaaagaagcugaagccgcguuggcuggacgcccgcaucuacucagacccccucgcccugaaagaguuuaaggaguucgccgcgggucggaagagucugacccucaacuugaucaccgagauggggcgccugcccacguucaugacccagaaggcgcgagacgccuuggacaaucuagcaguccugcacaccgcagaggucggcgggcgcgcguauaaccacgcccucucagagcugccugagacccuggagacucuccugcugcucacccugcuggccaccgugaccggcgguaucuuccuauuccugaugagcgggaagggcauagggaagaugacgcuggguaugugcugcauaaucaccgcauccauccugcugugguacgcacagauccagccgcacuggaucgcggcuagcaucauccuggaguucuuccucaucguacugcugauccccgagcccgagaagcagcgcacgccucaggacaaccagcuaacauacguggugauugccauccugaccgucguggcagccacgauggcgaaugagaugggguuucuggagaagaccaagaaggaucucggucugggcucaauuaccacccaagaguccgagagcaacauccuggauauugaccuccgcccggcuuccgcauggacacuguacgcgguugccacgaccuuuguuacacccaugcugcggcacagcaucgagaacuccagcgugaacgugagucucacggcgaucgccaaccaggccacuguccugauggguuugggccgcggguggccccucagcaagauggacaucggcgugccauugcuugccaucggguguuauucccaagugaacccgaucacccuaaccgccgcgcuccugcuccuugucgcccacuacgccaucaucggcccugggcugcaagccaaagcgacgagggaggcccagaagcgggccgccgccgggaucaugaagaaucccaccguggacggcaucacugucaucgacuuggaacccaucccguacgaccccaaguucgagaagcaauuagggcaggucaugcuucucgugcugugugugacccagguucugaugaugcgcaccaccugggcgcucugcgaggcccugacccuugccacaggccccaucagcacucuaugggaggggaaccccggucgguucuggaacaccaccaucgcaguguccauggccaacaucuuucgcggcagcuaccuggcgggggccggccuccuguucuccauuaugaagaacaccacgaacacgagacgcgggaccggcaacauuggcgaaaccuuaggggagaaguggaagucccggcugaaugcacuaggcaaguccgaguuccagaucuacaaaaaguccgggauacaagagguggacagaacgcuggccaaggagggcauaaagcgcggugagaccgaucaccacgccgucucccgcggcucugccaagcugcggugguucguggagcguaacauggugacgccggagggaaaggucguagacuuggggugcggccgcggcgguugguccuacuacugcgguggucugaagaacgugcgcgaggucaaagggcugaccaagggcgggcccgggcacgaggagcccauccccaugagcacauacgguuggaaccugguacggcugcaaagcgggguugacguauucuucaccccgcccgaaaaaugcgacacccuguuaugcgacauuggcgaguccucacccaaccccaccaucgaagccggccgaacgcuacgggugcugaaccucguggaaaacuggcuuaacaacaauacccaguucugcaucaagguccugaacccuuacaugccguccgugaucgagaagauggagacacuccagcgcaaauacgggggcgcccuggugcgaaacccccuaagccgcaacuccacccacgaaauguacugggucagcaacgccaccgggaacaucguguccagcgugaacaugauaagucgcaugcugaucaaccgguucacgaugaagcacaaaaaggcgacuuacgagccggacgucgaccucggaagcgggacccgcaacaucggcaucgagaacgagauccccaaccuggauaucaucggcaagcggaucgagaaaaucaagcaagagcacgaaacuuccuggcacuaugaccaggaccaucccuacaagaccugggcguaucacggcagcuacgaaacuaagcagaccggcuccgccagcuccauggucaacgggguggucaaacuccugacuaagcccugggacguagugccgaugguuacgcagauggcuaugacggacacaacccccuuuggacagcaacgcguguucaaggaaaagguggauacucggacacaggagcccaaggagggcaccaagaagcugaugcgcaucaccgcugaguggcuguggaaggagcucgggaagaaaaagacgccucggaugugcacccgugaggaguucacccggaagguccgcagcaacgcggcccugggcgccaucuucaccgacgagaauaaguggaaguccgcccgggaggccguagaagauagccguuucugggagcuggucgaccgggaacgcaaucuccaucucgaggggaagugcgaaacuugcguguacaacaugaugggcaagcgggagaagaaacugggggaguucggcaaggccaaggggagcagagccauaugguacauguggcucggggccagguuccucgaguucgaggcacugggcuucuuaaacgaggaucauugguucagccgcgggaacagccuauccggcguagaaggggagggcuuacacaagcucggcuauauauugcgcgacgucagcaagaaggagggcggagcgauguacgccgaugacacagccgggugggacacccgcaucaccuuagaggaccucaagaaugaggagauggugacgaaccacaugaagggggagcacaagaagcuggccgaggccaucuucaagcugaccuaccagaacaagguuguccggguucaacgcccuacccccgggggcacugugauggacaucaucuccagaaaggaccagcggggcucagggcaggucggcaccuacgggcuuaacaccuucacaaacauggaggcgcagcuaauacgccagauggaaggcgaggguaucuucaaguccauccagcggcuaaccgugacggaggagaucgccgugcaaaauuggcucgcccgcguugggcgggagcgccugagcaggauggcgaucuccggcgacgacugcguggugaagccgcuggacgaucgcuucgccuccgcgcuuacugcccugaacgacauggggaaaguccggaaggacauccagcagugggagcccucccgcggcuggaacgacuggacacaggugccguucuguucucaccacuuccaugagcugguaaugaaggacgggcggguccuuguuguacccugccggaaccaggacgagcugaucggccgggcccguaucucccagggcgccggguggucccuaaaggagaccgcuugccucggaaaguccuacgcgcagauguggacgcugauguacuuucaucgucgcgaccugagacucgcggccaacgccaucugcuccgcuguccccucccacugggugcccacuagccgcaccaccugguccauucacgcgaagcacgaauggaugaccacggaggacaugcuggccguguggaaccgggucuggauccaagagaacccguggauggaagauaagacccccguggagagcugggaagaggucccauaucuggggaagagagaggaccaaugguguggcucucucaucggacugaccucccgcgccaccugggccaagaacauccagacagcaaucaaccagguccggagccucaucggcaacgaggaguacaccgacuacaugcccucuaugaagcgcuuucggaaggaggaggaggaggcuggcgugcugugguga

SEQ ID NO: 25212 - RNA, 9876 nt, Artificial Sequence
  derived and/or modified CDS sequence (opt11) from DENV-2__EU569716__SS-prME
accgccggugugaucaucaugcucauccccaccgcaauggcguuccaccucaccaccagaaacggggaaccccacaugaucgugggccggcaggagaaggguaagucgcuguuguucaagaccgaggauggcgugaacaugugcacccucauggcgaucgaccucggcgagcugugugaggacaccaucaccuacaagugcccccuccugcggcagaaugagccugaggacaucgacugcuggugcaacagcaccagcaccugggugacuuacgggaccugcaccacgacgggcgagcacagacgcgaaaaacgaagcgucgcccucgugccccacguggguauggggcucgagacucggacugagaccuggaugucaagcgagggggccuggaagcacgugcagcgcaucgagacuuggauacugcgccaccccggcuuuaccauaauggcagcgauccuggccuacaccaucgggaccacacacuuccaacgggcccucaucuucauccuucugacggccguggcgcccagcaugaccaugcgcugcaucggaaucagcaaucgggacuucguggagggcgucucgggaggcucguggguggacauaguguuagagcacgggucaugcgucaccacgauggccaagaauaagcccacccuggacuucgaguuaaucaagaccgaggcaaagcagcccgcuacccucagaaaguacugcaucgaggccaaacugacgaauaccaccaccgagucccggugcccgacucaaggagagccuagccugaaugaggagcaagacaaacgcuuuaucugcaagcacuccaugguggaccggggcugggggaacgguugcggccuauucgggaaaggagguaucgugaccugcgcgauguucaucugcaaaaagaacauggagggcaaggucgugcugcccgagaacuuggaguacaccaucguuaucacgccccacaguggggaggagcacgcaguuggaaacgacacggggaagcacgguaaggagauaaagaucaccccgcagagcagcauaaccgaagccgagcucacgggcuaugggaccgugacgauggagugcagcccccgaaccggcuuggacuucaacgaaaugguguuacuccaaauggaggacaaggcuuggcugguccaccgucagugguuccuggaccucccccugcccugguugccgggggccgacacccagggcagcaacuggauccaaaaggagacccucgugaccuucaaaaacccccacgcgaagaagcaggacguggucgugcuggggucccaggagggcgccaugcacacugcccugaccggggccaccgagauccagaugagcucggggaauuugcuuuuuacaggccaccugaagugccgccuccggauggacaagcugcagcugaagggaauguccuacagcaugugcacuggcaaguuuaagaucgucaaggaaaucgcggagacccagcacgggacgaucgugauacgcguucaauacgagggcgacggguccccuugcaagaucccguucgagaucauggaccuagaaaagcgauacguucuggggaggcugauuacagugaacccgauagugaccgagaaagauagcccggucaacauagaggcggagccacccuucggagacuccuacaucauaauagggguggagccaggccaguuaaagcugaacugguucaagaaggggagcuccaucggccagauguucgagacaaccaugcgcggggcgaagcguauggcaauccugggggacacggccugggacuucggcagccucgggggcgucuuuaccucaaucggcaaggcccugcaccagguuuucggugcuaucuacggggccgccuucagcgguguguccuggaccaugaagauucugauuggcgugaucauuaccuggaucgggaugaacagcagguccacgagccuuuccgugagccucguccuggugggggucgugacucuguaucugggggucaugguucaggccgacuccggaugcguggugagcuggaagaacaaggaacugaagugugggucgggaaucuucaucaccgacaacguccauacauggacugagcaguauaaguuccaacccgaaagccccucuaaacuggcgucugccauacagaaggcucacgaggagggcaucugugggauucggagcgugaccaggcucgagaaccugauguggaagcaaauuaccccggagcuuaaucacauucuauccgagaaugaagugaaacuuaccaucaugacgggugacaucaagggaaucaugcaggccggcaagcggucuuuacgcccgcagccuaccgagcucaaguacuccuggaaaacuuggggcaaggcgaagauguuaucuaccgagucccacaaccagacguuccugaucgacggucccgagaccgcggaaugcccaaacacaaaccgggccuggaacagccucgaggucgaggacuacggcuucggggucuucuccaccaacaucuggcugaagcuacgcgagaagcaggacguguucugcgacucaaagcucauguccgccgcaaucaaggacaaccgcgccgugcacgcggacaugggcuacuggaucgagagcgcccugaacgacacguggaagauggagaaagccuccuucaucgaagucaagaguugccacuggccaaagucccacacccuguggagcaacggaguccucgagagcgagaugauaauccccaagaacuucgcuggccccgugagccagcacaacuacagaccgggcuaccauacccaaacagccgggcccuggcaccugggcaaguuggagauggacuucgacuucugcgaggggaccacgguaguggucaccgaggacuguggcaaucggggaccgucauugcgcacuacaacagcguccgggaagcugaucaccgaaugguguugucggagcugcacccugcccccgcuccgcuaccggggcgaagauggcugcugguacgguauggagauccgcccucugaaggagaaggaggaaaaccuagugaacucccuugugaccgccggccauggccagaucgacaacuuuagcuuaggcguacuggggauggcccucuuccuggaggagaugcugcggacgcgcgugggcacuaagcaugccauccugcugguggcgguguccuucgucacacugaucaccgggaauaugucauuucgggaccuuggcagagugauggucaugguuggggccacgaugaccgacgacaucggcaugggcguaacuuaccuggcccuacucgccgcguucaagguaagacccaccuucgcggccggacugcugcuccggaagcugacauccaaggagcuaaugauggcaaccauugguaucgccuuacugucacagagcaccauucccgagacgauacuggagcugacggacgcccuggcguuggguaugauggugcucaagauagugcggaauauggagaaguaccagcuggccgucaccauuauggccauccugugcguaccgaacgccgugauccuccaaaacgccuggaaggucagcuguacuauccuggcggccguaagugucagcccccugcuccugaccuccagucagcagaaggccgauuggauaccgcuggcucuaacgaucaagggccugaaccccaccgcgaucuucuugacuacccucucccggacuagcaaaaagagauccuggccgcugaacgaggcagugauggcuguaggaaugguaagcauccuggccuccucccuacugaagaacgauauccccaugacaggaccccugguagccggcggguuacugaccgugugcuacguccugacaggccggagcgcagaccucgagcuggagcgugcggccgacgugaagugggaggaccaggcagagaucucagguucaucucccaucuuaagcaucacgaucuccgaggacggcagcaugucuaucaagaacgaggaagaggaacagacccuuacaauauuaauacggaccggccuguuggugaucagcggaguauucccgguguccaucccaaucacagcugcugcuugguaccucugggaggugaagaagcagcgcgccggaguucugugggacguaccaagcccgccgcccgucgggaaggccgaacucgaggacggcgccuaccguaucaagcagcgcggaaucuuuggcuacucccagaucggcgcggggguuuacaaggagggaaccuuccacaccauguggcacgugaccagaggggccgugcugaugcaccgaggcaagcggauagagcccagcugggccgacgucaagaaggaccugaucuccuacggugggggcuggaagcucgagggggaauggaaggaaggggaggaaguccaagugcuggcgcuggagccugggaagaacccccgcgccguccagacaaagccgggccuauuuaagacgaacaccggcaccaucggcgccgugagccuggauuucuccccgggcaccagcgggucccccaucguggaccggaaggguaaagucgucgggcuguacgggaacggagugguaacgcgcucaggagccuacguguccgccauugcccagacagagaaauccaucgaggauaaccccgaaaucgaggaugauauuuuccggaagaagcgacugacuaucauggacuugcaccccggagcagggaagaccaaacgauaccugcccgccaucgugcgcgaggccaucaagcggggccugaggacgcucauacuggccccuacccgcgucguggccgcggagauggaggaagcccugcgugggcuccccaucagauaucagacccccgccauccgugccgagcacaccggccgcgaaaucguggaccugaugugccacgcaacguucaccaugcggcuacucagcccgguccgcgugccgaacuacaaccugaucaucauggacgaggcgcauuucacggaccccgccuccauugccgcacgggguuacaucagcacucguguggagaugggggaagccgcuggcaucuucaugacggcgacgcccccaggcagccgagaccccuucccccagucgaacgcucccauuauggacgaggagcgcgaaauccccgagcgguccuggaacagcggacacgagugggucacagacuucaaggggaaaaccgugugguucgucccauccaucaaggccggcaacgacaucgcugccugucuacgcaaaaacgguaagaaggucauccagcucagccggaagacuuuugacuccgaguacgugaagacccgggccaaugacugggacuucgucguuacgaccgacauuucugaaaugggggccaauuucagagccgagcgcgugaucgacccccggcgcugcaugaagccagugauucugacggacggcgaggaacggguuauacuggcgggccccaugccgguaacucauucaagcgccgcccagcgcagaggcaggaucggcagaaaucccaagaacgagaaugaccaguacauuuacaugggcgaaccacucgagaacgacgaggacugcgcccacuggaaggaggccaaaaugcugcuggacaacaucaacacccccgagggcauuaucccguccauguucgagccagagcgggagaaggucgaugcaaucgacggggaauaccgccuccggggcgaggcacgcaagacguucguggaccugaugcggcgcggggaccugccaguguggcucgccuaccguguggccgcggagggcaucaacuacgcggaccgccgguggugcuucgacgggaucaagaacaaccaaauucuggaggaaaacgucgagguagagaucuggacgaaggagggugagagaaagaagcugaagccccgguggcucgacgcccguaucuauagcgauccgcuggcccugaaggaguucaaagaguucgccgcaggccggaaaucccucacccucaaccugaucacugagauggggcgacuccccaccuucaugacgcagaaagcccgcgacgcgcucgacaaccuggcaguucuccacaccgcugagguagggggccgcgcauacaaccacgccuuaagcgaacuucccgagacccucgaaacccugcuccuuuugacgcugcucgccaccgugacuggcgggauuuuccuguuccugauguccgggaagggaaucgggaagaugacccucggcaugugcugcauaauaacugcuucgauccugcuuugguacgcgcagauccagccgcacuggaucgcggccuccaucauuuuagaguucuuccugaucgucuuauugauccccgagcccgaaaaacagcggacgccccaggacaaccagcugaccuacguggugaucgcuauacugaccgucguggccgcuaccauggcuaacgaaaugggguuccucgagaagacgaagaaggaccugggucugggcagcaucaucacacaggagagcgagucuaacauccucgauauugaccugaggccugcuagcgcguggacccuguaugccguggccaccacguucgugacgcccaugcuacggcacucgaucgagaacucaucggugaacgugagccugaccgcgauagccaaccaggccaccguuuuaaugggacucggcagaggguggcccuuauccaagauggacaucggcgugccccugcucgcuaucgggugcuacagucaggugaaccccaucacgcugaccgcugcucugcuccuccugguugcccauuacgccaucaucggaccgggcuugcaggcaaaagcgacccgcgaagcccagaaacgggcugccgccgggauaaugaagaaccccaccguggacggcaucacggugaucgaccuugagcccaucccauacgaucccaaguuugagaagcagcucggucaggucauguuacuggugcugugcgugacacagguccucaugaugcgaaccaccugggcucugugcgaggcccugacgcucgccacuggccccaucuccacacuaugggaggggaaccccggccgauucuggaacacgacuaucgccguguccauggccaacauuuuccgcgguuccuaccuggcgggggccggccuccuguucagcaucaugaagaauacuacgaacacccggcgcgggacgggcaacaucggagagacccugggggaaaaauggaagagucggcuaaaugcauugggcaagagcgaguuccagaucuauaagaaguccggcauccaagagguggaucgcacccuugccaaggagggaaucaagcgcggggagaccgaccaccacgcugucagccgcggcuccgccaagcuacgcugguucguggagcgcaacaugguaacgccggagggcaaggucguggaccugggcugcggccggggcggguggagcuacuacugcggcgggcugaaaaacgugcgcgaggucaaggggcuuaccaagggaggucccgggcacgaggagcccauccccaugagcaccuauggcuggaaccuggucagguugcagagcgggguugacgucuucuucacaccacccgagaagugcgacacccuacugugugacauuggcgagagcuccccgaaucccaccaucgaggccggacguacccuucgggugcugaacuugguggagaacuggcugaauaacaacacccaauucugcaucaaagugcucaacccguacaugcccagcguuaucgagaagauggagacuuuacagcgcaaguacggcggcgcccuagugcggaacccccuauccagaaauuccacccacgagauguauuggguguccaacgccaccgguaacaucguguccuccguaaacaugaucucgcgcaugcucaucaauagauucaccaugaaacauaagaaggccaccuacgagccggacgucgaucugggcuccgggacucgcaacaucggcaucgagaacgagauccccaaccuugacaucaucggcaagagaaucgagaagaucaagcaggagcacgagaccagcuggcacuacgaucaggaccauccauauaaaacgugggccuaccacggguccuacgagaccaagcagacuggcagcgccucaagcauggucaacggggugguccgccuccugacaaagccaugggacgucgucccgauggucacucaaauggccaugaccgacacgacccccuucgggcagcaacggguguucaaggagaagguggacacccgcacgcaggagcccaaggaaggcacgaagaaacugaugcggaucacggccgaguggcuuuggaaggagcuggggaaaaagaagacgccccggauguguacccgggaggaguuuacgcgcaaggucagauccaacgccgcccugggcgccaucuucaccgacgagaacaaguggaaguccgccagagaggccguagaggauucucgguucugggagcucgucgaccgcgagcggaaccugcaccuggaggggaagugcgaaacaugcguguacaacaugaugggcaagcgcgagaagaagcucggggaguucggcaaggcaaaggggagccgggccauaugguacauguggcugggggcccgauuccuggaguucgaggcacucggcuuccugaacgaggaucacugguucagccgcgggaacagcuugagcggcguugagggggagggucuccacaagcugggcuacauccugcgcgauguuucuaagaaggaagggggcgcaauguacgccgacgacaccgccggaugggacacgcggauuacacuggaggacuuaaagaacgaggagauggugaccaaucauaugaagggcgagcauaagaaauuggcggaggcuauauucaagcucacuuaccaaaacaaggugguccgggugcagcgcccgacgccccgaggcaccgugauggauaucaucagucgcaaagaucagcggggcuccggccagguggggaccuacggccugaacaccuucacaaacauggaggcacagcugauccgccaaauggaaggagagggcaucuucaagagcauccagcaucucacugugaccgaggagaucgccgugcagaauuggcuggcccgggugggccgugagaggcugucccgcauggcuauaaguggggaugacugcguggugaagcccuuagaugaucguuucgccuccgcgcugacagcccugaacgauauggguaagguccgcaaggauauccaacagugggaacccucgcgaggguggaacgacuggacccaggugccauucugcucccaucacuuccacgagcucguuaugaaagauggacgcguccugguggugcccuguagaucgcaggaugagcugaucggccgcgcccggaucucccagggcgccggcuggagccuaaaggagaccgccugcuuagggaaaucuuacgcgcagauguggacccuaauguacuuucaucgccgggaccuccgacuggccgccaacgccaucugcucagccgugccuagucacugggugccaaccagccggacgacaugguccauccacgcgaagcacgaguggaugaccacugaggacauguuagccgucuggaaucgcguauggauccaagaaaauccguggauggaagacaagacgcccguggagagcugggaggaggugcccuaccuuggcaagcgcgaggaccaauggugcgggagccugaucggccugacaucccgggccaccugggccaagaauauucagacagcgaucaaucagguacgcagccucaucgguaacgaggaguacacagauuacaugcccaguaugaagcgguucaggaaagaggaggaggaggcaggcguucugugguag

SEQ ID NO: 25213 - RNA, 9876 nt, Artificial Sequence
  derived and/or modified CDS sequence (opt11) from DENV-2__EU569717__SS-prME
acggccggcgugauaaucaugcugauaccuaccgcaauggcguuccaccucacuacgcggaacggggagccccauaugaucguggggcggcaagagaaggggaaaagccucuuguuuaagaccgaggacggcguuaacaugugcacauuaauggccaucgaucugggggagcugugcgaggacacgaucacguacaagugcccccuccuucgccagaacgagccagaagacaucgacuguuggugcaacagcaccucgacgugggugaccuacggcacaugcaccacgaccggcgagcaucggcgcgaaaaacgauccguagcccucguuccccauguggggaugggccuggagacccgaacagagaccuggaugagcagcgaaggggcguggaaacauguccagcggauugagacguggauccuuaggcacccgggcuucaccaucauggcugcgaucuuggcguacacgauagggaccacgcacuuccagcgugcccucauauuuauccugcugaccgccguggcgccaagcaugaccaugcgcugcauaggcaucagcaaccgggacuucguggagggcgucagcggcggcuccuggguggacaucgucuuggagcacgggagcugcgucacgacuauggcuaagaacaagccgacccuggacuucgagcuaauuaagaccgaggcuaaacagcccgcuacccugcgcaaauacugcaucgaggcaaagcugacaaacacgacaaccgagucccgaugcccgacgcagggggaaccaucucuaaaugaggagcaggacaagcgcuuuaucugcaagcauuccauggucgacagaggcugggggaacggcugcgguuuauucggcaagggcgggaucgugaccugcgccauguucacaugcaagaagaacauggagggcaagguggugcugcccgagaaccuggaguacaccaucgucaucacgccucacaguggggaggaacacgccguggguaacgacacagggaagcacgguaaggagaucaagaucaccccacaaaguagcaucaccgaagccgagcucaccggauaugggacggugaccauggagugcagcccccggaccggucuggacuucaacgaaaugguccuacugcagauggaggacaaggcuuggcugguccaccgccaaugguuccuggaccuccccuugccauggcugcccggggccgacacacaagguuccaacuggauccagaaggagacccucgugaccuucaagaacccccaugcgaagaagcaggacgucgucguguuagggagccaggagggcgcuaugcauaccgcgcugacgggggccacagagauccagaugucuagcggaaaccuccuguucacagggcaccugaaaugccgccuacgaauggacaagcugcagcugaaggggaugucauacagcaugugcaccggcaaguucaagaucgucaaggaaauagccgagacucagcacggaacaaucgugauccggguucaguacgagggggacggauccccaugcaagaucccuuuugagaucauggaccucgagaagcggcacguccuggggcgccugauuacuguuaacccgauaguuaccgagaaggacagcccagugaacauugaggcggagccgccguucggcgacuccuacauaauaaucgggguagagccgggccagcucaagcugaacugguucaagaaggggagcuccauuggccagauguucgagaccacgaugagaggugccaagcggauggcuauccucggggacaccgcgugggacuuugggagccucgggggcguguucacguccauugggaaggcucugcaccaaguguuuggcgcgaucuacggugccgccuuuagcgggguguccuggaccaugaagauccugaucggugugaucaucacguggauagggaugaacagcagguccaccagcuuguccgucucucucguccuggucggcgucgugaccuuguaucuaggggugaugguacaggcugauuccgguugcguggugagcuggaagaacaaggagcugaagugcggguccgggauuuucaucacugauaacguccacacguggaccgaacaguacaaguuucagccagaaucaccgaguaagcuggcgucugcaauucagaaggcccacgaagaggggauuugcgggauccggagcguuacccgccucgaaaaccugauguggaaacagaucacccccgagcugaaccacauacucuccgaaaaugaggugaagcugacgaucaugaccggcgacauaaaggggaucaugcaggccgggaaacggucucuucgaccucagccuaccgagcugaaguacuccuggaagaccuggggcaaggccaaaaugcuuuccacugaaucccacaaccagaccuuccugaucgacggccccgagacggcggagugcccuaacaccaaucgcgccuggaacagccucgagguggaggacuauggcuucgggguguucucuaccaauaucuggcugaagcuacgcgaaaagcaggacguguucugcgacagcaagcucaugucugccgcgaucaaggacaaccgggcaguccacgcggacaugggcuacuggauagagagcgcccucaacgauaccuggaaaauggaaaaggcauccuucaucgaggucaagagcugccauuggccaaagucccacacauuauggagcaacggagugcucgaauccgaaaugaucauucccaagaacuucgccggucccgugagccagcacaauuaccgcccgggcuaccauacccagaccgcuggucccuggcaccugggcaaguuggaaauggacuucgacuucugcgaggggacgaccgucguggucaccgaggacugcggcaacagaggcccaucgcucagaaccacgacagcgucgggcaaguugauuaccgaguggugcugcagaucguguacccugcccccgcucagguaccggggcgaggacgggugcugguacggcauggagauucgcccccucaaggagaaagaggagaaccuggugaacucccucgucacggcggggcacggccaaaucgacaacuucagucugggcguccucgggauggcgcuauuccuggaagagaugcugcggacccgcguuggcaccaagcaugcaaucuugcugguggcggucagcuucgugacacugaucacgggcaauaugucuuuccgggaccuuggacgcgugaugguuauggugggggccacaaugacggacgacauaggcaugggcgugaccuaccuggcucugcuagcugcauucaaaguccgccccacguucgcggccggacugcuguuacgaaagcugacauccaaggagcugaugauggccaccaucggcaucgcccucuuaagccagucaacgauccccgagacuauccuggagcucacugacgcgcuugcgcuggggaugauggugcucaagauugugcgcaacauggagaaguaccagcuggccgucacaaucauggcuaucagcugcgucccgaacgccgugauacugcaaaacgcguggaaggucuccugcaccauccucgccgcggugucggucagcccccugcugcucacgagcucccagcagaaagccgacuggaucccguuagcccugacgauuaagggccucaaccccaccgcuaucuuuuugacgacgcugucgcggaccucuaaaaagcgcagcuggccgcuuaacgaggccgugauggcuguaggcaugguguccauacuggccagcagccugcucaaaaacgacaucccgaugaccggaccccugguggccgguggguuauuaaccguguguuacguccuaacgggccgguccgcggaccuggagcuggagcgagcggcagacgugaaaugggaggaucaggccgagaucagcggguccagcccuauacugaguaucaccaucagcgaagacggcaguaugagcaucaaaaacgaggaggaggaacauaccuugaccauacucauacguacgggccugcuggugaucuccgggguauucccggugucgaucccuauuacagcggcggcuugguaccugugggaggugaagaagcaacgcgcaggcguacugugggacgugcccagcccaccgcccgugggaaaggcggagcuggaggacggugccuaucguauuaagcagaggggcaucuucgguuauagccagaucggugcagggguguacaaggagggcacguuucacaccauguggcacguuacccgaggagccguucuuaugcauagaggcaaaagaaucgagccuucuugggccgacguaaagaaggaccugaucagcuacgguggcggcuggaagcuggagggggaguggaaggaaggggaggagguccaaguccuugcccuggaaccagggaaaaauccccgcgccguccagacgaagcccggccuguucaagacaaacaccgggaccaucggcgccgucucauuagacuucagcccaggcacgagcgggagccccaucgucgaccggaagggaaaggucgugggucuguacggcaacgguguggucacccgcagcggugccuauguuagcgccaucgcccagacggagaaguccaucgaggacaaccccgagaucgaggacgacaucuuccggaagaagcggcugaccaucauggaucuucaccccggcgcggguaagacgaaacguuaucugcccgccaucgugcgggaggccaucaagcggggcuuaagaacguuaauccuggcucccacccgcguaguagcugccgagauggaggaagcucuccgggggcugcccauucgcuaucaaacccccgccauccgggcugagcacacgggccgugagauuguggacuugaugugucacgccacauucacaaugaggcugcugucccccguaagggugcccaacuauaaccucaucaucauggaugaggcgcacuucaccgacccggcuagcaucgccgcacgggguuauaucuccacccgcguggagaugggggaggccgcgggcaucuucaugacagccacgccucccgggagccgggacccguucccccaaucuaacgcgccgauaauggaugaggagcgcgagaucccggagcgcagcuggaacuccggccaugaguggguaacugacuucaagggaaagacggucugguuugugcccucaaucaaggccggcaacgacauagcugcgugccugagaaagaauggcaaaaagguuauacagcugucccggaagaccuucgacuccgaguacgugaagacgcgugccaacgacugggacuuugucgugaccacugacaucuccgagaugggugccaacuuucgggccgagcgcgugaucgacccccgccggugcaugaagccgguaaucuuaacggacggcgaggagcgugucauucuggccggacccaugccggugacccacucgucagccgcccagcgacgcggccggaucgguaggaaccccaagaaugagaacgaccaauacaucuauaugggcgagccccuggagaacgacgaagacugugcccacuggaaggaagccaagaugcuccuggacaacauuaauacgcccgaggguaucaucccgucuauguuugagccggaacgggaaaagguggacgccaucgacggggaguaccgguuaagaggcgaagcccgaaagacguucguggaucuuaugagacgcggggaccugcccgucugguuggcguaccgagucgccgccgagggcauuaacuacgcggauagacgguggugcuuugacgggaucaagaacaaucaaauccucgaagagaacguugagguggaaaucuggaccaaagaaggcgaacggaagaaacuuaagccccgguggcuggacgcccgaaucuacuccgacccccucgcguuaaaggaguuuaaagaguucgccgcaggacggaagucccugaccuuaaaucugauaacugaaauggggagacuacccacuuuuaugacacagaaggcccgcgaugcauuggacaaccuggcuguucugcacacagccgaaguagggggccgcgcguacaaccacgcccucuccgagcugcccgagacccucgaaacucuccuguugcucacacugcuggccaccgugacaggggguaucuuccucuuccugauguccggcaaaggcauagggaagaugacgcugggcaugugcugcaucaucaccgccucaauccuccugugguacgcccagauccagccacacuggaucgcggcgucaauaauccuggaguuuuuccucauaguacuguuaauccccgagccugagaagcagcggaccccucaggacaaccaacucaccuacguggugaucgcgauccugaccgucguagccgccacgauggcaaacgagaugggguuccuggagaagacuaagaaggaccucgggcuggggagcauuaccacccaggaauccgaaagcaauauccuugacauagacuuacgaccggccuccgccuggacccuguacgccguggccaccaccuuugugacccccaugcugcggcacagcauugagaacuccagcgugaacgugucucucacggcgaucgccaaucaggccaccguuuuaaugggacucgggcgcgguuggccccucagcaaaauggacaucggcguuccccugcuggccaucggaugcuacucccagguaaacccgaucacccucaccgcugcccugcugcuccuggucgcccauuacgccauaaucggcccgggucugcaggccaaggcgacucgcgaggcccagaaaagggccgccgccgguaucaugaagaaccccacaguugacggcauaaccgugaucgaucucgagcccauuccguacgaccccaaguuugaaaagcaacuggggcaaguuaugcugcucgugcucuguguuacccaaguccugaugaugcgcacgacaugggcgcugugcgaggcccugacccuggcuaccggccccaucagcacgcugugggaagggaaucccggccgauucuggaacaccacaaucgccgugagcauggcaaauauauuuagaggcagcuaccuggcgggugcgggauuacuguucuccaucaugaagaacaccacgaacacgcggcgcgggaccggcaacaucggcgaaacccugggggagaaguggaagucccggcugaacgcccuaggcaaguccgaguuucagauauacaagaaguccgguauccaggaaguagaccgcacgcuggccaaggagggcaucaaacgaggggaaaccgaccaucaugcgguuucacggggcucagcuaaauuacgaugguuuguggagaggaauauggugaccccggagggcaaggucgucgaccucgggugcggccgcggcggguggagcuacuacuguggcggguuaaagaacgugcgcgaggucaaagggcugaccaagggugggccugggcacgaggagcccaucccaaugagcacguacggcuggaaccucgugcggcugcaaagcggcguggacguauucuucaccccacccgagaagugcgacacccuucucugugacaucggcgaguccagccccaaccccacaaucgaggccggccguacgcugcgggugcugaaucuaguggagaauuggcugaacaauaacacgcaauucugcaucaaaguacugaacccguacaugcccucuguaaucgagaagauggagacccuccagcgcaaguacggcggcgcucuggugcgcaacccacuuucgcggaacuccacccacgagauguacugggucagcaaugccaccgggaauaucguguccuccgugaacaugaucucccgcaugcugguaaaccgguucacgaugaagcacaagaaagcuaccuacgaaccggacguggaccucggcagcgggacccgcaauauaggcaucgagaaugagauaccgaaucuggacauuaucgggaagcggaucgagaagauaaagcaggagcacgagaccuccuggcacuaugaucaagaccaucccuacaagaccugggccuaucacgggagcuacgagacaaaacagacgggcuccgcgagcuccauggugaacggggucgugcgccugcucacaaagcccugggacgugguaccgauggugacgcaaauggcaaugaccgacacaacccccuucggccagcagcggguuuucaaggagaaggucgacacgcgcacccaggagcccaaggaagggaccaagaaacugaugaggaucacagccgaguggcuuuggaaggagcuagggaagaagaaaacgcccaggauguguacccgggaggaguucaccagaaagguacggagcaacgcggcgcugggcgccaucuucaccgacgagaacaaguggaaguccgcgcgcgaggcugucgaggacagucgguucugggaguugguggaucgcgaaaggaaucuccacuuagaagggaagugcgagacguguguguauaacaugaugggcaagcgcgagaagaaacugggcgaguucggcaaagccaaaggcagccgugccaucugguauauguggcucggggcccgcuucuuagaguucgaagcccucggcuuccucaacgaggaucauugguuuagccggggaaauucgcugagcggaguugagggggaggguuuacacaagcucggcuauauccuccgagaugugucgaaaaaggaaggaggcgcgauguacgccgacgacaccgccgggugggacacacggaucacguuggaggacuugaaaaacgaagagauggugacgaaucacaugaagggcgagcacaagaaacuggccgaggcgaucuucaaguuaaccuaccagaacaaggucguccgugugcagcgcccaacaccacgcgggaccguuauggacaucaucucccgcaaagaccagcgaggaagcggucagguggggacauacggccucaauaccuucacuaauauggaggcgcagcugauccgccagauggagggugaaggcaucuucaaauccauucagcgguuaacggugacggaggagaucgcuguccagaacuggcuagcucgcguaggcagagagcgguuaagccggauggccaucuccggggacgacugcguagucaagccacuggaugaucgcuucgccagcgcucucaccgcccugaacgacauggguaaagugcguaaggacauucagcagugggaacccucgcgcggguggaacgacuggacccaggugccuuucugcagccaccacuuccacgagcuggucaugaaggacggccgggugcucgucguccccugccggaaccaggaugagcucaucggccgugcccgcauuucccagggcgccggauggucgcugaaagagacagcaugccuagggaagucguaugcgcagauguggacguugauguacuuccaccggcgagaccugcggcuagccgccaacgcgaucugcagugccguacccucccacugggugcccacaagucgcacuaccugguccauccaugcgaaacacgaauggaugaccacggaggacaugcuggccgucuggaaccgcguguggauccaggagaauccauggauggaagacaagacccccguagagagcugggaagaaguccccuaccuuggcaagagggaggaccaauggugcggaucucucaucggcuugaccuccagagccaccugggccaagaacauccaaacugcgaucaaccaggugcgcagccugaucgggaacgaggaguacaccgauuauaugcccagcaugaagcgcuuccggaaagaggaagaggaggccggugugcucugguga

SEQ ID NO: 25214 - RNA, 9876 nt, Artificial Sequence
  derived and/or modified CDS sequence (opt11) from DENV-2__EU569718__SS-prME
accgccggcgugaucaucaugcugauccccaccgccauggcuuuccaccucaccacccgcaauggggagccccacaugaucgucggccggcaggagaaggggaaaucgcugcuguuuaagaccgaggacggcgugaacaugugcacccucauggccaucgaccucggggaacugugcgaggacaccaucaccuacaagugcccccuccugcgccagaacgagcccgaagacauagacugcuggugcaacagcaccuccacgugggugacauacgggaccugcaccaccacuggggagcaccggcgcgagaagcgguccgucgcccuggugccccacguggggaugggccucgagacacguaccgagaccuggaugagcagcgaaggggcguggaagcacguccaacggaucgagaccuggauccugaggcacccggguuucacuaucauggcagcgauccuggcguacaccaucgggacgacgcacuuccagcgggcccucaucuuuauuuuacugaccgccguagcgcccucgaugaccaugcgcugcauuggcaucuccaaccgggacuucguagaggguguaagcgggggcuccuggguggacaucguucucgagcaugggaguugcgucaccacgauggccaagaacaagcccaccuuggacuucgaguugaucaagacggaggcgaagcagccugccacacuccgcaaguacugcaucgaggccaagcugacuaacaccacaacggagucgcggugccccacgcagggcgagcccucgcugaacgaggaacaggauaagcgcuuuaucugcaagcacuccauggucgaccggggcuggggcaacggcugcggccuuuucgguaagggcgggauagugaccugcgccauguucacguguaagaagaacauggaggguaaggucgugcugcccgagaaccuggaguacaccaucgugauaacgccccacagcggggaggaguacgccgucggcaacgacaccgggaagcauggcaaggagauuaagaucaccccgcaguccagcaucaccgaagcugaacucaccggcuacggcacggugacgauggaguguagcccccggacaggccuggauuucaacgagaugguuuuguuacagauggaggacaaggcgugguugguccaccggcagugguuccuggaccucccccugccauggcuuccgggugccgacacgcagggcuccaacuggauucagaaggagacacucgugaccuucaagaacccccacgcgaagaagcaggacgugguugugcuggguagccaggagggcgccaugcacaccgcucugaccggcgcuacggagauccagaugucauccgggaaccuacuuuucaccggucaccugaagugccgccuccggauggacaaguuacagcuuaaggggauguccuacagcaugugcaccgggaaguucaagaucguaaaggagaucgccgagacccagcacggcacgaucgugauccguguacaguaugaaggcgacggcuccccaugcaagauucccuuugaaaucauggaccucgagaagcggcacguccuggggcgccugaucaccgugaacccgaucgucaccgagaaggauagccccgucaauguggaggcggagccgcccuucggugauuccuacaucaucaucgggguggagcccggccagcugaaacuuaauugguucaagaaggggucuuccaucggccagauguuugagaccacgaugcgcggcgcgaaacggauggccauccugggcgacaccgccugggacuucggcagccucggaggcgucuucaccucgaucggcaaagcgcuucaccagguguucggcgcgauuuacggcgccgccuucaguggaguguccuggaccaugaagauucugaucggggucaucauuacguggaucggcaugaacagccgcuccaccagccuguccguaucucucguccuggucggcguggugacccuguaccucggggucaugguccaagccgacuccggaugcguggucagcuggaagaacaaagaacugaagugcggguccgggaucuucaucaccgacaacgugcacacguggacugagcaguacaaguuccagcccgaaagccccucaaaacuggcguccgccauccagaaggcccacgaggaggguaucugcgggauccggagcgugaccaggcucgagaaccugauguggaagcagaucacucccgagcugaaccacauccucucugagaaugaggucaagcuaacgauuaugaccggugauaucaaagggauuaugcaggcgggcaagcgcagcuugagaccgcagccgaccgagcucaaauacucuuggaaaaccuggggcaaagccaaaaugcugucaacagaaagucacaaccagaccuuccugauugaugggcccgagacagcagaaugcccgaacaccaaccgggccuggaacucccuggagguggaggacuacgguuucgggguguucuccacgaauaucugguuaaagcuacgcgagaagcaggacgucuuuugugacucaaagcucaugucagccgccaucaaggacaaccgggcggugcacgcggacaugggcuacuggaucgaaucugcacugaacgacacauggaagauggagaaggcaucguuuaucgaagucaagagcugccacuggccaaagucccacacccuguggagcaacggcgugcucgaguccgagaugaucauccccaaaaacuucgccgggcccgugagucagcacaacuaucgcccaggcuaccacacccagaccgccgggcccuggcaccuggguaagcuggagauggauuucgacuuuugcgaggggacgaccguggucgugaccgaggacugcggcaaccggggcccgagcuugcgcaccacuaccgcgucggggaaguugaucaccgaguggugcuguaggaguugcacccugccgccgcuccgcuaccggggagaggacgggugcugguacggcauggagauccgcccacugaaggagaaggaggagaaucugguuaacucccucgucacggccggacacggccagaucgacaacuucagcuugggcgugcugggcauggccuuauucuuagaggagaugcugcguacccgcgucggcacgaagcaugccaucuuacuggucgcgguguccuucgugacccuuaucacggguaacaugagcuuccgggaccucgggcgcgugauggugauggugggcgccaccaugaccgacgacaucggcaugggcgugaccuaucuggcccugcucgccgcuuucaagguacgacccacguucgcggccgggcugcugcuccguaagcuaaccuccaaggagcugaugauggccaccaucggcaucgcccuccugagccagaguaccauccccgagacgauccucgaguugaccgacgcccuggcacuaggcaugaugguucucaaaaucguccgcaacauggagaaguaccagcuggccgugaccaucauggccaucagcugcgugccgaacgccgucauccugcagaacgcauggaagguguccugcacaauccucgccgccgucagcguuagcccucugcugcucacgagcucacagcaaaaggcagacuggaucccuuuagcucugaccaucaagggccucaacccaaccgcaauuuucuuaacuacgcugagccgaaccuccaagaagcggagcuggccgcucaacgaagccgugauggccgugggcaugguuuccauucuggcgagcagccugcucaagaacgacauccccaugaccgggccccugguugccggcgguuuacugaccgucugcuacguguugaccggccguucggcggaccuggagcucgaacgagccgccgacgugaagugggaggaccaggcugaaaucagcggguccagccccauccuguccaucaccaucagcgaagacggcucgaugagcaucaagaaugaggaggaggagcagacccuuaccauacucauccggacgggccugcuggugaucuccgggguguucccggugagcauccccauuaccgccgcggcgugguaccugugggagguuaagaagcagcgcgccggagugcugugggacguacccagcccgccacccgucgggaaagccgagcuggaggauggcgccuaccguaucaaacagagagggaucuucggcuauucccagaucggcgcgggggucuacaaagaaggcaccuuccacacuauguggcacgugacacgaggggccguccucaugcaccgcggcaagcgaaucgagcccuccugggccgacgugaagaaggaccugaucagcuacgggggcggcuggaagcucgaaggugaguggaaagagggcgaggaggugcagguccucgcccuggagccgggcaagaacccucgcgccguacaaacgaagcccggccuguucaagaccaacaccgggaccaucggcgcggucuccuuggacuucucuccaggcacguccgggagccccaucguggaccggaagggcaagguggugggccuguacggcaacggcgucgugaccaggucgggggcguacgugagcgccaucgcccagaccgagaaguccaucgaggacaaccccgagaucgaggaugauaucuuccggaagaagcgccugacaaucauggaucuccacccaggugcggggaagacgaagcgauacuugcccgccaucguccgcgaggccaucaagcggggccugcgcacucugauccucgccccgacgcgagugguagccgcggaaauggaggaagcccugcgggggcugcccauccgauaucagaccccugccauccgggcagagcacaccggccgcgagauagucgaccucaugugccacgcaaccuucaccaugcggcugcugucacccguucgggugcccaacuauaaccucauaaucauggacgaggcgcacuucaccgaccccgccucgauugccgcccggggcuacaucuccacccgcgucgagaugggggaggccgcgggcaucuucaugaccgccacgccgccggggucgcgcgacccguucccacaguccaacgcccccauuauggacgaggaacgagagauccccgagcggucauggaacuccggacacgaguggguaaccgacuucaaggggaagacggugugguucgucccgagcaucaaagccggcaacgacaucgcagccugccugcgcaagaacggcaagaaggugauccagcugucacguaagaccuucgacuccgaguacgugaagacaagagcuaacgacugggacuucguggugaccacggacaucagcgagaugggggccaauuuucgggccgagcgcguuauugacccgaggcggugcaugaagccggucauccucaccgacggcgaggagagagugauucuggcggggcccaugccggugacucacagcucugccgcucagcgccggggaagaaucgggcgcaacccuaagaaugagaaugaccaguacaucuacaugggcgagccccuagagaacgacgaggacugcgcccacuggaaggaggccaagauguuacuggacaacaucaacacccccgagggcaucauaccgagcauguucgagcccgagcgggagaaagucgacgcgauagauggggaguaccgccuccggggcgaggccaggaaaacauuuguugaccucaugcgaagaggggaucugcccguguggcuggccuaccgugucgccgccgagggaaucaauuacgcggaccgccgcuggugcuucgacgggauaaagaacaaccagauccucgaggaaaacguggaggucgagauuuggaccaaggagggcgagcgcaagaagcugaagccgcgcuggcuggacgcacgcaucuacuccgacccccuggcccuaaaggaguucaaggaauuugccgcgggccggaagucgcuaacccucaaccuuauuacugaaauggggcgcuuacccacguuuaugacccagaaggccagagacgcccucgauaaccuggcggugcugcacacugccgaagugggcgggaaggcguacaaccacgcccucuccgagcugcccgagacccuggagacccuccugcugcucacccugcuugccacugucacagggggcauauuccucuuccugaugagcggcaagggcauuggcaagaugacguugggcaugugcugcauuaucaccgccuccauucucuuaugguacgcccagauccagccgcacuggaucgcggccagcaucaucuuggaguucuuccucauagugcugcucauacccgagcccgagaaacagaggacaccccaggacaaucagcucaccuacgugguuaucgccauucugaccgucguggccgcuacuauggcgaaugagaugggauuucuggaaaagaccaagaaagacuugggauuagguagcaucaccacccaagaguccgagucaaacauccuggacaucgaucuucggccggccagcgcuuggacgcuguacgccgucgccacaaccuucgugaccccuaugcugcgccacagcaucgagaacuccagcgugaacgucucccuaacggcgaucgcaaaccaggccacagugcuaaugggguugggccguggguggccccuguccaagauggacaucggcgugccccugcuggcaaucgguugcuacucccaggucaaccccaucacccucaccgcggcccuucugcuccugguggcccauuacgccaucaucggcccuggccugcaggccaaggcgacgcgggaagcccagaagagggccgccgccgggaucaugaaaaacccuaccguagacgggaucaccguuauugaccucgagcccauaccauacgaccccaaguucgagaagcagcugggucaggugaugcugcucgugcuguguguaacccaggugcuaaugaugcggacaaccugggcccucugcgaggcacuuacccucgccaccggccccauaagcacccucugggagggcaaccccggccgcuucuggaacaccaccaucgccgucuccauggccaacaucuuccggggaucauaccuggcgggggccgggcuccucuucucgaucaugaagaacaccacgaacacccgcagggggacaggcaauauuggcgagacccugggggagaaguggaagucgcgccugaacgcccucggaaaaucugaguuccagaucuacaagaaaagcgggauccaggaggucgacaggacgcuggcuaaggagggcaucaagcgcggggaaacagaccaccacgcggugucccggggcagcgccaagcugcgcugguucguggagaggaauauggucaccccggagggcaaagugguggaccugggaugcggccgcggaggguggaguuacuacugcggaggccugaagaacguccgagaggugaagggccucaccaaaggcggacccggccaugaggagccaauccccaugagcacguacggauggaaccuggugagacugcagucaggggucgacguguuuuucaccccgcccgagaagugcgacacccugcucugcgacaucggcgagucgagccccaaucccaccaucgaggccggccggacgcugcgcgugcugaaccucgucgagaacuggcucaauaauaacacccaguucugcaucaaggugcugaacccguacaugcccuccgucaucgagaagauggagacccuccaacggaaguacgggggugcucugguccgcaacccccugucaagaaacuccacccacgagauguacugggugucaaacgcaaccggcaacaucgugucuagcgucaacaugaucagccguaugcugaucaaccgauucaccaugaagcauaagaaggcaaccuacgagccggacguggacuuaggaagcgggacgcggaacauuggcauagagaacgagauccccaaccuggacaucaucggcaagcgcaucgagaagaucaagcaagagcaugagaccuccuggcacuacgaccaggaccacccauacaagacaugggccuaccacgggagcuacgagaccaagcagaccggcuccgccagcuccauggugaauggggucgugcgucugcucacgaagcccugggacgucgucccgauggugacgcagauggccaugaccgacaccacccccuucggccagcagcgcguguucaaggaaaaggucgacacacggacucaagagcccaaggaggguaccaagaagcugaugagaaucaccgccgaguggcuguggaaagagcucgggaagaagaagacacccaggaugugcacccgagaggaguucaccagaaaggugcgcagcaaugcggcccuuggcgccauauucaccgacgagaacaaauggaagagugcacgggaggcggucgaggacagccgcuucugggagcugguggaucgggagcgcaaccuccaccuggaggggaagugcgagacguguguuuacaacaugauggguaagcgggagaagaagcugggggaguucggcaaggcgaagggcucccgcgcaaucugguacauguggcuuggggcccgauucuuggaguucgaagcucugggcuuccucaacgaggaucacugguucagccgcgggaacaguuuguccggagucgagggagaggggcugcacaagcucggcuacauccugcgggacguuagcaagaaggaaggcggggcgauguacgccgacgacaccgccggcugggacacgcgcaucacccuggaggaucucaagaacgaggagauggugacgaaccacaugaagggcgaacacaagaaacuggcagaggccauauucaagcugaccuaccagaauaaggucgugcgggugcagcgcccgacgcccaggggaaccguaauggacauuaucucccguaaggaccagcgcgggucaggacagguggggacguacggucugaacaccuucacaaacauggaggcgcagcugauacgacaaauggagggggaagguaucuucaaguccauccagcgccugaccgugacggaggagauagccguccagaacuggcucgccagggugggccgcgagcggcugagccgcauggccaucuccggggacgacugcguggucaagccccuggacgaccgguuugcuagcgcgcucaccgcccugaaugacaugggcaaggugcgcaaagacauccagcagugggagcccucucguggguggaacgacuggacccaaguuccauucugcucacaccacuuccaugagcuggucaugaaggacggcagagugcucgugguuccgugccggaaccaggacgaacugaucggccgugcccggaucucacagggcgccggcuggucucugaaagagaccgccugccucgggaagucguaugcgcagauguggacgcugauguacuuccaccgcagggaccugcgccucgccgccaaugccaucugcagcgccgugcccucccacugggugcccacuagccggaccacuugguccauccacgcgaagcacgaguggaugaccacggaagacaugcuggccguguggaaccgcguauggauccaggagaacccauggauggaggacaaaacucccguggagagcugggaggagguccccuaccugggcaagcgcgaggaccaguggugcggaagccucaucggccugaccuccagagcaaccugggccaagaacauccagacggcgauuaaccaggugcggucucugaucgggaaugaagaguacacggacuacaugcccuccaugaagcgguuccgcaaggaggaagaggaagccggugugcucugguga

SEQ ID NO: 25215 - RNA, 9876 nt, Artificial Sequence
  derived and/or modified CDS sequence (opt11) from DENV-2__EU596488__SS-prME
acagcaggggucaucaucaugcucaucccaaccgucauggcguuucaccucaccacccgcaacggggagccccauaugaucgugggccgucaagagaaggguaaauccuugcuguucaagaccgaggacggggugaacaugugcacacucauggcgaucgaucugggggagcucugcgaggauacaaucaccuacaagugcccccuccugcggcagaaugaaccggaggacaucgacugcuggugcaauagcaccagcaccuggguaaccuaugguaccugcacuaccacuggggagcaccggcgcgaaaagcgauccguugcguuggugccccacguggguaugggccucgagacccgcacugagaccuggaugagcagcgaaggagccuggaaacaugugcagagaaucgagaccuggauacugagacacccgggauucacaaucauggccgccauccuggcguacaccauagggaccacacacuuucaacgggccuugaucuucauccuccugaccgccgucgccccuaguaugaccaugcggugcaucggcauaaguaaucgggauuucgucgagggcgucagcgggggcucguggguggauauaguccucgaacacgggagcugcgugaccacuauggcgaagaauaagccaacccucgacuucgaacugaucaaaacggaagcgaaacagcccgcaacacugaggaaguacugcaucgaggccaaacugaccaacaccaccaccgagucccggugcccgacacagggggagccaagccuuaaugaggaacaggacaaaagguucaucugcaagcauuccaugguggaccggggcugggggaacggaugcgggcuguucggaaaaggagggauugugaccugcgccauguucacauguaagaaaaacauggagggcaaagugguguugcccgagaaucuggaguacaccaucgucaucacgccccacagcggggaggagcacgcagugggaaacgacaccggaaagcacgguaaggagauuaaaauuaccccucagucaagcauuaccgaggccgagcucaccggauacggcacggugaccauggagugcagcccccgcaccggucuagacuucaacgagaugguucugcuucagauggaggauaaggcuuggcuggugcaucggcagugguuccuggaccucccccugcccuggcuccccggugccgauacccagggcagcaacuggauccagaaggagacguuggugaccuucaagaacccccacgccaagaaacaggaugucgugguccuggggucgcaggagggggcgaugcacaccgcccugaccggugccacggagauacagaugagcagcggcaacuugcuuuuuaccggccaccuuaagugucguuuaagaauggacaaacugcaacugaaagggauguccuacagcaugugcacuggcaaauucaagaucgugaaggagaucgccgagacccagcacgggacgauagugaucagaguccaguacgagggugaugguagucccugcaagauucccuucgagaucauggaccuggagaaacggcacguguuagggcgccugaucacugugaacccgaucgucaccgagaaggacagccccgugaacaucgaggccgagccgcccuucggggacuccuauaucaucaucggaguggagcccggccagcuuaagcugaacugguucaagaaggguagcucaaucggucagauguucgaaacgaccaugcgcggugcuaagcggauggccauccuaggagauaccgccugggacuucggaagccucgggggcgucuucaccucuaucgggaaggcucugcaccagguguuuggugcgaucuauggcgcggccuucuccgggguguccuggaccaugaagauucuaaucgggguuauaaucacguggauagggaugaauagccgcucgaccagccuguccgucagccuggucuugguaggcgucgugacccuguacuuaggggucauggugcaggccgauacugggugcguggucucauggaagaacaaggaguugaagugcggcagcgggauauucauuacggacaacgugcauacauggaccgagcaguauaaauuccagcccgagucgccgagcaaacuagccagcgcgauccagaaggcucaugaagagggcaucugcgggauccggucagugacccgucucgagaaccugauguggaagcagauaacgcccgaauugaaucacauucucagcgagaaugagguaaaguuaacaauaaugaccggcgacaucaaggggaucaugcaagcaggcaagagaagccuccgcccacaacccacggagcucaaauacagcuggaagaccuggggcaaagccaagaugcugucgaccgagagccacaaucagacauuucugaucgacgggcccgagaccgcagaaugcccgaacacuaaccgggcguggaacucccucgagguggaagacuauggcuucgggguguucagcacaaacaucuggcugaaacugagagagaagcaggacgucuucugcgacuccaagcucaugucggccgcuaucaaggacaaccgggcagugcacgccgacaugggauacuggauagaauccgcacugaacgacaccuggaaaauggaaaaagccagcuucaucgagaucaaguccugccacuggcccaagagccacacccugugguccaacggugugcuagagagcgagaugaucauucccaaaaauuucgccgggcccgucucccagcacaacuaccgcccggguuaccacacacagaccgcggggccuuggcauuugggcaaacuggagauggauuuugacuucugcgaggggaccaccguggucgucaccgaggacuguggaaaccgggggcccagccuccgcacgaccacagccagcgguaaacuaaucacugaguggugcugccgguccugcacguugccgccguuacgcuaucggggcgaggacgguugcugguacggaauggagauccggcccuugaaggagaaggaggagaaucuagugaacagccuagugacugcggggcacggacaaauagacaacuuuucccugggcguguuggguauggcccucuuucuggaggagaugcuucgaacgcgcgucggcaccaagcacgcaauccuccugguagccgucaguuucgugacgcuaaucacggggaacauguccuuccgagaccucggccgcgugauggucauggugggggcgacaaugacagacgacaucggcaugggcgugacauacuuagcccugcuggcggccuucaaaguucgccccaccuucgcagcaggucugcuccuccggaagcugaccucgaaggaguuaaugauggcgaccaucgguaucgcccuccuaucacagagcacuauccccgagaccauuuuagagcuuacugacgcucuugcccugggaaugauggugcucaagaucgugcgcaacauggagaaguaccagcuggcggucaccaucauggccaucuccugugugccgaacgccgucauccuccagaacgccuggaaggucucgugcacgauccucgccgcgguguccgucagcccccugcugcucacaaguagccagcaaaaggccgauuggaucccccuggcccugaccauaaaaggccucaacccaacggcgauuuuccuaaccacccugucccgcaccucaaagaagcgcuccuggccguugaacgaggccgugauggcagucgguauggucucuauccuggccucuagccugcucaagaacgauauccccaugaccgguccccugguggcuggcgggcugcucacugugugcuacguccugaccggccggagcgccgauuuagagcucgagcgcgccgccgacguaaagugggaggaucaagcggagaucuccggaucaucccccauucugagcauaaccaucucggaggaugggucaaugucaaucaagaacgaggaggaggaacacacccuuacuaucuugauccguacaggccuguuggugaucaguggggucuucccggugagcauccccaucaccgccgccgcgugguaccucugggagguaaagaagcaacgcgccggcguccugugggacgugcccagcccuccgcccguuggcaaggccgagcuagaagacggcgcguaccguauaaagcagcgcgggaucuucggguacucgcagaucggagccggggucuauaaggaaggcaccuuccacaccauguggcacgugacucgcggggcggugcucaugcaccgaggcaaacggaucgaacccucuugggcggaugucaagaaagaccugaucuccuacggaggcggguggaagcuggagggggaauggaaggagggugaggagguccaggugcucgcccuggaacccgggaagaacccgcgggcaguacagaccaaacccgggcuguuuaagaccaacacugggacgaucggcgccguaucauuggacuucucccccgggacgucgggcucccccauaguggaccgaaagggcaaggucguggggcuguauggaaacggaguggucacccgguccggggccuaugugucagccaucgcccagaccgagaaguccauagaagacaaccccgagaucgaggacgacaucuuccggaaaaagcgccugacgaucauggaccuccaccccggcgccgggaagacgaagcgguaccugcccgcgaucguccgagaggccaucaaacggggccugcgcacccucauacucgccccaaccagggucguggccgcugagauggaagaggcucugcgaggacugccaauccgcuaccagacgccggccaucagagccgagcacacgggccgggagauaguggacuugaugugccacgccacauucaccaugcggcugcugagccccguacgcgugccgaacuacaacuugauaaucauggacgaggcccacuucacggauccggcguccaucgccgcuagaggcuacaucagcacccgcguggagaugggggaggcugcaggaauauuuaugacagcgacgccgcccgggagcagagacccguucccccagagcaacgcucccaucauggacgaggagcgugagauccccgagcggucauggaacuccggccacgagugggucacggauuuuaaagggaagaccguaugguucguaccguccaucaaagccggaaacgacaucgcagcgugucugcgcaaaaacggcaaaaaggucauacagcugucgcgcaagaccuucgacuccgaguacgugaaaacccgcgccaaugacugggauuuuguagucacgaccgacaucagcgagaugggggccaacuuccgggccgagcgcgugaucgauccccggcgcuguaugaagcccgugauccugaccgacggcgaggaacgggucauccuggccgggcccaugccagugacccacagcagcgcggcucagcgccgcggacggaucgggcgaaaccccaaaaaugaaaacgaccaguacaucuauaugggcgagccccuggaaaacgacgaggauugcgcccauuggaaagaagcgaagaugcuccucgauaacauaaacacgcccgagggcauaaucccuuccauguucgaaccggagcgggagaagguggaugccaucgacggggaguacagacuccggggcgaagcgcgcaagacuuucguugaccucaugcggcgcggugaccugccaguguggcuggccuaccggguggccgccgaagguaucaacuacgccgaccgccguuggugcuucgacgggauuaaaaacaaccaaauccucgaagagaacgucgaaguggagauuuggaccaaggaaggugagaggaaaaagcugaagccccgcuggcuggacgcacgcauauacagugacccccuagcccugaaggaguuuaaggaguucgccgcaggcaggaagucccugacccucaaccugaucacugaaauggggcgccugccgaccuucaugacacagaaagcacgggacgcccucgauaacuuggccgugcugcacacugccgagguggguggucgcgccuacaaccacgcccugagcgaguugccugagacacuggagacccuacugcugcucacacuguuagccacugugacugggggcaucuuccucuuccugauguccggaaagggcaucgggaagaugacccuggguaugugcugcauaaucaccgccagcauccuccucugguacgcccagauccagccgcauuggaucgccgcaucgauuauccuugaguucuuucucaucgugcuuuuaauccccgagccggagaaacagcggacaccccaggacaaucagcuuaccuauguggugauugccauacugacggucguggccgccaccauggccaacgaaaugggguucuuagagaagaccaagaaagaccucggacuggggagcaucaccacgcaagagucagaguccaacauccuggacaucgacuuacgcccagcgagcgccuggacccuguacgccguggcgaccacuuucgucacucccaugcugcggcacuccaucgagaacagcuccgucaacgugucucucaccgccauugcgaaucaagccacuguccugauggggcuggggaggggguggccccucaguaagauggauaucggagucccccucuuagccaucgggugcuauagccaagucaacccuaucacccucacggcagcgcuguugcuccuggucgcccacuacgccauuaucggccccgggcugcaggccaaggccacccgcgaggcgcagaagaggaccgccgccgggauaaugaagaacccaaccguugauggcaucacagugauugacuuggaacccaucccguacgaccccaaguucgaaaagcagcuggggcaggucauguugcuagugcugugcgugacgcagguccugaugaugaggaccacaugggcgcucugcgaagcucuaacguuagcgaccggacccaucuccacccucugggaggggaaccccggucguuucuggaacaccacaauagcgguaagcauggccaauaucuuccgcggcuccuaccuggcaggggcaggccuccuauuuagcaucaugaaaaacacaaucaauacgcggcgcgggaccgguaauauaggagagacgcugggugagaaguggaagucccggcuuaacgcgcucggaaagagcgaguuccagaucuacaagaaguccgggauccaagaaguggauaggacccuggccaaggaggguaucaagcgcggugagacugaccaccacgcggucagccgcgguuccgcgaagcugcggugguuuguggagcguaacaugguuaccccugagggcaagguaguggaccucgggugcggacgcggcggguggucuuacuacugcggcgggcugaagaacguccgcgaggucaaggggcuuacgaaaggugggcccggccacgaggagccaauucccauguccaccuacggauggaacuuaguacgguugcagagcgggguagacgucuucuucacaccgcccgagaaaugcgacacccugcuaugcgacaucggagagagcucccccaaccccacaaucgaggcaggccggacuuuacgggugcuaaaccucguggagaacuggcugaacaacaacacccaguuuugcgucaaggugcuaaauccuuacaugcccagcgugauagagaaaauggaaacacuucagcgcaaauauggaggcgcccugguucggaauccacugagccgcaacucaacccacgagauguacuggguguccaacgcuacgggcaacaucgugagcuccgucaacaugaucagccgcaugcucauaaaccgguucaccaugaaacauaagaaagccacguacgagcccgauguggaccucggcucagggacgcgcaauaucgggauagaaaacgagauacccaaccuggacaucaucggcaaacgaauagaaaagaucaaacaggagcacgagacgagcuggcacuacgaccaggaccauccguacaagaccugggcauaucaugggucguacgagaccaagcaaaccgggucagcgucuagcauggugaacggcgucgucaagcuacugacaaagcccugggacguggugccuauggugacucagauggccaugaccgacacuacuccauucggccaacagcgcguguucaaggagaagguggacaccaggacccaggagcccaaggagggcacgaagaaacugaugcgcaucacggccgaauggcuguggaaggagcucgggaaaaagaagacgccuaggaugugcacccgggaggaguucacccggaagguccguagcaacgccgcccuuggugcgauuuucacggacgaaaauaaguggaaguccgcuagggaggcaguagaggauucacgguucugggagcucguggacagggagcgcaauuuacaucucgaagggaagugugaaacauguguuuauaacaugaugggcaagagagagaaaaagcugggcgaguucggcaaggcgaagggcagccgugcgaucugguacauguggcucggggcgcgguuucuggaguucgaggcucuuggguuccucaacgaagaccacugguucucccgcggcaauagccugagcggcguggagggggaaggacugcacaaacuugguuacauauugcgggacguuuccaagaaggagggaggggcuauguacgcugacgacacugcgggaugggauacgaggauaacauuagaggaucucaagaaugaggagaugguuaccaaccacaugaagggugagcacaaaaagcuggccgaggcgaucuucaagcuaaccuaccagaacaaagucgugcggguucagcgucccacgccccgggggacggucauggacauaauuagccgaaaagaccagcgcggcuccggucagguagggaccuacggccucaacaccuuuaccaacauggaggcccaacugauacggcagauggagggugaggggaucuucaagucuauccagcgccucacugucacagaggagaucgccguccagaacuggcucgcgagagugggccgcgagcggcuuucuaggauggcgauuagcggggacgacuguguggucaaaccacuggacgaucgguucgcauccgcccuaacggcccucaacgacaugggcaaggugcgaaaggacauccagcagugggagcccagcaggggguggaacgacuggacgcagguuccguuuugcucccaccacuuccacgaacugguaaugaaggacggccgcgugcucgugguucccugccggaaucaggacgagcugauugggcgcgcccggaucucgcagggcgccggguggagucugaaggagacggccugcuugggcaagagcuacgcgcagauguggaccuuaauguacuuccauaggcgggaccugcgacucgccgcaaacgcaaucugcuccgcugugcccucgcacuggguacccaccucccggaccacuuggagcauccacgccaagcacgaguggaugacgacugaggacaugcuggcagucuggaaccgcguguggauccaggagaauccguggauggaggacaagacgccaguggagagcugggaggagguucccuaccugggcaaacgcgaggaccaguggugcgguucucucauuggccugacaucgcgggccacgugggccaagaacauccagaccgcgaucaaccaggugcgaucucugaucgggaacgaggaauacaccgauuacaugcccaguaugaaacgguuccgcaaagaggaggaagaggccggugugcucugguga

SEQ ID NO: 25216 - RNA, 9876 nt, Artificial Sequence
  derived and/or modified CDS sequence (opt11) from DENV-2__EU596489__SS-prME
accgccggggugaucaucaugcugaucccgacugccauggcguuccacuugaccacccggaacggggagccccauaugauagucggacggcaggaaaagggaaagagccugcuguucaagacggaggacggcgugaacaugugcaccuugauggccaucgauuugggggaacugugcgaagacacgaucaccuacaagugcccacuccuacgccagaaugagcccgaggacaucgauugcugguguaauuccacgagcacgugggugaccuacgggacuugcaccacuacgggcgaacacagacgugagaagcgguccgucgcccuggugccccacguggggaugggccuggagacacgcaccgagaccuggaugagcuccgagggggcuuggaagcacgugcagaggaucgagacguggauccugcgucaccccgguuucaccaccauggccgcgauccuggccuacaccaucgggacgacgcacuuccagcgggcucucaucuuuauucugcugaccgccguggcgcccaguaugaccaugcgcugcaucggcaucuccaaccgggacuucguugagggcgucagcggggguuccuggguugacauugugcucgagcacgggagcugcgucacaaccauggccaagaacaagccuacccuggacuucgagcugaucaagaccgaggccaagcagcccgccacguuacgcaaguacuguauugaagccaagcuuaccaacaccaccacagagucccggugccccacucagggggagcccucccuaaaugaggagcaagacaagcgauucauuugcaaacacuccauggucgaccggggcuggggaaacggaugcggccuguucggcaagggcggaaucgugaccugcgcuauguucacguguaagaagaacauggagggcaaggucgugcugcccgagaaucuggaauacacgauagugaucacgccgcacucaggggaggagcacgcagucggcaacgacaccgggaagcacgggaaggagauuaagaucaccccacaguccaguauuaccgaggccgagcucacgggguacggcaccgugaccauggagugcagcccccguacaggcuuagacuuuaacgagaugguauuacugcagauggaggacaaagccuggcugguccacagacagugguuccuagaccucccccugcccuggcugccuggggcagacacgcagggcagcaacuggauacagaaagaaacccucguaaccuucaagaauccccaugccaagaagcaggacguggucgugcugggaucucaggagggcgcgaugcacaccgcucugacgggggccaccgagauucaaaugagcagcggcaaccuccuguucaccggacaccugaagugucgccuccggauggacaagcuacagcugaaggggaugagcuauaguaugugcaccggcaaguucaagauuguaaaagagaucgccgaaacgcagcacgggacaaucgugauccgcgugcaguacgagggcgacggcuccccaugcaagauccccuuugagaucauggaucuagagaagcggcauguccuggggcgccuuaucaccgugaauccgaucgugaccgaaaaggacagccccgucaacaucgaggcagagccgcccuuuggagacuccuacauaaucauugggguggagccgggccagcucaagcugaacugguuuaagaagggcagcucaauuggccagauguucgagacgaccaugcgcggagccaagcggauggcuauccugggcgacacugccugggacuuuggcagccucggcggcguguuuacuaguaucgggaaggcccugcaucaggucuuuggcgcgaucuauggcgccgcguucagcggggugucguggacgaugaagauccucaucggcgugaucaucacauggaucgggaugaacagccgcucuaccagccugucagucagccuggugcugguaggcaucgucaccuuauaucucggagugauggugcaggcagacaccgggugcguugucuccuggaagaacaaggagcuaaagugcggcagcgggaucuuuaucaccgacaacguacacacauggacggagcaauauaaauuccagcccgaguuccccuccaaacuggcgagcgccaucaaaaaggcccacgaagaggggaucugcgggauucguagcgucacuagacucgagaaccuaauguggaagcagaucacccccgagcugaaccacauccuguccgagaaugaggugaagcugaccauuaugaccggcgauauuaaggggauuaugcaggcgggcaagcggagucugcguccgcaacccacggaguuaaaguacucuuggaagaccuggggcaaggccaaaaugcugagcacugagucccacaaccagaccuuccugauugaugggcccgaaacggcggagugcccgaauaccaaccgggccuggaacagccucgagguggaggacuacggcuucggggucuucuccaccaacauuuggcucaagcugcgcgagaagcaggauguguucugcgauucaaaguugaugucggccgccaucaaggacaaccgggccgugcacgcggacaugggcuacuggauugagagcgccuuaaacgacaccuggaaaauggagaaagcuucguucauagagaucaagagcugucacuggccaaagucccacacccuguggagcaacggggucuuagaguccgagaugauuauacccaagaacuucgccgggcccguuagccagcacaauuaccgcccgggcuaccacacacagaccgccgggcccuggcaccugggcaagcuggagauggacuucgacuucugcgaagggaccacuguagucgugacggaggacugcggcaaccggggccccucccuucgcaccaccaccgcgucuggcaaguugaucacggaguggugcugccgaagcugcacccugccuccgcuccgauaccggggagaggacgggugcugguacggcauggagauccgcccgcugaaggagaaggaggaaaaccuggugaacucccucgucacugccggccacggacagaucgacaacuucagccugggcgucuuggggauggcucucuuccuggaggaaaugcugcggacccgcgugggcacgaaacacgccauccucuuagucgcgguguccuucgugacccuuauuacgggaaacaugagcuuccgggacuuaggccgggucauggugauggugggggccacaaugacggacgacaucgguaugggcgucacauaccuagcccugcucgccgccuucaagguccgccccaccuuugcggccggucugcugcuccggaagcugaccucgaaagagcuuaugauggcaacuaucggaauagcccuccugagccaguccaccauccccgagacgauccuggagcucaccgaugcgcuggcgcuggggaugauggugcucaagaucgucagaaacauggagaaguaccagcuggccgugacgauaauggccaucaguugcgugccgaacgcaguaauacugcagaacgccuggaaggugagcugcacuauccucgcggccguaucagucucgccccuguuguugacuuccucccagcagaaggccgacuggaucccccuggcccugaccauaaaggggcuaaaccccacggcgaucuuucugaccacacuuucuaggaccuccaagaagcgcaguuggccgcucaaugaggccguuauggccgucggcauggugaguauucuggccagcucccugcucaaaaacgacauccccaugacggggccacugguagcgggcgggcuccuuaccgucugcuacgugcugaccgggcggagugcugaccuggagcuagagaaggccgccgacgugaagugggaggaucaggccgaaaucagcggguccagccccauccuguccaucaccaucagcgaggauggcuccaugucgaucaagaacgaagaagaggagcacacgcuuaccauccucauacgcaccggauuguugguuauuucagggguauucccgguuagcauccccauuaccgccgcggccugguaccucugggaggucaagaagcagcgggccggagugcugugggaugugccaagcccaccgccugucgggaaggccgagcuggaggacggugccuaucguaucaagcagcgggggauuuucggcuauagccagaucggcgcgggagucuacaaggaggguacauuccauaccauguggcacgucacccgcggggccguucugaugcaccggggaaagcgcauugagccauccugggccgaugugaagaaggaccugaucucauacgggggcggguggaagcucgagggugaguggaaggaaggcgaggagguacagguuuuggcccuggagcccggaaaaaauccccgggccgugcaaacuaagcccggccuguucaagacgaacacggggaccauaggcgcgguaucccucgacuucagccccggcaccuccgguagucccaucgucgaccgcaagggcaaggugguggggcuguacgguaacggcgucgucacucgguccggagcuuacgugagcgcgaucgcccaaacggagaaaaguauugaggacaacccggagaucgaagacgacaucuuucgcaaaaagcggcugaccaucauggaccuccaucccggcgcggggaaaaccaaacgcuaccugcccgccaucguccgugaagcaaucaagcgcggccugcggacccugauucucgccccgacgcgcgugguggccgcggagauggaggaagcccuucgcgggcuacccauucgauaucagacccccgccauaagggccgagcacaccggccgugaaauuguggaucucaugugccacgccaccuucacgaugcgccugcugagucccguacgugugccgaauuacaaccuuaucaucauggacgaggcacacuuuacggaccccgccagcaucgccgcccguggcuauauuuccacacgggucgaaaugggugaggcugcggguaucuucaugacggccacgccgcccggcucacgggauccguuuccccaaucuaacgcccccaucauggacgaggaacgggagauccccgagcgaagcuggaacuccggccacgagugggugaccgacuucaagggcaagaccgugugguucguccccucgaucaaagccggcaaugacaucgcggccugccuccggaagaacggcaagaaagugauccagcuaucccgcaagaccuucgacagcgaguacgugaagacacgagccaacgacugggacuucgucgugaccaccgacauuucagaaaugggggccaacuuucgcgcggagcgcgugauagacccgcgccggugcaugaagcccguuauccucacugacggcgaggagagagugauccuugcggggcccaugccggucacgcauucuuccgccgcccaacggcguggccgcaucgggcggaacccuaagaaugagaacgaccaguauaucuacaugggagagccccucgagaacgacgaggacugcgcccacuggaaagaggccaagaugcuccuggacaacaucaacacccccgagggaauuaucccgagcauguucgagcccgagagagagaaggucgacgcgauagacggggaguauaggcugcggggcgaagcccggaagacguucguggaccucaugcgccgcggagaccugcccguguggcuggccuaccgcgucgccgcagaggggaucaacuacgcugaccggcguuggugcuuugacgggaucaagaacaaccagauauuagaggaaaacgucgagguggagauauggacgaaagagggggagcggaagaagcuaaagccuagauggcuggacgccagaaucuauuccgacccccucgcguuaaaggaguuuaaggaguucgccgcgggacguaaaucgcugacgcucaaccucaucaccgagauggggcggcucccaaccuuuaugacccagaaggcucgcgacgcccuugacaaccuggcaguccuccacacggccgaaguuggagggcgggcguacaaccacgcccucuccgagcugcccgagacccuggagacccuccugcugcucacccugcuggcgacggucaccgggggcaucuuccucuuccugaugucagggaagggcauagggaagaugacgcugggcaugugcugcaucaucacugccucaauccuccugugguacgcccagauccagccucacuggaucgccgccuccaucauccuggaguucuucuuaaucguccugcugauccccgagcccgaaaaacagcgcaccccccaggacaaccaacugacguacguggugauugccauccuaaccgugguggccgcuacuauggccaacgagaugggguuccuggaaaagacaaaaaaggacuugggccugggcuccaucacaacccaggagagcgaguccaacauccuggacaucgacuuacgcccggccuccgcauggacccuguacgccgucgccaccacguucgugacccccaugcuacgccacuccaucgaaaacuccagcgugaacgucucccucaccgccauugcgaaccaggccacggugcucaugggccugggccggggguggccccucagcaagauggauauaggugugcccuuguuagccaucggguguuacucccaggucaacccgaucacuuugaccgcggcccugcugcucuuagucgcccacuacgccauuaucgggcccggccugcaggcaaaggcgacgcgcgaggcccagaagcgcaccgccgccgggaucaugaagaaucccacgguggacggcaucaccgucaucgaccucgaaccgaucccguacgaccccaaguucgagaagcagcugggccagguaauguugcucgugcugugcgucacccaggugcugaugaugcggaccaccugggcccucugcgaggcacugacccuggcaaccggccccaucagcacccuaugggagggcaaccccgggcgcuucuggaacacaaccaucgccguuuccauggccaacauuuuucggggcuccuaccuggccggggcgggacucuuauuuuccaucaugaagaacaccaccaacacgcgccgggggaccggcaacaucggcgagacgcugggagagaaguggaaaucgcgccugaacgccuugggcaagucggaguuccagauauacaagaagucugggauccaagaggucgaccggacccuggccaaagagggcauuaaacggggagagacggaccaucacgccgugucccgggggucagcgaaacugcgcugguuuguggagcgaaacauggucaccccagaggguaaggugguagaccucggguguggccgcgguggcuggaguuacuacugcggaggacugaagaauguccgggagguuaagggccugacuaagggagggcccgggcacgaagaaccgauccccaugucuaccuacggcuggaaccuagugcgccuacaguccggggucgacguguucuucacuccgccagaaaagugcgacacacuccucugcgacaucggcgagaguagcccaaaccccaccaucgaggcuggccgaacacugagaguauugaaccucgucgagaacuggcucaacaacaacacccaguucugcgugaaagugcucaacccguacaugcccuccgucaucgagaagauggagacgcuccagagaaaguacgggggcgcacuggugcgcaaccccuugucccguaacuccacccacgagauguacugggugagcaacgccaccgggaauaucgucuccagcguaaacaugaucucccgaaugcuuauuaaccgcuucaccaugaagcacaagaaagcaacauaugagccggauguggaccugggcucggggacccggaauauugguaucgagaaugaaauccccaaucucgacaucaucggcaaacgcauugaaaaaaucaagcaagagcacgagaccuccuggcacuacgaccaggaccaucccuacaaaacgugggcauaccacgggagcuaugagacgaagcagaccggcuccgccagcucuauggucaacggggugguaaagcuucucaccaaacccugggacgucguuccaauggugacccagauggccaugaccgacaccacccccuucggccagcaacggguauucaaggagaagguugacacgagaacccaggaaccaaaagagggcacuaagaaauugaugcggauuacggccgaguggcuguggaaggagcucgguaagaagaaaacgccacgcaugugcacgcgagaagaguucacucgcaagguacggagcaacgccgcgcugggugccaucuucaccgacgagaacaaguggaaaucugcgcgcgaggcggucgaggauagccguuucugggagcuuguugacagggagcggaaccuacauuuagaggggaagugugagaccugcgucuacaacaugauggguaaacgcgagaagaagcugggggaguucgggaaagcgaagggcucccgggcgaucugguacaugugguuaggggcccgcuuccuugaguucgaggcccugggcuuucucaaugaggaccacugguucagccggggcaacucccugagcggaguggagggggagggacuacacaagcucggguacauauuacgcgacgugagcaagaaggagggcggggccauguacgcagaugacacggccgguugggacacccggaucacccuggaagaucuaaagaacgaggagauggucaccaaccacaugaaaggcgaacacaagaagcuugccgaggccaucuucaaacugacguaucaaaacaagguggugcgcguccagcggccgacgcccagagggaccgucauggacaucaucucccgaaaggaccagagaggcagcggccagguugggaccuacggccucaacacguuuaccaacauggaggcccagcugauacgccagauggagggggagggaaucuucaaauccauccagcggcugaccgucaccgaagagauagcggugcagaacuggcuugcccgcgugggccgggagcgcuugagucggauggccauuucuggcgacgacugugucgucaagccccuggacgaccgcuucgccagcgcccucacggcccugaacgacauggguaaggugcguaaggacauccaacagugggagccuucccgagguuggaacgacuggacccagguuccguuuugcucucaccacuuucacgagcuggugaugaaggacggccggaugcucguaguacccugccgcaaccaagacgagcugaucgggagggcccgcaucucacaaggggccggauggucucugaaagaaacugccugccuagggaaguccuaugcccagauguggaccuuaauguacuuccaccggcgagaccugcgguuagcggcaaacgcaauuugcagcgcggugccaucccacugggugcccaccagccguacgaccuggagcauccaugcgaagcacgaguggaugacgaccgaggacauguuggccguauggaaccggguguggauccaagagaacccauggauggaggacaagacgcccguugaaagcugggaggagguccccuaccugggcaagcgcgaggaccaauggugcggaucacucaucggccugacuagcagagccaccugggccaagaacauccagaccgccaucaaccaggugaggagccugaucgggaacgaggaguacacggacuacaugccuuccaugaagagauuucggaaggaggaggaggaggcgggcgugcuaugguga

SEQ ID NO: 25217 - RNA, 9876 nt, Artificial Sequence
  derived and/or modified CDS sequence (opt11) from DENV-2__EU596490__SS-prME
accgccggaguaauuauuaugcuuauccccacagucauggcguuccaccucacgacccgcaacggugagccccacaugaucguaggccggcaggagaaggggaagucccugcuguucaagaccgaagauggagucaauaugugcaccuuaauggcgaucgaccugggagaguugugcgaggauaccaucacauauaaaugcccccuccugcgccagaacgagcccgaggacaucgacugcuggugcaacucgaccagcaccuggguuaccuauggcaccugcaccaccacuggcgaacaccggagggaaaagcgguccguggcccugguuccccaugucgggaugggccucgagacccgaaccgagaccuggauguccagcgaaggggccuggaagcacguucagcggaucgagacguggauucugcgccauccuggcuucacuauuauggcagcaauccuggcguauaccaucgggaccacgcacuuccaacgggcccucaucuucauucugcugaccgcuguggcccccucgaugaccaugcgcuguaucggcaucuccaaccgggacuucguagagggggugagcgggggcucuuggguggacaucguccucgaacacgggagcugcguuaccacgauggcgaagaacaagcccacacuggauuucgagcugauaaagaccgaggcaaaacagccggcuacccuccgcaaguacugcauugaggccaagcugacuaacaccacuaccgaaagccggugcccgacacagggugaacccagccugaacgaggagcaggacaaacgcuucauuugcaagcacuccaugguggauagggguugggguaacggcugcgguuuauucggcaagggcgguaucgugaccugugccauguucacgugcaaaaagaacauggaggguaagguggugcuucccgaaaaucuggaauacaccauugugaucacgccccacucuggggaggagcaugcggucggcaacgacaccgggaagcacgggaaggagauaaagauaaccccgcaguccagcaucaccgaagccgaguuaacuggcuacgggacggugaccauggagugcucgccccgaacaggacuugauuuuaacgagaugguccugcuccagauggaagacaaggccuggcuagugcacagacagugguuucuggaccucccccugcccuggcugccaggagcggauacacagggcagcaacuggauacaaaaggaaacacuugugaccuucaagaauccgcacgccaagaaacaggacgucgugguccuggggagucaggaaggcgcgaugcacaccgcacugacaggggccacggagauccagaugagcagcggcaaccuccuguucaccggccauuugaagugcaggcuccguauggacaaacugcagcugaaggggauguccuacucaaugugcaccggcaaauucaagauagugaaagagauugccgaaacccagcacgggaccaucguaauccgcguccaguacgagggcgacggcucccccuguaaaaucccauucgagaucauggacuuggaaaagaggcacgugcucgggcgccugaucacagugaacccgauagucacggagaaggacucacccgugaacaucgaagccgagccgcccuucggagacuccuacaucauuaucgguguggagccgggccagcuuaagcugaauugguucaagaaggggagcucaaucggccagauguucgagaccacgaugcgcggcgcgaaacgcauggccauccucggggauaccgccugggauuucggcucccuggggggagucuucacuagcaucgggaaagcccuccaccagguguucggcgcgaucuacggugcggccuucucugggguguccuggaccaugaagauccugauuggcgucaucauaacguggaucggcaugaacucccgcuccaccagccuguccgugucacucguccuggucgguguggugacucuguaucucggggugauggugcaggccgacaccggcugcguggucaguuggaagaauaaagagcugaagugcggcagugggauauucauaacggacaacgugcacacuuggaccgagcaguacaaguuucagccggaauccccgagcaagcuggcaagcgcgauccagaaagcgcacgaggaggguaucugugggaucaggagugugaccaggcucgaaaauuugauguggaagcagaucacgccugaacugaaccacauccugagcgagaaugaggucaaacugaccauaaugaccggcgacauaaaggguauaaugcaggcgggcaagcggaguuugcgcccccagccgaccgagcucaaguacucauggaaaacguggggcaaggccaagaugcuguccacagagagccauaaccaaaccuuccucauagacgggcccgagaccgcugagugcccgaauacgaaucgggcguggaauucccucgagguggaggauuacggcuucgggguguucucaaccaacaucugguugaagcugagagagaagcaagacgucuucugcgacuccaaacucaugagugccgcgaucaaggacaaccgcgccgugcacgccgacaugggcuacuggaucgaguccgcgcugaacgacaccuggaagauggagaaggccagcuucaucgagauuaaguccugccacuggccaaagucccacacccugugguccaauggcgugcuagagucggagaugaucauacccaagaacuucgccggccccgucucccagcauaacuaccggccgggcuaccacacccagacugcagggccauggcaccugggcaagcuggagauggacuucgauuucugcgagggaacaaccgugguagucaccgaggauugcgguaacaggggccccagccuccgcacgacaaccgcaagcgguaagcugauaaccgaguggugcugcagguccugcacgcugccgccgcucagguaccggggcgaagacggguguugguacgggauggagauccgcccccugaaagagaaggaggagaaccucguaaauucgcucguuaccgcggggcacggccagaucgacaacuucucccuggggguccugggcauggcacucuucuuggaggaaaugcugcggaccagagugggcaccaagcacgccauccucuuaguggccgucagcuucguuacucugauuaccgguaacauguccuuucgggaccucggccgagugaugguaauggugggggcgacgaugaccgacgauaucggcaugggcgugacguauuuggcccugcucgccgcuuucaagguccgccccacauucgcggccggccugcugcuccggaagcugaccucgaaggagcugaugauggcgaccauaggcaucgcccuccugucccagagcacgauccccgagaccauccuggagcucaccgacgcgcuagcccugggaaugauggugcucaagaucgugcgcaacauggaaaaguaccaacuugcuguuacgauuauggccaucuccugugugccgaacgccgugauccugcaaaacgcauggaaagucagcugcacgauccucgcagcggugucugucagccccuuacuccuaaccuccagccaacagaaggccgacuggaucccacuggcgcuuaccaucaagggccucaaccccacggccaucuuccugacgacccugagccguaccuccaaaaagcgauccuggcccuuaaacgaagcggugauggccgugggaauggucucuauccuugccuccucgcuacucaagaaugacauacccaugaccgggccucuggucgccggcggguuacucacggugugcuacguccugaccgggcggagcgccgaccuggagcuagagcgagccgccgacgugaaaugggaagaccaggccgagaucagugggucauccccaauccugagcaucacaaucucagaggacggcaguauguccaucaagaacgaggaggaggaacauaccuugacgauccuuauccggacgggccugcuggugauuagcggggucuucccggucuccauaccaaucaccgcagccgcgugguaucucugggaggugaagaagcagcgcgccggcgucuugugggacguuccaucgccgccucccguggggaaggccgaacuagaggacggagccuaucggaucaagcagcgcgggaucuuuggcuacucccagaucggagccggggucuacaaggagggcaccuuccacaccauguggcaugugacgcguggggcggugcucaugcaccgcggcaagcggaucgagccuagcugggccgacguuaagaaggaccugaucuccuacgggggcggcuggaagcuggagggggaguggaaggagggggaggagguccaaguccucgcccuggagcccggcaagaacccucgggccguccagaccaagcccggccuuuucaagacgaacaccgggacaaucggggccgugucccucgacuucuccccgggcaccagcgggagucccaucguugaccggaaaggcaaagugguggggcuguacggcaacggggucgucacacgcucaggggcguacguguccgccaucgcccaaacggagaagaguaucgaggauaaucccgaaaucgaggacgacaucuuccggaagaaacgccugacuaucauggacuuacaccccggcgcagggaagaccaagcgguaccugccagcgaucguccgcgaagccaucaagaggggccugcgcacacugauccuggccccuacccgcgucguggccgcggaaauggaggaggcgcugcgggggcugccaauacgcuaccagacgcccgccauccgggccgagcacacgggcagggagaucguugaccucaugugccaugccacuuucaccaugagacugcugagccccguccgcgugccgaacuauaaccuuaucaucauggacgaggcccacuuuacggacccggcguccaucgcagcccggggcuacaucucaacucgcguagaaaugggggaggcagccggcaucuucaugaccgcgacgccccccgggucccgggacccauucccccagagcaacgccccgaucauggacgaagagcgcgagauccccgagcgcuccuggaacagcggccaugagugggucacggauuucaaagggaaaaccgugugguucguaccaaguaucaaggcuggcaacgacaucgccgcgugccugaggaagaacgggaagaaggucauccaguugagccggaaaaccuuugacuccgaguacgugaagacacgugcgaacgacugggacuucguggucacgaccgacaucagcgagaugggcgcaaacuuccgggcagagcgcgugaucgacccccggaggugcaugaagcccgugauauuaacggacggcgaggagcgggucaucuuggccgggcccaugccggugacccacuccucugccgcccagcgccgcggccggaucgggagaaaccccaagaacgagaacgaucaguauaucuacaugggcgagcccuuagaaaacgacgaggacugugcccacuggaaggaagccaagaugcuccuggauaauaucaacacgcccgagggcaucaucccgagcauguucgagcccgaacgggagaaggucgaugccaucgauggggaguaccgucugcguggggaggcgcgcaagaccuuugucgaucucaugcggcgaggggacuuacccguguggcuggccuaccgcguggccgccgagggaaucaacuacgcugaccgucggugguguuucgaugggaucaaaaacaaccagaucuuagaagagaacgucgagguggaaauauggaccaaggaaggcgagcggaaaaagcugaagccgcgguggcuggacgcgcgaaucuauuccgauccccucgcacuaaaggaguucaaggaguuugccgccggccggaagucacugacauugaaccuuauaacugagaugggccgccuacccaccuucaugacccagaaggcgcgggacgcccucgacaaccuggccguccugcacaccgccgaggucggcggccgcgccuacaaccacgcguuaagcgagcugcccgagacgcuggagacccuccugcugcugacccugcuugccacggugacgggcggcaucuuccucuuucuaauguccgggaagggcaucgggaagaugacccuaggcaugugcugcaucaucacagccucuauccuccugugguacgcucagauacagccccacuggauugccgcguccauuauccuggaauucuuccucaucguuuugcugauacccgagcccgagaagcagcggacaccccaggacaaccagcucaccuacguggugaucgccauccugacggucguggccgccaccauggcgaacgagaugggguuucuggagaagaccaagaaagaccucggcuuaggcagcaucaccacgcaagagagcgaguccaacauucuggacauagaccuacgcccggcgagugccuggacacucuacgcgguggcuacgaccuucgucacgccaaugcugcggcacuccaucgaaaacaguuccgugaacgugagccucaccgccaucgcgaaccaggccacgguauuaauggggcugggacgcggcuggccucucuccaagauggacgugggcguuccccugcuggcgauagggugcuacagccaagugaacccgauaacgcucacggccgcgcugcugcuccugguugcccacuacgccauuaucggucccggguugcaggccaaggccacucgggaagcgcagaagcggaccgccgccgggauaaugaagaauccgacuguggacggcaucacgguaaucgaccucgagcccaucccguacgaucccaaauucgagaaacagcugggccaggugaugcuucuagugcugugcguuacccaggugcucaugaugagaacuaccugggcccucugcgaggcccuuacgcuggcuaccggccccauuuccacccuuugggaggggaaccccggcagauucuggaacacaacgaucgccgugucuauggcuaacauauuccgcggcuccuauuuagccggggcugggcuccucuuuagcauaaugaagaacaccacuaacacccgacgggggacgggcaacaucggggaaacuuugggggagaaauggaagucccggcugaacgcucugggaaagucggaauuccaaaucuacaagaaguccgggauccaggaggucgaccgcacccuggccaaggaaggcauaaagcgaggugagaccgaucaccacgccgugucccgcggguccgcaaagcugcguugguucgucgagcgaaauauggucaccccggagggcaaggucguagaccucgggugcggccgcggcggauggagcuacuacugcggcggccugaaaaacguccgggaagugaaggggcugaccaagggcgguccaggucacgaggagcccauaccgauguccaccuacggguggaaccucgugcgguuacagagcggggucgaugucuucuucacuccgcccgagaagugcgacacgcuccucugugacaucggcgagucaucaccgaaccccaccauagaagcggggcgcacuuugcgggugcugaaccuuguugaaaacuggcugaacaacaacacccaguucugugugaaggugcugaacccguacaugcccuccgucaucgagaaaauggagacccuccagcgcaaauacgggggagcccuagugcggaacccccuguccaggaacagcacgcaugagauguacuggguguccaacgccaccggaaacaucgucucuuccgugaacaugaucagccgcauguugaucaacagguucaccaugaagcacaagaaggccacauacgagccggacguggaccuuggcuccgggacgcgcaacauaggcaucgaaaacgaaauucccaaccuagacaucaucggcaagcggaucgagaaaaucaaacaggagcacgagaccagcuggcauuacgaccaggaccaccccuauaagacuugggccuaccaugggucauacgagaccaagcagacgggcagcgcuagcagcauggugaauggggugguaaaguuacucacgaagccaugggacgucgugccgauggugacccagauggccaugaccgauacaacccccuucggucagcagcgcgucuucaaggagaaaguggacacccggacacaggagcccaaggaggguacgaagaagcugaugcgcaucaccgccgaaugguuguggaaggaacucgggaagaagaagacgccccggauguguacgcgugaggaauuuacgcggaaaguccgcucuaacgcggcccugggcgcgauuuucaccgacgagaacaaguggaaguccgccagagaagcaguggaggacucccgcuucugggagcugguggaucgggagcggaaccuccaccuggaggggaagugugaaaccugcgucuacaacaugaugggcaagagggagaagaagcucggggaguucggcaaggccaagggcagcagggccaucugguacaugugguuaggggcgcgauuccuggaguucgaagcccuaggguuccucaacgaagaccacugguucucccgcggcaauagccugagcggcguggagggagagggccuccacaagcugggguacauccugcgggauguguccaagaaggaggggggggccauguacgcugacgacacggcggggugggacacgcggaucacguuggaggaccucaagaacgaggagauggucaccaaccacaugaagggcgagcauaagaagcucgcagaggccauuuucaagcugaccuaccaaaauaaaguagugcggguccagagaccuacaccccggggaaccgugauggauaucauaagccggaaggaccaacgcggcuccggccagguggggaccuacggacucaacaccuuuacgaacauggaggcacaacugauccgacagauggaaggggagggaaucuucaagagcauccaacgucugaccgucaccgaggagauugccgugcaaaacuggcucgcaagaguaggccgcgagaggcugucccgcauggcgaucagcggggacgacugugucguaaaaccacuggacgaccgguucgccuccgcgcucacagcccugaacgacaugggcaaggugcgcaaggacauccagcagugggagcccagccggggguggaacgacuggacgcaaguaccguucugcucccaucacuuccacgagcuggugaugaaggacggcagagugcucgucgugccaugccggaaucaggacgagcugaucggccgcgcgcggaucagccaaggugccggcuggucccugaaggagacagcuugcuuaggcaaaagcuacgcccagauguggacacugauguauuuucaccgccgggaccuacgccucgccgcgaacgcuauuugcucagcaguaccaucccacugggucccgaccuccaggaccacguggagcauccacgccaagcacgaguggaugaccaccgaggauaugcuggccguguggaaccgcguguggauccaggaaaacccauggauggaggacaagacgcccgucgaguccugggaggaagugcccuaccugggcaagcgcgaggaucaguggugcgggagccucaucggccugaccagccgggcgacaugggccaagaacauccagaccgcgaucaaccaggugcgcucgcugaucgggaacgaagaguauaccgacuacaugcccagcaugaagcgguuccgcaaggaagaggaggaggccgggguccucugguga

SEQ ID NO: 25218 - RNA, 9876 nt, Artificial Sequence
  derived and/or modified CDS sequence (opt11) from DENV-2__EU596491__SS-prME
accgcgggugugauaaucaugcucaucccaaccgugauggcauuccaccucaccacuagaaacggggagccccacaugaucgucgggcggcaggagaaagggaagucccugcuuuuuaagaccgaggacggugugaacaugugcacccucauggcaaucgacuugggcgagcugugcgaagauaccaucacauacaagugcccccucuuacgccagaacgagcccgaggauauagauugcuggugcaacagcacauccaccuggguuacauacgggaccugcaccacaacgggggagcaccgacgcgagaaacgguccguugcccuaguuccccacgucgggauggggcuggagacucggacggagacauggauguccagugagggggccuggaagcacgugcagcggauugagaccuggauccugcggcacccgggcuucaccaucauggcagccauccuagccuauaccaucgggaccacgcauuuccaacgggcgcuaauuuuuauccugcugaccgcaguggcccccagcaugaccaugaggugcaucggcaucuccaaccgugacuucguagaaggcgucagcggaggcucauggguggauauagugcuggagcacgguaguugcgugaccacuauggcgaagaacaagcccacgcuggauuucgagcugaucaagacugaggcgaagcaacccgcgacccuccgcaaguacuguaucgaggccaaguugacgaauaccaccaccgaguccagauguccgacgcagggugagcccagccugaacgaagaacaggacaagagguucaucugcaaacacaguaugguggaucggggcugggggaacggcugugggcuguucggcaaagguggcauuguaaccugcgcgauguucacgugcaagaagaauauggaggguaagauugugcagcccgaaaaccuggaguauaccaucgugaucacgccccacagcggggaagaacacgcuguaggcaacgauaccgguaaacauggcaaagaaaucaagaucaccccgcaauccagcaccacggaggccgaguugacuggauauggcacagugaccauggagugcucaccacgaaccggcuuggauuucaacgagaugguucugcugcaaauggaagacaaagccuggcucguccaucggcagugguuuuuggaccugccacucccuugguuaccgggcgccgacacgcaagggucaaacuggauccagaaggaaacccucguuaccuucaagaauccccacgccaagaaacaggacguugucgugcucgggucccaagagggugcuaugcauacggcccugacgggggcgaccgaaauccagaugagcucaggcaaccuucuguucaccggccaccugaaaugucgccugaggauggacaagcuccagcugaagggaaugucuuacucuaugugcaccggaaaguuuaagaucgucaaggaaauagccgaaacgcagcaugguacgaucgugauccgcgugcaauacgaaggcgauggcucccccugcaagauccccuucgagaucaccgaccuggaaaagagacacgugcucgggaggcugauuaccguuaauccuaucgucacagaaaaggacgcccccgucaauaucgaggccgagccgccguucggugacagcuacauuaucguggggguggaaccgggucaauugaaacuuaauugguucaagaaagggucgagcaucggccagauguucgagaccacgaugcgcggcgcuaaacggauggccauucugggggacaccgcaugggacuuuggcucccucggcggagucuucaccuccaucggaaaggcacuccaccaagucuucggagcgaucuacggcgccgccuucucagggguuagcuggacgaugaaaauccugaucggcguuaucauaaccuggaucgggaugaacucgcguucuacaucccugagcgugucccuggugcuagucggcguggugacgcuguaucugggggccgugguucaagcggacucugguugcgucgugucguggaagaauaaggagcucaaaugcggcagcgggauauucaucacggacaacgugcacaccuggaccgagcaguauaaguuccagcccgagucccccucaaagcuggccucggccauacaaaaagcccacgaagagggcaucugcggaauuaggucaguaaccaggcuggagaacuuaauguggaagcaaaucacuccagaacugaaccacauccugagcgagaacgaggucaagcucaccaucaugaccggcgacaucaaggggauaaugcaggccggaaagcggagccugcgcccucagccaacggaacugaaguacucuuggaaaaccuggggcaaggccaagaugcucuccacggagagccauaaccagacguuccuuaucgaugggcccgagacugcggagugcccuaacaccaaucgggcauggaacucccuagagguggaagacuacggcuuugggguguuuaccacuaauauauggcuuaagcugcgcgagaagcaggaugucuucugcgauagcaagcugauguccgcggccaucaaggauaaccgggcagugcacgccgacaugggcuacuggaucgagucugcacuuaaugacacauggaagauggagaaggccucguucauagaggucaagagcugccacuggccaaaaucccacacccuguggagcaacggcguacuagagagcgaaaugaucauacccaagaacuuugcggggccggugagccaacauaauuaucgcccagguuaccacacccagacggcaggacccuggcaccugggcaagcuggagauggacuucgacuucugcgaaggaaccacgguaguagugacagaggacugcggcaaccggggaccgucccuccgcaccacaaccgcgagcgggaaacuuauaaccgaguggugcugccggaguugcaccuugcccccgcugcgcuauagaggcgaggauggcugcugguacgggauggagauucgcccacucaaggagaaggaagagaaccuagugaacucccuggucaccgcgggucacggucagaucgauaacuucucccugggcguccuggggauggcccuguuccucgaagagauguugcggacacgggugggcaccaagcaugcgacccugcucgucgcccuaucauuugugacucugauaacgggaaacaugucguuccgggauuugggucgagugauggucauggugggggcaacaaugacugacgauaucgggaugggcguaacguaccuggcccuguuagccgcauuuaaaguccgccccacguuugccgccggccuguuacuccgcaaacuuaccuccaaagagcuuaugauggcgaccauuggcaucgcccuccugagccaguccacccugccggagacgauucuagagcuaaccgacgcgcuugcccucgggaugaugguucugaagauugugcgcaacauggaaaaauaucaacuggcuguaaccaucauggccauuagcugcguuccgaacgccguuauccuacagaaugccuggaaagucagcugcacuauuuuagccgccgugagcgugucgccacuucuccuaaccagcucacagcagaaggcugacuggauuccgcuggcgcucaccaucaaggggcugaaccccaccgcaauuuuccugaccacgcucagccguaccuccaagaagcgcucauggccgcugaacgaggcuaucauggccgugggaauggucuccaucuuggcaaguucccucuugaaaaacgauauuccgaugaccgggccgcucgucgcuggcgggcuccuaaccgugugcuacguguuaacggggcggucagcggaccucgaacuggagcgcgccgccgacgucaagugggaggaccaggccgagaucuccgggaguagccccauccuauccauuaccaucagcgaggacggaucuaugucgauuaaaaacgaagaggaagaacagacccucaccaucuugaucagaaccggcuugcucgucauuuccgggguuuucccggucaguaucccuauaacagcggcggccugguaccuaugggagguuaagaaacaacgcgccggcguucuuugggacguccccuccccaccgccuguagggaaagccgagcucgaggauggagcguaccgaaucaagcagagggggauucuuggcuacucacagaucggcgccgggguguacaaggagggcaccuuccacaccauguggcacgucacccggggugcggugcugaugcacaggggcaagaggaucgagccaucaugggccgacguuaaaaaggaccuaauaucuuacgggggcggguggaagcuggagggugaguggaaggagggcgaggagguccaaguauuggcucucgagccuggcaagaacccacgcgcaguucagacaaagcccggcaucuucaaaaccaacaccggaacaaucggcgccgucucccuagauuucagcccaggcacguccgggagccccaucguagaccgcaagggaaaagucgucgggcucuacggaaacggcguggugaccagaagcggggcuuacgucucggccauugcgcagaccgagaaguccaucgaagacaaccccgaaauagaggaugacaucuuccggaagaagcgccucaccaucauggacuuacaccccggcgcgggaaaaacgaagcgcuacuuacccgccaucgugcgcgaggcuaucaagcguggucuccgaacccugauccuggccccgacacgcgugguugcggccgaaauggaggaggccuugagaggacucccaaucagauaccagaccccagcgauccgggccgagcacacgggacgcgagaucguggaccugaugugccaugcgaccuucaccaugcgacugcucagccccguucgcguucccaacuauaaccugaucauaauggacgaggcacacuucaccgaccccgcgagcaucgccgcacgaggauacaucuccacccgcguggaaaugggugaggcagcuggcaucuucaugaccgccacgccgccggggagccgggacccguucccucaguccaaugcgcccauuauagacgaggagcgcgagauccccgaacggucuuggaacucaggccacgagugggugaccgacuucaaggggaagacgguuugguucguuccuagcaucaaggcgggcaacgacaucgcugcuugucugcgcaagaacgggaaaaagguuauccagcucucccggaagaccuucgacagcgaguacgucaaaacgcgcgccaacgacugggacuuugucguaaccacggauaucagugaaaugggagcuaacuucaaggcagaacgggucaucgacccgcggcggugcaugaagccggugauccuaaccgauggcgaggagcgugugauccuggccgggccuaugccggucacccacucuucagccgcccagcggcgcgggcgcauugggcggaaccccaagaaugagaaugaccaguacaucuacaugggagagccacucgagaaugaugaagacugcgcgcauuggaaggaggcgaagaugcuguuggacaauaucaauaccccggaggggauaauuccgagcauguucgagcccgagagggaaaagguggacgccguggacggggaguaccggcugcgcggggaggcacguaagacauucguagaccugaugcgccgcggagaucugccuguguggcucgccuacaagguggcagcggagggcaucaauuacgccgaccgcaaguggugcuucgacgggauaaagaacaaucaaauccuugaggaaaacgucgagguagagaucuggacuaaggagggcgagcggaagaaacugaaaccacgcuggcucgacgcucggauuuacuccgacccgcuggccuugaaagaguucaaagaguucgcggccggucgcaagagccucacgcuuaauuugaucaccgagaugggccgguuacccaccuucaugacccaaaaggcccgaaaugcacuggacaauuuggcgguccuccacaccgcggaggucggugggagggcccauaaccacgcgcugagcgaguuaccugagacccucgagacucugcugcuccucacuuuacucgccaccgugaccggcgggaucuucuuauuccuaaugagcgggaagggaaucggaaagaugacccucggcaugugcuguauuauaacggcguccauuuuacugugguaugcgcaaauucagccgcacuggaucgcagccagcaucauccucgaguucuuucuuauuguccugcucauuccggagcccgaaaagcagcgcacgccgcaagacaaccaacugaccuauguuguuaucgcaauacugaccguaguagccgcuacgauggcaaacgagaugggguuucucgagaaaaccaagaaggaccucggcuucggaucuauuacaacacaggaguccgaaaguaacauucuggacaucgacuugcggcccgccuccgccuggacgcuguacgccguggccaccacauucgugacccccaugcugagacacaguaucgagaacuccagcgucaaugugucgcucacggcaauagcaaaccaggcgaccguucugauggguuuagggaaaggcuggccccucagcaagauggacauaggggugccccuccuggcgaucgggugcuauucucaggugaacccgauaacccucaccgcagcccugcugcuucuggucgcccauuacgccaucaucggucccgggcugcaagcgaaggccacccgggaggcccagaagcgcgccgccgcggggauuaugaagaauccuaccguggacgguaucacagugauagaccucgagcccaucccguacgaccccaaguucgaaaagcagcuggggcaggucaugcuauugauccugugcgucacccaggugcugaugaugcggacgaccugggcacucugugaggccuugaccuuagcaacaggucccaucagcacgcucugggagggaaaccccggccgguucuggaacacuaccauagcggucagcauggccaacaucuuccgcggcagcuaucuugccggugcaggguuacuguuuuccauaaugaagaauaccacaaacacacggcgcgggaccggcaacgugggcgagaccuuaggggagaaguggaagucccggcugaaugcgcuaggcaaguccgaauuucagauauacaagaaguccgggauccaggagguggauagaacucuggcgaaagagggcaucaagcgcggagagacugaccaccacgcggugucccgggguagcgcaaaguuacggugguucguggagcgcaacaugguuaccccggaaggaaaggucguggaccuagguugcgggcggggcggguggucauacuauugcggcggacugaagaauguccgcgaggugaagggucugaccaagggcggccccgggcacgaggagccaauccccaugaguacauacggcuggaaucucgugcggcuacaguccgggguagauguuuucuucaccccgccggaaaagugcgacacccugcuuugcgauaucggugagagcagucccaaccccacuaucgaggccggccgcacgcugcggguccugaaccuaguugagaacuggcuaaacaacaauacacaguucugcauuaagguccucaacccguauaugcccagugugaucgagaagauggagacccuccagcguaaguacggaggcgcgcuggugcguaacccacucucaagaaacucuacccacgagauguacugggugagcaacgccaccgggaacaucgugucgagcgugaacaugaucuccagaaugcugauaaaccgcuucacgaugaagcauaagaaggcuacuuacgagccagacgucgacuuggggagcgggacuagaaacauuggcaucgaauccgagauccccaaucuggacaucaucggcaagcgcaucgagaagaucaaacaggaacacgagaccagcuggcacuaugaccaggaucacccguacaagacgugggccuaucaugggucuuacgagacgaagcagacgggcagcgccuccucaauggugaacggagucguccgacugcucacaaagcccugggauguggugccgaugguaacccagauggcaaugacggacacuaccccuuucggucaacagcggguguucaaggagaagguggacacgcgcacucaggagcccaaggaaggaaccaagaaguugaugaagaucaccgcugaauggcuguggaaagagcuugggaagaagaaaacaccccggaugugcacuagggaggaguucacccggaagguccgcuccaacgcggcccugggagccaucuucaccgacgaaaauaaauggaaaucagcccgggaggcgguugaagauggccgcuucugggagcuggucgaccgggaacggaaccuccaccuggagggcaaaugcgagacauguguguacaauaugaugggaaagcgggagaaaaaguuaggagaguucgguaaggccaaaggaucccgggcuaucugguauauguggcucggcgcacguuuucuggaguucgaggcgcugggguucuugaacgaggaccacugguuuagccgcggcaacucccuaagcgggguggagggcgagggauugcaccgacuaggguacauccucagggaagucggcaagaaggaagguggugccauguacgccgacgacaccgcugggugggauacccggaucacccuggaggaccuuaagaacgaggagauggugacgaaccacaugaagggagagcauaagaaacuggcggaggcgauauucaagcugaccuaccagaacaagguggugcgcguucaacggccgacgccccggggcacgguaauggauaucauaucaaggaaggaccagcgcgguagcggccaggucgggaccuacggcuugaacacuuucaccaauauggaggcccagcuaauccgacaaauggagggcgaggggaucuucaagagcauucaacaccugaccgccacggaggaaauugccgugcagaacuggcucgcccgggugggucgcgagcggcucucccgcauggcgaucagcggggaugacugcgucguaaagccuaucgacgaccguuuugccucggcccugacggccuuaaacgacaugggcaaagugcguaaggacauccagcagugggaaccaagcagagguuggaacgacuggacccagguuccauucugcucccaucauuuccacgagcuggugaugaaagacggcagggugcugguggugcccugccggaaucaggaugagcucaucggacgagcacggaucagccagggcgcgggcuggucgcuaaaggagaccgcuugccugggcaagagcuacgcccaaauguggaccuuaauguauuuucaccgccgggaucugcgccuagccgccaacgcaaucugcuccgcgguacccagccacugggucccaacuucccggaccaccuggucuauccacgccaaacacgaguggaugacgacggaggacauguuggccguguggaaccgcgucuggauccaggagaauccauggauggaagacaaaacgcccguggaauccugggaggaggugccauaucuggguaagcgcgaggaccaguggugcgguagccucaucggccucacgagccgcgcgacgugggcgaagaacauccagacggcuauuaaucaagugcggucgcugaucggcaacgaggaauauaccgauuauaugcccaguaugaagcgcuuccgcagggaggaggaggaggccgggguucugugguga

SEQ ID NO: 25219 - RNA, 9876 nt, Artificial Sequence
  derived and/or modified CDS sequence (opt11) from DENV-2__EU677141__SS-prME
acagccggugugaucauuaugcugauccccaccgccauggcguuccaucucacuacccgaaacggggagccccauaugaucgugggccgucaggagaaggggaagucccuucuguucaagaccgaggacggcguuaacaugugcacacuuauggccaucgaccugggcgagcugugugaagacaccaucacguauaagugcccgcuccugcgccaaaacgagcccgaggacauugacugcuggugcaauagcaccagcaccuggguuaccuaugggaccugcaccaccacaggggaacaccggagagagaaacggagcgucgcccuggugccccacguggggaugggcuuagagacccguacagaaaccuggaugagcagcgagggggcauggaagcacguacagcgcaucgagacuuggauccugcgccacccgggguucacaaucauggcagcgauccuugccuacaccaucggaacaacccacuuccagcgggcccucaucuucauccuacucacagccguggccccaucuaugacuaugcgcugcaucggaaucuccaaucgggacuucguggagggcgucagcggaggcuccuggguggacaucguguuagagcacgggagcugcgugaccacaauggccaagaauaagccuacccuugacuucgaacugaucaagacugaggccaagcagccggcgaccuugcgcaaguauuguaucgaagccaagcugacaaauaccaccacugagucgaggugcccuacccagggcgagcccucuuugaacgaggaacaggacaaacgauucauuugcaagcacuccaugguggacagagguuggggaaacggcugcggacuauuuggaaagggagguauuguaaccugcgcuauguucacguguaaaaagaacauggaagguaagguggugcugccugagaaccuggaauacacuaucgugauaacgccucauagcggggaagagcacgcugucggaaacgacacagggaagcauggcaaggaaaucaaaauaacgccgcaguccaguaucaccgaggccgaguugaccggguacggcacggugaccauggaaugcucuccccgcaccgggcuggacuucaacgagaugguccuucuccaaauggaggacaaggccugguuaguccaccggcagugguuucuggaccuccccuuacccuggcugcccggggcagacacccagggcagcaacuggauccaaaaagaaacgcucgugaccuucaagaauccccacgcgaagaagcaggauguggugguccuggggucccaggagggcgccaugcacacugcccugaccggagcaacagagauacaaaugagcagcgguaaucuccuguucaccgggcaccuaaagugccgacuucggauggacaagcugcagcugaaggggauguccuacuccauguguaccggcaaguucaagaucgucaaggagaucgcugagacccaacacgggacuauagugauuagagugcaguacgagggcgacggcaguccgugcaagauucccuucgagaucauggaccucgagaaaagguacgugcuuggccgccuaauuaccgugaauccuaucgugaccggcaaggacucucccgucaacauugaagcggagccgcccuucggugacuccuacaucaucauagguguggagccuggucagcucaaguuaaacugguucaagaagggcagcuccaucgggcagauguuugagaccacuaugcgcggggccaagcggauggccauccuuggcgacaccgcuugggacuucggcagccugggggguguuuuuacgucgaucggcaaagcgcugcaccagguauucggugcgauauacggagccgccuuuagcggcguguccuggaccaugaagauccugaucggcgugaucauuacguggauaggcaugaacagucgcaguacaagccugagcgucagccuugugcugguggggguagugacucuguaccucggcgugaugguccaggcugacucgggcugcguggugagcuggaagaacaaggaacuaaagugcggguccggcaucuucauaacagacaacguccauacuuggacagaacaguacaaguuccagccagagaguccaagcaagcuggcguccgccauacagaaggcacacgaggaggggaucugcgguauccggagcguuacccgccucgagaaccugauguggaagcagaucacacccgagcugaaccacauacucuccgagaacgaggugaagcugacaaucaugaccggagauauaaaggguaucaugcaggccggcaagcggucguugcgcccucagccaaccgagcugaaauacagcuggaagaccugggggaaggccaagaugcugaguaccgaaucccacaaccagacauuccugaucgacgggccagagacagcggaguguccaaacaccaacagggccuggaauucccuagaggucgaggacuacggguucgguguguucuccacgaacaucuggcugaaguugcgcgagaaacaggacguauucugcgauagcaagcucaugagcgcugccaucaaggacaaucgggccguacacgcggacaugggguauuggaucgagagcgcccugaacgacaccuggaagauggaaaaggccuccuucaucgaggucaagagcugucauuggccaaagucccacacccucuggagcaacggcgugcucgagagcgagaugaucauccccaagaacuucgccggcccagucagccagcauaacuaucgcccgggguaccacacccagacagccggcccuuggcaccuggggaaacuagaaauggacuucgauuucugcgagggcaccacggucguggucaccgaggauugcggcaaucgggggcccagccuccggacgacgaccgcguccgguaagcugauaaccgaguggugcugucggagcugcaccuuacccccccuccgcuaucgcggagaggacggcuguugguacggcauggagauccgcccccugaaggagaaagaggagaaccucguaaacucgcucgugacggccgggcacggucaaaucgacaacuuuagccuggggguccuggggauggcgcucuuccuggaagagaugcugcggacccgcguggggaccaagcacgccauuuuacuggucgcggucuccuuugucacgcucauuacgggcaacaugagcuuccgggauuuggggcgcgugauggucauggugggcgcaaccaugaccgaugacaucggcaugggggugacuuacuuagcccugcucgccgccuucaagguccgucccacguucgcggccgggcuacuccuccguaagcugacuaguaaggaguugaugauggccaccaucggaaucgccuugcuaagccagucaaccauccccgagacuauacuggaguugacggacgcccuggcgcugggaaugauggugcucaaaaucgugcggaacauggagaaguaccaguuggccguuaccaucauggccauacugugcgugccaaacgccguaauccuccagaaugcuuggaaggucaguuguaccauacuggcugcggugucaguuagcccauuacuccugacaagcagccagcagaaagccgacuggaucccccuggcccucacaauuaagggacugaaucccaccgcgaucuuccugaccacgcuuucccggaccaguaagaagcgcuccuggccgcugaacgaggccgugauggccguaggaauggucagcauacuggcaucaucucuccugaagaaugacaucccgaugacaggcccccugguagccgguggccuccuaaccgugugcuacguccucaccgggcggagcgcggaucucgagcuggagagggcggcugacguaaagugggaagaucaggcugaaaucaguggaucaucccccauccugaguaucaccaucagugaggacggcagcauguccaucaagaacgaggaggaggagcagacccucacuaucuuaauccggacggggcugcucgugauaaguggcguauucccgguuuccauaccaauaaccgccgcggcuugguaccugugggaggucaaaaagcagcgcgccggaguccuaugggacguucccucuccgccaccagugggcaaggccgagcucgaggauggagccuaucggauaaagcagcgcggcaucuucggcuauucccagaucggggcgggcguuuacaaagaggggaccuuccacaccauguggcacgugacgcggggugccgugcugaugcaccgcggaaagcggaucgagcccagcugggccgaugucaagaaggaccuuaucuccuacggcgggggguggaagcucgagggcgaauggaaggagggugaagagguccaaguguuggcccuggagccaggcaagaacccccgcgccguccagacaaagccaggccuuuucaagaccaacaccggaaccaucggagcggugagccuggacuucuccccggguacgagcggcucccccaucguggaccggaagggcaagguugugggccuguacggcaacggggucgucacccgaagcggagccuauguaagcgcgauagcccagacugagaaguccaucgaggacaaucccgaaauugaagaugacauauuccguaaaaagcgccuaaccaucauggaccugcaucccggggcugguaagacgaagcguuaccugccugccaucguucgugaggccaucaagcgugggcugcgcacgcucauccucgccccgacacgugucguugccgcugagauggaagaggcucuucgcggcuuacccauccgcuaucagacaccggcgauccgggccgagcacacgggcagggagaucguggaccugaugugucacgccacuuucaccaugcggcugcucucgccgguccgcgugccgaacuacaaccugaucauuauggacgaggcgcacuucaccgaccccgccuccaucgccgcccggggguacaucagcacucgcguggagaugggcgaagcggcggggaucuucaugaccgcgacaccgcccggcucuagggauccguuuccgcagagcaacgcaccuaucauggacgaggagcgcgaaaucccugagagauccuggaacagcggacaugaaugggucaccgacuucaagggcaagaccgugugguuuguaccguccauaaaagccggcaacgacaucgcggccugccugcgcaagaacgggaaaaaggucauccaguuaagccggaagaccuucgacucugaauacgugaagacccgcgccaacgacugggacuucguggucacgacagacaucagcgagaugggcgccaacuuccgggccgagcgcgugaucgacccgcggcggugcaugaagcccgugauccuuaccgacggggaggagcggguaauccuggcgggcccgaugccggugacccacuccagcgccgcucagcgccgcgggcggaucggccgcaacccuaagaacgagaaugaucaguacaucuacaugggggagccccuagagaacgacgaggauugcgcccacuggaaggaggccaagaugcugcuugacaacaucaacaccccugaggggauaaucccguccauguuugaaccagagcgggaaaagguggacgccauugacggcgaguaccgccucaggggcgaggcacgcaaaacguuugucgaccucaugaggcgcggagaccugcccguguggcucgccuauagaguggccgcagaggggaucaacuaugcugaucgucggugguguuucgauggcaucaagaacaaccagauacuggaggagaacgucgaaguggagauauggacgaaggagggcgagcgcaagaagcugaaaccgcgguggcucgacgcccgcauuuacagcgacccacuggcccugaaagaguuuaaagaguucgccgcggggcggaagucccucaccuuaaacuuaauaaccgagaugggcaggcucccaacauucaugacucagaaagccagagacgcucuggauaaucuggccguccuccauaccgccgaggucggggggagagcuuacaaucacgcccugagcgagcugccggagacccuggaaacgcugcugcuacugacccugcucgcgaccgugacgggcgggaucuuuuuguuucugauguccgggaagggcauaggcaagaugacucucgggaugugcugcauaauuacagccagcauauugcugugguaugcccaaauccagccccacuggaucgcggccuccauaauccucgaguucuuucugaucguccuucucauccccgagccggaaaagcagcggacgccacaggacaaccaacugaccuaugugguaaucgccauacugaccguaguggcggccacgauggcgaacgagaugggcuuccucgagaagaccaagaaggaccugggcuuggggagcauaauaacucaggaguccgagucaaacauccucgauauagacuuacgcccggccagcgccuggacccuguaugcaguggccaccaccuucgugacaccuauguuacgucauagcaucgagaacagcagugugaaugugucccuaaccgcuauugcgaaccaagccacgguuuugaugggccuagggcgcggcuggccacuguccaagauggacaucggggugccacugcucgccaucggaugcuauagccaagugaauccgaucacccuuacugcggcguuacucuugcugguugcucacuacgccaucauuggacccgggcuccaggccaaggccacccgcgaggcccaaaagcgggccgccgccggcaucaugaagaaccccacgguggacggaaucacugugaucgaccuggagcccauacccuaugacccgaaguucgagaagcaacugggccaagucaugcuucuggugcugugcgugacccagguccucaugaugcgcaccacaugggcgcugugcgaagcacugacgcuugccaccgggcccauuucaacucugugggagggcaacccgggccguuuuuggaacacgacuaucgcagugaguauggccaacaucuuccguggguccuauuuagcgggugccgggcuucuguucagcaucaugaaaaauacgacgaauacgagaaggggcaccggcaacauuggggagacccuuggcgagaaguggaagucccggcuaaacgcccuggguaagagugaguuucagauuuacaagaaauccggcauacaagagguggaccggacacuggcaaaggagggcaucaaacggggcgaaacagaccaccacgcagugagcaggggaagcgccaaacuccgcugguucguggagcgcaacauggugaccccggaggggaaggucguagaccugggcugugggagaggcggcuggucauauuauugcggcggccugaaaaacguccgcgaagucaaggggcucacuaaaggcgggcccggccacgaggagccgauacccaugagcaccuacggauggaaccuggugcggcugcagucgggaguggacgucuucuuuacaccgcccgagaaaugcgauacauugcugugcgacauaggagagucaagucccaaccccaccaucgaagccgggcgaacgcucagaguccucaaccugguugaaaauugguugaauaacaacacgcaguuuugcaucaaaguauuaaacccguacaugcccagcguaaucgagaagauggaaaccuugcagagaaaguauggcggggcacugguucggaacccgcugucccguaacuccacacacgaaauguacugggucagcaaugccacaggcaacaucgugagcuccgugaauaugaucucccgcaugcucauuaaucgguucacaaugaagcacaagaaggccacguacgagccggacgucgaccugggguccggcacacgcaacauaggcauugagaacgaaauaccaaacuuggauauuaucgggaaacggaucgagaaaaucaagcaggagcacgagacgagcuggcauuacgaccaggaccacccuuacaagaccugggccuaccauggguccuacgagacgaagcagaccggaagcgcauccagcaugguaaacggcgugguccggcucuuaaccaagcccugggacguugucccuauggucacgcaaauggcgaugacggauaccaccccuuucggacagcagcggguguucaaagagaagguugauacccgcacgcaggagcccaaggaggggaccaagaagcugaugcggauaacggccgaguggcucuggaaagaacugggcaagaagaagacgccccgaaugugcacgcgggaagaguuuacgcgcaaagugcgguccaacgcggccuuaggggccaucuucaccgacgagaauaaguggaaguccgcucgcgaggcaguggaggacagucgguuuugggagcuagucgaccgugaacggaaccugcauuuggaggguaaaugugagaccuguguguacaacaugauggguaagcgcgagaagaagcucggcgaguucggcaaggcgaaggggucacgugcgaucugguacauguggcugggugcccgcuuucuggaauuugaagcacuaggcuuccugaacgaagaucacugguucagucguggaaacucacugagcggcguggaaggcgagggccuccacaagcugggguacauccugcgugacguaaguaagaaggaaggcggagcgauguacgccgacgauacggccggcugggauacucggauaacccucgaggaccucaagaacgaagagauggugaccaaccauaugaagggggaacauaagaagcuggcugaggccauauucaagcuaacguaccagaauaaggucguucgcguucagcggccgacaccgcgggggaccgugauggacaucaucagccggaaggaccagcggggcuccggacagguuggaaccuacgggcugaacaccuuuacaaacauggaagcacagcugauccgccagauggagggcgaggguaucuucaagagcauccagcaccucaccgucaccgaagagaucgcggugcaaaacuggcuagcucggguugggcgcgagagacugucccgcauggccaucagcggugacgacugcgucgucaaaccccucgacgaccgguucgcuucggcgcugacggcccugaacgacaugggcaagguucgcaaggacauccagcagugggagcccagccguggcuggaacgacuggacccaaguaccguucugcucccaucacuuccaugaacucgugaugaaggacgggcggguccugguggugccgugccggaaccaggacgagcugaucggccgagcgcgaaucagccaaggcgcgggcuggucccucaaggagacggccugccuggguaaaagcuacgcgcagauguggacucucauguacuuccaccgucgcgaccuucgcuuggccgcgaaugcaaucuguuccgcuguccccagucacuggguuccaacgucucgcaccaccuggagcauccaugcgaagcacgaguggaugacgaccgaggacaugcuggccguuuggaaccgagucuggauccaggagaacccauggauggaagacaagacacccguggagaguugggaagaggugcccuaccuugggaagagagaagaucaguggugcggcucacugaucggccugacaucucgggcaacuugggccaagaacauucagacugcgaucaaucagguccgcucuuuaaucggcaacgaggaguacacggacuauaugcccagcaugaagcgguuccgcaaggaagaggaggaggccggcgugcugugguga

SEQ ID NO: 25220 - RNA, 9876 nt, Artificial Sequence
  derived and/or modified CDS sequence (opt11) from DENV-2__EU677144__SS-prME
acugcaggcaugaucaucaugcugauccccaccgccauggcguuccaccucaccacccgcaacggggagccucacaugaucgugggccggcaggagaaggggaagucccugcuguucaagaccgaggacggcgugaacaugugcacccucauggccaucgacuuaggcgagcugugcgaggacaccaucaccuacaaaugcccccuccugcgccagaacgagcccgaggacaucgacuguuggugcaacuccaccagcaccugggugaccuacgguaccugcaccaccacgggcgagcaccggcgagagaagcggucuguggcccuggucccccacgucgggaugggccuggagacccgcaccgagaccuggaugagcuccgagggggccuggaagcacguucaacggaucgaaacauggauccugcgccacccgggcuucaccauuauggcagcgauacuggccuacaccaucgggaccacacacuuccagcgggcccucaucuucauccugcugaccgccgucgcgcccagcaugaccaugcgcugcaucgggaucuccaaccgggacuuuguggagggcgugagcggaggcuccuggguugacaucgugcucgagcacgggagcugcgucaccaccauggccaagaacaagccgacccuggacuucgagcucaucaagaccgaggcaaagcagcccgcgacccuccggaaguacugcaucgaagcuaagcugacgaacaccaccaccgagucccggugcccgacgcaaggcgagcccagccugaacgaggagcaggacaaacgcuucaucugcaagcacaguauggucgaccgcggcuggggaaacggcugugggcuguucggcaagggcgguaucgugaccugcgcgauguucacguguaagaagaacauggagggaaaggugguacugccagagaaccuggaguacaccaucgucauaacgccccacagcggggaggagcacgccgugggcaacgacaccgggaagcacggcaaggagaucaagaucacaccgcagaguagcaucaccgaggcagagcucacgggguaugggacggucaccauggagugcaguccccguaccggccucgacuucaacgaaauggugcugcuccagauggaggauaaggccuggcuggugcaccggcagugguuccuggaucuaccccugcccuggcugccgggggccgacacccagggccucaacuggauccaaaaggagacguuagucacauucaagaacccccacgcgaagaagcaggacguggugguacuggggagccaggagggggccaugcauaccgcccucaccggggccacugagauccagauguccagcggcaacuuacuguucaccggccaccuaaagugccgccugaggauggacaagcugcagcucaaagggaugagcuacuccaugugcaccggcaaguucaagaucgugaaggagaucgccgagacccagcacgggacgaucgucauacgugugcaguaugagggcgauggcagccccugcaaaauccccuucgagauaauggauuuagagaaacgguacguccuugggcgucucaucaccgucaacccgaucgugaccgaaaaggacucccccgugaauaucgaggcggagccgcccuucggcgacagcuauauuaucaucggggucgagccgggccagcugaaacugaacugguucaagaagggguccagcauuggccagauguucgagaccaccaugcgcggcgcgaagcggauggccauccucggggacaccgccugggacuucggcucccucgggggcguuuucaccagcaucgggaaagcccugcaccagguauucggcgcgaucuacggcgccgcguucuccggcgugagcuggaccaugaaaauccugaucggcguaaucaucacguggauagggaugaacucccgcagcacgucccucagcgugucccugguccuggugggcguggucaccuuguaccugggagugauggugcaagccgacagcggcugcgucguguccuggaagaacaaggagcugaagugcggcagugggaucuucaucacugacaacgugcacacguggaccgaacaguacaaauuccagcccgagucccccaguaaguuggcgagugcaauccaaaaagcccacgaagagggcaucugcgggauccgguccgucacccgccuggagaaccugauguggaagcagauaacccccgagcucaaucauauacugagcgaaaacgagguaaagcugacgauaaugaccggcgacauaaaaggcaucaugcaggccggcaagcgaagucucagaccgcagccaacggagcucaaguacagcuggaagacauggggcaaggccaagaugcuguccacggagagccauaaccagaccuuccucaucgacgggcccgagaccgcggagugcccgaacaccaaccgggccuggaauucccuggagguggaggacuacggcuucggggucuucagcacgaauaucuggcugaagcuuagggagaagcaggacguguucugugacuccaagcugaugagcgccgccaucaaggacaaccgggccgugcaugcagacauggguuacuggauugaguccgcacugaacgacaccuggaagauggagaaagccagcuucaucgagguaaagagcugccacuggcccaagagccacacccucugguccaacggcgugcuggagucggagaugauaauucccaagaacuucgccgggcccgucucucagcacaacuaccguccgggcuaccacacccaaacggccgggcccuggcaccucggcaaacucgagauggauuucgacuucugcgaggggacgacgguuguagugaccgaggacugcgguaaccggggccccagcuugcgcacgacgaccgcgagugggaagcugaucacggaguggugcugucgguccugcacccuccccccccugcgcuaucggggcgaggacgggugcugguauggaauggagauacgcccccuaaaggagaaggaggaaaaucucgucaacagccuggugacggccgggcacggccagaucgacaacuucucccugggcguacuugggauggcccuuuuccuggaggagaugcuuaggacccgagucggcaccaaacacgccauccugcucguggcggugagcuucguuacccucaucacggggaacauguccuuucgggaccugggccgcgugauggugauggucggggccaccaugaccgacgauaucggcaugggcgugaccuaccuggcccuccucgccgccuucaaggugcgcccuacguucgcggccgggcuguuacuacggaagcuaaccagcaaggagcucaugauggccaccaucggcauugcacugcugucccaaagcacgauccccgagacgauccucgaacugaccgacgcucuggcgcuggggaugaugguccuaaagaucgugcgaaacauggagaaguaccagcuagccguaaccaucauggccauccucugcguccccaacgccguaauccugcagaacgccuggaagguuuccugcaccauacuagcggccgucagcgugagcccccuccuccucacgagcucccaacagaaagcagacuggaucccguuagcccugaccaucaagggccugaaccccaccgcgaucuuucucaccacgcuaagccggacgaguaagaagcgcagcuggccgcugaacgaggccgucauggccguaggcaugguguccaucuuggccagcucgcugcugaagaacgacauccccaugaccgggcccuuagucgccggcggguuacugaccgugugcuacguucugacgggccgcucggcggaccuggaacuggagcgcgccgccgacgucaagugggaggaccaagccgaaaucagcgggucaagcccaauuuuguccauaacgauuagcgaagacggcucgaugagcaucaagaacgaggaggaggagcagacucugaccauccugauucgcacgggccuccuggugaucuccgggguguucccagucucuauacccauuaccgccgcggcgugguaccugugggaagugaagaagcaacgcgcgggcguguuaugggacguccccagcccgccgcccauggagaaggccgagcuggaggacggagcauaccggaucaagcagcgcggcaucuucggguacagccagaucggcgcgggcguguacaaagagggcaccuuucacacaauguggcacgugacccgcggugccguuuuaaugcaccgcggcaaaagaaucgagcccuccugggccgacgugaagaaggaccucaucagcuacggcgggggcuggaaacuggagggggaguggaaggagggggaagagguacagguccuggcccucgagccuggcaagaacccccgagcggugcagacuaagcccgggcucuucaagaccaauaccggcaccauuggggcggugucccuggacuucagcccgggaacguccgguagcccgaucgucgaccggaagggcaagguggugggccucuacgguaacggcgucgugacccgcuccggcgccuacgugucggccaucgcccagaccgagaaguccauagaggacaaccccgaaauagaggaugacaucuuccguaagaagcgccugaccaucauggaccugcaccccggggcgggcaagacgaagcgguaucugcccgccaucguacgcgaggccaucaagcgcgggcuccgcacccugaucuuagccccgacccgcguaguggccgcagagauggaggaggcccuccggggccugcccauccgauaccagacgcccgccauucgggccgagcacacgggccgcgagaucgucgaccugaugugccacgccaccuucacaaugcggcuguugagcccugugcgcguuccgaacuauaaccuuaucaucauggacgaggcacauuucaccgaccccgccagcaucgccgcccggggguacaucuccacucgagucgagaugggcgaggcggccgggaucuuuaugacagcaacgccgcccggcagccgggacccguuuccccaguccaacgcccccaucauggacgaggaacgcgagaucccggaacggagcuggaacuccggucacgagugggucacagacuucaagggaaagacggugugguucgucccuagcauuaaggccgggaacgacaucgcggcgugccugcgcaagaacggcaagaaggucauccaguuaucccggaagaccuucgacagcgaguacgugaagacccgugccaacgacugggacuucguggugaccacggauaucuccgagaugggcgccaacuuccgggccgagcgcguaaucgauccccgccgcugcaugaagcccgucauccugaccgauggggaggagcggguuauccucgcggggcccaugccggugacccacagcuccgccgcccagcgccgcgggcggaucggccgcaaucccaagaacgaaaacgaccaguauaucuacaugggggagcccuuagagaacgaugaggacugcgcccacuggaaggaggccaagaugcugcucgacaauaucaacacccccgagggcaucauuccgagcauguucgagccggagcgggagaagguagacgcgauagacggcgaguaccgccugaggggugaggcccgcaagacguucguggaccugaugcggcgcggcgaccuccccgugugguuggccuaccgggucgccgcugaagggaucaacuacgcggaucgccgguggugcuucgauggcaucaagaacaaccagauucuggaggagaacguggagguggagaucuggacgaaggaaggugagcgcaagaagcucaagccgcgguggcuggacgcccgcaucuacucugacccccuggcccucaaggaguucaaggaguuugccgcgggucggaaaucccugacccugaaccucaucaccgagaugggucgccuacccacguucaugacccagaaggcccgggacgcccuggauaaccucgcgguccugcacacagccgaggucgggggccgcgcguacaaccacgcgcuguccgagcuucccgaaacacuggagacgcugcuccugcugacccuccuggccaccguuaccggcggcaucuuccucuuccucaugagcggcaaggggaucgguaagaugacgcuggggaugugcugcaucaucaccgccucgauacugcucugguacgcccagauccagccccauuggaucgcggccagcaucauccuggaguucuucuugauugugcuccugaucccugagcccgagaagcagcggacgccccaagacaaccagcugaccuacguggucaucgccaucuuaaccguggucgccgcuacgauggcgaacgagaugggcuuccuugaaaagaccaagaaggacuuagggcucggcucaaucaucacccaggagagcgagagcaacauccuggacaucgaccugcgcccggccagugccuggacccucuacgccgucgcaacgaccuucgucacccccaugcugcggcauaguaucgagaacuccucggugaacgucucucucaccgcaauugccaaccaagccacggugcucaugggccuugggcgcggauggccccuguccaagauggacaucggggugccccuccuggccaucggcugcuacucccaggucaacccgauuacccugaccgcggcccuucugcuacucguggcgcacuacgccaucaucgggcccggccugcaggccaaggcgacucgcgaggcccagaagcgcgccgcagccggcaucaugaagaaccccacgguggacgggaucaccgucaucgaccucgagcccaucccauacgaccccaaguucgagaagcagcucggacagguuaugcugcuggugcuuugcgucacccaagugcuuaugaugcgcaccacgugggcgcugugugaggcccucacccuagcaaccgggcccaucagcaccuuaugggagggaaaccccgggcgguucuggaacacgaccaucgccguguccauggccaacaucuuccgcggcagcuacuuagcgggcgccgggcugcuguucuccaucaugaagaacaccaccaacacgcggcgcggcaccgggaacaucggggagaccuugggcgaaaaauggaaaucccggcugaacgcccugggcaagagcgaguuucagaucuacaagaaguccggaauccaggaagucgaccgaacccucgcuaaggaggggaucaagcggggcgaaacggaccaccacgcggugucccgcggguccgccaagcuucggugguucguggagcgcaacauggucaccccggagggcaaggugguggaccugggcugcgggcggggcgggugguccuauuauuguggugggcucaaaaacgugcgcgaggugaagggacugaccaagggcggucccggccacgaggagccgaucccuaugagcaccuacggguggaaucuggugcggcuacagucuggcgucgacguguucuucacgccgcccgagaaaugcgacacccuacugugcgacaucggggaguccucacccaaccccaccaucgaggccgggcgcacacuccggguguugaaccuggucgagaacuggcucaacaacaacacucaguuuugcauaaaggugcugaacccguacaugcccuccgugauagagaagauggagacccugcagcguaaguacggcggggccuuaguccggaaccccuugagccgcaacuccacccacgagauguacugggugagcaacgccaccggcaauauuguguccuccguuaacaugaucucccgaaugcugaucaaccguuucaccaugaagcacaagaaggcgacguacgagcccgacguggacuuggggaguggcacccgcaauaucgggaucgagaacgagauccccaaccucgacaucauuggcaagcgaaucgaaaagaucaagcaggagcacgagaccucauggcacuacgaccaggaccaccccuauaagaccugggcguaccauggcagcuacgagacgaagcagaccgggucggccagcuccauggugaacggcgucgugcgccugcuaaccaagccgugggauguggucccgauggucacccagauggccaugacggacaccacccccuuugggcagcagcggguauucaaggagaaggucgacacccgcacgcaggaaccgaaggagggcaccaagaaacucaugcggaucaccgccgaguggcuguggaaggagcugggcaagaagaagacgccccgcaugugcacgcgggaggaguucacccgcaaggugcggucgaacgcggcccucggugccaucuucacagacgagaacaaguggaaaagcgcccgcgaagccguggaggacagccgguucugggagcuggucgaucgcgagcguaaccugcaccucgagggcaagugcgagaccugcguguacaacaugauggguaagcgcgagaagaagcugggcgaguucgggaaggcgaagggcucccgcgcgaucugguacauguggcugggcgcuagguuccucgaguucgaggcgcugggguuccugaacgaggaccacugguucucacggggcaacucccucagcgggguggagggcgaggggcugcacaagcugggcuacauccuccgcgacgugagcaagaaggaggggggugcuauguacgcagacgacacggccgguugggacacccggaucacucuugaggaccuaaaaaacgaggaaauggucaccaaucacaugaagggggagcacaagaagcucgcugaggccaucuucaagcugaccuaccagaacaaggucgugcgcgugcagcgcccgacgccccgcggcacggucauggacaucaucucccgcaaggaccagcgggggucgggccaggugggcaccuacggacugaacaccuucaccaacauggaggcucagcucauacgccagauggaaggcgaggggaucuuuaaauccauccagcacuugaccguaaccgaggagauagccgugcgcaauuggcuggcccgcgugggcagagaacgccucagccggauggcgauaucgggcgaugacugcguggucaagccgcuggacgaccgcuucgccagcgcguuaacggcccugaacgacauggggaaggugcggaaggacauccagcagugggagccuucccgcggauggaacgacuggacccaggugccguucugcagccaccacuuccacgagcuggugaugaaggacgggcgggugcuaguggugccaugccgcaaccaggaugagcucaucgggagagcccgcaucucccagggggccggcuggagccugaaggagaccgccugccugggcaaguccuacgcgcagauguggacccucauguacuuccaccggcgagaccugcggcuggccgccaacgcgaucugcagcgccguacccucccacugggugccuacgagccguaccaccugguccauccacgcgaagcacgaguggaugaccaccgaggacauguuggcggucuggaaucgcguguggauacaggagaacccguggauggaggacaagacccccguggagagcugggaggagguccccuacuuagggaagagagaggaccaguggugcggcucccugauugggcucaccagccgcgccaccugggcaaagaacauccagaccgcgaucaaucaggugcggagccucaucggcaacgaagaguauacggacuacaugccuuccaugaagagauuccggaaggaggaggaggaggccggggugcugugguag

SEQ ID NO: 25221 - RNA, 9876 nt, Artificial Sequence
  derived and/or modified CDS sequence (opt11) from DENV-2__EU677145__SS-prME
acugccggcgucauugucaugcugauccccaccgcaauggcuuuccaccucaccacccgcaacggcgaaccccacaugauugugggccgacaggagaaggggaaguccuugcuguucaagaccgaggauggcgugaacaugugcacccucauggccaucgaccugggggagcuaugugaggacacaauaacuuauaaaugcccacuccugcggcaaaacgagcccgaggauaucgacuguuggugcaacuccaccagcacguggguaaccuacgggaccuguacgacgacuggcgagcaccggcgcgagaagcgguccguggcacugguaccccacguggggaugggccuagaaacccgcaccgagacguggauguccucagagggggccuggaagcacguucagcgcaucgagaccuggauccuacgucacccgggcuucacaaucauggcugcuaucuuagccuacacuaucgggaccacgcacuuccaacgggcucucaucuucaucuuacugaccgccgucgcccccagcaugacaaugcgcugcauuggcauaagcaaucgggacuucgucgagggcguaagcgggggcuccuggguggauaucguacucgagcaugggagcugugugacaacgauggccaagaacaagcccacccuugacuucgaacugauaaagaccgaggcuaagcagccggcgacauuacgcaaguacugcaucgaggccaagcugacuaacaccacaacugagucccggugcccgacgcagggcgagcccagccugaaugaggagcaggacaagcgcuucaucugcaaacacuccaugguggaccggggcugggggaauggcugcgguuuauuuggcaagggugggauugugaccugcgcgauguucacuugcaagaagaacauggaggggaagguagugcagcccgagaauuuggaauacaccaucgucaucacgccccacucuggagaggaacacgcugugggcaacgacacagggaagcacggcaaggagaucaaaaucaccccgcaaucaagcauuaccgaggcagagcugacaggguacggcacggucacgauggaaugcagcccccggaccggccuggauuucaaugagaugguccuguugcagauggaagauaaggccuggcuggugcaucggcagugguucuuagaccugccccuccccuggcuuccaggggcagauacccagggaagcaacuggauacagaaggagacgcuggucaccuucaagaacccccacgcgaagaagcaagacguugugguccucgggucccaagagggcgcaaugcauaccgcccugaccggggcuacggagauucagaugaguagcggcaaccuuuuguucaccggucaccuuaaaugccgccugcgcauggacaagcuccagcugaaagggauguccuacagcaugugcacagggaaguucaagauagugaaggagaucgccgaaacccagcaugggacgaucgugauacgcgugcaguacgagggagauggcucccccuguaaaaucccauuugagauuaccgacuuagagaagcggcauguacucgggaggcuaaucaccgugaacccgaucaucaccgagaaggauucacccgucaacaucgaggccgagccucccuucggcgacuccuauaucauaaucggcguggaaccgggccagcuuaaacuaaauugguuuaagaaggguucguccauugggcagauguucgagacuacaaugcguggcgccaaacgcauggccauucugggggacaccgcuugggacuucggcagccucggagggguguucaccagcauagguaaggcacuccaccaggucuucggggcgaucuacggggcagccuucagcgggguguccuggacgaugaagauccugauaggcgugaucaucaccuggauagggaugaauagccgguccacgagccugucugucagcuuggugcucgugggcgucguuacccuguaccugggggcuauggugcaggcggacuccgguugcgugguaucuuggaagaauaaggagcucaagugcggcucugggaucuucaucacggacaacgugcacacguggaccgagcaguacaaguuucagcccgagucaccgagcaagcuggccucugccauccagaaggcccaugaggaaggcaucugugguauccggagcgucaccagacuggagaaccucauguggaagcagauuacgcccgagcucaaccacauccuguccgagaacgaggucaagcucaccauaaugaccggcgacaucaaagggauuaugcaagccggcaagagaucucugcggccucagcccaccgagcugaaguauagcuggaagacguggggcaaagcgaaaaugcucucgaccgaaucccacaaccagaccuuucugauagaugggcccgagaccgccgagugcccgaacaccaacagagccuggaacagccuggagguggaggacuacggguucggcgucuucaccaccaacaucuggcucaagcugcgggagaaacaggacgucuucugcgacuccaaacugaugucggccgcuaucaaggacaaccgggcgguucaugccgauaugggguacuggauagagucggcccucaacgacacuuggaagauggagaaagccagcuucaucgaggucaaguccugccacuggccaaagagccacacccugugguccaacggcgugcuggagagcgagaugaucaucccuaaauccuucgccgguccggugagucaacacaacuaccgcccgggcuaccauacgcaaaccgcggggccuuggcaccucggaaaguuagagauggacuuugacuucugugaagggaccaccguggugguuacggaggacuguggaaaccgggggcccagccugcgcacgaccaccgcaagcgggaagcucaucacggaauggugcugccggagcuguacccugcccccgcugagauaccguggcgaggacggaugcugguauggaauggaaauccgacccuuaaaggagaaggaggagaaccuggucaacucccuggugaccgccggccacggccagauugacaacuuuuccuugggcgugcucgggauggcccuguuccuagaagagauguugcggacccgcgucgguacgaagcacgccaucuugcuuguggccgucucuuucgucacucugaucaccgggaacaugucguuccgcgacuuaggccgcguuauggugauggugggggcuaccaugacggacgacauugguaugggcgugacauaucucgcccugcuggccgcguucaaggugcgccccaccuucgccgccgggcuccuguuacggaagcucaccucaaaggagcuuaugauggccaccaucggaaucgcacugcucagccaaaguacaaugcccgagacaauccuggaacugaccgacgcgcuagcccuggggaugaugguccuaaagauagugcgcaauauggagaaguaccagcucgcggugacuaucauggccaucagcugcgucccgaacgcuguuauccuucagaacgcauggaaggucuccugcaccauccucgcgaccgucagcgugagcccccucuuacuaacgucgagucaacagaaggccgacuggaucccccucgccuugacgauaaaggggcugaaccccaccgcaaucuuccuaaccacccucagccggacauccaagaaacgcagcuggccguugaaugaggccaucauggccgucggcaugguuaguauccucgccagcucucugcugaagaacgacauccccaugaccgggccccucguggcuggcgggcugcugacaguaugcuacgugcuuacgggccggucggcugaccucgagcuggaacgcgcggccgaugugaaaugggaggaccaggcagaaauaagcggguccagccccauccucagcauuacuauuuccgaagacggauccauguccaucaaaaaugaggaagaggagcaaacucugaccaucuugauccggacgggacuucugguaaucuccgggguuuucccgguuucuauccccauaaccgcagcggcuugguacuugugggaagucaagaagcagcgcgccggcguccucugggacgugccuagcccgccgcccgucgggaaggccgaauuggaggauggggccuaccggauuaagcagcgcgggauacucggcuacucucagaucggcgcggguguauacaaggaagggacuuuccacaccauguggcacgugacccgcggagcgguccucaugcaucgcggcaagcggauagagcccuccugggccgauguaaagaaggaccuaauaagcuacgggggcggauggaagcucgagggggaguggaaggagggcgaagaaguucaaguacucgcccuggagcccgggaagaacccccgcgcagugcagaccaagccuggcaucuucaagacaaacaccgggaccauaggcgcgguuucccuggacuucuccccgggaaccuccgggagccccaucgucgauagaaaggguaaggugguaggucuauauggaaauggcguagugacgcgguccggggccuauguuagcgccauugcucagacggagaagucuaucgaggacaaucccgaaaucgaagacgauauauucaggaaaaagcgccugacaaucauggaccuacaccccggcgccggcaagacuaagcgguaccuccccgccauaguccgcgaggccauaaagcggggccugcgcacgcuaauccuugccccgacucgcgugguggccgcggagauggaggaggcccuccgggggcugccaauacgcuaucaaacucccgccauccgagcggaacauaccggccgugaaaucgucgaccucaugugccaugcaacuuucaccaugcggcuguugucccccgugagagucccgaacuauaaccugaucaucauggacgaggcacacuucaccgacccagccagcaucgccgcucggggcuacaucuccacccgcgucgaaaugggggaggccgccggcaucuucaugacggccacgccgcccggaagccgugaccccuucccccaauccaaugcucccaucauggacgaggagcgggagaucccggagcgaagcuggaauaguggccacgaguggguaacggacuucaagggcaagacgguaugguuugucccgagcauaaaggccggcaaugacauagcggccugccuccgcaagaacggcaagaaagugauucaacucuccaggaagacguucgacagcgaauacguaaagacucgcgccaaugacugggacuucgucgugacgacugacaucuccgagaugggggccaauuucaaggccgagcgggugaucgaccccagaaggugcaugaagcccgucauucugacggacggcgaggaacgcgugauccucgcggggccgaugccggugacacacagcucggcagcccagcgacgcggccgcaucggucggaaccccaagaaugagaacgaccaguacauauacaugggcgagccccuggagaacgacgaggacugcgcccacuggaaggaggcuaagaugcugcucgauaacauaaacacccccgaggggauaaucccgaguauguucgagccggagcgcgaaaaggucgaugccaucgacggggaguaccggcugcgcggcgaagcccggaagacuuucguggaccugaugaggcgcggggaccuccccgucuggcuggccuaccgcgucgccgcugagggcaucaauuaugcggaccgcaaguggugcuucgacgggaucaagaauaaccagauccuggaggaaaauguugagguggagauuuggacgaaagaaggcgagcgcaagaaacucaaaccgcguuggcuggacgcccgcaucuacagugaccccuuggcccucaaagaguucaaggaguucgccgcgggacgaaaaucacucacuuuaaaccuuauaacugagauggggcgccuacccaccuucaugacgcaaaaggcgcggaacgcgcuggacaaccucgccguccuucacacggccgaggcgggcgggagggccuacaaccaugcccuguccgaacuacccgaaacccuggagacacugcuucugcugacgcuccuggccaccgugaccggcggcaucuuucuuuuccucaugagcgggaagggcauuggcaagaugacccugggcaugugcuguauaauuaccgccuccauccugcucugguaugcucagauccagccucauuggaucgccgccagcaucauccuggaguucuuccugaucguccugcugauuccggaaccagagaagcagcggacgccacaggacaaccagcugacauacgucgugaucgcgauccucacuguuguggccgcgaccauggcgaacgagaugggguuccuggagaagacgaagaaggaucugggccucggcucgaucaccacccaggaguccgaaagcaacauccuagauaucgaccugcgcccggccuccgccuggacccuguacgccguggcgacgaccuucguaacacccaugcuacggcauaguauugagaacuccuccgugaacguuucccugaccgcgaucgcaaaucaggccacuguccucauggggcugggcaaaggguggccccugucuaaaauggacauaggugucccccuacuggcaaucgggugcuauucccagguaaacccuauuacucugaccgccgcccucuuauugcucguugcacacuacgccauaaucggaccaggcuuacaggcaaaggccacacgcgaggcccagaagcgggccgcugcgggaaucaugaagaaccccacgguggacggaaucaccguuaucgaccuugaaccaauaccguaugacccuaaguucgaaaaacagcucggacagguaaugcugcugauccucugugugacccaagugcugaugaugcgcaccacgugggcucuuugcgaggccuugacucuugcuaccggucccauuagcacacugugggagggaaacccuggcagguucuggaacacuaccaucgcagucucuauggcgaacaucuuccggggcagcuaccuagcaggggccggcuuacuguucucgaucaugaagaauacuacaaauacacgccgggggacuggcaacauaggugaaacccucggagagaaguggaagucccgccugaacgcacugggcaaguccgaauuucagauauacaagaagucagguauccaggagguggaccggacccuagcgaaggagggaaucaagcgcggggagacggaccaccacgccgugucccgcggcagugccaagcugcgcugguucgucgagcggaacaugguuaccccggagggcaaggugguggaccugggaugugggagaggagggugguccuacuacugcggaggucucaagaacgugcgggagguaaaaggucuaacgaagggcgggcccggacacgaggagccggucccgaugagcacguacggauggaaccucguccgccuccaguccgggguggacgucuucuuuacgccgccagaaaaaugugauacgcugcugugcgacaucggcgaauccagcccaaaccccaccauugaggcgggccguacccuacgcguacuuaaucugguggaaaacuggcucaacaacaauacccaguucugcaucaaggucuuaaacccguauaugcccuccgugauugaaaagauggagacucugcagcgcaaauacgggggcgcccuggugcguaauccccugucaagaaauuccacgcacgagauguacugggugagcaacgcgaccgggaacauuguguccagcguaaacaugauuucccgcaugcucaucaaccgguucaccaugaagcacaagaaggcaaccuacgaaccggaugucgacuugggcucugggacccguaacaucgguauugaauccgagauccccaauuuggauaucaucggcaaacgcaucgagaagaucaagcaagagcacgagacuucguggcauuaugaccaggaucacccauacaagacuugggccuaccacggguccuacgaaacgaagcagaccggcagcgccagcuccauggucaacggagugguccgccuguuaaccaagcccugggauguagugccaaugguuacccaaauggccaugacggauacgacccccuucggacagcagcgcguguuuaaggagaagguggacaccaggacccaggagcccaaggagggcaccaagaaacuuaugaaaaucacagcggaguggcuuuggaaggagcugggaaagaaaaagacgccccgcaugugcacgagggaagaguucaccaagaagguccgcuccaacgccgcccugggcgcaauauucacagacgagaauaaauggaaguccgcacgggaggcgguugaggaugggcgcuucugggagcugguggaccgggagcgaaacuuacauuuagaagggaaaugcgagacgugugucuauaacaugauggggaaacgggagaagaagcugggcgaguucggcaaagccaaggggucgcgagcgaucugguacauguggcuuggcgcccgguuccuggaguucgaggcucugggguuccugaacgaggaucauugguucucgcgcggcaacagccuaagcgggguggagggggaaggccugcaccgucugggguacauccuccgcgaggucggcaagaaggagggcggcgccauguacgcugacgacacggccgggugggacaccaggauuacccuggaggaccuaaagaaugaggagauggucaccaaccauaugaagggcgaacacaagaagcuagccgaggcgaucuucaagcugacguaccagaacaagguggugagggugcaacguccgacgccccguggcaccgugauggauaucaucucucggcgcgaccagcgagggucgggccaggucgggaccuacggccugaacacauucacuaacauggaggcccagcucauccgucagauggaaggcgaaggcaucuucaagaguauccagcaccuaacggccaccgaggagaucgccguacagaauuggcuagccagagugggccgugagcgccucucccguauggcgaucagcggggaugauugcgucgugaagcccaucgaugacagguucgccuccgcccugacggcccuaaacgacauggggaagguucggaaagauauccagcagugggagcccagccgcggguggaacgacuggacccaggucccguucugcucacaucacuuccacgaguuagugaugaaggacggacgggugcugguuguaccuugccgcaaccaggacgaacugauaggccgggcacgcaucagccagggggcgggguggucccucaaggagacggcuugccuggguaagaguuacgcccagauguggacccugauguacuuccaccggcgcgacuuaagacuggcggcaaacgcuaucugcuccgccgugcccagccacugggugcccaccucucgcacgacuuggagcauccacgcgaaacacgaguggaugacgaccgaggacaugcuggccguguggaaccggguguggauacaggaaaacccguggauggaggauaagacgccgguugaauccugggaagaaguuccauaccucgguaagcgcgaagaccaauggugcggaucacugauaggcuuaaccagccgugcgaccugggccaagaacauccaaaccgccauaaaucaggugaggucccucaucggcaaugaggaguacaccgacuauaugccaucuaugaagagauuccgucgagaggaggaggaggccggcguccugugguga

SEQ ID NO: 25222 - RNA, 9876 nt, Artificial Sequence
  derived and/or modified CDS sequence (opt11) from DENV-2__EU677146__SS-prME
accgugggagucauagugaugcuaauccccaccgcgauggccuuucaccucaccacccgcaacggagagccgcacaugauugucggcaggcaggagaaggggaagucccuacuguucaaaaccgaggacggggucaacaugugcacucucauggcgauagaccugggggaacugugcgaggauaccaucaccuacaagugcccgcuccugcggcagaacgagcccgaggacaucgauugcuggugcaacagcaccagcaccugggugaccuacgggaccugcaccacuacgggcgaacacaggcgcgagaaacggucgguggccuuggucccgcacgugggaaugggacucgagacccgcacugagaccuggaugagcucagagggcgcauggaagcaugugcagcgaaucgagaccuggauccugcgccacccgggauuuaccauuauggccgcuauccuggcguacaccaucggaacgacccacuuccaacgggcucucauuuucaucuugcuaaccgccguugcgcccagcaugaccaugcgcuguaucggcaucucuaacagagacuucguggaaggcgugaguggggggucaugggucgauauugugcucgagcacgguagcugcgugaccacgauggcgaagaacaagcccaccuuagacuucgagcugauaaagacggaggcgaaacagccggccacccuccgcaaguacugcaucgaggccaagcugacaaacaccacaacggagucccggugcccgacgcagggagaaccuagccugaacgaggagcaggacaagagguuuaucugcaagcacucuauggucgaccggggcugggggaacggcugcggccuguucggcaagggcgggaucgucaccugcgcuauguucacgugcaaaaagaacauggagggcaaggugguccuaccugagaauuuagaguacacaauugugaucacgccucacagcggagaggagcacgcagugggcaacgacaccgggaagcacgguaaggaaaucaagaucaccccgcaguccagcaucacagaggccgaguuaaccgguuacggcacagugaccauggagugcagcccccggaccggucuggauuucaacgagaugguacuacuccagauggaggacaaagcuuggcuggugcaccggcagugguuccuugaccucccccugcccuggcucccgggggcagacacccagggcagcaacuggauccagaaggagacgcugguuaccuucaagaacccccaugcgaagaagcaggacguagugguuuuggggucccaggagggugccaugcacacugcccugaccggggccacagaaauccagaugagcagcgggaaccuacuguucaccggucacuugaaaugucgccuccggauggacaaacugcaacuaaagggcauguccuacuccauguguacggguaaguuuaagaucgugaaggagaucgccgagacccagcaugggacgaucgucauccgcgugcaguacgagggugacgguucccccugcaagauccccuucgaaaucauggaccucgaaaaacggcacguguuggggagguugaucacggucaauccgauugugaccgagaaggauagccccgugaacaucgaagcagagccaccuuucggcgacuccuacaucaucauagggguagagccaggccagcucaagcugaacugguucaagaagggcuccuccauaggccagauguucgagacuaccaugcgaggcgcgaagcguauggcuauauugggugacacugccugggacuucggcagccucgggggcguuuuuaccuccaucggcaaggcccugcaccagguguucggcgcaaucuacggcgcggccuucucugggguuucauggaccaugaaaauccuaauaggcgugaucaucacguggaucggaaugaacucgcgcagcaccagucuguccguaagccuggugcuggugggcgugguuacccuguaucucggggugauggugcaggccgacaguggcugcguggugagcuggaagaauaaggaacugaagugugggucgggaauauucauaaccgacaacgugcacacguggaccgaacaguauaaguuccagcccgagagccccaguaaacuggccuccgcgauacagaaggcccacgaagaggguaucugugggauccggucugucacccgccucgagaauuuaauguggaagcagaucacacccgagcuuaaccacauccucucugagaacgaggccaaguuaacaauaaugacgggugacaucaaagggauaaugcaggcgggaaagcggucacugaggccgcagcccaccgaacucaaguauuccuggaaaacguggggcaaggcaaagaugcugagcacggagucccauaaccagaccuuccugaucgacggacccgagaccgcggagugcccgaacaccaaccgugccuggaacagccuugaaguggaggacuacggauucggggucuuuaguacgaauaucuggcugaaacugcgcgagaagcaagaugucuucugcgacaguaagcugaugucggccgccauaaaagauaaccgggccguucaugcugacaugggauacuggauugaaagugcuuugaacgacacuuggaagauggagaaggccuccuuuauugagaucaagagcugccacuggccuaagucacauacccucuggagcaacggcguccucgaguccgagaugaucauccccaagaacuucgcugggcccgucucgcaacauaacuaccgcccgggcuaccacacgcagacggccgggccuuggcacuuggggaaacuggagauggacuucgacuucugcgaagggacgaccgugguggucacugaagauugcgguaaccggggucccagccucagaacaacgacggcauccgggaagcugaucaccgaauggugcuguaggagcugcacccugcccccgcuccgguaucggggcgaggacgggugcugguacggcauggagauccguccacugaaggagaaggaggaaaaccugguaaacucccucgugacggccgggcacggccagaucgacaacuuuagccugggcguguuggggauggcgcucuuccuggaagagauguuacggacccgcgugggcacaaagcacgccauccuucugguugccgucagcuuugugacacugauuacugguaacaugagcuuccgggaccucggccgcgugauggucauggugggggccacuaugacggaugauauuggcaugggugugaccuaucuggcucugcuagccgccuucaagguccgacccacguucgcggccggccugcugcucagaaaacuaaccuccaaggaacugaugauggccacgaucgguaucgcccuccucagccaguccacaauacccgaaaccauccuugaguugacggacgcgcuggccuuggggaugauggugcucaagaucgugcgcaacauggagaaguaccagcuggccgucacaaucauggcgauaagcugcgugccgaacgcggugauccugcagaacgccuggaaggucuccugcaccauccucgcggcugugagcgucuccccccugcugcucacaaguucccagcagaaagccgacuggauaccccuggcccugaccaucaagggccuaaaccccacagcaaucuuccugaccacgcugagccggaccuccaagaagagaagcuggccgcucaacgaggccgugauggcuguaggcaugguguccauccuggccagcagccugcucaagaacgacaucccaaugaccggccccuuaguagccggcgggcugcugaccgucugcuacguucugacaggcagauccgcggaucuggaguuggagcgcgcggccgacgugaagugggaggaccaggcagagaucaguggguccagccccauccucuccaucaccauuagcgaggacggcuccaugucaauaaagaacgaggaggaggagcacacgcugaccauccucauacggacgggccugcugguuaucucgggggucuucccggugucuauucccauaaccgccgcggcaugguaccucugggaggugaaaaagcaacgcgccgguguccugugggacgugcccagcccgccgcccguggggaaggccgagcuagaggauggcgcauaucggauaaagcagcgcgggauauucggcuacagccagaucggcgcgggagucuacaaagaaggcacuuuccacacgauguggcacgugacccgcggggcagugcuuaugcaccgcggcaagcggaucgagcccucuugggccgacgucaaaaaggaccugaucucauacgggggcggcuggaagcucgagggggaguggaaggaaggagaggagguucaggugcucgccuuagagcccgggaagaacccacgcgccguccagacgaagccgggccuuuucaagaccaacaccgggaccaucggcgcggucucccucgacuucucacccggaacguccgguucacccaucguggaucgcaaggguaagguuguggggcuguauggcaacgguguggucacccgcuccggcgccuacguguccgccauagcccagaccgagaaauccauugaggacaaccccgagaucgaagaugacaucuuccggaagaagcggcugaccaucauggaccuccaccccggcgcggggaagaccaagagguaucugcccgccaucgugagagaggcuauaaaacggggacugcgcaccuugauccucgccccgaccaggguaguggccgcggaaauggaggaagccuuacggggguuacccauacguuaccaaacucccgccauccgggccgagcacaccggccgugagaucguggaucucaugugucacgccaccuucacuaugcgucugcuaagucccguccgagugcccaauuauaaucucauuaucauggacgaggcgcacuucaccgaccccgcuagcaucgccgcgcgggguuacaucuccacgcggguggagaugggggaagcugcgggcaucuuuaugacggccacgccgccggggucccgggacccauucccccagaguaacgcaccgaucauggaugaagagcgugaaauccccgagcggagcuggaacuccggucacgaguggguaaccgacuucaaggggaagacugugugguucguaccgagcaucaaggcgggcaaugacaucgcggcgugccugcgcaagaacgggaagaaagugauccagcugucccggaagaccuucgauuccgaguaugugaagacccgagcuaacgacugggacuuuguagucaccacggauauuuccgagaugggcgccaacuuccgggccgagcgagugaucgaccccaggcgcugcaugaagcccguuauccucacagacggcgaggagcgggucauucuggcggggccgaugccggugacgcacagcucagccgcucagcgccgcgguaggauagggcgcaacccuaaaaacgaaaacgaccaauacaucuacaugggggagccccuggaaaacgaugaggacugugcccacuggaaggaggcuaagaugcuucuagacaauauuaauacuccugagggcaucauaccgucuauguuugagcccgagcgggaaaaaguggacgcgauagacggggaguaccgucugagaggggaggccaggaagacuuuuguugaucucaugcguaggggggaccugccuguguggcuggcauaccggguggcagccgagggcaucaacuacgcggaucggcgauggugcuucgacgggauaaaaaacaaccagauucucgaagagaaugucgagguggagaucuggaccaaggagggcgagagaaagaaacugaagccucgguggcuggacgcccguauauacuccgacccgcucgcucuuaaggaauucaaggaguuugccgcggguaggaagucccugacccucaaccucauaacugagauggggcgccugcccacuuucaugacccagaaggcccgggaugcccucgacaaccuggccguccugcauaccgccgaggucggcgguagagcguacaaccacgcccuuuccgagcuucccgagacucuggagacguuacuucuccucaccuuacuggcuacugucaccgguggaaucuuccucuuccuuaugagcgggaaaggcauagggaagaugacguugggcaugugcugcaucaucaccgcguccauccuccugugguacgcacagauccagccccacuggauugcggccagcauaauccuggaauuuuuccucauaguccugcugauccccgaaccggagaagcaacggacgccccaagauaaccagcucaccuacguggugaucgccauccuaacaguaguggccgccacgauggcgaacgagaugggguuccuggagaagaccaaaaaggaccucggccuggguagcaucacuacccaggaauccgagagcaacauccuggacaucgaucuccgcccggccuccgcauggacccuguacgcuguggccaccaccuucgucacuccuaugcuucggcacagcaucgagaacuccucggugaaugucuccuugacggccaucgccaaccaagcuaccguccugauggggcugggcagaggauggccucugucuaagauggacaucggcgugcccuuguuagccaucgggugcuacagucaagugaacccgaucacccucaccgcugcccuccugcugcugguggcccacuaugccaucaucggcccaggcuuacaggccaaggcgacgcgcgaggcucaaaagcggaccgccgccgguauuaugaaaaacccaacaguggacggcaucacugugauagaccucgagccgaucccauaugaccccaaguucgaaaagcagcuggggcaggucauguuauuagugcuaugcgugacgcaagucuuaaugaugcgcacaacgugggccuugugcgaggcgcugaccuuggccacgggucccaucagcacccuaugggaggggaauccgggccgguucuggaacaccaccaucgccgucucuauggccaauaucuuccgcggcucuuaccuagcgggugcggggcucuuguucucuauaaugaagaauacgaccaacacacggcgggggacggguaacaucggggagacguugggagagaaguggaagucacggcuaaaugccuuaggcaaauccgaauuucagauuuacaagaagagugggauccaagaaguggaucgcaccuuggcgaaagagggcaucaagcguggagagaccgaccaucacgccgucagccgcggcagcgcgaagcugcggugguucguggaacgaaauauggugaccccggagggaaaggugguggaucucggcugcggccgcggcgggugguccuacuacuguggcggacugaaaaacgugcgcgaggucaaggggcugacaaagggcggucccggccacgaagagcccaucccuaugagcaccuauggcuggaacuuggugcggcuacaaagcgggguggauguguuuuucacuccgcccgagaagugugacaccuugcucugcgacauaggagaauccagucccaacccuacgaucgaagccgggcgcacccugcggguucugaaccugguggaaaacuggcugaacaauaacacccaguucugcaucaagguccugaacccguauaugccauccguuauagagaagauggaaacacuccagcgcaaguacgggggcgccuuggugcggaacccuuugagccgaaacuccacccacgaaauguauugggucagcaacgccacggggaacaucguguccucggugaacaugaucucgcguaugcuuaucaaccgguucaccaugaagcacaagaaggcuacuuacgaaccggacgucgaccucggcagcgggacccguaacaucggcaucgaaaaugagauccccaaccuggauaucaucggcaagcggaucgagaagaucaagcaagagcaugagacgagcuggcacuacgaucaggaccauccuuacaagaccugggcguaucacggguccuacgagaccaagcagaccggauccgccucauccauggugaacggcgugguaaagcuucuuaccaaaccaugggacguagugccgauggucacacagauggccaugaccgacaccacgccauucggccagcagcgcguguucaaggagaagguggacacgcggacccaggaaccaaaggagggcaccaagaagcugaugcgaaucacggccgaguggcuguggaaggagcucgggaagaaaaaaacgccccggaugugcacucgcgaggaguucacucggaagguccgcagcaacgccgcgcugggcgccauuuucacggacgagaacaaguggaaguccgcccgggaagcaguggaggacagccgauuuugggagcuggucgaccgggagcgcaaccuacaccuggaggggaagugcgagacguguguguacaacaugauggggaaacgggagaaaaaacugggggaguuuggcaaagcaaaggggucccgcgccauuugguacaugugguuaggggcaagauuucuggaauuugaggcauuaggcuuccugaacgaggaucauugguucagccguggaaacaguuugaguggcguggagggagagggacugcacaagcuuggcuauauccuccgggacgucagcaagaaggaggggggggccauguaugcagaugacaccgccggaugggacacccgcaucacgcuggaggaucucaagaacgaggagaugguaaccaaccacaugaagggcgaacacaagaagcucgccgaggccaucuucaaacugaccuaccagaacaaggugguccgggugcagcggccgacgcccaggggaacggugauggacaucaucucccggaaagaucagagggggagcggccagguagguaccuacgggcucaauacauucacaaacauggaggcccagcuuauacggcagauggagggggagggcaucuucaaguccauccagcgccugacgguaaccgaggagaucgcggugcaaaacuggcucgcgagggucggccgcgaacgcuuaagccgcauggccaucuccggagacgacugcguggucaagccgcuggacgaucguuucgccagcgcccuaacugcgcugaacgacaugggcaagguucgcaaggacauccagcagugggagccgagccggggguggaaugauuggacccaggugccguucuguagccaccauuuccacgaguuagugaugaaggauggccggguccucguugugcccugcagaaaccaggaugaguugauuggacgcgccagaauaucgcaaggcgccggcuggagccuaaaggagacggccugccucggaaagagcuaugcccagauguggacccugauguacuuccaucgccgggaccugcgccucgcugccaacgcuauauguucagccguccccucccauugggugcccacuagccggaccaccuggucaauccacgccaagcaugaguggaugacuaccgaggacaugcuggcggucuggaaccgcgucuggauccaggaaaauccguggauggaggacaagacgcccguggagagcugggaggaggugccguaccugggcaagcgagaggaccaaugguguggcucgcucauaggucugacuucccgugcuaccugggccaagaacauccagaccgccauuaaccagguccgaucccugaucggcaacgaggaguacaccgauuacaugcccuccaugaaacguuuccgcaaagaggaagaggaggcggggguguugugguga

SEQ ID NO: 25223 - RNA, 9876 nt, Artificial Sequence
  derived and/or modified CDS sequence (opt11) from DENV-2__EU687214__SS-prME
accgccgggguaauuauuaugcugauccccaccgcaauggcguuccaccucaccacccggaacggggagccccacaugaucgucggccggcaggagaaggggaagucccuucuguucaagaccgaggacggcgugaacaugugcacccucauggcuauagaccugggggagcucugugaggauacaauaacauacaaaugcccccuccugcgacagaacgagcccgaggacaucgacugcuggugcaacagcaccagcacgugggucacauacgggaccugcaccaccaccggcgagcaccggcgcgagaagagguccguggcccuggugccccauguggggaugggacuagagacucggaccgagacuuggaugagcucagagggggccuggaagcacguccaacggaucgagaccuggaucuuaaggcacccgggcuuuaccaucauggccgcgauccuggcauacacuaucgggaccacgcacuuccaacgggcucucaucuuuauccugcugaccgccguggcgcccucuaugaccaugcgcugcauaggcaucuccaaccgggacuucguagagggcguaagcggcggcagcuggguggacaucgugcucgagcaugggucgugcgucacuacaauggccaagaacaagccaacccuggacuucgagcugaucaagaccgaggccaagcagcccgccacgcuucgcaaguacuguaucgaggccaagcugacgaacaccaccaccgaaucccggugccccacgcagggcgagcccucgcugaacgaggagcaggauaagcgcuucauuugcaagcacuccauggucgaccggggcugggggaauggcugcggccucuucgggaaaggcgggaucguuaccugcgcgauguucacgugcaagaagaacauggagggcaaggucgugcugccugagaaccuggaguacaccaucgugauaacgccccauagcggggaggaacacgcaguuggcaacgacaccgggaaacacggaaaagagaucaagaucaccccgcaguccagcaucacugaggcagagcucaccggguacggcacggugaccauggagugcagcccccggaccgggcuggauuucaacgagauggucuuacuccagauggaagacaaggccuggcugguccaccggcagugguuccuggaccucccccugcccuggcugccgggggccgauacccaaggcagcaacuggauccagaaggagacgcuggugaccuucaagaacccccaugccaagaagcaggacgugguagugcuggggucccaggagggcgccaugcacacggcccugaccggugccacggaaauccagaugagcuccggcaaccuccuguucaccggccaccuaaaaugccgucuccguauggacaagcugcagcugaaggggaugucuuauagcaugugcaccggcaaguucaagaucgucaaggagaucgccgagacacagcacgggacgaucgugauccgagugcaguaugagggcgacggcucccccugcaagaucccuuucgagaucauggacuuagagaagcggcacguccuggggcgacugaucaccgugaacccgaucgucaccgaaaaggacagccccguaaacaucgaggcggagccgccuuucggagacucuuacaucaucaucgggguggagccgggccagcugaaacugaacugguucaagaaggggagcuccaucggccagauguucgagaccacgaugaggggcgcuaagcggauggccauccugggagacaccgccugggacuucggcagccuagggggcguguucacauccaucgggaaagcacugcaccaggucuucggcgcgaucuacggcgccgccuucagcgggguguccuggacuaugaagaucuuaaucggcgugaucaucacguggaucgggaugaauagccgcuccaccagccuuuccgucagccuagugcuagugggcgucgugacccuguaccucggcgugaugguccaggcggacacgggcugcguaguguccuggaagaacaaggagcugaagugcggaagcgggauuuucaucaccgacaacgugcacaccuggacggaacaguacaaguuccaacccgagagccccagcaagcuggcgagcgccauccagaaggcccacgaggagggcaucugcgggauccgguccgucaccagguuggagaauuugauguggaagcagaucacgccugagcuaaaccacauccucagugagaacgagguaaagcugaccaucaugaccggcgauaucaaggggaucaugcaggccggcaagcggucccuacgcccgcaaccaaccgagcucaaguacagcuggaagacguggggcaaggccaagaugcugaguaccgagucgcacaaccagaccuuccugaucgaugggcccgaaacugccgagugcccgaacacgaaccgggccuggaacucccucgagguagaagacuacggcuucggaguguucagcacuaacaucuggcuaaaacuucgcgagaagcaagacguguucugcgacuccaagcucaugagcgccgccaucaaggauaaccgggccguccacgccgacaugggcuacuggauagagucagcgcuaaacgacaccuggaagauggagaaggccuccuucaucgaaaucaaguccugccacuggcccaagagccacacccucugguccaacggcgugcuugagagugagaugauuauacccaagaacuucgccgggcccgugucccagcacaacuaccgcccgggcuaucacacccagacggccgggcccuggcaccugggcaagcuggagauggacuucgacuucugcgagggaaccaccgucguugugaccgaagauugcggaaaccggggucccagccucagaacgaccacugcuagcggaaagcugauuaccgaguggugcugccggucgugcacgcugcccccacuacgcuaccggggcgaggacgggugcugguacggcauggagauccgaccucugaaggagaaagaggagaaccuggucaacucucucgugaccgccgggcauggccagaucgacaacuucucacugggcgugcugggcauggcccuuuuccuggaggaaaugcuccggacccgcgucggcacaaagcacgccauccuccucguggcggugaguuucgucacgcugaucaccgggaauauguccuuccgcgacuugggccgcgugaugguaauggucggggcaaccaugaccgaugacaucggcaugggcguuacguacuuggcccuguuggcagccuucaaggugcgccccaccuuugcggccggccuguuacucagaaagcugacaucuaaggagcugaugauggccaccauaggcaucgcccuccuaagucaguccacgaucccagagaccauccuggaacuaaccgaugcccuggcgcuggggaugaugguccucaagaucgugcgcaacauggagaaguaccagcuggccgugaccauuauggccaucuccuguguccccaacgccgugauccugcagaaugccuggaaggugagcugcacgauccucgcggccgucuccguuagcccccugcugcucaccucuagccagcagaaggccgacuggaucccccuggcccugaccaucaagggccucaacccaacugccaucuuccuuacgaccuugucccggacaagcaagaagcgaagcuggccgcucaacgaggcugucauggcuguggguauggugagcauccuggccaguagccugcucaaaaacgacauccccaugaccggucccuuggucgccggagggcuguuaaccgugugcuacgugcugaccggccggagcgcggaccuugagcucgagcgugcggcugaugucaagugggaggaccaggccgaaaucuccggaagcucccccauccuaaguaucaccaucuccgaggacggcagcaugaguaucaagaacgaggaggaagaacacacccuuacgauccucauccguacggggcugcuggugaucucuggaguuuucccggucuccauccccaucacagccgcggccugguaccucugggaagugaagaagcagcgcgcgggcgugcuaugggacguccccagcccgccacccgugggaaaggccgagcuggaggacggcgccuaccggaucaagcagcgcgggaucuucggcuacucgcagaucggcgcagggguuuacaaggagggaaccuuccauaccauguggcacgucaccagaggggcggugcucaugcaccgcggcaagcgaaucgaacccagcugggccgacgugaagaaggaccugaucuccuacgggggcggcuggaaguuagagggggaguggaaggaaggcgaggagguacaaguucucgcccuggagcccgggaagaauccccgcgcugugcagaccaagcccggacuguucaagacuaacaccggcacgaucggcgcggucagccucgauuuuucccccggcacaucugguucccccaucguggauagaaagggcaaggugguuggguuguacggaaacggcguggugacgcgcagcggggccuacgucagugccaucgcccagacugagaagaguaucgaggauaacccagaaaucgaggacgacaucuuccggaagaagcgccugacuauaauggaccuccaccccggcgcggggaagaccaagcgguaccuacccgccaucguuagagaggcuaucaagcgugggcugcgcacucugauucucgccccaacccgagugguugccgcagagauggaggaggcgcugcgggggcugcccauccgcuaccagacacccgccauccgugccgagcacaccggccgcgagaucguggaccuaaugugccaugccaccuuuacaaugcgucugcugagccccgugagggucccuaacuacaaccucaucaucauggacgaggcgcacuucacugaccccgcuuccaucgccgcccgcgguuacaucucgacccgcguggagaugggggaggccgcaggaaucuucaugaccgcaacgccgccuggguccagagacccguucccccagagcaacgcccccauaauggacgaagagagggagauccccgagcggucuuggaacucgggccacgagugggugacuaacuucaaggggaagacagucugguucgugccguccaucaaggcgggcaacgacaucgcggccugucugcgcaagaacggaaagaaggugauccagcugucacggaagaccuucgacuccgaauacgucaagacccgcgccaacgacugggacuucguggugacgaccgacaucagcgagaugggggccaauuuucgugccgaacgcguuaucgacccccggcgcuguaugaagcccgugaucuuaacagacggcgaggagcgggugauccuggcgggacccaugccggucacccacuccucagccgcucagcgcaggggccgaaucgggcgcaaccccaagaacgagaacgaccaguacaucuacaugggcgagccgcuggagaacgaugaagacugcgcccacuggaaggaggccaagaugcugcuggacaacauuaacacgcccgagggcaucaucccguccauguucgagcccgaaagagagaagguggacgcgauugacggggaguaccgccugcggggagaggcucgcaagaccuucguggaccugaugcggcgcggggaccugccggucuggcuggccuaccggguggccgccgagggcaucaacuacgcggaccgacggugguguuucgacgggaucaagaauaaccagauccucgaagagaacguggagguagagauauggaccaaggagggcgagcgcaaaaagcugaagccgcgguggcucgacgcgcgcaucuacagcgacccacucgcccugaaggaguucaaggaguucgcagccggccggaaaucccugacgcucaaccugaucacagagauggggcgccugccaaccuucaugacucagaaggcccgcgacgcuuuggacaaccuggccgugcugcacacggccgaggucggcgggcgcgcguauaaccacgcccucagcgaacugcccgagacgcuggagacccuccugcugcucaccuuacuggccaccguuacgggcggcaucuuccucuuccugauguccggaaagggcaucgggaagaugacccuggggaugugcuguaucauuacagcuagcauccuccugugguaugcccaaauucagccgcacuggaucgcggccuccaucauccuggaguucuuccucaucgugcuccuuaucccggaacccgagaagcaacggacgccccaggacaaccagcucaccuacgucgugaucgccauccucacugugguugccgccaccauggcuaacgagaugggguuucuggagaagaccaagaaggaccucggccugggcucuaucacgacgcaggagagcgaguccaacauccuugacaucgaucuuagaccagccagcgccuggacccuauacgccguggccaccaccuucgugacgcccaugcugcgacacuccauagagaacagcuccgucaacgugagccucacugcgaucgccaaucaagccaccguacugaugggguugggccgcggguggccccucagcaagauggacaucggcgugccucuccuggccaucgggugcuacagccaggugaaccccauaacccucacggcggcacugcuguugcuaguggcccacuacgccaucaucgggcccgggcuccaggccaaagcgacgcgcgaggcccagaagcggacagccgccgggaucaugaagaaccccaccguagacggcaucacgguuaucgaccucgagcccaucccguacgaccccaaguucgagaagcagcugggacaggugaugcugcucguccugugcguuacccagguacugaugaugcguaccaccugggcccucugcgaggcguugacgcuggccaccggccccaucuccacucucugggaggggaacccaggccgguucuggaacaccacaaucgccgucagcauggccaacaucuuccgcggcagcuaucuggcuggggcgggucuccucuucagcaucaugaagaacaccaccaacacccgacgcgggacgggcaauaucggagagacccugggggaaaaguggaagucccggcucaacgcccucggcaagagcgaauuucaaaucuacaaaaagagcgggauccaggagguggaccgcacucuggccaaggaggguauaaagcgcggggaaaccgaccaccacgccgugucgcgcggaucugcgaaacuucggugguucgucgagcgcaacauggucacgccggaaggcaagguggucgaucucggcugcggccgcggcggauggucauacuacugcggcgggcugaagaacgugcgagaggugaagggguugaccaagggcgggcccgggcacgaggagcccaucccaauguccacauacggcuggaaccucguacgacugcagagcgggguggacguguuuuucaccccgccagagaagugcgacacccugcucugcgauauuggcgaaagcagccccaacccuaccaucgaggcgggccgcacccugcgaguccugaaucucguugagaacuggcugaacaacaacacccaguuuugcgugaaaguucugaacccguacaugccuaguguaaucgagaaaauggagacccuccagcgcaaguacggaggggcccuggugcgaaacccccugucccgcaacucgacacacgagauguacuggguuuccaacgcgaccgggaacaucgugagcucggugaacaugauaagccguaugcugaucaaccgcuucaccaugaagcauaagaaggccaccuacgagccggacgucgaccucggaucugggacucgcaacaucggcaucgagaacgagauucccaaccuagacaucaucggaaagcggaucgagaagaucaagcaggagcacgagacgagcuggcacuacgaccaggaccaccccuacaagacaugggcguaccacggguccuacgagacgaagcagacgggcagcgcuucuagcauggugaacggaguggucaaguugcucaccaagccuugggacguaguaccgauggucacccagauggccaugacagacaccacccccuucggccagcagcgcguguucaaagaaaagguugacacccggacccaagagcccaaggagggcacgaagaagcugaugcgcaucaccgcggaguggcuuuggaaggagcuagggaagaagaaaacgccgcguaugugcacccgcgaggaguucacgcggaagguccgcuccaacgccgcgcuuggggccaucuucaccgacgagaacaaguggaaguccgcuagggaagcgguugaggacagccgcuucugggagcuggucgaccgggagcgcaaccuccaccuggaggggaagugugaaaccuguguguacaacaugaugggcaagcgggagaagaagcucggugaauuugggaaggcgaaagguagccgagccaucugguauaugugguuaggugcccgguuccuggaguuugaggcccuaggcuuccucaacgaggaccauugguucagccgcgggaacucgcuguccggaguggagggggagggccuccacaaacuuggcuacauccuucgggacgucuccaagaaagaggguggugccauguacgcugacgacacugcugggugggauacgcgcaucacccuggaagaccucaaaaacgaagagauggugaccaaccacaugaaaggcgagcacaagaagcuggccgaggcuaucuucaagcugaccuaucagaacaaggugguccggguccagcgcccuacgccacgcgggaccgugauggacauuaucagccggaaggaccagcgcggcuccggccaggucgggacguacggccucaacaccuucacgaacauggaggcccagcugauacgacagauggagggggaggggaucuucaagucuauccagcgccugaccgugaccgaggagaucgcggugcagaacuggcucgcaagagucggccgcgagagacugucccgcauggccaucucgggggaugacugcguagugaagccccuggacgaccgguucgccucggcauuaauugcgcugaacgacaugggcaagguccgaaaggacauccagcagugggagccaagccgggguuggaacgacuggacccaggugccguucugcagccaccacuuucacgaauuggucaugaaggacggccgcguucucguugugccgugcagaaaucaagacgaacugaucgggcgcgcacggaucagccaaggugccggcuggagcuuaaaggagacggcaugccuuggcaagucguacgcucagauguggacccugauguauuuucaccgacgggaucugcgccucgcggccaacgccaucugcuccgccguccccagccacuggguccccaccucccgcaccaccuggaguauccacgccaagcaugaguggaugacgaccgaggacaugcuggccguguggaaccgcgucuggauccaggagaacccguggauggaggacaagacccccguggaguccugggaggaggugcccuaccuuggcaagcgcgaagaccaguggugcgggagccucaucggcuuaaccagccgcgccacgugggccaagaacauccaaacagccauuaaucaggugcgcucccugauugggaacgaggaguauacugacuacaugcccaguaugaagcgguuccgcaaggaggaggaggaagcgggcguccucugguga

SEQ ID NO: 25224 - RNA, 9876 nt, Artificial Sequence
  derived and/or modified CDS sequence (opt11) from DENV-2__EU687215__SS-prME
accgccggggucaucauaaugcugauccccaccgccauggcguuccaccucaccacccgcaacggggaaccucauaugaucguuggucggcaggagaaggguaagucucugcuauucaagacugaggauggugugaacaugugcacccucauggccaucgaccugggggagcugugcgaggauaccaucacguacaagugcccccuccugcggcagaacgagcccgaggauaucgacugcuggugcaacagcaccucaaccugggugaccuacgguaccugcaccaccacgggcgagcaccggcgcgagaagcgguccgucgcucuggugccccacgucgggauggggcucgaaacccgcacugagaccuggaugagcuccgaaggggccuggaagcacguccagcggauagagacauggauucugcgucauccgggguucacaaucauggccgcgauacuggccuacaccaucgggacuacgcacuuccagcgugcccucaucuucauucuucuaacagcuguggcuccuagcaugaccaugcgcugcaucggcaucuccaaccgggacuucguggagggcgucucugggggcuccuggguggacaucguucucgagcacgggagcugugucaccaccauggccaaaaauaagcccacccuggacuucgagcuaaucaagaccgaggccaagcagcccgccacccuucgcaaguacugcaucgaagccaagcugacaaacaccaccaccgagucccggugcccgacgcaaggcgagcccagccucaacgaggaacaggacaagcgcuucaucugcaagcacuccaugguggaccggggcugggggaacggcugcggccuguucggaaaaggagggaucgugaccugcgccauguucacgugcaagaagaauauggagggcaaggucgugcugcccgagaaccuggaguauaccaucgugaucacaccccacagcggcgaggagcacgccguuggcaaugacacuggcaagcauggcaaggagauaaagauaacaccgcaaaguagcauuaccgaggcugagcuuacaggcuacggcacggugacgauggaauguagcccccggaccggacuggauuucaacgagaugguguugcuccagauggaggacaaggccuggcuaguucaccggcagugguuccuggacuuaccucugccguggcugcccggggcugauacacagggcagcaauuggauacagaaagagacgcucgugaccuucaagaacccccacgcgaaaaagcaggacguagucguucuggguagucaggagggggccaugcacaccgcgcugaccggagccacggagauccagaugucuagcggcaaccuccuauucaccggacaccugaagugccgccuccggauggacaagcugcagcugaaggguauguccuacagcaugugcacaggcaaauucaaaauagucaaagagauagccgagacccagcacgggacgauagugauccgcgugcaauacgaaggagacggcucccccugcaagauccccuucgagauuauggaccucgagaaacggcauguccugggucgccucaucaccgugaauccaauuguaaccgagaaggacagccccgucaacaucgaagcggagccgcccuuuggugauuccuacauaaucaucgggguggagcccggucaacucaaguuaaacugguucaagaaggggagcuccaucggucagauguucgagaccacgaugcgaggcgccaagcggauggccauccugggcgacaccgccugggauuucgggagccucgggggcguguucacguccaucgggaaagcccuccaccaggucuucggggcaaucuacggcgccgccuucagcggggucuccuggaccaugaagaucuugaucggcgugauaaucaccuggauagggaugaacagccguucaaccagccuguccguuagccuagugcuggugggcguggugacccuguaccucgggguaaugguccaagccgacaccggcugcguggugagcuggaaaaacaaggagcugaagugcggaucagggaucuucaucacggacaacguacacaccuggaccgagcaguacaaauuccagcccgaguccccgagcaaacuggcgagcgccauacagaaggcccacgaagaaggaaucugcgggauucgguccguaacgcgcuuggaaaacuuaauguggaagcagauaacgcccgaacugaaccacauccucagcgaaaacgaggugaagcugacaauuaugaccggcgacaucaaggggaucaugcaagccggcaagcggucccugcgcccgcaaccgacggaacucaaguauucuuggaagacuuggggcaaagccaagaugcuguccacggagagccacaaccagaccuuccucaucgacgggccggagaccgcugaauguccuaauacgaaccgggcuuggaacucucuugaggucgaggauuauggcuucgggguguucagcaccaacaucuggcugaaacuaagggagaagcaggacguauuuugcgauuccaagcucauguccgccgcaaucaaagacaaucgcgccguucacgcagacaugggcuauuggaucgaguccgcgcugaacgacaccuggaagauggagaaggccagcuuuaucgagauuaagucuugccacuggccaaagagccacacucugugguccaauggcgugcucgagagcgagaugauuauccccaagaacuucgcagggcccgugucgcaacacaacuaccgcccgggauaucacacccagacagccgguccauggcaccuggguaaguuggagauggacuucgacuucugugagggcaccaccgucgugguuaccgaggacuguggcaaccggggcccuagucugcgcacgaccaccgcaagugggaaauuaaucaccgaguggugcugccggucgugcacgcugcccccgcuacgcuacagaggggaagacggcugcugguauggcauggagauccgcccauuaaaggagaaggaggaaaaccuggucaacagccucgugaccgccgggcacggacaaaucgacaauuucucccugggcguccucggcauggccuuguuccuggaagaaaugcugcggacccgcgucggaaccaagcaugccauccucuugguagcugugagcuucgugacgcugaucaccgggaacauguccuuccgggacuugggccgcgugauggugauggucggggcgaccaugacagacgacaucggcaugggcgugacguaccucgcauugcuagccgccuucaaggugcggcccacuuucgcagccggguuacuguugcgcaaacugacuagcaaagagcugaugauggccacuaucgguaucgcacuccuaucacagagcaccauccccgagaccauuuuagagcucacggacgcccuggcguuggggaugaugguccuuaagaucgugcgcaacauggagaaguaccagcuggccguuaccaucauggccaucucuugcgucccgaacgcagugauacugcagaacgcguggaaggugagcugcaccauccucgcggccguguccgugagcccccugcugcuuaccuccagccagcagaaggccgacuggaucccccuggcccuuaccaucaagggcuugaaccccacagcgaucuuccugacgacccugucccggacgucuaagaagagguccuggccccugaaugaggcagucauggcagugggaaugguguccaucuuagccuccagccugcucaagaacgacauuccuaugaccgggccucuagucgccgguggguugcucacugugugcuacguguugaccggccggagcgcggaucucgagcucgagcgagccgccgacgugaagugggaggaucaggccgagaucucagguagcuccccaauccucagcaucaccaucagugaggacggaucaauguccaucaagaacgaggaggaggagcacacccuaacgauucuuauccggaccggccuauugguuaucagcgguguguuuccggucagcauccccaucacggccgcggccugguacuuaugggaggugaagaaacaacgagccggcgugcugugggacguccccagcccgccgccggugggcaaggccgagcuggaggacggagccuaccggaucaagcagcgcgggaucuuuggcuacucccagaucggcgcggggguguacaaagaggguaccuuccacaccauguggcacgucacgcgcggggcggugcucaugcaccguggcaagcgcaucgagcccagcugggccgacgugaagaaggaccugaucaguuacgggggcggcuggaagcuggaaggagaguggaaagagggcgaggagguacaagugcuggcucucgagcccgggaagaacccccgagccgugcagaccaagcccgggcuguucaagaccaagaccgggacgauaggcgcggugucccucgacuucucucccggaaccagcgggucccccaucguugaccggaagggcaaggugguggggcuguacggcaaugggguggugacccgcagcggggccuacguuuccgccaucgcccaaaccgaaaagagcauagaggacaaucccgagaucgaagacgacauauuccggaagaagcgccugacgauaauggaccuccaccccggugcggggaagaccaagcgguaucuccccgcaauuguaagagaggccaucaagcggggccuccgaacccuuauccucgcgccgacccgcguggucgcugcggagauggaggaagcccuccggggacugcccauccgguaccaaacgcccgcaauccgggccgaacacaccggccgcgaaaucguggaccucaugugccacgcaacauucacgaugcggcugcugagucccguccgcgucccgaacuauaaccucaucauuauggacgaggcgcacuucaccgauccugccuccaucgccgccagaggcuacaucagcacccgcguggagaugggggaggcggccggcaucuucaugacagccacgccgcccgggucccgggacccguucccucagagcaaugcccccauaauggacgaggagcgcgaaauccccgaacgcagcuggaacuccgggcaugagugggucacggacuuuaaggggaagacugugugguucgugccguccauuaaagccggcaacgacaucgcugcuugccugcggaaaaacggcaaaaaggugauccaacucagccggaagacuuucgacuccgaguacgucaaaacccgcgccaacgacugggacuucguggugacgacugauaucucugagaugggggcgaacuuccgggccgaacgcgucaucgacccuagaagaugcaugaaacccgugauccuaaccgacggcgaggaacgggugauacuggcggggccuaugccggucacccacuccucagccgcccagcgccgcggccggaucggucgcaacccaaagaacgaaaacgaccaguacaucuacaugggggagccccuggagaacgaugaggacugcgcccacuggaaggaggccaagaugcuccuggauaauaucaacacgcccgagggcaucauucccuccauguucgagcccgaacgggagaagguggacgcgaucgacggggaguaccgccugaggggcgaagcgcgcaagaccuuuguggaccucaugcggcgcggggaccugccaguuuggcucgccuaccguguggcggccgagggcaucaauuacgccgacagaagguggugcuucgacgggaucaaaaacaaccagaucuuggaagagaacguggaagucgagauauggaccaaggagggcgagcggaagaaacucaagccgcgguggcuggacgccaggauuuacagugacccccucgcuuuaaaggaguucaaggaguucgccgcgggccggaagagucugacccugaaccugaucacggagauggggcgccugccuaccuucaugacccagaaggcacgcgacgcccucgacaaccuggccgugcuacacaccgccgaggucgggggacgcgcauacaaccacgcgcucagcgaacuucccgagacguuggagacccuccugcugcucacccugcuggccacagugacaggcggcaucuuccucuuucugauguccgggaagggcaucgggaagaugacccugggcaugugcugcaucaucacugccagcauccuccugugguacgcacagauccagccgcacuggaucgccgccucaaucauccuggaguucuuucucaucguccugcugauccccgagcccgagaagcaaaggacgccccaggacaaccaacucacguacgucgugaucgccauccuaacaguggucgccgccaccauggcgaaugagaugggguuccucgagaagacuaagaaggaccucggcuuaggcagcauaacuacgcaggagagcgaguccaacauucuggauaucgaccuacgaccggccuccgcuuggacccuguacgccguggcgaccgcguucgugacccccaugcugcggcacuccaucgagaacucuagcgucaaugugucccucacggccaucgccaaccaggccaccguucugauggggcugggccgcggguggccccucucgaagauggacauaggcgugccccugcuagcaaucgggugcuacagccaggugaacccgaucacacucaccgcagcccugcugcuccugguggcucacuacgccauuaucggcccgggccugcaggcgaaggccacgcgcgaggcccagaagcggaccgccgcugguaucaugaagaaccccaccguagacggcaucaccgugaucgaccucgaacccaucccguacgaccccaaauuugagaagcagcugggccaggugaugcugcucguccugugcgugacccaggugcugaugaugcgcacaacaugggcgcucugugaggcccugacgcuagcaacgggccccauuuccacucugugggagggcaaucccgggagguucuggaacacuaccaucgccgugagcauggccaauaucuuuaggggcuccuaccuggcaggggcaggccucuuauucucgaucaugaagaacacgaccaauacccgccgcgggaccggcaacaucggcgagacguugggggagaaguggaaaagucggcugaacgcuuuaggaaagagcgaguuccaaaucuacaagaaguccgggauccaagagguggaccgcacucuggccaaggagggaaucaagcguggagagaccgaccaccacgcggugagucgcgguuccgccaagcugcggugguucgucgagcggaacauggugaccccugagggcaagguggucgaccucgggugcggccgcggcggguggagcuacuacugcggcgggcuuaagaaugugcgcgaggugaagggacugacgaagggcgggcccggccacgaggagcccauccccauguccacauacggcuggaaccucguccggcugcagagcgguguggacguguucuucaccccacccgagaagugugacacccugcucugugacaucggcgagagcucacccaaccccacgauugaggccggccgcacauugcgaguucugaaccucguggagaauugguugaacaacaacacccaauucugcgugaagguccuaaacccguacaugcccagcgugaucgagaagauggagacucuccagcgcaaguacgggggcgcccuaguucggaacccccugucccgcaauaguacgcacgagauguacugggucagcaacgcaacgggcaacauagugagcuccguaaacaugaucucucgcaugcuuaucaaucgguuuaccaugaagcacaagaaggcaaccuaugagcccgacgucgaucucggcuccgggacccgcaacaucgggaucgagaacgagauccccaaccuagacaucauuggaaaacgcauagagaaaauuaagcaggagcaugaaacgagcuggcacuacgaccaagaccaccccuauaaaaccugggccuaccacggguccuacgagaccaagcagaccgggagcgccuccucuauggugaacgggguggucaagcugcugacuaagccgugggauguggucccgauggugacccaaauggccaugaccgacaccacgccuuucggccagcaacgcguguucaaggagaaggucgacacccggacacaagagccaaaggagggcacuaagaagcugaugaggaucacggccgaguggcuguggaaggaacuggggaagaagaagacgccccggaugugcacgcgugaggaguuuacccggaagguccgcuccaacgcggcuuuaggggccaucuucacggacgagaacaaguggaaguccgcccgggaggcuguugaggacucacgcuucugggagcuggucgaccgggagaggaaccuccaucuggaggguaaaugcgagaccugcguuuacaacaugaugggaaagcgggagaagaaauuaggggaguucgguaaggcgaaggguucuagggccaucugguacauguggcuuggcgcccgguuucuggaguucgaggcucugggcuuccucaacgaggaccauugguucucgagagggaacagccugagcggcguggagggggagggccuccacaaauuaggcuacauccugcgggacgucucgaagaaggagggcggggcgauguacgcugacgacaccgccgggugggacacgcgcaucacgcuagaggaucucaagaaugaggaaaugguaaccaaccauaugaagggcgaacacaagaagcuggccgaggccaucuucaaguugacuuaccagaacaaggugguaagagugcagaggccuacaccccgggggacggugauggacauaaucagccgaaaggaccagcgcggguccggccaggucgggaccuacggccucaacaccuucaccaauauggaggcccagcugauacggcagauggagggggagggcaucuucaaaagcauccaacguuugacggugacugaggaaaucgccguacagaacuggcuggcccgggucggccgcgagcggcugucccguauggccaucagcggggacgacugcguggugaagccccuggacgaccgguucgcaucggcgcucacugcccugaacgacaugggaaaaguucggaaggacauucagcagugggagcccucgcggggguggaaugacuggacccaaguuccguuuugcucccaccacuuccacgaguuggugaugaaggacggcagaguccucgucgugccgugucggaaccaggacgagcugauugggcgcgcccggaucucccagggugcggguuggucccugaaggagacggccugccucggcaagagcuacgcgcagauguggacccugauguacuuccauaggcgggaccugagacucgcggccaacgccaucuguagugccguccccucucacugggugccuaccucccgcacaaccuggucgauccacgcgaagcacgaauggaugacaaccgaggacauguuagccguguggaacagagucuggauucaggagaauccauggauggaggacaagacccccguggaguccugggaagaagugcccuaccugggcaagcgcgaggaucaguggugcgggucacucauaggcuugaccagccgggcaacgugggcuaagaacauccaaaccgcuauaaaccagguacgcucccugaucgggaaugaggaauacacugacuacaugcccucaaugaagcgguuccgcaaggaagaggaggaggccggcgugcugugguga

SEQ ID NO: 25225 - RNA, 9876 nt, Artificial Sequence
  derived and/or modified CDS sequence (opt11) from DENV-2__EU687216__SS-prME
acggccggcgugaucgucaugcugauacccaccgcgauggcguuccaucucacaacccggaauggagagccccacaugauaguaggccggcaggagaaggggaagucccugcuguuuaagacggaagacggcgugaacauguguacccucauggccauugaccugggugagcugugugaggacacaaucacguacaaguguccgcuuuugcgccagaaugagcccgaggacaucgacugcuggugcaacucuaccucuaccugggucaccuacgggacgugcacaaccacuggcgagcaccggcgggagaagcgguccguggcccuggucccucacgucggaaugggccuugagacacggaccgagacuuggaugagcucggagggagcguggaaacacguacagcgcaucgagacuuggauccuacgucacccgggcuucacgauuauggccgcgauccucgccuacaccaucgggacuacucauuuccagagagcccucaucuucauucugcugaccgccguggcccccagcaugacaaugcgcugcaucggaaucucgaaccgggacuucgucgagggcgugagcggggguucauggguggacaucguccuugagcacgggucuugcgugaccacgauggccaagaacaagccgacgcuggacuuugagcugaucaagacugaagccaagcaaccugccacccuucgcaaauacuguaucgaggccaagcucacgaauacaaccacggaaucccggugcccaacacagggcgagcccagcuugaacgaggagcaggacaagcgcuucauaugcaagcauaguaugguugaucgcggcugggggaacggcugcggcuuauucggcaaggggggaaucgugaccugcgcgauguucacgugcaagaagaacauggaggguaaaaucgugcagcccgagaaucuugaguacaccaucgucauaacgccccacagcggggaggagcacgccguuggcaacgacacugggaaacacgggaaggagaucaagaucaccccucaguccagcaccaccgaggcggaauuaacgggguacggcacagugacaauggagugcagcccacggaccggccucgacuucaaugagauggugcuucugcagauggaggacaaggcuuggcucguccacagacagugguuccuggaccucccucuccccuggcugccgggggccgauacgcagggcaguaauuggauccagaaggaaacucuggugaccuucaagaacccccacgcaaagaagcaggacguggucguccucggaucccaggagggcgcgaugcacaccgcccugacgggggccacagagauccagaugucgucggggaaccucuuauuuacugggcacuuaaaaugccgccuacguauggacaagcuccagcugaaggggauguccuacagcaugugcacaggcaaauucaagaucgucaaagaaaucgcugaaacgcagcacgggaccaucgugaucagaguacaauacgaaggcgacggcucgccgugcaaaauacccuucgagauaacggaucuugagaagcggcacguccucggccgacuuaucaccgugaacccgauugugacggaaaaggacaguccggucaacaucgaagcggagccccccuuuggcgacuccuauauuauuguaggugucgagccgggccaguugaagcucaacugguucaagaaggggagcuccauuggucagauguucgagaccacuaugaggggcgccaagcggauggcaauccuaggggauaccgcaugggacuucggaagccucggcgggguauucacguccauaggaaaagcgcuccaucagguauuuggugcgauauacggcgcugccuucagcggggugagcuggacaaugaaaauccugauuggcgucaucaucaccuggaucgggaugaacucacgcuccacuucucuguccgugucgcugguucucgucggcguggucacguuauaucuaggugcaaugguccaggcggacucggggugcaucgugaguuggaaaaauaaggagcucaagugcggcuccgggaucuucaucacagauaaugugcacaccuggaccgagcaguacaaauuccagcccgagucgccaagcaagcuggccuccgcgauccagaaggcccacgaggaggggaucugcgggauccggucuguuacgcgccuggagaaccucauguggaagcaaaucacucccgagcugaaccacauccugagugagaacgaggugaaauugaccaucaugaccggcgacaucaaggggaucaugcaggccggcaagcguagccugcggccgcagcccacggagcugaaauacagcuggaagaccugggguaaggcgaagaugcucucuaccgagucgcauaaccagaccuuccuaaucgaugggcccgagacagcagagugcccgaacaccaaccgggcuuggaacucucucgagguggaggauuacggguucggagucuucaccacgaacaucuggcucaagcugcgugaaaaacaggacguguucugcgacuccaagcugaugagcgccgcuauuaaggacaauagggcggugcaugccgacaugggcuacuggaucgaguccgcccugaaugacaccuggaagauggagaaagcaagcuuuauagaggucaagucgugccauuggcccaaaagccacacgcuuuggucgaacggcgugcuggagucagagaugaucaucccaaagaacuucgccgggcccgugucccagcacaacuaucgcccgggcuaucacacccaaaccgcuggcccguggcaccucggcaagcuggagauggauuuuaacuucugcgaggggaccacagucguugucaccgaggauugcggcaaccggggccccagcuuacggaccaccaccgcuagcgggaagcucaucaccgagugguguugucggucgugcaccuuacccccgcugcgauaccgaggcgaggacggauguugguacggcauggagauccguccccucaaggaaaaggaggagaaccuggucaacucacuggucacagccggucacgggcagauagacaauuuuagucucggcgugcuggggauggcccuuuuuuuggaagagauguugcggacgcgcguuggcacaaaacacgcgaucuuacucguggcauugagcuucgugacguugaucaccggaaacaugagcuuccgagaccucggacgcguaauggugauggugggggccacuaugaccgaugacaucggcauggggguaaccuaccuggcccuauuagccgcguucaaggugcgaccuacuuucgccgcagggcuccuguuacggaagcugacgagcaaggagcucaugauggcgaccaucggcauagcccuucugucccagagcacccugccagaaaccauccucgaacugacugacgcucuggcccucgggaugaugguauugaagaucguccgcaacauggagaaauaccagcuggccgugacuaucauggccauaagcugcgugccaaacgcagucauccuccagaacgccuggaaggugagcuguacuauccuggccgcaguauccgucagcccccugcuuuugaccuccagucagcagaaggccgauuggauuccccuggcgcucaccaucaagggccugaauccuacggccaucuuucugaccacccucucccggacgaguaagaagcgcucguggccgcugaacgaggccaucauggcagugggcauggucagcauuuuggccuccucacuucugaagaaugacauccccaugaccgggccccuaguggcgggcggguuguuaaccgugugcuacguccucaccggccggucggcggaccucgagcuggaacgcgccgccgaugugaaaugggaggaccaggcagagaucucugguagcagccccaucuugagcaucacuaucucugaggacggcagcauguccauuaaaaacgaggaggaagagcaaacccuaacuauccuaauccggacuggucuacucgugauuagcggggucuucccgguguccauccccauuacugcggccgcgugguaccugugggaggugaagaagcaaagggccgguguccugugggaugugcccagcccgccgccggugggaaaagccgagcucgaagacggggcguaucguauuaagcagcgcgggauccugggcuacucccaaaucggcgccgggguauacaaggagggcacguuccacaccauguggcaugugacccgaggagcugugcugaugcaccgcgguaagcggaucgaacccagcugggcugacgucaagaaggaucucaucuccuacgggggaggauggaaacuggagggggaguggaaggagggagaggagguccaagugcuggcccucgagccugggaaaaacccccgugcuguccagaccaagcccggcaucuucaagacgaacacggggaccauaggggccgugagccuggauuucucgcccggcaccagcggguccccuaucguggaccggaagggcaagguaguuggguuguacggcaacggcguugucacgcgcagcggugcauacguaucugccaucgcgcaaaccgagaagucuauugaggauaaccccgagaucgaagacgacaucuuccggaaaaagcgccuaaccauaauggacuugcaccccggggccgggaaaaccaaacgguacuuacccgccaucguaagggaggccaucaagcgaggccugagaacgcucauccuugcgccgaccagggucguggcggcagaaauggaggaggcgcugcgggggcugcccauccgcuaccagacacccgccauccgggccgagcacaccggucgcgagaucguagaccugaugugccacgcgacguucaccaugcggcuguuaagucccguccgcguaccgaauuauaacuugaucauaauggacgaggcucacuuuacggaccccgccucaaucgcugcccgggguuacauuucuacccgcguggagaugggggaggcggcgggcaucuuuaugacggcaacgccgcccgggucccgggacccauucccccagagcaacgcucccauuauggacgaggagagagagauccccgagcgguccuggaacagcggucaugagugggucacagacuucaaggggaaaacggugugguucguucccuccauuaaggcgggcaacgacaucgccgcaugcuuacggaagaacggcaagaaggugauccagcuuagucggaagacguuugacucagaguacgucaagacccgugccaacgacugggacuucguggucaccaccgacauaagcgagaugggcgccaauuucaaagcggagagaguaaucgauccccgccgaugcaugaagcccguuauccuuacugacggcgaagaacgcgucauccuagccgggcccaugccggugacccacuccagcgccgcccaacggcgcggacggauugggcggaaucccaagaacgagaacgaccaguacaucuauaugggcgagccccuugagaacgaugaggacugcgcccacuggaaggaggcaaagaugcugcuggacaauauaaauacccccgagggaauuaucccguccauguucgagcccgagcgcgagaaggucgacgcgaucgacggagaguacagauuacgcggcgaggcccgcaagacuuucguagagcugaugcggcgcggggaucugcccguuugguuagccuacaagguugccgcggaggguaucaacuaugccgaccgcaaguggugcuucgaugggaucaaaaacaaccagauacuggaggagaacgucgagguggagauauggacgaaggagggagagcggaaaaaacugaagccgagguggcucgacgcccggauuuacucugacccccuggcacugaaggaguucaaggaguuugccgccggccgcaagagucucacccugaaucugauaacugagauggggcgguugccgaccuucaugacccagaaggcccgcaacgcccuagauaaccuggccguucuacauaccgcggaagucggcgggagggccuacaaccaugcgcugucagaauugcccgagacgcucgaaacucugcuucuucugaccuuacucgccacagugacgggcggcaucuucuuguuccuuauguccggaaaggggguagguaagaugacccucggcaugugcuguaucaucaccgcaucuauccuucugugguaugcgcagauccagccacacuggaucgccgccuccauuauccucgaguucuuccuaaucguguuguugauucccgaacccgaaaagcagcgcacgccccaagacaaccaacugaccuacguggucaucgccauucugacggugguggcugcgaccauggccaacgaaaugggcuucuuggagaagacgaaaaaggaccugggauucggcagcauaaccacccaggagagcgaguccaacauccuggacauagaucuccggcccgcauccgccuggacccuguaugccgucgccacgaccuucaucacaccaaugcugagacacuccaucgaaaauagcuccguuaacguaagccucaccgcuauagccaaucaggccacuguccugaugggacugggcaagggauggccccucagcaagauggacaucggcgugccccuguuggcgaucgggugcuacagucaagugaacccgaucacccuuaccgccgcccugcugcuccugguggcccauuacgccaucaucggccccggccugcaggcgaaggccacccgcgaagcccagaagcgagcugccgcugggaucaugaagaacccgacggucgauggcauuaccguaaucgaccucgagcccaucccguaugaucccaaguucgagaaacaacuggggcaagucauguuacucauccugugugugacccaggugcugaugaugcgcaccacuugggcccuuugcgaggcccugacucuggccaccggcccgaucuccacccucugggaagggaaccccggccguuucuggaacacuaccauugcugugagcauggcgaacaucuuuaggggcucguaccuggccggggcuggcuuacuguucagcauaaugaagaacaccacaaacacgcggcgagggacaggcaacgugggcgagacacuuggcgagaaguggaagucucgucugaacgccuugggcaagagcgaguuccagauauacaagaaaucggguauccaggagguggaccggacccuggcgaaggaggggaucaagcgaggugagacggaccaccacgcugucucgcgcggcuccgcgaagcugcggugguuuguagagcgcaauauggugacuccggagggcaaggucguggaucucgggugugggcgcgguggcuggucauauuauugcggcggccugaagaacgugcgcgaagucaaaggacugaccaagggcggccccggucacgaggaacccauacccauguccaccuacggauggaaccucgugagacugcaaagcgggguggacgucuucuucacgccgcccgagaagugugacacucugcucugugauauaggcgagagcucccccaaucccaccaucgaagcuggccgcacacugcggguacugaaucucguggagaauuggcugaacaacaacacccaauucugcaucaaggugcugaauccguacaugcccagcgugaucgagaagauggagacgcuccagcgcaaguauggaggcgcucugguaagaaauccucugucccgcaauagcacacacgagauguacugggucuccaacgcgacugggaauauuguuagcuccguuaacaugaucagccguaugcucauuaaccgcuucaccaugaagcacaagaaagccacguaugagccggacgucgaccucggcucgggaacccggaacaucggcaucgagucugagauacccaaccuggacaucaucggcaagcgaaucgagaagaucaagcaagaacacgagaccuccuggcacuacgaucaggaccauccuuacaagacuugggcuuaccaugggaguuacgaaacaaagcagacuggcuccgccagcuccauggugaacggcgugguccgcuuacucacgaagccuugggaugugguaccgauggugacgcagauggccaugacugacacgacccccuucggccaacagcggguguucaaggagaaaguggacacgcggacucaagagcccaaagagggcacgaagaagcuuaugaagauaaccgcggaaugguuguggaaggagcucggaaaagagaagacgccacggaugugcacgcgcgaagaguuuacucggaaaguccgcagcaacgccgcacugggcgcaaucuucacggacgaaaacaaguggaagagugcacgggaggcaguugaggacggacgcuucugggagcugguugaccgggagcgcaaucuucacuuagagggcaagugcgagacgugcgucuacaacaugauggguaagcgagagaagaagcugggcgaguuuggcaaggccaaagggagccgcgccauuugguacauguggcuuggcgcacgguucuuggaguucgaagcgcuaggcuuccucaacgaggaccacugguuuagccgcggcaacagccuaagcgggguggagggggagggccuccaccgucucggguacauccugcgggaagucggaaagaaggagggcggagccauguacgccgacgacacggcaggcugggacacacggaucacgcuggaagaccucaaaaacgaggaaauggugacuaaucacaugaagggcgagcacaagaagcuggccgaggcgauuuucaagcugacguaucagaacaagguggugcgcgugcagcgcccgacgccacggggcaccgugauggauaucaucucacggaaggaccagcgcgggagcgggcaggucggcaccuacggauuaaacaccuucacgaacauggaggcccaacugauacgccagauggaaggcgaagggauuuucaaauccauccagcaucugaccgccacagaggaaaucgccguccaaaacuggcucgcacgggugggacgggagcgucugagccgcauggcuauuuccggggacgauugcgucgugaagccgauagacgaccgguucgccucggcacugacggcccugaacgacaugggcaaggugcgcaaggauauccagcagugggagccuuccagaggguggaaugauuggacccaggugccguucugcagccaccacuuccacgagcuugucaugaaggauggacgcgucuuggucgugcccugccgaaaccaggacgaacucauaggucgcgcucggauuucccagggagcgggcuggagcuuaaaggagaccgcguguuuagggaaauccuacgcccagauguggacccucauguauuuccaccgucgggaccugcgccuugccgccaacgccauuugcuccgccgugcccucccacuggguccccaccagccggacgaccugguccauacacgccaaacacgaauggaugaccacugaagacaugcucgccguguggaaccggguguggauccaggagaacccguggauggaggacaagacgccaguagagagcugggaggaaguccccuaucugggcaagcgggaggaccaguggugcgggucccugaucggccuuaccagccgagcgaccugggccaagaacauccagacggccaucaaucaggugcggagccucauuggcaacgaagaguacacggauuauaugccguccaugaaaagguuucgucgggaggaagaggaggccggaguccuaugguaa

SEQ ID NO: 25226 - RNA, 9876 nt, Artificial Sequence
  derived and/or modified CDS sequence (opt11) from DENV-2__EU726770__SS-prME
accgcuggcgugaucauuaugcuaauucccacggcaauggcuuuucaccucaccacacgaaacggagaaccacacaugaucguugggcgccaagaaaaaggaaagagcuugcuauucaaaaccgaggacggagucaacaugugcacgcugauggcgauagaucucggagagcuaugcgaagacacgauuaccuacaaaugcccacuacucaggcaaaacgaaccggaagauauugacuguuggugcaauucaacauccacgugggucacguauggaacaugcacaacaacgggagagcacagaagggagaaaaggucgguagcccuagucccacacguggguaugggccuagagacacgaacagaaaccuggaugucauccgagggagcauggaaacacguacaaaggauagaaacguggauucuacgccauccgggcuucaccauaauggcggccauacucgccuacacuauaggcacaacucacuuccaaagagcccugauauucauacugcucaccgcgguagcgcccuccaugaccaugcgaugcaucggaauaucgaaccgcgauuuuguagagggugugucaggaggcucauggguagacauaguccuagaacacgggagcuguguaacuacaauggcaaagaacaagccaacacucgacuucgaacuaaucaagacggaagcgaaacaaccugcuacacugcgcaaguacugcauagaggcuaaguugacaaacaccacaacggaaagcagaugucccacucagggagaaccaagucuaaaugaggagcaagauaaaagauucauauguaaacacucgaugguggacagagggugggggaacgguugugggcucuucggcaagggcgguauaguuacaugugccauguucaccugcaaaaagaacauggagggcaaagugguccugccagagaaccuagaauacaccauaguaauaacaccccauucuggcgaagaacacgccguggggaacgauaccggaaagcacggcaaagagauaaagauaacgccgcaaagcagcauaacagaagcggaacugaccggcuacggcacuguaaccauggaaugcucgccgagaaccggauuagauuucaacgaaaugguccuucuucaaauggaagacaaagcguggcuaguucaucgccagugguuccuagaccucccucuaccauggcuacccggcgccgauacacagggaucgaacuggauccaaaaagaaacacuaguuacauucaaaaacccgcaugcaaagaaacaggacgugguaguauuaggaucacaggagggcgcuaugcacacagcacuuacgggcgcaacggaaauacaaaugucaucaggaaaucucuuauucaccgggcacuuaaaauguagacuacgcauggacaaacugcaauugaaagggaugucuuacucuaugugcacggggaaauuuaaaauagugaaggaaaucgccgagacacaacacgguacuauagugauccggguccaauacgaaggggacggcagccccugcaagauaccuuuugagaucauggacuuggagaagagacacguacugggacggcuaauuaccgucaauccgaucgucacagagaaggacucgcccgucaacaucgaggccgaaccgcccuucggcgauagcuacauaauaauuggaguugaacccggccaacugaagcugaacugguuuaagaagggaucuuccauugggcaaauguucgagacgaccaugcggggagcgaaacgaauggccauacugggggauacagcaugggauuucggcagccuagguggaguauuuacgucaaucggcaaagcacugcaccaagucuucggggcuaucuacggggcggcauucagcggaguaucauggacgaugaagauacugaucggcguaauaauaacuuggaucgggaugaauaguagaagcaccucacuuucggugucguuagugcugguugguguaguaacacucuaucucggagucauggugcaagccgacacugggugcguaguaagcuggaaaaauaaggaguugaagugcggcagcggcauuuucaucacugauaacguacauacguggaccgagcaauacaaauuccaaccagaaagcccgaguaaacuagcaagugccauccaaaaagcccaugaagaggggaucuguggcauaagaagcguaacccgccucgagaauuuaauguggaaacagauuacccccgagcucaaccacauucugagcgaaaacgaagucaaacuaaccauaaugacaggugauauaaaaggaaucaugcaggcgggcaaacggagccuaaggccccaaccaaccgaacugaaguacaguuggaaaacguggggcaaagcaaaaauguuaagcacagagucacacaaccaaacguuucucauagacgggccggaaacggcggaauguccaaacacaaacagggccuggaauucccuggaggucgaagacuacggcuucggaguuuucagcacgaacauuuggcucaaacugcgggaaaaacaagacguauucugcgacucaaaguugaugagcgcugccauuaaagauaacagggccguccacgccgauaugggauacuggaucgaaucagcauuaaacgauacauggaaaauggagaaagcaucguuuauagaaauaaaauccugucauuggccuaagagccauacacucuggucgaacgggguccuagaaucagagaugauaauaccgaaaaacuucgcgggccccguuucgcagcacaauuaucgaccgggcuaccacacucagaccgcuggaccguggcaucucggcaaauuggaaauggacuucgacuuuugcgaggggacaaccguaguggugacagaggacugcggcaaccguggaccuucacugaggaccacaacagccucggguaagcuaauaacagaaugguguugccgaagcuguacacugcccccgcuccgauaccggggggaagacgggugcugguacggcauggaaauccggccacuaaaggaaaaggaggagaaccucgugaacucccuugugacagcggggcacggccagauagacaauuucucccuagggguccuaggaauggcgcucuuucucgaagagaugcuccggacuagaguagggacgaaacaugcaauucuacucguagccgucuccuucguuacguugauaacugguaauaugucauuuagagaccuggggcgcguuaugguaaugguuggcgccacgaugacagacgacauuggaauggggguaaccuaccuagcacuccuagcggccuucaaggugcgacccacuuucgcagcaggucuccuacucagaaagcucaccuccaaagaacuuaugauggcaaccauagguaucgcacuucugagccagucaaccauuccagaaaccauccuggaacuaaccgaugcacuagcacucggaaugaugguucuaaagauuguaagaaauauggaaaaguaccaacucgccguaacuauaauggcuaucagcugcgucccaaacgcggucauacugcaaaaugcuuggaaggugucaugcacaauccuagcggcaguaucgguaagcccccuacuacuaacgucaucacaacagaaggcagauuggauaccacuugcucuaacaauuaaaggauugaacccaacagcaauuuuccucacuacacucucucguaccucaaaaaaacgcucguggccacuaaacgaagcggugauggcggucgguauggugagcauucuagcguccagcuuacuaaagaaugacauaccgaugaccggacccuuagucgcaggaggccuucugacgguuugcuacguauuaacgggacggucugcugaucuugaguuggaacgcgcggccgacguaaaaugggaggaccaagccgagauaaguggguccagcccaauucuuagcaucaccauauccgaggacgggagcauguccauaaagaacgaagaagaagagcauacauuaacaauacuaauacggacaggacugcucgucauuuccggaguguuccccgucucuaucccaauaaccgcugcggcaugguaucuuugggaagucaagaagcaacgagcgggaguccucugggacgucccgucuccaccccccguggguaaagcggaacuggaagacggggcguaccgaauaaagcaacggggaauauucggguauagccaaaucggagcagggguauacaaggagggcacauuccacaccauguggcaugugacccguggagcaguccuaaugcauagaggaaaacggaucgaacccuccugggcagacgucaaaaaggaccugaucagcuacggaggagguuggaagcuagagggcgaguggaaagagggcgaggaggugcaaguacuagcguuggaaccaggcaagaaccccagggcagugcagacgaaacccggccucuucaagacuaacacaggaacaaucggggcaguaucacuggauuuuucuccaggcaccagcggaaguccaaucguagaucgaaaggggaaggucguaggacuauaugggaauggaguggucacgcgaucaggugccuacgucagcgccauugcccagaccgaaaagaguauagaagacaauccugagauagaagacgacauauuccggaaaaaaagauugacaaucauggaccuacauccaggugcagggaaaacaaagcgauaccuccccgcaaucguacgcgaagcaaucaaaagagggcuacgaacccuaauacucgccccgacccgcgugguggcagcagaaauggaagaagcgcuccgugggcuccccauaagguaucagacucccgcaaucagggcggaacacaccggccgagaaaucgucgaucugaugugccacgcaacguucaccaugcggcuauuauccccgguaagagucccgaacuacaaucucauuauaauggacgaagcccacuuuaccgaucccgcgucaauagcggccaggggauacauuuccaccagagucgagaugggagaggccgcgggaauauucaugacagcgacgccaccagguucacgcgacccguucccucagucgaacgcacccauaauggacgaagaaagggaaauaccagagaggagcuggaauucgggacacgaguggguaacugacuucaaaggcaagacggucugguucguuccaaguaucaaagcuggaaacgacaucgcagcgugucuccguaaaaauggcaaaaagguaauccaacucucucgaaaaaccuucgauagcgaauaugugaagacgcgggcgaacgacugggauuuuguagucacaacagacauauccgaaaugggcgcaaacuucagagcagagagagugaucgacccaaggcgaugcaugaagccggucauccucacggacggugaagaacgaguuauccuggcaggccccaugcccgugacccacagcagcgcagcucaacgcagggggcgaauugggcgcaauccgaaaaacgaaaacgaccaauacauauacaugggggaaccgcuagagaaugacgaagacugcgcgcacuggaaagaagcgaaaaugcuacuagacaacauaaauacgccggaaggcauuauaccguccauguuugaaccagaacgagagaaaguagacgcaauugacggugaguacaggcuacguggggaagcccgcaaaacuuuuguggaccugaugagacgcggcgaccugccaguuuggcuggcauaccguguugcagcagaagguauaaauuaugcagaccggcgauggugcuucgaugggaucaaaaacaaucaaauacuagaggaaaacgucgagguugaaaucuggacuaaagaaggcgaaaggaaaaaacuaaaaccgagauggcucgacgcccgaauuuacagcgauccgcucgcacuaaaggaguucaaagaauucgcggcgggccggaagagccuaacgcucaaccucauuacagaaaugggacgccucccaacauucaugacgcagaaagcgagagacgcacucgauaaucuugccgucuuacacacagccgaagucgguggucgcgcauauaaccacgcacuuucagaacuacccgagacgcucgagacccuauuauuacuuaccuugcucgcaacaguaaccgggggcaucuuccuauuucuaauguccggaaagggaauugguaaaaugacccucgggaugugcugcaucauaaccgccucaauucuccuaugguacgcccagauccaaccgcauuggaucgccgccagcauaauccuggaguucuucuugaucguauugcuuauacccgaacccgagaaacagagaacuccgcaggacaaccaacuaaccuacguaguaauagcgauacuaacggugguggccgcaacgauggccaacgagaugggauuccucgagaaaaccaagaaggaccucggauuaggaucaaucaccacucaggagucggagagcaacauacucgauauagaucuaagaccagcuagcgcguggacacuauacgcgguggcaacuaccuucgugaccccuauguuaagacacucaaucgaaaacucaucgguuaaugucagccucacagcgaucgccaaccaagcgaccguacuaaugggauuaggucgcgguuggccacugucaaagauggacauuggcguaccacugcuugcgauuggaugcuacagccaaguaaacccgauaacgcuaaccgcagcgcuccuccuguuaguggcacacuaugcaaucaucgggccaggacugcaggcaaaagcaacaagggaggcccagaagcgcacugccgcugggauaaugaaaaacccaacaguagacggcauuacugucaucgaccucgaaccaauccccuacgacccaaaauucgagaaacaacuuggucaaguaaugcuccuaguacugugugucacgcaggucuuaaugaugcggacaacgugggcgcuaugcgaggcauugacgcuagcuaccgggcccauaucgacguuaugggaggggaacccagggcgcuucuggaacacgacgauagcgguaucuauggcgaacauauuccgcggguccuaccuggccggggccggacugcuauucucgauaaugaaaaacaccacaaacacgaggagaggcacggggaacauaggugaaacgcugggagagaaauggaaaaguagauuaaacgcgcuaggaaaaagcgaguuccagauauauaaaaaauccgguauacaggaaguugaccgcacccuugcaaaagaaggcaucaagcgcggagagaccgaccaccacgcagugucaagggggucagccaagcucaggugguucguagagcgcaacaugguaacuccggaggggaaaguaguagaccucggcugcggaagaggcggcuggagcuacuacuguggcggacugaaaaaugugcgugaggucaaggggcucacaaagggaggcccuggucacgaagaacccauccccaugucaaccuauggguggaaucuaguacgccuucaaucaggcguggacguauuuuucacgccgccggaaaagugcgauacccuccucugcgacauuggggagagcaguccaaacccaacgauugaggcgggacgcacgcugcgggugcuaaaccucguagaaaauuggcucaacaacaacacgcaauucugcgucaaaguauuaaacccauauaugcccuccguuauagagaaaauggagaccuuacagcguaaauacgggggagcgcugguaagaaacccccucagccgaaacucgacgcaugaaauguacugggugucgaaugcaacuggcaacauagugaguucaguaaacaugaucucgcggauguuaauuaacagauucacgaugaagcacaagaaagcaaccuaugaaccggacguugaucugggaagcgguacccgcaacaucggaauagaaaaugagauuccgaaccucgauaucaucggaaaaagaauugaaaagauuaaacaagagcacgagaccaguuggcauuacgaccaagaccaccccuacaaaacuugggcauaccacggaucauacgagacaaaacaaacgggcucugcgagcagcauggucaacgggguagucaaacuccuaaccaaacccugggacgucgugcccaugguuacacaaauggcgaugacagauacgacgcccuuugggcaacaaagaguguucaaggagaaggucgauacccgcacucaggagcccaaagaaggaaccaagaagcucaugagaauaacagccgaauggcuauggaaagaacuggggaagaaaaagacgccaagaaugugcacaagggaagaauucacuagaaaagugagaagcaaugcagcacuaggggccauauucacggacgagaacaaauggaaaucugcgcgcgaggcuguagaggauagucgguuuugggaguugguggaccgggaaaggaacuuacaccucgaaggaaaaugcgaaacuugcguguacaauaugaugggcaagcgagaaaaaaaacugggggaguucggcaaagcaaaagggagcagggccauaugguacauguggcuaggcgcacgguuccucgaauucgaagcccucggcuuccuaaacgaggaccacugguucagcaggggaaacucgcuauccggagucgagggagagggccuucauaaauuggguuauauacuccgugacgugagcaagaaagaggguggcacgauguacgccgacgauaccgcgggcugggacacccgcauaacguuagaggaccucaagaaugaagaaauggugacuaaccacaugaaaggcgagcauaagaaacuggccgaggcgauauucaaguugacauaccaaaacaagguagugaggguacaaaggccgacgcccaggggaacagugauggauauaaucagccgcaaagaccagagaggaagcgggcaagugggaacauacgggcuaaacacguucacaaacauggaagcccagcugauacgccagauggagggagagggcauauucaaaagcauccagagacucacagucacggaagaaauagccgugcagaauuggcuugcccggguaggacgcgagagacugucaagaauggcaauuucaggggaugacugcguggugaaaccucucgacgaucgcuucgcgagcgcguuaacagcgcuaaacgacauggggaaagugcgcaaagacauccaacaaugggagccgagccgaggcuggaaugacuggacccaggucccuuucugcucacaccacuuucaugaacuagugaugaaggacggcagaguacucguagugccgugccguaaccaagaugaacucauaggcagagcacggauaagccagggcgcgggcuggucacuaaaagaaacagcgugccugggaaaaucuuacgcccaaauguggacacuaauguacuuccacagacgagaccuaagacuagcagcaaacgccaucugcagcgcgguaccaucucauugggugccaacaagccgaacgacguggucaauucacgcuaaacacgaguggaugacgacagaggacaugcuggccgucuggaaccgggucuggauacaagaaaauccuuggauggaagauaagacgccaguggaaagcugggaagaaguaccauaucuuggcaaaagagaggaccaauggugcgguagccugauaggccugaccucccgagccacaugggcgaaaaacauccaaaccgcaauaaaucaaguacgaucacuuaucggcaacgaggaauacacggacuauaugcccagcaugaagagguuccgaaaagaggaagaagaagcgggagugcuaugguag

SEQ ID NO: 25227 - RNA, 9876 nt, Artificial Sequence
  derived and/or modified CDS sequence (opt11) from DENV-2__EU781135__SS-prME
accgccgguguaaucaucaugcucauccccacagccauggcguuccaccucacuacacgcaauggggaaccccauaugaucgucgggaggcaggagaaagggaaaucccugcuuuucaagaccgaggacggaguuaacaugugcaccuugauggcgauugaccugggugagcugugcgaggacaccauuaccuauaaaugcccucucuugcgccagaacgagcccgaggacaucgacugcuggugcaauucuacauccacgugggugaccuacggcaccuguacaacuacgggcgagcaccggcgcgagaagagaucugucgcccuggugccccauguagggaugggcuuagaaacucggaccgagaccuggaugagcucagagggggccuggaagcauguccagcgaaucgaaaccuggauccugcgccauccgggguucaccaucauggcggcgauacuugcauauacuaucgggaccacucacuuccagcgggcccugaucuucaucuuauuaacagccguggcgcccagcaugacaaugagaugcaucggcaucucuaaccgggauuucguagaggggguaagcggggguuccuggguggacaucgugcucgagcacgggagcugcgucacaacgauggcgaagaacaagcccacccuggauuucgagcucaucaagacugaggccaagcaacccgcuacccuccguaaguacuguaucgaggccaaacugacgaacaccaccaccgaaucccggugcccaacgcaaggcgagcccagccugaaugaggagcaggacaaacgcuuuauuugcaagcacagcaugguagacaggggcugggguaacggcugcggccuguuuggaaagggcgggauugugaccugugcgauguucacgugcaagaagaacauggagggaaaggucguccugccagagaaccucgaguacaccauagugauuacgccucacagcggcgaggagcacgcagucggcaaugacaccgggaagcacggcaaagagaucaaaaucacaccgcaguccaguaucaccgaggcggagcucaccggguacggcacggugaccauggaaugcucuccccguaccggccuggauuucaacgagauggugcugcuccagauggaggacaaggccugguugguccaccggcagugguuucucgacuugcccuuacccuggcugccgggggccgauacccagggcagcaacuggauucagaaagagacucucgugaccuucaagaacccccacgcgaagaagcaggacguagucgugcuggguucucaggagggcgccaugcacaccgcccugacaggggcgacggagauccagaugagcuccggaaaccuccuguucaccggccaccugaagugccgccuccggauggauaagcuacagcugaaggggauguccuauagcaugugcaccggcaaauucaagaucgucaaagagaucgcagagacgcagcaugguacgaucgugauucgcgugcaguacgagggcgacggcucgcccugcaagauccccuucgaaaucauggaccucgaaaagaggcacguccugggccguuugaucaccgugaacccgaucguuaccgaaaaggacagcccagucaacaucgaggcggagccgcccuucggggacuccuacauuaucaucggugucgagccuggccagcucaagcucaacugguucaagaaagggaguuccaucggccaaauguucgagaccacgaugagaggcgccaagaggauggcaauauugggagauaccgccugggacuucgggagccuaggagggguauuuacguccaucgguaaggcguuacaucaagucuuuggcgcgaucuauggcgcggccuucagcgggguguccuggaccaugaagauccuuaucggcgugauaaucacguggaucgguaugaacucacgcuccaccagcuuguccgucagccuagugcuugugggcgucgugacccuauaccucggugugaugguccaggccgauaccggcugcguugugaguuggaaaaauaaagagcugaagugcggcucuggcaucuucauuacggacaacguccacaccuggacagagcaguacaaguuucagcccgaauccccuagcaaguuggcgagcgccauccagaaagcucacgaggagggcaucugcgggauccggucagugacacgcuuggagaacuugauguggaaacagauaacgcccgaguuaaaucauauccucagcgagaacgaagugaaguugaccauaaugacuggcgacaucaaggguaucaugcaagccgggaagcggagucugcgcccccagcccaccgaauugaaguacagcuggaagacgugggggaaagcaaagaugcugagcaccgagagucacaaccagaccuuccuuaucgacgggcccgaaaccgcggaaugcccgaauacgaaucgggccuggaacucccucgaggucgaggacuacggauuugggguguucagcacuaauauauggcugaagcugcgggagaagcaggacguguucugcgacuccaagcucaugagcgcggcaaucaaggacaacagggcuguucacgcggacaugggguacuggaucgagucugcauugaacgauaccuggaagauggaaaaggccucauucaucgaaaucaaguccugucauuggccaaagagccacacccuauggaguaauggaguucuagaaagugagaugaucauccccaagaacuuugccgggccuguaagucagcacaacuaccgcccgggcuaccacacgcagacggccgggccauggcaccugggcaagcuggaaauggacuucgacuucugcgaggggacuaccguagucguaacagaggauuguggcaacagaggccccagccuccggacgaccaccgcuagugggaagcugaucaccgaguggugcugccggaguugcacgcugccaccccucagguaccggggcgaggauggguguugguacggcauggagauacgcccccuaaaggaaaaggaagagaacuugguuaacagccucgucaccgccgggcacgggcagaucgacaacuucagccucggcgugcugggcauggcccucuuccuggaggagaugcugcggacccgagucggcaccaagcacgccauccuccuggucgcgguuucauucgucacgcugaucaccgggaacauguccuuucgggauuugggccgcgugauggugauggucggggccacaaugaccgacgauaucgggaugggcgugacguacuuagcccugcuggccgcguucaaggugcgccccaccuucgcugcggggcuccugcuccgcaaacuuaccagcaaggagcugaugauggccacuaucgguaucgcccuccugucacagagcacgauccccgagaccauccuggagcucaccgacgcacuugcacuggggaugauggugcucaagaucgugcgcaacauggagaaauaccagcuggccgugaccaucauggccaucuccuguguaccgaacgccgugauucugcagaacgccuggaaggugagcugcacgauucucgcggccgucagcgugucgccccugcugcucaccucuucccaacagaaggcggacuggaucccgcuggcacugaccaucaagggccucaaccccaccgcgaucuuucuaacgacccugagucggaccagcaagaagagauccuggccguuaaacgaggcgaucauggcggucgguauggugucaauccuggcgucgagucuacucaagaacgacauccccaugacugggccguugguagcgggugggcugcucacugucugcuacguacugaccgguagaagcgcggaccuagagcucgagcgugccgcggacgucaagugggaggaccaagccgagaucuccggaagcagcccuauacugucgauuacuaucuccgaggacggcagcaugucuaucaagaacgaagaggaggagcacacucuaacuauccucauccguacuggacuuuuggucaucagcggaguguucccgguuucaauaccuauuaccgccgcggcgugguaccucugggaggucaagaaacaacgcgccggcgugcugugggacgugcccagucccccucccguagggaaggccgagcuggaagacggcgccuaucgcaucaagcagcgcgguauauucggcuacucccaaauaggcgcggggguuuauaaagagggcaccuuccacaccauguggcacgucacccgaggggccguccuuaugcaccgcggcaaacgaauagagcccagcugggccgacgugaagaaggaccugauuuccuacgggggcggauggaagcuggagggagaguggaaagagggcgaagaggugcagguccucgcacuggagccagguaagaacccccgcgccguucagaccaagcccggccuguucaagaccaacaccgguacgaucggugcgguuucgcucgacuucucacccgguaccagcgguuccccgaucgucgaccgcaagggcaagguuguagggcuguacggcaacggcguagugacccgcucaggagcguacgucuccgccaucgcccagaccgagaaguccaucgaagacaaccccgaaaucgaggacgauauauucaggaagaagcggcugacgaucauggaucugcacccaggagcggggaagacgaagcgguaccugcccgcuaucguccgggaggccaucaaacggggccugcguacucugauacuagccccgaccagagugguugcugccgagauggaggaggcccugagggggcugcccauccgcuaccagacgcccgcgauccgggccgagcacacuggccgcgaaaucgucgauuuaaugugccacgccacuuucacgaugcgccuacuuagcccgguaagggugccgaacuauaaucucauuaucauggacgaggcgcacuucacggaccccgccuccaucgccgcacgggguuauauauccacacgcgucgaaaugggggaagcggcgggaaucuuuaugaccgccacgccgcccggauccagagacccguucccccagagcaacgcccccaucauggacgaggaacgcgaaauaccugagcggucuuggaacagcgggcaugagugggugacggauuucaaggggaagacugucugguuugucccguccauaaaggccggaaacgacauugcggccugccuacggaaaaacggcaagaaggugauccagcuaucucggaagaccuuugacuccgaguacguaaagacccgcgccaacgauugggauuucgucguuacgaccgacaucagcgagaugggggccaacuuucgggcugagaggguaaucgacccacggcgcugcaugaaaccggucauacucaccgacggugaggagcgggucauacuggcggggcccaugccggugacccacuccucugccgcacagaggcgcggccggaucgggcgcaaccccaagaacgagaacgaccaguacaucuacaugggcgagccccuggagaacgacgaggacugcgcucacuggaaggaggccaagaugcuccucgacaacaucaacacccccgagggcauaaucccguccauguucgagccggagcgggagaaagucgacgcgaucgacggggaguaccgucugagaggcgaggcccgaaagacguucguagaucugaugcggagaggggacuuaccuguauggcuggccuacagagucgccgccgagggcauaaacuacgcggaccgccguuggugcuucgacgguaucaagaacaaucagauacucgaggagaacguagaaguggagaucuggacgaaggagggcgagcgcaagaagcucaagccgcgauggcuggacgcucgcaucuacagcgacccccucgcccugaaagaguucaaggaguucgccgcgggccgaaagucccugacgcucaaccuuaucacggagauggggcgccuaccuaccuucaugacccagaaagcccgggaugcccucgacaaccuggcuguccuccacacugcagagguuggcgggcgcgcguacaaccaugcccuuagcgagcugcccgagacacuggagacccuccuguuacucacccugcuggccaccguaaccgguggaaucuuucucuuccugaugucuggcaagggcaucgggaaaaugacccucgggaugugcuguaucaucaccgccagcauccuacugugguacgcccagauccagccgcacuggaucgcggcuucgauaauccuggaguucuuucucauuguguuacugaucccggagcccgagaagcaacggacgccccaggacaaucagcucaccuacguggucaucgccauccugacggugguggccgcuacaauggcuaaugaaaugggguuccuggagaagaccaagaaagaccucggccugggcucuaucaccacccaggagagcgaguccaauauccuagacauugaccuccgcccggcuagcgccuggacucuguacgccguugcuaccaccuucguuacgcccaugcugcggcacuccauugaaaacucuagugugaacgucagccuuaccgcgaucgcaaaucaggccacuguauuaaugggccugggcagaggguggccccucuccaagauggacauaggcgugcccuuacucgcuauaggguguuacagccaggucaauccgaucacccucacggcggccuugcugcucuugguggcccacuacgcgaucauaggccccggacugcaagccaaggcgacccgggaggcccagaaacggaccgcagcagggaucaugaagaacccaaccguggaugggaucacggucauugaccucgagcccauaccuuacgacccgaaguucgagaagcagcugggacaggucauguuacucguccucugcgucacccagguucugaugaugcgcaccaccugggccuuaugcgaggcccugacucuagccaccgggcccaucucaaccuugugggaggggaacccggggcguuucuggaauaccacgauugccgugucgauggcuaacaucuuccgcggauccuaccuggccggggcgggguuacucuucagcauaaugaagaacaccaccaacacccggagagggacugguaacauuggcgagacccugggggagaaguggaagucgcggcucaacgccuugggcaagucagaguuccagaucuauaagaaauccgggauccaggagguugaccgaacuuuggccaaggagggcaucaaacguggggagaccgaccaccacgccgucagccgcggauccgcgaagcugcgaugguucguggagcgcaacauggucacgccagaaggcaagguuguagacuuaggguguggccggggcggguggagcuacuacugcgggggccugaagaacgucagggaggugaaggggcuuaccaagggugggcccgggcacgaggagcccaucccaauguccaccuauggcuggaaccucguccggcuacagucaggggucgacguguuuuucacgccgcccgagaaaugugacacgcugcuuugcgacaucggcgaauccaguccgaaccccaccaucgaggcuggccgcacccuacgggugcugaaccucgucgagaacuggcugaauaacaacacucaauucugcgugaaggugcugaacccguacaugcccagcgucaucgagaagauggagacccuucagaggaaguacgguggcgcccuuguacggaacccacugucacguaacagcacgcacgagauguacuggguaaguaacgcaaccgggaauauuguaagcuccgugaauaugaucagccguaugcuuauaaacagauucacaaugaaacacaaaaaggccaccuacgagccagacguggaucucggcuccgggacccgcaacaucggcaucgagaaugaaauccccaaccuggacaucauuggcaagcguaucgaaaagaucaaacaggagcacgagacgagcuggcacuaugaccaggaucaucccuacaagaccugggccuaccacggguccuacgaaacgaaacagacggguagcgccuccagcauggugaacgggguugugaaacugcucaccaagcccugggacgucgugccgauggugacucagauggcaaugaccgauaccacucccuucggucaacagcgcgucuucaaggagaagguggauacccggacccaggagccuaaggaaggcaccaagaagcucaugcguaucaccgcugaguggcuguggaaggagcucgggaaaaagaaaacuccccggaugugcacccgggaagaguucacacggaaggugcgcuccaacgccgcgcucggugccaucuucaccgacgagaauaaauggaaguccgcccgggaagcugucgaagauucccgcuucugggagcuggucgaccgggagcggaaccuccaccuggagggaaaaugcgagaccugcgucuacaacaugaugggcaagcgggaaaagaaguuaggggaguucggcaaggcaaagggaucacgcgcgaucugguacauguggcucggcgcccgguuccuggaguucgaagcgcugggcuuccuuaacgaggaccacugguucucacgagggaacagccugagcggcguugaaggcgaggguuuacacaagcucggcuacauccugcgggacguguccaagaaggagggcggggcaauguacgcggacgacaccgcagggugggacacgcgcaucacccuggaagaccucaagaacgaggagauggucaccaaucacaugaagggcgagcacaagaaacuggccgaggccaucuucaagcugaccuaccagaacaagguggugcgcguacagcgccccacgccaagggggaccgugauggacaucaucagucggaaggaccagagagguaguggccagguggggaccuacggcuuaaacacauuuacaaacauggaggcgcagcuaauccgacagauggagggagagggcauauuuaaaucgauacagagacugacugucaccgaagaaauagcgguacagaauugguuggcucggguuggcagagagcggcugucccgcauggccaucagcggggacgacugugucgugaagccccuggaugaucgcuucgcauccgcccucaccgcgcucaacgacaugggcaaaguccgcaaggacauucagcagugggagcccucccggggcuggaaugacuggacgcagguuccuuucuguucccaccauuuccacgaguuagugaugaaggauggccgcgugcucguggugcccugccggaaccaggaugagcugauugggcgcgcccggaucucacagggggcagguuggucgcugaaagaaaccgcgugcuugggcaaaagcuacgcccagauguggacccugauguauuuccaccgccgggaucugcgcuuagcggcaaacgccaucugcuccgccgugccgagccacuggguccccaccucccggaccacguggagcauccaugcaaagcaugaguggaugaccacagaggacaugcuggcuguguggaaccgcguguggauccaggagaauccauggauggaggacaaaacccccguugagagcugggaggaagugcccuaccuuggcaagcgcgaggaccaguggugcgggagccucaucgggcucacgucucgggcaacaugggcaaagaacauccagacggccaucaaccaaguacgcucacugaucgggaacgaagaguacaccgacuacaugccaucaaugaagcgguuccgaaaagaggaggaggaagcggggguccucugguga

SEQ ID NO: 25228 - RNA, 9876 nt, Artificial Sequence
  derived and/or modified CDS sequence (opt11) from DENV-2__EU687222__SS-prME
accgccggcgugaucaucaugcugauccccaccgccauggcguuccaccucaccacccgcaacggggagccccacaugaucgucggccggcaagagaaggggaagucccugcucuucaagaccgaggacggcguuaacauguguacccucauggccaucgaccugggggagcugugcgaggacacgaucaccuacaaaugcccccucuugcggcagaacgagccggaggacaucgacugcuggugcaacagcaccucuaccugggugaccuacgggacaugcaccaccacuggagaacaccggcgcgagaagcgguccgucgcccuggugccccacguggggaugggccucgagacccgcacagagaccuggaugagcagugagggggccuggaagcacguccagaggaucgaaaccuggauccugcgccacccgggcuucaccaucauggccgcgauccuggccuacaccauugggaccacgcacuuccagcgggcacucaucuucauccugcugaccgcaguggcgccuuccaugaccaugcgcugcaucggcaucuccaaccgagacuucguggagggcgucagcgggggcuccuggguggacaucgugcucgagcacgggagcugcgucaccacgauggccaagaauaagcccacccuggauuucgaacugaucaagaccgaggccaagcagcccgccacccuacgcaaguacugcaucgaagcgaagcuuacgaauacaaccaccgagucccggugcccgacccagggcgagccgagccugaacgaggagcaggacaagcgcuuuaucugcaagcauaguaugguggaccggggcugggggaacggcugcggccuguuuggcaagggcggcaucgugaccugcgcuauguucacgugcaagaagaacauggagggcaaggucgugcugcccgagaaccuggaguacaccauagugaucacgccccacagcggggaggagcacgcugucggaaacgacaccgggaaacacgggaaggaaaucaagaucacuccgcaauccagcaucaccgaggccgagcucacgggguacggcacggugaccauggagugcagcccgcggaccgggcuggacuucaacgagauggugcuuuuacagauggaggacaaggccuggcugguucaccggcaaugguucuuggaccucccccugcccuggcuaccgggggccgacacccagggcagcaacuggauacaaaaggagacgcucgugacuuucaagaacccccacgccaagaagcaggacguagucgugcuggggucccaggagggcgccaugcacaccgcccugaccggggcgacggagauccagaugagcagcggcaaccuacuauuuacaggccaccugaagugcaggcuucggauggacaagcugcagcuuaaggggauguccuacagcaugugcacggguaaguuuaagaucgucaaggagaucgccgagacccagcacgggacgaucgugauucgcgugcaguacgagggcgacggcucccccugcaagauucccuucgagaucauggaccucgagaagcggcacguccuggggcgcuugauaaccgucaacccgaucgugaccgaaaaggacagcccugucaacauugaggcggagccgcccuucggcgacuccuauaucaucaucgggguugagccgggacaacuuaaacugaacugguucaagaaggggagcuccaucggccaaauguucgagaccacgaugcgaggcgccaagcggauggccauccugggggauacugcaugggacuucggcucucucgggggcguguucacauccaucgggaaggcccugcaccaggucuucggcgcuaucuacggcgccgccuucagcgggguguccuggaccaugaagauccuaaucggcgugauuaucacguggauaggaaugaacagccgcuccaccagccucuccgucagccucgugcuggugggcguugugacccuguaccucggugucaugguccaggccgacuccggcuguguagugagcuggaagaacaaggagcugaagugcggcuccgggaucuucaucaccgacaacguccacacguggaccgagcaguacaaauuccagcccgagagcccaagcaagcuggcguccgccauccaaaaagcacaugaagagggcaucugcgguauacggagcgugacccgccuagagaaccugauguggaaacagaucacccccgagcugaaccacauacucuccgagaacgaggugaagcugacgaucaugacuggcgacaucaaggggaucaugcaagcgggcaagagaucccugagaccgcaacccaccgagcucaaauacuccuggaaaacauggggcaaggccaagaugcugagcaccgagucccacaaccagacguuccugaucgaugggccagagacggcugagugcccgaacaccaaccgggccuggaacagccucgagguugaggacuacggauucggggucuuuuccacgaacaucuggcugaaacugcgcgagaagcaggacguguucugcgacucaaaacucauguccgccgccaucaaagacaaccgggccguccacgcggacaugggcuacuggaucgagagcgccuuaaaugacaccuggaagauggagaaggcuaguuuuaucgagaucaaaagcugccacuggcccaagucccacacccuguggagcaacggcgugcucgagagcgagaugaucauccccaagaacuucgccgggcccguuucgcagcacaacuaccguccgggcuaucacacccagaccgccgggcccuggcaccugggcaagcuggagauggauuucgacuucugcgaggggaccaccgucguggugaccgaagauugcgggaaccggggccccagccuaagaaccacgaccgcguccgggaagcugaucacugaguggugcugccggagcugcacccugcccccgcuccgcuaccggggcgaggacgggugcugguacggcauggagauucgaccccugaaggagaaggaggagaaccuggucaauucccucgugacggccgggcacggccagauagacaauuucagccugggggugcuggggauggccuuauuccuggaggagaugcugcggacccgcgucggcaccaagcacgccauccuccuaguggcgguguccuucgucacccugaucacggggaacaugagcuuucgggaccucggacgcguaauggugauggucggugccaccaugaccgacgacaucggcaugggcguaacguaccuagccuuacucgccgccuucaaggugcggcccacguucgcggccgggcuguugcuccggaaacugaccuccaaggaguuaaugauggccaccaucggcaucgcccuccugagucaguccaccauucccgagacgauccucgagcucaccgacgccuuggcgcuggggaugaugguucucaagaucgugcgcaacauggagaaauaccagcucgccgugacuaucauggcuaucagcugcguaccuaacgccgugauccugcagaacgccuggaagguguccugcaccauacucgcggccguaagcgugagcccccuacugcucacgagcucccagcagaaggccgacuggaucccccuggcccucaccaucaaggggcucaaccccaccgcgaucuuccugaccacgcugucccggaccuccaagaagagaagcuggccgcucaacgaggccgucauggcagugggcauggugagcauccuggccucuagccugcucaagaacgacauccccaugacugggccacuggucgccggcgggcugcuuaccgucugcuacguguugacgggacggucugcggaucuggagcuugagcgcgccgcugacgucaagugggaggaccaagccgagaucagcggguccagccccauccuguccaucaccaucagcgaggacggcucaaugagcaucaagaacgaagaggaggagcauacccugaccauccucauccgaacgggccugcucguaaucuccgggguguucccgguaagcaucccaaucaccgccgcggccugguaccucugggaagugaagaagcaacgcgccggcgugcugugggacguccccagcccgccgcccgugggaaaggccgagcuggaggauggcgccuacagaaucaagcagcgcgggaucuucggcuacagccagaucggggcagggguguacaaggagggcaccuuccacacaauguggcacgucacccgcggggcggugcucaugcaccgaggcaaacggaucgagcccuccugggcugacgugaagaaggaucugaucucauacgggggcgguuggaagcuggagggggaguggaaggagggcgaggagguccaggugcucgcacuggagcccgggaaaaacccccgcgccgugcagacgaagcccggccuguucaagaccaacaccgggaccauaggcgcggugucccucgacuucucacccggcacguccggguccccaauuguagaccgcaagggcaagguggucgggcuguacggcaacggcguggugacccgcuccggagccuacgucucugccauagcccagaccgagaaguccaucgaggacaaccccgagaucgaggacgauaucuuccggaagaagcgccugacuaucauggaccuccacccuggggcggggaagacgaagcguuaccuucccgccauagugcgcgaggcaaucaagcgaggucugcgcacccugauucucgccccgacccgcguggucgccgcggagauggaggaagcccuccgggggcugcccauccgcuaccagacgcccgccauccgggccgagcacacgggccgcgagaucguggaccucaugugccacgccacguucaccaugagacugcugucccccgucagggucccgaacuacaaccucaucaucauggacgaggcgcacuucaccgaucccgccaguauagccgcccggggcuacaucuccacgcgcguggagaugggggaggccgcgggcaucuucaugaccgcgacgccgcccgggucacgggacccguucccccaguccaacgcacccaucauggacgaggagcgcgaaauccccgagcggaguuggaacagcggccacgagugggucaccgacuuuaaaggcaagacggucugguucgugcccagcaucaaggccggcaacgacaucgcggccugucuucgcaagaacggcaagaaggugauacagcugucccgcaaaaccuuugacucggaguacgucaagaccagggccaacgauugggacuucguugucaccaccgauaucagugagaugggggccaacuuccgggccgagcgcgucaucgacccccggcgcugcaugaagcccgugauccucaccgacggcgaagagcgggugauucuggcgggucccaugccggucacccacucuuccgccgcccagcgccgcggccguaucggacgcaaccccaagaaugagaaugaccaguacaucuacaugggcgaaccccuggagaacgaugaggauugcgcccacuggaaagaggcgaagaugcuccuggacaacaucaacaccccugagggcauaaucccgucuauguucgagcccgagcgggagaaagucgaugcgaucgacggggaguaucgccuccggggcgaggcgcgcaagacguuuguggaccucaugcgacgcggggaccugccaguguggcuggcuuacagaguggccgccgagggcaucaacuacgcggaccgccgguggugcuucgacgggaucaaaaauaaccagauucucgaggagaacguugaggucgagaucuggaccaaggagggugagcgcaagaagcugaagccgcgguggcuggacgcccgcaucuacuccgacccccucgcccugaaggaguucaaggaguucgccgccggccggaagucccugacgcucaaccugauaaccgagaugggccgccugccuacguucaugacgcagaaggcccgggacgcacucgacaaccuggccguguugcacaccgccgaggucggugggcgcgcauacaaccacgcccucucugaacuccccgagacccuggagacgcuccugcugcuuacccugcuggccaccgugaccggcggcaucuucuuauucuuaaugucugggaagggcaucgguaagaugacgcugggcaugugcugcaucaucaccgcauccaucuuguuaugguacgcccagauucagccgcacuggaucgcggccagcaucauccuggaguucuuccucauagugcugcugauccccgagcccgagaagcagcggacgccccaggacaaccaacucacguacgucgugaucgccauccugaccguggucgccgccacgauggcgaacgagaugggcuuccuggagaagaccaagaaggaccucggccugggcagcaucacgacccaggagucagagagcaacauucuggacauugaccuccgcccggccuccgccuggacgcuguaugccguggcaacuacguucgugacgcccaugcugcggcacagcauagagaacagcagcguuaacgugucccucacggcuaucgccaaccaggccaccguucugauggggcugggccgcggguggcccuugagcaagauggacaucggcgucccccugcucgccauugggugcuacucccaggugaacccgaucacccucaccgcggcccugcugcuccugguagcccacuacgccaucaucggaccaggccugcaggcuaaggcaacgcgcgaggcccaaaagcggaccgccgccggcaucaugaagaaccccaccgucgacggcauuaccgucauugaccucgagcccaucccguacgacccaaaguucgagaagcaacugggccagguaaugcugcucguacugugugugacacaagugcugaugaugcgcacaaccugggcccugugcgaagcccuaacucuggcuacaggccccauuagcacccucugggaggggaaucccgggcgguucuggaacaccaccaucgccgucuccauggccaauaucuucagaggaucguaccuggccggggcgggacuccucuucagcaucaugaagaacacgaccaacacccggcgcgggacgggcaacauaggcgagacgcugggagagaaguggaaguccagacuaaacgcccucggcaaaagcgaguuccagaucuacaagaaguccgggauccaggagguggaccgcacccuagccaaagagggcaucaaacgcggggagaccgaccaccacgccgugagucguggcagcgcgaagcugcggugguucguggagcgcaacauggugacaccggagggcaagguggucgaccucgggugcggccgcggcggguggucguacuacugcggugggcucaagaacgugcgcgaggugaagggguuaacgaagggcgggcccggacacgaggagcccauccccaugagcaccuacggcuggaaucucguccggcugcaaagcgggguggacguguucuucaccccgcccgagaagugcgauacccugcucugcgauaucggcgaguccagcccgaaccccacgaucgaggccggccgcacccugcggguccugaaccucguggagaacuggcugaacaacaacacccaguucugcauuaaagugcugaauccguauaugcccucugucaucgagaagauggagacccuccagcgcaaguacgggggugcccuggugaggaacccccucucccgcaacuccacucaugagauguacugggugagcaacgccacgggaaacaucgucuccagcguaaacaugaucucccgcaugcuaaucaaccgguucacaaugaagcacaagaaggcgaccuacgagccggacguggacuuaggcagcgggacucgcaacaucggcaucgagaaugagauccccaaccuggauaucaucggcaagcggaucgaaaagaucaagcaggagcacgagacgucguggcacuacgaccaggaccaccccuacaagaccugggcguaccacgggaguuacgaaaccaagcagaccggcuccgccagcuccaugguuaacgguguggugaagcugcucacgaagcccugggacgucgugccgauggugacccagauggccaugaccgacaccacgccuuucggccagcagcgcgucuucaaggagaagguggacacccgcacgcaggagcccaaggaggggacuaagaagcuuaugcgcaucacggccgaguggcuguggaaggaacucgggaagaagaaaacgccccggaugugcaccagagaggaguucacccggaaggugcgcagcaaugccgcgcugggcgccaucuucacugaugagaacaaauggaaguccgcacgagaggccguggaggacagccgcuucugggagcugguggaccgcgagcgcaaccuccaucuagaggggaagugcgagacaugugucuauaacaugaugggcaagcgggagaagaagcugggggaguucggcaaggcgaagggcucucgagcgaucugguacauguggcucggugcccgguuccuggaguucgaggcccugggcuucuuaaacgaggaccacugguucucccgcggcaacagccuguccggcguggagggagagggccugcacaaguuaggcuacauccugcgggacgugagcaagaaggagggcggugccauguacgccgacgacaccgccgggugggacacccgcaucacgcuggaggaccucaagaacgaggagauggucacaaaccauaugaagggcgagcacaagaagcuggccgaggccauauucaagcugaccuaccagaacaagguggugcguguccagcgcccaacgccacgggggacggugauggacaucaucucccgaaaggaucagcgcggcagcggccagguggggaccuacggucucaacacguucaccaacauggaggcccagcuaauccggcaaauggagggagaaggcaucuucaaguccauccagcgccugacggucacugaggagaucgcggugcagaacuggcuagcccgggugggccgggaacggcugagccgcauggccaucuccggggacgacugcguagugaagccccuggaugacagauucgccucagcccucaccgcgcugaacgauaugggcaaagugcgaaaggacauccagcagugggagcccucccggggguggaacgacuggacucaggucccguucugcagccaccacuuccacgagcuggugaugaaggacggccgagugcucguggugcccugucguaaccaagacgagcugaucgggcgcgcccggaucucccagggagccggcuggagccugaaagagacggccugccucgggaaguccuacgcccaaauguggacccugauguacuuccaccgccgggaccugcgccucgcugccaacgccaucugcagcgccguacccucucacuggguccccaccagccgcaccaccugguccauucacgcaaagcacgaguggaugacaaccgaggacaugcuggcgguguggaaccgcguguggauccaggagaacccguggauggaggacaaaacccccgucgagagcugggaggaggugccuuaccugggcaagcgcgaagaccaguggugcggcagccucaucgggcugacaucccgggccacgugggcuaaaaacauccagaccgccaucaaccaggugcgcucucugauugggaaugaggaguauaccgacuacaugcccuccaugaagcguuuucgcaaggaagaggaggaggcaggcguccucugguga

SEQ ID NO: 25229 - RNA, 9876 nt, Artificial Sequence
  derived and/or modified CDS sequence (opt11) from DENV-2__EU687223__SS-prME
acugcuggggucauaaucauguugaucccgacggcgauggcauuccaccugacaacacggaacggggaaccccacaugaucguagggcggcaggaaaaaggcaaaagccuacuguucaaaacugaagacgguguaaacaugugcacccugauggcaaucgauuuaggcgaacucugugaagauacgaucacauacaaaugcccccuacuaagacagaacgaaccagaagacauugauugcuggugcaacagcacgagcacauggguaacauacggaacgugcaccaccacaggcgagcaccgaagggaaaaacggucaguggcgcucgucccucacguaggcauggggcuugaaacgaggacggagacuuggauguccagugagggugcguggaaacacguacagagaauagaaacguggauacuccggcacccuggcuucacaaucauggcagccauacucgcauacacaaucggaaccacacacuuccagcgggcccuaauuuuuauccuauuaacagcggucgcgcccucuaugacgaugagguguauaggaauuagcaauagagauuuuguagagggggugagcgggggcagcuggguugacaucguacuggaacauggcuccugcgucacuaccauggccaaaaacaaaccaacgcucgacuuugagcuaauaaaaacagaggcgaaacaaccugcgacguuaagaaaauauugcauagaagccaaguuaacaaacacuacaaccgaaagucgaugucccacccaaggagaaccaagccugaacgaagaacaggacaaacgcuucauaugcaaacauagcaugguugacaggggaugggggaacgguuguggacuauuuggcaagggaggcauagucacgugugcuauguucacgugcaagaaaaacauggaggggaagguaguacucccagaaaaucucgaauacacgaucguaaucacaccgcacucgggagaagaacacgccgucggcaacgacacagggaagcacgguaaggaaauaaagaucacaccccagaguagcaucaccgaggcugaacuaacaggauacggaacuguaaccauggagugcucacccagaacaggccuugacuucaaugaaaugguccucuuacaaauggaggacaaggccugguuaguccacagacaaugguuccuggaucucccguugcccuggcugccuggagccgacacucaaggaagcaacuggauccagaaagaaacccuggucacguucaagaacccacacgcaaagaaacaggacguggugguacucggaucacaggagggcgcaaugcauaccgcucuuaccggcgcaacagagauacagauguccucaggcaaccuccuguuuacggggcaucugaaaugccgccuucgcauggacaaacuccaacuuaaagggauguccuacucgaugugcacagggaaauuuaaaauagucaaagagauagcggaaacgcagcacgguaccaucguaauccgcgugcaguacgaaggugacgggagcccgugcaagauaccguucgaaauaauggaccucgaaaaacgacacguccuuggucggcuaaucacaguaaauccuaucguaaccgguaaagacagccccgugaacauagaagcagagccaccauucggagauagcuacaucauaauaggaguagaacccgggcagcucaagcucaacugguuuaagaaggguagcucaauuggacaaauguuugagaccaccaugcgcggagcgaaaagaauggcaauacuaggugauacagcgugggauuucggcagucuaggagggguguucacgagcauugggaaggcccugcaccaaguguuuggggcuauauauggagcugcuuucucaggcguguccuggaccaugaagauacuaaucgguguuauuaucacguggauaggcaugaacagucgcucaaccagccucucagugucgcuagucuuaguagguguggucacgcuguaucuaggcgugaugguacaagccgacucaggauguguagugaguuggaaaaacaaggaacugaaaugugggucagggauauuuauuacggacaacguccacacguggacagaacaguacaaauuucagccagaauccccuucaaaacuugcguccgcaauccaaaaggcccaugaggagggaauaugugguauaagaucuguaacgcgcuuggaaaaccuaauguggaagcaaauaacaccugagcuaaaccacauccugagcgaaaacgaagucaaacuuacaauuaugacuggugacauaaaagguaucaugcaagcuggaaaacggucgcucagaccacaaccgaccgaguugaaguauucauggaagaccuggggaaaggccaagaugcuuucaacggagagucauaaccaaacguucuugauagacggcccagagaccgcggaaugcccgaacacgaacagggccuggaauagccuggaaguggaagauuacggauucggcguguucucgacaaauauaugguuaaaacuucgggaaaaacaagacguuuucugcgacaguaagcuaaugagugccgcgauaaaagacaaccgcgcagugcacgcggacaugggcuacuggaucgagucugcgcuaaacgacacauggaaaauggagaaggcauccuucauagaaauuaaaagcugccacuggcccaagagccacacacucuggagcaacgguguccucgaaucggaaaugaucauacccaagaauuuugcaggacccgugucgcaacacaacuaccgccccggguaccacacccaaaccgccggacccuggcaccuaggcaaacucgaaauggacuucgacuucugcgagggcacuacaguaguggucacggaagauugcggaaaucgagggccaucacuucguacaacgacggcaucaggcaaacuaaucacugaaugguguuguagauccugcacacuacccccucuacgcuaccgcggagaagacggauguugguacggcauggaaauacguccccucaaagaaaaagaggagaaccucguuaauucacucgucaccgcaggacauggccaaaucgacaauuucucguuaggcguacuuggcauggcccucuuccuagaagagaugcuccggacgcgcguaggaaccaaacacgcaauacuacuggucgcggucagcuuuguaacgcuaauaacgggcaacaugagcuucagagaucugggacgcguaauggucaugguuggagcgaccaugacagacgacauaggaaugggggucacauaucuagcacuauuagcagcguuuaaaguaagaccgacauucgccgccggucugcuccucaggaaacuaaccaguaaagagcuaaugauggccacaauaggcaucgcccuccuaucccaaucgacaauaccggagacuauccuagaguuaacggacgcucuugcccucggaaugauggugcuaaaaauaguacgcaacauggaaaaauaccaacuggcaguaaccaucauggcaaucagcuguguucccaaugcgguaauacuccagaacgcuuggaaaguuucgugcacuauccucgcagccguaagcguuaguccccugcucuuaaccagcucccagcaaaaagccgacuggauaccguuagccuugacaaucaaaggacucaauccaacugcgauuuuccugacuacucucaguaggaccagcaagaaacgaagcuggcccuuaaacgaagcgguuauggcuguagggaugguaagcauccuagcauccagucucuugaaaaacgauauccccaugacuggaccgcuagucgccgggggacuccucacggucugcuacguacuaacugguagaagugcagaccuggagcucgagcgagcagcggacgugaaaugggaggaucaggcggagaucucugggucgucgcccauacuguccaucaccauaagcgaggacgggaguaugaguauaaagaacgaggaggaagaacacacucuaacaauccuuauaagaacagggcugcuggugaucagcggcgccuucccggugucgaucccuaucacugccgccgccugguaucuaugggaggugaagaagcagcgggccgguguccuaugggaugugccaagcccgccucccguagguaaggcagaguuagaagacggcgccuaucggauaaaacaacguggcauuuuugguuacagccagaucggugccggaguauauaaagaagggacuuuccauacaauguggcauguaacccgcggagccguacuaaugcacagagguaagcgaauugaacccucgugggcagacgucaagaaagaccuaauuuccuacggaggaggguggaaacuugagggagaauggaaagagggggaggaaguacaaguacuggcucucgagccaggaaagaacccacgggcuguacaaacaaagccuggccucuucaagacgaauaccggcacaaucggagccgucucacuggacuuuuccccaggaacaucgggcaguccuauagucgaucgcaagggaaaaguaguuggucuuuacggcaauggaguggugaccagaucaggggcauacgugucagcgaucgcgcaaacggagaagaguaucgaagacaaccccgagauagaggacgacaucuuccgaaagaaacgccugacaauaauggaccuccacccgggagcuggaaagacaaaacgcuaccuaccagccaucguucgcgaagcaauaaaacgaggguuacgaacacuaauacucgcaccaacccgagugguggcugcagaaauggaagaagcccuacgaggguugcccauacgcuaccagacacccgccauucgggccgagcacaccgguagagaaaucgucgacuuaaugugccacgccacuuucacgaugcggcucuuaucaccgguaagaguaccaaauuacaauuuaauaauaauggacgaagcccacuucacagacccugcaagcauagcagcucgcgguuacaucagcacacgggucgaaaugggagaagccgcagguauauucaugacagccacgcccccaggaucccgggaccccuucccgcagucaaacgcuccuaucauggaugaagaacgagaaauaccggagcggucguggaacucaggacaugagugggucacugacuucaaggggaaaaccguaugguucguaccaagcaucaaagccggaaaugacauugcggccugccugcggaaaaacggaaagaaagugauccagcugucucgaaagacuuuugacucagaauacguaaaaaccagggcaaaugacugggacuucguaguaacgacggacauuucugaaaugggggcgaacuuccgagccgagagagugaucgacccucggcgauguaugaagccggucauacucaccgauggagaggagcggguaauccucgcgggcccaaugcccguaacgcacagcuccgcggcgcaaagacgagggcgaauaggacgcaaccccaaaaacgaaaacgaccaguacaucuacaugggggagccucucgaaaacgacgaagacugcgcucauuggaaagaagccaagauguuacuggacaacauaaauacuccugagggaaucauccccucaauguucgagcccgaaagggaaaagguugaugcaaucgauggagaauaccgauugcgcggggaagccaggaagacauuugucgaccuaaugcgcagaggggaccuccccguuuggcuggcguaccgugucgcagcggagggaauuaacuacgcggacaggagaugguguuucgacggaauuaaaaacaaccaaauauuggaggaaaacguggaagucgaaaucuggacaaaagaaggggagcgaaagaagcuaaagccacgauggcuggacgcccgaauauacagugacccccucgcauugaaggaguucaaggaauuugcggcaggcagaaaaucacucacguuaaaucucaucacagaaauggggagauuacccacguucaugacgcagaaggcgcgagacgcccuagacaaccuugccgugcuacacacggccgagguaggcggccgugcguacaaucaugcacuuagugaacugccugaaacacuugaaacgcuacuacucuuaacacuacuagcaacagugacuggcggaaucuuccucuuccuaauguccggcaaagggauaggcaaaaugacccugggaaugugcugcauuauuacagcgucaauacuacucugguacgcucaaauccaaccccacuggaucgccgcuuccaucauacuagaguucuuccugaucguauuacuaauaccggagccagagaagcagaggacaccccaagacaaucaacugacguacgugguaauagccauauuaacggucguagccgccacaauggcgaacgagaugggauuccuagagaaaaccaagaaagacuuaggccucggaagcaucacgacccaagaaagcgaaucgaacauauuagacaucgacuugagaccagcgagcgccuggacccucuaugccgucgccacuacguucgucacaccaauguuacgacauaguauugaaaacagcagcgugaauguuucccuaacugcgaucgcgaaccaagccacaguucugaugggucucggaagaggcuggccacugucaaagauggacauaggagugccacuccuggcaauagggugcuauucacaagugaaucccaucaccuuaacggcagcacuacuacuccuggucgcacauuacgcaauaauugggccgggacuucaagccaaggcaaccagggaagcacaaaaacgcacugccgcgggcaucaugaaaaacccaacagucgacggcauaacugucauagaccuagagcccauaccguacgaccccaaguucgaaaaacagcuaggccaagucauguugcucguccugugcgucacccagguucugaugaugaggacaacgugggcucugugcgaagcgcugacccucgcgacaggacccauaagcacacuaugggaagguaacccuggccgauuuuggaacacuacaauagcaguguccauggcaaacauauuccggggaagcuaccucgccggcgccggccuccuauuuucaauaaugaagaauaccacuaauacgcgacgaggaacugguaacaucggggagacacuaggagaaaaguggaagucacgacuaaacgcucuagggaaaucggaguuccagaucuacaagaaaucaggaauacaggaagucgaccguacacuagccaaggaggggauaaagcgcggugaaaccgaccaucacgcaguuuccagagguagcgccaaacucagaugguucguagagagaaacaugguaacuccagagggaaaagucguggaccuuggaugcggcagaggcggauggagcuauuacugcggaggccucaaaaacgugcgggaagugaaggggcuaacaaaagguggaccuggacaugaggagcccauaccgaugagcacguacgguuggaaccuagugagauugcagucaggagucgacgucuucuuuacgccaccugaaaaaugcgacacgcuacucugcgacaucggcgaaagcucacccaaucccaccauagaggccggacguacccuacggguccucaaccucgucgagaauuggcugaauaacaacacacaguucugcaucaagguccuuaacccauacaugcccucaguaauagagaagauggaaacacuccaaagaaaauacggcggugcccugguccguaacccucuguccaggaacagcacacacgaaauguauuggguaagcaaugcuaccgggaacauuguaucauccgugaacaugaucucgaggaugcucauuaacagguucacgaugaaacauaagaaagcgacguaugaacccgacguggaccuggguagugggacgcguaacauuggcauagaaaacgaaaucccgaaccucgacauuaucgguaaaagaauagagaaaauaaagcaagagcaugaaacaucauggcauuacgaccaggaccaccccuacaaaaccugggccuaucacggaagcuacgagaccaaacagaccgggucagccuccagcauggugaacggagucgucaagcuacuaacgaagccuugggacgucgugccgaugguaacacaaauggccaugacagauacgacgcccuuuggucaacagcgaguauuuaaagaaaaaguugacacucggacccaggagccaaaggagggaaccaagaagcuaaugcgaaucacagcagaauggcuguggaaagaguuaggaaagaagaaaacuccucgcaugugcacgcgugaagaguucacacggaagguacgaucaaacgcggcacugggagcaaucuucacggacgaaaauaaauggaaauccgcgcgcgaagcagucgaagacagcagguucugggaacucguagaccgugagagaaaccuccaccucgaggguaaaugcgagaccugcgucuacaacaugaugggcaagagggaaaagaagcucggagaguuugggaaagcaaaaggaucaagagcgaucugguauauguggcuaggggcaagauuccuagaguucgaggcacugggcuuccuaaacgaggaccauugguucagcaggggcaacagccucuccggaguggagggcgaaggccuucacaaguuaggcuacauccuacgcgacguuaguaagaaagaagggggagcgauguacgcggaugauaccgccggaugggauacccguauaacgcuggaggaccuuaaaaacgaggaaaugguaaccaaccauaugaaaggcgagcacaagaaacuagccgaggccaucuucaaacuaacauaucaaaauaaagucguacgagugcaaagaccgacacccagggggacugugauggacauaaucucuaggaaagaccaacgcgguuccgggcagguuggcaccuacggucucaauacguuuacgaacauggaggcgcagcugaucagacaaauggaaggggaaggaaucuuuaaaagcauacagcgacuaacagucacagaggaaaucgccguccaaaauuggcuagcccguguaggucgggaaagguugagccgcauggccaucagcggcgaugacugcgucgucaaaccgcuggacgaucgauucgcgucggcccuaacggcgcuaaacgacaugggaaaaguaagaaaagacauacaacaaugggaacccagccgaggcuggaaugauuggacacaagugccuuucuguucccaucauuuccaugagcuaguaaugaaagacggacgcguccuaguagucccaugccgaaaucaggaugagcuuaucggucgcgcccgcaucucccaaggggcaggauggagccuaaaggaaaccgccugccugggaaaaucauaugcacagauguggacacucauguacuuccaucgucgggaucuacgucucgcggcaaacgcaauaugcagugccgugccgucccacuggguaccgacgagccgcacuacgugguccauacacgcgaagcaugaguggaugacaaccgaagacaugcuggccgucuggaaccgcgucuggauccaggaaaauccauggauggaggacaaaaccccaguagagucuugggaggaagucccguaccuaggaaagcgcgaggaccaguggugcgggucguuaauaggcuuaaccucaagagcaacaugggccaagaacauccaaaccgccauaaaucaaguccgaucgcucauaggcaacgaggaauacacagauuacaugccaagcaugaaaagauuccgcaaggaggaagaagaagccggcguacugugguag

SEQ ID NO: 25230 - RNA, 9876 nt, Artificial Sequence
  derived and/or modified CDS sequence (opt11) from DENV-2__EU687227__SS-prME
accgccggcgugaucaucauguugauccccaccgccauggcguuccaccucaccacccguaacggggagccccauaugaucgucggccgucaggagaaggggaaguccuuauuguucaagaccgaggacggagugaacaugugcacccucauggccaucgaccugggggagcugugugaggacaccauuaccuacaaguguccccucuugcgccagaacgagcccgaagacaucgauugcuggugcaacucuaccucuaccugggugaccuacggaaccugcaccaccacgggcgagcaccggcgcgaaaagcgguccguagcccugguaccgcacguggggaugggccucgagacccgcaccgagacguggauguccucagaaggggcuuggaagcacguccagcggaucgagaccuggauccugcgccacccgggauucaccauuauggccgcgauccuggccuacaccauugggacgacccacuuccaacgagcccucaucuucauccugcuaaccgccguggcgcccagcaugaccaugcgcugcauuggcauuuccaaccgggacuucguagagggagucagcgggggguccuggguggacaucguacucgagcacgggagcugcgucaccacgauggccaaaaacaagcccacccuggacuucgagcugaucaaaaccgaggccaagcagcccgccacccuccguaaguacugcaucgaagccaaacugacaaauaccaccaccgagucccguugcccgacgcagggcgagcccagccugaacgaggagcaagacaagcgcuucaucugcaaacacuccaugguggaccggggcugggggaacggcugcggucuguucggcaagggcgggaucgugaccugugcgauguucacgugcaagaagaacauggagggaaagguugugcugcccgagaaccuggaguacacuaucgugaucacaccccacagcggagaggagcacgccgucggcaaugacaccgggaaacacggaaaagaaaucaagauuaccccgcaguccagcaucaccgaggccgagcucaccggcuacggcacggucaccauggagugcagcccccggacuggccuggacuucaacgagauggugcugcuucagauggaggacaaggccuggcugguccaccggcagugguuccuagaccucccccugcccuggcugccgggggccgacacccaaggcagcaacuggauccagaaggagacgcucgugacauucaagaacccccacgcgaagaaacaggauguggucgugcugggcucccaggagggcgccaugcauacagcccugaccggggccacggagauccagaugagcagcggcaacuuacuguuuaccggccaccugaaaugccgccuccggauggauaagcugcagcugaaggggauguccuacagcaugugcacaggcaaguuuaagaucgucaaggagaucgcggagacgcaacacgggacgaucgugauaagagugcaauacgaaggcgacggcucccccugcaagauuccguucgaaaucauggaccucgagaagcggcacguccuggggcgccugaucaccgugaacccgaucgugaccgagaaggauagcccagucaacaucgaggcagagccacccuucggcgacuccuacaucaucaucgggguggaaccgggucagcucaagcugaacugguucaagaaggggagcuccaucggccaaauguucgaaacaacgaugcgcggcgccaagcggauggccauucugggugacaccgcaugggacuucggcucacucgggggcgucuucaccagcaucgggaaggcccugcaccaggucuuuggcgcgaucuacggcgccgccuucagcgggguguccuggaccaugaagauccugaucggcgugaucaucacauggauugguaugaacagucguuccaccagccuguccgucagcuuagugcuggugggagucguaacccuguaucucggggugaugguccaggccgacuccggcugcguggugagcuggaagaacaaagagcuuaagugcggcuccgggaucuucaucaccgacaacguccacacguggacugagcaguauaaguuccagccggaaagccccagcaagcuggcguccgccauacagaaagcccacgaggagggcaucugcgggauccggagcgugacccgccucgagaaccugauguggaagcagaucacucccgaacugaaccacauccucuccgaaaacgaggugaagcugacuaucaugaccggcgauaucaaggggaucaugcaggcaggcaaacguagccuucgcccgcagcccacugagcucaaguacucauggaagaccugggguaaggccaagaugcugagcacggagucccacaaccagaccuuccugaucgacggccccgagaccgcagagugcccuaauaccaaccgggccuggaacagccucgaggucgaggacuacggcuucgggguguucuccacgaauaucuggcugaagcugagagagaaacaggacguguucugcgacagcaagcuuauguccgccgccaucaaggacaaccgggccguccacgcggacaugggcuauuggaucgagagcgccuugaacgacacuuggaagauggagaaggccuccuucaucgagaucaagagcugccacuggcccaagucccacacccuguggagcaauggcguacucgaguccgagaugaucauccccaagaacuucgccgggcccgugucacagcacaacuaccgcccgggcuaccacacccaaaccgccggaccuuggcaccugggcaagcuggagauggacuucgacuucugcgaagggacgaccgugguggucaccgaggacugcggcaaccggggccccagcuugcgaaccacgaccgcguccgggaagcugauuaccgaguggugcugcagaagcugcacccugcccccgcucagauaccgcggcgaggacgggugcugguacggcauggagaucagaccccugaaggagaaggaggagaaucuggucaacuccuuggugacggccgggcacggucagaucgacaacuucagucugggcgugcugggaauggcccucuuccuggaggagaugcugcggacccgcgucggcaccaagcacgcaauucuccugguggcgguguccuucgucacccugaucaccgggaacaugagcuuccgggaccucggucgcgugauggucauggucggggccaccaugaccgacgacaucggcaugggcgugaccuaccuggcccugcuugccgccuucaaggugcgccccacguucgcggccgggcuuuuauugaggaagcugaccuccaaggagcugaugauggccaccaucggcaucgcccuccugagccaguccaccauccccgagacgauucuagagcucaccgacgcccuggcgcucggaaugaugguccucaagaucgugcgcaacauggagaaguaccagcuggccgugacuaucauggcgaucagcugcgucccgaacgccgugauccuacagaacgccuggaaggucuccugcaccauccucgcggcggugucugugagcccccugcugcucacaagcucacagcagaaggccgacuggaucccccuggcccugaccauuaagggucucaaccccaccgcgaucuucuuaacgacgcugagccggaccuccaagaagcgcucguggccgcuuaaugaggccgucauggccgugggcauggugaguauacuggccagcagccugcucaagaacgacauucccaugaccgggccgcuggucgccggcggguugcucaccguuugcuacgugcugacugggcgguccgcggaccuggagcucgagcgcgccgcugacguuaagugggaggaccaagccgagaucagcgggaguagccccauccuguccaucaccauuagcgaggacggcaguaugagcaucaagaaugaggaggaggagcacacccugaccauccuuauacggacgggccuguuggugauuuccgggguguucccggugagcauccccauuaccgcugcggccugguaccucugggaggugaagaagcagcgcgccggcgugcugugggacguccccagcccgccgcccgugggcaaggccgagcuggaggacggcgccuacaggaucaagcagcgcgggauuuucgguuacagccagauuggcgcggggguguacaaggagggaacauuucacaccauguggcaugucacccgcggggcggugcucaugcacagggggaagcggaucgagcccucgugggccgacgucaaaaaggaccugauuagcuacggcggcggcuggaagcuggagggggaguggaaggagggugaggagguccaggugcucgcccuggagcccggcaagaacccccgcgccgugcagacgaaacccggccuguucaagaccaacacggggaccaucggcgcggucucguuagacuuuagccccggcacguccgggagccccaucgucgaccggaagggcaagguggucgggcucuacggcaacggcguggugacccgcuccggggcguacgucagcgccaucgcccagaccgagaagucaaucgaggacaaccccgagaucgaagacgacaucuuccggaagaagcgacuuaccauuauggaccuccaucccggcgcggggaagacgaagcgguaccugcccgccaucguacgcgaggccauuaagcggggccugcgaacccugauccucgccccgacgcgcgugguagccgcggagauggaggaagcccugcgggggcugccaaucagguaccaaacccccgccauccgggccgagcacacaggccgcgagaucguugaccugaugugccacgccaccuucaccaugcggcugcucucccccguucgcgucccaaauuacaacuugauaauuauggacgaggcgcacuucaccgaucccgcgucaaucgccgcacgggguuacaucucgacgcgcguggaaaugggggaggccgcggguaucuucaugaccgccacuccgcccgguagccgggacccguucccgcaguccaacgcccccauaauggacgaggaacgcgagauacccgagcggucuuggaacuccggccacgagugggugaccgauuucaaggggaagacggucugguucgugcccucgaucaaggccggcaacgacauugcggcaugucugcgcaagaacggcaagaaggugauucagcugucccggaagaccuucgacucggaguacguaaagacccgcgccaacgacugggacuucguggugaccacggacaucuccgagaugggggcaaacuuccgggccgagcgcgucaucgacccccgucgcugcaugaagcccgugauccucaccgacggcgaggaacgggugauacuggccgggccaaugccggucacacauagcuccgccgcccagcgcaggggccggaucgggcgcaaccccaagaacgagaacgaccaauauaucuauaugggcgagccccuggagaacgacgaggacugcgcacacuggaaggaggccaagaugcuccuggacaacaucaacacccccgagggcaucauuccgagcauguucgaacccgagcgggagaagguggacgcgaucgacggcgaguaccgccuacggggcgaggcccgcaagacuuucguggaucucaugcggcgcggggaccugccagucuggcuggccuaccggguugcggccgagggcaucaacuacgcggaccgccgcuggugcuucgacgggaucaagaacaaccagaucuuggaggagaacgucgaagucgagaucuggaccaaggagggcgagcgcaagaagcugaaaccgcgguggcuggacgcccgcauuuacuccgacccccuggcccugaaggaauucaaggaguucgcugcgggucggaagucccugacccucaaccugauaaccgagauggggcgccugcccacguucaugacccagaaggcccgggacgcccucgacaaccuggccguacugcacaccgccgaaguuggcggacgcgcguacaaccacgcccucuccgaacugccggagacccuggagacgcuucugcugcucacccuacuggccacggugaccggcggcaucuuccucuuccugaugagcgggaagggcaucgggaaaaugacgcuggggaugugcugcaucauaacggcuuccauucuccugugguacgcccaaauccagccgcacuggaucgcggccagcaucauccuggaguucuuccucauagugcugcugauccccgaacccgagaagcagcggacuccccaggacaaccagcucaccuacgugguuaucgccauccugaccguggucgccgccacgauggcgaacgagaugggguuccuggagaagaccaagaaggaccuaggucugggcagcaucaccacucaggaguccgagagcaauauucuggacauugaucuccgcccggccuccgccuggacauuauacgccguggccacgaccuucgugacccccaugcugcggcacagcaucgagaacuccagcgucaaugugucccucacggcgaucgccaaccaggccaccgugcugauggggcugggccgcggguggccccucagcaagauggauauaggcgugccccugcuggccaucgguugcuacucccaggucaacccuaucacccucaccgcggcacugcugcuucuaguggcccacuacgccaucaucggccccggccugcaggccaaggcgacgagggaggcccagaaacggaccgccgccgggaucaugaagaaccccaccgucgaugguaucaccgugaucgaccucgagccaauuccguacgaccccaaguucgagaagcagcugggccaaguuaugcugcucguccugugcguuacccagguacugaugaugcgcaccaccugggcccuaugcgaagcguuaacccuggcaacggggcccaucagcacccucugggaggggaaccccggccgguuuuggaacaccaccaucgcuguguccauggccaacaucuuccgcggcagcuaccuggccggggcgggccuccucuucuccaucaugaagaacacgaccaacacacggcgcgggaccggaaacaucggagaaacgcugggggagaaguggaaguccagacugaacgcccucggcaaguccgaguuccagaucuacaagaaguccgggauccaggagguggaccgcacgcuggccaaggagggcaucaagcguggggaaacagaccaccaugcugugucccgcggcagcgcgaagcugaggugguuugucgagagaaacaugguaaccccggagggcaagguggucgaccucgggugcggacgcggggggugguccuacuacugcggcgggcuaaagaacguucgcgaggugaaggggcugacgaagggcggacccgggcacgaggagcccaucccuaugagcaccuacggcuggaaccugguccggcugcaaucagggguggacguguucuucacaccaccugagaagugugacacccugcugugcgacaucggcgaaaguaguccaaaccccacgaucgaggccggccgcacccugcggguccugaaucuaguugagaacuggcucaacaacaacacccaauuuugcaucaaggugcugaacccguauaugcccuccgucaucgagaagauggagacccuccaacgcaaguaugggggcgcacuugugcggaauccccugagccgcaacucuacacacgaaauguacugggugagcaaugccacggggaacaucgucuccuccgugaacaugaucucccgcaugcugaucaaccgguucaccaugaagcacaagaaggcgaccuacgagccggacguggaccucggcagcgggaccagaaacaucgguaucgaaaaugagauccccaaccuagacaucaucggcaaacgcaucgagaagaucaagcaggagcacgaaacgucuuggcacuacgaccaggaucacccauacaagaccugggcguaucacggcucauacgagaccaagcaaaccggcagcgccagcuccauggucaacgggguggugaagcuuuuaacgaagcccugggacgucguuccgauggugacccagauggccaugaccgauacgacgccuuucggccagcaacgcgucuucaaagagaagguggacacccggacccaggagcccaaagagggcaccaagaagcugaugcgcaucacggccgaguggcuguggaaggagcucggaaagaagaagacgccucggaugugcacccgcgaagaguucacccggaaggugcgcagcaacgccgcgcugggcgccaucuucacugacgagaacaaguggaagagcgcucgagaggccgucgaggacagccgcuuuugggagcugguggaccgggagagaaaccuccaccuggaagggaagugcgagaccugcguguauaacaugaugggcaagcgggagaagaagcugggugaguucggcaaagccaagggcucacgcgcgaucugguacauguggcucggggcccgguuccucgaguucgaggcccugggcuuccucaacgaggaccacugguucagucgcgggaacucgcugagcggcguggagggggagggacugcacaaacuaggcuacauccugcgggacgugagcaagaaggagggcggggccauguacgcagacgacaccgccgggugggacacucgcaucacgcuggaggaccucaagaacgaggagauggucaccaaccagaugaagggcgaacauaagaaacuggccgaggccaucuucaaacucaccuaccagaacaagguggugcggguccaacgcccgacgccccggggcacggugauggauaucaucagccgcaaggaccagcgcggcagcggccagguggggacuuacggacucaacaccuucaccaacauggaggcccagcugauccggcagauggagggcgagggcaucuucaaguccauccagcgccugacggucaccgaggagaucgcggugcagaacuggcucgccaggguaggccgcgagcggcugagccgcauggccauaucaggggacgacugcguugugaagccucuggacgaccgguucgccagcgcccucaccgcgcugaacgacaugggcaaggugcgcaaggacauccagcagugggaacccucgcgcggcuggaacgacuggacacaggucccguucugcagccaccauuuucaugagcuggugaugaaggacggccgggugcucgucgugcccugccggaaccaagaugagcugaucgggcgcgcgcggaucucccaaggcgccggcuggucucugaaggagacggccugcuuagggaaguccuaugcccagauguggacccugauguacuuccacagacgggaccugcgcuuagcugcgaacgccaucugcagcgccgugcccucccacuggguccccaccagccggacgaccugguccauucaugccaaacacgaguggaugacgaccgaggacaugcuggcgguguggaaccgcgucuggauccaggagaacccguggauggaggacaagacccccgucgagagcugggaggaggugccauaccugggcaagcgcgaggaucaguggugugggagcuugaucggcuugaccucccgggccacgugggccaagaacauccagaccgccauaaaccaggugcgcagccugaucggcaacgaagaguacaccgauuacaugcccuccaugaagcgguuccgcaaggaggaggaggaggcgggcguccucugguga

SEQ ID NO: 25231 - RNA, 9876 nt, Artificial Sequence
  derived and/or modified CDS sequence (opt11) from DENV-2__EU687228__SS-prME
acugcgggcgugaucaucaugcuaauccccaccgccauggcguuucaccuaaccacccgcaacggggagccgcacaugaucgucggccggcaggagaaggggaagucccuguuauucaagacggaggacggcgugaacaugugcacccucauggcuaucgaccugggggagcugugcgaggacaccaucaccuacaagugccccuuacugcggcaaaacgagcccgaggacauugacugcuggugcaacagcaccagcaccugggugacauacgggacgugcacgaccacgggcgagcacaggcgcgagaagcggucugucgcccuggugccucacguugggaugggacucgagacccgcaccgagacuuggaugagcagcgagggggcauggaagcacguccagcggaucgagaccuggauccugagacacccgggcuucaccauuauggccgcgauccuggccuacaccaucggcaccacgcacuuucaacgggcccucauauucauuuuacugacagccguggcgcccagcaugaccaugcgcuguaucggcaucuccaaccgggacuuuguugagggugucucagggggcucguggguggacaucgugcuggagcacgggagcugcgucaccacgauggcgaagaacaagcccacccuggacuucgaguuaaucaagaccgaggcgaagcagcccgcuacccuccgcaaguacugcaucgaagccaagcucacgaacaccaccaccgagucccguugcccgacgcagggcgagcccagccugaacgaggagcaggacaagcgcuuuaucugcaagcacuccaugguggaucguggcuggggcaacggcuguggccuguucggcaaggggggcaucgugaccugcgcgauguucacguguaagaagaauauggaaggcaagguagugcugcccgagaaccuggaguacaccaucgucaucacgccccacagcggggaggagcacgccgucggcaacgacaccgguaagcacggcaacgagaucaagauuaccccgcaauccagcaucaccgaggcugagcuaacgggguacggcacuguaaccauggagugcagcccccggaccggccuggacuucaacgagauggugcugcuccaaauggaggacaaggccuggcugguccaccggcagugguuccuugaccucccccugcccugguuacccggcgccgacacccagggcagcaacuggauacagaaagagacguuagugaccuucaagaacccccacgcgaagaagcaggauguugucgucuuggggagucaggaaggggccaugcacaccgcccugaccggggccacggagauccagaugagcagcggcaaccuccuguuuacuggccaucugaagugccgccucagaauggacaagcuccaguuaaaggggauguccuacagcaugugcacgggcaaguucaagaucgucaaggaaaucgccgagacccagcacgggacuaucgugauucgcgugcaguacgagggcgacgggucuccuugcaagauccccuucgagaucauggaccucgagaagcggcacguccuggggagacuaaucaccgugaacccgaucguuaccgagaaggacagccccguuaacaucgaggcugagccacccuucggcgacuccuacaucaucaucgggguggagccgggacaguugaaguuaaacugguucaagaaggggagcagcaucggccagauguuugaaaccacgaugcgcggggccaagcggauggccaucuuaggggacaccgccugggacuucggcagccucggcggcguguucaccuccaucgguaaggcccuacaccaggucuucggcgcgaucuacggggccgcguuuagcgggguuuccuggaccaugaagaucuuaaucggcgugaucaucacguggauugggaugaacucgcgcucuaccagcuugagugucagccucgugcuggugggcgucgugacccucuaccucggcgugaugguccaggcugauuccggcugcgugguaagcuggaagaacaaggagcugaagugcggcuccggaaucuucauuaccgauaauguacacaccuggaccgagcaauauaaguuccagcccgagagccccucgaagcuggcguccgccauccagaaagcccacgaagagggcaucuguggcauccgcagugugacaaggcucgagaaccugauguggaagcaaaucaccccagaacugaaccacauccucuccgagaacgaagugaagcugacgaucaugaccggagacaucaaggggauuaugcaggccggcaagcggagcuuacggccgcagcccacugagcucaaguacucauggaagacuugggguaaggccaagaugcugagcacggagucccauaaccagaccuucuugauugacgggccggagaccgcggagugcccgaacacaaacagggccuggaacagccucgaagucgaggacuacggcuucgggguguucuccacaaacaucuggcugaagcuucgcgagaagcaggacguguucugugauagcaaacucauguccgccgccaucaaggacaacagagccguccacgcggacaugggcuauuggauagagagcgcccugaacgacacguggaagauggagaaggcuuccuucaucgaaaucaagagcugucacuggcccaaaucccacacccuguggagcaacggcgugcucgagucugaaaugauaauccccaagaacuuugcagggcccgugagccagcacaacuaccggccggguuaccacacccagaccgccgggcccuggcaccugggcaaguuagagauggacuucgacuuuugcgaggggacgaccguaguggugacggaggacugcggcaaccguggcccaucuuuacgcaccacgaccgcgucugggaaacugaucaccgaguggugcugccggagcugcacccuccccccgcuccgcuacagaggcgaggacggcugcugguacggcauggagauccgcccccugaaggagaaggaggagaaccuggucaacucgcucgugacggccgggcacggccaaaucgacaacuucucgcucggaguccuggggauggcgcucuucuuagaagagaugcugaggacccguguugguaccaagcaugccaucuuacugguggcgguguccuucguaacccugaucacaggcaacaugagcuuccgggaccucggccgcgugauggugauggucggggcaacgaugaccgaugacaucggcaugggcgugaccuaccuagcacuccuagccgccuucaagguccgccccacguucgcggcagggcugcuguuacggaaguuaaccuccaaggagcugaugauggccaccaucggcaucgcccuccugagccaguccaccauuccugaaaccauccucgagcucacagacgcccuggcgcuggggaugaugguccucaagaucgugcgcaacauggaaaaguaccagcuggccgugaccauuauggccaucagcugcgucccuaaugccgugauccugcagaacgccuggaaaguguccuguaccauucuugcugccgucucggugagcccgcuucugcucacgagcucccagcagaaggccgacuggaucccacuugcccugaccaucaaggggcucaaccccaccgcgaucuuccugaccacgcugagucggaccuccaagaagcgcagcuggccccucaacgaggccguuauggcagucggcauggucuccauccuggccuccagcuugcucaagaacgacaucccaaugaccgggccccugguugcuggcgggcuccucaccgugugcuaugugcugacgggccgguccgcggaccuggagcucgagcgcgccgccgacgucaagugggaggaccaggccgagaucagcgggaguagccccauccuuagcauaacgaucagcgaggacggaagcauguccaucaagaacgaggaggaggagcauacgcuaacgauccucauccggaccggccuacuggugaucucuggaguguucccagugucgauaccgaucaccgccgcggccugguaucucugggaggugaagaaacagcgcgcaggcguucugugggacguccccucaccgccgcccguggggaaagccgagcuggaggauggcgcguaccggaucaagcagcgcgguauuuucggcuacagccagaucggcgcgggcguguauaaggagggcaccuuccacaccauguggcacgugacccgcggagccguccucaugcaucgcggcaagaggaucgagccguccugggcugacgugaagaaggaccucaucagcuacgggggcggauggaaacuggaaggagaguggaaggagggcgaggagguccagguucucgcccuugagcccgggaagaauccccgcgccguucagacaaagcccggccuguucaagaccaacaccgggaccaucggcgcggucucccucgacuucagccccggcaccucggggagccccaucgucgaucguaagggcaaggucguugggcuguacggcaacggcguggugacacgcucuggagcauacgucagcgccaucgcccagacggagaaauccaucgaggacaacccugaaaucgaggacgacaucuuccggaagaagcgccugaccaucauggaccugcaccccggagccgguaagacgaagcgguaccugcccgccaucgugcgugaggccaucaagcgggggcugcgcacccugauccuggccccgacccguguuguagccgcugagauggaggaggcccuuagaggccugcccauccgcuaccagacucccgccaucagggccgagcacacgggacgcgagaucguggacuuaaugugucacgccaccuucaccaugcgccugcugagcccagugcgcgucccgaacuacaaucucauaaucauggacgaggcccacuucaccgaccccgccagcaucgccgcccggggcuacaucuccacgcgcguggaaaugggggaggccgcaggcauuuuuaugaccgccaccccgccggggagccgggauccguucccgcaauccaacgcccccaucauggacgaggagcgcgagauccccgaacggagcuggaacuccggccacgaguggguuaccgacuucaagggcaagacgguaugguucgugccgucuaucaaggccggcaacgacaucgcggccugucuucggaagaauggcaagaaggugauccagcugucccggaagacauucgacagcgaguacgucaagacacgcgccaacgauugggacuucguaguaaccaccgacaucuccgagaugggugcgaacuuccgggccgagcgcgucaucgauccgcggcgcugcaugaagcccguuauccucaccgauggugaggagcgggucauacuggcggggcccaugccggugacccacagcuccgccgcccaacgccgcggucggaucgggcgcaaucccaagaacgagaacgaucaguacaucuacaugggcgagccccuggagaacgacgaggacugugcucacuggaaggaggcaaagaugcuccuggacaacaucaauacgcccgagggcaucaucccuucaauguucgaaccggaacgggagaaggucgacgcgaucgauggggaguaccgccugcggggcgaggcccgaaagacguucguggaccucaugcggcgcggggaucugcccgucuggcuggccuaccggguagccgcugagggcaucaauuacgcggaccgacgguggugcuucgacgggaucaagaacaaccagaucuuagaagagaacguggaagucgagauuuggacgaaggagggcgaacgcaagaagcuuaagccgcgguggcuggacgcccgcauauacuccgacccgcucgcccucaaggaguucaaggaguuugccgccggccggaaaucccugacucucaaccuuaucaccgagaugggacgccuacccacguucaugacgcaaaaggcccgugacgcccucgacaaccuggccguccugcacaccgcugagguuggcgggcgcgcauacaaccacgcccucuccgagcuacccgagacccuggagacgcuccugcuucucacacugcuggcuacaguaaccggcgguaucuuccuguuccugaugagcgggaagggcaucggaaaaaugacucuggggaugugcugcaucauuaccgcuuccauccuccugugguacgcccagauccagccgcacuggaucgcggccagcauaauccuagaguucuuucugaucguucugcugaucccugagcccgagaagcagcggacuccacaggacaaccagcucacguacguggugaucgccauccugacgguggucgccgcuacuauggcgaacgaaaugggguuccuggagaagaccaagaaggaccucggccugggcuccaucaccacgcaggaguccgagaguaacauucuagacaucgaccuucgcccggccucggcuuggacgcuguaugccguugcuaccaccuucgugacccccaugcugcggcacuccaucgagaauuccagcgucaauguuagccucacggcgauugccaaccaggccaccguccugaugggacugggccgcggguggccucucagcaaaauggacauuggcgucccccuuuuggcaaucgggugcuauucccaggugaauccgaucacccucacugccgcccuccuguugcuuguggcccacuacgccauuauaggccccggccugcaagcgaaggcgacgcgcgaggcccagaaaagaaccgccgccgguauuaugaagaaccccaccgucgacggcauuacggugaucgaccucgagcccauccccuacgaucccaaguucgagaagcaguugggccaggugaugcugcuugucuugugcguuacccaggugcugaugaugcggacaacgugggcauugugcgaggcacugacccuggccacggggcccaucagcacucucugggaggggaacccuggccgguucuggaauaccacgaucgccguuuccauggcuaacaucuuccgcggcagcuaccuggccggggcaggccuccucuucuccauuaugaagaacacgacuaacacccggcgcgggaccggcaacaucggcgaaacccugggggaaaaguggaagucccgacugaacgcccucggcaaguccgaauuccagaucuacaagaaauccggcauccaggagguagaccggacccuggccaaagaggggauuaagcgcggggagaccgaccaccaugccgugucccguggcucagcaaagcugcggugguucgucgaacgcaacaugguuacccccgagggcaagguggucgauuuggggugcggccgcggcggguggucguacuacuguggcgggcugaagaacgugcgcgaggugaaggggcugacgaagggggggccugggcacgaagagcccauccccaugucaaccuacggcuggaaccucguccggcugcaaagcgggguggacguguucuuuacuccgcccgagaagugcgacacgcuucuaugcgacaucggcgaauccucccccaauccuacgaucgaggccggccgcacccugcggguccugaaucucguggagaacuggcugaacaacaacacccaguucugcaucaaggugcugaacccguacaugcccuccgucaucgagaagauggagacccuccagcgcaaguacgggggagcccugguacggaauccccugagccgcaacuccacccaugaaauguacugggugucgaacgccacggggaacaucguauccagcguaaacaugauuucucgcaugcuuaucaaccgguucaccaugaagcacaagaaggccacguacgagccggacguagaccucggcucgggaacccgcaacaucggcaucgagaaugagauccccaacuuagacaucaucggcaagcggaucgagaagaucaagcaagagcacgagacgucguggcacuaugaucaggaccaccccuacaagaccugggcuuaccacggaucguacgagaccaagcagaccggguccgccagcuccauggucaacgggguagugaagcugcucaccaagcccugggauguggugccgauggugacccagauggccaugaccgacaccacgcccuuuggccagcagcgagucuucaaggagaaaguggacacacggacacaagagccgaaggaaggcaccaagaagcucaugcgcaucacggccgaauggcuguggaaggagcucgggaagaaaaagacgcccagaauguguacccgcgaggaguucacgcggaaggugcgcuccaacgccgcgcugggcgccaucuucacggacgagaacaaguggaaguccgcccgggaggccgucgaggacagcagguucugggagcugguggaccgugagagaaaccuccaccuggaggggaagugcgagaccugcgucuacaacaugaugggcaagagagagaagaagcugggggaauucgguaaggccaagggcucucgcgcgaucugguacauguggcucggugcccgguuccuggaguuugaggcucugggcuuccucaacgaggaccacugguucagccgcgggaacucccuguccggcguggagggcgagggccuccacaaacucggguacauccuucgggacgugagcaagaaggagggcggggccauguacgcggacgacaccgcagggugggacacccgaauuacgcuggaggaccugaagaacgaggaaaugguuaccaaccacaugaagggcgagcacaagaagcuggcagaggccaucuucaaacucaccuaucaaaacaagguggugcggguccagcgcccaacgccccgggggaccgugauggacauaaucucucggaaggaccagcgcggcucaggccaaguggguaccuacggccucaacaccuucaccaauauggaagcccaauuaaucagacagauggagggggagggcaucuucaaguccauccagagacugaccgugaccgaggagaucgcggugcaaaacuggcucgcccggguggggcgcgagcggcugucacgcauggccaucuccggggacgacugcgucgugaagccccuggacgaccgguucgccagcgcccucaccgcgcugaacgacaugggcaaggugcgcaaggauauacaacagugggaaccaucgcggggguggaacgacuggacccaggucccauucuguagccaccacuuccacgaacuggugaugaaggauggucgcgugcuaguugugcccugccggaaccaggacgagcugaucgggcgagcccggaucucccagggcgccggcuggagccuuaaggagacagccugccucgggaaguccuacgcccagauguggacccugauguacuuccaccgcagagaccugcgccucgcggccaacgccaucugcucagcuguccccucccacuggguuccaaccucccggacgaccugguccauccacgccaagcacgaguggaugacgaccgaggacaugcuggcgguguggaaucgcguguggauccaagagaauccguggauggaggacaagacccccgucgagagcugggaggaggugcccuaccucggcaagcgagaggaccaguggugcgggagccucaucggccugaccucccgggccacgugggccaagaacauccagacggccauuaaccaggugcgcagccugaucgggaacgaggaguacaccgauuacaugcccucuaugaagcgguuuagaaaggaggaggaggaggccggcgugcugugguga

SEQ ID NO: 25232 - RNA, 9876 nt, Artificial Sequence
  derived and/or modified CDS sequence (opt11) from DENV-2__EU687230__SS-prME
acugccgggguaaucaucaugcugauccccaccgcuauggcguuccaucuaaccacccguaacggggaaccccacaugauagucggccggcaagaaaaggguaagucgcugcuguucaagaccgaagacggcgugaacaugugcacccucauggccaucgaccuaggggaacugugcgaggauaccaucaccuacaagugcccccuccugcgccagaaugagccagaggacauagacugcuggugcaacaguacuucgaccugggugaccuacggaacauguaccacuacgggcgagcaccggcgggagaagcguuccgucgcccugguuccccacgucgggaugggacucgagacuaggaccgagaccuggaugagcagcgagggugccuggaagcacguccagcggaucgagaccuggauacugcgccacccgggcuuuaccaucauggcugcgauacuggccuacaccaucgggaccacacacuuucagcgggcacucauuuuuauccugcugaccgccguggcgcccagcaugaccaugcgcugcauaggcaucucaaaucgugacuucguagaaggagucagcggcggcucgugggucgauaucguccucgagcaugguaguugugucaccacuauggccaagaacaaacccaccuuagacuuugagcugaucaagaccgaggccaagcagcccgcuacccuccgcaaguacuguaucgaggccaaacuuacgaauaccaccacugagucccggugcccgacucagggagagcccagccugaacgaggagcaggacaaacgcuucaucugcaagcacuccaugguagaccggggaugggggaacgggugcggccuguuuggcaaaggcgggauugugaccugcgcaauguucacgugcaagaagaacauggagggcaaagucgugcugcccgagaaucuggaguacacaaucgugaucacuccccauagcggggaggagcacgccguuggcaacgacacugggaagcauggcaaggagaucaagaucacaccccaguccaguaucacugaggccgaguuaaccggguaugguacgguuaccauggagugcuccccgcggacuggcuuagacuucaaugagauggucuuauuacaaauggaggauaaagccuggcuaguccaccggcagugguuccuugauuuaccacuacccugguuaccgggggccgacacacaaggcagcaacuggauccaaaaggagacucucguaaccuucaaaaacccccacgcgaagaagcaggauguggucguucugggcucccaggagggcgccaugcauacggcccugaccggagcuacggagauccagaugagcucgggaaaccucuuauucaccggccaucugaaaugucgccuccgaauggacaagcuacagcugaaagggauguccuauuccaugugcaccggcaaauucaagaucgucaaagagaucgcggagacccagcacggcaccaucgugauacgcgugcaauacgagggcgacggcuccccuuguaagauccccuucgagauaauggaccucgagaagcgacacguguuaggccgccucaucaccgugaauccgaucguuaccgagaaggacagccccguuaacauagaagcggaaccacccuucggcgacagcuacaucauaaucgggguggagcccggccagcucaaauugaacugguucaagaaggggagcuccaucggccagauguuugagaccacaaugcgaggcgccaaacggauggccauccugggugauacugccugggacuuuggcagccucggaggcguguucacaaguaucggcaaggccuuacaccagguauucggagcuauauauggcgccgccuucagcggggucuccuggaccaugaaaauccuuaucggcgucaucaucacguggaucgggaugaacucccggggcaccucccugucagugucccucguuuuggugggagucguuacguuguauuugggcguuaugguucaggccgacagugggugcgugguguccuggaagaacaaggaacuuaagugcggaucaggcauuuucaucacagauaauguccacacguggacagagcaguacaaguuccagcccgagagucccagcaagcucgccuccgccauccagaaggcccaugaggaggguaucuguggcauccgguccguaacucgccucgaaaaucugauguggaaacagaucaccccggagcugaaucacaucuugagcgagaacgaggugaagcugaccaucaugaccggagacaucaaaggcaucaugcaagcgggcaagcggucccuucgcccgcagccaaccgagcucaaguacagcuggaagaccugggggaaagccaagaugcucucuacggagagccacaaccagaccuuccugaucgacggccccgagacggcugaaugcccgaacacaaaccgggccuggaacucccucgaagucgaggauuacggguuuggcguguucagcacgaacaucuggcugaaacugcgcgagaagcaggacguuuucugcgacuccaagcucaugagcgccgccaucaaggauaaccgagcgguccacgcggauaugggauauuggaucgagucugcauugaaugauacauggaagauggagaaggcgagcuucaucgagauuaaguccugccauuggcccaagagccauacccucuggucuaacgggguacucgaaagcgagaugaucaucccuaagaacuucgcgggccccgugucccagcacaacuaucguccgggguaccacacccagaccgcuggucccuggcaucugggcaagcucgagauggacuucgacuuuugcgagggcacgacagucgugguaaccgaggacugcggcaaccggggucccucacuccgcaccacuaccgcgucaggcaagcugaucaccgaguggugcugccgguccugcacccugcccccucuacgauaucggggcgaggaugguugcugguacgggauggagauacgcccccugaaggagaaagaggagaaccuggucaacucgcucguaaccgccgggcacggacagaucgacaacuucuccuugggggugcuggguauggcccuauuccuggaggagaugcugaggacgcgcgucgguaccaaacacgccauccuccuaguagcggugagcuucgucacacugaucacgggcaacauguccuuccgggaucucgggcgcgugaugguuauggucggcgccaccaugacggacgauaucggcaugggggugacguauuuggcucugcuagcugcguucaaaguccgcccuacauucgcggccggccugcuccuccggaaguugaccagcaaggaguugaugauggccacaaucggcaucgcccuccugagucaaagcacgaucccugagaccauccuggagcucaccgaugcccuggcacuagguaugauggugcucaagauuguccggaacauggaaaaguaccagcuggccgugacgaucauggccaucucaugugucccgaacgccgugauacugcaaaacgcuuggaaggugucuugcacgauccucgcggccgucuccguauccccgcugcugcucacguccagccagcaaaaggccgauuggaucccccuugcccuuaccaucaaggggcucaacccaaccgcgaucuuccugacaacucugagucggaccagcaagaagcgcagcuggccgcucaacgaggccgucauggccguggggauggugagcauccuagccuccucccugcucaagaacgacauccccaugaccggcccccugguggccgggggacugcugacugugugcuacgugcuaacuggucggagcgcggauuuagaguuagagagggccgcugacgugaagugggaggaccaggccgagaucuccggcuccuccccaaucuuaagcaucaccaucucggaagacggcagcaugucaaucaagaacgaggaggaggagcacacgcugaccauccucauccgcacaggguuauuggugaucagcgguguauuuccggucaguauccccauaacggccgcggcaugguaucucugggaggugaagaagcagcgcgcaggggugcugugggacguccccagcccgccucccguagggaaggccgagcuugaagacggggccuaucggauaaagcagagggguaucuucggguacucccagaucggagcgggcguguacaaggaggggaccuuccacaccauguggcacgucacccggggugccgugcucaugcaucguggcaagcgaaucgagccaucuugggccgaugugaagaaggacuugaucuccuauggcggcggcuggaaacuugaaggcgaguggaaggagggggaggagguccaggugcucgcccuggagcccggcaagaacccccgcgcgguccagacgaaacccgggcuguucaagaccaacacaggcaccauaggcgcgguuagccuggauuucuccccggggacgagcgguucccccauuguagacagaaaggguaagguagucggccuguacgggaacggggucgugacccgcagcggcgccuauguuuccgccaucgcccagacggagaaguccaucgaggacaauccagagauagaagacgacauauuccggaaaaagcgccuuaccaucauggaccuccacccuggggccggcaaaacgaagcgguaccugcccgccaucgugcgcgaggccauaaagcgggggcuacgcacccugauccucgccccgacucgcguggucgccgcugagauggaagaggcucugcgaggacugcccauccgcuaccagaccccugccauccgggcagagcacacuggccgcgagaucgucgaccuaaugugccacgcuaccuuuacuaugcggcuccucuccccagugagagugccgaacuacaaccuuaucaucauggacgaggcgcauuucacggacccggccuccaucgccgcccggggguacaucaguacacgcguggagaugggcgaggccgcggggauuuucaugaccgccacuccacccggcuccagggacccguucccccagagcaaugccccgauuauggacgaggagagagagauacccgagcgguccuggaacucugggcacgaguggguuaccgacuuuaagggcaagacugucugguucgugcccuccauuaaggccgguaaugacaucgcggccugucuacgcaaaaacgguaagaaggugauccagcugagccguaaaaccuuugacuccgaguauguaaagaccagagccaacgacugggacuucguggugacaacggacaucucugaaaugggcgccaacuuucgggccgagcgcgucaucgaccccagaaggugcaugaagccagugauccucaccgacggcgaggagcgggugauccuggcgggacccaugccggucacgcacuccagugccgcgcagaggcgcggucggaucggucguaaucccaaaaacgagaaugaccaguauaucuacaugggcgaaccucuggaaaacgacgaggacugcgcacacuggaaggaggcaaaaaugcuucuggauaacaucaacacccccgaaggaauuauuccguccauguucgagcccgagcgggaaaaaguugacgcgaucgacggcgaauaccgccugcgcggagaggccagaaagacguuuguggaucucaugcggcgcggagaccugcccgucuggcuggccuaccggguugccgcagaggggauuaacuaugcggacaggcgguggugcuucgacggcauaaagaacaaccagaucuuggaagagaacguggaagucgagaucuggaccaaggagggcgagcggaagaagcugaagccccgguggcuggacgccagaaucuauagcgacccccucgcccuaaaggaguucaaggaguucgcagcuggccgaaagucacuuaccuuaaacuugaucaccgaaaugggccgauugcccaccuuuaugacucagaaggcccgggaugcacucgauaaccuagccgugcugcacaccgccgagguagggggccgcgcguacaaccacgcccucagcgagcugcccgagacucuggagacgcuucuguugcucacgcugcuggccacaguaaccggcgggaucuuccucuucuugauguccggcaaggguauaggcaagaugacguuaggaaugugcugcaucaucaccgcgagcaucuuacuaugguacgcacagauacagccgcauuggauagcagccucgauaauccuggaguucuuucucaucgugcuacugauccccgagcccgagaagcagcgcacgccucaagauaaccagcucacauacguggucaucgccauccugaccguugucgccgccacgauggcgaacgagaugggauuucuggaaaagaccaagaaggaccucggccuugggagcauuacaacacaggagagcgaguccaacauacuggacaucgaccuccgcccggccagcgccuggacgcuguacgccguagcaaccacuuuugugacccccaugcugcggcauucgauagagaacagcagugugaacgugucguugacggcgauagccaaccaggccaccgugcugauggggcuaggacgcggauggccccucucaaagauggauaucggugucccacugcuggccauaggcugcuacucccaggugaacccgaucacccucaccgcagcccuguuacuauuaguggcucacuacgccaucaucggucccggucuccaggcaaaggcgacgagggaggcccagaagcggaccgccgcagggauuaugaagaaucccacagucgaugggauuaccgugaucgaccucgaacccauuccguacgaccccaaguucgagaaacagcuuggccaggugaugcugcucguccuguguguuacccaggugcucaugaugcgcaccaccugggccuugugugaggcacugacccuggcuacggggcccauuuccacccucugggagggcaaccccggucgguucuggaauaccacuauugcagugagcauggccaacaucuucagggguucauaccuagccggugccggucuucucuucagcaucaugaagaacaccacgaacacccgucgcggcacgggcaacaucggggagacgcugggcgagaaguggaaguccagauugaacgcccucggaaagucggaguuccagaucuacaagaaguccggcauccaggagguggauaggaccuuagccaaggaggggaucaaaaggggcgagacugaccaucacgccgugagccgaggcucagcgaagcugcggugguucguagagcgcaauaugguaaccccggaggggaaagugguugacuuagguugcgggaggggcggguggaguuacuacugcggcggacuuaagaacgugcgagaggugaaagggcugacgaagggcgggcccggccaugaggagcccauacccaugagcaccuaugguuggaacuuaguccgguuacaaagcggaguggauguguucuucacuccgccugagaagugcgacacgcuauugugcgacaucggcgaaaguuccccaaaccccacgaucgaggccgggcgcaccuuacgggugcuuaaccucguggagaacuggcucaacaacaacacccaauucugcaucaaggugcugaacccauacaugcccagcguaaucgagaagauggaaaccuugcagaggaaguacggcggggcccuggugaggaaccccuuauccagaaacagcacccacgagauguacugggucuccaacgccacgggcaacaucgucagcuccgugaacaugaucagcaggaugcugauaaaccgguucaccaugaagcacaagaaggccaccuacgagcccgacguggaccucgggucaggcacccguaacaucggcaucgaaaacgagauccccaaccuggauauaauugggaagcggaucgagaagaucaagcaggagcacgagacgagcuggcacuacgaccaggaccaucccuacaagaccugggcguaccacggcuccuacgagaccaagcagacggggagcgccucaagcauggucaacggcgucgugaaacugcucacaaagcccugggaugucgugccgaugguaacccagauggccaugaccgauaccacgccguucggccaacagcgcguguucaaagagaaaguugacacccggacccaggaacccaaggaggggaccaagaaacuuaugagaauuacggccgaaugguuguggaaagaacucggaaagaagaagacuccccggaugugcacccgcgaggaguucacccggaagguccgcagcaacgccgcgcuaggggccaucuucacggacgagaacaaauggaaguccgcccgggaggccguugaagacucccgcuuuugggagcuaguagaccgggaacgcaaccuccacuuagaggguaaaugcgagacuugcgucuacaauaugauggggaagcgggagaagaagcugggcgaguuuggcaaagccaaggggucucgcgcuaucugguacauguggcucggcgcccgguuccuggaguucgaggcacugggauuccucaacgaggaccacugguuuucccgcggcaacucucucagcggggucgagggcgagggacuucacaagcucggguauauccugcgagacgucuccaaaaaggaaggcggagccauguacgcggacgacacugcgggcugggauacccgcaucacgcuugaggaccucaagaacgaggagauggucaccaaucacaugaaaggcgaacauaagaagcuggcagaggccaucuucaagcugaccuaccagaacaagguggugcggguucaacgcccuacucccaggggcacgguaauggacaucaucucuaggaaggaccagcgcggcuccggucaggugggaaccuacgggcucaacacauucacaaauauggaggcccagcugauacggcagauggagggcgaaggcauauucaagagcauccagagacugacagucaccgaagaaaucgcggugcagaacuggcucgcccggguggggagggagcggcuguccagaauggccaucagcggcgacgauugcgucgugaagccucuggacgaccgauucgccucagcccucaccgcgcugaacgacauggggaagguccgcaaggacauccagcagugggaacccucacggggcuggaacgacuggacccaggucccguucuguucccaucacuuucaugagcuggugaugaaggacgggcgcguucucgucgugccuugccggaaccaagacgaacugauaggccgcgcccguaucagccagggggccggcugguccuuaaaggagacggcgugccuuggcaaaagcuacgcccagauguggacguugauguacuuccaccgccgggaccugaggcucgcggcaaacgccaucugcucugccguucccucacacuggguccccaccagccggacgaccugguccauucacgccaagcacgaguggaugacgacugaagacaugcuggccguguggaaccgaguuuggauccaggaaaauccguggauggaggauaaaaccccuguggaaagcugggaagaggugccuuaccuggggaagagagaagaccaguggugcgguagccuuaucgggcucaccucucgggccacgugggccaagaacauucagacugcaaucaaccaggugcgaagucugaucgggaacgaagaguacaccgacuauaugcccucaaugaagcgguuccggaaagaggaggaggaggcgggaguccucugguag

SEQ ID NO: 25233 - RNA, 9876 nt, Artificial Sequence
  derived and/or modified CDS sequence (opt11) from DENV-2__EU687231__SS-prME
acggcaggagugauaauuaugcugauacccaccgccauggcguuccaccucacgacgcgcaacggggaaccucacaugaucguuggccgccaagagaaaggaaaaucacuguuauucaaaacugaggacggcgugaacaugugcacucuaauggcuaucgacuuaggggagcuaugcgaggauaccaucacuuauaaguguccacuacugcggcagaaugagccggaagacaucgauugcuggugcaacucuacuucaacgugggugaccuacggaaccugcaccacaacgggggagcaccgucgcgagaaacgguccguugcacuugugccccauguggggaugggcuuggagacccgcacagagacauggaugucgagcgagggggccuggaaacacguucaacgaaucgagaccuggauccugcgccaccccggcuuuacaaucauggccgcaaucuuagccuacacgaucgggaccacgcacuuccagcgggcccucaucuucauccuacugaccgcgguggcgccguccaugaccaugcgaugcauaggcauaucuaaucgggacuucguggagggaguuucagggggcuccuggguggauaucgugcuugagcacgggucuuguguaaccacaauggccaaaaauaagcccacccuggauuuugagcugaucaagaccgaggcaaagcaacccgccacccuccgcaaguauuguauagaggccaagcugacuaauaccaccacagaaucgaggugcccgacgcaaggcgagcccucacuuaacgaggagcaggacaaacgcuucaucugcaagcauucaauggucgacaggggcugggggaacgguugcggccuguuuggcaaaggagggaucguuacaugcgcuauguucacguguaagaagaacauggaggggaaggucgugcugcccgagaaccucgaguacacuauagugauuacgccccacagcggggaggagcacgccgucggcaacgacacugggaaacacggcaaggagauuaagaucacaccccaaucuagcauuacugaagccgagcucaccggguauggcacggugaccauggaguguucccccaggaccggccuugacuucaaugagaugguccugcuucaaauggaggacaaggcauggcugguacaccggcagugguuuuuggacuuaccccugccuuggcugccuggggcggacacacaaggcagcaauuggauucagaaggaaacauuagugaccuuuaagaacccacacgccaagaaacaggacguggucguccucgggucccaggaaggugccaugcacaccgcccugaccggcgccacugagauccagaugucaaguggaaaucuccuguuuaccggucacuuaaagugucgccuccggauggacaaacuccagcugaagggcauguccuacagcaugugcacgggaaaauucaagaucguaaaggagaucgcggagacacagcacgggacaaucguaauacgcgugcaguacgagggggacggcucccccugcaagauucccuucgaaauuauggacuuagagaaacggcacguccugggucgucucauuaccgugaauccgaucgugaccgagaaggacucgcccgucaauauugaggcagagccgccauucggcgacuccuauauaaucaucggcguggagccgggucaacucaaacugaacugguucaagaaagggagcaguauugggcaaauguucgagacuacaaugcgcggagccaagcggauggcgauacugggcgacaccgccugggauuucgguagccuaggcgggguguucacguccaucgguaaggcccugcaucaggucuucggcgcgauauauggcgccgccuucagcgggguguccuggaccaugaaaaucuugaucggggugauuaucacguggaucgggaugaacucuagguccaccagccuguccgucagccuaguacuggugggcgucgugacauuguaccucggcgugaugguccaggccgacuccggcugugugguuucguggaagaacaaagagcugaagugcggcuccggaaucuucaucaccgacaacguccauacguggaccgaacaguacaaguuccagcccgaaucucccuccaagcuggcgucugccauccagaaggcccacgaggagggcauaugcgggauacggagcguaacucgccuugagaacuuaauguggaagcagauaacccccgagcugaaccacaucuuaagcgagaacgaggugaagcugacaaucaugacuggcgacaucaaggggaucaugcaggccggcaaacgaucacugcgcccgcagcccacagaacucaaauacuccuggaagaccuggggcaaggccaagauguuaucaacagagucccacaaucagacuuuccugaucgacgggcccgaaaccgcggagugcccgaacacaaauagagccuggaacagccuagaaguugaggacuacggguucgggguauucuccacgaacaucugguuaaagcugcgcgagaagcaggacguuuucugcgacagcaaacugaugagcgcugccauuaaggacaaucgggcaguacacgcggacaugggcuacuggaucgagagcgcccugaacgacacuuggaagauggagaaggcuuccuucauugagaucaagucaugucauuggcccaagucccacacgcucuggucgaacggggugcucgaguccgagaugaucauucccaagaacuucgccggucccguaagccagcauaacuacaggccgggauaccacacgcagacagccggcccuuggcaccugggcaagcuagagauggacuucgauuuuugcgaggggacaacgguggucgugacggaggacuguggcaaccgcgguccaucgcuccgcacaaccaccgcguccgggaagcugaucaccgaguggugcugucguagcugcacccugcccccgcucagauacagaggggaagacgggugcugguauggcauggagauacgcccacuaaaggagaaggaggagaaccugguaaacagccuagugacggcugggcauggucagaucgacaacuuuagccugggugugcuggggauggcccucuuccuagaggagaugcuucgaacacgcgucggaaccaagcacgccauacuucuggucgcggugucuuucgucacuuugauuaccgggaauaugagcuuccgggacuuaggcagagugauggugauggucggugcaaccaugaccgacgauauaggcaugggggugacuuaccuagccuuauuagccgccuucaaggugcgccccacguucgcggcuggucuguugcuccggaaguuaacauccaaggaacugaugauggccaccauugguaucgcccuccugagccagaguacaauucccgaaacaauccucgagcucacagacgcacucgcacuugggaugauggucuugaagaucguccgcaacauggagaaguaccagcucgccgugaccaucauggccaucagcugcguccccaaugccgugauccugcagaacgccuggaagguguccuguaccauacucgcggcagugagcgugucuccuuuacugcuuaccucaucgcagcagaaggccgacuggaucccacuagcccugacaauuaaggggcucaaccccacugcgaucuucuuaacaacucuaucucggacgucgaaaaagcgcagcuggccucuaaacgaggccguaauggccgugggcauggugucuauacuggccucaagccugcucaagaacgacauccccaugacugggccccugguggccggugggcuccucaccgugugcuacgugcugacgggccggagugcggaucuggagcuagagcgcgcugccgauguuaaaugggaggaccaggcugagauaucaggguccuccccgaucuuauccauaacaaucagcgaggacggcuccaugagcaucaaaaacgaggaggaggaacacaccuuaaccauccucauccggaccggcuugcuggugaucuccgggguauucccggucagcaucccgaucaccgccgcggccugguacuugugggaagugaagaaacagagggccggcgugcuaugggacguucccagcccuccgcccguggggaaagcagagcuggaggacggggcauaccggaucaaacagcgcgggauauucggcuacucucagaucggcgcugggguauacaaggaggguaccuuccacaccauguggcacgucacucgcggcgcaguccucaugcaucgcgggaagcggauugagccaucaugggccgauguaaagaaggaccugaucagcuacgggggcggcuggaagcucgagggggaauggaaggagggagaagaggugcagguccuugcccuggaacccgggaagaauccccgggccgugcagacgaaacccggccuguucaagaccaacacagguaccaucggagcggucucccuagacuucagccccggcacguccggcagcccgaucguggaccggaaggggaaggugguugggcuguacggcaacggggugguuacccguaguggugccuaugucucugccaucgcucaaaccgaaaaguccauagaggacaauccggagaucgaagaugacaucuuccgaaagaaacgccugacaauaauggaccuccaccccggcgcugggaaaacgaaaagguaccuuccagccaucgugcgcgaagcaauaaaacggggccugcguacacucauccucgcacccacccggguggucgcagcggagauggaggaggcacuccgggggcugccgauucguuaucaaacccccgccauccgggcagagcacacggggagggaaaucgucgaccucaugugucacgcaacauucaccaugcggcuacuguccccaguacgcgucccaaacuacaaccucaucaucauggacgaggcgcacuuuacggaucccgccagcaucgccgcccggggguauaucucgacgcgcguggaaaugggggaagccgcuggaauauucaugaccgccacgccgcccggaagccgggacccuuucccccaauccaaugcaccgaucauggacgaggagcgcgagaucccugagcgcagcuggaacagcgggcacgaguggguuacagacuuuaaggggaagacggugugguucgugccaucgaucaaggccggcaaugauaucgcugccugccugaggaagaacgguaaaaaggugauccagcugucccgaaaaaccuuugacagcgaauacgugaagacacgagcgaacgacugggacuucguggugaccacggacaucagugaaaugggggcgaacuuccgagccgaaagagucaucgacccccggcgcugcaugaagcccgucauccucaccgacggggaggagcgggugauccuggcgggacccaugccggucacccacucauccgcagcccagaggcgcggccgaaucgggcgaaauccaaagaacgagaacgaucaguacauuuacaugggcgagccccucgagaaugaugaggauugcgcccacuggaaggaggcaaagauguugcuggacaauaucaacacccccgagggcaucaucccuagcauguucgagcccgagcgagagaagguugacgcuaucgauggagaguaccgcuuaagaggggaagcccgcaagacauuuguggaccuuaugaggcgcggcgaccugcccguuugguuagcuuauaggguggcagcagaaggcauuaacuacgccgauaggcgguggugcuuugacgggaucaaaaacaaccagauacuggaggagaacguggaagucgagaucuggaccaaggaaggagagcggaagaaguugaagccaagauggcucgaugcccgcaucuauucugacccccucgcacugaaggaguucaaggaauuugcagcgggccggaagucgcugacccuaaaccugaucaccgagauggggcgccugcccacguucaugacucagaaggccagagacgcacucgauaaccuggccguccuacauaccgcggaggucggcgggcgggccuacaaucacgcacucuccgagcuacccgaaacucuugagacgcuauuacugcucacccugcucgcgacggugaccggcggcauauuucuauuccugaugagcgggaagggcaucggcaagaugacguugggcaugugcuguaucaucaccgccuccaucuuacuuugguaugcccagauccagccacacuggaucgcggcgagcaucauucuggaguucuuccucaucgugcugcugauccccgagcccgaaaagcagcgaacuccgcaagacaaccagcucaccuacgucgucaucgccauccugaccguggucgccgccacaauggcuaaugaaaugggguuucuggagaagaccaagaaggaucucggauuggggagcaucacgacgcaggaguccgagagcaauauacucgacaucgaccuccgcccggcauccgccuggacccuguacgcggucgccaccaccuuugugaccccaaugcuacgacauaguauagagaacucgagcguaaaugugucccucacagcaauagcuaaccaggcaacugugcugauggggcugggacgcgguuggccccucagcaagauggacaucggcgucccgcuacuggccaucgggugcuacucccaggugaacccgauaaccuuaaccgcagcucuguugcuccugguugcccacuaugccaucaucgguccgggccugcaggcuaaggcgacgcgcgaggcccaaaagcggaccgccgccgggaucaugaagaauccgaccgucgauggcauuaccguuaucgaccucgaaccuaucccguacgaccccaaauucgagaagcaacugggacagguuaugcuacucguccugugcguaacccaaguguuaaugaugcgcacgacaugggcccuaugugaggcucuaacauuagcaacgggccccaucucuacccucugggaggggaacccugggagguucuggaacacgacgaucgcagucuccauggccaauaucuucaggggcagcuaccucgccggggcgggccuccuauucucgaucaugaagaauacgaccaauaccaggagggggaccggcaacaucggugagacgcucggggaaaaguggaagucucggcuuaaugccuuaggcaaguccgaguuccagauauauaagaagaguggaauacaagagguggauagaacacuggccaaagagggcaucaagcgcggugagacggaccaccaugcggucuccagggguucagcgaagcugcgaugguucguggagcggaacauggugaccccugagggcaaaguaguagaucucgguugcggccgcggcgggugguccuacuacuguggcggguugaagaacgugcgcgaggugaaaggacugacgaagggcgggcccgggcacgaggagcccauccccaugagcaccuacggcuggaaccuuguccggcugcagagcgggguggacguguucuuuaccccgccugaaaaaugcgacaccuugcucugcgacauaggcgagaguagcccgaacccgacgauagaggcgggacgcacccugcgggucuuaaauuuaguggaaaacuggcuaaacaacaacacacaguucugcaucaaagugcuuaaccccuacaugcccucggugaucgagaagauggagacucuccagcguaaauacgguggcgccuuagugcggaacccucuuagccgcaauaguacucaugagauguacuggguuagcaacgcaacggguaauaucgucuccagcgugaacaugaucucucguauguuaauuaacagguucaccaugaagcacaagaaggccaccuacgagccggacgucgaucucggcagcgggacacgaaacaucgggauugagaacgaaauccccaaucuggacaucauagggaagcggaucgagaauauaaaacaagagcacgagacgucauggcacuacgaccaggaccaccccuacaaaacuugggcguaccacgggagcuaugagaccaagcagacaggcuccgccucgaguauggucaacggggucguaaagcugcuaacgaagcccugggacgucgugccgauggugacccagauggccaugaccgauacuacacccuucggccagcaacgcguuuucaaggagaagguugacaccagaacccaggagccuaaggaggggaccaagaagcucaugcgcaucacugccgaguggcuguggaaggaacugggcaagaagaaaacgccgcggauguguacuagagaggaguucaccagaaaggugcgcuccaacgccgcguugggcgcaaucuuuacggaugagaacaaguggaagucugcacgggaagcggucgaggauucacgcuucugggagcugguggaccgagaacgcaaccuccacuuagaagggaagugcgagaccugugucuacaacaugaugggcaagcgggagaagaagcugggggaguucggcaaggccaagggaagcagggcgauaugguauauguggcucggggcucgguuccuggaguucgaagcucucggguuccucaacgaagaucacugguucucacgcgggaacucucuguccggcguggagggggagggccuacauaaacucggguacauauuaagagauguaucaaagaaggagggcggagccauguaugcggaugacacugccggaugggacacgagaaucacgcuggaagaccucaagaacgaggagauggucacgaaucacaugaagggugagcacaagaagcuggccgaagcgauuuucaagcugaccuaucagaacaaggucgucagaguccagcgcccuacgccccgugggacggugauggacaucaucucccggaaagaccagcguggcucaggccaggugggaaccuacgggcucaacacuuucacaaacauggaagcccaacucauacggcaaauggaaggggagggcaucuucaagucuauacagagacugacggugaccgaagaaaucgcggugcagaacuggcucgcccgggugggccgagaacggcugagcaggauggccaucuccggggaugacugcgucgucaaaccucuggacgacagauucgccagcgcgcucaccgcgcucaacgacaugggcaagguccgcaaggauauccaacaaugggagcccucacgcggguggaacgauuggacccaaguuccguuuugcagccaucacuuccacgagcuggugaugaaggacgggcgcguguuagucgugcccugucggaaccaggacgaguugauuggccgcgcccguaucucccagggcgccggcuggucacugaaggaaacagccugucucgggaagucauacgcccagauguggacgcugauguauuuucaucgccgggaccugcggcuugcugcgaaugccaucugcucugccguacccucccacuggguccccaccagccggaccaccuggaguauccacgcgaagcacgaauggaugacgacggaggacaugcuggcgguguggaaccgcguguggauccaggaaaacccguggauggaggacaagaccccagucgagagcugggaggaggugcccuaccugggaaagagagaggaucaguggugcgguagccuaaucgggcugaccucccgggccacaugggccaagaacauccagaccgccaucaaccagguaagaagccugaucgggaacgaggaguacaccgacuacaugcccuccaugaagcgguuccgcaaagaggaggaagaggcgggcguccugugguga

SEQ ID NO: 25234 - RNA, 9876 nt, Artificial Sequence
  derived and/or modified CDS sequence (opt11) from DENV-2__EU687199__SS-prME
accgccggggugaucaucaugcugauacccaccgccauggcguuccaccuuaccacccggaacggggagccacacaugauugucggccggcaggagaaggggaagucccuucuguucaagacugaggacggagucaacaugugcacccucauggcuaucgaccugggggagcucugugaagacaccauuaccuacaaaugcccccuccugagacagaacgagcccgaggacaucgacugcuggugcaacaguaccagcaccugggugaccuacgggacguguaccaccacgggcgagcaccggcgcgagaagcgguccgucgcccuugugccccacguggguaugggucucgagacccggaccgagacguggaugagcucagagggggccuggaagcacguccagcggaucgagaccuggauacugcgccacccgggcuucaccaucauggccgcgauccuagcauacaccauagggaccacgcacuuccagcgggcccugaucuucauucugcugaccgccguggcgcccagcaugaccaugcgcugcaucggcaucuccaaccgggacuucguggagggcgucagcgggggcuccuggguggauauugugcucgaacacgggagcugcguuaccacgauggccaagaacaagcccacacuggacuucgagcugaucaagaccgaagccaagcagcccgcaacccuccgcaaguacugcauagaggccaagcugacgaacaccaccacugagucccggugcccgacgcagggcgagcccucgcugaacgaggagcaggacaagcgcuucaucugcaagcacuccaugguggaccggggcugggggaacggcugcggccuguucggcaagggcgggauagugaccugcgcgauguucacgugcaagaagaauauggagggcaaggucgugcugcccgagaacuuagaguacaccaucgugaucaccccacacagcggggaggaacacgccgucggcaacgacaccgggaagcaugguaaggagaucaagauuaccccgcaguccagcaucaccgaggccgagcucaccggguacggcacggugaccauggagugcagcccccggacuggccuggacuucaacgagauggugcugcuccagauggaggauaaggccuggcugguucaccggcaaugguuccuggaccucccgcugccauggcugccgggggccgacacucagggcucgaacuggauccagaaggagacgcucgugaccuuuaagaacccucacgcgaagaagcaggacgucgucgugcuggggucccaggagggggccaugcacaccgcccugaccggggccacggagauccagaugagcagcgggaaccuccuguucaccggccaucugaagugccgccuccggauggacaagcugcagcugaaggggaugucguacaguaugugcaccggcaaguucaagaucgucaaggagaucgccgagacccagcaugggacgaucgugauccgcguacaguacgagggcgacggcucccccugcaagauccccuucgagaugauggaccucgagaagcggcacguguuggggcgccugaucaccguuaacccgaucguuaccgagaaggacagucccgugaacaucgaggcagagccgccuuucggcgacuccuacaucaucaucgggguggagcccggccaguugaaguugaacugguucaagaagggguccuccaucggucaaauguucgagacuacgaugcgcggugcaaagcguauggccauacuuggggacaccgcaugggacuucggcagccucgguggaguguucaccuccaucgggaaggcccugcaccaggucuuuggcgcgaucuacggcgcagccuucagcggggugucguggaccaugaagauccugaucggcgugaucaucacguggaucgggaugaacagccgauccaccagccuguccgucagccucgugcuggugggcgucgugacccucuaccucggggugaugguccaggccgacaccggcugcguggugucguggaaaaacaaggagcugaagugcggcagcgggauuuucaucacggacaacguccacaccuggaccgagcaguacaaguuucaaccugagucccccucuaagcuggcaagcgccauccagaaggcgcacgaagaggggaucugugggauccgguccguaacccgacucgaaaaccugauguggaagcagaucacacccgaguugaaucacauacugagcgagaacgaagugaaguuaaccaucaugaccggcgacaucaagggcaucaugcaggccggaaaacgguccuugcgcccccagcccaccgagcucaaguacagcuggaagaccugggguaaggccaagaugcuguccaccgagagccacaaccagaccuuccugaucgacggccccgaaaccgcugaaugcccgaacacgaaccgggccuggaacucucucgaggucgaggacuacggcuucgggguguucagcaccaacaucuggcugaagcugcgcgagaagcaagacguguucugcgauuccaagcucaugagcgccgccaucaaagacaaucgggccguccacgcggacaugggauacuggaucgaguccgcccugaacgacaccuggaagauggaaaaagcuagcuucaucgagaucaaguccugccacuggcccaaaagucacacccugugguccaacggcgugcucgagagcgagaugaucauccccaagaauuucgccggacccguaucacagcauaacuaccgcccgggcuaccacacccagacggccggacccuggcaccugggcaagcucgagauggauuucgacuucugcgaggggaccacuguaguggugaccgaggacugcggcaaccggggacccagccuccgcacgacgaccgcgagcgguaagcugaucaccgaguggugcugccgguccugcacgcugcccccgcuccgcuaccggggcgaagacgguugcugguacggcauggagauccgcccccugaaggaaaaggaggagaaccuagucaacucucucguuaccgccgggcacggccagaucgacaacuucucccugggugugcuggguauggcccucuuccuugaggagaugcugcguacacgcgucggcacuaagcacgccauccuccugguugcggugagcuuugucacgcugaucacagggaacaugucguuccgggaccugggccgcgugauggugauggucggcgccaccaugaccgacgacaucggcaugggagugacguaccuggcucugcucgccgccuucaaggugaggcccaccuucgcggccggacuucugcugcggaagcugacuagcaaggagcugaugauggccaccaucggcaucgcccuccugucccaaagcacgauccccgaaaccauccuggagcucaccgacgcucuggcgcuggggaugaugguccucaagaucguccguaacauggagaaguaccagcuggccgugaccaucauggccaucaguuguguccccaaugcagugauccugcagaacgcuuggaaggugagcugcacaauccucgcggcugugucggugagcccccugcugcucaccuccagccagcagaaggcagacuggaucccccucgcacugacgaucaagggccucaaccccaccgcuaucuuucugacaacccugucccggacgagcaagaaacgcuccuggccgcugaacgaggccgucauggccgugggcaugguaagcauccuggccuccagccugcucaagaacgacauccccaugaccgggccgcuggucgcaggcggacugcucacggugugcuacguccugacaggccgcagcgcggaccuggagcuggagcgcgccgccgaugucaagugggaggaucaggccgagaucucagggucguccccgauccugagcaucaccaucuccgaggacggcagcauguccaucaagaacgaggaggaggagcauacgcugacgauccucauccggaccggacuacuggugauaagcgggguguuccccgucuccaucccgauaaccgccgcggccugguaccucugggaggugaagaagcagcgcgccggcgugcugugggacguccccagcccaccgcccguggggaaggcggagcuggaggacggcgcuuaucguaucaaacagcgagggaucuucggcuacucccagaucggcgccgguguguacaaggagggcaccuuccacaccauguggcaugucacgcgcggggccgugcucaugcaccgcggcaagcggaucgagcccagcugggccgacgugaagaaggaccuaaucagcuacgggggcgguuggaagcuggagggggaguggaaagagggcgaggagguccaggugcucgcccuggagccagggaagaacccccgugcgguacagaccaagccgggccuuuucaagaccaauaccggaacgaucggcgcggucagccucgacuucucccccggaaccagcgggucccccaucguggaccggaagggcaagguugucgggcuguacggcaacggcguggugacccgcucuggggccuacguguccgcuaucgcccagacugagaaguccaucgaggacaaccccgagaucgaggacgacaucuuccggaagaagcgcuugacgaucauggaccuccacccgggggcggggaaaacgaaacgguaccugcccgccaucgugcgcgaggccaucaagcggggccugcgcacccuaauccucgcaccgacccgaguggucgccgcggagauggaggaagcccugcgggggcugcccauccgcuaccaaacgcccgccauccgggccgagcacaccggccgcgagaucguagaccucaugugucaugccaccuucaccaugcggcuguuaagccccgugcgcgugccgaacuacaaccucaucaucauggacgaggcucacuucacggaccccgccuccaucgccgcccggggcuacauaagcaccagaguggagaugggggaggccgcgggcaucuucaugaccgcaaccccgcccgggucccgggaucccuucccccagucuaacgcccccauuauggacgaggagcgcgagauccccgagcgguccuggaauagcggccacgagugggugacggacuucaaggggaagaccgucugguucgugccgucaaucaaggccggcaacgacaucgcggccugccuucgcaagaacggcaagaaagugauccagcugagccggaagaccuucgacucugaguacgucaagacccgcgccaaugacugggauuuuguggugacgaccgacaucagcgagaugggggccaacuuccgggccgagcgcgucaucgaccccagacggugcaugaagcccgugauccucaccgacggagaggagcgcgugauccuggcggggccaaugccggucacccacuccucggccgcccagcgccgcggcaggaucgggcgcaacccaaagaacgagaaugaccaguacaucuauaugggcgagccccuggaaaacgacgaggauugcgcccacuggaaggaggccaagaugcuccuggacaacaucaacacgccagagggcauuaucccguccauguuugagcccgagagggagaagguugacgcaauugacggagaguaucgccugcggggcgaagcgcgcaagaccuucguggaccucaugcggcgcggggaccugcccguguggcuggcuuaccggguggccgcagagggcauuaacuaugcggaccgccggugguguuucgaugggauuaaaaacaaccagauccucgaagagaacguggaggucgaaauuuggaccaaggagggggagcgcaagaaacugaagccgcgguggcuggacgcccgcaucuacagcgacccguuagcccugaaagaguucaaggaguucgccgcgggucggaagucccugacccucaacuuaaucacggagauggggcgacucccaaccuucaugacccagaaggccagagacgcccucgacaacuuggccgugcuccacaccgcagaggucggcgggcgagcauacaaccacgcccuaucagagcugcccgagacucuggagacccuccugcuguugacccugcuggccaccgugacuggcggcaucuuccuuuuccuuauguccgggaaaggcaucgggaagaugacccugggcauguguuguauaaucaccgccagcauccuacugugguacgcccagauacaaccgcacuggaucgcggccuccauuauccuggaguucuucuugaucgugcuauuaauccccgagcccgaaaagcagcggacgccucaggacaaccaguugaccuacgucgugaucgccauacugacuguggucgccgcuacgauggcgaacgagaugggguuccuggagaagacaaagaaggaucucggccugggaagcaucaccacgcaggagagcgaguccaacauccuggacaucgaccuccgcccggccagcgccuggaccuuguaugccguggccacuaccuucgugacgcccaugcuacgccacuccaucgagaacagcuccgucaacgugucacucaccgcgaucgccaaccaggccaccgugcugauggggcugggccgcggguggcccuuauccaagauggacaucggcguaccccugcuggccaucgguugcuacagccaggugaaccccauaacccuaacggcggcccugcuguugcugguggcccauuaugccaucauuggcccgggccuccaggccaaggcaacccgcgaagcccaaaagagaaccgccgccgggaucaugaagaaccccaccgucgacggcaucacggugaucgaccucgagcccaucccuuaugaccccaaguucgagaagcagcugggccaggugaugcugcucguccuguguguaacucaggugcugaugaugcgcaccaccugggcccucugcgaggcgcugacucuagcuaccgggcccauuuccacccucugggagggcaaccccggccgguuuuggaauaccacgaucgcggucagcauggccaacaucuuccgcggcuccuaccuggccggggcgggcuugcucuucaguaucaugaagaacaccacaaacaccagacgugggacgggaaacaucggggagacccugggugagaaguggaaaucccggcuuaacgcccucggcaagagcgaguuccagaucuacaagaaguccgggauccaggagguggaccgcacccuggccaaggaaggcaucaagcgcggggagacggaccaccacgccguaucgcgcggcuccgcgaagcugcguugguuuguagagaggaacaugguaacuccggagggcaaggucgucgaccucgggugcggccgcggagggugguccuacuauugcggcggguuaaagaaugugcgcgaggugaaggggcugaccaagggcggccccgggcacgaggagccaauccccauguccaccuacgguuggaaccucguccggcugcaaucggggguggacguguucuuuacaccgccugagaagugcgacacgcugcucugcgacaucggagagagcucccccaaccccaccaucgaagcgggccgcaccuugcgggugcugaaccucguggaaaacuggcugaacaacaacacccaguucugcgucaagguccugaacccuuauaugccuagcgugaucgagaagauggagacccuccaacgcaaguacgggggcgcucugguccggaauccccugucacgcaacagcacgcacgagauguacugggucuccaacgccaccgggaacauugugagcuccgugaacaugaucagccgcaugcuaaucaaccgguuuaccaugaagcacaagaaggccaccuacgagccggacgucgaucucggcuccgggacgcgcaauaucggcauagagaacgagauccccaaccuggacaucaucgguaagcggaucgagaagaucaagcaggaacacgagaccaguuggcacuacgaucaggaccaccccuacaagaccugggcguaccacgggaguuacgagaccaagcagacgggcagcgccuccagcauggugaacggggucgucaagcugcucaccaaacccugggacguggugccuauggucacccagauggccaugaccgacacaacccccuucggccagcagcgcguguucaaagagaagguggauacccggacccaggagccuaaggagggcacgaagaagcugaugcgcaucaccgcugaguggcuguggaaggagcucgguaagaagaagacaccccggaugugcacccgcgaggaauuuacacggaagguccgcuccaacgccgcucugggcgccaucuucaccgacgagaauaaguggaaguccgcccgggaggccguggaggacucgcguuucugggaguuggucgaccgggagaggaaccuccaccuggaggggaaaugcgagacaugcguguacaauaugaugggcaagcgggagaagaaguuaggggaguucggcaaggccaaggggagccgcgccaucugguacauguggcucggggcccgguuccuggaguucgaggcacugggauuccucaacgaggaccacugguucucccgcggcaacagccugagcggcguggagggggaggggcugcauaagcucggcuacauccugcgugacgucuccaagaaggagggcggggcaauguaugcagacgacacugccgggugggacacgcgcaucacccuggaggaccucaagaacgaggagauggugaccaaccacaugaagggcgagcacaagaagcuggccgaggcgaucuucaagcugaccuaccagaacaagguggucagggugcaacgcccgacgccccgcggaacugugauggacaucaucagccgcaaggaccaacgcggcuccggccaggucgggaccuacggccucaacacuuucacgaauauggaggcccaguugauccggcagauggagggcgagggcauuuucaagagcauccagcgcuugaccgugaccgaggaaaucgcggugcagaacuggcuugcccgggucggcagggagcgacuguccaggauggcuaucagcggcgacgacugcgucgugaagccccuggacgacagauucgccucagcccucaccgcgcugaacgacaugggcaagguccgcaaggacauccagcaaugggagcccagccggggguggaacgacuggacccaggugccguucugcucccaccacuuccacgagcuggugaugaaggacggccgcguccuaguuguuccaugccgcaaccaggacgagcugaucggcagggcccggaucagccagggcgcaggcuggucccugaaagagacagccugucucggcaagagcuacgcccagauguggaccuugauguacuuccaccgccgggacuuacgccucgcggccaacgccaucugcuccgcaguccccagccacugggugcccaccucccgcaccacgugguccauacacgcgaaacaugaguggaugaccaccgaggacaugcuggcgguuuggaaccgcgucuggauccaggaaaacccguggauggaggacaagacccccguggaguccugggaggaggugcccuaucugggaaagcgugaggaccaguggugcgggagucucaucggccugacgagccgggcaaccugggccaagaacauucaaaccgccaucaaccagguacgcucccugaucgggaacgaggaguacaccgacuacaugcccagcaugaagcgguuccgcaaggaagaggaggaagcgggcguacucugguag

SEQ ID NO: 25235 - RNA, 9876 nt, Artificial Sequence
  derived and/or modified CDS sequence (opt11) from DENV-2__EU687235__SS-prME
accgccggcgugaucaucaugcucauccccaccgccauggcuuuccaccucaccacccggaacggagagccgcacaugaucgucggucggcaggagaaagggaagaguuugcuguucaagaccgaagacggcgugaacaugugcacgcucauggcgaucgaccugggcgaguugugugaagacaccauaacauacaagugcccgcuccugcgccaaaacgagccggaggacaucgacugcuggugcaacagcaccuccaccugggugaccuaugggaccugcaccaccacgggugaacaccggcgcgagaagcgauccguagcccuggugccccacgugggaaugggccuugagacccggaccgagaccuggaugagcagcgagggggccuggaaacacguacagcggauugagacguggauacuacgccacccuggcuucacuaucauggcagcgauccuggccuacacuaucggaaccacgcacuuccaaagagcccucaucuucaucuuacugaccgccguagcgcccaguaugaccaugcgcugcaucgguaucuccaaccgcgacuucgucgagggcgucagcggcgggaguuggguggauaucguucucgagcauggcuccuguguuacaacgauggccaagaacaagcccacccuggauuuugagcugaucaagaccgaggcaaagcagcccgccacgcuccgcaaguacugcaucgaagccaaacuuacgaacaccaccaccgacucccggugcccgacccagggggagccgagccugaacgaagagcaagacaagcguuucaucuguaagcauuccaugguggacaggggcugggggaauggcugcggccucuuugggaagggagggauugugacgugcgcgauguucacuugcaagaagaacauggagggcaaggucgugcugccugagaaccucgaguauacuaucguaauaacgccccacuccggugaggagcacgccguaggcaaugacaccgggaaacacggcaaggagaucaagaucaccccgcaguccagcaucacagaagcggagcucacaggauacggcacgguaaccauggagugcucaccccggaccggccucgacuucaacgaaaugguguugcuccagauggaggacaaggccuggcuggugcaccggcagugguucuuggaucucccccuacccuggcuccccggggccgacacccagggcucgaauuggauucagaaggagacgcucguuacguucaagaacccccacgcaaagaagcaagacgugguagugcuggggucccaggagggcgccaugcauaccgcccugaccggggcaacggagauccagaugagcuccggcaaccuccucuucacuggccaccugaagugccggcuccgaauggacaagcugcaguuaaaggggaugaguuauaguaugugcaccggcaaguuuaagauagucaaggagaucgcugaaacccagcaugggacgaucgugauucgcgugcaguacgagggagauggcucccccuguaagauccccuucgagaucauggaccucgagaagcgacaugucuuagggcgccugauuaccgucaacccgauuguaacggaaaaggacucgcccgucaacaucgaggccgagccgcccuuuggcgacuccuauaucaucaucgggguggaaccgggccagcuaaagcugaacugguucaagaagggcagcuccauugggcagauguucgagacaacgaugcgcggggcaaaacggauggccauccuaggugacacggcgugggacuucgguagcuuggggggcguguucacuuccauuggcaaggccuuacaccagguuuuuggcgcgaucuacggugccgccuucagugggguuucauggacuaugaagauccugaucggcgugaucaucacuuggaucgggaugaacagccgcuccaccagccuguccguuagccucgugcuggucggcgucgugacccuauaccucggggugaugguccaggcugacacuggcugcguggugucguggaagaacaaggagcucaaguguggcagcgggaucuucaucacggacaacguccacaccuggaccgagcaguacaaguuccaaccugagucgccgagcaagcuggcgucugccauccagaaggcccaugaagagggcaucugcgguauccgguccguuacccgacuggaaaaccugauguggaagcagauaacgcccgaacugaaccacauacucucugaaaacgaggugaaguuaaccaucaugaccggcgauauuaaggggaucaugcaggccggcaagcgcucccugcgcccgcaaccaaccgagcucaaauacagcuggaagacguggggcaaggccaagaugcugagcaccgaaagccacaaccagaccuuccuaaucgacgggccggagacugcggagugcccgaacacgaaccgugccuggaacucccucgaggucgaggacuacggcuucggcguguucagcaccaacaucuggcugaagcugcgcgagaaacaagacguguucugugacuccaaguugaugucugccgcaaucaaagacaacagggcaguccaugcugacaugggcuacuggaucgaguccgcccugaacgacaccuggaagauggagaaggcuagcuuuaucgaaauaaaaucgugccacuggccgaaaucacacacccugugguccaacggcgugcuagagagcgagaugaucauucccaagaacuucgccgggccagugucucagcacaacuaccggcccgguuaccacacccaaaccgcggggcccuggcaccugggcaaguuagagauggacuucgauuucugcgaggggacaacugucgugguaaccgaggacugcggcaaccgggggcccagucuccgcacgaccacagcuuccgguaagcugauuaccgaaugguguugccggucaugcacgcugcccccgcugcgcuacaggggcgaggacgggugcugguacgguauggagauccgacccuugaaggagaaagaggagaaccugguuaauagccucguuaccgccggacacggucagauagacaacuuuucccugggcgugcuggggauggcucuauuucucgaggaaaugcugcggacccgggucggcaccaagcacgccauccuccugguggcggugagcuucgucacgcugaucaccgggaacaugucuuucagggaucucggccggguaauggugaugguaggggccacgaugaccgacgauaucggcaugggugucacguaccuggcccuguuggccgccuucaaggugcgcccgaccuuugcagccgggcugcuacuccggaaauuaaccaguaaggagcugaugauggcaaccaucggcaucgcccuccugucucaaucuacuauccccgagaccauccuggagcucaccgacgcauuggcguuagggaugaugguccucaagaucguucguaacauggagaaguaccaauuagccgucacgauaauggccaucuccugcgucccgaacgcgguuauccugcagaacgcguggaaggugagcugcacgauccucgccgccgucuccgugucaccccugcugcucacguccagccagcagaaggccgacuggaucccucuggcccuaacuaucaagggucucaaucccaccgcgaucuuccuuaccacccugucccgcaccagcaagaaacgguccuggccccucaacgaggccguaauggcagugggcaugguaucgauacuggccuccagccugcucaagaaugacaucccgaugacugggccccuggucgcuggcgguuuacucacggugugcuacgugcuuacgggccggagcgccgaucuggagcuagagagagccgccgacguuaagugggaggaccaggccgagauauccgggagcucccccauacugucgaucaccauaagcgaggacggcucaauguccauuaagaacgaggaggaggagcauacacucacgauccuaauccguaccgggcugcuagugaucagcggggucuucccggucaguaucccgaucacugcggcggcuugguaccucugggaggugaaaaagcagagagccggcgugcugugggacguccccagcccgccccugguggggaaagcagagcucgaggacggcgccuaccggaucaagcaacgcgggauauucggcuacucccagaucggcgcagguguuuacaaggagggcaccuuccacaccauguggcacgucacgcgcggagccgugcugaugcaucgcggcaagcggaucgagcccagcugggccgacguuaagaaggaccugaucuccuacggggggggcuggaagcucgaaggggaguggaaggaaggugaggaaguccagguccuugcccuggagcccgggaagaaucccagggcagugcagaccaagcccggccucuucaagaccaauaccgggacgauaggugcggucucucuggacuucucccccggcacgagcgggucccccaucguggaucguaagggaaagguugucgggcuauacgggaacggcguggugacccgcagcggggccuauguguccgccaucgcccagacggagaaauccaucgaggacaacccggagaucgaggacgacauuuuccggaaaaagcgccuuaccaucauggaccugcaccccggagcgggcaaaaccaagcgguaccugccagccaucgugcgcgaggcuauaaagcgaggcuuacggacccucaucuuagcucccacccgcgugguugcugcugagauggaggaggcccugcgggggcucccgauccgcuaccaaacucccgccauacgggcagaacacacaggccgcgaaaucguggaccuaaugugccaugcaacguucaccaugagacugcuuucacccgucagaguccccaauuacaauuuaaucauaauggacgaagcgcacuucacggacccggccucuaucgccgcccggggcuacaucagcacuaggguggagaugggggaggccgcuggaauauuuaugaccgccaccccgcccgggucccgggaccccuucccgcagaguaacgcccccaucauggacgaggaacgcgagauccccgagcgguccuggaacucgggccacgagugggucacagacuucaaggggaagaccgucugguucgugcccuccauaaaggcuggcaacgacaucgcggccugccugcgcaagaacgguaaaaaggucauccagcucucccggaagaccuucgacucagaguacgucaaaacccgcgcgaacgacugggacuucguggugaccaccgacaucagcgaaaugggggccaacuuucgggccgagcgcgucaucgacccgcgacgcuguaugaaacccgugauccugaccgacggggaggagagagugaucuuggcuggucccaugcccguaacccacuccagcgccgcccagcgcaggggcaggaucgggcgcaacccgaagaacgagaacgaccaguacaucuacaugggugagccccuggagaacgacgaggacugcgcccacuggaaggaggcaaagaugcugcuggauaacaucaacacgcccgaaggcaucauuccguccauguucgagccggaacgggagaagguggacgccauugacggggaguacagacuccggggcgaggcucgcaaaaccuuuguggauuugaugcgcaggggggaccugcccgucuggcucgccuaccggguagccgccgaggggaucaacuacgcggacagacgguggugcuucgacggaaucaagaacaaccaaauccucgaggagaacguggaggucgagaucuggaccaaggagggcgagaggaaaaagcugaagccccgguggcucgaugcgcgcaucuauagcgacccgcuggcccugaaggaguucaaggaguucgccgcgggccggaagucccucacgcucaaccucaucacggagauggggaggcucccuaccuucaugacgcagaaggcccgggacgcccuagacaaucuagccgugcuucauaccgccgagguagguggucgagcguauaaccacgcccugagcgagcuuccugagacgcucgagacccugcuucuccucacucuccucgcaaccgugacgggaggcauuuuccuguucuugaugucgggaaagggaaucgggaagaugacccucggcauguguugcauaaucaccgccagcaucuugcugugguacgcccagauccagccccacuggaucgcggccuccaucauccucgaguuuuucuugaucgugcuguugaucccggagccggagaagcagcggacgccccaggauaaccagcugacauacgucguaaucgccauucucacgguggucgcggccaccauggcgaaugaaaugggguuucucgagaagaccaaaaaggauuuaggccucggcagcaucacuacgcaggagagcgaguccaacauccucgacaucgaccugcggcccgccagcgccuggacccuguacgccguggcaaccaccuucgugacgccgaugcuccggcacuccaucgagaacagcuccgucaacguuagccugaccgcgaucgccaaccaggccacugugcugauggggcucggccggggguggccccuaucaaagauggacaucggcgucccucuccucgcaauagggugcuacagucaggugaaccccaucacccugacggcggcccugcuccugcucgucgcccacuacgccaucaucggcccaggccuccaggcaaaggcgacacgcgaggcgcagaagcggacggcugccgggaucaugaaaaaccccaccgucgauggcauuacggucauugaccuugagcccauacccuacgacccgaaguucgagaagcagcugggccaggucaugcuccugguccugugcgugacccagguucucaugaugcgcaccaccugggcccugugcgaggcccugacgcucgccaccggaccaaucagcacgcugugggagggaaaccccggccgcuucuggaauaccacgaucgcugucagcauggcaaacaucuucaggggcuccuaccuagccggugcggggcuccuguuuagcauuaugaaaaacaccaccaacacgcggcgugguacgggcaacaucggagagacauuaggagaaaaguggaagucccggcucaacgcacucggaaagucagaguuccagaucuauaagaaguccgggauacaggagguggaccgaacccuggccaaggagggcaucaagcgcggagagaccgaccaccacgccgugagccgcggauccgccaagcuacggugguucguagagcgcaauauggugacucccgagggcaaaguggucgaccucggcugcggccgcggcggauggagcuacuacugcggcggucugaaaaacgugagagaggugaaggggcucaccaagggcggcccugggcacgaggagccaaucccaaugucgaccuacggcuggaaccugguccggcugcagucaggaguggacguguucuucaccccgcccgagaaaugcgacacgcuccugugcgacaucggugaaagcuccccuaaccccaccauagaggccgguaggacucugcgaguccucaaccugguggagaauuggcugaacaacaacacgcaguuuugcgugaaaguccucaaccccuacaugcccagcguaauugagaagauggaaaccuugcagcgcaaguacgggggagcccuggugcggaacccccugagucgcaacagcacgcacgagauguacugggucuccaacgccaccgggaacaucgugagcuccguuaacaugauaagccgcauguugaucaaccgguucaccaugaagcacaagaaagcuaccuacgaaccggacguggaccugggcuccggaacgagaaauauuggcaucgagaacgaaaucccgaacuuagacaucauaggcaagaggaucgaaaagauaaaacaggagcacgagaccagcuggcacuaugaucaggaccaccccuacaagaccugggcguaccacggguccuaugagaccaaacagacgggcagcgccuccaguaugguuaaugggguagucaaguugcugaccaagccaugggacguggugcccaugguaacccagauggcaaugaccgacacaaccccguuuggucagcagaggguguucaaggaaaaaguggacacccguacccaggagcccaaagaggguacaaagaagcugaugcgcaucaccgccgaguggcuauggaaggagcuggggaagaagaagacgcccaggaugugcaccagagaggaguucacgcggaaaguaagguccaacgccgcuuugggcgccaucuuuaccgacgagaauaaauggaaauccgcccgagaagccgucgaggacagucgcuuuugggaguuggucgaccgcgagcgcaaccugcaccuagaggggaagugcgagaccugcguuuacaacaugaugggcaagcgggagaaaaagcucggagaguucggcaaggccaagggcucacgcgcuauaugguacauguggcugggggcccgauuccuugaauucgaggcccuaggcuucuuaaaugaggaccacugguucucgcgugguaacagccugagcgguguagaaggggagggccuccauaagcugggcuacaucuuacgggacgucuccaagaaggagggcggcgcuauguacgcggacgacacagccggaugggacacgcgcaucacccuugaggaccuaaagaacgaagaaauggugaccaaccauaugaagggcgagcauaagaagcucgcagaggcuaucuucaaguuaacuuaccaaaacaaggugguccgagugcagcgucccacgccgcgcgggacugugauggacaucaucagcaggaaggaccagcguggcuccggccaggucgggaccuacggccucaacaccuucacgaacauggaggcccagcugauuagacagauggagggagaagguaucuucaagagcauccagcguuugacugugaccgaagagaucgcggugcagaauuggcuugcgcgagucggacgcgaacgccugucccgcauggccaucucuggggacgauuguguagucaagccacuagacgaccgguucgccuccgcccugaccgcgcugaaugauaugggcaagguccguaaggacauacagcagugggagcccagccggggguggaacgacuggacccagguccccuucuguagucaucacuuccacgaguuagugaugaaggacggaagaguccugguggugccgugccggaaucaggacgaacugaucgggcgggcccggaucagccaaggcgccggcuggucucucaaggagaccgccugccuggguaagagcuaugcgcagauguggacccugauguacuuccacagacgggaccuccgccuggcggcuaacgccaucugcucagccguccccagccacugggugcccaccucccggacaacguggagcauccacgccaagcacgaguggaugaccaccgaggacaugcuggcgguguggaaccgcguuuggauccaggaaaacccguggauggaggacaaaaccccaguggaauccugggaagaagugcccuaccuuggcaagcgcgaggaucaguggugcgggaguuuaaucgggcuuacuucccgggccacuugggccaaaaacauccagaccgccauaaaucaggugcgcagccucauagguaacgaagaguacaccgacuacaugcccagcaugaagcguuuccgcaaggaggaggaggaggcaggugugcuaugguaa

SEQ ID NO: 25236 - RNA, 9876 nt, Artificial Sequence
  derived and/or modified CDS sequence (opt11) from DENV-2__EU687236__SS-prME
accgccggggugaucaucaugcugauccccaccgccauggcguuccaccucaccacccgcaacggcgagccccacaugaucgucgggcggcaagagaaggggaagucgcuucuguucaagacggaggacggcgugaacaugugcacccucauggccaucgaccugggggagcugugcgaggacaccauaacguacaagugcccauuacugcgccagaacgagcccgaggauaucgacugcuggugcaauagcaccagcaccugggugacuuacgggaccugcaccaccacgggugaacaccggcgcgagaagcgguccgucgcacuggugccccacguggggaugggcuuagaaacacgcaccgaaaccuggaugagcagcgagggggccuggaagcacguccagaggauagagaccuggauacugcgccacccgggguucaccaucauggccgcuauccuggccuacaccaucgggaccacgcacuuccagcgggcccuuaucuucauccugcugaccgccguggcgcccuccaugaccaugcgcugcaucggcaucuccaaccgggacuuuguggagggcgucucagggggcuccuggguggacaucguacuagagcacgggucgugugucaccacgauggccaagaacaagcccacccuggacuucgagcucauuaagacugaggccaagcagcccgcuacccuccgaaaguacugcaucgaggccaagcugacgaacaccaccaccgagucccguugcccgacgcagggggagcccagccugaacgaggagcaggauaagagguucaucugcaagcacuccaugguggaucggggcugggggaacggcuguggccuguucgggaagggcgggaucgugaccugcgcgauguucacguguaagaaaaacauggaaggcaaggucgugcugcccgaaaacuuagaguacaccaucgugaucacgccccacagcggggaggagcacgcugucggaaacgacaccggcaagcacggaaaggaaaucaagaucaccccgcagagcagcaucaccgaggccgagcucaccggguauggcacggugaccauggagugcagccccaggaccggccuggacuucaacgagauggugcugcuccagauggaagacaaggccuggcuggugcaccggcagugguuccuggacuuaccccugcccuggcugccgggcgccgacacccagggcucuaacuggauccagaaagagacgcucgugacauuuaagaauccccacgcgaaaaagcaggacguugucgugcugggcucccaggagggcgccaugcacaccgcuuugaccggggccacggagauucagaugucgagcggcaaucuccuguucaccggccaucugaagugcagauugcggauggacaagcuucaacugaagggcaugucuuacagcauguguaccgggaaauucaagaucgucaaggagaucgccgagacccagcacggaacgauagugauccgcgugcaguacgagggcgacggcucccccugcaagaucccuuucgagauaauggaccucgagaagagacacguucugggccgccucaucaccgugaauccaauugugacggagaaggacagccccgucaacaucgaggcggagccgcccuucggcgacucuuacaucaucaucgggguugaaccgggccagcucaagcugaacugguuuaaaaaagggagcuccaucggccaaauguucgagacaacgaugcguggcgccaagcggauggccauccugggggacaccgccugggacuucggcagccucggggggguguucacguccaucggaaaggcccugcaccagguguucggcgcgauauacggcgccgccuucucggggguguccuggacaaugaagauccuaaucggcgucaucaucacguggaucgggaugaacagccgcucuaccagccuguccgucagccuaguguuagugggcguugugacccuguaccucggggugauggugcaggccgauaccggcugcguagugucguggaaaaacaaggagcugaagugugguucagggauuuucaucacggacaacguccacaccuggaccgaacaguacaaguuccaacccgagucacccagcaagcuggcguccgccauccaaaaggcccacgaggagggcaucugcggaauucgauccgugacucgccuagaaaaccugauguggaagcagaucacacccgagcugaaccacauccucagcgagaaugaaguuaagcugaccauaaugaccggcgacauuaaggggaucaugcaggccggcaagcgcucccugagaccgcaaccuaccgagcucaaguacagcuggaagaccuggggcaaggcaaagaugcuguccacugaaagccauaaccagaccuuccugaucgacgggcccgagaccgccgaaugcccgaacacgaaccgggccuggaacucccucgagguugaggacuacggcuucgggguguucucaacaaauaucuggcugaagcugcgcgagaaacaggacguuuucugcgacuccaaacuaaugagcgcugccaucaaggacaaccgggccguccacgcggacaugggguacuggaucgagagugcccugaacgacacauggaagauggagaaagcgucguucaucgagaucaaguccugucacuggcccaagagccacacccugugguccaauggcgugcuagagagcgagaugaucauaccuaagaacuucgccgggcccguuucccagcacaacuaccgccccggauaccacacucagacggccgggcccuggcaccugggcaagcucgagauggacuucgacuuuugcgaagggaccacgguaguggugaccgaggacugcggcaaccgcggccccagccuccgcacgaccaccgcguccgggaaacugaucaccgaguggugcugcagauccugcacacuacccccgcuccgcuaccggggcgaggacgggugcugguacggcauggagauccgcccccugaaggagaaagaggagaaucuggucaacagccucgugaccgccgggcacggucaaaucgacaacuucucccugggcgugcuagggauggcccucuuccuugaggagaugcugcgcacccgcgucgggaccaagcacgccauacuccugguggcagucagcuucguuacucugauuaccgggaacaugaguuuccgggaccucgggcgcgugauggugauggucggggccaccaugaccgaugacauuggaaugggagugacguaccuggcccuguuagccgcauucaaggugcguccgaccuucgcggccgggcugcugcuccggaagcuaaccagcaaggagcucaugauggccaccaucggaaucgcccugcugucccagucuacgauccccgagaccauccuggaguugacggacgcuuuggcauuaggcaugaugguccucaagaucgugcgcaacauggagaaauaccaacuggccgugaccaucauggcgaucuccugcgucccgaacgcggugauccugcagaacgccuggaaagugagcuguacgauccucgcggccgucuccgugucaccacugcugcucacuuccagucagcagaaggccgauuggaucccacuggcucugaccaucaagggcuuaaaccccaccgcgauuuuccugacgacccugagccggaccagcaagaagcgcuccuggccucucaacgaggccgucauggcgguaggcauggugagcauacuggccuccagccugcucaagaacgacauccccaugaccggcccauuagucgccggcgggcugcucaccguguguuacgugcugaccggccgguccgcggaccuggaguuggagaaggcugccgacgucaagugggaggaccaggccgagaucuccgguagcucccccauccugagcaucacgauuuccgaggacgguagcauguccaucaagaaugaagaggaggagcacacccugacgauccucauucgcacuggcuugcuggugauaucagggguuuucccggucuccauccccauaaccgccgccgccugguaccucugggaggugaagaaacaacgggccggcguucugugggacguccccagcccgccgcccguggggaaagcugagcuggaggacggcgccuaccgcaucaagcagcgggguaucuucggcuacagucagaucggugcggggguguacaaggaggggaccuuccacaccauguggcaugucacgcggggcgccguccucaugcaccggggcaagcguaucgagcccuccugggcggacgugaagaaggaccugaucucauacgggggaggguggaagcuggagggggaguggaaagagggcgaggagguccaagugcuggcccuggagcccgggaagaacccccgggccgugcagaccaagccgggccuuuuuaagaccaacaccgggacgaucggcgcggucagccucgacuucucccccggcaccagcgggagccccaucgucgaccgcaagggcaagguggucgggcuguauggcaacggcguggugaccaggagcggggccuacgucuccgccaucgcccagaccgagaagucgaucgaggacaaccccgagauagaagacgacaucuuccgcaagaagcgacugacgaucauggaccugcaccccggggcggggaagaccaagcgcuaucugcccgcaaucgucagggaggccaucaaacgcggccugcggacccugauucucgccccgacccgcguggucgcggcugagauggaggaggcccugcgcggguuaccaauccgguaucagacccccgccauccgcgcugagcacaccggucgugagaucguagaccucaugugccacgccaccuucacaaugcgccugcugagccccgugcgggucccgaacuauaaccucaucaucauggaugaggcgcacuuuacggaccccgcuuccauagccgcccgcggauacauuagcacacggguggagaugggggaggccgcgggcaucuucaugaccgcgaccccacccgggucccgcgacccguucccccagagcaaugccccuaucauggacgaggagcgggagauccccgagcguuccuggaacaguggccacgaaugggucacggacuucaaggggaagaccgucugguucgugccguccauuaaagccggcaaugacaucgcggccugucuccggaagaacggcaaaaaagugauucagcuguccagaaagacauucgacucagaguaugucaagacccgugcgaacgacugggacuucguggucacgaccgauaucagugagaugggggccaauuuuagagccgagcgggugaucgacccccgccguugcaugaagcccguuauccucaccgacggcgaggagcgggugauccuggcggggcccaugccggucacccacuccagcgccgcucaacggcgcggccgcaucgggcgcaacccaaagaacgagaacgaccaguacaucuauaugggcgaaccccuggagaacgacgaggacugcgcccacuggaaggaggccaaaaugcuauuagauaacauaaacacgcccgagggcaucaucccguccauguucgagcccgagcgcgaaaagguggacgcgaucgacggggaguaucgacugcgcggcgaggcccggaagacauucguggaccucaugcgccgcggggaccucccggucuggcuggcuuaccgcguggccgccgagggcaucaauuacgcggaccgccgcuggugcuucgauggaaucaagaacaaccagauccucgaggagaauguggaggucgaaauauggaccaaggagggagagcgaaagaaguuaaagccgagauggcuggacgcccggauuuacagcgacccucuagcccugaaggaguucaaagaauuugcugcgggcagaaagucccugaccuugaaccugaucacggagauggggcggcugcccaccuucaugacccagaaagcccgcgaugcccucgacaaccuggccgugcugcauacugccgaggucggcgggcgggcguacaaccacgcccucagcgaacugccggaaacgcuggaaacccuccuccugcucacccugcucgccaccguaacgggcggcaucuuccucuuccuaaugucagggaagggcaucgggaagaugacccugggcaugugcugcaucaucaccgccucgauccuucugugguaugcccagauucagccgcacuggaucgcggcauccaucaucuuagaauucuuccucaucguauuguugauacccgagcccgagaagcagcgcacgccccaagacaaccaacucaccuaugucguuaucgccauacugacgguggucgccgccaccauggcuaacgagaugggguuucuggaaaagaccaagaaggaccucggccugggcagcaucaccacgcaagagucagaauccaauaucuuagacaucgaucuucggccggccagugcuuggaccuuguacgcuguugccacaacauucgugacgcccauguugagacacuccaucgagaacagcuccgucaacgucagccucaccgcgaucgccaaccaggcaaccguguugaugggacugggacggggguggccccucuccaagauggacaucggcgucccccuccuggccaucgggugcuacagucagguuaaccccaucacccucacggcugccuuacugcugcugguggcccauuaugcaaucaucggcccggggcugcaggccaaggcgacccgcgaggcccagaaacgcaccgccgcuggcaucaugaagaaccccaccgucgacgggaucacggugaucgaucucgagccgaucccuuacgaccccaaguucgagaagcagcuggggcaggugaugcugcucguccugugcguaacccagguccugaugaugcggacgacaugggcccucugcgaggcguugacgcuugccacuggccccaucuccacacugugggaggggaacccaggccgcuucuggaacaccacgaucgccgucucaauggccaacauauuccggggcaguuaccuggcgggagcgggcuuacucuucagcauaaugaagaacaccaccaacacccgccgggggacgggaaacaucggcgagacccuuggggagaaguggaagucccgccugaacgcccuuggcaaaagcgaguuccagaucuacaagaaauccgguauacaggaaguggaccguacccuggccaaggaaggcaucaagcgcggagagacagaccaccacgccgugagccggggcuccgcaaaguugcggugguucgucgagcgcaacaugguuacgccggagggcaagguggucgaucucgggugcggcagggggggcuggagcuacuacugcgggggacugaagaacgugcgggaggugaagggccugacuaagggcgggcccgggcacgaggagcccauccccauguccaccuacggcuggaacuugguucgccugcaaagcgggguggacguguucuucaccccgccugagaagugcgauacgcugcucugcgauauaggcgaguccuccccgaaccccaccaucgaggccggucggacacuacgcguccugaaccucguggaaaacuggcugaauaacaacacccaguucugcgugaaggucuugaacccguacaugcccagcgugaucgagaagauggagacccuccagcggaaguacgggggggcccuggugcgcaacccccugucgcggaacagcacgcaugagauguauugggucuccaaugccacaggaaacaucgugagcuccgugaacaugauuagccgcauguugaucaaccgcuucaccaugaagcacaagaaggccaccuacgaaccggacguagaccucggcucagggacgcggaauaucggcaucgagaacgaaauccccaaccuggauauuauagggaaacgcaucgagaagaucaaacaggagcacgagaccucuuggcacuacgaccaagaccaccccuacaagaccugggcguaucacggaucguacgagaccaagcagacggguucagccuccagcauggugaacgggguggucaagcuacuaaccaagcccugggacguggugccgauggucacccagauggccaugaccgacacgacccccuucggccagcagaggguguucaaggagaaaguggauacacgcacucaggagccaaaggagggcaccaagaagcuuaugcggaucaccgcagaguggcuguggaaagagcucgggaagaagaaaacgccacggaugugcacccgugaggaguucacgaagaagguccgcagcaaugccgcgcugggcgccaucuucaccgacgagaacaaguggaaguccgcccgggaggccguggaggacucccgcuucugggaguuggucgaccgggagcgcaacuuacaccuggaggguaagugcgagacuugcguguacaacaugaugggcaaacgagagaagaagcuaggggaguucggcaaggccaagggcagcagagcgaucugguacauguggcucggggcgcgguuccuggaguucgaggcgcugggguucuuaaacgaagaccauugguucucgcgcgguaacagccugagcggcguggagggagagggcuuacacaagcucgguuacauccugcgggacgucucaaagaaggaggggggggccauguacgcggaugacaccgccgguugggacacgcgcaucacccuggaggauuugaagaacgaggagauggugaccaaucacaugaaaggcgaacacaagaaguuggcagaggccaucuuuaaacugaccuaccaaaacaaggugguccgggugcaacgcccgacgccccgggggaccgugauggauauaauaagccggaaggaccagcgcggaaguggucagguugggaccuauggccucaacacauucacgaauauggaggcccaacugauccgccagauggaaggggagggaauuuuuaagucuauccaacgccucacugugaccgaggagaucgcggugcagaacuggcucgcccgggucggcagagagcggcugucccgcauggcaaucagcggcgacgacugcgucgugaagccccuggacgaccgguucgccucagcccucaccgcacugaaugacaugggcaaagugcgcaaggacauccagcagugggagccgucacggggguggaaugacuggacccagguaccauucuguucccaucauuuccacgagcugguuaugaaagacggccgcguucuggugguccccugccguaaccaggacgagcugauuggacgcgccagaauaagccagggcgccggcuggucucugaaagagacggccugccucggcaagagcuacgcucagauguggacccucauguauuuccaccgccgggaccugcgccucgcggcuaacgcaaucuguuccgcgguccccagccacuggguacccacgucccggaccacguggucaauccacgccaagcacgaguggaugacaaccgaggacaugcuggccguguggaaccgcguguggauccaagaaaauccguggauggaggacaagacccccguggaguccugggaggagguacccuaccugggcaagcgggaggaccaguggugcgggagcuuaaucggccugacgagccgcgccacgugggccaagaacauccagacugcgauaaaccagguccgaucccugauugggaacgaggaauacaccgacuacaugcccagcaugaagagguuccguaaggaggaggaggaggcaggcgugcucugguag

SEQ ID NO: 25237 - RNA, 9876 nt, Artificial Sequence
  derived and/or modified CDS sequence (opt11) from DENV-2__EU687237__SS-prME
accgccggagugauuauaaugcugauccccaccgccauggcuuuccaucuuaccacccgcaauggagagccacauaugaucgugggacgacaggaaaaggggaagagucuccuguuuaagaccgaggacggcgugaacaugugcacccucauggccauagaccuaggggagcucugcgaggacaccaucacauacaagugcccccuccugcgccagaacgagccagaggacaucgauuguuggugcaacucaacgagcaccuggguuaccuacggcacgugcaccaccacgggcgaacaccggcgagaaaaacgguccgucgcccugguaccccacguggggaugggccuagaaacccggaccgagaccuggaugagcagcgagggggcuuggaagcacguccagcggaucgagacguggaucuugcgccacccgggcuucaccauaauggcagcgauccuggccuacacuaucgggaccacgcauuuccagcgggcccucaucuucauucugcugaccgccguggcgcccagcaugaccaugcgaugcaucggcaucuccaaucgggacuucguggagggcgucagcgggggcuccuggguugacaucgugcucgagcacgggagcugcgucaccaccauggccaagaacaagcccacgcuagauuucgagcugaucaagaccgaggccaagcagcccgccacccuccguaaguacugcaucgaggccaagcugacuaauaccaccaccgagagucggugcccgacgcagggagaacccagccuaaacgaggagcaggacaagcgcuucaucugcaagcacucgaugguggaucggggcugggggaacggaugcggucuguucggaaagggggggaucgugaccugugcgauguucacguguaagaaaaacauggagggaaaggugguccuucccgaaaacuuggaauacacuaucgugaucacaccccacagcggagaggagcacgccgucgguaacgacacggggaagcacgguaaggagaucaagaucaccccgcaguccagcaucaccgaggcggagcuuaccggguacggcacggugacgauggaguguagcccccgcaccggccuggacuucaacgagauggugcugcuccagauggaggacaaggcgugguuggugcaccgccaaugguuccuggacuugccccugccguggcugccuggggccgacacgcaaggaagcaacuggauccaaaaggagacucucgugacauucaagaacccucacgcgaagaagcaggacguggucgugcuggguucccaggagggcgccaugcacacugcucugaccggggccaccgagauacagaugagcuccggcaaucucuuauucaccggucaccuaaaguguaggcuccggauggauaagcugcagcuaaaggggaugaguuacagcaugugcaccggcaaguucaagaucgucaaggaaaucgcggaaacccagcacgggacgaucgugauccgcguccaguacgagggcgacggcucccccugcaagauccccuucgagaucauggaucucgagaagaggcacguccuggggcgccugaucaccgugaacccgaucgugaccgagaaggacagccccgucaauauagaggcggagccgcccuuuggugacuccuacauuaucaucgggguggagccggggcaguuaaagcugaauugguucaagaaggggagcuccaucggccagauguucgagaccacgaugcgcggcgccaagcggauggccauccugggggauaccgccugggacuuuggcagccucgggggcguuuuuaccucaaucgggaaagcccugcaucagguuuucggcgcgaucuacggcgccgcuuuuagcgggguguccuggaccaugaagauccugauaggugugauuauaacguggaucggaaugaacucacgcagcaccagcuuauccguaagccuggugcugguuggcgucgugacccuguaccucggcgucaugguccaggccgauacuggaugcgugguguccuggaagaacaaggaguuaaagugcgguucugggaucuuuaucacggacaauguccauaccuggaccgaacaguacaaauuccagcccgagucgcccagcaagcuggcgagugccauccagaaggcccacgaggaaggaaucugcgggauucgguccgugacccgguuagaaaaccugauguggaagcagaucacgccugagcugaaccacauccucagcgagaacgagguaaagcugaccauuaugaccggggacaucaaggggaucaugcaggccggcaagcguucccugcgcccgcagcccaccgagcucaaguacagcuggaagacguggggcaaggcaaagaugcugucuaccgagagccacaaccaaaccuuccugaucgacggucccgagaccgcggagugcccgaauacgaaccgggccuggaacucccucgaagucgaagacuacggcuucggggucuucagcacuaacaucuggcugaaguuacgagagaagcaggacguguucugcgacuccaagcucaugagcgcugccaucaaagauaaccgggccguccacgcagauaugggguacuggaucgaguccgcccuaaaugacaccuggaagauggagaaggccagcuucaucgagaucaaguccugucacuggcccaagucucacacccucuggagcaacggcgugcucgagucugagaugaucauccccaaaaacuucgccgguccggugagccagcauaacuaccgcccgggcuaccacacacagacggcaggcccauggcacuuaggcaaguuagagauggacuucgauuuuugcgaagggaccacugugguugugaccgaggacugcgguaacaggggccccagccuccgcacgaccaccgcgagcgguaagcugaucaccgaguggugcugucgguccugcacgcugccccccuugcgcuaccggggcgaagacgggugcugguacggaauggaaauacgcccccugaaggagaaggaagagaaccuggucaacagccucgugaccgccgggcacgggcagaucgacaacuucucccugggcgugcuggggauggcccucuuucuggaggagaugcuucggacccgcgucggcacgaagcacgccauccuccugguggcggugaguuucgucacuuugauuaccgggaacauguccuucagagaccucggccgugugauggugauggucggugcuaccaugaccgacgacaucgguaugggagugaccuaccuggcacuacucgcugccuuuaaggugcgccccaccuucgcggccggccuucugcucagaaagcugaccagcaaggaguugaugauggccaccaucggcaucgcccuucucucccagagcacgauuccagagacuauauuagagcucaccgaugcgcuggcgcuggggaugaugguucucaagaucgugcgcaacauggagaaguaccagcuggcggugaccaucauggcgaucaguugcgucccaaacgccgugauucuacagaaugccuggaaggucagcugcacgauucucgcggccgucagugugucgccccugcuacucaccuccagccagcagaaggcagauuggaucccccuggccuugaccaucaagggacucaacccaaccgcgauauuccugacgacccugucccgaaccagcaagaaacgguccuggccucucaacgaggccguuauggcagugggcauggugagcauccuggccuccucacugcucaaaaacgauauccccaugacagggccccugguagccggcgggcuacucacaguguguuacguguuaaccgggcggucagcggaccuggagcucgaacgugcugccgacgucaagugggaagaucaggccgagaucucugggagcagcccaauccugagcaucaccaucuccgaggacggcuccauguccaucaaaaacgaggaggaggaacacacccugacgauccuaauacggaccggccugcuggugaucagcgggguguuuccggucaguaucccaaucaccgccgcugcaugguaccucugggagguaaagaagcagcgcgcuggcguucugugggacguccccagcccgccgcccguggggaaggcugagcuggaggacggcgccuaccggauuaaacagcgcgguaucuucggcuacagucagaucggcgcggggguguacaaggaaggaaccuuccauaccauguggcacgucacgcgcggggccguguugaugcacagagguaagcggaucgagccuagcugggccgacgugaagaaggaccuaaucuccuaugggggcgguuggaagcuggaaggggaguggaaagaaggcgaggagguccaagugcucgcccuggaaccugggaagaacccccgcgccgugcagaccaagccuggcuuguucaagaccaacacaggaacgaucggcgcggucagccucgacuucucccccggcacuagcgggucccccaucguggaccguaagggcaagguagucgggcuguacggcaacggcguggugacccgcagcggggcuuacguaucagccaucgcccaaaccgagaaguccaucgaggacaaccccgagauugaggacgacauauuccguaagaagcgccugacgaucauggacuugcaccccggggcggggaagacuaagcgguaccugccagccauaguacgcgaggccaucaagcggggacugcgcacucuaauucucgccccgacccgcguggucgccgcggagauggaggaagcccugcgggggcugcccauccgguaccaaacgcccgcuauccgggccgagcacacgggccgcgagaucguggaccucaugugccaugcgaccuuuaccaugcggcugcugagccccgugagaguuccgaacuauaaucucaucaucauggacgaggcgcauuucacggaccccgccucgaucgccgcacggggguacauaagcacccgcguggaaaugggggaagccgcgggcauuuucaugaccgccacgccgcccggguccagagacccguucccccaaagcaacgcgccaaucauggacgaagagcgcgagaucccugaacggucauggaacagcggccacgaauggguuacggacuucaaggggaagaccgucugguucgucccguccaucaaggccggcaacgacauagcggccugccugagaaagaauggcaagaaggugauccagcugagccgcaagaccuucgauuccgaguacgucaagacgcgcgccaacgacugggacuucguggugacgaccgacaucagcgaaaugggugccaacuuccgggcugagcgcgucaucgacccgcgccgaugcaugaagcccgugauccuuacagacggcgaggagagagugauccuggcgggucccaugccggucacccacuccagcgccgcccagcgucgcggccggaucgggcgcaaccccaaaaaugagaacgaucaguacaucuacaugggcgaaccccuggagaaugacgaagacugcgcccacuggaaagaggcuaagaugcuccuggacaacaucaacacccccgagggcaucauaccaaguauguucgagcccgagcgggagaaaguugacgcgaucgauggcgaguaccgccugcggggcgaggcaagaaagaccuuuguggaucucaugcggcgcggggaccugcccgucuggcuggcauaccggguagccgccgagggcaucaacuacgcggaccgccgguggugcuuugacggaauaaagaacaaccagauccucgaggagaauguggagguggagauauggacuaaggagggggagcgcaagaaacugaagccgcgguggcucgaugcccgcaucuacagcgacccccucgcccugaaagaguuuaaggaguucgccgcgggacggaagucccugacgcucaaccugaucacagagauggggcgccuacccaccuucaugacacagaaggcucgggacgcccucgacaaccuggccguguugcacacugcagaggucggcgguagagccuacaaccaugcccuaagcgaacugcccgagacgcuagagacccuucugcuccugacguuacuggcuaccguaacgggcggaauuuuucucuucuugauguccgggaagggcaucgggaagaugacacugggcaugugcugcaucaucacugccaguauucuccugugguacgcccagauccagccgcacuggaucgcggcauccauuauacuggaguucuuucucauagugcugcuuauccccgagccggagaagcaacggacgccccaggacaaccagcucaccuacgucgucauagccauccugacaguggucgccgccaccauggcaaacgagaugggcuucuuggaaaaaaccaagaaggaccucggccugggcagcaucaccacgcaggagucagaaucaaacauccuggacaucgaccuccgcccggcaagcgccuggacccuguaugccguggcgaccaccuucgugacgcccaugcucaggcacuccaucgagaacucuuccgucaaugugagccuaaccgcaaucgcaaaccaggccaccguguuaauggggcugggccgcggauggccccuaucuaagauggauauuggcgucccccugcuggcaaucggguguuacagccaggugaacccgaucacccucacggcggcccugcugcuccugguggcccacuacgccaucaucggaccuggccugcaggccaaggcgacgagggaggcacagaaacggacagcagccgggaucaugaagaaccccacaguugaugguaucacggugaucgaucucgagcccaucccuuacgaccccaaguucgagaagcaacugggccaggugaugcugcucguccugugcgugacccaagugcuaaugaugcgcaccaccugggcccugugcgaagcguugacgcuggccacuggcccuaucucaacccuaugggagggcaaccccggccgguucuggaacaccacgaucgccgucagcauggccaacaucuuccgcggcuccuaccuggcaggggcgggccuccucuucagcaucaugaagaacaccaccaacacuaggcgcggcacgggcaacaucggcgaaacccugggggagaaauggaagucucggcugaacgcgcucgguaagagcgaauuccagauuuacaagaaguccgggauccaggagguggaccggacccuggccaaggaagguaucaagcgcggggaaaccgaccaccacgccgugagccgcggcuccgcgaagcuucggugguucguagagcgcaacauggugacgccggaaggcaaggugguggaccucgggugcggccgcggcggguggucuuacuauugcggcgggcucaagaacgugagggaggugaaggggcucacuaaaggcgggcccgggcacgaggagcccauccccaugagcaccuauggcuggaaccucguccggcuccagagcgggguggacguauucuucacgccgccggagaagugcgauacgcugcucugcgacaucggggagagcuccccgaaccccaccaucgaagcaggccgcacccuacggguacugaaucuaguggagaacuggcucaacaacaacacccaguucugcgugaagguccugaacccuuacaugccuucugugaucgagaagauggagacccuucagcgcaaguacgggggggcccuggugcggaacccccugucacgaaacagcacgcaugagauguacugggucuccaacgccaccgggaacauagucagcuccgucaauaugaucagccgcaugcugaucaaccgguucaccaugaagcacaagaaagccacuuacgagccggauguagaucuuggcuccggcacgcgcaacaucgggauagagaacgagauccccaaccuggacaucaucggcaagcggauugagaaaaucaaacaggagcacgagaccagcuggcacuacgaccaggaccaccccuacaagacuugggcguaccacgggucuuacgagaccaagcaaacgggcagcgcuuccagcauggugaacgggguggucaagcuacucacgaagcccugggacguggugccgaugguaacccagauggcuaugaccgacacgacccccuuuggccagcagcgcguguucaaggagaagguggacacccggacccaggagcccaaagagggcacgaagaagcugaugcgcaucaccgcggaauggcuguggaaggagcucgggaagaaaaagacuccccguaugugcacccgcgaggaguucacgcggaaggugcgcuccaacgcagcgcuaggagccauuuucaccgacgagaacaaguggaagucugcccgggaagccguggaggacuccagauucugggagcuggucgacagagagcgcaaucuccaccuugaggggaagugcgagacaugcguguauaacaugaugggcaagcgggagaaaaagcugggggaguucggcaaggcgaagggcagccgcgcgaucugguacauguggcucggcgccagauuucuggaguucgaggcccugggcuuccucaacgaagaccauugguucucccgcgggaacagccugagcggcguugagggggagggccugcacaagcucggcuacauccugagagacguguccaagaaggaggguggcgccauguacgcggacgacaccgccgggugggacacucgcaucacccuggaggaccucaagaaugaggaaauggugaccaaccacaugaaaggcgagcauaagaagcuggccgaggcaaucuucaagcugaccuaccagaacaaggugguacgggugcagcgcccgacgccccgcgggaccgugauggauaucauaagucggaaggaccagcgcgguuccggccaggucgggaccuacggccucaacaccuucacgaacauggaggcccagcugauccggcagauggagggggagggcaucuucaaauccauccagaggcugaccgugaccgaggagaucgcggugcaaaacuggcucgcccgggucggccgcgagcgacuuuccagaauggccaucucgggggacgacugcguggugaagccccuggacgaucgguucgccagcgcacucacggcgcucaacgacaugggcaagguccggaaagacauccagcagugggagccaucgcggggguggaacgacuggacccaggugcccuucugcagccaccacuuccacgagcuggugaugaaggacggccgcgucuuaguggugcccugccggaaccaagacgagcugaucggacgcgcccggauuagccagggcgccgguuggucccugaaggaaaccgccugccucggcaaguccuacgcccagauguggacgcugauguacuuccaucgccgugaccugcgccucgcggccaaugccaucugcuccgccgugccaagccacugggugcccaccucccggaccacguggagcauacacgcgaagcacgaguggaugacuaccgaggacaugcuggcgguguggaaccgcguuuggauccaggaaaaccccuggauggaagacaagacccccguagagaguugggaggaagugccguacuuagguaagcgcgaagaccaguggugcgggucacucaucggccugacgagccgcgccacaugggcaaagaacauccagaccgccaucaaucagguccgcucccugaucgggaacgaggaguacaccgacuacaugcccagcaugaaacgauuccgcaaagaggaggaggaggcaggcgugcucugguag

SEQ ID NO: 25238 - RNA, 9876 nt, Artificial Sequence
  derived and/or modified CDS sequence (opt11) from DENV-2__EU687238__SS-prME
acagcaggggugauaaucaugcuaaucccuaccgcaauggcauuccaccuaacuacaagaaacggggaaccucacaugaucgucggccggcaggaaaaggggaagagucuucuguucaagaccgaagacggugugaacaugugcaccuuaauggcuaucgaccugggggaacugugcgaagacaccaucaccuacaagugcccccuccugcggcagaaugagcccgaggacaucgacugcuggugcaacagcaccaguacgugggugaccuaugggacaugcacgacuacgggggaacaccggcgcgagaagagauccgucgcccuggugccccacguggggaugggucucgaaacccgcaccgagaccuggaugagcucagagggcgcguggaaacacguucagcggauagagaccuggauccugcgccacccgggcuucaccaucauggccgccauccuggcguacacgauagggaccacgcacuuccagagggcccuaauuuuuaucuuacucacugccguagcgcccagcaugacaaugcgcugcauuggcaucuccaaccgugacuucguggaaggcgucagcgggggcaguuggguggacaucgugcucgagcacgguucuugcgugaccacuauggcuaagaacaaacccacccuggacuucgagcugauuaagacagaggcgaagcagccggccacauuacgcaaguauugcauugaggccaaguuaacgaacaccaccaccgagucucgauguccaacacagggcgagcccucucugaacgaggagcaggacaagcgcuucaucugcaaacauucgaugguggaucgcggcugggggaauggcugcggcuuauucggcaaaggagggauagugaccugcgcuauguucacgugcaagaagaacauggaggggaagguggugcugccagagaaucuugaguacaccauaguaaucacuccccauagcggggaagaacacgccguaggcaacgacaccgggaagcacggcaaggaaaucaagaucaccccgcaguccagcaucacggaggccgaguuaaccggguauggcacugugaccauggagugcagcccacguaccggccuggacuuuaacgagauggugcugcuccagauggaagacaaagcguggcugguacaccggcagugguuccuggacuugccccuuccuuggcugccgggggcagacacccagggcagcaauuggauccaaaaggaaacucucgucaccuucaaaaacccucaugcgaagaagcaggacgugguaguacuggggucgcaggaaggggccaugcauaccgcgcuaaccggggccacggagauacagaugagcagcgguaacuugcuguucaccggucaccugaagugucgccuccggauggacaaacuucaacugaaggguauguccuacagcauguguaccggcaaguucaagaucgucaaggagauagcggaaacgcagcauggcacgaucgugauccgcguacaguacgaaggcgauggcucucccuguaagauacccuuugagaucauggaccuagagaagcggcacguccuggggcgccuuaucaccgugaaccccaucgugacggagaaggauucucccguuaacaucgaggcggagccgccuuucggggacucguacaucaucaucggggucgagccgggccaguugaagcugaacugguucaagaagggguccagcaucggccagauguuugaaaccacgaugcgcggcgcaaaacggauggccauccugggggacaccgccugggacuucgggagcuuaggagggguguucacgaguaucgggaaagcgcuucaccaagucuuuggcgcgaucuacggcgcugccuucuccggggugucguggaccaugaagauccuuaucggcguaacgaucaccuggaucgggaugaacagccgcuccaccagccugucggucagucucguguuggugggcgucgugacccuguaucucggggugaugguccaggccgacacuggcugcguggugucuuggaagaacaaagagcugaagugcggaagugguauuuuuaucacggacaauguccauaccuggaccgagcaguacaaguuccagcccgaaagccccagcaagcuggccagcgcgauccagaaggcccacgaggaaggcaucugcgggauacgguccgugacgcgccuugagaaccugauguggaagcaaaucacgcccgaacugaaccacauccugagcgagaacgaagugaagcugacaaucaugacuggcgacauaaaagggaucaugcaggccggcaagcguucccugcgcccgcagcccacggaacugaaguacuccuggaagacauggggcaaggccaagaugcuguccaccgagagccacaaucagacguuucugaucgacgggccagaaacagcggagugucccaacaccaaccgggccuggaacucccuagaaguagaggacuacggcuucggcguguucuccaccaacauuuggcugaaacuucgcgagaagcaggacgucuucugcgacuccaaguugaugagcgccgccaucaaagacaaccgggcgguccacgcugacaugggcuacuggauagaguccgcccugaaugacaccuggaagauggaaaaggccagcuucauagaaaucaaguccugccacuggcccaaaucccauacacugugguccaacggcguccucgagucggagaugaucauccccaagaacuucgccggucccgugucccagcacaacuaucgcccgggcuaccauacgcagaccgccggccccuggcacuuaggaaaacuggagauggacuucgacuucugcgaagggaccaccgucguugugacagaggacugcggcaaccggggcccuucccuccggaccacuaccgcgucugggaagcugauaacugaguggugcugccggaguugcacucugcccccgcuccgauaccggggcgaggacggaugcugguacggcauggagauacgcccccugaaagagaaggaggagaaccugguuaauagccucgugaccgcugggcacggccagaucgacaauuuuucccugggcgugcucggaauggcccuauuccuggaggagaugcugcgcacacgcgucgggacaaagcacgccauacuccucguggcagugagcuuugucacccuaauaaccgggaauaugucguuucgggacuuaggcagggugauggugauggucggagccaccaugacggacgacaucggcaugggcgucacuuaccuggcauuacucgccgcguucaaagugcgacccacuuuugcggcugggcugcugcugcgcaaguuaaccagcaaggagcugaugauggcaacgauaggcauugcccuccuaucgcagagcacuauccccgagaccauucuagagcucacagacgcccuggcucuggggaugaugguacuuaagaucgugcgcaacauggagaaguaccagcucgcagugacgauuauggccaucuccugugucccgaacgcagugauccuucagaacgccuggaaggugucaugcaccaucuuagcagccgucuccgugagcccacugcuguuaaccuccucgcaacaaaaagccgacuggauuccgcuggcccugaccaucaagggccucaaccccacggcuaucuuccucacuacccugucucggaccagcaagaagcgcucuuggccgcucaacgaggccguaauggccgugggcauggugagcauccuagccucaucucugcucaagaacgacaucccaaugacugggccccuggucgcuggcgggcugcucacugucugcuacguucugacgggccggucggcggaccuggagcucgagcgagccgcugacguaaaaugggaggaccaggccgagaucagcgggaguuccccgauccucagcaucaccaucagcgaggauggaagcauguccauaaagaacgaagaagaggagcacacuuuaacuauccuuauccggacggggcuuuugguuaucucgggaguguuucccguuucgauucccaucaccgccgcggcuugguaccucugggagguaaagaagcagagagccggcgugcugugggacguccccagcccuccucccguuggcaaggccgagcuggaggauggugcguaccggaucaagcagcgcggaaucuucggcuauucccagaucggcgcaggcguuuacaaggagggcacguuccacacgauguggcacgucacccgcggcgccguguuaaugcaccgcggcaagcgaaucgagcccagcugggccgacgucaagaaggaccugaucuccuacggaggcgguuggaagcuagagggggaguggaaagagggcgaggagguccaggugcucgcucuggagcccgguaagaacccucgcgccgugcaaacgaagcccggccuguucaagacuaacacaggcacaaucggcgcuguaucucucgacuucaguccaggcaccuccggcagucccaucguggaccggaaggguaaagucgucgggcuuuacggaaacgguguggugacccggagcggcgccuacgucuccgccaucgcgcagacggagaaauccaucgaggacaaccccgagaucgaagacgacaucuucaggaagaagcgccucaccaucauggaccuccaccccggcgcaggaaagacaaagagauacuugccagcaaucgugcgagaagcgaucaagcgcgggcugcguacccucauuuuagccccgacgagggugguagccgcggagauggaagaagcccugcgugggcuucccauccguuaccagacccccgcuauccgggccgagcacacaggccgcgagaucguggaucucaugugucacgccacguucacaaugcgucuguuaagcccuguuagagucccgaacuacaaucucauuaucauggaugaggcacacuucacggaccccgccaguaucgcggcccgaggcuauaucagcacucgcguugagaugggggaagccgcggggaucuucaugacagcgacgccgcccggaucccgggauccauucccccagaguaacgcucccaucauggacgaagaacgcgaaauuccugagcggucauggaacagcggccacgaaugggugaccgacuucaaggggaagacgguuugguucguucccuccauuaaggccggcaacgacauugcggccugccugcgcaagaacggcaagaaaguaauccaauugagccggaagaccuucgacuccgaauacgucaagacgcgggccaaugacugggacuucguggugaccaccgacauuucugagaugggcgccaacuuccgcgcggaacgcgucauagacccccggcgcugcaugaaaccggugauccucacggacggcgaggagcgcgugaucuuggccgggcccaugccggucacgcacagcagugccgcucagcgccguggccggaucgggcgcaaccccaaaaacgagaacgaccaguacaucuacaugggcgagccccuggaaaacgacgaggacugcgcucacuggaaggaggcgaagaugcuacuggacaacauuaauacccccgagggcaucauaccguccauguucgagccggaacgggagaagguggaugcaaucgacggggaguaccgguugcggggcgaggcccgcaagacauucguugaccucaugcggcgcggggaccugccaguguggcuggcauaucgaguugccgccgagggcaucaauuacgcggaccgacgguggugcuucgaugguaucaagaauaaccagauucucgaggagaacguugaggucgagaucuggaccaaggagggugaacgcaagaagcugaagccgcgguggcuggacgcccgcaucuacagugacccccucgcccucaaggaguucaaggaguucgccgcgggacggaagucacuaacacucaaccugaucaccgagauggggcgccuuccuaccuucaugacccagaaggcccgcgacgcacucgacaaccuggccguucuacauacggccgaggucggagggagggcguacaaucaugccuugagcgagcuaccggagacccuggaaacccuccuacucuuaacccugcuggcaacggugaccggcggcaucuuucucuuucucaugucugggaaggguauagggaagaugacucugggcaugugcuguaucauuacugcgagcauccugcugugguacgcccagauccaaccacacuggaucgcggccucgauaauccuggaguucuuccucaucguacuguugauccccgagcccgagaagcaacgcacaccccaagacaaccaguuaacguaugugguuaucgccauccugacugucgucgcagccacaauggcgaacgagauggguuuucucgagaaaaccaagaaggaccuuggccuggggagcaucaccacgcaggagagugaguccaacauccuggacauagaccuccgcccggccagcgcauggaccuuguaugccguggccaccacauucgugacccccaugcugcggcacuccaucgagaacaguagugugaacgucucucucacagcgaucgccaaccaggcgaccgugcugauggggcugggacguggauggccgcucuccaagauggacaucggcgucccucugcuugcuauaggcuguuacagccaggugaacccuaucacgcucaccgcggcccugcugcuccugguggcccacuaugcgaucauuggccccggccugcaggccaaggcuacccgcgaagcccagaagagaaccgccgcuggaauaaugaagaaccccacgguugacggcaucaccgugaucgaccucgagcccaucccuuaugacccuaaauucgagaagcaacugggccagguuaugcugcucguccuuugcgugacacaggugcugaugaugcgcaccacgugggcccucugcgaggcauugacccuggccaccggccccaucuccacacucugggagggcaaccccggcagauucuggaacacgaccaucgccgucuccauggccaacaucuuucgaggcuccuaccuggccggggcgggccucuuguuuucuaucaugaagaacaccaccaacacacggcggggcaccggaaauaucggugagacgcugggagagaaguggaagucccggcuuaacgcucugggcaagagcgaguuccagauuuacaagaagucaggaauccaggaaguggaccgcaccuuagcaaaggagggcaucaagcgcggugagacugaccaccacgcuguuucaaggggcuccgccaagcuccggugguucgucgaacgaaacauggucacaccggagggcaagguggucgaucuugggugcggcagagggggcugguccuauuacugcggcgggcugaagaacgugcgcgaggucaaggggcuuacuaagggcggacccgggcaugaggagccgauccccauguccaccuacggcuggaacuugguccgccugcagagcgggguggacguguuuuucacucccccggagaagugcgauacccugcucugcgacaucggcgagagcucccccaaccccaccauagaggcaggcagaacacuucggguccugaaccucguggagaacuggcugaauaacaacacccaauucugcgugaagguccuaaacccguacaugcccagcgugaucgagaaaauggagacccuccagcgcaaguacgggggcgcccucgugcggaacccccugucccgcaacagcacccacgagauguacugggucuccaacgccaccggaaacaucgugagcuccgugaacaugaucagccgcaugcucaucaaucgguucacaaugaagcacaagaaggccacguaugagccggaugucgaccucggcuccgggacccgcaacaucggcaucgaaaacgagauccccaaccuugacaucaucgguaagcggauagagaagauuaagcaggagcacgagaccagcuggcacuacgaccaggaccaucccuacaaaaccugggcguaccacggaaguuacgagacgaagcagaccggcagcgccucaucuauggugaacgggguggucaagcugcugaccaagcccugggacguggugccgaugguaacccagauggccaugacggacacgacgcccuucggacaacagcgcguguucaaggagaaaguagacacccguacccaggagcccaaggagggcacgaagaagcugaugagaaucaccgccgaguggcuguggaaggagcuugguaagaaaaagacgccccggaugugcacgcgcgaagaguucacccggaagguacgcuccaacgcagcguuaggcgcgauauucacagacgagaacaaguggaaguccgcccgggaggccguagaggacucccgcuucugggagcuggucgaccgggaacgcaaccuccaucuggaggguaaaugcgagaccugcguguacaacaugaugggcaagcgggagaaaaagcugggagaguucggcaaggccaaaggcagccgcgcuaucugguauauguggcucggggcacgguuucuggaauuugaggcccugggcuuucucaacgaagaccauugguuuucucgcgguaauaguuuaagugggguggagggggagggacugcacaagcucggguacauccugcgggauguuucaaagaaggagggcggagcaauguacgcggaugacacggccgguugggacacccgcaucacccuggaggaccucaagaacgaagagauggucacuaaccacaugaagggggaacacaaaaagcuggccgaagccauuuucaagcugacguaccagaacaagguggucagggugcaacgcccaacaccccgggggaccgucauggacaucauuucacggaaggaccaacgcgguucaggccaagucggaaccuacggccucaacacguucacaaacauggaggcucaguugauccggcagauggagggggagggcaucuucaagagcauccagcgccugaccgugaccgaagagauagcggugcaaaacuggcucgcccggguaggccgcgagcggcuguccaggauggccaucagcggggacgauugcguugucaaaccccuggacgaucgguuugcguccgcccuaacggcgcuuaaugacauggggaagguccgcaaggacauacagcaaugggagcccagucggggguggaacgacuggacccaggugcccuuuugcagucaccauuuccacgaacuggugaugaaggacggccgcguccuaguugugccgugccggaaucaggacgagcugaucggccgagcccggaucucccagggagcgggguggucccugaaagagaccgccuguuuaggaaagagcuacgcucaaauguggacuuuaauguacuuccaucgccgggaccugcgccucgcagcuaacgccauuugcucugccguacccagccacugggugccaacgucccggacaaccugguccauccacgcuaaacacgaguggaugacuacggaggacaugcuggccguguggaaccggguguggauccaagagaaccccuggauggaagacaagacgccgguggagagcugggaggaggugcccuaccugggaaagcgugaagaccaauggugcgggagccucaucggcuuaaccagccgggccaccugggccaagaacauccagacagcuaucaaccagguccguucccuaauugggaaugaagaguauaccgacuacaugcccagcaugaagagguuucgaaaagaggaggaggaagcgggaguucucugguaa

SEQ ID NO: 25239 - RNA, 9876 nt, Artificial Sequence
  derived and/or modified CDS sequence (opt11) from DENV-2__EU687240__SS-prME
acggugggagucaucauaauguugauccccacggccauggccuuccauuugacaacccgcaacggagagccacacaugauuguuggccggcaggagaaggggaaaagucuguuguucaagaccgaggacggagugaacaugugcacacucauggcgaucgaccugggcgaacuaugugaagacaccaucaccuacaagugcccccugcugaggcaaaacgagccugaggauaucgacugcugguguaacagcaccagcaccugggucaccuacggcaccuguacaacgacgggcgaacaccgucgcgagaagaggucaguggcacuggucccccaugugggcaugggucucgaaaccagaaccgagacuuggaugagcucagaaggcgcguggaagcacgugcagcggaucgagaccuggauacuacgccacccuggguucacaaucauggccgccauccuagcauacaccauaggaaccacacacuuccaacgcgcucuuaucuucauccugcugacagccguugcccccucgaugacaaugcgcugcauaggcaucucgaaucgagacuucguggaggguguuucugggggcuccugggucgacaucguacuagagcacgguuccugcgugaccacuauggcgaaaaauaaacccacccuugacuucgagcuaauuaagacugaagcuaaacaacccgccacuuugcgcaaguacugcaucgaggccaaacugaccaauacuacgaccgagagccgaugcccgacacaaggagaacccucacuaaacgaggaacaggacaaacgcuucauaugcaagcacucgauggucgaccguggcuggggcaacggaugcggccucuucggcaagggcgggauaguaacuugcgcuauguucacguguaagaagaacauggaggggaagguggugcugccugagaacuuagaguacaccaucgugauuacgccccacucaggggaggagcaugcgguuggcaaugacacagggaagcacggaaaggagaucaagauaacaccccagucaaguaucacagaagcagaacuuacaggguacgguacggugaccauggaguguagcccccggaccggccuagacuuuaaugagaugguccugcuccaaauggaggacaaagcauggcugguucaccggcagugguuccuggaccuuccccuccccuggcugccuggggcggacacgcagggaagcaacuggauacagaaggagacgcuagugacuuucaagaauccccaugccaagaagcaggaugucguggucuuagggucgcaggaaggcgcaaugcacaccgcccucaccggcgccaccgagauccagaugucaucgggcaaucuacuguucacgggccaccuuaaaugcagacuccggauggauaaacuucagcugaaggggauguccuauaguaugugcaccggcaaguuuaagauugugaaggagaucgcggaaacccagcacgguacuaucgugauccggguccaauacgagggagacggcucccccugcaagauuccauucgaaaucauggaccucgagaagcgccaugugcuggggcgucuuaucaccguuaacccgaucgugacggagaaggacucgcccgugaacauugaggcagaacccccauucggagacuccuacauuaucaucgggguugagcccggccaguugaaauuaaacugguuuaagaaggggagcuccaucggccagauguuugagacgacgaugcgcggcgcuaaaagaauggcaauacugggggacaccgccugggacuucggcucucucggugggguauucaccucuauaggaaaagcucuacaccaaguuuuuggggccaucuacggcgccgccuucuccggcgugucuuggacaaugaagaucuuaauuggaguuaucaucaccuggauaggcaugaauagucguagcacaucguuaagugugagucuggucuuaguaggcguaguaacccuuuaccucggggugauggugcaggccgacucggguuguguggugucauggaaaaacaaagaauuaaaguguggaucaggaaucuucaucacagauaacgugcacacauggaccgagcaguacaaauuccaaccugagagccccagcaaauuagccuccgcgauucaaaaggcccacgaagagggcauaugcgggauuaggucuguaaccaggcucgagaauuuaauguggaaacagaucacccccgagcugaaccauauccuuuccgaaaacgaggccaaauugacaaucaugacaggagacauuaaggggaucaugcaggccggcaaacgaucauuaagaccccaaccuacagaauugaaauauagcuggaagaccuggggcaaggcgaaaaugcuguccacggagucacacaaccagacuuuucugaucgacggccccgaaaccgcagaguguccgaacaccaacagggcuuggaacagccuggagguugaggauuacgguuucggggucuucuccacaaacaucuggcugaagcugcgcgagaaacaggauguauuuugugauucgaagcuaauguccgccgcuauuaaggauaaccgagcgguccacgccgauaugggcuacuggauagaaucggcccugaacgacacuuggaaaauggaaaaagcguccuucaucgaaaucaagagcugccauuggccuaaaucacacacguuguggaguaacggugugcucgagagugagaugauuaucccgaagaacuuugccgggcccgucagccagcacaacuaucgcccgggcuaccacacccagacggcgggcccuuggcacuuaggaaagcuggaaauggacuucgauuucugugaggggacgaccgucguggugaccgaggacugcggaaaucgcggccccagcuugcgcaccacgaccgcgucuggcaagcuaauuaccgaguggugcugccggagcugcacccugccaccccugcgcuaccggggugaggacggauguugguacggcauggagauccgaccccugaaggagaaagaggagaaucugguuaauucccuggugaccgcuggccauggccagaucgacaauuuuucacuaggcgugcugggcauggcccucuucuuggaggagaugcuucguacgcgggucggcacgaaacacgcuauacucuuaguggcgguuucuuucguaaccuugaucaccgggaacaugucauuucgggaccugggaagagucauggugaugguaggggccacuaugaccgaugacaucgguauggguguuacguaccuggcccugcucgcugcguucaaggugcgccccacuuucgcggcuggccuccugcuacggaaacugaccucaaaagaguuaaugauggcaacgaucggcaucgcguuacugagccaguccacuaucccggaaacaauccuggagcucacggacgcccucgcgcuggggaugauggugcuuaagaucgugcgaaacauggagaaguaccagcuggccgugacaaucauggccaucaguugcgugccgaacgccguaauccugcagaaugcauggaagguuaguugcaccauacuggcugccgugagcgugaguccccugcuguuaacgagcucucagcaaaaggccgauuggauacccuuggcucugacgauuaagggcuugaaccccacggcuaucuuccugacgacguugagccgcacgagcaagaagcgcagcuggccacucaaugaggccgucauggcagucggcaugguuuccauacuugcaagcagccuccucaagaacgacaucccuaugaccggaccgcugguggccggcggccugcucaccgucugcuaugugcugacaggucgcagcgcggaccucgagcucgagcgcgccgcggacguaaagugggaggaucaagccgaaaucagcggaaguagcccuauccugucuauaaccaucagcgaagauggguccauguccaucaagaaugaggaggaggagcacacuuugacaauucucauaaggacgggccugcuggugauaucuggggucuuuccggugucuauccccaucacggcggccgcgugguaccucugggaagucaagaagcagcgcgccggcgugcucugggacgucccaucgccgccgccaguggguaaagcggaacuugaggacggcgccuaucguaucaagcaaaggggcauauucggcuacucgcaaauaggcgcggggguguauaaggaagguacauuccacaccauguggcacgucaccagaggggcaguacucaugcaccgcggcaagcggaucgagcccuccugggccgacgugaagaaggaccugauuagcuacggaggcggcuggaaguuagagggggaguggaaggagggagaggagguccaggugcuagcccuagaaccggggaaaaacccccgugccguucaaacuaagcccggccuguucaaaacaaacaccggcaccauuggcgccgugucccucgauuucagccccggcacguccggcagucccaucguggaccggaaggguaaggugguaggucuguacgggaauggcguagucacgcgcaguggagcuuaugucucagcaaucgcucaaacagagaaaaguauugaggauaaccccgagaucgaggacgacaucuuuagaaagaaacgcuuaacaaucauggaccuccaccccggggcgggaaaaacgaaacgguaccuccccgcaaucgugcgcgaggcaaucaaacggggacugagaacccugaucuuggcccccacccgcgucgucgccgcggaaauggaggaagcacucagagggcuccccauccgcuaccagacgcccgccaucagagccgagcauacgggucgugaaaucguugaccucaugugccacgccaccuucaccaugcggcugcuguccccugugcgcgugccaaauuauaaccucaucaucauggacgaggcccacuuuaccgaucccgcgagcaucgccgcuagaggcuacaucagcacgagaguggaaaugggggaggccgcgggcaucuucaugacggccacaccgccaggcaguagagauccuuucccgcaguccaacgcccccaucauggaugaagagagggagauccccgaacgaagcuggaacagcggccacgagugggugaccgacuucaaagggaagacgguaugguucguaccgagcaucaaggcugguaacgacaucgcugccugccuccgcaagaacggcaaaaagguuauucagcuuagccggaagacuuuugacagugaauacgugaagacgcgcgccaacgacugggacuucgugguuacgacggacaucuccgagaugggcgccaacuuucgggcugagagggugaucgacccaaggaggugcaugaagcccgugauccuaaccgacggggaggagcgcgugauucuggcagggccuaugccggucacgcacagcucggcagcccagagacgcggccggauugggcgcaacccgaaaaaugagaacgaucaauacaucuacaugggcgagccacuugagaaugacgaagacugugcccacuggaaggaagccaagaugcuucuugacaacauuaacacccccgaaggcauuauaccgaguauguuugagccugaacgcgagaagguggacgcgauagauggcgaguaccgccuacggggugaggcaagaaagacguucguugaucuuaugcggcggggcgaccugcccgucuggcuggcuuaucgggucgccgccgaggguaucaacuaugcggaucggagaugguguuuugacgggauaaagaacaaccaaauccuggaggaaaauguggagguggagaucuggacuaaggaaggcgaacguaaaaagcugaagccgcgguggcuugacgcacgcaucuacuccgaucccuuggcccugaaagaguucaaagaguucgcggcaggccgaaagucgcucacucuuaaccugaucacagagauggggaggcuuccaacauuuaugacacagaaagcccgcgaugcccucgacaaccuggccguacuacauaccgccgagguuggcggucgcgcguauaaucacgcgcuuuccgaacucccggagacacuggagacgcuccuacugcuaacacugcuggccaccguuaccggcggcaucuuucucuuccugaugagcggaaagggcaucgguaagaugacgcucgggaugugcuguaucauaaccgccucaauauugcugugguacgcccagauucaaccgcacuggaucgcagcaucgauaaucuuggaguucuuucucaucguauuacugauccccgagcccgagaagcagcggacgccccaggauaaccaacucaccuacgucgugaucgcaauccugaccgucgucgcagcaaccauggccaaugaaaugggguuccuggaaaagacuaagaaggacuugggucugggcagcauuacgacccaggaguccgagagcaauauacuggacaucgaccuccgcccggccucggccuggacgcuuuaugccguugccaccacuuucgugacccccaugcugcggcacuccaucgaaaauuccagcgucaacguuucccucacggcgauugcuaaucaggcaaccguccuuaugggacuuggacgcggguggccccugagcaaaauggacauuggcgucccucugcuagcaauaggcuguuacucccaagugaacccuauaacuuugacggcagcccugcuucucuuaguggcucacuacgccauuaucggcccaggacuccaggccaaggcgacgcgcgaagcccagaagcggacugccgccggcauaaugaagaacccuaccgucgacggcaucacaguaaucgauuuagagccgaucccguacgacccaaaauucgaaaagcaauuagggcaagugauguugcuaguuuugugugugacucagguucugaugaugcgaaccacaugggccuuaugugaggcacugacacucgcaaccggcccaaucucaacuuugugggaggggaauccggggcgguucuggaacaccaccaucgcaguguccauggccaacauauuucgaggcagcuacuuggcaggggcgggccuccuguucucgauaaugaaaaacaccaccaauacgcgaagaggaacaggcaacauaggcgagacccugggagagaaauggaaguccaggcugaacgcuuugggcaagucagaguuccagaucuauaagaagucugggauccaagagguugaucgcacccuggcuaaagaaggcaucaagcgaggggagaccgaccaccaugccgucucccggggcagcgcaaagcugcgcugguucguggagcgcaauaugguaaccccggaaggcaagguagucgaccucgggugcggcagaggcggguggaguuacuauugcggcgggcugaagaauguacgcgaaguaaaagggcuuacgaagggcggaccgggucacgaggagccgauccccaugagcaccuauggauggaaccucguucggcugcagagcgguguggacguuuucuuuacuccuccggaaaagugugacacccugcucugcgauaucggagaauccucacccaaccccaccaucgaggcuggccggaccuuacgcguucugaacuugguggagaacugguuaaacaacaacacccaguuuuguaucaaggugcuaaaccccuacaugcccucggucaucgaaaagauggagacucugcaacgcaaguacggcggcgcccugguacgaaacccccuuagccguaacuccacucacgagauguacuggguuagcaacgcaacuggcaacaucgucuccagugugaacaugauaagucguauguuaauaaaucguuucaccaugaagcauaagaaagccacauacgagccggacguggaccucggcaguggcacccguaauauaggcauagagaacgagauaccaaaccucgacaucaucgggaagcgcaucgagaagaucaaacaggagcacgaaacuucauggcacuacgaucaggaccaccccuacaagaccugggcguaccacgggucauacgaaaccaagcagaccgguucggcuagcaguauggucaauggggucgucaagcuguuaacgaagcccugggaugucguaccgauggucacccaaauggccaugacugauaccacuccguucggacaacagcguguuuucaaagagaagguggacacucggacccaggagccaaaggagggcaccaaaaagcugaugagaaucaccgccgaauggcuguggaaggaacucggcaaaaagaagacuccuaggaugugcacccgagaggaguucacccggaagguucgaagcaacgccgcccugggagcuaucuuuacggacgagaacaaguggaaguccgcccgcgaggccguugaggacagucgcuucugggaguugguggaccgugagaggaaccuacaucuggaggguaaaugcgaaacuugcguauacaacaugaugggaaagagagagaagaagcuaggggaguucggcaaggcgaagggaagucgcgccaucugguauauguggcugggcgcccgguuccuggaguucgaggcucugggguuucucaacgaagaucacugguucagccgcgguaacagccuguccggagucgagggagagggccuacauaagcucggcuauauucuaagggauguaucgaaaaaggagggcggagcgauguacgcugacgacaccgccgggugggauacccgcauaacgcuggaagauuuaaagaacgaggagauggugaccaaccacaugaaaggcgagcacaagaaacuagccgaagcgaucuucaaauugacguaccagaacaagguugugcgaguacagcgacccacgccccggggcaccgugauggacauaaucagucguaaggaucaacgugggagcgggcagguugggacauacggccucaacacuuuuacaaauauggaagcccagcugauccggcaaauggaaggcgagggcauuuuuaagaguauucagcgccugaccgucaccgaagaaaucgcaguccaaaacuggcucgcccggguuggccgugaacggcugagccggauggcuaucucuggggacgacugcgucgugaagccucuggacgaucgguuugccagcgcauuaaccgcguugaacgacaugggcaaggugcgcaaagacauccagcagugggaacccucccgcggcuggaaugauuggacccaaguuccguucuguagccaccauuuccacgagcuggugaugaaggacggccgcguauuagucguccccugucgcaaccaagaugaacucauagggcgcgcacggaucagucaaggcgcuggcuggucccugaaggagacggcgugucucgguaaaucuuacgcacagauguggacacucauguacuuccaccgccgcgacuugaggcucgcggccaacgcaauaugcagcgcggugccaagccauuggguccccaccagccgaacaaccugguccauccaugcgaagcacgaguggaugacgacagaggacauguuagcgguguggaaccgcguguggauccaggagaaccccuggauggaagacaaaacgcccgucgagagcugggaggaggugccauaccugggcaaacgcgaggaccaguggugcgggucacuuauugggcuuacaucccgagccacgugggcgaagaauauccagacagcgaucaaccaggugcgaagccugaucgggaacgaggaguacacggacuauaugcccucgaugaagcgauuccgcaaagaggaagaagaggccgguguccucugguga

SEQ ID NO: 25240 - RNA, 9876 nt, Artificial Sequence
  derived and/or modified CDS sequence (opt11) from DENV-2__EU687241__SS-prME
accgccggcgugauuauaaugcugauuccaaccgccauggcguuccaccucaccaccagaaacggagagccccacaugauaguuggccggcaggaaaaggggaagucccugcuguucaagaccgaagacggcguuaacaugugcacucucauggccaucgaccugggcgaacugugcgaggacaccaucacauauaaaugcccucuucuccggcaaaacgaacccgaggacaucgacugcugguguaacagcaccagcaccugggugaccuacgggaccugcacaaccaccggggagcaucggcgggagaaacggucagucgccuuagugccccacgugggcauggggcucgagacccggacugagacauggaugagcagcgagggcgccuggaaacacguccagcggaucgagaccuggauccugcgccaccccggcuuuaccaucauggccgcgauccuggcuuacagcauagggaccacccauuuccagcgugcccucaucuucauacugcugacggccguggcaccgucuaugacuaugaggugcaucggaaucagcaaucgggacuuuguggagggcgucuccgggggcucguggguggauauuguguuggagcacggguccugcgucacuaccauggccaaaaacaagccgacgcuggacuucgaguugaccaagacggaggccaagcaacccgcgacuuuacgcaaauacugcaucgaggcaaagcugacgaauaccacuaccgagagcagaugcccgacgcagggcgagcccagucugaacgaggagcaggacaagcgcuucaucugcaaacauagcaugguugaccggggcugggggaacggcugcggccuguucggcaagggugggaucguuaccugcgcgauguucacgugcaagaagaauauggagggcaaaguaguccuaccagagaaucuggaguacacuaucgugaucacgccccacaguggggaggaacaugcaguggggaacgauaccgggaaacacggcaaggagaucaagauaaccccucagagcuccauaaccgaggccgagcucacggguuacggcacggugaccauggagugcagccccaggaccggccuagacuucaaugagauggugcuguuacagauggaagauaaggccuggcugguccaccgccagugguuccuggaucucccccugcccuggcugccuggagccgacacucaaggcuccaacuggauccaaaaggagacguuagugacauucaagaacccacaugcaaagaagcaggacgugguggugcuggggagccaagagggcgcaaugcacacagcucugaccggggccacggagauacaaaugagcuccggcaaccugcuguucacaggucacuugaagugccgccuccggauggauaagcugcagcuuaagggcaugucuuacuccaugugcaccggaaaguucaagaucgucaaggaaaucgccgagacccaacaugggacaaucgugauccgcguacaguacgagggggacggcagcccgugcaagauccccuuugagaucauggaucucgaaaagcggcacguccuuggccgccugaucaccguuaacccgaucgugacagagaaggacucccccgucaacaucgaggcggaaccgccuuucggcgauucuuacaucaucauagggguggaacccggccagcucaaacugaacugguucaagaagggcuccagcauuggucagauguucgagaccacaaugcgaggugcgaagcggauggccauacuuggugauaccgccugggauuucggcucccucggggggguauucaccagcaucgggaaggcuuuacaccagguuuucggcgcgaucuacggcgccgccuucucagggguaagcuggaccaugaaaaucuugauuggggucaucauuacauggauagguaugaacucccgcuccaccuccuugagcgugucucucguacuggugggagucgugacccucuaccuuggggugaugguccaagcugacaccggcugcguggugagcuggaaaaauaaagagcugaagugcgguuccgggaucuuuauaacugauaacgugcacaccuggacggaacaguacaaauuccagccugaaagccccagcaagcuagcguccgcaauccagaaggcccacgaagagggcaucugcgggauccgcagcgugacgcgccucgagaaccugauguggaagcagaucaccccugaacuaaaccauauccucuccgaaaacgaggugaaguugaccaucaugacuggcgacaucaaggggaucaugcaggccggcaaacggucauuacgcccgcagcccacugagcuuaaguauaguuggaaaacguggggcaaggccaagaugcuaaguacagagucccacaaccagacguuucugauugaugggcccgaaaccgcggaguguccaaauacgaaccgggccuggaauagccuagaggucgaggacuacggauucggaguguucuccaccaauaucuggcugaaacugcgcgaaaagcaggacguguucugcgacaguaagcucaugucugcugcaaucaaggacaaucgagcagugcaugcggacaugggguacuggaucgagagcgcacucaacgacaccuggaagauggagaaggccucguucaucgagauuaagagcugccacuggccuaagagccacacccuguggagcaacggggugcucgaaucugagaugaucauccccaagaacuuugcggggcccgugucccagcauaacuaucgcccgggauaccacacgcaaaccgccgggcccuggcacuuaggcaagcuggagauggacuucgacuucugcgagggcacgaccgugguggugaccgaggacugcgguaaucggggcccgagccuccgcacgacgaccgcgucggggaagcugauaaccgaguggugcugcagaucgugcacgcuccccccucuccguuauaggggcgaggacgguuguugguacggcauggagauccguccccugaaggagaaggaggagaaucuugugaacucacuagucaccgcagggcacggccagaucgacaacuucagucucggaguucuugggauggcgcuuuucuuggaggagaugcugcggacccgcgucggcaccaaacaugcuauccuccugguggcgguguccuucgucacucugaucacagggaacaugagcuuccgagaccucggccgcgugaugguaauggucggggcgacuaugaccgaugacaucggcaugggcgugacguaccuggcgcugcucgccgccuucaagguacggcccaccuucgccgcuggccugcugcuuagaaagcugacuagcaaggagcugaugauggccacuauaggcauagcccuccugagccaguccacgauccccgagaccauccuggaacucaccgaugcccuggcgcuggggaugaugguccucaagauagugcgcaccauggagaaguaucagcuggccguuacgaucauggcgaucucaugcgucccgaacgcggucauccugcagaaugccuggaagguguccuguacgauccuugcggccgucagcgucagcccccugcugcugacgucgucccagcagaaggccgacuggauuccacuggcccugaccaucaagggucuaaaccccacagccaucuuccugacuacccugagccguaccuccaaaaagcgcucguggccacugaaugaggccguuauggccgugggaauggugucuauucuggccagcagccugcucaagaacgacauccccaugacggggccguuaguugccggcgggcuguugacggugugcuacguccugacgggcagaucggcggaccuggagcucgagcgcgcugccgacgucaaaugggaagaucaagccgaaaucagcgggagcagccccauccuuuccaucacuaucuccgaagaugguucgaugagcaucaagaaugaagaggaggagcacacacugaccauccucauucggaccggucucuuagucaucuccgguguguucccgguuagcauccccauuacggccgcggcgugguaccucugggagguaaagaagcagcgcgccggcgugcucugggacguccccucaccgccgcccgucgggaaggccgagcuggaagauggcgccuaccggaucaagcaacguggcaucuucggcuacagucagaucggcgcugggguguacaaagaagguaccuuccauacaauguggcaugucacccguggugcugugcucaugcaccgcggcaaacgaauugagcccuccugggccgauguuaagaaggaccugauauccuacgggggcggcuggaagcuggaaggggaauggaaagagggagaagagguccaggugcucgcgcuggagcccgggaagaaccccagggcuguccagaccaagcccggcuuauucaagaccaacacugggaccaucggcgcggucuccuuggacuucucgcccggcaccagcgggagucccaucgucgaucggaagggcaagguagucgggcuguacggcaacgguguggugacccgcucaggggcguacguaagcgccauugcucaaacggagaagucuaucgaggacaacccagaaauugaggacgacaucuuccggaagaagcgccugaccaucauggauuuacaccccggcgcggggaaaaccaagcgguaccugcccgccaucgugcgggaggccaucaagcgaggcuuacggacccugauccucgcuccaaccaggguggucgcggcggagauggaagaggcccugcggggacugcccauccgauaccagaccccggccauccgggcggagcacaccggccgcgagaucguggauuugaugugccacgccaccuucacgaugcgccuacuguccccagugagggucccgaacuacaacuuaaucauaauggacgaggcgcacuucaccgaccccgcaaguaucgcagcacggggcuacaucuccacccgcguugagaugggugaggccgcgggcaucuucaugacagcgacgccgcccgggagccgggacccguucccccaguccaacgcccccaucauggacgaagagcgcgagaucccagagcgcagcuggaacucaggccacgaaugggugaccgacuucaaagggaagaccgucugguucgugccgagcaucaaagcagguaaugacaucgcggccugccugagaaagaacggcaagaaagugauccagcugucucggaagacauucgacucggaguaugucaagacgcgugccaaugacugggacuucguggugacaacagacaucagcgagaugggagccaacuucagagccgagagagucaucgacccccgacgcugcaugaagcccgugaucuugaccgauggagaagaacguguuauccuggcggggcccaugccagucacgcacucuuccgccgcccagcgcagaggacggaucgggcgcaaccccaagaaugaaaacgaccaguacaucuacaugggcgaaccccuggagaaugacgaggacugcgcccacuggaaggaggccaagaugcuccuugauaacauuaacacccccgagggcaucaucccuucuauguucgaacccgagcgagaaaagguggacgcaaucgacggggaguaccgccugcggggagaggcccgcaagaccuucguggaucucaugcggaggggggaucugcccgucuggcuugccuaccgugucgcugccgagggcaucaacuacgcugaccgccgguggugcuucgacgggaucaagaacaaccaaauauuagaggaaaacgucgaggucgaaauuuggaccaaggagggcgagcguaagaagcugaagccgcguuggcuggacgcgcgcaucuacuccgacccccucgcccuaaaagaauucaaagaguucgccgcuggccgcaaaucccugacgcucaaucugaucaccgagauggggcgccuccccaccuuuaugacccagaaggcgcgggaugcacucgacaaccuggcgguacuccacacggcagagguaggcggccgcgcguacaaccaugcccucagugagcugcccgagacccuggagacccuccugcugcuuacacugcuggccaccgugacgggcggaauuuuccucuucuugaugagcggcaagggcaucgguaagaugacccugggcaugugcugcaucaucaccgccuccaucuuacuaugguacgcccagauccagccucauuggaucgcugcuagcauuauccuggaguucuuccuaauagugcugcuaauccccgaacccgagaagcagagaaccccccaggacaaucagcucacguacgucguaaucgccauccugaccguagucgccgcaaccauggcuaacgagaugggguuccuugagaagacaaagaaagaccucggucugggguccauaaccacucaagagucugaaagcaauaucuuagacauugaccuccgaccggccucggcauggacccuguacgccguggccaccacguucgugaccccuauguugcgccacagcaucgagaacuccagcgucaacgugucccucacugcgaucgccaaccaggcgaccguacugauggggcugggccguggguggccccucaguaagauggacauaggagucccucuucuagccaucgggugcuacucgcaagugaacccgaucacguugacagccgccuugcugcucuugguugcccauuaugccaucaucggccccggccugcaggcuaaagcgacucgcgaggcucagaagagaaccgccgcggggaucaugaagaaccccaccguggauggcauaacuguaauugaccucgagccaaucccguacgacccgaaguucgagaaacaacuuggccaggucaugcugcugguguuaugcguuacucaagugcugaugaugcgcaccacgugggcccucugcgaggcccugacgcuggcuaccggccccaucagcacgcucugggaggggaaccccggacgauucuggaacacgacgaucgccgucaguauggcgaauauuuuucgcggauccuacuuggcaggggcgggccugcucuuuuccaucaugaagaacaccacgaacacaagacgcgggaccgggaacauaggcgaaacgcugggcgaaaaguggaaaucccggcugaacgcgcucggcaaguccgaguuccagaucuauaagaaguccgguauccaggaaguagaccgaacccuugccaaggaggguaucaagcgaggggagacggaucaccacgccgucucccguggcagcgcgaagcugaggugguucgucgagcgcaacauggugacaccggagggcaagguggucgaccucgggugcggccgcggcggguggagcuauuacugcggcgggcugaagaacgugcgcgaggugaaggggcugaccaaggggggccccggccacgaggagcccauccccaugagcaccuauggcuggaaucucguccggcuccagagcgggguggacguguuuuuuacgccgcccgagaagugugacacucugcucugcgacaucggcgaguccucacccaacccuacaaucgaggccggccgcacuuugcggguucugaaccucguggagaauuggcugaacaacaauacgcaguucugcgugaaaguucugaauccguacaugcccucaguaauagagaagauggagacgcuccagcgcaaguaugggggggcgcuggugcggaaccccuuaucacgcaauuccacccaugagauguacugggucagcaaugccaccgggaacaucguguccagcgugaacaugaucucccgaaugcucaucaaccgguucaccaugaagcacaagaaggccacguacgagccggacguagaccucggcucggggacuaggaacaucggcaucgaaaaugagauucccaaccuggacauuauuggcaaacggaucgagaagaucaagcaggagcacgagacuuccuggcacuacgaccaggaccaccccuacaagaccugggcuuaccauggcucguacgagacaaagcagacagggucugccuccucaauggugaacggggugguaaagcuauugaccaagccgugggauguggugccgaugguaacccaaauggccaugacggauacuacccccuucgggcaacagcgcguguucaaggagaaaguggauacccggacgcaggagccgaaggaagguacuaagaaacucaugcgcauaaccgccgaguggcuguggaaagagcuuggaaagaagaagacgccucggaugugcacacgcgaggaauucacccggaaaguacgcagcaacgccgcgcugggcgccaucuucacagacgagaacaaauggaaguccgcuagggaggcuguggaggacagccguuucugggaacuggucgaccgggaacgcaaccuacacuuggaggggaagugcgagacgugcguguacaacaugaugggcaagagggagaaaaagcugggugaguucggcaaggccaaaggcucccgcgcgauaugguacauguggcucggggcccgguuccuggaguucgaggcccugggcuuucuaaacgaggaucacugguucagccgagggaacucgcuauccggcguggagggggagggccugcacaaacucggcuacauucugcgggaugucagcaagaaggaaggcggcgccauguacgcggacgacacggccgggugggacacccgcaucacccuggaggaccucaagaacgaggagauggugaccaaccauaugaagggagagcacaagaagcuggccgaggccaucuuuaagcugacuuaccagaauaaggugguccgggugcagcgcccgacgccccgcgggacugugauggauauuauauccaggaaggaucaacgcggaucgggccaggucgugaccuaugggcucaacacguuuaccaauauggaagcccagcugauccggcaaauggagggcgaggggaucuucaagagcauccaacgccugacagugacugaggagaucgcgguccagaacuggcucgcccgggugggacgcgaacggcugagccgcauggccaucuccggcgacgacugcgugguaaagccacucgaugacagauucgcgagcgcccucacggcgcuuaacgauaugggcaaagugaggaaggacauucagcagugggaaccuagccggggcuggaacgauuggacccagguaccuuucuguucccaccauuuucacgaacugguaaugaaggacgggagggugcuuguggucccuugccgcaaccaagacgagcucaucggccgcgcccggauaucacagggggccggcuggagccugaaggagaccgccugccucggcaaauccuacgcucagauguggacacugauguacuuccaccgccgggaccugagguuagcggccaacgccaucuguagugcagugcccucccacugggugccaaccagccggacgacgugguccauccacgccaaacaugaguggaugaccaccgaagacaugcuggccgucuggaaccgcguguggauccaggagaacccauggauggaagacaaaacacccguggagagcugggaggaggugccauaccuggggaagcgcgaggaccaaugguguggcagccuuaucgggcugaccuccagagccaccugggccaaaaacauccagacggccaucaaucaaguccgcagccugaucggcaaugaggaguauacggacuacaugcccuccaugaagagauuccgcaaggaggaggaggaggcgggggugcuuugguaa

SEQ ID NO: 25241 - RNA, 9876 nt, Artificial Sequence
  derived and/or modified CDS sequence (opt11) from DENV-2__EU687242__SS-prME
accgcuggcguaaucauaaugcugauccccaccgccauggcguuccaccugaccacccgcaacggggagccccacaugaucguaggccggcaggagaaagguaaaucccugcuguuuaagaccgaagacgguguuaacaugugcacccucauggccaucgaucugggggagcugugugaggacaccaucaccuauaagugcccgcuccuccgccaaaacgagcccgaggacaucgacugcugguguaacagcaccagcaccugggugacauacgggaccugcaccaccacgggcgagcaucguagggagaagcggucugucgccuuagugccccacguggggaugggccucgagacccgaaccgagaccuggaugaguagcgaaggugccuggaagcauguccaacggaucgagacguggauacugcgacacccgggcuucacaaucauggcggcgaucuuagccuacacuaucgggaccacccacuuccagcgggcguuaauuuuuauucuguugacugcgguagcucccagcaugaccaugcgcugcaucgguauaagcaaccgugauuucguggagggcguaagcgggggcucuuggguggacaucgugcuggaacacgggagcugcgucacaacgauggccaagaauaagcccacccuggacuucgagcugaucaagacggaagccaaacagcccgccacccucaggaaguacugcaucgaggcaaaacuuacgaacaccaccacugagucccggugcccuacgcaaggcgagcccucucugaacgaggaacaagacaagcgcuucaucugcaagcacuccaugguggaccggggcugggggaacggguguggucuguucggcaagggcgggauugugacaugcgcgauguucacgugcaagaagaauauggaggggaaggucguguugcccgagaaucuggaguacaccauuguuaucacaccccacucuggggaggagcacgccguaggcaacgacacggguaagcacggcaaggagaucaaaaucacuccgcaguccagcauaaccgaagcggaauuaaccggguacggcaccgucacaauggaaugcagcccccggacgggccuggacuucaacgagaugguccugcuccagauggaggauaaagccuggcuuguccaccgccagugguuccuggaccucccgcuucccuggcugcccggggccgauacccaggggagcaacuggauacaaaaggaaacccucgugaccuucaagaauccccacgcgaagaaacaggacguggucguauuagggucccaggagggagccaugcacacagcacugaccggggcuacugagauccagaugagcagcggcaaccuccuguucaccgggcaccugaagugucggcuccggauggauaagcugcagcucaaggggaugagcuauuccaugugcaccggcaaguuuaagaucguaaaggagauagcggagacccagcauggcaccauagucauccgcgugcaguaugagggcgauggaucgccguguaaaauccccuucgagauaauggaucucgagaagcggcacguccuggggcgccucaucaccgugaacccuauagucaccgagaaggauagccccgucaauauugaggccgagccgcccuucggugacuccuacauaauaauagggguggagccgggccagcucaagcucaacugguuuaagaaggggagcuccaucggccaaauguucgaaaccacgaugcgcggggcaaaacggauggccauccugggggacaccgcgugggauuucggcagccuugggggcguguucaccuccaucgggaaggcacuccaccaagucuuuggagcgauauauggcgcggcuuuuagcggcgugagcuggacuaugaaaauccugauuggcgugaucauaacguggaucgguaugaacucuagguccacaucccuguccgucagccucguacuggucggcguagugacuuuauaccuaggggugaugguccaggcggacaccggcugcgugguguccuggaagaauaaagaacucaaguguggaucagggauauucaucacggauaacguccacacauggaccgaacaguacaaguuccagcccgagagucccagcaagcuggcgagcgccauccagaaagcacacgaggaaggaaucugcgggauccgguccgucacccgccuagagaaccuaauguggaaacagaucacgcccgagcuaaaccacauccuaagcgagaacgaggugaaguugaccaucaugaccggcgacauacgggggaucaugcaggcuggcaagagaucccuucggccgcagcccacagagcucaaguacagcuggaagacguggggcaaggccaagaugcugucgaccgagucgcauaaccagaccuuccugaucgacggucccgagacugcugaauguccgaacacaaacagggccuggaacagucucgaggucgaggacuacggcuucggagucuuuucuaccaacaucuggcugaagcugcgggagaagcaagauguguucugugauucuaagcucaugucugccgccaucaaggacaaccgugcgguccacgcagacaugggcuacuggaucgaguccgcacugaacgacaccuggaaaauggagaaggcauccuuuaucgagaucaagagcugcuacuggccuaagagccacacccucuggucgaacggcguccucgaguccgagaugaucaucccaaagaacuuugccgggcccgugucccagcauaauuauaggccuggguaccacacccagaccgccgggccauggcaccugggcaagcuagagauggacuucgacuucugcgaggggaccacugucguggugacugaggacugcggcaaccgagggcccagcuuacggacgacuaccgcgucagggaagcugauuaccgaauggugcugcagaagcugcacacuacccccgcugcgguaccgcggagaggacgggugcugguauggcauggagauccggccccugaaggagaaagaggaaaaccugguaaacagccucguuaccgcugggcacggccagauagacaacuuuaguuuaggcgugcuggggauggcacucuuccuggaggagaugcugcgaacucgggucggcaccaagcaugcuaucuuacugguggcggugaguuuugucacccugaucaccggcaacaugaguuuuagggaccucgggcgggugauggugauggucggugcaaccaugacagaugacaucggcaugggcgugacguauuuggcccugcuggccgccuuuaaggugaggcccacauucgcggccgggcuacugcuccgcaagcugacuucgaaggagcugaugauggcaaccauuggcauugcccuucuaucccagagcacaauccccgaaacaauauuggaguuaaccgacgcucuggcgcuggggaugaugguccucaaaauaguucggaacauggagaaguaccagcuggcagugacuauuauggcaaucuccugcguuccuaaugccgugauucugcagaacgccuggaagguaaguugcaccauucuggcggccgucuccgucagcccccuccugcucacguccucacagcagaaagcggauuggauccccuuggcccugacuauuaagggccucaaccccaccgcgauuuucuuaacuacucugucccgcaccagcaagaaacgguccuggccgcucaaugaggcgguaauggccgucggcaugguuagcauccuggccuccagccugcucaagaacgacaucccuaugacugggccucucguggccggcgggcuguuaacggucugcuacgugcugacuggacgcucggcggaccuggagcucgagcgagcagccgacgucaagugggaggaccaggccgaaaucuccgggagcucccccauucucucaaucacuaucucagaggacggcagcaugagcaucaagaacgaggaggaggagcauacccucaccauucucauccgcaccggccuguuggugaucagcgggguguucccggucuccauccccaucacggccgcggcaugguaccucugggaagugaagaagcagcgggccggcguccugugggacguccccagcccgccacccgugggcaaggccgaacuggaggacggcgccuaccgaauaaaacagagaggaaucuuuggcuacucccaaaucggugcggggguguauaaggagggcaccuuccacacaauguggcacgucacgcgcggggccguauugaugcaccgggguaaacgcauagaaccgagcugggccgacgugaagaaggaccuaauuucauacgggggcggguggaagcuggagggugaauggaaggagggggaggaaguccaggugcucgcccucgagcccgggaagaaccccagggcgguccagacuaagcccggucuguuuaagacaaacacagggaccaucggagcagucagccucgauuuuuccccugggacuagcgggucaccaauaguggaccggaaggggaaaguggucgggcuguacgggaacggcgucguaacgaggaguggggcuuaugucuccgcuaucgcccagacagagaaguccaucgaggacaaucccgagauagaggacgacauauuccgcaagaagcggcugacgauuauggaccuccacccgggagcggggaagaccaagcgcuauuuacccgccaucguucgugaagccaucaagcgcggauuacgcacccugauccucgcccccacccggguggucgccgcggagauggaggaagcacugcgcggacugcccauucgguaccagacgcccgccauccgcgccgagcacacgggccgcgagaucguggacuuaaugugccacgccaccuuuacgaugcgcuugcugagccccgugcgugucccgaacuacaaccucaucaucauggacgaggcgcacuucacggaccccgccuccauugcggcccgcggcuauaucagcacaaggguggaaaugggugaggccgcuggcauauucaugacagcaacgccacccgggucccgcgacccguucccccagagcaaugccccgaucauggacgaggagcgggaaauccccgaaagauccuggaacagcggccacgagugggugacagacuucaaggggaagaccguaugguucgugccgucaaucaaggccgguaacgauauugcugccugucuccggaagaacggcaagaagguuauccagcugucucgcaaaaccuucgauuccgaguacgucaagacccgggccaacgacugggauuucguggugacgaccgacaucagcgagaugggggcuaacuuucgcgccgagcgagucauagacccccgcagauguaugaagcccgucauccugaccgacggcgaagaacgcguaauccuggcgggaccgaugccggucacgcauuccagcgccgcucagcgccgaggccgcaucgggcggaacccgaagaacgagaacgaccaguacaucuacaugggcgagccccuggagaacgaugaagacugugcccacuggaaggaggccaagaugcuuuuagacaauaucaauaccccagagggaaucauaccguccauguuugagcccgagagggaaaagguggacgcgaucgacggggaguacagacugcgaggcgaagcccggaagaccuuuguugaccucaugcgccgcggugaccugcccgucuggcuugccuaucgaguggccgcagagggaaucaacuacgcggaccggcgcugguguuucgaugguaucaagaacaaccagauucucgaagagaacguggaggucgagaucuggaccaaagagggggagcggaagaagcugaagccgcgcuggcuggacgcucggaucuauagcgacccacucgcccugaaggaguucaaggaguuugccgcaggccguaaaucccugaccuugaaccugaucacggagaugggcagacugcccacuuucaugacccagaaggcucgcgaugcacucgacaaucuagcgguauugcacaccgcagaggucggagggcgggcauacaaucacgcccuuaacgaacugcccgagacgcuggagacccuccugcugcuaacccucuuagccaccguuacgggcgggauauucuuguuccucaugucggggaaaggcaucgggaaaaugacucuaggcauguguugcauuaucaccgccuccauccuacucugguacgcccagauccagccgcacuggaucgcggcgagcauaauccuggaguucuuccugaucgugcuauuaauccccgagcccgagaagcagcggacuccacaagacaaccaacucacuuacgucgugaucgccauccugacgguagucgcggccacaauggcgaaugagaugggguuccuugagaagacuaagaaggaucuaggccugggguccaucaccacgcaggagagcgagucuaauauccuggacaucgaccuccguccggccuccgccuggacacuguacgccguggcuacaacauucgucacacccaugcuccgccauagcaucgagaacagcagcgugaauguguccuugacggcgauagccaaccaggccaccguacucaugggguuaggccgcggguggccccucagcaagauggacaucggcguaccauugcuggcgaucgggugcuacucccaagucaacccgaucacacucacggcagcccuguugcuccucguggcccacuacgccaucaucggccccggccugcaagccaaggccacucgggaagcccagaagcguaccgccgccggaauaaugaagaaccccacggucgacggcaucacggugaucgaccuagagcccaucccguacgaccccaaguucgagaagcagcugggccaagugaugcuguugguccugugugugacccagguguuaaugaugcgcaccaccugggcucucugcgaagcccugacgcuugcaacaggccccauuucuacacucugggagggaaaccccggccgcuuuuggaacaccacgauugccguaagcauggcuaacaucuuccggggcagcuaccuggcuggggcgggccuauuguucaguauaaugaaaaacacaacaaacaccaggcgggggacggguaacaucggcgagacccugggggagaaguggaaaucccgucugaacgcccucggaaaguccgaguuccaaaucuacaaaaagucggggauccaagaggucgacaggacccuggcaaaggagggcaucaagcgcggugagaccgaucaccacgccgugucccgcggcagcgcuaaacuuaggugguuuguugagcggaacauggugacgccggagggaaaaguaguugaccuagggugcgggagaggagggugguccuacuacugcggagggcugaagaacgugcgggaggugaagggccugaccaaaggagggccagggcacgaggagcccauacccaugagcaccuacggauggaaccucguccgccugcaauccggcguggacgucuucuucacaccacccgagaagugcgacacguugcucugcgacaucggcgagagcagccccaacccuacgaucgaggccggccggacccuccguguccuaaacuugguggagaauuggcugaauaacaacacacaauuuugcgugaaggucuugaacccguacaugcccuccgugaucgagaaaauggaaacccuccagcggaaguacggaggcgcccuaguaagaaauccccugagcagaaacuccacgcacgagauguacugggucucaaaugcaaccgggaauauaguguccuccguuaacaugaucucccgcaugcucaucaaucgcuucaccaugaaacacaagaaggccaccuacgaaccggacguagaccucggaucaggaacccggaacauaggcaucgaaaacgagauccccaaucuggacaucauugggaaacggaucgagaagaucaagcaggagcacgagaccuccuggcacuacgaccaggaccacccuuacaagacgugggcguaccacgggagcuaugagacaaagcagacaggcuccgcuuccuccaugguaaacgguguaguuaagcuguugaccaagcccugggacgugguaccgauggucacccagauggccaugaccgacacgacccccuucggccaacagcgaguguucaaggagaagguugacacccgcacccaggagcccaaggaggggacgaagaagcuaaugcggaucaccgcagaguggcuguggaaggagcucgggaagaagaaaacaccccgcaugugcacccgggaggaguuuacgcgcaaaguccggagcaacgcagccuuaggcgccauauuuaccgacgagaacaaguggaagucagcccgcgaggccguggaggauagcagguuuugggagcuggucgaccgcgagagaaaccuccaccuggaggggaagugcgagaccugcguguacaauaugauggggaagagagagaagaagcugggggaguucgguaaggccaagggcucccgggcaaucugguacauguggcugggagcccgguuccuggaguucgaggcucugggcuuccucaacgaggaccacugguucagccgggggaacucccuguccggcguugagggggagggucuucacaagcuaggcuacauccugcgcgacgucaguaagaaggagggcggggcaauguacgcggaugacaccgccgggugggacacccggaucacccuggaagaccucaagaacgaggagaugguuaccaaucauaugaagggcgagcacaagaaacuugccgaggccaucuucaaguuaaccuaccagaacaagguuguccgcgugcagcgcccgacacccagggggaccgugauggacaucaucaguaggaaggaccagagaggcagcggucagguagggaccuacggacugaacaccuuuacgaacauggaggcccagcugauucgccagauggaaggggaaggaaucuucaaauccauccagcggcugacagugaccgaggagauagcggugcaaaacuggcucgccagagucggccgggagcgcuugucaaggauggccaucagcggcgacgacugcgucgucaagccccuggacgaccgcuuugccuccgcucucacagcuuuaaacgacaugggcaagguccgaaaggauauccagcaaugggagccgucccggggguggaacgacuggacccaaguaccauucugcagccaccacuuccacgaguuggugaugaaagacggacggguucucgugguucccugccgcaaccaggacgagcuaauuggucgagcccgcauaucccagggcgccggauggagcuugaaggagaccgcaugccucgguaaaaguuacgcgcaaauguggacgcuuauguauuuccaccggcgcgaccuccggcuugcggccaacgccaucugcagcgcgguccccucccauugggugcccacaucgcgcacaacgugguccauccacgccaagcacgaguggaugacaaccgaggauaugcuggcgguuuggaacagagucuggauccaggagaacccguggauggaagacaaaacacccgucgagagcugggaggaggugcccuaccugggcaagcgggaggaccaguggugugggucccucaucggccugacuagccgagcuacuugggccaagaacauccagaccgccaucaaucaggugcggagccugaucgggaaugaggaauacacggacuacaugcccuccaugaagcgcuuccggaaagaagaggaggaagccggggugcugugguga

SEQ ID NO: 25242 - RNA, 9876 nt, Artificial Sequence
  derived and/or modified CDS sequence (opt11) from DENV-2__EU687243__SS-prME
accgcgggugugaucaucaugcugauccccaccgcaauggcguuccacuugacaacccgcaauggggaaccucacaugaucgucggccggcaggagaaggggaagucccugcuguucaagaccgaggauggcgugaauaugugcaccuugauggcaauagaccugggggagcugugcgaggacacuaucaccuacaaaugccccuuacuucgccaaaacgagcccgaggacauugacugcuggugcaacagcaccagcaccugggugaccuaugggaccugcaccaccacgggugagcaccggcgcgagaagcgguccgucgcccuggugccccacguggggaugggcuuggagacccgcaccgagacuuggaugagcuccgaaggugcauggaagcacguucagcggaucgagacguggauacugcgccacccgggcuucaccaucauggcggccauccuggccuacaccaucgggaccacgcacuuccagcgggcccucaucuuuauccugcugaccgccguagcgcccucaaugaccaugcgcugcaucggcaucagcaaccgggacuucguggaaggcguuucggguggcuccuggguagacaucguguuggagcacgggagcugugucaccacgauggccaaaaacaagcccacccuggacuucgagcucaucaaaaccgaggcgaagcagcccgccacccuccgcaaguacugcauugaggccaagcugacaaacacaacaaccgagucccguugcccgacccagggcgagcccagccucaacgaggagcaagacaagcgguucaucugcaagcacuccaugguagaccggggcugggggaacggcuguggccuguucggcaagggcggaaucgugacuugcgcgauguucacgugcaagaagaacauggagggcaagguaguccugccggaaaaccuggaguauaccaucgugaucacgccccacuccggggaggagcacgccgucggcaaugacacgggcaagcacgguaaggagaucaaaaucacaccgcaguccagcaucaccgaggccgaacuaacaggguaugggacggugacgauggaaugcagcccccggaccggccuggacuuuaacgagaugguguuguugcagauggaggacaaggcuugguugguccaccgucagugguuccuggaccucccucugccguggcugcccggggccgacacacaggggagcaacuggauucaaaaagagacucuggugaccuucaagaacccccacgcgaagaagcaagauguggucgugcuggggucacaggaaggggccaugcacaccgcccugaccggagccacggagauacagaugagcagcggcaaccuccuguuuaccggucaccugaagugccgccuccggauggacaagcugcagcugaaggggaugucuuauucgaugugcaccggaaaguucaagaucgucaaagaaaucgccgagacgcagcacgggacuauagugauccgugugcaguacgagggcgacggcucccccugcaagauuccuuucgagaucauggaucucgagaaacgccacguccugggccgccugaucacugugaacccgaucgugaccgagaaggacagccccgucaacaucgaggcggaaccgcccuucggcgacuccuacaucaucaucgggguggagccgggccaguugaagcucaacugguucaagaaggggucguccaucggccagauguucgagaccacgaugcgcggcgccaagcggauggccauccugggcgacacagcaugggauuucggcagccucgggggcguuuucacauccaucggaaaggcgcuucaccaggucuucggcgcgaucuauggcgccgccuucagcggggugagcuggacaaugaagauccugaucggggugaucaucacguggaucggaaugaauagcagaagcaccagccugagugucucgcucguacuggucggcgucgugacccuguaccuaggggugaugguccaagccgacaccgggugcgugguauccuggaaaaacaaggaacuuaagugcggcucagggauuuuuauuacggauaacguacacaccuggaccgagcaguacaaauuccagccugagucccccagcaaacuggcgagcgcaauccagaaggcccacgaagaaggcaucugcgggauccgguccgugacccgccucgagaaccucauguggaaacagaucacgcccgaacugaaucacauucucagcgagaacgaggugaagcugaccaucaugaccggcgacauccggggaaucaugcaggccggcaagcgcagucugaggccgcagcccaccgaacuaaaguacucauggaagacuuggggcaaggccaagaugcuguccaccgaaagccacaaccagacguuccugaucgacgggcccgagaccgcggagugcccgaauacgaaccgcgcuuggaacucccucgaaguugaggacuauggcuucgggguguucagcaccaacaucuggcugaaacuucgggagaagcaggauguauucugcgacucgaaacucaugagcgcugccauuaaggacaaccgcgcgguccacgcggauaugggguacuggaucgaauccgcccugaacgacaccuggaagauggagaaggccagcuucauagagaucaaguccugccacuggccuaagagccacacucugugguccaauggcgugcucgagagcgagaugaucaucccuaagaacuucgccgggcccgugucccagcacaacuaccgucccggauaccacacccagacggccgggcccuggcaccugggcaagcuggagauggauuucgauuucugcgaggggaccaccguaguggugaccgaggacuguggcaaccggggacccagcuuacggacgaccaccgcgagcgggaagcugauaaccgagugguguugccguuccugcacacugcccccgcuucgguaccgcggggaggacgggugcugguacggcauggagauccgaccccugaaggagaaggaggagaaccuggucaacagccucgugaccgccggacacggccagaucgacaacuucucccugggcguccugggcauggccuuauuccuggaggagaugcugagaaccagagucggcaccaagcacgccaucuuauuaguggcagugagcuucgucacgcugauaaccgggaacaugucauucagggaccucggccgcgucauggugauggucggcgccaccaugaccgacgauaucgguaugggcguaacguaccuagcccugcucgcagccuucaaaguccggcccacguucgcggccgggcugcugcuacggaagcugaccagcaaagagcugaugauggccaccaucggcaucgcccuccugagccagagcacgauuccggagaccauacuggagcucacugaugcccuggcgcuggggaugaugguccucaaaaucgugcggaacauggagaaguaucagcucgccgugaccaucauggccaucucaugcgucccgaacgccgugauccugcagaacgccuggaaggugagcugcacaauccucgccgccguaucugugucaccgcuucugcugaccucuucgcagcagaaggccgauuggaucccucuggcccugaccaucaagggccucaaccccaccgcuaucuuccugacgacgcugucgcgcaccagcaaaaagcgauccuggccccuaaacgaggccguuauggcuguggggauggucagcauacuggccuccucacuguuaaagaaugacaucccgaugaccgggccgcuggucgccggaggguuacucacggugugcuacgugcugaccggccgaagcgcggaucuggagcucgagagagccgccgacgucaaaugggaagaucaggccgaaaucuccggaagcucacccauccugucuaucaccaucuccgaggauggcagcauguccauaaagaacgaggaggaagaacacacccugacaauccucaucagaaccggccugcugguaaucagcgggguuuucccugucucgaucccaaucaccgccgcggccugguaccucugggaggugaagaaacagcgcgccggggugcugugggacgugcccagcccgccgccaguugggaaagccgagcuggaggauggcgcauaccggaucaagcaacggggaaucuucgguuacucacagaucggcgcggggguauauaaggagggaaccuuccauaccauguggcacgucacgcgcggggccguacucaugcaccggggaaagcgcaucgagcccagcugggccgacgugaagaaagaccugaucuccuacgggggcgguuggaagcuggagggggaauggaaggagggcgaggaaguccaggugcucgcccuggagcccgggaagaacccgagggccgugcagaccaaacccgggcuguucaagaccaacacagggaccaucggcgcggucagccucgacuucuccccaggcaccagcgggucccccaucguggaccgcaaaggcaagguggucgggcuguacggcaacggcguggugacgcggagcggggccuaugucuccgccauugcccagaccgaaaaguccaucgaggacaacccggagauagaggacgacaucuuccgcaagaagcggcucaccaucauggacuugcaccccggcgcgggaaagaccaagagguaccugccggcaaucgugagggaggccaucaagcgcggccugcgcacccugaucuuggcaccgacacggguggucgccgcggagauggaggaggcccugcgcggccuccccauucgguaccagacgcccgcgauccgcgccgagcacaccggccgggagaucguagacuuaaugugccacgcuaccuucaccaugcgccugcugagccccgugcgggugcccaauuacaaccucaucauuauggacgaggcgcacuucacggaccccgccuccaucgccgcccgcggcuacaucagcacccggguggagaugggggaagccgcggggaucuucaugaccgccacaccgcccgggucucgcgacccguucccucagucgaaugcacccaucauggacgaggagcgggagauccccgagcgcuccuggaacagcggccacgagugggugacggacuucaaggggaagaccgucugguuuguuccgucaauaaaggcggguaacgacaucgcggcaugucugcggaaaaacggcaaaaagguuauccagcugucccgcaagaccuucgacuccgaguacgugaagacacgggccaacgacugggacuucguggugacgaccgacaucagcgagaugggggccaacuuccgcgccgagagggucauugacccucgccggugcaugaagcccguaauccucacggacggcgaggagcgcgugauccuggcggggccgaugccggucacccacuccucugccgcccaacgacggggccgcaucgggcggaaccccaagaacgagaaugaccaguacaucuacaugggcgagccccucgagaaugacgaagauugcgcgcacuggaaggaggccaagaugcuccuggacaacaucaacacgcccgagggcauuaucccguccauguucgagccagagcgcgagaagguggaugcgauagacggggaguaucggcugcggggcgaagcccgaaagaccuucgucgaccuaaugcgccgcggugaccugccggucuggcuggccuacagaguggccgcagagggcaucaauuacgcggaccggagguggugcuucgacgggaucaagaacaaccagauccuagaggagaacguggaggucgagauauggaccaaagagggagagagaaagaagcugaagccgcguuggcuggacgcccggaucuacagcgacccccucgcccugaaggaguuuaaggaguuugccgcggggcgcaaauccuugacccucaaccugaucacggagauggggaggcugcccacguucaugacccagaaggcgcgcgacgcccucgacaaucuggccgugcugcacaccgcggaggucggugggcgggcguacaaccacgcccucaacgagcugccugagacgcuggagacccuccugcugcucacccuguuggcaaccgucacgggcggaaucuuccucuuccugaugagcgggaaagggaucgggaagaugaccuuagguaugugcuguaucaucaccgcauccauccuccucugguaugcccagauccagccgcacuggaucgcggcgagcaucauccuggaguuuuuccucaucgugcugcugauccccgagcccgagaagcagcgcacgccccaggacaaccagcugacauacguggugaucgccauccugacagucgucgccgccaccauggcgaacgagaugggguuccuggagaagaccaaaaaggaccugggcuugggcucaaucacgacgcaggagucggaguccaacaucuuggacaucgaccuccggccggccuccgccuggacccuguacgcaguagcuaccacuuucgugacccccaugcugcgccacuccauugagaacuccagcgugaacgugucccucaccgcgaucgcgaaccaggccacagugcugauggggcugggucgcggguggccccuuagcaagauggacaucggcguuccccugcuggccaucggaugcuacagucaggugaaccccaucacccucacggccgcccugcuauugcugguggcccauuacgccauaaucggaccuggccugcaggccaaggcgacccgggaggcucagaagcgcaccgccgcggggaucaugaagaaccccacggucgacggcaucacgguuaucgaccucgagcccaucccguacgaccccaaguucgaaaagcaacugggccaggugaugcugcucguacugugcgugacccaagugcugaugaugcguaccacaugggcccucugcgaggcccugacgcuggcgaccggccccaucagcaccuugugggaggggaaccccggccgauucuggaacacgaccauugccguuuccauggcaaacaucuuccgggguucguaccuagcaggagcgggccuccucuuuucgaucaugaagaacaccaccaacacccgccgggggacgggcaacauaggcgaaacccugggggagaaguggaagucccggcuaaacgcacuuggcaaguccgaguuccagaucuacaagaaguccgggauacaggagguggaccggacccuggccaaggagggcaucaaacgcggggaaaccgaccaucacgccgugucgcgaggcucggcgaagcugcguugguuugucgaacggaacaugguuacgccggagggcaagguggucgaccucgggugcggccgcggcggcuggucguacuacugcgggggccugaagaacgugcgggaagugaaggggcugaccaaaggcgggcccggucacgaggaaccgauccccaugagcaccuauggcuggaaucucguccgccugcagucaggggucgacguguuuuucaccccgcccgagaagugcgacacgcugcucugcgacaucggagagagcagccccaaccccacuaucgaggccggccgcacccugcgcguccugaaccucguggaaaacuggcugaacaacaacacccaguucugcguaaagguccugaacccguacaugccuuccguuaucgagaagauggagacacuccagcggaaguacgggggcgcgcugguccgcaacccccugagcagaaacuccacgcacgagauguauugggucagcaaugccaccgggaacaucguguccagcgugaacaugaucucccggaugcugaucaaccguuucaccaugaagcacaagaaggccaccuacgagccggaugucgacuugggcagcgggacacggaauaucggcauugagaacgaaauccccaaccuggacaucauaggcaagcgcaucgaaaagaucaagcaagagcacgagaccuccuggcacuacgaccaggaucaccccuacaaaaccugggcuuaccacgggucuuacgagacgaagcaaacgggcagugccagcuccauggugaacggaguaguaaagcugcucaccaaaccgugggacgugguuccgauggucacgcagauggccaugaccgacacgacccccuucggccagcagcggguguucaaagaaaagguggacacccgcacacaagagccaaaagagggcacgaagaagcugaugagaauaaccgcugaauggcuguggaaggagcuugggaagaagaagacaccccguaugugcacccgggaggaguucacccgcaagguccggucgaaugccgcgcugggugccaucuucaccgaugagaauaaguggaaguccgcccgcgaggccguggaggacagccgguucugggagcuggucgacagggagcggaaccuccaucuggaagggaagugcgagaccugcguguacaacaugaugggcaagcgcgagaagaagcugggcgaguucggcaaagccaagggcucacgggcgaucugguacauguggcucggggcccgcuuccuggaguucgaggcccugggcuuccucaacgaggaccacugguucucgagggggaacucccugucuggcguggagggggaaggccugcacaaacucggcuacauccugcgcgacguuagcaagaaggagggcggggccauguacgcggacgacaccgccgggugggacacgcggauaaccuuggaggaccucaagaacgaagagaugguuaccaaccacaugaagggcgagcauaagaagcucgcggaggccaucuuuaagcugaccuaccagaacaaagucguccgcguacagcgcccgacgccccgggggaccgugauggacaucaucucccgcaaggaccagcgggggagcggucaggucgggacauacggccucaauaccuucacuaacauggaggcccaacugauccgccagauggagggggagggcauuuucaaguccauccagcggcugacggugaccgaagagaucgcggugcaaaacuggcuagcccgcgucggucgggagcgccugagccggauggccaucuccggggaugacugcguggugaagccccuggacgaucgcuuugcgagcgcccucaccgcgcugaaugacauggguaagguccggaaggacauucaacagugggaaccuucccgcggguggaacgacuggacccaggugccguucugcucucaccacuuccacgagcugguuaugaaggacggccggguccucguggugcccugccgcaaccaggaugagcugaucggccgggcgcgcaucucccagggagccggcuggagccugaaagagaccgccugccuggggaagucauacgcccagauguggacccugauguacuuccaccguagagaccugcgacucgcggccaacgccaucugcagcgcgguacccucccacugggugcccacaucacgcaccaccuggucuauccacgccaagcaugaguggaugacgacagaggauaugcuggcaguguggaaccgcgucuggauccaggagaacccguggauggaagacaagacucccguggagucaugggaggaggugcccuaccugggcaagcgggaggaccaguggugcgggucccucaucggacuuacgagccgcgccaccugggccaagaacauccagaccgccauuaaccagguccgaagccugauugggaacgaggaguacaccgacuacaugcccuccaugaagcgcuucaggaaggaggaggaggaggcgggcguguuaugguga

SEQ ID NO: 25243 - RNA, 9876 nt, Artificial Sequence
  derived and/or modified CDS sequence (opt11) from DENV-2__EU687245__SS-prME
accgccggagugaucauaaugcugauccccacagccauggcguuucauuugaccacccggaauggggagccccacaugauugucggccgucaggagaaggggaagucauuacuguucaagaccgaggacggggugaauaugugcacccucauggccauugaucugggggagcugugcgaggacaccauaaccuauaagugcccccuucugcgccaaaacgagcccgaggacaucgauugcuggugcaauaguaccagcaccugggugaccuacgggacauguaccacgacuggcgagcaccggcgcgagaagcgguccgucgcuuuaguaccccacguggggaugggucucgagacccggaccgagaccuggaugagcagcgagggggcuuggaagcacgugcagcggauugagaccuggauccugcgacauccgggcuucaccauuauggccgcuauacuggccuacacgaucgggaccacucacuuccagagggcccugauauucauacugcugaccgcgguggcgcccagcaugacgaugcgcugcaucggcauuucgaaccgagacuucguggagggcguaagcgggggcuccuggguggacaucgugcucgagcaugggagcugcgucacaacgauggcgaagaacaagcccacccuggacuucgagcucauaaagaccgaagccaagcagcccgcaacccuccguaaauacugcaucgaagcaaaacugacgaacaccacaaccgaaucccggugcccgacgcagggggagccaagccuaaacgaggagcaggauaagcgcuucaucugcaaacacucaaugguggaccggggcugggggaacggcugugggcuguuuggaaagggcggcaucgugaccugcgcuauguuuaccugcaagaagaacauggagggaaaggucgugcugcccgagaaccuggaguacaccaucguaaucacgccccacagcggggaggagcacgccgucggcaacgacaccgggaagcacggcaaggaaaucaagaucaccccgcaguccucuaucaccgaagccgagcucaccggguacggcaccgugacaauggagugcagccccaggaccggccuggacuuuaacgaaaugguacuacuccagauggaagauaaggccuggcugguccaucgucagugguuccucgaccucccccugcccuggcugccgggggcagacacacagggcagcaauuggauccagaaggaaacgcucgugacuuuuaaaaacccccacgcgaagaagcaggacguggucgugcucgggucccaagaaggcgccaugcacaccgcacugacaggggccacggaaauccagaugagcagcggcaaccuccuguucacuggacaccugaagugccgccuccggauggacaaacugcaguuaaaagggauguccuacucgaugugcaccggcaaguucaagaucgucaaggagaucgccgagacacagcaugggacgaucgugauccgcgugcaauacgagggcgacggcucccccugcaagauccccuucgagaucauggaccucgagaagcggcacguccuggggcgccugaucaccgugaacccgaucgugaccgagaaggacucaccagucaacaucgaggcggagccgcccuuuggugacuccuauaucaucaucgggguugagccggggcagcucaagcugaauugguucaaaaaggggagcaguaucggccagauguucgagaccacuaugcgcggcgccaagcguauggccauacugggugacaccgccugggacuucggcucacucgggggcguguucaccuccaucgggaaggcccugcaccaggucuucggcgccaucuacggcgccgcguucucggggguaaguuggaccaugaagauuuuaaucggcgugauuaucacuuggaucgggaugaacagccgcuccaccagccugagugucagccucgugcuggugggcgucgugacgcuguaccucgggguaauggugcaggccgauaccggcugcgugguguccuggaagaacaaggaguugaagugcggcagugggaucuucaucaccgacaacguccauaccuggaccgagcaguauaaguuccaacccgagucccccagcaaguuggccagcgccauccagaaagcccacgaagagggcaucugcgguauccgguccguaaccagacuagaaaaccucauguggaaacagaucacgcccgagcugaaucauaucuugucugagaacgaggugaagcugacuaucaugaccggcgacaucaaggggauuaugcaagccggcaaaaggucccugcgcccgcagcccaccgagcucaaguacagcuggaaaacguggggaaaggccaagaugcuguccaccgaaucccauaaccagaccuuccugaucgaugggcccgagaccgcggagugccccaacacgaaccgugccuggaacucucucgagguagaggacuacggcuuugggguguucaguaccaacauauggcugaaguugcgcgaaaagcaggacguguucugcgacuccaaauuaauguccgccgccauuaaggauaaucgggcgguccacgcugacaugggcuauuggauagagucggcccucaacgacaccuggaagauggagaaggccagcuucaucgaaaucaaguccugucauuggccgaagagccacacccuguggaguaacggcgugcucgaaagugagaugaucauacccaaaaauuucgcggggccugugucccaacacaacuaccgcccgggcuaccacacccagacggccgggcccuggcaucugggaaagcuggagauggacuucgacuucugcgaggggaccaccgugguggugaccgaggacugcggcaaccggggccccuccuuacgcacgacuacugcgucggggaagcugauuaccgagugguguugccgguccugcacgcugccuccucucagguaccggggcgaggacgggugcugguacggaauggagauccgcccuuugaaggagaaggaggagaacuuagucaauagccucgucacagccgggcacggccagaucgacaacuucucccugggcgugcucggaauggcucucuuucuggaagagaugcugcggacgagagucggcaccaagcacgcuauccuccugguggcggugagcuucgugacgcugaucaccgggaacauguccuuccgcgaccucgggcgcgugaugguaauggucggggccacgaugaccgacgauaucggcaugggcgugacguaccuggcgcugcucgccgccuucaaggugcgccccacuuucgcggccgggcuacugcugcgaaaacucaccagcaaggagcugaugauggccaccaucggaaucgcccuccugucccagucgacgaucccagagaccauccuggagcuuaccgacgccuuagcccugggcaugaugguccugaagaucguccgcaacauggaaaaguaccagcuggccguaaccaucauggcaaucuccugcguuccgaacgcugugauccuucagaaugcuuggaaggucagcugcacuauccuggcugccgucuccgugagcccacugcugcucaccuccagccagcagaaggccgacuggauaccccuagcauuaaccaucaagggccuaaaccccacggccaucuuucuaacuacccuguccagaacgagcaagaaacgcuccuggccgcucaacgaggccgucauggccgugggcauggugagcauccuggccuccagcuuacucaaaaacgacauccccaugacagggccccuggucgccggcgggcugcucacggugugcuacguuuugacuggccggagcgcggaucuggagcucgagcgcgcagccgacguaaagugggaggaccaggcugagaucagcgggucgagccccauacugagcauaaccaucucugaagacggcagcauguccaucaaaaacgaggaggaggagcacaccuuaacuauccucauccgaaccggccuuuuggugaucagcgggguguuccccgucuccauccccaucaccgccgcugccugguaccuaugggaggugaagaagcagagagccggcgugcugugggacguccccagcccgccccccguggggaaggccgagcuggaggacggcgccuaccgcaucaagcagagaggaauauucggcuacucucagaucggcgcgggagucuacaaggagggcaccuuccauaccauguggcacgucacacgcggugccgugcucaugcaccgcggcaaacggaucgaacccagcugggcugacguaaagaaagaccugaucucauacgggggaggcuggaagcuggagggggaauggaaggagggugaagagguccaggugcucgcucuggaacccgggaaaaaucccagggcagugcaaaccaagcccggccuguucaagaccaacaccgggacgaucggcgcggucagccuagacuucucgccgggcaccagcgggucccccauaguggaccggaagggcaagguggucgggcuguacgggaacgggguggugacgcgcagcggggccuacgucucggcaaucgcccagaccgaaaaguccauugaggacaacccagagaucgaagacgacaucuuucggaagaagaggcugacgaucauggaccuccacccaggcgcggggaagaccaaacgguaccugcccgccaucguacgcgaagccaucaagcgcggccugcgcacccugauccucgcuccgacccgugugguagccgcggagauggaggaggcccucagagggcuccccauccgcuaccagacaccagccaucagagcggagcauaccggccgcgagaucguggaccucaugugccacgccaccuuuaccaugcggcugcugucccccgugcgcguuccgaacuacaacuugaucaucauggacgaggcgcacuucacggauccggccuccaucgcugcccggggcuacaucagcaccagaguggagaugggugaggccgcgggcauuuucaugaccgccacucccccggggucccgggacccguucccccagagcaacgccccgaucauggaugaggagcgcgagauacccgagcgguccuggaacagcggccaugagugggugacggauuucaagggaaagacggucugguuuguuccgucaaucaaggcaggcaacgauaucgcugccugccuacgaaagaacggaaaaaaggugauccagcuuagccggaagaccuucgacuccgaguacgucaaaacccgcgccaacgacugggacuucguggugacgaccgacauuucagagaugggggccaacuuccgggcugagagaguaauagacccccggcgcugcaugaagcccgugauccucaccgacggcgaggaacggguaauacuggcggggcccaugccgguaacccacaguucagccgcgcagcgccguggccggaucgggcgcaaccccaagaacgagaacgaccaguacaucuacaugggcgagccucuggaaaacgacgaggauugcgcucacuggaaggaggccaaaaugcuucuggacaacaucaauacgcccgaggggauaauaccuuccauguucgagccagagcgggagaagguagaugcgaucgacggggaauaccgccuccggggcgaggcccgcaaaacguuuguggaucucaugcggcgcggcgacuuacccguauggcuggccuaccggguugccgccgaaggaaucaacuacgcugacagacgguggugcuucgauggcauaaagaacaaccagauccucgaggagaacguggaagucgaaaucuggacaaaggaaggcgagcgcaagaaguuaaagccacguuggcuggacgcccgaaucuauagcgaccccuuagcccugaaagaguucaaggaguucgcggcgggccguaaauccuugacacucaaccugaucacggaaauggggcgucugcccaccuucaugacccagaaagcccgggacgcgcucgacaaccuggccgugcugcacaccgccgaagucggugggcgugcuuacaaccacgcccucaaugagcugcccgaaacgcuggagacacugcugcugcucacccugcuggccaccgugacgggcggcaucuuccucuuccuuaugagcgggaagggcaucgggaagaugacccugggcaugugcugcaucauaaccgccuccauccuccugugguacgcccaaauccagccgcauuggaucgcagccagcaucauucuggaguucuuccucaucgugcugcuuauccccgagccagagaagcagcggacgccccaggauaaccagcugaccuacgucgugauugccauacuuacgguggucgccgccaccauggcgaacgagaugggcuuucuagaaaagaccaagaaggaucucggcuugggcucaaucaccacgcaggagagcgagucgaauaucuuggacauagaccucaggccagccuccgcuuggacacuguacgcaguggcgaccaccuucgugacccccaugcugcgacacucuauagagaacagcagcgucaacguaagccucaccgcgaucgccaaccaggccacaguccugauggggcuuggcaggggguggccuuuaagcaagauggauauaggcgucccccugcuggccaucgguugcuacucgcagguuaauccaauuacccucacggcggcccuacugcuacugguggcccauuacgcuaucaucggccccggguugcaggcaaaggcgaccagggaagcccagaagcgcaccgccgccgggaucaugaagaaccccacugucgaugguauuacggugaucgacuuggagcccaucccguacgaccccaaguucgagaagcaguuaggccaggugaugcugcucguucuuugcguuacccaggugcugaugaugcguaccaccugggcccucugugaggcgcugacucuggccacuggcccgauuuccacccucugggaggggaaccccggccgcuucuggaauaccacaaucgccgucuccauggccaacaucuuccgcggcucguaccuugccggggcgggccuccuguuuuccaucaugaagaacaccaccaacgcucggcgcgguaccggcaacauaggcgagacgcugggugagaaguggaagucccgguugaacgcccucggcaaauccgaguuccagauauacaagaaauccgggauccaggaaguggaccgcacacuagccaaagaaggcaucaagagaggggaaaccgaccaccacgcggugucacgggguagcgccaagcuccgcugguucgucgagcgcaacauggugacaccggagggcaagguggucgacuuaggcugcggccgcggaggguggucuuauuacugcggcgggcugaagaacguucgcgaagugaaggggcugacgaagggcgggcccggccacgaggaaccaauccccaugagcacuuacggcuggaaucuggugcggcugcaguccgggguggacguguucuuuaccccgcccgagaagugcgacacccuguuaugcgacaucggcgaaucaucgccgaaccccacaaucgaagccggcaggacucugcggguccugaaccuagucgagaauuggcuaaacaacaacacccaguucugcguaaagguccugaauccauacaugcccagcgugaucgagaagauggaaacccuccagcgcaaguacgggggcgccuugguucggaauccguuaagcagaaacuccacccaugagauguauugggugagcaacgccacagggaacaucgucucaagcguuaauaugaucucccgcaugcugauuaaccgguuuacgaugaagcacaagaaggcgacguacgagcccgacgucgaucucggcucagggacccguaacaucggcaucgaaaacgagauccccaaccuggacauaauuggcaagcggaucgaaaaaauaaagcaggagcacgagaccuccuggcauuacgaccaagaucaccccuacaaaacaugggccuaccacgggagcuacgaaaccaagcaaacuggguccgccagcuccauggugaacgggguggucaagcugcuaacaaagcccugggauguugugccgauggucacgcagauggcuaugaccgacaccacgcccuucggacagcagcgcguguucaaggaaaagguggacacccggacucaggagcccaaggaaggaaccaagaagcugaugcgcauaacagcggaguggcuuuggaaggaguuggggaagaagaaaaccccccggauguguacccgcgaggaguucacccgcaaaguccgaagcaacgcggcacugggcgccaucuucacggaugagaacaaguggaaguccgcccgggaggccguugaggacagccgguucugggagcuggucgaccgggaacgcaaccuccaccuggagggaaagugcgagaccuguguguauaacaugaugggcaagcgagagaagaaacugggugaguucggcaaggcaaagggcucccgcgccaucugguacaugugguugggggcccgauuccuggaguucgaggcccugggcuucuugaacgaagaccacugguucagccgcgggaacucccuaaguggcguggagggggaggguuuacacaaguuaggcuacauccugcgggacgucagcaagaaggagggcggggcuauguacgccgacgacacggccgggugggacacccgaauaacgcuggaggaccucaaaaacgaggagauggugaccaaccacaugaagggcgagcauaagaagcuggcggaggccaucuucaagcugacguaucagaauaagguagugcgggugcagaggccgacgucuagggggacggugauggacaucaucagucggaaggaccagagaggcuccggccaggucgggaccuauggccuaaacaccuucaccaacauggaggcccagcugauccgccagauggaaggggagggcaucuucaaaaguauccagcgccuuacggugaccgaggagaucgccgugcagaauuggcucgcccgggucggccgcgagcggcugucacgcauggcuaucucgggggacgacuguguggugaagccccuggacgaccgguucgccucagcgcucacggcccugaacgacauggggaaaguucgcaaagacauccagcagugggaaccaagcagaggguggaaugacuggacacaggugccuuucugcucccaccacuuccacgaacuggugaugaaggacggacgcgugcucgugguacccugucggaaccaggacgagcugaucggucgcgcccggaucagccagggcgccgguuggucccugaaagagacggccugccucggcaagagcuacgcgcagauguggacccugauguauuuucaccgccgggaucugcgacuggccgccaaugccaucugcuccgccgugcccagccacugggugcccaccagucggacgacauggagcauccacgcaaaacacgaauggaugacgacggaagauaugcuggccgucuggaaccgcgucuggauccaggaaaacccuuggauggaggacaaaaccccggucgaauccugggaggaggugcccuaccuaggcaagagagaggaucaguggugcggcucauugaucggacugaccagccgggccacgugggccaaaaacauacagaccgcggucaaccaggugcgcucccugaucgggaacgaggaguauaccgacuacaugcccagcaugaagcgguuccgcaaggaggaggaggaagcgggcguacuuugguga

SEQ ID NO: 25244 - RNA, 9873 nt, Artificial Sequence
  derived and/or modified CDS sequence (opt11) from DENV-2__HQ541798__SS-prME
accgccggcaugaucuucaugcugauccccaccguuauggcauuccaccucaccacccggaauggggagccccacaugaucgucagccggcaggagaagggcaagucgcuauuguucaagacaggggacggggugaacaugugcacccucauggcaauggauuuaggggagcuaugugaagauaccaucaccuacaagugcccccugcugcgacagaaugaaccugaagacaucgacuguuggugcaacagcaccaguaccugggugaccuauggaaccugcacgaccaccggcgaacacagacgcgagaaacggagugucgcccuggugccccacguggggaugggacucgaaacccgcaccgagaccuggauguccagcgagggggccuggaagcacgcacagcggaucgagaccuggauccuccgccacccgggcuucaccaucauggcugccauccuggccuacaccaucgggaccacccauuuccaacgcgcccucaucuuuauccuguugaccgccgucgcgccguccaugacaaugcgcugcaucggcaucucaaacagagacuuuguggagggcguguccgguggcagcugggucgauaucgugcucgagcacggguccugcgugaccacgauggccaaaaacaagcccacccuagacuucgagcuuaucaagacggaggcaaagcagagcgccacccuccguaaguacugcaucgaagccaaacugacgaacaccacgaccgagaguaggugccccacgcagggcgaaccgagccugaacgaggagcaggacaagcgguucgucugcaagcacuccaugguugauaggggcugggggaauggcugcggccuguucgguaagggggguaucgugaccugcgcgauguucacuugcaagaaagacaugaagggggaagucgugcagcccgagaaccuagaguauacaaucgugaucacgccacacucuggggaggaacaugccgucggaaacgacaccgggaagcauggaaaggagaucaaaaucacgccccaauccagcaucaccgaggcagagcugaccgguuacgggacggugaccauggagugcuccccgcgcacuggucucgacuucaacgaaauggugcugcugcagauggagaacaaagccuggcucguacaccggcagugguuccuggaucugccccuccccuggcuucccggggccgauacccagggcucuaacuggauacagaaggagacgcuggugacauucaagaauccccacgcgaagaagcaggacgugguggugcucggcagucaggaaggcgccaugcacacagcccugaccggggccacugagauccaaaugagcagcggcaaccuccucuuuaccggccaccucaagugccgccugcggauggacaaguuacagcugaagggcaugaguuauagcaugugcaccggcaaguucaaggucgugaaggagaucgccgagacccagcacgggaccaucguuauaagaguucaguacgagggcgacggcucccccugcaagauccccuucgagaucauggaccuggagaaacgccacgugcucgggcgccuaaucaccgugaaucccaucgucacagaaaaagacagcccuguuaauaucgaggcggagccgcccuuuggcgauucauacaucaucaucgggguggagcccggccagcugaagcucaauugguucaaaaaagggagcagcaucggccagaugcuggagacaacuaugagaggcgccaagcggauggcuauccugggggauaccgcuugggauuuuggcucgcucgggggcgucuucacuuccaucgggaaagccuugcaucagguguucggggcgauuuacggcgccgccuucuccgggguguccuggacaaugaagauccugaucggcguaaucauuacguggaucgggaugaacagccgcucgaccagccuguccgugagccucgugcuggugggcguggugaccuuguaccucggggugauggugcaggccgacuccgguugcguggucagcuggaagaacaaggagcugaagugugggagcgggaucuucauaacagacaacgugcacacguggaccgagcaguacaaguuucagccggagaguccguccaagcuagcgucagcuauccagaaggcccacgaggagggcaucugcgggauacguagcguuacccgccucgagaacuuaauguggaagcagauuacccccgagcugaaccacauccucuccgagaaugagguuaagcugacaaucaugaccggcgacaucaaggggaucaugcaggcuggcaagcggagccuucgcccccagccuaccgagcucaaguauuccuggaagaccuggggcaaggcuaagaugcuuaguacggaaucccacaaucagaccuuccuaauagacgggccugagacagcggagugcccuaacaccaaccgggccuggaacagccucgagguggaggacuacgguuucgggguguucacgaccaacaucuggcugaagcuacgcgagaagcaggaugucuucugugacuccaaguugaugagugccgccauuaaagacaaccgggccguacaugcggacaugggauacuggaucgaguccgccuugaaugacaccuggaaaaucgaaaaggccagcuucauugagguuaaguccugccacuggccgaagccccacacucuguggagcaacgagguccucgaguccgagaugauaaucccgaagaacuucgcgggcccugugagccagcacaauuaccgccccggcuaccacacucagaccgccggcccauggcaucugggaaagcuggagauggacuuugacuucugcgagggaacgaccguugucgugaccgaggacuguggaaaccggggccccagccuccgcacgaccacggcguccgguaagcugauuaccgaaugguguugucgcagcugcacguugcccccucuucgcuaccgcggugaggauggcuguugguacgggauggagaucaggccccugaaggaaaaggaggagaaccuggugaacucccucguaaccgccggacacgggcagauagacaauuucagccuaggcgugcugggaauggcacucuuccucgaagagaugcugcguacccgcguggggaccaagcacgccauccuccuagucgcuguguccuuugugacgcugaucacuggcaacaugucguuccgggacuuagggcgcgucauggugauggugggcgccacgaugaccgacgacaucgguaugggagucacguacuuggcucugcuggccgccuucaaggugcgccccaccuuugcggccggccuuuugcugcggaagcugaccuccaaggaguugaugaugaccacgauugggaucguguuacugagccaguccacgauccccgagaccauccuggagcucaccgacgcacuggcccuaggcaugauggugcucaagaugguucgcaagauggagaaauaccaguuagccgugacgaucauggcgauucugugugugccgaacgccgugauacuacagaacgccuggaaagucagcugcaccauccuggcggugguguccguuagcccgcuguuccucaccuccucucaacagaaagccgauuggaucccccuggcguugaccaucaaggggcucaaccccacggccaucuuccugaccacacugucccggacuaauaaaaagcgcagcuggccgcucaaugaggcgaucauggccguagguaugguguccauccuggccagcucgcugcucaaaaacgacaucccgaugacgggcccccuuguggccggagggcuccuuaccgugugcuacguguugaccggccggucagccgaccuggaguuagagcgcgccgcggacgucaagugggaggaccaagcggagauaagcggcuccagccccaucuuguccauuaccauuagcgaggacggcuccaugagcauaaaaaacgaggaagaagagcagacgcugacuauccucaucaggaccggccugcuggugaucuccggacucuucccggugagccugcccauaaccgccgccgccugguaccuuugggaggucaagaaacagagggcagggguacucugggauguucccagcccgccgcccgucgguaaagcggaacuugaggacggggccuaucgcauaaaacagaagggcauccuaggguacagccagaucggcgcaggcguguacaaggaggggaccuuccauacgauguggcacguuacucgcggagcuguccuaaugcacaagggaaagcggaucgagcccuccugggccgacguaaagaaggaccugaucucguauggcgggggauggaagcuggagggcgaguggaaagagggggaggaggugcagguccuugcgcuggaacccggaaagaacccccgcgccgugcagacuaaacccgggcuguucaaaaccaacgccggaacgaucggggccgugucgcucgauuucagccccggaaccucgggcagcccuaucaucgacaagaaggggaaggugguaggccuauacgggaauggcguggucacccgcucaggcgccuacguaagcgcgaucgcgcagacagagaagucuaucgaggacaaccccgaaaucgaggacgacauuuuccgcaagcggaagcugacgaucauggaccugcacccaggggccggcaagacgaaacgguaccugcccgccauaguccgggaggcgaucaagcgcgggcugagaacccugauccucgccccuacucgcgugguggccgccgaaauggaggaggcccuccgggggcugcccauccgcuaucagacgcccgcgauucgcgccgagcauaccgggcgggagaucgucgaccugaugugccacgccacuuucacaaugcgcuuacugagccccguccgggugccgaacuauaaccucaucauaauggacgaagcccacuucacggaucccgccucgaucgccgccagaggcuacaucuccaccaggguggagaugggcgaagcugcggggaucuucaugacagccacuccacccgguagccgcgacccguucccccaguccaacgcccccaucauggacgaggaacgggagauccccgaacguucauggucgagcgggcacgagugggucacggauuucaaggguaagaccgugugguuuguuccgucaaucaaggccgggaaugacaucgccgcaugccugcgcaagaacggcaagaaggucauccaacugagccggaaaaccuucgauuccgaguaugugaagacccggacgaacgacugggacuucguugucaccaccgacaucagcgaaaugggggcgaacuucaaggccgagcgcgugaucgaccccagaaggugcaugaagccggucauccucacugacggggaagagcgcguaauccuggcuggcccgaugccuguaacgcacucaucagcagcacagcggcgggggcgcauaggacgcaaccccaagaacgagaaugaucaguacaucuacaugggagagccgcuggagaacgaugaggacugcgcccacuggaaggaagccaagaugcuccuggacaauaucaauaccccggaggguaucaucccgucgauguucgagcccgagcgggagaaaguggacgccaucgauggcgaguaccgccugcgcggggaggcccgcaagaccuucgucgaccuaaugagacguggagaccugcccguguggcuggcguaccgaguggcggccgaggggaucaacuacgccgaccgccguuggugcuucgacggcaucaagaauaaccagauccucgaggaaaauguagagguggagaucuggaccaaggagggggagcgcaaaaaacugaagccgcgguggcuugacgcacgcaucuacucagacccccucgcccugaaggaguucaaggaauuugcggcuggaagaaaaucucugacccuaucgcuuauuaccgagaugggccgccuaccaaccuucaugacccagaaagcccgggacgcccuugacaaucuggcuguccugcacacagccgaggccgggggccgcgccuacaaccacgcacuuuccgagcucccugagacccuagaaacguuauuacugcucaccuuacuggcgaccgugaccgggggaauuuuccuuuucuugaugagcggcagaggaaucggcaagaugacccuggggaugugcugcauuaucacagccuccaucuuguuaugguacgcccaaauacagccgcauuggaucgccgccagcauuauccuggaguucuuccuaaucguccugcugauucccgaacccgagaagcagcgcaccccccaggacaaccagcucacuuaugucgugaucgcuaucuuaaccgucguugccgccacuauggcuaaugaaaugggcuuccuagaaaagaccaagaaggaccuuggacugggcagcaucacgacccagcagccggaguccaacauucuggacaucgauuuacggcccgccagcgcauggaccuuguacgccgucgccacaaccuucgugacccccaugcugaggcauuccaucgagaacagcuccgucaacguuagccuaacggccauagccaaccaagcgaccgugcugaugggccuggggaaaggcuggccgcugucaaaaauggauauuggagucccgcugcuggccauuggaugcuacagccaggugaaccccauaacccuuaccgccgcccuguuucugcucguggcgcacuacgccaucaucgggccaggacuacaggccaaggcuacccgugaggcccagaaaagggccgccgcaggcauuaugaagaacccgaccgucgacgguauaacggugaucgaccuggauccgauccccuaugaucccaaauucgagaagcagcucggccagguaaugcugcugguccucugcgugacccaaguacugaugaugcguaccacgugggcucuuugugaggcccuaacgcucgcgacagggccuauuucuacacugugggagggcaacccggggcgcuucuggaacacaacgauagccgucagcauggccaacauauuccgcggcucuuaccucgcaggcgccgggcugcuauuuagcaucaugaaaaacaccaccaacacccggcgcggaacggggaacaucggcgaaacacucggggagaaguggaaaucccgacuuaaugcguuggggaaguccgaguuccagaucuacaagaaguccggcauccaggagguggaccgcacucuugccaaggaagggauaaagcggggcgagaccgaccaccacgccgugucucgcggauccgccaagcugcggugguucgucgaacgcaacauggugacgccagagggcaagguggucgacuuaggcugcgggcgggggggguggucauacuacugcggcgggcugaagaacgugcgcgaggugaaagggcugacgaagggcgggcccggccacgaagaacccaucccuauguccacauacggguggaaccugguccgguuacaguccggcguggauguguucuuuacgccucccgagaaaugugacacccugcugugcgacaucggggagagcuccccgaacccgaccguagaggcaggccggacccuucgugugcugaaccugguggagaauuggcucaauaacaacacucaauucugcaucaaaguucugaacccuuacaugccaagcgugaucgagaagauggaggcccugcagcgcaaguacgggggggcacuggugagaaacccgcucuccaggaacagcacccacgagauguacugggucucuaaugccagcggcaacauaguguccagcgugaacaugauaucacgaaugcugaucaacagauucacgaugcgccacaagaaggccacuuacgagcccgacguagaucuggggagcggcacccgcaauaucgggaucgaguccgaaaucccgaaccucgacaucauaggcaagcgaauuaagauuaaacaggagcaugagaccagcuggcacuaugaccaagaucaccccuacaagaccugggcguaccacggguccuacgagaccaagcagaccgggagcgccucaagcaugguuaacggcgugguacggcugcuuaccaagccgugggacgucgugccaauggucacacagauggccaugacggacaccaccccuuucggccagcagcgcgucuucaaggagaagguggacacgcggacucaagagccgaaggaaggcacuaagaaacucaugaagauaaccgccgaauggcuguggaaggaguugggcaagaagaagacgccucgcauguguacccgggaggaguucacccgcaagguacggucaaacgccgcgcucggggcaauuuucaccgacgagaacaaguggaaaagugcucgcgaagccguggaggauagcagguucugggagcuggucgauaaggagcgcaaccuccaccucgagggaaaaugcgaaaccuguguuuacaacaugauggggaagagggaaaagaagcucggcgaguucggcaaggccaaagguagccgggcgaucugguacauguggcugggcgcgcgguuccucgaguucgaggcccuugguuuccugaacgaggaccacugguucucacgcgagaacucccucagcggcguggagggcgaaggccugcauaagcuuggguacauacuccgggacgucagcaagaaggaagggggugccauguacgcggacgacaccgcagggugggacacgcgcaucacccuggaggacuuaaagaacgaggaaauggugacuaaccauauggagggcgagcauaagaagcucgccgaggccauauucaagcucacauaccaaaacaagguggugcgggugcagcgccccaccccccgggggaccgugauggacaucaucucccgccgggaccagcgcggcuccggacaggucggaacguacggccugaacacauucaccaacauggaagcccaguugauccgccaaauggaaggggagggcguguuuaagagcauccagcaccugaccgucacagaggagauagcgguccagaauuggcuggcgcggguagggcgcgagcggcuuagucgcauggccaucagcggcgacgacugugucgucaagccucuggaugaccgguucgcaucggcccugacggcgcuuaaugauaugggaaaggugcgcaaggacauccagcagugggaaccgagccgaggguggaaugacuggacccaggugcccuuuugcucacaccacuuccaugagcucauuaugaaggacggccgcguccuagugguuccgugccguaaccaggaugagcucaucgggcgcgccagaaucagccagggcgccgggugguccuuacgcgagaccgccugcuugggcaagagcuacgcccagauguggucccucauguacuuccaucggagggaccugcggcuagcagccaaugccaucugcagcgccgucccaucgcacugggugcccacgagccgcaccaccuggucuauccacgcgaagcaugaguggaugaccgcggaggauaugcucacgguguggaaccgggucuggauucaggagaacccguggauggaggauaagacgcccguggaauccugggaggagauucccuaccuagggaagcgcgaggaccaguggugcgggagccugaucggcuugaccuccagggccaccugggccaagaacauccagaccgccaucaaccaggugcgcagucugaucgggaacgaggaguacacggacuacaugccguccaugaagcgcuuccgucgcgaagaggaagaggcggggguccuaugguga

SEQ ID NO: 25245 - RNA, 9876 nt, Artificial Sequence
  derived and/or modified CDS sequence (opt11) from DENV-2__JF730053__SS-prME
accgccggcaugauuaucaugcugaucccuacugugauggcuuuccacuugaccacccgaaacggggagccccauaugauugucaguagacaagagaagggcaagagccugcuguucaaaacgggggacggcgucaauaugugcacucuaauggcuauggaccugggagagcugugcgaggauaccaucaccuauaagugcccgcuccuuaggcagaacgagcccgaggauaucgacuguugguguaauucuaccuccacgugggugaccuacgggaccuguacuacgaccggcgaacaccggcgggagaagcgguccgucgcucuggucccccauguggggaugggccuagagacucgcaccgaaacguggaugucaagcgagggggccuggaagcacgcccagcgaaucgaaacuuggauucugcgccaucccggcuucaccauaauggcugcgauucuggccuauaccaucgggaccacgcacuuucaacgggcccugaucuucaucuugcuuaccgccgucgcaccgucaaugaccaugcgguguaucggaaucagcaaccgggauuucguggagggcgucucggggggcagcugggucgacaucgugcuggaacacggguccugcgugaccacgauggccaagaacaagcccacgcuggauuucgaauuaaucaaaaccgaggccaagcaaucagcaacccuccgcaaguauuguauagaggcuaagcugacgaacaccaccacagagucccgaugccccacacagggcgaaccgagccugaaugaggagcaggacaagcguuuugucugcaagcacuccaugguagaccggggcugggggaacggauguggccuauuuggcaagggcgggauagugaccugcgccauguucacgugcaagaagaacaugaagggcaagguaguccagccggagaaccuggaauacacaauuguuaucacuccccacagcggcgaagagcaugcaguaggcaacgauaccgggaagcacggcaaggaaauuaaaaucacaccucaguccagcaucaccgaggccgagcuuacgggcuacggcacgguaacaauggaguguuccccacgcaccggucucgauuucaaugaaauggugcugcugcagauggagaacaaggcguggcucguacaccggcagugguuccuagaccugccacuccccuggcugcccggcgcugacacccagggcucgaacuggauacagaaggagaccuuggugacauuuaaaaacccucacgcgaagaagcaggacgugguaguacucgggucacaagagggcgccaugcacaccgccuugacuggggccacggagauucagaugucuagugguaacuugcucuucacagggcaccugaagugucgccugcggauggacaaacuccagcugaaggguauguccuauuccaugugcacuggcaaauucaagguggucaaggaaaucgccgagacccagcacgggacgaucgugauccggguccaguaugagggcgacgguucgcccuguaagauccccuuugaaaucauggacuuagaaaagcggcacgugcucgggcgccugauuaccgucaaccccaucgucaccgagaaggauagcccggugaacaucgaagcagagccgccguucggcgacagcuauauaaucauuggcguggaacccgggcagcugaaacuuaacugguucaagaaggggagcucuaucggacagaugcuggagacuacgaugcgaggcgccaagaggauggccauccucggggacacugccugggacuucggcucucuagggggaguuuuuacauccaucggaaaggcgcugcaccagguuuucggcgccaucuacggcgccgcuuucagcgggguguccuggacgaugaagaucuuaaucggggucaucauuacguggauagggaugaacucgagaucaacuagccuguccgugagccucgugcuggucggcguagugaccuuguauuugggggucaugguccaggccgacuccggcugcguggucucuuggaagaacaaagaguuaaagugcgggagcggcauauuuauaacugacaaugugcacacauggacggagcaguacaaguuccagccggagucccccagcaaacuagcgucggccauccagaaggcacacgaggagggaaucugcgggauuaggagcguaacccgccuagagaacuugauguggaagcaaauaacgcccgaacugaaucacauccucuccgagaaugaggugaaacugacaauuaugacuggagacaucaaggggaucaugcaggcuggcaagcgcagccuccggccacaacccaccgaguuaaaguacaguuggaaaacauggggcaaggcaaagaugcugagcacggagagucacaaccaaaccuucuugaucgaugggcccgagacagcagagugucccaacaccaaccgugcguggaacagccucgaaguggaggacuauggcuucggcguauucaccacgaacauuuggcugaagcugcgggaaaaacaagacgucuucugugacuccaaguuaaugagcgcagccaucaaggacaaccgggccgugcacgcggacauggguuacuggaucgaaagugcccuaaacgacacauggaagauagagaaggcuagcuuuauugaggugaagucgugccacuggccgaaaagccauacccugugguccaacgagguccucgagagcgaaaugaucauuccgaagaacuucgccggccccgugucgcagcacaacuacaggcccggauaccacacacaaacggcaggccccuggcacuuagggaaguuggagauggacuucgacuucugcgagggcaccacaguuguagugaccgaggacugcgggaaucguggacccucccucagaacgaccacugcaucugggaaacugaucaccgaguggugcugucggucuugcacgcugccuccccuccguuaccgcggcgaggacggcuguugguacgguauggaaaucaggccgcugaaggagaaggaggagaaccuugugaacucccucgugaccgcugggcacgggcagaucgacaacuucucccugggcguacucggcauggcccuauuuuuggaggagauguugagaaccagggucgggacaaaacacgccauacucuuggucgcgguaucauucgugacucugaucacagggaacauguccuuucgggaucuugggcgcgucaugguaaugguuggggccaccaugaccgacgacauugggaugggggucaccuaccuggcacuucuugccgccuuuaaagucagaccuaccuuugcggccggacugcuccuccggaaacugaccucaaaggagcucaugaugaccacuaucggcaucgugcugcuuucccaaagcaccauccccgaaaccauccuggaacucacggacgcacuggcccugggcaugaugguccugaagauggugcgaaaaauggagaaguaccagcucgccguaaccaucauggccauauuaugcgugcccaacgcggugaucuuacagaacgccuggaaggucuccugcaccauccuugccgugguuagcgucagcccucuguuccucaccagcucucagcaaaaagccgauuggaucccccuugcccugaccauuaaggggcucaaucccacggcuauuuuccugacgacccuuucccggacuaacaagaagagaucuuggccccucaaugaggccauaauggcggugggcaugguuucaauccuagcgucgaguuuacucaagaacgacaucccgaugacgggcccacuggucgccgggggauuacucaccguguguuacguccugaccgggcgguccgccgaccuugaacucgaacgggccgcagauguaaagugggaagaccaggccgaaaucucugggagcucucccauauugagcauaacaaucagcgaggauggaucaauguccauuaagaacgaggaagaagagcagacgcugaccauuuuaauccgaacgggccugcuugugaucagcggccucuuuccuguaucccugcccaucacagccgccgccugguaucucugggagguuaagaagcagcgcgcugguguauugugggacgugcccucaccgccgcccguuggcaaggcggaacuagaagacggggcguaccggaucaagcagaaaggcauccugggguauucccagaucggagcuggcguuuacaaggaagggaccuuccacacuauguggcacgucacccgcggugcugugcucaugcacaaggggaagaggaucgaaccaucaugggccgacgugaagaaggaccucaucucauacggugguggcuggaaacuggagggcgaauggaaagagggagaggaggugcagguacuagcgcuggagcccggcaaaaauccgcgcgccgugcaaacaaagcccgggcuuuuuaaaaccaacgcggggacgaucggagccguaagccuagacuuuucgccuggcacgagcgggucccccaucaucgauaaaaaggggaaggugguggggcuauacgggaacggcguggucacucgaagcggcgccuacguguccgcgaucgcucagacugaaaaguccaucgaagacaauccagagaucgaagaugacaucuuccguaagagaaaguuaaccauaauggacuugcauccuggcgccgguaagaccaaaagauaccucccagcaaucgugcgggaggccaucaagcgugggcuacggacccuuauucuugcccccacccgugucgucgccgccgaaauggaagaggcccugcggggccuucccauccgcuaccaaacucccgccauccgcgcagagcacaccgggagggagaucguagaccucaugugccaugcaacauucaccaugcgcuugcugucgcccguccgagugcccaacuauaaccuaaucaucauggaugaggcccacuucacggacccggccuccaucgcggcccgcggcuacauaagcacccguguggagaugggcgaggccgccgggaucuucaugaccgcuacgccgccaggcuccagggaccccuucccgcagagcaacgcgcccaucauggacgaggagcgagagaucccagaacgcucuugguccuccgggcacgagugggucacagauuuuaagggcaaaacggucugguucguuccgagcaucaaggcagggaaugauaucgccgcuugccugcggaagaacgggaagaaggucauccagcugucccggaagaccuucgacuccgaguacguuaagaccaggaccaacgacugggacuucguggugacaaccgauaucuccgaaaugggcgcgaacuuuaaggccgaacgcgugaucgacccucggagaugcaugaagccaguuaucuugaccgacggggaggagcggguuauacuggccggacccaugccggugacgcacucguccgcugcccagaggcgcggccgcaucgggagaaacccgaaaaacgagaacgaccaguacauauacaugggagagccccucgagaacgacgaggacugugcgcauuggaaagaagccaagaugcucuuggacaacaucaacaccccggagggcaucauaccuagcauguucgagccggagcgcgagaagguggacgcuaucgacggugaguaccgccuucgcggcgaggcucggaaaaccuucgucgauuuaaugcggcgcggcgacuugcccguguggcuggccuaucggguggcggccgaagguauaaauuacgccgaccgcagauggugcuucgacggcauuaagaacaaccagaucuuagaggagaacguugagguggaaaucuggaccaaggagggggagcggaagaaacugaagccccgguggcuggacgcccgcauuuacuccgacccacuugcuuugaaggaguucaaggaguucgcagcuggccggaagagucugacgcucagucugaucacggagaugggccgcuugcccacuuucaugacccagaaggcccgugacgcccucgacaacuuagcgguccugcacacggccgaggccgggggucgugccuacaaucacgcccuuagugaacugcccgagacccucgaaacccuucugcuccucaccuuguuagcgacggugacugggggcaucuuccucuuccugauguccgggcggggcaucggaaagaugacccugggcauguguugcauuauaacggcaagcaucuuauuaugguacgcccaaauccagccccacuggaucgcagcaucuaucaucuuggaguucuuucucaucgugcuguuaaucccggagccggaaaagcagcgcaccccccaggacaaccaguugacuuacgucguuauugcgauccugaccgugguagcagccaccauggccaacgaaaugggcuuccuggagaagacgaaaaaagaccucgggcugggcuccaucaccacccagcagccagagaguaacauacuagacaucgaccuccggccggccuccgccuggacguuguaugccguggcgaccacuuuugugacccccaugcugcgccauagcauagagaacuccagcguuaaugucucccucaccgccaucgcuaaccaggcgacuguucuuaugggccuagggaagggcuggccccucucgaagauggacauuggaguccccuuauuagccaucggaugcuauucccaggugaauccaauuacgcucacggccgcccucuuccugcucguggcgcacuacgccaucauaggacccggcuuacaggccaaggccacccgggaggcccagaagcgcgcggcggccgggaucaugaagaacccaaccgucgacggaaucaccgugaucgaccuagaccccaucccguacgacccaaaauucgagaagcaacucggccaagugaugcuucugguccucugcgucacacaggugcuaaugaugagaaccaccugggcgcugugugaggcucucacccuggcgacggggccaaucagcacucuaugggagggcaacccaggacgcuucuggaauaccacuaucgcugucucgauggccaacaucuuccgcgggagcuauuuagcaggugccgggcugcuguuuuccaucaugaagaauacaaccaacaccagacgaggaacggggaacauaggcgagacauugggcgagaaguggaagucccggcugaaugcgcuggggaaguccgaguuucagaucuacaaaaaguccggaauccaggagguagaccgcacccuagccaaggagggaaucaaacgaggagagaccgaccaccacgccguuucccgggggucggccaagcugaggugguucguugaacgcaacaugguaacgccggagggcaagguggucgaccuaggcugugggcgaggcgguuggucuuacuauuguggaggacucaagaacguccgcgagguaaaagggcugacaaaaggcgggcccggccacgaagagcccauccccaugagcacuuacggguggaaccugguccggcuccagagcgguguggacguauucuucaccccgcccgagaagugcgacacacuccuuugcgauauaggugaauccagucccaaccccacugucgaagcggggcgcacgcuuagggugcuaaauuugguggagaacuggcuaaacaacaacacccaguuuugcauaaagguccugaauccguacaugcccuccgugaucgagaagauggaggcccugcaacgcaaguacggcggggcccugguccggaacccccucucucgcaacucgacccacgagauguacugggucaguaaugccucgggcaacauagugagcuccguaaauaugaucagcagaaugcugauuaaccguuucacgaugcggcacaaaaaggccaccuacgaaccggacgucgauuugggguccggcacccgcaauaucggcauagagagcgaaauuccuaaccucgacauaaucggcaagcguaucgagaagaucaaacaggagcacgagaccucguggcacuacgaccaggaucaccccuacaaaacgugggcguaccacggcagcuaugagaccaagcagacggggucugccagcagcauggugaauggcgucguccggcuguuaaccaagcccugggauguggugccgauggucacgcagauggcgaugaccgacaccacccccuuuggacagcagcgcguguucaaggaaaagguggacacgcgaacacaggagcccaaggagggcaccaaaaaacucaugaagauaaccgccgaguggcuguggaaagaacugggcaagaagaagacacccaggaugugcaccagagaggaguucacgcgaaaaguaaggucuaacgcggcguugggggccauuuuuacugacgaaaacaaguggaagucggcccgagaggcgguagaggauucaagguucugggagcugguagacaaagagagaaaccugcaucucgagggcaagugugagacguguguguacaacaugaugggaaagcgggagaagaagcugggcgaauuugggaaggccaaggguagccgcgcgaucugguauauguggcugggcgccagguuccuagaguucgaggcccugggguuucugaacgaggaccacugguucucccgcgagaacagccucucaggcguggagggugagggucuucacaaauuaggguauauuuuacgggacgucagcaagaaggaggguggcgccauguacgcggaugacacugcagggugggacacacgaaucacccuugaagacuuaaagaacgaagagauggugacgaaccacauggagggagaacacaagaagcucgccgaggccaucuucaaacugacuuaccagaacaaggugguccgggugcagcguccgacaccgcgggguaccguaauggauaucaucucgcgucgugaucaacgcgguagcgggcaagucggcaccuacggguugaacacauuuaccaacauggaggcccaacucauccgccagauggaaggcgagggcguauucaaguccauacagcaccugacggucacagaggaaauagcggugcagaacuggcuagcccggguggggcgcgagagacucagccgcauggccauuaguggcgacgacugcguggucaaacccuuggacgaccgguucgccagcgcccugaccgcacucaaugacaugggcaagguccgcaaggacauccaacaaugggaacccucccgggguuggaacgacuggacacaagugcccuucugcagucaucacuuccacgagcugaucaugaaggacgggcggguccuuguggugccuugccguaaccaagacgaguuaaucgggcgcgcccggauaucccagggcgccggguggagccugcgcgagaccgccugccugggcaagucauacgcucagauguggagcuugauguauuuucacaggcgcgaccugcggcuagcagccaacgcgaucugcuccgccgucccgagccacuggguucccacgucgcggacgaccuggucaauacacgcuaaacacgaauggaugacggccgaggacaugcuuaccguguggaauagggucuggauucaggagaacccguggauggaagauaagacgcccguggaaagcugggaggagauccccuaucugggaaagcgcgaagaccaguggugcgggucccugauuggacucacuucccgggccaccugggccaagaacauccaaaccgcgaucaaccagguccggucccugaucgggaacgaagaguacacggacuacaugcccagcaugaagcgcuuucgucgcgaagaagaggaggcgggcguuuuaugguga

SEQ ID NO: 25246 - RNA, 9876 nt, Artificial Sequence
  derived and/or modified CDS sequence (opt11) from DENV-2__EU529706__SS-prME
accgcaggcgugauuauaaugcugauccccacagccauggccuuccaccucacuacccgcaacggggagccgcacaugauuguaggcagacaggagaaggguaagucccuucuguucaagaccgaggacggcgugaauaugugcacccucauggcuaucgaucugggugagcugugcgaggacaccaucaccuauaagugcccucuccugcggcagaacgagcccgaggacauugauugcuggugcaacagcaccagcaccugggugaccuaugggaccugcaccaccacaggcgagcacagacgggagaaacguucagucgcccuggugccccacguggggaugggacuagagacccgcaccgagaccuggaugagcagugagggggcauggaagcacguucaacguaucgagaccuggaucuugagacacccgggcuucacgaucauggcagcgauccuagccuacaccaucggaaccacccacuuccagagggcccucaucuucauucuccucaccgccguggcgcccagcaugaccaugagaugcaucggcaucuccaaccgggacuucguggaaggcgugagcgggggcuccuggguggacaucguucucgagcacgggagcugugucacaacgauggccaagaauaagcccacccuggacuuugagcugauaaagaccgaagcaaagcaacccgccacccuccggaaguauugcaucgaggcgaagcuaacaaacacaaccaccgagucccggugucccacgcagggcgagcccagccugaacgaggagcaggacaagagauucaucugcaagcacuccaugguggacagaggcuggggcaacggcugcgggcuguuuggcaagggaggcauaguuaccugugcgauguucacgugcaaaaagaauauggaggggaaggucgugcagcccgagaaccuggaguacaccauagugaucacaccgcacagcggagaggagcacgccgucggcaacgacaccgggaagcacggaaaagagaucaagauuaccccgcaguccagcaucacugaggccgagcuaacuggguauggcacgguuaccauggaaugcaguccacggaccggccucgauuucaacgagauggugcugcugcagauggaggacaaggccuggcucguccacaggcagugguuccuggaccuuccauugccauggcugccgggggcggacacccagggcagcaacuggauucagaaggagacgcuggugacguucaagaacccacaugcgaaaaagcaggauguagucgugcucgggagucaagaaggggccaugcacaccgcccuaacgggggccacagagauccaaaugagcaguggaaacuuacuguuuaccggccaccugaagugcagacugcggauggauaagcugcagcugaaggggauguccuacagcaugugcaccggcaaauucaaaauugucaaggaaaucgccgagacccagcacgggacgaucguuauucgcguucaguaugagggugacgguucccccugcaagaucccuuucgagauaauggaccuggagaagcggcacgucuuagggcgccugaucaccgugaacccaaucguuaccgaaaaggauucacccguuaacauagaggccgaaccgcccuucggcgacucuuacaucaucaucggcguggagcccggccagcugaaacucaacugguucaagaaggggagcuccaucggccagauguucgagaccacgaugcgcggcgccaagcggauggcaauucugggggacaccgccugggacuucggcucucuaggcgggguauucacguccaucgggaaggcacugcaccaggucuucggggcgaucuacggcgccgccuucagcggggucuccuggaccaugaaaauccugauuggcgugaucauuacguggauuggaaugaacagcagauccaccagccuguccgugagcuuagugcucgugggcgucgugacgcuguaucuuggggugaugguccaggccgacaccggcugugugguguccuggaagaauaaggagcucaagugcggcagcgggaucuuuauaacggacaauguccacaccuggaccgagcaguacaaauuccagcccgagucccccagcaaguuggcuucagccauccagaaggcccaugaggagggcauuugugggauacgauccgugaccagacuggagaaccugauguggaagcagaucacgccagaacuaaaccacauucuuagcgagaacgaaguuaagcucaccaucaugaccggcgacaucaaggggaucaugcaagccggcaaaaggucccuucguccgcagcccaccgagcuuaaauacucauggaagacguggggcaaggcaaagaugcucuccaccgagagccacaaccaaaccuucuuaauugaugggcccgagacggcggagugcccgaacacgaaccgggccuggaauucccuggaggucgaggacuacggguucgggguguucucuacaaacaucuggcuuaaacugcgugagaagcaggauguguucugcgacucuaaguugaugagcgcggccaucaaggauaaccgugccguccacgcggauauggguuacuggauugaguccgcgcucaacgacacguggaaaauggagaaggccucguucauagaaaucaaaucaugccacuggcccaagagccauaccuuaugguccaauggcgugcuggagagcgagaugauuauccccaagaacuuugccgggcccgugucccagcacaauuaucgcccuggcuaccacacccagaccgcggggcccuggcaccucgguaagcuggagauggacuucgaucugugcgagggaacuaccguaguggugaccgaggacuguggcaacagggggcccuccuuacgcacgaccaccgccagcgggaagcugaucaccgaauggugcugccgauccugcacgcugcccccgcuccgcuacagaggcgaggacggguguugguauggaauggagauccgcccgcugaaagagaaggaggagaaccuggucaacucacucguuaccgcagggcauggccagauagacaacuucucccucggcgucuuagggauggcacucuuccucgaggagaugcugcgaacccgcauagggaccaagcacgcaauccucuuggucgcggugaguuucgugacucugaucaccgggaacauguccuuccgggaucucggccgcgucauggugauggugggugccaccaugaccgacgacaucggcaugggugucacguaccuggcacugcucgcugccuuuaaagugcggcccaccuuugcggcugggcugcuccuccggaagcugaccucgaaggagcugaugauggccaccaucgggaucgcguuacucagccagagcacgauucccgagacuauccuggaacuaaccgacgcccuggcgcucgggaugaugguucucaagauaguucgcaacauggagaaguaccagcuggcgguuaccaucauggccauauccugcgucccgaacgccguaauacugcagaacgcauggaaggugucuugcacgauauuagcagccguguccguuagcccucuucuccugaccucaucucaacagaaagccgacuggaucccucuggccuuaaccaucaagggcuuaaaccccaccgcaaucuuccugacgacccugucccggacgagcaagaagcgcucuuggccacucaacgaagccgugauggccguaggcauggucucaaucuuggccucgagccuguuaaagaacgacauccccaugaccgggccucugguggccggcggguuacucacggugugcuacguacugaccgggcggagcgcagaucuggagcuggagcgcgccgccgacgugaagugggaggaccaggcugagauuuccgggagcucccccauucugagcaucacaaucuccgaggacggcucgauguccaucaagaacgaggaggaggagcacacccugacgaucuugauccggacagggcugcuggugauuagcggcguguucccgguuucgauccccaucaccgccgcugccugguacuugugggaggucaaaaagcagcgugccggugugcugugggacguacccagccccccgcccguagggaaggcugaacuggaagauggcgcuuacaggaucaagcagagggggaucuuuggguacucccagaucggcgcggggguauacaaggaaggcaccuuccacaccauguggcacgucacccgcggggccguacuaaugcaucggggcaagcguauagagcccagcugggcggauguuaagaaggacuuaaucucuuacgggggaggcuggaagcuggagggggaguggaaggagggcgaggaagugcagguccuggcccuggagcccggcaagaauccccgagccgugcagaccaagccgggccucuuuaagaccaauacggguacuaucggagccgugagccucgauuucagccccgguaccagugggucucccaucguagaccggaaggguaaggugguagggcuguauggcaauggcgucgugaccaggaguggugcauacguaagugccaucgcgcagaccgagaaaucuaucgaggacaaccccgagaucgaggacgacauauuccggaagaaacgccuaacgaucauggaccuccacccuggcgcagggaagacaaagcgguaccugcccgccauaguccgcgaggcuaucaaaaggggacugcgcacucugauccucgccccgacccgcgucguggccgcagaaauggaggaggcccugcgcggccucccuauccgcuaccagacucccgccauccgggccgagcacaccggucgcgagaucgucgaccucaugugccacgcgaccuucaccaugcggcugcuaucacccgugagagucccaaacuacaaccucaucaucauggacgaggcgcacuucacugaccccgcauccauagccgcccggggcuacauaagcacacgcgucgagaugggugaggccgcgggcaucuucaugaccgcuacgccucccgggagucgugacccguucccccagagcaaugcacccaucauggacgaggagcgcgagaucccagagcguuccuggaacagcgggcacgagugggugacugacuuuaaggggaaaaccgucugguucgugccguccaucaaggccgggaacgacauagcggcaugccuucgcaagaauggcaagaaagugauacagcucucccggaaaaccuucgauuccgaguaugugaagacccgcgccaacgacugggauuucgucguuacgaccgacaucagcgagaugggggcaaauuuuagggccgagcgcgugaucgaccccagacgcugcaugaagcccguaauccucaccgacggcgaggagcggguaauccuggcggguccaaugccggugacccauagcagcgccgcccagcgccgcggcagaaucggucguaaccccaagaacgagaacgaccaguacauuuacaugggcgagccccuggagaacgacgaggacugcgcccauuggaaagaggcaaagaugcuucuggacaacaucaauacgcccgaaggcaucauccccucgauguuugagcccgagcgggagaagguagacgcgaucgacggugaguaccgucugagaggcgaggcccgcaagaccuucguggacuuaaugcggcgcggggaccugcccguguggcuggccuaccgcgucgcagccgaaggcaucaacuacgcagaccgccgguggugcuucgacgguaucaagaacaaccagauccucgaggagaacguggagguggagaucuggacaaaggagggcgagcgaaagaagcugaaaccgagauggcuggacgcccgcauauacagcgacccgcucgcccugaaggaguucaaggaauuugccgcgggccggaagucauuaacccugaaccugaucacggagauggggcgcuuacccaccuucaugacccagaaggcacgggacgcccucgauaaccuggccguccuacauacagcugaggugggggggcgcgcauacaaccacgcccugagcgagcugcccgagacgcuggagacccuacuacugcucacgcuacuggccacugucacgggcggcaucuuucucuuccuuauguccgggaaggggaucggaaagaugacccugggcaugugcuguauuaucacugccagcauccuccugugguaugcgcagauccaaccacacuggaucgcggcaucgaucauccuggaguuuuuccugauagugcugcugauuccagagcccgaaaagcagcggacgccccaagacaaccagcuaaccuacguggucaucgccauucugacggugguggccgccaccauggcgaacgagaugggguuuuuggagaagaccaagaaggaccucggccugggcucaaucaccacgcaggagagcgaguccaauaucuuggacauugaccuccgccccgccucugccuggacccuguacgccgucgccaccaccuuugugacgcccaugcugcggcacuccaucgagaauagcuccgugaacguaagcuuaaccgcgauugccaaccaggcgacuguccugauggggcugggccggggguggcccuuguccaagauggauaucggcgugccauuguuggccauaggcugcuacagccagguuaacccgauaacucucacggcggcccugcuguugcugguggcacauuacgcaauuaucggccccggccuacaggccaaggcaacucgagaggcccagaagcggaccgccgcagggaucaugaagaauccuacaguggacggcaucacggucaucgaccucgaacccaucccguaugaccccaaguucgaaaagcaacuuggccaggugaugcuguuggugcuuugcgucacccaggugcucaugaugagaaccaccugggcccucugcgaggcgcuaacgcuagcaaccggcccaaucagcacccuaugggaagggaaccccggccgauucuggaauaccacgaucgccgucucaauggccaacauuuuccgcggauccuaccuggccggugcgggccuccuuuuuagcaucaugaagaacaccacaaauacccgccgcgggacuggcaacaucggcgagacccucggcgagaaguggaaaagucgguugaacgcccuuggcaagagugaguuccagaucuacaaaaaaagcggcauccaggagguagacagaacccuggcgaaggaggguauaaaacgcggggagaccgaucaccacgccguaagccggggcuccgcgaaacuacggugguucguggagcgcaauaugguuacgccugaggggaaggucguggaccuagggugugggagaggcggguggaguuacuacugcggugggcugaagaauguacgcgaggugaaaggccugaccaaaggcggccccggucacgaggaacccaucccgaugagcacguauggcuggaaccucguucggcuacagagcggggucgacgucuucuucacuccgcccgagaagugcgauacacuacucugcgauaucggcgaaagcaguccaaaucccaccguugaagcaggcaggacccugaggguccugaaccuuguggagaacuggcugaacaacaacacccaauucugcguuaagguccugaacccguauaugcccaguguuaucgagaaaauggaggccuugcaacgcaaguacgggggcgcccugguucggaacccccugucgcgcaauucgacccaugaaauguacugggucuccaaugccacggggaacauuguguccuccgugaacaugauaagcaggaugcugauuaaucgguucaccaugaagcacaaaaaggcuaccuacgagccugacguggaccucggcucugggacccguaacauuggcauagagagcgagauccccaaucucgacauaaucggcaagcggaucgagaagauaaaacaggagcaugagacguccuggcacuacgaccaggaccacccuuauaagacgugggccuaccacgggagcuacgagacgaagcagaccggaucugccagcuccauggugaacgggguggucaagcugcuuacgaagccgugggacgucgucccgauggucacccagauggccaugacugauaccacgccguucggacaacagcgcguguucaaggagaaaguggacacccggacccaagagcccaaggaaggcacgaaaaagcugaugcgaaucacggccgaauggcuguggaaggagcucgggcggaagaagacgccucggaugugcacccgggaggaguucacccgcaaaguccggucgaacgcggcccugggugccauuuucacggacgagaacaaguggaaaucggcucgcgaagccguggaggacagccgguucugggagcugguagaccgcgagcggaaccuccaucuggaggguaagugcgagacuugugucuacaacaugaugggcaagcgugaaaagaagcugggcgaguucggcaaggcuaaaggcucgcgcgcgaucugguacauguggcuaggcgcccgcuuuuuagaguucgaggccuuaggguuccucaaugaggaccacugguuuagccgggggaacagcuuauccggcguggagggggagggccugcacaagcucggcuacauacugcgagacguuagcaagaaggagggcggcgccauguaugccgaugauaccgccggcugggacacccggaucacgcuggaggaccuuaagaacgaggagaugguuacuaaucacaugaagggcgagcauaagaagcuggcagaggccaucuucaaacugaccuaccagaacaaggugguccgggugcaacgcccgacgccucgggguacagugauggacaucaucagucgcaaggaccagcgugggagcggucagguggggaccuacggccucaacaccuuuacuaacauggaagcgcagcugauuaggcagauggaaggggaaggcaucuucaagagcauccagcggcugacuguuacugaagagauagccgugcagaauuggcucgcccgcgucgggcgggaacgccuuagcaggauggccauuuccggugacgacugcguggugaagccccuggaugaccgguucgcaagcgcguugaccgcccuaaacgauauggguaagguucggaaagacauccagcaaugggagcccucccgcggguggaacgacuggacccaggugcccuucuguagccaccacuuccacgagcuggugaugaaggacggccgaguccuagucguacccugccgcaaccaagacgagcugaucgggcgggcacgcauuucccagggcgcaggcuggagccugaaggagacugcuugccucggcaaauccuacgcccagauguggacccugauguacuuccauaggcgagaucugcggcucgccgcuaacgcuaucugcucugcuguaccuucucacugggugccuacgagcagaaccacauggucaauccacgcgaagcaugaguggaugacuaccgaggauaugcuggcuguguggaaccgcgucuggauccaggagaauccguggauggaagauaagacccccguggagaguugggaagaggugcccuaucuuggaaagcgggaagaccagugguguggguccuugauuggccuaacgucccgcgcuacaugggcuaaaaacauucagaccgcgaucaaccagguccguagccugaucgggaacgaagaguacacagacuacaugcccuccaugaagcgcuuccgcaaagaggaggaggaagccggcguacucugguga

SEQ ID NO: 25247 - RNA, 9876 nt, Artificial Sequence
  derived and/or modified CDS sequence (opt11) from DENV-2__EU482720__SS-prME
accgcgggugugaucaucauguugauacccacagccauggcguuccaccucaccacccgcaauggggaaccccauaugaucgugggccggcaagagaaggggaagucccugcuguucaagaccgaggauggcguuaacauguguacccuaauggccaucgaucugggggaacuuugcgaagacaccaucaccuacaagugucccuuguugcgccagaacgagcccgaggauaucgacugcuggugcaacuccaccagcaccugggugaccuacgggaccugcaccaccacgggugagcaccggcgcgagaagcggagugucgcgcuggugccacauguggguaugggccucgagacacguaccgagaccuggaugagcagcgagggggccuggaaacacguccagcgaauugagacguggauucugcgccacccaggcuucaccaccauggcagccauacuggccuacaccaucgggacgacccacuuccagagggcucucaucuuuauccugcuaaccgccguggcacccagcaugaccaugcgaugcaucggcaucuccaauagagacuucguggaaggcgucagcgggggcuccuggguugacaucgugcuggagcacgggagcugcgucacgacaauggccaagaacaagcccacgcuggauuucgagcugaucaagacagaggcgaaacagcccgccacccuccgcaaguacugcaucgaggccaaacugacgaauacgaccacggagucacggugcccgacccaaggcgagcccucucugaacgaggaacaagauaagcgcuucaucugcaagcacaguaugguggaccggggcugggggaacgguugcggccuguucggcaagggcgggaucgugaccugugcgauguucacgugcaagaagaacauggagggcaaggucguuuugcccgagaaccuggaauacacgaucgugauuacgccccacagcggugaggagcacgccguaggcaacgacaccgggaagcacggcaaggagauaaagauuaccccgcagucaagcaucaccgaagccgagcuuacgggguacggcaccgugaccauggagugcucuccccggaccggccuggacuuuaaugagauggugcugcuccagauggaggacaaggccuggcugguucaccgucaaugguuccuggaccucccccugcccuggcugccgggcgccgacacgcaggguucgaacuggauccagaaggagacgcuggugacauucaagaacccccacgcgaagaaacaggacguugucgugcuggggucccaggagggcgccaugcauaccgccuuaacgggugccacggagauccagaugucgagcgggaaccuccuguucaccggccaccugaagugucgccuccggauggacaagcugcagcugaaggggaugagcuacagcaugugcaccggcaaguucaagaucgucaaggagauugcagagacucagcacgggaccaucgugauccgcgugcaguacgagggcgacggcuccccgugcaagauccccuucgagaucauggaccucgagaaacgccauguccugggucgccucaucaccgugaacccgaucgcgacggagaaggacagcccuguuaacaucgaggccgagccgcccuuuggagacuccuacaucaucaucggggucgaaccgggccagcucaagcugaacugguuuaagaaggggagcucaaucggccagauguucgagacgaccaugaggggcgccaagcggauggccauccugggggacaccgccugggacuucggcucguuagggggcguguuuacaucgaucgggaaggcgcuccaccagguguucggcgcuaucuacggcgcagccuuuagugggguauccuggacgaugaagauccugaucggcgugaucaucaccuggauugggaugaacagccgcuccaccagccuguccgugagccucguccugguggggaucgugacccuguaccucgggguaauggugcaggcagacacaggcugcgucgucuccuggaagaacaaagagcugaagugcgggagcgggaucuucaucaccgacaacgugcauaccuggacugagcaguacaaauuccagcccgagucccccagcaagcuggcaagcgccauccagaaggcccaugaggagggcaucugcgggauccgguccgugacgcgccuggaaaaccucauguggaaacagaucacccccgaguuaaaccacauccugagcgaaaaugaggucaaacugacaaucaugaccggcgauaucaaggggaucaugcaagccgguaagcggucccugaggccgcagcccacggagcuuaaguacagcuggaagacguggggcaaggcgaaaaugcuguccaccgagagccacaaccagaccuuccucaucgacgggcccgagaccgccgagugcccgaauaccaaccgggccuggaacagccucgagguagaggacuacggcuucgguguauucagcaccaacaucuggcuuaaguuacgcgagaagcaggacgucuucugugacuccaagcucaugucagccgccaucaaagauaaccgggcggugcacgccgacaugggcuacuggauagaguccgcccuuaacgacacguggaaaauggagaaggccagcuucaucgagauaaaguccugccacuggcccaagucucauacacuguggagcaacggcgugcuugaaagcgaaaugauuaucccgaagaacuucgccgggcccgucucccagcacaacuaccgcccgggcuaccacacccagaccgcggggcccuggcaccuuggcaagcuggagauggacuucgacuuuugugaggggaccaccgugguggucacugaggacugcggcaaccggggccccucccuccgcaccacgaccgccucugggaagcugaucacggaauggugcugucgguccugcacccugcccccgcuccgcuaccggggcgaggacggguguugguacgggauggagauccggccccugaaggagaaggaggagaaccuagugaacucccuagugaccgccggucacggucaaaucgacaacuucucccugggcguacuggggauggcccuauuccuggaggagaugcugcggacccgcgugggcacgaagcaugcaauucuccugguggcaguuagcuucgugacccugauuacggggaacaugucauuccgggaccucggccgcgugauggucauggugggugccaccaugacggacgacauugguaugggcgucaccuacuuggcccugcuugccgcauucaagguccgcccaaccuucgccgccgggcugcugcuccggaagcugacgagcaaggagcugaugauggcaacuaucggcaucgcccuccuaucccagagcaccaucccugaaaccauccuggagcucaccgacgcgcuggcccuggggaugauggugcucaagauagugagaaauauggagaaauaccagcuggccgucacgaucauggccaucuccugcgugccgaaugccgucauccugcagaacgcguggaaaguauccugcaccauccucgccgccgucuccgugagcccccugcugcucaccuccagccaacagaaggcggacuggaucccccuggcgcugaccauaaaggggcucaaccccacggccauuuuccugacuacccugucccggaccagcaagaagcguuccuggccccucaaugaggccgucauggccgugggcauggucagcauccuagccuccucacuucuaaagaacgacauccccaugacgggucccuugguggcgggcgggcugcucaccgugugcuacguccucaccggccggagcgcggaccuggagcucgagaaggccgccgacguaaagugggaggaccaagccgagaucucagggagcuccccaauccugagcaucacaaucuccgaggacggcagcauguccaucaagaacgaggaggaggaacacacgcuuaccauacucaucagaaccggccugcucguaaucagcggcgucuucccugucuccauccccauaaccgcagccgccugguaccuaugggaggugaagaagcaacgggcuggcguccugugggacguccccagcccgccgccuguggggaaggccgaacuggaggauggugcguaccgcaucaagcagcgugggaucuucggcuauucccagaucggcgccggggucuacaaggagggcacuuuccacacgauguggcacguuacccguggggcggugcucaugcaccggggcaagaggaucgagcccagcugggccgacgugaagaaggaucugaucagcuacgggggcggauggaaguuagaaggggaguggaaggagggcgaggaggugcaggucuuagcacuggagccggggaagaacccccgggcgguucagacuaaacccggccuauucaagacaaacacgggcacgaucggcgccgugagucuggacuucuccccgggcaccucagggucgcccauaguggaccgcaagggcaaggucguaggacuguauggcaacggcguggucacucggagcggggccuauguguccgcuaucgcgcagacggagaagucaaucgaggacaaccccgagaucgaggacgacaucuuccgcaagaagagacugaccaucauggaccuccaccccggagcggggaagacgaagcgcuaccugcccgccauugugcgggaggccauuaagcguggccugcggacgcugaucuuagccccgacgcgcguuguugcggcugagauggaggaggccuugcgcgggcugccuauccgguaccaaacccccgccauacgcgccgaacacaccggucgugagauuguggaucucaugugucacgcgacauucacuaugcgccugcugagccccguccgggugccgaacuauaaccucaucaucauggaugaggcccacuucaccgauccagccuccaucgccgcccgcggcuacaucagcacccggguggagaugggggaggcggccggcaucuucaugacagccacaccgcccgggucuagagauccauucccccaaagcaacgcccccauuauggacgaggaacgggaaauucccgagcgcucguggaacagcggccacgagugggucaccgauuucaagggaaagaccgugugguucgugccauccaucaaggcgggcaacgacaucgccgccugccugcgcaaaaacggcaagaaggucauccaacugagcagaaagaccuucgacagugaguacgugaagacgcgggccaacgacugggacuucgugguuaccaccgacauuagcgagaugggggccaauuuccgcgcggagcggguuaucgacccccgucggugcaugaagcccgugauccucaccgauggcgaggagcgcgucauacuggccggucccaugccugugacgcacucaagcgccgcccagcgacgcggcaggaucggacggaaccccaaaaacgaaaaugaccaguauauauacaugggcgagccucuugagaacgacgaggacugcgcccacuggaaagaggcgaagaugcuucuagacaauauaaacaccccugagggaaucaucccaaguauguucgagcccgagcgcgagaagguggacgccaucgauggggaguaccggcuucggggcgaggccagaaagaccuucgucgaccuaaugcgccgcggggaccugcccguguggcuggccuaccgcguggccgcggagggcaucaacuacgccgaccggcgcuggugcuuugacgggaucaagaacaaccaaauccucgaggagaacgucgaaguggagaucuggaccaaggagggcgaacggaagaagcugaagccgcgauggcuggacgccagaacguauagugaucccuuggcccugaaggaguuuaaggaauuugcggccggcagaaaaucccugacccucaaccugaucacggagauggggcggcugcccaccuucaugacgcagaaggcccgcgacgcccucgacaaccuggcggugcugcacaccgccgaggucggcggccgggccuacaaccacgcccuaucugaguugcccgagacucuggagacccuguugcugcucacguuguuagcaaccguaaccgguggcaucuuccucuuccugaugucugggaagggcaucgggaagaugacccugggcaugugcugcaucaucaccgcuagcauccuccugugguacgcgcagauucagccacacuggaucgccgcuaguaucauccucgaguuuuuccucauaguccugcugauccccgagccugaaaagcagcgcacaccccaggauaaccagcucaccuacguggugauagccauccugacggucguggccgcaaccauggccaacgagaugggauuccuggagaagacgaagaaagaccucggacugggcucuaucaccacccaagaaagcgaguccaacauccuggacauagaccuccggccggccucagccuggacgcuguacgccguggccacgaccuucgucacccccaugcugcgccacuccaucgaaaacagcucugucaacgugagccucaccgccaucgcaaaucaggccacgguacugauggggcugggcaggggguggccucucuccaagauggacaucggcgugccccugcuggcgaucgguugcuacagccaggugaaccccaucacgcucaccgccgcccuucugcugcuuguagcccacuacgcaaucaucggccccggccugcaggcgaaggccacccgagaggcccagaagcgaacggccgccgggaucaugaagaaccccaccguggacggcaucacggugaucgaccucgagcccaucccguacgaccccaaguuugagaagcagcuugggcaggucauguugcucgugcugugcgucacucagguccugaugaugcggacgaccugggcgcuuugcgaggcccugacucuggcaaccggcccgaucuccacgcucugggagggcaacccaggccgauucuggaauaccaccaucgccguguccauggccaacaucuuucggggcuccuaccuggccggggcgggccuccucuucagcaucaugaagaacacaacgaacaccaggagagguacuggcaacaucggagagaccuugggagagaaguggaaguccaggcugaacgccuuaggcaaaagugaguuccagauauacaagaaguccgguauccaagaaguggaccggacgcuggcgaaagagggcaucaagcgcggugagacggaucaccacgcggucagccggggcuccgccaagcugcgcugguucguggagcggaacauggugaccccggaggggaaggucguggaccucgggugcggccgcggaggcuggagcuauuacugugggggccugaagaacguccgggaggucaagggccuaaccaagggcgggcccggccacgaggagcccauucccauguccacguacggcuggaaccucguccgccugcagagcgggguggacgucuucuuuaccccgccggaaaagugcgacacucuccucugcgacaucggcgagagcucccccaaccccaccaucgaagccggucggacccuacgcgugcugaaccugguagagaacuggcuaaacaacaacacucaguucugcgucaagguguuaaacccuuacaugcccagcgugaucgagaagauggagacccuccagagaaaguacgggggcgccuugguccgcaauccccugucccggaauagcacccacgagauguacuggguuuccaacgccaccgggaacauugugagcuccgucaacaugauuucccgcaugcugaucaacagauucacaaugaaacacaagaaggcaaccuacgagccggacguggaucucggcuccggaacccggaacaucggcaucgagaacgagaucccuaaucuggauaucaucggcaaacgcauagaaaagaucaagcaggaacacgaaaccagcuggcacuacgaucaagaccaccccuacaagacgugggcuuaccaugggucauacgagaccaagcagacaggcagcgccuccagcauggugaacggggugguuaaguugcucaccaagcccugggacguggucccgaugguuacgcagauggccaugaccgacacaacccccuucggacagcagcggguguucaaggagaagguugacacgagaacccaggaacccaaggagggcaccaagaagcugaugcggauuaccgcugaguggcuauggaaggaacucgggaagaagaagacgccacgcaugugcacccgggaggaguucacucgcaaagugcgguccaacgcggcccuaggcgccaucuucacugacgagaacaaguggaaauccgcccgggaggccguggaggacucccgauucugggagcuggucgaccgcgaacggaaucuccacuuagaggggaagugcgagaccugcguguacaacaugauggguaagcgcgagaaaaagcugggggaguucgguaaggcgaagggcagccgcgcgauuugguacauguggcucggggcccgcuuccucgaguucgaggcccugggcuuccucaacgaagaccacugguucucccggggaaacucacucagcggcgucgagggagaggggcugcauaagcugggcuacauccugcgcgacguguccaagaaggagggcggggcgauguacgccgaugacaccgccgguugggacacccggaucacccuggaggaucucaagaacgaggaaauggucacgaaccacaugaagggagagcacaagaagcuggccgaggccaucuucaagcugaccuaccagaacaaggucgugcgcgugcagcggccgacgccccgcgggaccgucauggauaucaucagccgcaaggaccagaggggcuccggccaggugggaacuuacggcuugaacaccuucaccaauauggaggcccagcugauccgccagauggagggugagggcaucuucaagagcauccagcgacugaccgugacugaggagaucgcaguacagaacuggcucgcucgcgucggccgagaaaggcuuucccguauggccaucagcggggacgacugcguggucaagccacuggacgaccgauucgccuccgcguugaccgcccugaacgacauggggaaggugcggaaggacauacagcagugggagcccagucgcggguggaacgacuggacccaggugccguucugcucccaccacuuccacgagcucgucaugaaggacggccggaugcucgucguaccaugcagaaaccaagacgagcugaucggccgggcccgcauuagccagggcgcgggcuggucccugaaggagacggcuugccucgggaaaucguaugcgcaaauguggacccugauguacuuccaccggcgcgaccugcgguuggccgcgaacgccaucugcucagccguccccagccacugggugcccacgucccguaccaccuggagcauccacgccaaacacgaguggaugaccacggaggacaugcuggcaguguggaaccgggucuggauccaggagaacccguggauggaggacaaaacccccguagaauccugggaggaggugccauacuuaggcaagcgagaggaccaguggugugggagccucaucggccuaaccagccgcgccacuugggccaaaaacauccagacggcgaucaaccagguccggagucugaucgggaacgaggaguacaccgacuacaugcccagcaugaagcgcuuccggaaggaggaggaagaggccggugugcucugguga

SEQ ID NO: 25248 - RNA, 9876 nt, Artificial Sequence
  derived and/or modified CDS sequence (opt11) from DENV-2__EU482721__SS-prME
accgccggcgugauaaucaugcugaucccuaccgccauggcguuccaucucacaacccggaacggggaaccacacaugaucgucggcaggcaggagaaggggaagagccuguuauucaagaccgaggacggcgugaacaugugcacgcucauggcgaucgaccuuggggaauuaugcgaggauacgauaaccuacaagugcccguuguugaggcagaacgaacccgaggauauagacugcuggugcaacagcaccagcaccugggugacauacgggaccugcaccaccacaggcgagcaccggcgugagaagcgguccgucgcccuggugccccacguggggaugggccucgagacccgcaccgagaccuggaugagcuccgagggggcguggaagcacguacagcggaucgagacuuggauccuacgccacccgggauucacuaccauggccgcgauacuagccuacaccauaggcaccacccacuuccagcgggcccucaucuucauacugcucaccgcuguggcgcccucgaugaccaugcgcugcauugggauaaguaaccgcgauuucguggagggggucagcgggggauccuggguagacauagugcucgaacacgguagcuguguuacgacuauggccaagaacaaaccaacccuugacuucgagcugaucaagacagaagccaaacagcccgccacgcuacguaaguacugcaucgaggccaaguugaccaacacgaccacggagucccggugcccgacccaaggggagcccagccugaaugaggaacaggauaagcgguucaucuguaagcauuccaugguggaucgaggcuggggcaacggcugcgggcuuuuuggaaagggugggaucgugaccugcgcgauguucaccuguaagaaaaacauggagggcaaaguggugcagcccgaaaaccuggaguacacgauugugauuaccccccacagcggggaggagcacgccgucggaaacgacaccggcaaacauggcaaggagaucaagaucacaccgcagagcagcaucacggaggccgagcugacgggguacggaacggugaccauggagugcagcccucggacuggccucgacuucaacgagauggugcugcuacaaauggaggacaaggccuggcucguccaucggcagugguuccuggaccugccccuccccuggcugccgggggccgacacccaaggcagcaacuggauccagaaggagacgcugguuaccuucaagaacccccacgccaagaaacaagauguggucgugcucgggucccaagaaggugccaugcacaccgcccugacgggcgccacggagauccaaaugucuagcggcaaccuccuguuuaccggccaccugaagugccgccugcggauggauaaauuacagcugaaggggauguccuacagcaugugcaccggcaaguucaagaucgucaaggagaucgccgaaacgcaacacgggaccaucgugauccgagugcaguacgagggugacggaucccccugcaagaucccguucgagaucauggaccuggaaaagcggcacguccuugggcgccuaauaaccguuaaccccaucgugaccgaaaaggacagccccgucaauaucgaggcggagccucccuucggagacuccuacaucaucaucgggguggagccgggccaacugaagcucaacugguucaagaaggggucuuccaucggacagauguucgagacuaccaugcgcggcgccaaacggauggccauccugggggacacagccugggacuucgguagccucggaggcguguucaccaguaucgggaaggccuuacaccaggucuucggggcgaucuacggagccgccuucagugggguguccuggacgaugaagauccugaucgggguuaucaucaccuggaucgggaugaacagccgcucaacgagccuuucggucagcuuggugcucguggggauugucacccuguacuuaggggugauggugcaggcggauacagguugcgucguguccuggaaaaacaaggagcucaagugcggguccgggaucuucaucaccgacaacgugcacaccuggaccgagcaguacaaguuccagcccgagagccccagcaagcuggcaagcgcgauucagaaagcccacgaagaaggcaucugcgggauucggucagucacgcgcuuagaaaaccucauguggaagcagauuacccccgaguuaaaccauauucugagcgagaacgaggucaaacucaccaucaugaccggcgacauuaaggggaucaugcaggccggcaagcggagccuacgcccgcagccaacggagcugaaguacucuuggaagacguggggcaaggccaagaugcucuccaccgaaucccauaaccagaccuuccugauugacgggccggaaaccgcggagugcccgaacacuaaccgggcuuggaauagcuuagaggucgaggacuacggauucggagucuucagcaccaacaucuggcucaagcugcgugagaaacaggacguauuuugcgacuccaagcugaugagcgccgccaucaaagacaaccgggccgugcaugcggacaugggcuacuggauagaguccgcacucaacgacacuuggaagauggagaaggcgagcuucaucgagaucaaguccugccacuggccuaagagccacacccuaugguccaacgggguauuagaaagcgagaugaucauccccaagaacuucgccgggcccgugagccagcacaauuaccgccccggcuaucacacucaaaccgccgggcccuggcaccucggaaaguuagaaauggacuucgacuuuugcgaggggaccaccguggucgugacggaggauugcgggaaccgggggccaagccugcgcacaacuaccgcauccggaaaguugaucacggaaugguguugcagguccugcacccugcccccacugcgauaccggggcgaggacgggugcugguacggcauggagauccgcccguuaaaggagaaggaggagaaucuggugaacagccuggucaccgccgggcacggccagaucgacaacuuuucccucggcguguuggggauggcccuguuucucgaggagaugcugcguacccgcaucggcacgaagcacgccauucugcucguggcgguaagcuuuguaaccuugaucaccgggaacaugucguuccgggaccuaggccgcgugauggucauggucggggccaccaugacggacgacaucggcaugggcgugaccuacuuggcccugcuggccgccuuuaaggucaggcccaccuucgccgccggacuucugcuucggaaacucaccagcaaggaacugaugauggcuacuaucgguaucgcucugcucucacagagcaccauccccgaaacuauccuggagcugaccgaugcccuugcgcuggggaugauggugcugaagaucgugcgaaauauggagaaauaccagcuagccgugacuaucauggcaauuuccugcgugccgaaugccgugauccugcagaaugcguggaaggugucaugcaccauacuugcggcaguguccgugagccccuuacuccucaccucaagccaacagaaagccgauuggauaccccucgcccugaccauaaagggccugaaucccacggcgaucuuuuuaacgaccuuaucccggaccagcaagaagcgcuccuggcccuuaaacgaggccaucauggccgucggcauggugagcauccucgccuccagccuguuaaagaacgacauccccaugacggggcccuugguagccggcgggcugcugaccgugugcuacguccucacaggccggagcgcugacuuagagcuggagcgcgccgcugaugucaagugggaggaucaggcagagaucagcgggagcucgcccaucuuaagcaucaccaucuccgaggacggcagcauguccaucaagaacgaggaagaggagcacacccugacgauccucauccggacuggccuccuggugaucucugguguguuccccgucuccaucccuauuaccgcggcugccugguaccugugggaagugaagaagcagcgcgccggaguguuaugggauguacccucaccgccacccguggggaaggccgagcuggaggacggcgccuaccggauaaagcaaagggggaucuucggauacucccagaucggcgcggggguguacaaggaaggcaccuuucacacgauguggcaugucaccaggggggccgugcugaugcaccgcggcaagcggauagagcccagcugggcagacgugaaaaaggauuuaaucuccuacgguggcggcuggaaacuggagggggaguggaaggaaggcgaagaaguucaggugcuggcccuugagccugguaagaauccccgcgcugugcaaaccaagcccggccuauucaagacaaacaccgggaccaucggagccgucagccuggacuucagucccggcacgucugggucccccauuguugacaggaagggcaaggugguugggcuguacggcaacggcguggugacccgcagcggagccuacguguccgcgaucgcccaaacggagaaguccauugaggacaaccccgaaaucgaagacgacaucuuccggaagaagcgccugaccaucauggaccugcacccuggagcagguaaaaccaagagauaccuccccgccaucgugcgcgaggccaucaagcggggcuuaagaacacugauccuggccccgacgcgcguggucgccgcggaaauggaggaagcccuucggggacugccaauccgguaccaaacucccgccauucgugccgagcacacaggccgcgagaucguagaccugaugugccacgccacauucacgaugcggcuccugucacccguucgagucccgaacuacaaccugaucaucauggacgaggcucacuuuaccgacccagccuccaucgccgcccggggcuacaucagcacacgcguggagaugggagaggccgcgggcaucuucaugacggcaacgccgccggggucccgagacccguucccacagagcaacgcgcccaucauggaugaagagcgcgaaaucccugaacggucauggaacagcggccaugagugggugaccgacuucaaggggaaaaccgugugguucgugccauccaucaaagccggcaacgacauagcggccugccuccgcaagaacggcaagaaggugauccagcugagccggaagacauucgauagcgaguacgucaagacgcgggccaacgacugggauuucguggugacaacggacaucagugagaugggggccaacuucagggcggagcguguaaucgauccccggagaugcaugaaacccgucauccugacugacggugaggagcgggucauccucgcggggcccaugccaguuacgcacuccagcgccgcacagagaaggggacgaaucgggcgcaacccgaaaaacgagaacgaccaguacauuuacaugggcgagccccuggagaacgacgaggacugugcgcauuggaaggaggccaagaugcuucucgacaacaucaacacccccgagggcaucaucccguccauguucgagcccgagcgggagaaaguggaugcgaucgauggggaauaccgacuucggggugaagcccguaagaccuuuguggaccucaugcggaggggcgaucucccggucuggcuggccuaccgcguggccgccgaagggaucaacuacgcggaccgccgguggugcuucgacggaaucaagaacaaccagauccuggaggagaacguggaggucgagauuuggaccaaggagggcgaacgcaagaagcucaaaccgcgguggcuagacgcccgcaucuacagcgauccucuugcccucaaggaguucaaggaguucgccgcgggccggaagucccugacgcugaaccucaucaccgagauggggcgccugccgaccuucaugacgcagaaggcccgggacgcccuggacaaccucgcuguccuacacacggccgaggcgggcgggcgcgccuacaaccacgcgcugagugagcuccccgagacccuggagacccugcuccuguuaacucuccucgccacggugaccggcggcaucuuccuguuccucauguccggcaagggcaucgggaagaugacgcugggcaugugcugcaucauuacggccagcauccuguugugguacgcgcagauccagccgcauuggauagccgccucuaucauccuggaguuuuuucugaucguacuccugauuccagagcccgagaagcaacggacgccacaggauaaucagcugacguacguggucaucgccauuuugaccgugguggccgccaccauggccaacgagauggguuuccucgagaagaccaagaaggaucugggccucggcagcaucacgacucaggagucugagagcaacauccuggauaucgaccugcgcccggccucagccuggacccucuaugccguggcuacaacguucgugacccccaugcugcggcauucgauagagaauagcucgguaaacgucagccugacggcaauugcaaaccaggcuaccgugcucauggggcuaggcaaggguuggcccuuguccaagauggacaucggcguccccuuacuggcaaucgggugcuacagucagguuaacccgauuacccuuacggccgcccuacugcugcucguagcccacuacgccaucaucggcccuggccugcaagcgaaggccacccgcgaggcccagaagcgcgccgccgcgggcaucaugaagaacccaaccguggacggcaucacggucaucgaccuugagccgauuccguacgaccccaaauuugagaagcagcucggccaggugaugcugcugauccugugcgucacccaggucuugaugaugcggacaaccugggcccugugcgaagcgcucacgcuggccaccggcccaaucucuacccugugggaagguaaccccggccgcuucuggaauacgacuaucgccgugagcauggcgaacauuuuccguggcuccuaucucgccggggccggucugcuguucagcaucaugaagaacaccaccaacacgcgucgggggacgggcaacauuggcgaaacccucggggagaaguggaagucccgccugaacgcccugggcaaaagcgaauuccagauauacaagaaguccgggauccaggagguggaccggacucucgcaaaagagggcaucaagcgcggggagacugaucaccacgcugugucaagaggcuccgccaagcugcgcugguucguggagaggaauauggugacgccggaaggcaaagucguggaccuggggugcggccgcgggggcuggagcuacuacugcggaggcuugaagaaugugcgggaggucaagggccucaccaagggcggccccgggcacgaggagcccauccccauguccaccuaugguuggaaccucgugcgccuccaaagcggaguggacgucuuuuucaccccgcccgagaagugcgacacacuguugugugauaucggcgagagcuccccaaaucccaccaucgaagccggucggacuuuacgcgugcugaaccugguggaaaacugguugaacaacaacacccaguucugcaucaagguacugaauccguacaugcccagcguuaucgagaagauggaggccuugcaacgaaaguacgggggcgcgcucgugcgcaacccccugucccggaacaguacacaugagauguauuggguuagcaaugccacgggcaacaucgugucguccgugaacaugaucagccgcaugcugaucaaccgguuuaccaugaaacacaagaaggcuaccuacgagccggacgucgaccuggguuccggcacccggaauaucggcaucgaauccgagauccccaacuuggacaucaucggcaagagaaucgaaaaaauaaagcaggagcacgagacguccuggcacuacgaccaggaccaccccuacaagaccugggccuaccacgggucguacgaaacgaagcagaccggcucggcauccuccauggugaacggggugguccggcugcugacgaagccaugggacguggugccgauggugacccagauggcuaugacggacaccacgcccuucggccagcaacguguuuucaaagagaaaguggacacuagaacccaggaacccaaggaaggcacgaagaagcucaugaagaucacggccgaguggcuguggaaggaguuggggaagaagaagacgcccagaaugugcacgcgggaggaauucacccgcaagguccggagcaacgcugcccugggcgccaucuucacggacgagaacaaguggaagagcgcucgcgaggccguggaagacgggcgguucugggagcugguggaccgcgagcggaaccugcaucucgagggcaagugcgagaccugcgucuacaacaugauggggaaacgcgaaaaaaaguugggugaauucggcaaggccaagggcucgcgggccaucugguacauguggcuaggcgcgagauuccucgaguucgaagcccugggauuccugaacgaggaccacugguucucacggggaaauagccucuccgggguggagggggagggccugcaccgccugggauacauccucagggacgucuccaagaaagagggcggcgccauguacgccgacgacaccgccggcugggauacccgcaucacucuggaagaccuuaagaacgaggagauggucaccaaucauaugaaaggggagcacaagaaguuggcugaggccaucuuuaagcugaccuaccagaauaaaguugugcggguucagcgccccacaccccgcggcacggugauggauaucaucucccggaaggaccagcgcggcucggggcaagucggcaccuacgggcugaauaccuucaccaacauggaggcccaacucauacggcagauggagggcgagggcaucuucaagagcauccaacgccuaacagugaccgaggagaucgccgugcagaauugguuggcccgggucgggagagagcggcuaucccguauggcgauuagcggcgacgacugcguagugaagccgcuggacgaucgguucgccuccgcucugaccgcauugaaugacauggguaagguccgcaaggacauccagcagugggaacccagccgcggguggaaugacuggacccaggugcccuucuguucacaccacuuccacgaguuagugaugaaggacgggcguaugcugguugugcccugccggaaccaagacgagcucaucggccgcgccagaaucucucaaggggcgggguggucccugaaggaaaccgccugccuagggaagucauaugcgcagauguggacccucauguacuuccaccgaagggaccugcgacuugccgccaacgcaaucugcuccgccgugcccagccacuggguacccaccucccggacaacguggagcauucacgccaagcacgaguggaugaccaccgaggacaugcucgccguguggaaucgcguguggauccaggaaaacccguggauggaggacaagacccccgucgagucaugggaagaggugccauacuuagggaagagggaggaccaguggugcgggagccugauagggcucacgagcagggcgacgugggccaaaaauauccagaccgcaaucaaccaggugaggucacugaucggcaacgaggaguauacggacuauaugcccagcaugaagcgguuccgcaaggaggaagaggaggcgggcguccuuugguga

SEQ ID NO: 25249 - RNA, 9876 nt, Artificial Sequence
  derived and/or modified CDS sequence (opt11) from DENV-2__EU482722__SS-prME
accgccggcgugaucauaaugcugaucccgaccgccauggcguuccaccuaaccacccggaacggcgagccccacaugaucgugggccggcaggagaaggggaagucccugcuauucaagaccgaggacggcgugaacauguguacccucauggcaaucgaccugggggagcugugcgaggacaccaucaccuacaagugcccccucuugagacagaacgagccagaggacaucgacugcuggugcaacucaaccagcaccugggugaccuacggcaccuguacaaccacgggcgagcaccggcgcgagaaacgguccgucgcccuggugccccacguagggaugggccucgaaacgcggacugagacauggaugucguccgagggggcguggaagcacguccagcggaucgaaaccuggauccugcgccacccugguuucacaaucauggccgcgauccuggcuuauacgauuggaaccacgcacuuccagcgggcccucaucuucauucuauugaccgccguggcgcccagcaugaccaugcgcugcaucggcaucuccaaucgggacuucguugaaggcgucucggggggcuccuggguagacaucgugcucgagcacggaagcugcgucacaaccauggccaagaacaagccgacccuggacuucgagcugaucaagaccgaagccaagcagcccgccacccuccgcaaguauugcaucgaggccaagcugacgaacaccaccacugagucucggugcccaacgcagggcgagccaucacuaaaugaggagcaggacaaacgcuucauaugcaagcacuccaugguggaccggggcugggggaacggcugcggccuguucggcaagggcgggaucgugacaugcgcgauguuuaccugcaagaagaacauggagggcaagguaguauugccugaaaaucuugaguacaccaucgugaucacgccccacagcggggaggagcacgccgugggcaacgacacggggaaacacggcaaggagaucaagauaaccccgcaguccagcauuaccgaggcagaguuaaccggguacggaacaguuacuauggaauguagcccccggaccggccuggacuucaacgagaugguccugcuccagauggaggacaaagccuggcugguccaccggcagugguuccucgaccucccccugcccuggcuuccgggggccgacacccagggcagcaacuggauccagaaggagacgcuggugaccuucaagaacccacacgcgaaaaaacaggacguggucgugcuggggucccaggagggugccaugcacaccgcccugaccggugccacggagauccagaugucuucaggcaaccuccuuuucaccggccaccugaagugccgccuacgaauggacaagcugcagcugaagggcaugucuuacagcauguguaccggcaaguucaagaucguuaaggagaucgccgagacgcagcaugggacgaucgugauccgcgugcaguacgaaggcgacgguucuccuugcaaaaucccauucgagaucauggaccucgaaaagcgccacguccuggggcgccugauuaccguaaacccgaucgugaccgagaaggacucgcccguuaacauugaggcggagccgcccuucggcgacuccuauauaauaaucggcguggaaccgggccagcucaagcugaacugguuuaaaaaggguagcucgaucggccagauguucgagacaacgaugcgcggcgcaaagcggauggcaaucuugggggacaccgccugggacuucgggagccucggagguguguucaccucaaucgggaaggcucugcaccaggucuucggugccaucuacggcgccgccuucagcggaguguccuggacaaugaagauccugaucggcgugaucaucacguggauugggaugaacagccgcuccaccagccugucagucagccucgugcuggucggcguugugacgcuguaccucgggguuaugguccaggccgacuccggcugcguggugagcuggaagaauaaggagcugaagugcggcuccgggaucuucauuacugacaacguccacacguggacggaacaguacaaguuccagcccgagagccccucuaaacuggcguccgcuauccaaaaggcgcacgaggagggcaucugcgggauacggagcgugacccgccucgagaacuugauguggaagcagaucaccccggagcugaaucacauccucuccgagaaugaggugaagcugacuaucaugaccggagacaucaaggggaucaugcaggcaggcaagagaagccugcggccgcagcccaccgagcucaaguacuccuggaaaacauggggcaaagccaaaauguuaagcacggagucccacaaucagaccuuccugauagacggucccgaaaccgcggagugcccgaacaccaauagggcuuggaacaguuuggaggucgaggacuacggcuucgguguguucucuacgaauaucuggcugaagcuuagagagaagcaggacguguucugugacagcaagcuaauguccgccgccaucaaggacaaccgcgccguccacgcggacaugggcuacuggaucgagagcgcccugaacgauaccuggaagauggaaaaggccuccuucaucgagaucaaaaguugccacuggcccaagucccauacgcuguggagcaacggcgugcucgaguccgagaugaucauccccaagaacuuugccgggcccgugucccagcacaacuaccgcccgggcuaucacacgcagaccgccgggccuuggcauuugggcaagcuggagauggauuuugacuucugcgaggggaccaccgucguggugaccgaggacugcgguaaccgaggccccagccuccgcaccacgaccgccuccgggaaacugaucaccgaguggugcugccggagcugcacccugcccccgcuccgcuaccggggcgaggacggcugcugguacggcauggaaauccgccccuugaaagaaaaggaggagaaccuggucaacucccucguuacagccgggcacggacagaucgacaacuucagccugggggugcuggggauggcgcucuuccuugaggaaaugcugcggacccgcgucggcaccaagcacgccaucuuacuaguggcaguguccuucgucacucuuaucacggggaauaugagcuuucgggaucucggucgcgugauggugauggucggggccacaaugaccgacgauaucggaaugggcguuaccuaccuggcccugcuugccgccuucaaggugcgccccacguucgcagcagggcugcugcuccggaagcugacauccaaggagcugaugauggcgaccaucgggaucgcccuccugucccaguccaccauucccgagaccauccuagagcucacugaugcauuggcccuggggaugaugguccucaagauuguccgcaacauggagaaguaccaauuggccgugacuaucauggcgaucucuugcgucccgaacgccguaauccuucagaacgcguggaaggugucuugcaccauccucgcggccgucagcguuagcccucugcugcucacgucuucccaacagaaggccgauuggaucccccucgcccugaccaucaagggacucaaccccaccgcgaucuuccugaccacgcugagccggaccagcaagaagcggagcuggccgcucaacgaggccgucauggccgugggcaugguauccauccuggccagcagccuacuuaagaacgacauccccaugaccgggccccuagucgccggcgggcugcucaccgugugcuaugugcucacgggcagguccgcugaccuggagcucgagcgcgucgccgauguuaagugggaagaccaagccgagaucagcgggagcagcccgauccuguccaucaccaucagcgaggacggcuccaugagcaucaagaacgaggaggaggagcacacccugaccaucuuaauucggacgggccuucuuguuaucuccggagucuucccggugagcauccccauaacggccgccgcgugguaucucugggaaguuaagaaacagcgcgccgggguccugugggacgugcccagcccgccgcccguagguaaggccgagcuggaggacggcgccuaccggaucaagcagcgagggauuuucggauacagccagaucggcgccggggucuauaaagaaggcaccuuccacacuauguggcaugugacccgcggggcggugcuuaugcaccgcggcaagcgcaucgagcccagcugggccgacgucaaaaaggauuuaaucucguacgggggcggcuggaagcuggagggggaguggaaggagggcgaggaaguccaggugcucgcccuugagcccgggaagaacccuagggcaguacagacgaagcccggccucuuuaaaaccaacaccgggacuaucggugccgugucccuugacuuuagccccggcacguccgggagccccaucgucgaccggaagggcaagguaguggggcuguacggcaacggcgucgucacccgcuccggggcguacguaagcgccaucgcccagaccgagaaguccaucgaggacaaccccgagauugaggacgacaucuuucggaaaaagcgccuaacuauuauggaucuucaccccggcgccgggaagacgaagcgauaccugcccgccauuguccgcgaggccaucaagcgggggcuacgcacccugauccuagcgccgacccgcgucguggcagcugagauggaggaagcgcugcgggggcugcccauccgcuaccagacccccgcgaucagggcugagcacacgggccgagaaaucguagaccucaugugccacgcuaccuucaccaugcgccugcugucccccguucgggugccgaacuacaaccucauuaucauggacgaggcccacuucaccgaccccgcgagcaucgccgcacggggauacauuagcacgcgcguggaaaugggugaggccgccggcaucuucaugaccgcgacgccgccugggagccgggacccguucccccagagcaacgcccccaucauggacgaggagagagaaaucccugagcggagcuggaacuccggccacgaguggguaaccgacuucaaggggaaaacggucugguucgugccgagcaucaaggccggcaacgacaucgcggccugucugagaaaaaacggcaaaaaggugauccaacuuucccggaaaaccuucgacagcgaguaugucaagacccgagccaacgauugggacuucgugguuaccacggacaucuccgaaaugggggccaacuuccgggcagagcgcguaaucgacccccggcgcuguaugaagcccguuauucucaccgauggagaggagcgggucaucuuggcagggcccaugccagugacccauucauccgcggcgcagcgccgcggccggaucgggcguaaucccaagaacgagaacgaccaguacaucuacaugggcgagccccuggaaaacgacgaggacugcgcccacuggaaagaggccaagauguugcuggauaacauaaacacacccgagggcauaaucccgagcauguucgagcccgagcgggaaaagguggacgccauagacggcgaguaccgcuugcggggcgaagcccgcaagacguucgucgaccucaugcggcgcggggaccugcccguguggcuggcauaccggguggccgcagagggaauaaauuacgccgaccgacguuggugcuucgacggcauaaagaacaaucagauccucgaagagaacgucgagguggagaucuggaccaaggagggggagcgcaaaaagcugaagccacgcuggcuggacgcgcgcaucuauuccgauccccucgcccugaaagaguucaaggaguuugccgccgggcgcaagacccugacgcuaaaccuuaucacggagaugggucgccugcccaccuucaugacccagaaggcgcgugacgcacucgacaaccuggccguacugcacacagccgaggugggcgggcgcgccuacaaccaugcauugagcgaguuacccgagacgcuggagacccuccuucugcucacccuguuggccaccguuacaggcggcaucuucuuguuucugauguccgggaagggcaucgggaagaugacccugggcaugugcugcaucauaacugcuucuauccuccugugguaugcccagauccagccucacuggaucgccgcgucgauaauccuagaguucuuccucauaguccugcugauccccgaaccagagaagcagcggacgccccaggacaaccaacucacauacguggugaucgcaauccugacggucguggccgccaccauggcgaacgagaugggguuccuggagaagaccaagaaggaucuuggacugggcucuaucaccacucaggagagcgaguccaacauccuggacaucgaccuccgcccggcgagcgccuggacccuguacgccguggccaccaccuucgugacacccaugcuucggcacuccaucgagaauagcuccgucaacgugagccuaaccgccaucgcgaaccaggcaaccguccuuauggggcugggccgcgguuggccacucuccaagauggacaucggcgugccccugcuugccaucgggugcuacagccaggugaacccgaucacccucacggccgcgcugcugcuccuggucgcucacuacgcgaucauuggcccuggccugcaggccaaggccacucgcgaggcgcaaaagcggacagccgccgggaucaugaaaaacccaaccguggacggcaucacggugaucgaucucgagcccaucccguacgaccccaaguuugagaagcaguuggggcaaguaaugcugcucgucuuaugcgugacccagguccugaugaugcgcaccaccugggcccucugcgaggcucugacucuggcgaccggccccaucuccacccucugggaggguaaucccggccgguucuggaacaccacgaucgccgugucgauggccaacaucuuccgcggcuccuacuuggccggggccggccuccucuucagcaucaugaagaacaccaccaacacacgucgcgggacgggcaacaucggcgagaccuuaggggagaaguggaaaucccggcuaaacgcacuuggcaagagcgaguuccagaucuacaagaaguccggcauccaggagguggaucgcacccuggccaaggaaggcaucaagcgcggggaaaccgaccaccacgccgucagccgcgguuccgccaaacugcggugguucguggagcgcaacauggugacgcccgagggcaaggucguggaccuagggugugggcgcggcggguggagcuacuacugcggcgggcugaagaacgugcgcgagguaaagggccuaacaaagggcggaccagggcacgaggagcccauccccaugagcaccuacggcuggaaccucgugcgguugcagagcggggucgacgucuucuucaccccucccgagaagugugacacgcugcucugcgacauuggcgagaguuccccgaaccccacuaucgaggcgggccgcacccugcgggugcugaaccucguggagaacuggcugaacaacaauacucaauucugcgucaagguccugaacccauacaugcccagcgugauugagaagauggagacccuccaacgcaaguacggaggcgcucugguccggaacccccugucccgaaauucuacgcacgaaauguacuggguguccaacgccaccgggaacaucgugagcuccguaaacaugaucagccgcaugcugaucaaccgguucaccaugaagcacaagaaggccaccuacgaaccggacguagaccuugggucuggaacgcgcaauauaggcaucgagaaugagauccccaaccuugacauuaucggcaagcggaucgagaaaaucaagcaggagcacgagaccucguggcacuacgaccaggaccaccccuacaagacaugggcguaccacgggucguacgagacuaagcagacgggcagcgcguccuccaugguuaauggaguuguuaaacuccugacgaagcccugggacgugauaccgauggugacccagauggcuaugaccgacacuacccccuucggccagcagcgcguauucaaggagaagguggacacccggacacaggagccuaaggaggguacgaagaagcugaugcgcaucaccgccgaauggcuuuggaaggaacucggaaagaagaagacgccccggaugugcacccgcgaggaguucacgcggaagguucgcuccaacgccgcucuuggggcgaucuucaccgacgagaacaaauggaaguccgcccgggaggccguagaggacucccgcuuuugggagcugguggacagggagcgcaaccuccaucuggaggggaagugcgaaaccugcguguacaacaugauggguaagcgggagaaaaaacucggcgaguucggcaaggcuaagggcagccgcgccaucugguacauguggcucggggcgcgguuucuagaguucgaggcguugggcuuccucaaugaggaccacugguuuucccgaggcaacagccugaguggcguggagggcgaggggcugcacaagcuaggcuacauccugcgggacgucuccaagaaagaggguggggccauguaugccgacgacaccgcgggaugggacacgcgcaucacacuggaggaccucaagaacgaagaaaugguuaccaaccacaugaagggcgagcacaaaaagcuggcagaggccaucuucaagcugacuuaucagaauaaggugguccgggugcagcgcccaacgccgcgcgggaccgugauggauauuaucucucgcaaggaccagcgcggcuccgggcaggucgggaccuacggccucaauaccuucacgaacauggaggcgcagcugauccggcagauggagggggaggguaucuucaagucaauccagcgcuugacggugaccgaggagaucgccgugcagaacuggcucgcgcgggucggccgcgagcggcugucccgcauggccaucucuggggacgacugcguggugaagccucuggaugaucgguucgccuccgcccucacggcgcugaacgacauggggaagguccgcaaagacauccaacagugggagcccagccggggauggaacgacuggacccaggugccauucugcucccaucauuuccacgaacugguaaugaaggacggccgcguccucgugguacccugccggaaccaggacgagcugaucgggcgcgcccggaucucacagggagccggguggagucugaaggagaccgccugccucggcaagucauacgcccagauguggacccugauguacuuccaucgccgggaccugcgacucgccgccaacgcuaucugcuccgccguccccagccauuggguccccaccucccggaccacguggagcauccaugccaagcacgaguggaugaccaccgaggacaugcuagccguguggaaccgcgucuggauacaggagaacccguggauggaggacaagacgcccguggagaguugggaggaggugcccuaccuuggaaaacgugaggaucaguggugcgggagccucaucggucuuacgagccgggcgaccugggcuaagaacauccagaccgccaucaaccagguacgcucccuaaucgggaacgaggaauacaccgacuacaugcccucaaugaagagauucagaaaagaggaggaggaggccggcgugcucugguga

SEQ ID NO: 25250 - RNA, 9876 nt, Artificial Sequence
  derived and/or modified CDS sequence (opt11) from DENV-2__EU482723__SS-prME
accgcaggagucaucauuauguugauccccacagcuauggcguuccauuugaccacccgcaacggggaaccgcacaugaucguggggaggcaagaaaaagguaagucgcugcuguucaaaaccgaggacggcgucaacaugugcacccuuauggcaauugacuuaggcgagcugugcgaagacaccauuaccuacaagugcccgcucuuaaggcagaacgaacccgaggauaucgacuguugguguaacucuacgagcaccugggugacuuacgggaccugcaccaccacgggcgaacaucggagggagaaacgcuccguugcucugguaccgcacguagggaugggccucgagacgcgcaccgagaccuggaugagcagugagcgcgccuggaagcacguccagcgcaucgagacuuggauccugcggcaucccggguucacuaucauggccgcuauccuggcuuacacgauagguaccacgcacuuccagagagcgcucaucuucauucuccuaacagccguggcgcccagcaugaccaugcgcugcaucggcauaaguaauagagauuuuguggagggugucucaggcggguccuggguggacaucguccucgagcacgggucgugcguuaccacgauggccaaaaauaaacccacccuggacuuugaacugauaaagacugaggccaagcaacccgcuacccucagaaaguacugcaucgaggcgaagcuaacgaacacuaccacagagucgagaugcccgacgcaaggggaacccucacugaaugaagaacaggacaagcgguucaucugcaaacacuccaugguggaccgcggcugggggaacggcugcggacucuucggaaaaggugggauagugaccugcgcuauguuuacgugcaagaagaacauggagggcaagguagugcugcccgagaaucuggaguacaccaucgugaucaccccacacaguggggaggaacacgccguuggcaacgacacuggcaagcacgggaaagaaaucaagaucaccccucaaucaagcaucaccgaggccgaacuuaccggcuacgggacggugaccauggagugcucgccgcggaccggacucgauuucaacgagaugguacugcuccagauggaagacaaggcguggcucguccacaggcagugguuccuggaccucccacucccuuggcugccgggcgcagacacucaggggaguaacuggauccagaaagaaacccucgugaccuucaagaacccccacgcaaagaaacaggacguuguaguccucgggucccaggagggggccaugcauaccgcacugaccggggccacggagauccagaugagcagcgggaaccucuuauucacagggcacuugaagugcagacuccgcauggacaagcugcagcucaaggguauguccuacuccaugugcacagggaaguuuaaaauagucaaggagaucgccgagacccagcacgguacaauagugauccgggugcaguacgaaggggacggcucccccugcaaaaucccguuugagauuauggaccuggaaaagcggcacguccugggccgucuuaucacggugaaccccaucguaacagagaaggauucgccaguaaauauugaggcggagccacccuucggcgacucguacauaaucauagggguagagcccgggcaauugaaguuaaauugguucaagaagggcaguuccauuggacagauguuugagaccacaaugcguggagccaagcgcauggccauucugggcgauaccgccugggacuucgguagccucggaggggucuucacuucuaucgggaaggcgcugcaccaggucuucggggcgaucuacggggccgccuucagcggagugaguuggaccaugaagauacugaucggggugaucaucacguggaucggcaugaacucgaggucuacaagccuguccguuagccucguacucguuggggucgugacccuguaccugggagugaugguccaggcggauagugguugcguggugagcuggaaaaacaaggaacuuaagugcggcaguggcaucuucaucaccgacaacguccauacguggaccgagcaguacaaguuccagcccgagagccccaguaaguuggcguccgcgauucagaaggcucacgaggaggggaucugcggcauccgcagcgucaccagacucgaaaauuuaauguggaagcagaucacaccggagcuuaaccauauccucuccgagaacgaggugaaacugaccauaaugacgggggacaucaagggcauuaugcaagccgggaagcgcucgcugcggccgcaacccacagagcuuaaguacaguuggaaaaccuggggcaaggcaaagaugcugagcacugaaucccacaaucagacauuccugaucgauggccccgaaaccgcggagugcccgaauaccaaucgcgcuuggaacagccucgaggucgaggacuacggguucgguguguucuccaccaacauauggcugaagcugcgugaaaagcaggacguguuuugcgauuccaagcucaugagcgccgcgauuaaagacaacagggccgugcacgcggauaugggguauuggauagagagcgcccucaacgacacuuggaagauggaaaaagccuccuuuaucgagauuaagucaugccacuggccaaagucacauacccuguggagcaacggcguccuagaauccgagaugaucauacccaaaaauuucgcuggccccgugagucaacacaacuaccggccgggcuaucacacccaaaccgccggacccuggcaccuggggaaacuugagauggacuucgauuucugcgagggcacgacugucgucguaacugaggacugcgggaaccgcggaccuagccuccgaacgacgaccgcgucuggcaagcugaucaccgaaugguguugccgcagcugcacccugcccccgcuacgguaccguggggaagacgggugcugguaugggauggagauuagaccccuaaaggagaaggaggaaaaucuggucaauucucuggugacggccggacacgggcagaucgauaacuuuagccuugguguccugggaauggcacucuuccuggaggagaugcuacgcacucggguagggacuaagcacgccaucuuguuaguggcgguguccuuugucacguuaauuacagggaauaugagcuuccgcgaccucgggcgugugauggugauggucggcgcgacaaugaccgaugacaucgggaugggcgucacguaccucgcccugcucgcagcauucaaggugcgucccacguuugcagcaggccugcugcuccguaagcugaccuccaaagagcucaugauggcuaccaucgggaucgcccuccugagccaguccaccauaccggagacgauccuggaguuaaccgacgcgcuggcacuaggcaugaugguuuuaaagaucgugaggaauauggagaaauaccagcuggcagucaccaucauggccauaucaugcguuccgaacgccgugauacuucagaaugcguggaaaguaaguuguaccauccucgcggcgguuucggugagccccuugcuguuaacguccagucaacaaaaagccgauuggauaccccuggcguuaaccaucaaggggcugaaucccacagcgaucuucuugacuacauuaagccgcaccuccaagaagcgguccuggccucucaacgaggccgugauggccgugggcauggugucgauccuggccagcagccuucugaaaaacgacauccccaugacaggcccgcugguagccggagggcuguuaacuguuuguuacguacucaccggucgcucggcggaccuggaacucgagcgugcagcagacgucaagugggaagaccaagccgagaucuccggguccagccccauccuauccauaacuaucagcgaggacgguagcaugucuaucaagaacgaggaggaagaacacacccucaccauccucauccgcacuggccuucuggugaucaguggcguguuuccggucagcauccccaucaccgccgcggcaugguaccucugggagguuaagaagcaacgggcgggugugcugugggaugucccuucgccgccucccgugggcaaagccgaacucgaggacggggccuaucguauaaagcagcgggguauauucggguacucccagauuggagcgggcguguacaaggaaggcacuuuccacaccauguggcacgucacaaggggcgccgugcucaugcaccgggggaagcgcaucgagccgucgugggcugacgugaagaaagaccuuaucucguauggaggaggguggaagcuggagggcgaauggaaggagggugaggagguccaggugcucgcguuggagcccggcaaaaacccccgggcggugcagacgaagcccgggcuauuuaagacuaacacaggcacuauuggggcggucucccucgacuucagccccgggacguccgggagccccaucguggaccgcaaagggaaaguggugggacuguaugggaacgguguggugacgcgauccggagccuacgucagugccaucgcccagacugagaagaguaucgaggauaaucccgagaucgaggacgacauuuuccggaagaaacggcugacuaucauggaccugcaccccggagcgggaaagacgaagcgcuaucugcccgccaucguucgggaggccauuaagcgcggccuacgcacccugauuuuagccccgacccgggucguagcagcugaaauggaggaggccuugagagggcugcccauacgguaccagaccccagccauccgcgcagaacacacgggucgggagauuguggaccucaugugccacgccaccuucaccaugcgcuugcuguccccggugcgggucccuaacuacaaucucaucaucauggacgaggcgcacuucaccgaccccgccuccaucgcggccagaggcuacauuaguacgcguguugagaugggugaggccgccgggaucuuuaugacugccacaccgcccgguagccgcgacccguucccccaaaguaacgcaccgaucauggaugaagaacgggaaauccccgaacgaucuuggaacagcgggcacgagugggugaccgacuuuaagggaaaaacggucugguucgugcccucgauuaaggccgggaacgacaucgcagcuugccugaggaagaacggcaaaaaggugauccaacuaucucgcaagacguucgauagcgaguacguaaaaacccgggcgaacgacugggauuuuguggugaccacggacaucuccgaaaugggcgccaacuucagggcagagcgugucaucgacccccgccgguguaugaagccaguuauccucacggauggggaggaaagggugauauuagcgggaccgaugccuguuacccacagcagcgccgcacaacgucgagguagaaucggccgaaaucccaaaaacgaaaacgaucaauauauuuauaugggggagccacucgagaaugaugaggauugcgcgcacuggaaggaggccaaaaugcuucuggauaacaucaacacgcccgagggcaucaucccgucuauguucgagcccgagcgagagaagguggacgcgaucgacggggaguaucgccugcgcggggaggcucggaaaacguucguugaccuaaugagacggggcgauuugccaguaugguuggcauaccguguggccgcugaggguaucaacuaugcggaccgccgcuggugcuuugacggcaucaaaaacaaccaaaucuuagaggagaacguggagguagagaucuggacaaaggagggugaaaggaagaagcugaaaccucgguggcuggaugcucggaucuacagcgauccccucgcccuaaaggaguucaaggaguucgccgcaggucggaagucucucacgcuuaaccugaucacagagaugggccgacuccccacguucaugacccagaaggcccgcgacgcccucgauaaucuggcggugcugcacacagccgagguagggggccgugcguauaaccacgcccucuccgagcuccccgagacacuggaaacgcuccuacugcuuacccugcuggcuaccgugacugggggaaucuuccuuuuccugaugagcggaaaggggaucgguaagaugacacuagggaugugcugcauaaucaccgccuccauccucuugugguaugcacagauucaaccgcauuggaucgcggccagcaucauccuggaguucuuucucauaguguuauuaaucccagagcccgagaagcagcgcacgccacaagacaaccagcuuacuuacgucguaaucgccauccucaccguggucgccgccaccauggcgaacgaaaugggcuuccuugagaagacgaaaaaggaccucgggcugggcucuaucacaacccaggaaucugagagcaacaucuuagacaucgaccuccggccggccuccgcuuggacgcuguaugccgucgccacaacguuugugacccccaugcuccgccauagcaucgagaacuccucugugaaugugucacucacggcgaucgccaaccaggccacggugcugaugggccuggggagaggcuggccccucuccaagauggauaucggcgucccacugcuggccaucgguuguuacucccaaguaaacccaauaacauugaccgcggcccugcuguuacugguggcccacuacgcaaucaucggucccgguuuacaggcgaaggcgacccgugaggcccagaagcgcacugccgccggaauaaugaagaaccccacugucgacggaaucacgguaaucgaccucgagccuauuccguacgauccgaaguucgagaagcaacugggccaggugaugcugcucguguuaugcgugacacagguucugaugaugcggacaacgugggcucucugugaggcccuaacccuggccacggggcccauaucaacacucugggaggggaaccccgggcgguuuuggaacacuaccauagcggucucuauggccaacauauuccgagguagcuaccuugcaggcgccgggcuccuguuuagcaucaugaagaacacgacaaacacccgccggggcaccgggaauaugggcgaaacgcugggcgagaaauggaaguccagacugaacgcccucgggaaaucagaguuucagauauacaagaaauccggcauccaggaggucgaccguacccuagccaaggaggggaucaagcgcggcgagaccgaccaccaugcggucucccggggaagcgcgaagcugcgaugguuugucgagcggaacaugguuaccccggagggcaagguggucgacuugggcugcgggcgcggcgggugguccuacuauugcgggggacuuaagaacgugcgggaggugaagggacugacgaaggguggaccgggccaugaggagccaauacccaugagcaccuacggguggaaccucgugaggcuacagagcgggguggacguguucuucacacccccugagaagugcgacaccuugcucugcgacaucggggaguccagucccaaccccacgaucgaagcagggagaacccugaggguccugaaccucgucgaaaacuggcuaaacaacaacacgcaguucugcaucaaggugcucaacccauacaugcccuccgucaucgagaaaauggaaacucuccaacguaaguacggcggagcccuggugcgcaacccccugagccgcaacucuacccacgagauguacugggugaguaacgcuacgggcaauaucguuuccagcgugaacaugaucuccagaaugcugaucaaccgauuuaccaugaagcauaagaaggccacauacgaaccggacguggacuuggggagcggcacccggaauauaggaaucgagaacgagauccccaaccuggacaucauuggcaagcgaauagaaaagauaaagcaggagcacgaaacuucauggcacuaugaucaggaccacccuuacaaaacuugggcguaccauggcucuuaugagacaaagcagacgggcucugccagcaguauggucaauggcguugugaaacugcucacgaagcccugggacguaguuccgauggugacccagauggccaugacugacaccacaccguucggucagcagagggucuuuaaggaaaagguggacacccggacacaggaaccaaaggaggguaccaagaaguuaaugcguaucaccgcugaauggcuauggaaggagcucggcaaaaagaagacgcccagaaugugcacucgcgaagaguucacgagaaagguaaggagcaacgcggcacuaggcgccaucuucacagacgagaacaaauggaaauccgcacgcgaggccgucgaagacagccgguucugggaacugguggaccgugaacggaaccuucaccuggaaggcaaaugcgagacaugcgucuacaacaugauggggaagcgggagaagaaacugggcgaguuugguaaagcaaagggcucccgcgcgauuugguauauguggcugggcgcccgguuucuggaguucgaggcccugggguuucugaaugaggaucauugguucucgcggggaaacucccugagugggguagaaggcgaggggcugcacaaguuaggcuacaucuuacgggacgugucaaagaaagaggguggggcgauguacgcggaugacaccgccgggugggacacccggaucacguuggaggaccucaagaaugaggaaauggucacgaaucacaugaagggggagcacaaaaagcuagcagaagccaucuuuaagcugaccuaccagaacaaggugguccgcguccagcguccuacaccccggggcaccgucauggacaucaucucccgcaaggaccagcgugggagcggccaggugggcacuuacggacucaacacuuucacgaacauggaagcccaacugauacgccaaauggagggggaagggaucuucaagucgauccagcggcuaacagucacggaggaaaucgccguccagaacuggcucgcccggguugggagagaaagacuuucgcggauggccaucucaggcgacgacugugucguuaaaccgcuggacgaccgcuucgcuucggcacucaccgcgcuaaacgauaugggaaagguacggaaggacauccagcaaugggagcccagucguggauggaacgauuggacacaagucccguucuguagccaccacuuccacgagcuggugaugaaggacgggcgggugcucgucgugcccugcaggaaccaagaugagcugaucggccgggcccgaaucagucaaggagcugguuggagccugaaggagacggccugcuugggcaaauccuacgcccagauguggacgcugauguacuuucacaggagggaccugcggcuggccgcgaacgccauuuguagcgccgugcccucucauugggucccaacgucgaggaccaccuggaguauccacgccaaacacgaguggaugaccaccgaagauauguuagcuguuuggaauaggguuuggauccaggagaauccguggauggaagacaaaacgcccguggagagcugggaagaggucccauaucuagggaagcgggaggaucaauggugcggcagccucaucgggcugacgucucgcgccacgugggccaaaaacauacagaccgcaaucaaucaggugcggagcuuaauaggcaacgaggaguacaccgacuauaugccaaguaugaagcgauuccguaaggaagaggaggaagcgggaguccucugguga

SEQ ID NO: 25251 - RNA, 9876 nt, Artificial Sequence
  derived and/or modified CDS sequence (opt11) from DENV-2__EU482724__SS-prME
accgcgggagugaucaucauguuaauccccaccgccauggcuuuccaccucacaacccgaaacggagagccccacaugaucgucgggcgccaggagaaggggaagucucugcuguuuaagaccgaggacggggugaacaugugcacacuuauggccaucgaccugggagaacugugcgaggacaccauaacauacaaguguccucugcugcgccagaacgagcccgaggacaucgacuguuggugcaacucuaccagcaccugggugaccuacgguacguguaccacgacgggcgagcaccgucgugagaagagauccgucgcccuagugccccacguugggaugggccucgagacccggaccgagaccuggaugucuucagagggcgcauggaagcacguccagcggaucgagacguggauccuucgccacccgggcuucaccauaauggccgcgaucuuggccuauaccaucgggacgacucauuuucagcgggcauugaucuucauccugcucacggccguggcgccgagcaugaccaugagguguauuggcaucuccaacagggauuucguggagggcgucagcgguggcagcuggguggauauugugcucgagcacgguagcugcgucaccacgauggccaagaacaagcccacgcuggacuucgagcugauaaagaccgaggccaagcaaccugccacgcuccgaaaguauuguaucgaggccaagcugacgaacacgaccaccgagucucgguguccgacucagggcgagcccucccugaacgaggaacaggacaagcgcuucaucugcaagcauuccaugguggaccggggcuggggcaacggcugcggccuguucggcaagggggggauaguuaccugugcgauguuuaccuguaagaagaacauggagggcaaggugguccugcccgagaaccuggaguacacaaucgugauuacgccacacuccggggaagagcaugccguggggaacgauaccgggaagcacggcaaggagaucaagaucacuccgcaguccagcaucaccgaagcugaauugacaggauaugggacggugacuauggagugcagcccccggacgggccuugauuucaacgagaugguucuguugcaaauggaggacaaagcauggcugguccaucggcaaugguuccuugaccucccccucccuuggcugccgggggcagauacccagggaucaaauuggauucagaaagaaacucucguaaccuuuaagaacccacaugcgaagaaacaggaugugguuguguuaggaucucaggaaggcgcaaugcacaccgcccugaccggggccacggagauccagaugagcagcggcaaccuacuguucaccggucacuugaagugucgacuccgcauggacaaacugcagcucaaggggaugucuuacagcaugugcaccggcaaguucaagaucgugaaggagaucgccgagacccaacacgggacgaucgugauccgcgugcaguacgagggcgacggauccccuugcaagauccccuuugaaaucauggaccuugaaaaacggcacguccuaggcagacugaucaccgucaacccaaucgugaccgagaaagauagccccgucaacaucgaggcggagccucccuuuggcgacaguuauaucauuaucggggucgagcccggccagcuuaagcugaacugguucaaaaagggcagcuccaucggccagauguucgagaccacuaugcgcggcgcuaagcggauggcaauucugggggacacagccugggauuucggcagccucgggggaguauuuaccaguaucgggaaggccuugcaccaggucuucggagcaaucuacggcgccgccuuuucagggguguccuggacaaugaaaauccugaucggcgucauaaucacguggaucgguaugaacucucgcucuaccucacuauccguaagccucguuuuagugggcgucgugacccuguaccuaggugugaugguacaagccgacaccggcugcgugguguccuggaagaauaaggagcugaagugcgggucuggaaucuucauuaccgacaacguccacaccuggacggagcaguacaaguuccagccggaaucucccaguaagcuggcgagugccauacagaaggcccacgaggagggcauuuguggaauacgguccguaacccgcuuggagaaccugauguggaagcagaucacgcccgaguugaaucacauccucagcgagaacgaggugaaacugacaauuaugaccggcgacauuaagggcaucaugcaggccggcaagcggucccuuaggccgcagccuaccgagcucaaguacuccuggaagacguggggaaaggccaagaugcuuucgaccgagagccauaaccagaccuuccugaucgacgggccagaaaccgccgagugcccgaacacaucccgggccuggaauagccuagagguugaggacuacggcuucggcguguucucgaccaacaucuggcugaagcugcgcgagaagcaggacguguucugcgacagcaagcuuauguccgcagcuaucaaggauaaccgggccguccacgcggacaugggcuacuggaucgagucggcccugaacgacaccuggaagauggagaaggccuccuucaucgaaaucaagagcugccacuggcccaaaucccacacccuguggagcaacggcguacuggaauccgaaaugauaauccccaagaacuucgccggccccgugagucagcacaauuaccgcccggguuaccacacccagacggccgggcccuggcaccuuggcaagcuugaaauggauuucgauuucugugagggaacaacugucguagugacugaggacugugguaacagaggcccaagccuccgcacgacgaccgcgagugggaaacugaucaccgaauggugcugccggagcugcacgcugccuccgcuucgcuaccggggugaggacgggugcugguauggcauggagauacgccccuuaaaggaaaaggaggagaaucuggucaacuccuuagugaccgccgggcacggccaaaucgauaacuucagccugggugugcuggggauggcgcuguuccuggaagagauguuacggacucgcguuggcacuaaacaugccauuuuguuaguggcagugucauucgucacgcugauaaccgggaauaugucuuuccgggaccucggcagagugaugguuaugguuggggcuaccaugacagacgacaucggaaugggcgugacuuaccuggcacugcuugccgcguucaaggugcggcccaccuuugcagccgggcugcugcuccgaaagcugaccucgaaggaacucaugauggcuaccauaggaaucgccuugcugucgcaaucgacaauacccgagaccauccuagagcuaaccgacgcccuggcgcuagguaugaugguccucaagaucguacguaauauggaaaaguaccagcuugccguaacaaucauggcuaucagcugcgucccgaaugccgugauccugcaaaacgcuuggaagguguccugcacaauccucgcggccgucagcgugagcccccugcugcucacuagcucgcagcagaaggccgauuggaucccauuagcacugaccaucaagggccucaaccccaccgcgaucuuccugacgacacuuucccgcaccagcaagaagcgcucauggccgcucaacgaggccguaauggcugugggcaugguguccauccuggcaagcucgcuguuaaaaaaugauauacccaugaccggaccucuagucgccggcggacugcucacgguaugcuacguccugacuggccgauccgcggaccuugagcuugagcgcgcggccgacgucaagugggaagaccaggccgagaucaguggcuccagcccuauccugucgaucaccauuagcgaggauggcuccaugagcaucaagaacgaagaggaggagcauacccugacgauacucauccguaccgggcuguugguaaucucagggguguucccggucagcauacccaucaccgccgcugccugguaccucugggaggugaagaaacaacgcgccggugugcugugggacguccccaguccgccgcccgugggcaaggccgaacuagaggacggugccuacaggaucaagcagagaggaaucuucggcuauucgcagauaggcgcagggguguacaaggagggcaccuuccacaccauguggcacgugacgaggggggcggugcucaugcaccgcggcaagaggaucgagcccucuugggccgaugugaagaaagaccugaucucguaugggggcggcuggaaguuggagggggaguggaaggagggcgaggaaguccagguacucgcccuggagcccgggaagaacccccgcgccgugcagaccaagcccggccuguucaagaccaacacggggacgaucggugcggugucccucgacuuuagccccggcaccucggggagccccaucguggaccggaagggcaagguagucggccuguacggcaacgggguggugacgcggucgggggccuacgucagcgcuaucgcgcagaccgagaagucaaucgaggacaacccggaaaucgaagaugacauauuccggaagaaacgccugacgaucauggaccuccaccccggcgcggggaagaccaagcgguaccugccggccauuguacgcgaggccaucaagcgcggucugcgcacccugauccucgccccgacccgcguggucgccgcggagauggaggaggcccugcgggggcugcccauccgcuaccagacucccgccauccgggccgaacacaccgggcgcgagauuguggaccuaaugugccaugccacauuuaccaugcggcuucuguccccugugagagucccaaacuacaaccucauaauuauggacgaggcgcacuucacggacccggcaagcaucgccgcccggggcuauauuucaacgcgcguggagaugggcgaggcugcggggaucuucaugacggccaccccgcccgggagccgggauccauucccccaauccaacgcccccaucauggacgaggaacgcgaaauccccgagcggaguuggaauuccggccaugagugggugacggacuuuaaggguaagaccgucugguuugugccgagcaucaaggcggguaacgacauagcggccugucugcgcaaaaauggcaagaaggugauccagcuaagucggaagaccuucgacagcgaguacgugaaaaccagggccaacgacugggacuucguggugacgacggacauaucugagaugggggccaauuucagagcugagagggucaucgacccccggcgcugcaugaaaccggugaucuuaaccgacggcgaggagcgggugauccuggcagggccaaugccuguaacccacuccucagcggcccagcgucgcggccgcaucgggcggaaccccaagaacgagaacgaccaguauaucuauaugggugagccccuggagaacgaugaggacugugcccacuggaaggaggccaagaugcuccuggacaacaucaacacgccagagggaaucauuccgagcauguucgaacccgagcgggaaaaaguugacgcaauagauggggaguaucgucugcgcggagaggcccgcaagaccuucguggaccucaugcggcgcggagacuugcccgucuggcuggcuuaccggguggccgccgaaggcaucaauuacgcggacaggcgguggugcuucgacgggaucaagaacaaccagauccucgaagagaacguagaggucgaaaucuggaccaaggaaggcgaacgcaaaaagcugaagccgcggugguuggacgcucguaucuacagugacccauuggcgcucaaggaguucaaggaguucgcugcgggccggaagucacugaccuugaaccugaucacggagaugggccgacugcccaccuucaugacccaaaaggcccgggaugcccucgauaaccuugcgguccuucacacggccgaagucggcgggcgcgcuuauaaccacgcccuuuccgagcugcccgagacacucgagacccuacugcugcucacccugcuggccaccgugacgggcggcaucuucuuauuccugaugagcgggaaggggaucggcaagaugacccuggggaugugcuguaucauuaccgccucgaucuugcugugguacgcccagauccagccgcacuggaucgcggcaagcaucauacuggaauucuuccucaucgugcuguuaauccccgagcccgagaaacagcggacgccccaggacaaucagcucacuuacgucgugaucgccauccuaacgguggucgccgcuacgauggccaacgagaugggguuccuggagaagacaaagaaggaccucggccugggaucgaucaccacucaggaguccgagagcaacauccuggacaucgaucuccgcccggccuccgccuggacccuguacgcuguagccaccaccuucgucacgcccaugcuacggcauucaaucgaaaauuccagcgugaacgugucccuuaccgcgaucgccaaccaggccacgguguuaauggggcugggucgcgguuggccacucucuaagauggacauaggcgucccucuccuggccauaggguguuacucccaggugaauccuaucacauugacagcggcccugcugcuccugguugcucacuacgccaucaucggaccgggccugcaggcgaaagcgacccgcgaggcccagaagcggaccgccgccgggaucaugaaaaaccccaccgucgauggcaucacgguuaucgaucuugagcccauccccuacgaccccaaauuugaaaagcagcugggccaaguaaugcugcucguccugugugugacccagguuuugaugaugcgcaccaccugggcccucugcgaggcgcuuacccuggcgaccggccccaucagcacccucugggaggggaacccgggucgcuucuggaacacaacgaucgcgguauccauggcuaacaucuuccgcggaagcuaccuagccggagcgggccuuuuauucuccauaaugaagaauaccaccaacacacggcgcgggacgggcaacauuggcgagacccugggggagaaguggaaguccaggcugaacgcccucgggaaauccgaguuccaaauuuauaagaagagcgggauccaggagguugaccgcacccuggccaaggaaggcaucaaacgaggggagaccgaucaccacgcggugagucgcggcagcgcgaagcugcggugguuugucgagcgcaacauggugacgccggaggggaagguugucgaccucgggugcggcaggggugggugguccuauuacugcggcggacugaagaacgugagggaggugaaggggcucaccaagggagggccuggacaugaggagcccauacccaugagcaccuacggcuggaaccuagugcgacugcagagcgggguugacguuuuuuuuaccccgccagagaaaugcgacacgcuauugugcgauauuggcgaguccagccccaaucccaccaucgaggcuggccgcaccuugagggucuuaaaucucguggagaacugguuaaacaacaacacacaguuuugcgugaaggucuuaaacccguacaugcccagcgugauugagaaaauggagacccuccagaggaaguaugggggcgcgcuuguucggaauccccugagccgcaacuccacccacgagauguacugggucagcaacgcuaccgggaacaucguguccagcgucaauaugauaagcaggaugcugaucaacagauuuaccaugaagcacaagaaggccaccuacgagccggacguugaccucggcucagguacccgcaauauuggcauugaaaacgagauaccaaacuuagacaucaucgggaagcggauagagaaaaucaaacaggagcacgagacguccuggcauuacgaccaggaccacccguauaaaaccugggcauaccacgggagcuaugagacaaagcagacgggcuccgccagcuccaugguuaacgggguggucaagcuuuugacgaagcccugggacguggugccgauggucacccagauggccaugacagacacgacuccuuuuggccagcagcggguguuuaaggagaagguggacacccggacucaagagccgaaggagggcacgaagaagcugaugcguaucacugccgaguggcuguggaaggagcucgggaagaagaagacgccccgcaugugcacccgggaggaguucacgcggaagguacggagcaacgccgcccugggggccaucuucaccgaugagaacaaguggaaaagcgcccgugaggccgucgaggacagcagguucugggagcuggucgaucgggagcgcaaccuccaucuggaggggaagugcgaaaccugcguguauaacaugaugggcaagcgggagaagaagcugggugaauucggcaaggcaaaagggucucgcgcgauuugguauauguggcucggggcccguuuccuggaguuugaagcucugggcuuccucaacgaggaccacugguuuucacgcgguaacagcuuauccgggguggagggggagggacugcacaagcuagguuacauucuccgggacgugucgaaaaaagagggcggggccauguacgcggaugacacugcagggugggacacucgcaucacccuggaggacuugaagaacgaggaaaugguaaccaaucauaugaaaggcgaacauaaaaaacuggcugaggccauauucaagcugaccuaucaaaauaagguugugcgggugcaacgaccaacgccccgcgggaccguaauggacauaaucucccggaaggaccagcgagggucggggcagguugggaccuauggccucaauaccuucacgaacauggaggcgcaacugauacgucagauggagggggaaggaauauucaagucgauccagagauuaacagugacggaggagauagcgguucagaacuggcucgcccgggucggccgcgaaaggcucucccgcauggccaucaguggagacgacugcguggugaagccccucgaugaccgauuugccucggcacuuacagcgcugaaugacauggguaagguacgaaaagacauccagcaaugggagccgucucgaggguggaacgacuggacacaggucccguucuguagccaccacuuccaugagcuugugaugaaggacggcaggguccucgugguucccugccggaaccaagacgagcugaucgggcgggcaaggaucagucagggcgccggcuggagucucaaagagacggcaugcuuaggaaaguccuacgcccagauguggacccugauguacuuccaucgcagggaccugcgacucgcggcgaacgcaauaugcagugccguccccagucacugggugcccaccucucggacgacgugguccauccacgcuaagcacgaguggaugaccaccgaggacaugcuggcuguguggaaccgugucuggauacaagagaacccguggauggaggauaagacccccguagagucuugggaagaagugccauaccuaggaaagcgagaggaccaguggugugggagcuugauuggccuaacgagucgugccaccugggccaagaacauccagacagccaucaaccaggucagaagccugauuggcaacgaagaguacaccgacuacaugccaucgaugaagcgguuccgcaaagaggaggaggaggcgggcgugcugugguag

SEQ ID NO: 25252 - RNA, 9876 nt, Artificial Sequence
  derived and/or modified CDS sequence (opt11) from DENV-2__EU482725__SS-prME
accgccggggugauuauaauguugauccccaccgcuauggcguuucaucuuaccacccggaacggugagccucacaugaucgucggccggcaggagaaggggaagucucugcuguucaagaccgaagacggggugaacauguguacacucauggcgaucgaucucggggagcugugcgaggacaccaucacuuacaaaugccccuuacugaggcagaacgaacccgaagacauagacugcuggugcaacagcaccagcacuugggugaccuacggaaccugcaccaccacgggcgagcaucggcgcgagaagcgguccgucgcacugguuccccaugugggcaugggucucgagaccaggacagagacauggaugucgucggaaggggccuggaagcauguccagcggaucgagacguggauccuuagacauccgggauucaccaucauggccgcgauccuugccuacaccaucgguaccacacacuuccaacgggcacuuaucuucauucuguugaccgccgucgcgccuagcaugaccaugcgcugcaucggcaucuccaaccgggacuucguggagggcgucucagggggcuccuggguggauaucguguuagagcacgggagcugcguuacuaccauggccaagaacaagccuacgcuggacuuugagcugaucaagacugaggccaagcagcccgccacucucagaaaguacugcauagaagccaaacugacgaauaccaccacugaaucccgauguccuacucagggggagcccagccugaaugaggagcaagacaagcgcuucaucugcaagcacucaaugguggaccggggaugggguaacgggugcggccuguucggcaagggcgggauugugaccugcgccauguucacgugcaagaaaaacauggaaggcaaggucguccuaccugagaaccucgaauacaccaucgugaucacaccccacagcggggaggagcacgccgucggcaacgacaccgggaagcacggaaaggagaucaagaucaccccgcaguccagcaucaccgaggccgagcucacaggguacggcacggugacuauggagugcucuccccggaccggcuuagauuucaacgagauggugcugcuucaaauggaggauaaggccuggcucguccaccggcagugguuucuggaccucccccugcccuggcugcccggggccgauacccaggguagcaacuggauccaaaaggagacucucgugaccuucaagaacccccacgcgaagaagcaggauguggucguguuagguucccaggagggugccaugcauaccgcgcugaccggggccacugagauccagaugaguaguggcaaccuccuuuucaccggccaucugaagugucgcuuacggauggauaagcuucaacugaaggguauguccuacagcauguguacaggcaaauucaaaaucgugaaggagaucgccgagacccaacacgggacuaucgugauccgcguccaauacgagggcgacggcuccccuugcaagaucccauucgagaucauggaccucgagaagcggcacguccugggaaggcugaucacggucaacccgaucgucaccgaaaaggacagccccgucaacaucgaggcggagccgccuuuuggcgacuccuauaucaucaucgggguggagccaggucaacucaagcugaacugguucaagaaggggagcuccaucggccagauguucgagacuacgaugcgcggcgccaagcggauggccauccugggagacacagcaugggacuucggcucucucgggggcguguucaccagcaucgggaaagcccuccaccaggucuucggcgcgaucuacggcgccgcuuucucagggguguccuggacaaugaagauccugaucggcgugaucaucacguggaucggcaugaacagccgcuccaccagccugagcgucagccucgugcuggugggggucgugacucuguaccucggagugaugguccaggcugacaccggcugcguggugucauggaagaacaaggagcugaagugcgggagcgggauuuucaucacagacaacguccacacauggaccgagcaguacaaauuccaacccgaaucccccagcaagcuugcaagcgccauccagaaggcccacgaagagggcaucugugggauccgguccgugaccagacuugaaaaccuaauguggaagcagauuacuccagagcugaaccauauccugagcgagaacgaggugaagcugaccauaaugacuggugauauaaaggggaucaugcaagcugggaaacggucccugcguccgcagcccacggagcucaaauacagcuggaagacguggggcaaggccaaaaugcugucuaccgaaucccacaaccagacuuucuuaauagacgggccggagaccgcggaguguccgaauacgaaucgagccuggaacucccucgaggucgaggacuacgguuucggcguguucucaaccaacaucuggcugaagcugcgcgagaaacaggacguguucugcgacucaaagcucaugucggccgcgaucaaggauaaccgcgcaguccacgcggauaugggcuacuggaucgaauccgccuuaaaugauacuuggaagauggagaaagccaguuucaucgagaucaaguccugccauuggcccaagagccacacccuaugguccaacggcgugcucgagagcgagaugaucauccccaagaacuucgccgggccggugucccagcacaacuaccgcccgggguaccacacucagacggccgggcccuggcaccugggcaagcuggagauggacuucgacuucugcgaagggaccaccgucguggugaccgaggacugcggaaaucggggcccgagccuccguacgaccacagcguccgggaagcugaucaccgaguggugcugccgauccugcacgcuucccccgcuucgcuaucgcggggaagacgggugcugguacgguauggagauccgcccccugaaagagaaggaagagaaccuugucaacagucucgugaccgccggccacggucaaaucgacaauuucucccuaggcgugcugggcauggccuuauuccuggaagagauguuacggacucgcgugggcacuaaacacgccauucuucugguggcgguguccuucgucacacugauuaccggcaacauguccuucagagaucucggccgcgugauggugauggucggggcuaccaugacagacgacaucgggaugggcguaacguaccuggcccugcucgcggcuuucaaggugcgccccaccuucgcggcugggcugcugcucaggaagcucaccagcaaggagcugaugauggccacaaucggcaucgcccuccuaucccaaagcacgaucccugagacuauccuugaguuaaccgacgcccuggcgcugggcaugaugguccucaagaucgugcgcaauauggagaaguaccagcucgcggugaccaucauggccaucucguguguuccaaaugcagugauucugcagaacgccuggaagguauccugcacgauccucgcagccgucuccgugagccccuuauuacucaccuccagccaacagaaggccgauuggaucccccuggcccugaccauuaagggcuugaaccccaccgcaauauucuuaacaacccugucccggaccaguaaaaagcgaucauggccgcugaaugaggcugucauggccguggguauggugagcauacuggccucaucucugcucaagaaugauauccccaugaccgggcccuuggucgccggcggucugcucacgguguguuacguucuuacggggagaagcgcugaccuggagcucgagagggccgccgacguaaaaugggaggaucaagccgagauaaguggaagcucccccauccugagcaucaccauauccgaggacggguccauguccaucaagaaugaggaagaggaacauacccugacuauucucauucggaccggccugcucgugaucagugggguguucccggucucgauacccaucaccgcggcggccugguaccucugggaggugagaaagcagcgugccggcguccugugggauguucccagcccgccacccguggggaaggccgagcuggaggacggcgccuaccgcauaaagcagcgcgggaucuucggauauucacaaaucggcgcgggggucuauaaggaggggaccuuucauaccauguggcacgucacgaggggggcggugcucaugcaccgggguaaacgcaucgagccgagcugggccgacgugaagaaggaccuaaucucauacgggggcggcuggaaguuggagggggaguggaaggagggugaagagguccagguacucgcccuugagccagggaagaacccgcgggccgugcagaccaagccgggacuguuuaaaaccaacaccggcacgauaggcgcggugagccucgacuucucccccggaaccagcgggucucccaucguggaccgcaaggguaagguggucggucucuacggcaacggaguugugacacggucgggggcguacgucagcgccaucgcccagacugaaaaauccaucgaggacaacccagagaucgaggacgacauuuucaggaagaagcggcugaccauuauggaccuccaucccggcgcggggaagaccaagcgcuaccugccagcaaucgugcgggaggccaucaagcggggccugcgcacuuuaauucucgcgcccaccagaguggucgccgcggagauggaagaagcgcugcgcgggcugccaauacgauaccagacgccggccauccgcgccgagcauaccggccgggagauaguagaccucaugugucaugccaccuucaccaugcgccuccugagccccgugcgggucccgaacuacaaucucaucaucauggacgaggcgcacuucacggacccugcgucaaucgccgcccgcggcuacaucagcacccguguggagaugggcgaggcagcaggcaucuuuaugaccgccacgccgcccggguccagggauccauucccacagagcaacgcccccaucauggacgaagaaagagagauccccgagcgcuccuggaacagcggucacgaguggguuacggacuucaaggguaagaccgucugguucgugccgagcaucaaggccggcaacgacaucgcugccugucuacguaagaacggaaagaaggugauccagcugucccguaagaccuuugacuccgaguacgucaagacccgggccaacgacugggacuucguggugacuaccgauaucagcgagaugggggcaaacuuccgcgccgagcgggucauugauccccgccggugcaugaaacccgugauucugaccgacggugaggaaagagugauuuuagcggggcccaugccugucacccacucgagcgccgcacaacgccguggccgcaucggacggaacccaaagaacgagaacgaccaguacaucuacaugggcgagccccuagagaaugacgaggacugcgcucacuggaaggaggcgaagaugcuccuggacaauaucaacacgcccgagggcaucaucccguccauguucgagccggagcgcgagaaagucgacgcgauagauggggaauauagacuccgcggcgaggcccggaagaccuucguggacuugaugcgccgcggggaccugcccguuugguuagccuaccggguggccgccgaagguaucaacuaugcggaccgccgcuggugcuucgacgguauaaagaacaaccaaauccuggaggagaacguugagguggagaucuggaccaaggagggcgaacggaagaaacugaagccgcgcuggcuggacgcgcggauuuacagcgacccccuagcccugaaagaguucaaagaguuugccgcggggcgcaagucccuaacccucaaccugauaacggaaauggggcggcugccuaccuucaugacccaaaaggccagggaugcacuagacaaccuggccgugcugcacaccgcagaaguuggcgggcgggcguacaaccacgcucuuucggagcugccggagacgcuggagacucuccuguugcucacucugcuggccaccgugacgggcggcauauuccuuuuucugaugucggggaagggcaucgggaagaugacccucggcauguguugcaucauuaccgcaucuauuuuguuaugguacgcucagauccagccacacuggaucgcggccuccaucauccuggaguucuuucucaucgugcucuuaauucccgagccagagaaacagcgcacgccgcaggacaaucagcucaccuacgucgugaucgccauccugacggugguggcagccaccauggcgaacgaaaugggguuccuggagaagacaaagaaggaccucggccugggcagcaucaccacgcaagaaagugaguccaacauccuggacaucgauuugcgaccggccagcgcauggaccuuguacgccguggcgacuaccuuugugacgcccaugcugcgccacucaaucgagaacucuuccgugaacgugagccugacagcuaucgccaaccaggcuaccgugcugaugggucuggggcgcggguggccauugucaaagauggacaucggcgucccccugcuggccaucgggugcuacucucaaguuaacccgaucacccugacagcugcccugcugcuccugguggcccacuacgccaucaucgggcccggccugcaggccaaagcgacccgggaggcccaaaagcgcacagccgccggcaucaugaagaauccaaccgucgacggcaucacagugaucgaccucgagcccaucccguacgaccccaaguucgagaagcagcugggccaggugauguuacucguccugugcgugacccaggugcugaugaugcggaccaccugggcucucugcgaagcucugacgcuggcaaccggcccgaucuccacccucugggaggggaaucccggccgcuucuggaacaccacaaucgccgugaguauggccaacauauuccggggcucuuaccuggcaggggcgggccuccucuucucgaucaugaagaacaccaccaacacccgccgggggacaggcaacauaggcgagacccugggugagaaguggaagucccagcugaacgcccucggcaaguccgaguuccaaauauacaagaaauccgggauucaagaggucgaccgcacgcuugccaaggagggcauuaagcgcggggagaccgaccaccacgccgugagccgcggcuccgcaaaguugcggugguucgucgaacguaacauggucacgcccgaaggcaagguggucgacuuagguugcggacgcggcggauggagcuacuacugcggcgggcugaagaauguacgcgaggugaaaggccugaccaaaggugggcccgggcacgaggagccgaucccuauguccaccuacgguuggaacuuggugagguuacagagcgggguagacguguucuucaccccacccgaaaagugcgacacgcugcucugcgauaucggcgagaguuccccgaaucccaccauugaggccggucgaacgcuucggguccugaaccuggucgagaacuggcugaacaacaacacacaguucugugugaaaguccugaacccuuacaugcccucagugauagaaaagauggagaccuugcagcgcaaauacgggggcgcccuggugaggaacccccugagucgcaacagcacucacgagauguacugggucuccaacgccaccgggaacaucgugucauccgugaacaugaucucucgcaugcugaucaaccgguucaccaugaagcacaagaaggccaccuaugagccggacgucgaccucggcuccgggacacgcaacauuggcaucgagaacgagauccccaaccuggacaucaucggcaagaggaucgagaaaaucaagcaggagcacgaaacuagcuggcauuacgaccaggaccacccguacaaaaccugggcguaccacggguccuacgagaccaagcaaacggguucggccuccagcauggugaaugggguggucaagcugcucaccaagcccugggaugucguuccgauggucacccagauggcuaugacggauacgacccccuucggccaacagcgcguguuuaaagagaagguugacacccggacccaggagccgaaggagggcacaaagaaacuaaugcgcauaacggccgaguggcuguggaaggaacuggguaaaaagaagacgccacgaaugugcacaagggaagaguucacgcgaaagguccgguccaacgcggcucugggugccaucuucacggaugagaauaaguggaaguccgcucgggaggcaguggaggacucucgcuucugggaguugguagaccgggagcgcaaccuacaccuggagggcaaaugcgaaaccugcguguacaauaugaugggcaagcgggagaagaagcugggggaguuugggaaggcuaagggcagccgugcgaucugguacauguggcucggggcccgguuccuggaguucgaagcacuuggcuuccucaacgaagaccacugguucucccgcggaaacagcuugagcggugucgaaggggaaggccuucauaagcucggauacauccugcgggauguaucaaaaaaggaaggcggggccauguacgcagacgacacggccgggugggacacgcgcaucacucuggaggaccucaagaacgaggagaugguaaccaaccauaugaagggcgagcacaagaagcuggccgaggccaucuucaagcugacuuaccagaauaaggugguccgggugcagcgcccgacgcccagggggaccgugauggacaucaucagccguaaggaccaacgcggcuccggucagguaggcaccuacggccuaaacaccuucaccaacauggaggcgcagcuaauccggcagauggagggugaggguauuuucaaauccauccagaggcugaccguuaccgaggagauagcggugcagaacuggcucgcccgggucggccgggaacggcugucccgcauggcaaucagcggggaugacugcgugguuaagccccuagacgaccgguucgccuccgcccucaccgcgcugaacgacaugggcaaaguucgcaaggacauccagcagugggagcccagccggggguggaacgacuggacccaggugccguucugcucccaccacuuccacgagcugguaaugaaggacggcagaguucucguggugcccugccggaaccaagacgagcugaucgggcgugcccgaauaagccagggcgcaggauggucccugaaggagacggccugccucggcaagagcuacgcccagauguggacucugauguauuuccaccgucgggaccugcgccucgcggccaacgcuaucugcuccgccguccccagccacugggugccaaccucccguacgacguggagcauccacgccaagcaugaauggaugaccacggaggacaugcuugcgguguggaaccgcgucuggauccaggagaacccguggauggaggacaaaaccccaguggaguccugggaggaggucccguaucugggcaagcgugaggaucaauggugcgggagccucaucgggcugacgagccgggccaccugggccaaaaacauacagaccgcuauuaaccagguccgcucuuugaucgggaacgaggaguacaccgacuacaugcccagcaugaaacguuuccggaaagaggaggaggaagcgggcgugcuuugguga

SEQ ID NO: 25253 - RNA, 9876 nt, Artificial Sequence
  derived and/or modified CDS sequence (opt11) from DENV-2__EU482726__SS-prME
accgcuggcgugaucgugaugcugaucccuacggugauggccuuccaccucaccaccagaaacggggagccccauaugaucgugggacggcaggaaaaggggaaauccuuacuguucaagaccgaggacggcgucaacaugugcacccucauggccaucgaccugggggaacugugcgaggacaccauaaccuacaagugcccccuccugaggcagaacgagcccgaggacauugauugcuggugcaauagcaccagcaccuggguuaccuacgggaccugcaccaccaccggcgaacaccggcgggaaaagcggucaguggcccuggucccucacguggggaugggccuagagacccggacugagaccuggaugucuucggaaggggccuggaagcacgugcagcggaucgagacguggauccugcgccacccgggcuucaccaucauggccgccauccuggcguacacaaucggcaccacgcauuuccagcgggcccuuaucuuuauccugcugaccgccgucgcccccucuaugaccaugcgcugcaucggcaucucuaaucgggacuucgucgagggcgugagcggaggcucgugggucgacaucgugcuggagcacgggucgugcgugaccaccauggccaagaacaagcccacacuggacuuugagcugaucaaaacggaggccaaacagcccgccacccuccgcaaguacuguaucgaggccaagcugacgaauaccacuaccgagucccgcugcccgacgcaaggcgagcccagccugaaugaggagcaggacaagcgcuucaucugcaagcacuccauggucgaccggggcuggggaaacgggugcggucuguucggaaagggcgguaucgugacaugugccauguucacgugcaagaaaaacauggagggcaagaucguccagccugagaaccuagaguauaccauagucauuacgccccauagcggggaagagcacgcggugggcaacgacaccgggaagcacggcaaggaaaucaagaucaccccgcagucaagcaccaccgaggccgagcuaacuggguacggcaccgugaccauggagugcagcccccggaccggccuggauuucaacgagaugguccugcugcagauggaggacaaagcauggcucgugcaucgacagugguuccuggaccugccucuucccuggcugccgggggccgacacccaggguaguaacuggauccagaaggagaccuuagugaccuucaagaacccgcacgccaagaagcaggacguggugguccucggaucccaggagggggcgaugcauaccgcccugacgggggccaccgagauccaaaugucaucaggcaaccuccuguucaccggccaccugaaaugccgccuccggauggacaagcuacagcuuaaagguaugagcuacagcaugugcauuggcaaguucaagaucgugaaggagaucgccgagacucaacacgggacgaucgugauaaggguccaguacgagggggacggcuccccuugcaaaauccccuucgagauaaccgaccuggagaagcggcacgugcucggccgccugaucaccgugaacccaaucgucacggagaaagacgccccagugaacaucgaggcggagccgcccuucggcgacagcuacauuaucgugggggucgagccggggcaguugaagcucaacugguucaaaaaggggucuagcaucgggcagauguucgagacgacaaugcgaggcgccaaacgcauggccauccugggggacaccgccugggacuucgggucccucgggggcguguucacaucaaucgggaaagcccuccaucaaguguucggcgcgauauacggggcggccuucagcggggugagcuggacgaugaagauccugaucggagugauuaucacauggauaggcaugaacucccgcagcaccucacuuucugugucccuggucuuagugggcguggucacccuguaccugggggcuguggugcaggcggacagcgguugcgucgugucguggaaaaacaaggagcucaagugcggcucugggauuuucaucacggacaacguacacacguggacagagcaguauaaguuccagcccgaguccccuagcaagcuggccagcgcaauccagaaagcccacgaggaaggcaucugcgguauccgguccgucacacgcuuagagaaccucauguggaagcaaaucacgcccgaacugaaccacauccugagcgaaaaugaggugaagcucaccaucaugaccggcgacaucaaggggaucaugcaagcagguaagcggucacuacgcccgcaacccaccgagcugaaguacagcuggaagacguggggcaaggcgaaaaugcucuccaccgagagccacaaccaaaccuuccugaucgacgggccagagaccgccgagugcccgaacacgaaccgggcauggaacucccuggagguggaggacuacggcuucgggguauucacaaccaacaucuggcucaagcuacgcgagaagcaggacguguucugugacaguaagcugauguccgccgccaucaaagauaaucgggcggugcaugccgacaugggcuacuggaucgagagcgcccugaacgacaccuggaagauggaaaaagcauccuucaucgaggucaagagcugccacuggcccaagucccacacacuguggucgaacgguguguuagagagugagaugaucauucccaagaauuuugccgggcccgugagccagcacaauuaccgcccgggcuaccacacgcagaccgcggggcccuggcaccuuggcaagcuggagauggacuucgacuucugcgaagggacuacugugguggugacggaggacugcggcaaccggggcccauccuuacgcacgacuaccgcgagcgggaaguuaauuacggaauggugcugccguagcuguacucugcccccguuacguuaccggggcgaggacgggugcugguacggcauggagauccgaccccugaaggagaaggaggagaaccuggugaacucccuggugaccgccgggcacggucagauugacaacuucagcuuaggcgugcuggggauggcccuguuccucgaggagaugcugcguaccagagucggcacgaagcacgcuacgcugcugguugcgcugagcuucgugacccuaaucaccgggaauaugagcuuccgggaccucggacgcgucauggugauggugggggccacuaugaccgacgacaucggcaugggcgugaccuaccuggcacuacucgcagcguucaagguucgcccaaccuuugcagcuggguugcugcucaggaagcugaccuccaaggagcugaugauggccacgaucggcaucgcccuccugucucagagcacccugccagagacgauccucgagcugacagacgcgcuggccuugggaaugaugguacugaagaucguccgcaacauggagaaauaucaguuagcugugacaaucauggccaucagcugcgugccgaacgccgucauccuccagaacgcguggaagguguccuguaccauacuggccgcggucagcgugagcccccugcuacugacuagcucccagcaaaaggccgacuggaucccccuggcgcucacgaucaagggacugaaccccaccgccaucuuccugacaacccugagccggacguccaaaaagcgcagcuggccgcucaacgaggccaucauggccgugggaauggucuccauccuggccagcucccuccugaagaacgacauccccaugacugggccccugguggccgguggauugcugaccguaugcuauguccugaccggcagaagugccgaccucgagcuggagcgcgccgcagacgugaagugggaggaccaggccgagauaagugguucaagcccgaucuuauccaucacgaucagcgaagauggcucaaugagcauuaagaacgaagaggaggagcagacacucaccauccugauucgaacuggccugcucgugauaagcggagucuucccggugagcauccccaucaccgcggcggcuugguaucugugggaggugaaaaaacaacgcgcuggcgugcugugggacgugcccagcccgccccccguggggaaggccgagcucgaggacggcgcguaccggaucaaacagcgcgggauccugggauacagccaaauaggcgccggggucuacaaggagggcacguuccacaccauguggcacgugacccgcggggccguacugaugcaccguggcaagcggaucgaaccauccugggccgacguuaagaaggaccucaucagcuauggggguggcuggaaguuggaaggcgaguggaaggagggcgaggagguucagguguuggcccuagagccggggaagaacccccgcgccguccagaccaaacccggcaucuucaagacgaacaccggaaccaucggggcagugucccuggacuucagccccggcaccuccgggagccccauaguggaccggaagggcaaggucgugggguuguauggcaacggcguagucacgcgcuccggggccuaugugagcgccaucgcgcagaccgagaaguccaucgaggacaaucccgagauagaggacgauaucuuccggaagaaacgccucaccaucauggaccuucaccccggcgccgggaagacaaagcgguaccugccggccaucgugagagaagccaucaagaggggccugcggacguuaauccuggccccgacccgcguuguggcagccgagauggaggaggcccugcgggggcuucccauccgcuaccagacccccgcgauccgggccgaacacacgggccgcgagaucguggacuuaaugugccacgcgacguucaccaugcggcuacucagccccguccgcgugccuaacuacaaccugauaaucauggacgaggcccacuucaccgaccccgccagcaucgcugcucggggcuacauuucuacccgaguggagaugggggaggcagccggcauauucaugacggccacgccacccgggagccgggacccguuuccccaguccaacgcgcccaucauggacgaggagcgcgagauucccgagcggagcuggaacuccggccacgaguggguaaccgauuuuaaagguaagaccgugugguucgugccgagcaucaaggcgggcaaugacaucgcugcgugccugcgcaaaaauggcaagaaggucauucagcucucccggaaaacuuucgacagcgaguacgugaagacccgggccaacgacugggacuucguggucaccaccgacaucuccgagaugggggccaacuuccgggcggaacgugugauagauccccggcgcugcaugaaacccgucauuuuaacggacggugaggaacgggucaucuuggccgguccuaugccggugacccacagcagugccgcgcaacgccgcggccggaucggacgcaaccccaagaacgagaacgaccaguacaucuacaugggcgagccccuggagaacgacgaggacugcgcccauuggaaggaggcuaagaugcuauuggacaacaucaauacacccgagggcaucauaccguccauguucgagcccgagcgugagaaaguggacgccaucgacggugaguaccgccuccgcggcgaggcuagaaagaccuucguagaucugaugcggcgcggggaccuucccguauggcucgccuaccggguggccgcggaaggcauuaacuaugcggaccggcgguggugcuucgacgggaucaagaacaaccagauccuggaggagaacguagagguggagaucuggaccaaggagggcgagcguaagaagcugaagccgcgguggcucgacgcacggaucuacuccgacccccuggcccugaaggaguucaaggaguucgcggcgggccggaagucccucaccuuaaaccugaucaccgagauggggcgccuccccaccuucaugacgcagaaggcgagggacgcccuggauaaccuggccguccuccacaccgcagagguuggugggcgcgccuacaaccacgcccuuuccgagcuacccgagacccucgagacucuucuguuguuaacguuacucgcuaccgugaccggcgggaucuuccuguuccugaugagcgggaagggcaucggaaagaugacacucgggaugugcuguaucaucaccgccuccauacugcugugguacgcgcaaauccagccgcacuggaucgccgccagcaucauacucgaguucuuccugaucguccugcucaucccggagccagagaagcagcgcacaccccaggacaaccaacugaccuacguggugaucgccauccugacggucguggcggcgacuauggcgaacgaaauggguuuccucgagaagacgaagaaggaccugggccugggcagcaucacuacccaggagagcgagagcaacauccuagauaucgaccugcgcccggccuccgcguggacccuauacgccguugcaacgaccuucgucacccccauguugcggcacagcaucgagaacuccagcgugaacguuucccugaccgcuaucgcaaaccaggcaacgguccugauggggcucggccgcggguggccccugagcaagauggacaucggcgugccccugcucgcgaucgggugcuacagccaggugaauccgaucacccugaccgccgcauuacuccugcuggucgcccacuacgcgaucaucggccccggccuccaggcgaaggccacccgcgaggcucagaagcggacggccgccgggaucaugaagaaccccaccguggacggcaucaccgugaucgaccuagagcccaucccguacgaccccaaguucgagaagcaguuaggucaagucauguugcugguucuaugugucacccagguccucaugaugcgcacgaccugggcgcugugcgaggcccuaacucucgccaccggccccauaagcacgcugugggaggggaaccccggcagguucuggaacaccaccauugccguguccauggcgaacaucuuucgcggcagcuacuuggcaggagccggccuccuguuuuccaucaugaagaacaccacgaacacccggcgggggaccggcaacaucggcgaaacccugggggagaaguggaaaucccgacuuaacgcccugggcaagagugaguuccagaucuauaagaaguccgggauucaggaggucgacagaacgcuggcuaaggaggggaucaagcgcggcgagaccgaccaccacgcggugucacgcgggagcgccaaacuccgaugguucguggagaggaacauggugacgccggagggcaaggucguggaccuggggugcgggcgcggagguuggaguuacuacugcgggggccucaagaacgugcgggaggucaagggccucaccaaaggcggcccagggcaugaggaacccaucccaaugaguacguacggcuggaacuuaguccggcugcaauccgggguggacguguucuuuaccccgcccgagaagugcgacaccuuacugugcgacauaggcgagucaagccccaaccccaccauugaggcugggcgcacccugcgugugcucaaucuagucgaaaauuggcugaacaacaacacgcaguuuuguauaaaggugcucaacccguacaugccguccgugaucgaaaaaauggagacccugcagcggaaguacgggggcgcucuggugaggaacccccugagcaggaacaguacccacgagauguacugggucagcaacgccaccgguaauauaguguccagcgugaacaugaucucccgcaugcucaucaaccgguucacgaugaagcacaagaaggcuacguacgagccggacgucgacuugggcagcggcacccgcaacaucggcauagaguccgagauccccaaccuggacaucauaggcaagcgaaucgagaagauuaagcaggagcaugagaccagcuggcacuacgaccaggaccaucccuauaagacgugggccuaccacgggucuuacgagaccaagcagaccggcagcgccuccagcauggugaacgggguggucaagcuacugaccaaacccugggacguggugccgaugguuacgcagauggccaugacagauaccacaccguucggccagcagcgcguguucaaggagaaaguggacacgcggacccaggagccuaaagagggcaccaagaagcuaaugcgaaucacggcagaguggcucuggaaggaacuggggaaaaagaagacaccccggaugugcacccgcgaagaguuuacccggaagguccgcuccaaugcagcccugggcgccaucuuuacugacgagaacaaauggaagagcgcccgggaggcuguggaggacagucgcuucugggagcucgucgacagggagcgcaaccugcacuuggaggggaagugcgagacgugcguauauaacaugaugggcaagcgggagaagaagcucggggaguuuggaaaggcgaagggcagccgcgcgaucugguacauguggcugggggcccgguuccuggaguucgaggcccucggcuucuugaacgaggaccauugguucucccgcgggaauagccugucuggaguggagggggagggccuccaccggcugggcuacauccugagggaggucgggaagaaggagggcggggcgauguacgcggacgacaccgccggcugggacacccggaucacccucgaagaccugaagaaugaggagaugguaacgaaccacaugaagggggagcacaaaaagcuggcggaagccauauucaagcucaccuaucagaacaaggugguccgagugcagcgcccgacgccccggggcacugugauggacaucaucucccgcaaggaccagagaggcagcgggcagguugguacguacggguugaacaccuuuaccaacauggaggcgcagcucauucgccagauggagggcgagggcaucuucaaguccauccagcaucucaccgccacagaggagaucgccgugcagaauugguuggcccggguggggcgcgagaggcugagccgcauggccaucaguggcgaugacugcgucgucaagcccauugaugacagguucgcgagcgcccucacagcgcucaacgauauggggaaaguacgcaaggauauacaacagugggaaccaucccggggcuggaacgauuggacccaggucccguucugcucucaucacuuccacgagcucgucaugaaagacgggcgcgugcucgucguucccugccggaaccaggacgagcugaucggacgcgcccgcaucucccaaggcgccgguuggagccugaaggagaccgcgugucucggaaaguccuaugcgcagauguggacucugauguacuuccaccgccgggacuuacgguuagccgccaacgccaucugcuccgcggugccaucccacuggguucccacgagccggaccaccugguccauccacgccaagcacgaguggaugaccacggaggacaugcuggccguguggaaccgcguguggauccaagagaauccguggauggaggacaagacccccgucgagagcugggaggaggugcccuacuuagguaagcgcgaggaccagugguguggcucccucaucgggcugaccucucgggccacaugggcgaagaacauccaaacugccauaaaccagguuagaagccugaucggcaacgaggaguacaccgacuacaugcccucaaugaagcgguuccgccgggaggaggaggaggccggcguccucugguag

SEQ ID NO: 25254 - RNA, 9876 nt, Artificial Sequence
  derived and/or modified CDS sequence (opt11) from DENV-2__EU482727__SS-prME
acagcaggggugaucauuaugcucauccccaccgccauggcauuucaccuuacaacccgcaauggggaaccgcacaugauugugggcagacaggaaaaggggaagucucugcuguucaaaaccgaggacggcgugaauaugugcaccuugauggccaucgaccuaggagagcugugcgaggacaccauaacguacaagugcccccuccugcggcagaacgagcccgaggacaucgacuguuggugcaacagcacgagcaccuggguuaccuacgggaccugcacaaccacuggagagcaccggcgcgagaagcgguccgucgcccuggugccccacguggggaugggcuuggagacgcgcaccgagaccuggaugagcagcgagggggccuggaaacacguacagagaaucgagaccuggaucuuacgccacccgggcuuuaccaucauggcugcgauccuggcuuacaccaucggcaccacgcauuuccagagggcccucaucuucaucuugcugacagccguggcgcccagcaugaccaugcgcugcaucggaaucuccaaccgcgacuucguggagggugucagcgguggcucuuggguugacaucgugcucgagcacgggagcugcgucaccacgauggccaagaacaagcccacguuggacuucgagcucaucaagaccgaagccaagcagccggccacacuccguaaguauugcaucgaagccaagcugacgaacaccaccaccgagucccggugcccaacgcagggcgagccgagccuaaacgaggagcaggacaagagguucauaugcaagcauuccaugguggaucgggguugggggaacggguguggccucuucgguaagggcgguauagugacgugcgcuauguucacguguaagaagaauauggagggcaagguagugcugccggagaaccuggaguacacaaucgucaucacgccccacagcggggaggagcacgcugucggcaacgacaccgguaagcacggcaaggagaucaagauaaccccucaguccucuaucaccgaggcagagcucaccggguacggcacgguuaccauggagugcagcccccggaccggccuggacuucaacgagauggugcuguugcagauggaggacaaggcguggcugguccaccggcagugguuucuggaccucccacugcccuggcugccgggggcagacacccagggcagcaacuggauccagaaggaaacacugguuaccuuuaagaauccccacgcgaagaagcaggacguggucgugcuggguucccaggagggcgccaugcacaccgcccuuaccggcgccacggagauccagaugagcagugguaaccuccuguuuaccggccaccugaaaugccgccuccggauggacaagcugcagcugaaagggauguccuauagcaugugcaccggaaaauucaaaaucgucaaggagaucgccgaaacccagcacgggacgaucguaauccgcgugcaguacgaaggcgaugguucccccugcaagauccccuucgagaucauggaccuggaaaagcggcacgugcugggucgccugaucaccgugaacccgaucgugacugaaaaagauagccccgucaacaucgaggccgagccgcccuuuggugacuccuacaucaucauuggaguggagcccggccagcucaagcuuaacugguucaagaaggggaguuccaucggucagauguuugagaccacuaugcgcggcgccaaacggauggccauccuuggggauaccgccugggacuucggcagccucgggggcguguucaccucgaucggaaaggcgcuacaccaggucuucggcgcgauuuacggcgccgccuucagcggcgugaguuggaccaugaagauccugaucggcgugaucaucacguggaucgggaugaauagucgguccaccucgcugucugucagccucgugcuggugggcgucgugacacucuaccugggggugaugguucaagccgacucaggcuguguggugaguuggaagaauaaggagcugaagugcggaucaggaaucuuuaucaccgauaacguccacacuuggaccgagcaguauaaguuccagccagagagucccagcaagcuggcuuccgcaauccagaaagcgcacgaggagggcaucugcgggauccggagcguuacucgccucgagaaccugauguggaagcagaucacccccgaacuuaaucacauccucuccgagaacgaagugaagcucaccaucaugaccggcgacaucaaggggaucaugcaggcgggaaagcggagccugcguccgcagccaaccgagcucaaauacuccuggaaaacuuggggcaaggcgaaaaugcugaguacggagagccacaaccaaaccuuccugaucgacggccccgaaaccgcagaaugcccuaacaccaaccgggccuggaauagccuagagguggaggacuauggcuuuggaguguucuccacgaacaucuggcugaagcugcgcgagaagcaggacguguucugcgacagcaagcuaaugucugcugcaaucaaagacaaccgggccguccaugccgacaugggcuacuggaucgagucugccuuaaacgacacuuggaagauggaaaaagcguccuucaucgaggucaagagcugccacuggccgaagagccacacccuguggucaaacggcgugcucgaaagcgaaaugauuaucccaaaaaacuuugccgggcccgugagccagcacaacuacagaccgggcuaccacacccagaccgccgggcccuggcaccugggcaagcuggagauggacuucgauuucugugagggcaccacgguugugguuaccgaggacugcgggaaucggggacccucuuugcgcacgacgaccgcguccgggaagcugaucaccgaguggugcugccgcucgugcacccugcccccacuccguuaucggggcgaggacgguugcugguaugguauggaaauacgacccuugaaggagaaggaggagaaucuagugaacuccuuggugacugccgggcacggccagaucgacaacuucaguuugggcguucuggggauggcccuuuuccuggaggagaugcugcggacccgcgugggcaccaagcacgccauccuccugguggcagucagcuuugugacccugauuacggggaacaugaguuuccgggaucuaggcagggugaugguuaugguuggugccaccaugaccgacgacauuggcaugggcgucacauaucuggcccugcucgcugcuuucaagguccgccccacguucgcggccgggcugcugcuccgcaagcugacaucuaaagaacugaugauggccaccaucggaauugcccuccuaucgcaguccaccauacccgagacgauccucgagcucacagaugcccuggcgcucgggaugauggugcucaagaucgucagaaacauggagaaguaccagcucgcagucacuaucauggccaucuccugcgucccgaacgcagugauccugcagaacgccuggaaggucuccugcacgaucuuggccgccgugucggucagcccccugcugcucacgagcucccagcagaaagcagauuggaucccccuggcacucaccaucaagggccuaaaccccaccgcaaucuuccugaccacgcugagccggaccuccaagaagcgcucauggccgcucaacgaggccgugauggccgugggcaugguguccauccuggccucgagccugcucaagaacgacauccccaugaccggcccccugguugccggcggccugcucaccguuugcuacguccugacgggccgguccgcggaccuugagcucgagcgcgcugccgacguuaagugggaagaccaggccgagaucuccggguccagcccuauccuaucuaucaccaucucugaggacggcuccaugagcaucaaaaacgaggaggaagagcagaccuuaacaauccucauccggacgggucugcuggugaucuccggcgucuuuccggugaguauccccaucaccgccgcagccugguaccucugggaggugaaaaaacagagggccgguguccugugggacgugcccagcccgccgcccgucgggaaggccgagcuggaggauggcgccuacagaaucaaacagcgcggaaucuucggcuacucgcagauuggcgcgggggucuacaaggaagguacguuccacacgauguggcacgugacccguggggcagugcucaugcacagaggcaaacggaucgagcccuccugggccgaugucaagaaggaccugauaucguaugggggcggguggaaauuagagggggaguggaaggagggcgaggaaguacagguacucgcccuagagcccgggaaaaacccccgggccguccagacgaagcccggccucuucaagacgaacaccggcacuaucggcgcgguguccuuagacuucaguccagguacgucggggagcccaauuguagauagaaagggaaaggucgugggacuuuaugguaauggcguggucacccgcuccggugccuauguaagcgccauagcucagaccgagaagucaaucgaagacaaccccgagauugaagacgacaucuuccggaagaagcggcugaccaucauggaccuacaccccggcgcggggaagacgaagcgcuacuuacccgccaucgugcgcgaagccaucaaacggggcuugcgcacccugauccuugccccgacccgcgucguugccgcggagauggaggaggcccugagggggcugcccauucgcuaccaaacaccagccauaagagcagagcacacgggccgugagaucguggaccugaugugccacgccacguuuaccaugcggcugcuuagccccguccgagugccgaacuacaaccucaucauuauggacgaggcgcauuucacagaccccgccucaauugccgcccggggcuacauuuccacgcgaguagaaaugggggaggccgccggcaucuucaugaccgccacgccucccgggagcagagacccuuuuccgcagagcaacgcccccauaauggacgaggagcgcgaaauacccgagcggagcuggaacuccgggcaugagugggucacggauuuuaagggcaaaacggugugguuugugccgagcauuaaggccggcaacgacauugcggcuugccugcgcaagaacgggaagaagguaauccaguugucccggaaaaccuucgacucggaguacgugaagacccgggccaacgacugggacuucguggucacaacggauauuuccgaaaugggcgcaaacuuucgggccgagagggucaucgacccccgacgaugcaugaagccagugauccucacugacggcgaggagagagucauccuggcggggcccaugccggugacccacagcuccgccgcucaacgccggggucggaucggaagaaaccccaagaacgagaacgaccaguauaucuacaugggagagccacuggagaacgacgaagauugcgccuacuggaaggaggcaaagauguugcuggacaacaucaacacucccgagggcaucaucccgagcauguucgaaccggagagagagaagguggaugcgaucgauggagaauaucgccucaggggcgaggcccggaagacguucgucgaucuaaugcggcgcggcgaucugcccguguggcuggcguaccggguugccgccgagggaaucaacuacgcggaccgacgaugguguuucgauggcauaaagaacaaccagauccuagaggagaacgucgagguggagaucuggaccaaagagggcgagcgcaaaaagcugaagccgcggugguuagacgcccgcaucuacuccgacccccucgcgcugaaggaguucaaggaguucgcugcgggccggaagagucugaccuugaaccuuauuaccgagauggggcgcuugcccacguucaugacccaaaaggcgcgggacgcccuagacaaccuggcuguccuucacaccgccgaagugggcgggcgcgcguacaaccacgcacucuccgagcugcccgagaccuuggagacgcuccugcuguugacccugcucgcuacagugaccggcggcaucuuccuguuccugaugagcggaaagggaaucgggaagaugacgcugggcaugugcuguaucaucacagccaguauccuccugugguacgcccaaauccagccacauuggaucgcugcaucuauuauccuggaguucuuccucauuguauugcugaucccggagcccgagaagcagcggacgccccaggacaaccagcucaccuacguagugaucgccauccugacugugguugccgccacaauggcgaacgagaugggcuuccuggagaagacgaaaaaggaccucggccugggcagcaucaccacccaggaauccgagagcaacauccuggacaucgauuuacgcccggccagcgccuggacgcuguacgccguggccaccaccuucgucacucccaugcugcggcauagcaucgaaaauuccucugugaacgucagucucacagccaucgccaaucaggcuaccguccugauggggcugggccgcggauggccacucucuaagauggacaucggcgugccccugcucgccaucgggugcuauucccaagugaaccccaucacccuaaccgcggcccuacuccuucuagucgcccacuacgcuaucaucggccccggacugcaggcuaaagcgacucgcgaggcccagaaacgggccgccgcagggaucaugaaaaauccaaccguggacggcaucacugugaucgaccucgagcccauaccguacgacccuaaauucgagaagcaacuggggcagguuaugcuguuagugcugugcgugacccagguccuuaugaugaggacgaccugggcgcucugugaggccuugacccuagccaccggccccaucucgacgcucugggaggggaaucccggccgguucuggaacaccaccaucgccguguccauggccaacaucuuccgcggcucauaccuggcgggggcgggacuccucuucuccaucaugaagaacacuacaaacacccggcgcggcacaggcaacaucggcgagacccugggagagaaguggaagucccgccugaacgcccucggcaagucggaguuccagaucuauaaaaagucgggaauccaagagguggaucgaacgcuggccaaggagggaaucaagcgcggggagaccgaccaccacgcggucuccaggggcagcgcaaagcugcggugguucguggagcgcaacauggugaccccggaaggcaaggucguggaccuuggguguggccgcggcggaugguccuacuacuguggcggguuaaagaauguucgugaagucaaggggcuaaccaagggcggcccugggcacgaggaacccauccccaugagcacguacggcuggaaccucgugcggcuacaaagcgggguggacgucuucuucacuccccccgaaaaaugugacacccuucucugcgacaucggagagucgucucccaaccccacaaucgaagccggucgcacacugcgggugcugaaccucguggagaauuggcugaacaauaacacacaguucuguaucaagguacugaacccguacaugcccuccgugaucgagaagauggagacccuccagagaaaauacgggggcgcgcucguucggaacccccugagcaggaacaguacccacgagauguauugggucagcaaugccaccgggaacaucguguccuccgugaauaugaucagucggaugcuaauuaaucgguucacgaugaagcacaaaaaagcgaccuacgagccggaugucgaccucggcagcgggacccgcaacaucggcaucgaaaacgagauccccaaccuggacaucaucggcaagcgaaucgagaagaucaagcaggaacacgaaacuuccuggcauuaugaccaagaccaccccuacaagacgugggccuaucacggcucuuacgagacaaaacagacuggcuccgccagcuccaugguaaacgggguuguccgccugcucacaaagcccugggacguggugccgauggucacgcagauggccaugaccgacaccacccccuucggccaacagcggguguucaaagagaagguggauacgcgcacccaggagcccaaggagggcaccaagaagcugaugcggaucaccgccgaguggcucuggaaggagcucgggaaaaagaagacgcccagaaugugcacccgugaggaguuuacccgcaaggucaggagcaaugcggcccugggcgcuaucuucaccgacgagaacaaguggaaguccgcccgcgaagccguggaggacagcagguucugggaguuaguugaccgcgagcggaaucuccaucuggagggaaagugugaaacguguguguacaauaugaugggcaagcgcgagaagaagcuaggggaguucgguaaggcgaagggcucacgggccaucugguacauguggcuaggggcccgcuuucuggaguucgaggccuuaggguuccucaaugaggaccacugguucagccggcgcaauagccuauccgggguagagggugaagggcuccauaaguugggcuacauacuccgggacguaucgaaaaaggagggcggggcgauguacgcugacgacaccgccggcugggacacccgcaucacccuggaggacuugaagaaugaggagauggucacgaaccacaugaagggggaacacaagaagcucgccgaagcuauauucaagcugaccuaccagaacaaggugguccgugugcagcggccaacgccccggggcaccguuauggacauaaucucccggaaggaucagcgggggagcggucaggucggcacguacggucucaacaccuuuaccaauauggaggcucagcugauccggcaaauggaaggugagggaaucuucaaguccauacagcgccugaccguuaccgaagagaucgccguccagaacuggcucgcaagggugggccgcgagagacugagccgcauggccauuuccggggacgacugcguggugaagccgcuugacgaccguuuugccagcgcgcucacggcucucaacgacaugggcaagguccgcaaggacauccagcagugggagcccucucggggguggaacgacuggacccaggugccguucugcucucaccacuuucaugagcugguaaugaaagauggacgcguccucgucgugcccugcagaaaccaagacgagcugaucggucgcgcccgaauaucccaaggggccgguuggucccugaaagaaaccgccugucucggcaaauccuacgcccaaauguggacguugauguacuuccaccgccgggaccugcgccucgccgccaaugcuaucugcagcgccgugccaucccacugggugcccaccagccgcaccaccugguccauccacgcgaagcacgaguggaugaccacggaggauaugcuggcuguuuggaaccggguauggauacaggaaaacccguggauggaggacaagacgccgguggagagcugggaggaggugccauaccugggaaagcgcgaggaucagugguguggcucacugaucggauugacgucccgggccaccugggccaagaacauccagacggcgaucaaccagguucgcucgcugaucggcaacgaggaguacaccgacuacaugcccuccaugaagcgguuucgcaaggaggaggaagaagccggagugcucugguag

SEQ ID NO: 25255 - RNA, 9876 nt, Artificial Sequence
  derived and/or modified CDS sequence (opt11) from DENV-2__EU482728__SS-prME
acugccggcgucaucauaaugcugauucccaccgccauggcuuuccaccuuaccacccggaacggugagccacacaugaucgugggccggcaagagaaggggaagucccugcuguucaagaccgaggacggcgugaauaugugcaccuugauggccaucgaccugggugagcugugcgaggacaccauuacuuacaagugcccccuucugcgccagaacgagcccgaggacaucgacugcugguguaacucgaccagcaccugggugacauacggcacuugcaccacaacgggcgagcaccggcgugagaagcggaguguugcucuggugccccacguggggaugggccucgagacccggacugagaccuggaugagcuccgagggggccuggaaacacgugcagcggaucgagacguggauacugcgccauccgggcuucacaauuauggccgcgaucuuagccuauaccaucgggaccacucacuuccagcgggcccucaucuucauacugcuaaccgccgucgcucccucaaugaccaugcgcugcaucggcaucaguaaccgcgacuucguggagggcgucagcgggggcagcuggguagacauaguguuggaacacgggucuugcgucaccacuauggccaagaacaagcccacccuggacuuugagcugaucaagaccgaggcuaaacagcccgcgacccuccgcaaguacugcaucgaggccaaguugacgaacaccaccacagagucacggugcccgacgcagggcgagcccagccugaacgaggagcaggacaaaagguucaucugcaagcacucccucguugaccggggauggggaaacgguuguggacuguucggcaagggugggaucgugacgugcgcgauguucacgugcaagaagaacauggagggcaaaguaguucugcccgagaaccucgaguacacuaucguaauaaccccccacucaggagaagagcacgcggucgguaacgacaccgguaaacacggcaaggagaucaaaauuaccccgcaaucuagcaucacggaggccgagcuaaccggguacggcacggugacaauggaguguagccccaggaccggcuuagacuuuaacgagauggucuugcugcagauggaagacaaggcuuggcugguccaccggcagugguucuuggaucugccccugcccuggcucccuggggcagauacccagggcaguaacuggauccagaaggagacccuggugaccuucaaaaacccccacgcgaagaaacaggaugucgucgugcuggggucccaggagggcgcaaugcacaccgcccucaccggggccacggagauccagaugagcuccggcaaccugcuguucaccgggcaccucaagugucgccugcggauggacaaguuacagcucaagggcaugucuuauagcaugugcaccggcaaguuuaagaucgucaaggagaucgccgagacacagcacgggacgaucguaauccgggugcaguacgaaggcgacggcuccccuuguaagaucccauuugaaaucauggaccuggagaagcggcacgucuuggggcgcuuaaucaccgugaacccgaucgugaccgagaaggacagccccgucaacaucgaggcggagccgcccuuuggagacuccuacauaaucaucgguguggagccuggucagcugaagcugaacugguucaagaaggggucaagcaucggccagauguucgagacuacuaugcgcggugccaagagaauggcaauccucggcgacaccgcuugggauuucggaagccucggugggguguucaccuccauagggaaggcccuccaccaggucuucggggcgauauacggcgccgccuucagcgggguuaguuggaccaugaagauccuuaucggcgugauaaucacguggauagggaugaauagccgcagcaccagccucuccgucagccuugugcuggugggugucgugacacuauaccuggggguuaugguccaggccgacuccggcugcguggugagcuggaaaaacaaagagcuuaagugcggcuccggcauauucauuacugacaacguccacacguggaccgagcaguauaaguuccaacccgaaagccccucgaagcucgcguccgcgauacagaaagcccacgaggagggcaucugcgggaucaggagcgugacucgccuggagaaccuuauguggaagcaaaucacccccgaacugaaccacauccuuucggagaacgaggugaagcugacgaucaugaccggcgacaucaaggggaucaugcaggccggaaagcggagccugagaccgcagcccacagaacugaaguacucuuggaagacguggggcaaggccaagaugcugagcacagagucccacaaccagaccuuucugaucgacgggcccgaaaccgcggagugcccgaauaccaaccgggccuggaacagccuggaggucgaagauuacggcuucgggguguucucgacaaacaucugguuaaaguugagggagaagcaagacguuuucugcgacagcaagcugaugucagccgccauuaaggacaaccgggcugugcaugcggacaugggcuauuggaucgagagcgcccugaacgacaccuggaagauggagaaggccucauucaucgaggucaagagcugccacuggcccaagucccacacccucuggagcaacggcgugcuggaguccgagaugaucauccccaagaacuucgccgggcccgugagccaacacaacuaccgccccggguaccacacccaaaccgccgggcccuggcacuuaggcaagcucgagauggacuuugacuucugcgaggggacaaccguuguggucacggaggauuguggaaauagagggcccucacugcgcaccacaacggcguccgggaagcuaaucacugaguggugcugucgguccugcacccugccgccccuacgcuaccggggcgaggacgggugcugguaugguauggagauccgcccccugaaggagaaggaggagaaccucgugaacucccugguaaccgccgggcacggccagaucgacaacuucagucugggcguccucggcauggcccuguuccuggaggagauguugcggacccgcguuggcaccaaacacgccauccugcugguggccgucuccuucgugaccuuaaucacagggaacaugagcuuccgggaucuaggccgagugauggucauggugggagccaccaugaccgacgacaucggcaugggcguaaccuaccuggcccuucuggccgccuucaagguccgccccacauuugcggccgggcugcuccugagaaagcugacaaguaaggagcucaugauggccaccaucggcaucgcccugcugucgcaguccacaauccccgagacaauccucgaguuaacagaugcgcuggcguuggggaugauggugcugaagaucgugaggaacauggagaaguaccagcuggccgucacgaucauggccaucagcuguguccccaacgccgugauccuccaaaacgccuggaagguuuccugcaccauccuggcugcggugagcgucagcccucugcucuugacgucgucccaacagaaggcugacuggaucccccuggcccuuaccaucaagggcuuaaaucccacugccaucuuccugaccacguugagucggacuaguaagaagcgcagcuggccauugaacgaggcugugauggccgugggcauggucuccauacuggccuccagccuccucaagaacgacaucccgaugaccgggccccugguugccggggggcuacugaccgugugcuacguccugacuggccggucggcugacuuggagcuggagcgggccgccgacgugaagugggaggaccaggccgaaaucagcgguuccagcccaaucuuauccaucaccaucucugaagacggauccaugagcaucaagaacgaggaagaggaacagacacucacgauccugauccggacaggccuacuugugaucuccggggucuucccggugaguaucccaaucaccgccgcagccugguaccuuugggagguuaagaaacagcgcgcaggcguccugugggacguucccagcccgccgcccguagggaaggccgagcucgaggacggcgcguaccgcauaaagcagcggggaauauucggcuacucucagaucggcgcgggggucuauaaggagggcaccuuccauacgauguggcaugugacccgcggggccguucugaugcacagagguaaacggaucgaacccuccugggccgacgucaagaaggaccugauaagcuaugguggcgguuggaaguuagaaggggaauggaaagagggggaggagguccaggugcuggcacucgaacccgggaagaacccccgcgccguccagacaaagcccggccucuucaagacuaacaccgggaccaucggggcggugucccucgacuucagcccaggcaccagugggagccccaucguagaucggaaaggcaaggucguggggcuguauggaaacggcgugguaacccgcuccggggccuacgugagcgccaucgcccagaccgaaaaauccaucgaggacaaccccgagauugaggacgacaucuuccggaagaagcgccucacgaucauggacuugcaucccggcgcggggaagacaaagagauaccugccggccaucgugcgggaggccaucaaacguggacugcguacccugauccuggccccgacccgcgucguggccgcggaaauggaagaggcccuaagagggcuacccauccgcuaccagacccccgccaucagggcggagcacacaggccgcgagaucguggaccugaugugccaugcgaccuucacuaugcggcugcucucccccguacgcgucccgaacuacaaccugaucauuauggacgaagcgcacuucaccgacccagccucgaucgcagcacggggcuacauauccacgaggguggagaugggagaggccgcuggcauauuuaugaccgccacgccgccugggucgcgggacccguuuccccaguccaacgccccaauaauggacgaggaacgcgaaauccccgagcguagcuggaacaguggccacgaguggguuaccgacuucaaggggaagaccgugugguuugucccgagcauuaaggccggcaacgauaucgcggcaugucugcgcaagaacggcaagaaggucauccagcucucccggaagaccuucgacagugaguacgugaaaacccgagcaaacgacugggacuucguggucaccacggacaucuccgagaugggcgccaauuuccgugccgagcgcgugauagacccccgucguugcaugaagcccguaauccuaacagacggggaagaaagagucauccuggcggggcccaugccggugacucacaguuccgccgcccagcgccggggccggaucgggcgcaaccccaagaacgaaaacgaccaauauaucuauaugggcgagccgcuugagaacgacgaggacugcgcccacuggaaagaggccaagauguugcuggacaacaucaacacacccgaaggcauaauccccagcauguuugagcccgagcgggagaaaguggacgcgaucgauggugaguaccgcuuacggggcgaggccaggaagacguuuguagaccuuaugcggcgcggggaucugcccgugugguuagccuaucggguggccgccgagggcaucaacuacgcggaccgccgguggugcuucgacgggauuaagaacaaccagauccuggaggagaacgucgagguggagaucuggaccaaagagggagagcgcaagaagcuuaagccgagaugguuagaugcccgcaucuacuccgacccgcuggcccugaaggaguucaaggaguucgccgcaggccgcaagagccucacccugaaucugaucaccgagauggggcggcuccccacguucaugacccaaaaggcccgagacgcacuggacaaccuggcgguccuccacacugccgaagugggagggcgcgcguacaaucacgcccuguccgagcugcccgagacccucgaaacucugcugcuccugacucugcucgcgaccgugaccggaggcaucuuccuguuccugauguccgguaagggcaucgggaagaugacgcucggcaugugcugcaucauaaccgcguccauucugcugugguacgcacagauccagccgcacuggauagcggcauccaucauccucgaguucuuccugaucguucugcuaauccccgagcccgagaagcagcgaacgccccaagacaaccagcugaccuacguggugaucgcgauccucaccgucguggcagccacgauggcuaacgaaaugggguuccucgagaaaaccaagaaggacuuaggucugggcagcaucaccacccaagaguccgagucaaacauccucgauaucgaccugaggcccgccuccgccuggacgcuguacgcgguggccaccaccuucgucacucccauguuaaggcacagcaucgaaaauuccucugugaacguaucguugacggcgaucgccaaucaagccaccguccugauggggcucggccguggguggccccugagcaagauggacaucggugugccacugcucgccauaggcugcuacucccaggugaacccgaucacgcugacggcggcccugcugcugcugguugcacacuacgcgaucaucggccccggucuccaggccaaagcgacacgagaggcgcagaagagggccgccgccgggauaaugaagaaccccacggucgacggaaucaccguaaucgaucuggagcccaucccguacgaccccaaguucgaaaagcaguugggacaggucaugcuccuugugcugugcgugacacagguacucaugaugcgcaccaccugggcgcugugcgaggcccucacuuuggccaccggccccauaucaacgcugugggaggggaaccccggccgguucuggaacacaaccaucgccguguccauggcgaacauauucaggggcagcuaccuggcgggggccggccuccuguucucuauaaugaaaaacaccaccaacacacggcgcgggaccgggaacauuggagagacccugggcgagaaguggaagucccggcucaacgcacuggguaaguccgaguuucagaucuacaagaaguccgggauacaggagguggaccgcacgcuggccaaggagggcaucaagcgcggagagacugaccaccacgcggugucccggggcagcgccaagcuccgaugguucgucgagcgcaacauggugacaccggagggcaaggucguggaccugggguguggccgcgggggcugguccuacuacugcgggggccugaagaaugugcgcgagguuaagggccucaccaaggggggcccugggcacgaggagcccauccccaugagcaccuacggcuggaaccuagugcgucugcagagugguguggacguuuucuucacuccacccgagaagugcgacacccuacugugcgacauuggcgaauccucuccgaaucccaccaucgaagccggacgaacgcuacgggugcucaaccuggucgaaaacuggcuuaacaacaacacccaguucugcauuaagguacucaaucccuacaugcccuccguuauugagaagauggagacccuacaacgcaaguacgggggagcgcuagugcggaacccccugucacgcaacuccacccacgaaauguacugggucuccaacgccaccgggaauaucguguccagcgugaacaugaucucccguaugcucaucaacagauuuacgaugaaacauaagaaggcuaccuacgagccggacguggaccuaggcagcgggacccgcaauauuggcauugaaaaugaaauucccaaccuggauaucaucgguaagcggaucgagaaaauaaagcaggagcaugagaccuccuggcacuacgaucaagaccaccccuauaagacgugggccuaccacgggaguuacgagacaaagcagaccggauccgccucaaguauggugaacggggugguccgccuccugacuaaacccugggacguugugccgauggucacucagauggccaugaccgacacgacucccuuuggccagcagcguguguucaaggagaaggucgacacccgcacccaggaacccaaggaaggcaccaagaagcugaugcgaaucaccgccgaguggcucuggaaggagcuggggaagaagaagacuccccgaaugugcacccgugaggaguucacccgcaagguccggagcaaugcggccuugggggccauuuucaccgacgagaacaaguggaaguccgccagggaagccguggaggacagccgguucugggaauuggucgaccgggagcggaaccugcaucuggagggcaagugcgagacgugcguguacaacaugaugggaaagagagagaagaaacucggugaguucggaaaggcgaagggcuccagagccaucugguacauguggcuaggggcccgcuuccuggaguuugaggcccucggcuuccugaacgaagaccacugguuuagccgggguaacagccuguccggcgucgagggggagggacuccacaaacugggcuacauccugcgagacgucagcaagaaggagggcggcgcgauguaugccgacgacaccgccgggugggacacccggaucacccucgaagaccugaagaacgaggagauggugacgaaccacaugaagggcgagcacaagaagcuugcggaggccaucuuuaagcucaccuaccagaacaagguuguccgcguacagcgcccgacgccacgggggacagugauggacaucaucucccggaaagaucagcggggcagcggacaggucgguaccuauggccugaacaccuucaccaacauggaggcgcagcuuaucaggcagauggaaggcgaaggaauauuuaaguccauccaacggcucacggugacggaggagaucgcggugcagaacuggcuggcucgcgucgggcgugagcgucugagccggauggcaaucucuggggacgacugcguggugaagccucucgacgaccgauucgccucugcgcugacggcccugaaugauaugggcaagguucggaaggacauccagcaaugggagcccucccgcggguggaaugauuggacgcaggugccguucuguagucaucacuuccacgagcuggugaugaaggauggccggguccugguggugcccugccgcaaccaagacgagcugaucgguagagccagaauuucccagggagcaggguggucuuuaaaagagaccgccugccugggcaaguccuacgcgcagauguggacucuuauguacuuucaccgccgcgaccugcgccuggccgccaacgccauuugcuccgccguccccucacauugggugcccacgagccgcaccacguggucaauccacgcgaagcacgaguggaugacuaccgaggacaugcuagccguguggaaucggguuuggauccaagaaaacccguggauggaagauaagacccccguugagucaugggaagaggucccuuaccucggcaagcgggaggaccaguggugcgggagucugaucggccugaccucgcgggcaaccugggccaagaacauccagacggcgaucaaccagguccgcucgcucauuggaaaugaagaguauaccgauuacaugccgaguaugaagcgcuuccggaaggaggaagaggaggccggagugcugugguaa

SEQ ID NO: 25256 - RNA, 9876 nt, Artificial Sequence
  derived and/or modified CDS sequence (opt11) from DENV-2__EU482729__SS-prME
accgcaggagugauuaucaugcuaaucccaacugcaauggcguuccaccuaacgacgagaaauggagaaccacacaugaucguugggcggcaggagaaagggaaaucgcuacuguuuaaaacggaggacggaguuaacaugugcacucucauggcgauugauuuaggagaauugugugaagacacaaucacauacaaaugcccgcuccugcgacaaaacgaacccgaggauauagauugcuggugcaacuccacaaguacgugggugacauacggaacgugcacuacgaccggcgagcacaggcgagagaaaagaagcgucgcacuggucccucacgucggcauggggcuugagacacgaacagagacguggaugagcucagaaggagcguggaaacacguccaacgaauagaaacauggaucuuacgccacccaggauuuacgaucauggcggcaauccuagcauacacgaucgggaccacacacuuccaaagggcgcuaaucuucauucuccugaccgcuguggcgcccagcaugacgaugagaugcauaggaaucucgaacagggauuucguagaggggguuucuggagguagcuggguggacaucguccuggaacacggcagcugcgucaccacaauggccaaaaacaaaccuacgcucgacuucgaauuaaucaaaacagaggcuaaacagcccgcaacccugcgcaaauacugcauugaagcgaaacugacaaauacaaccacugaaucgagaugcccaacucaaggagaaccgucuuuaaacgaagaacaagauaaacgguucauaugcaaacacucgaugguggacagaggcuggggcaacgggugcggccuauucggcaaaggcggcauaguaaccugcgcuauguucacaugcaagaagaacauggaaggaaaaguuguacugccagagaaccucgaguacacaauaguuaucacgccacauucaggagaagaacacgcgguagguaacgacacugggaaacacggcaaagaaauaaaaauaacuccccagucuuccaucacggaagcagagcucacgggguacggcaccgugaccauggagugcucaccaaggacuggccuugacuucaaugagaugguacuacugcaaauggaagauaaagcaugguugguacaccgccagugguuccuagaccugccgcuucccugguugcccggcgccgacacccagggaaguaacuggauacaaaaagaaacauugguaacguucaaaaauccgcaugccaagaaacaagacgucgugguccuugggagccaggaaggggcaaugcacaccgcacuuaccggggcuacagaaauucagauguccagcgggaaucuacucuuuacaggacaccuuaaaugccggcugaggauggacaaacuucagcugaaaggcaugucauauaguaugugcaccggcaaguuuaaaauaguaaaagagauugcagaaacccaacacgggaccauugucauacguguucaauacgaaggugaugguaguccaugcaagauccccuucgagauaauggaccuagaaaagcgacauguauuaggcagacucauaacggugaacccuaucgugacagagaaagacucgccugucaauaucgaggcggagccaccauuuggagacagcuacaucauaauaggagucgagccuggacaauuaaagcugaacugguucaagaaaggaagcucaaucggccagauguuugagacgacaaugcgaggcgcaaagaggauggcgauacugggcgacaccgcgugggacuucgggucgcugggcggcgucuucacgucuauaggaaaagcccuucaccaagucuuuggggcaauuuacggagcagcauuuagcggcgugucguggacgaugaaaauccucauugggguaauaaucacauggaucggaaugaacucucgcucaaccucccuaagcgucagccuaguccuggucggagucguaacccuauaccuaggggucaugguccaggcagauaguggcugcgucguaagcuggaaaaauaaagaacucaaaugcggaagcgggaucuuuaucacagacaauguacacacauggacagagcaguacaaguuccaaccugagucccccuccaaguuagccucagcuauccaaaaagcacacgaagaagguauaugcggaauccgcagcgugaccagacuugaaaaucuuauguggaaacaaauaaccccugagcuaaaucacauacuaagcgaaaacgaagugaaacuaacgauuaugacaggggaaaucaagggaauaaugcaggccggcaagagauccuuaagaccccagcccacagagcugaaguacagcuggaaaacauggggcaaagccaaaauguuaagcaccgagagccacaaccagaccuucuuaaucgacggcccggaaacggcugaaugcccgaacacuaauagggcguggaacagucuggaagucgaggacuacggcuucggggucuucucuacgaacauaugguuaaagcuaagagagaaacaggauguauucugcgacagcaaacugaugagcgcggccauaaaggacaauagagcaguucaugccgacaugggauacuggauagaaagcgcgcuuaaugauaccuggaaaauggaaaaggccucauucauagaagugaaaucgugccacuggcccaaaucgcacacauuguggagcaaugggguccuggaaagugaaaugauaauccccaaaaauuucgcagggccaguaagccaacacaauuaccgaccgggauaucacacgcaaaucgcaggcccauggcaccuagggaaguuagaaauggacuuugacuucugcgaagggacuacggucguagucaccgaggacugcgggaacagagggccgucucuucgcaccacgacugcguccggcaaacugaucacggaauggugcugucgaagcuguacauugccaccguuacgauaccgaggagaagauggguguugguacggcauggagaucaggccauuaaaagagaaggaggagaaccucgucaauucacugguuaccgccgggcacggccaaauagacaacuucagccuaggcgucuuaggaauggcauuauuccuagaagagaugcuucguacacgcguugguaccaagcacgcaauauuacugauugcagugucguucgugacucucauaacgggaaacaugagcuuuagggacuuagguagaguaaugguaaugguaggugcaacuaugacagacgacauaggcaugggcgucaccuauuuagcccuucuugccgcguucaagguacgacccacguucgcggcagggcuacugcuaagaaaacucacgucaaaggaacugaugauggcgacaaucggaaucgcccugcucucccaaagcacuauccccgagaccauacuugagcuaacggacgcccuggcacuagguaugaugguccucaaaaucguacgaaacauggaaaaauaccaauuagccgucacgaucauggcaaucagcugcgugcccaacgcagucauucugcaaaaugccuggaagguuagcugcacuauccucgcggcaguaagugucucgccccugcuccugaccucgagccagcagaaagcagacuggaucccacuagcccucaccauaaagggacugaacccaacagcgauauucuuaacuacacuaaguagaacaagcaagaaacggaguuggccgcucaaugaagcgguaauggccguaggcaugguaucuauacuagcauccuccuuguuaaagaacgacaucccgaugacggggccacugguggcugggggacuacugacagucugcuacguccuuaccggccgaagcgcggaucuggaacucgaaagggcggcggacgucaaaugggaggaucaggcggaaaucucggguucaucacccauccuaaguauaacgauaagcgaagacggauccaugaguaucaagaacgaagaagaagaacaaacacuaaccauacuaauccggacaggucucuuagucauaucaggaguguuucccguuucgauuccgaucaccgcagcagcaugguaccuaugggaaguaaagaaacaaagggcaggagugcuuugggauguccccaguccaccuccgguggggaaggccgaauuggaagacggcgcguaucggaucaaacaaagggguauauucggcuacagucaaaucggcgcagggguuuacaaagagggaacuuuccauacaauguggcauguuacacgaggcgcuguauugaugcacaggggcaagcgaauugaaccaagcugggcagaugucaagaaagaccuaaucucguacgggggcggcuggaagcuagaaggagaguggaaagaaggagaagaaguacaggugcucgcacuagagccagguaaaaacccgcgggcugugcagacgaaaccaggacuauucaaaacuaauacagggacaauaggggcugugagccuagacuuuucgcccggcaccucggggagcccgauaguagaccgaaaagggaaaguagugggacucuacggaaacggcgucguuacacgaagcggggccuacguuagugccauagcacagacggagaaaagcauugaggauaauccggaaauagaagaugacaucuuccggaagaaacgacuuacuaucauggaccuacaccccggagccggcaaaacgaagagguacuuacccgcaauaguaagagaggcuaucaagaggggguuaaggacccuuauucucgccccaacacgcguaguggcggcagagauggaagaggcacugagaggccucccuauaagguaucaaaccccagcaauccgagcugagcacacaggucgggagauagucgaccugaugugccacgcaacauucacgaugagacuccuuucaccaguucgagugccgaauuacaaccugauaauaauggacgaggcacauuucaccgaccccgcgaguaucgccgcgaggggguacaucagcacccgagucgagaugggagaagccgcgggaaucuucaugacggccacaccgccgggcagccgcgaccccuucccccagucgaacgcacccauaauggacgaagaacgggaaaucccggagcgaucauggaacuccggacacgaaugggucacagacuuuaaaggcaaaacaguaugguucguaccuuccauaaaagccggcaacgauaucgccgcuugccuacggaaaaacggcaagaaggucauccagcugagucgaaaaacguuugacucagaauacgucaaaacccgcgccaaugauugggauuucgugguuacgacggauaucucggaaaugggagccaacuucagggcagagagagucaucgacccccggcggugcaugaagcccgugauacuuacggacggcgaagaacgaguaauacuagccgguccgaugccagucacacacucaagcgcggcccagaggcgcggucgaauaggacgcaacccgaaaaacgaaaacgaccaauacauauauaugggagaaccucuagagaacgacgaagacugugcguauuggaaagaggcaaagaugcucuuagacaauaucaacaccccagaagggaucauaccuuccauguucgaaccggagcgcgaaaaggucgacgcaaucgacggcgaauauagacuccgaggagaggcaaggaagacauucguagacuuaaugcgacgcggagaucuccccgucuggcuugcguacaggguagcagcagaaggcauaaauuaugcagaccggagauggugcuucgacggcaucaaaaacaaccaaauacucgaggagaacgucgaagucgaaaucuggacgaaggaaggggagcgcaagaaauuaaagccccgguggcuagaugcaagaauauacucagacccccuugccuugaaggaguucaaagaguucgccgccggaaggaaaagccuaacuuuaaaccucaucacagagaugggaaggcuaccgaccuucaugacccaaaaagcccgggaugcauuggacaaccuagcgguccuacauacagcggagguaggcggccgcgcguauaaccacgcgcuaagcgaacuaccagaaacgcuugaaacacugcuucuacucacgcuccuagcaacaguaacgggaggcaucuucuuauuccugaugagcggcaagggaaucgggaaaaugacacucggaaugugcuguaucauaacggccagcauacuucucugguacgcccaaauacaaccgcauuggauagccgcguccauaauauuagaguuuuuccucauaguacuacuuaucccggaaccugagaagcagcgaacuccccaggacaaccaacugaccuacgucguuaucgcaauucucacuguaguagcggccacaauggccaacgagaugggauuccuagagaaaacgaagaaagaucuaggacugggaagcauaacaacgcaggaaagcgagagcaauauucuggacauagaucugcgcccagcgucagcuuggacacuguacgcuguagcgaccacauuuguaacgccaauguuacggcacuccauagaaaauagcucagucaaugugucccuaaccgccaucgccaaccaggccacgguacucaugggacugggacggggcuggccccuuaguaagauggacauaggugugccucuucucgcaauuggaugcuacucccaagugaauccaaucacacuuacagcagcccuacucuuguugguagcgcacuacgcaaucauaggaccgggucuccaggcaaaagcgacaagggaagcgcagaagcgggcugccgcaggcauaaugaagaauccaaccguagauggaaucaccgucauagaccuggagccaauaccguaugacccuaaguuugagaaacagcugggccaggucaugcuccugguccuaugugucacgcaaguccugaugaugcgcacgacaugggccuuaugcgaggcccucacacuugcaacaggcccaaucaguacguugugggaaggcaaccccggacgauuuuggaacacaaccaucgcagucuccauggcaaacaucuuccgagggagcuaccuagccggcgcgggccuacuguuuuccaucaugaaaaacaccaccaacacgagaagaggaacuggaaauaccggugagacccuaggagagaaauggaagaguaggcuaaaugcacuaggaaagucggaguuucaaaucuauaagaaauccggcauccaggaaguggauaggacgcucgcaaaagaaggaauuaagcggggcgaaaccgaccaccacgcaguauccagagggucagcuaaacugcggugguuugucgagcgaaacauggugacaccagaaggaaaagugguagaccucggcugcggacgagguggguggagcuacuacugcgggggacucaaaaauguacgcgaagucaaaggccugacgaagggcgggcccggacaugaggaaccgauccccauguccacguacggguggaacuugguaagacuccaaaguggcguagacguauucuuuaccccgccggaaaagugcgacacgcuccuaugcgacaucggcgaaagcuccccuaauccaacaauagaggcggggagaacuuuaaggguguuaaaccucguagagaacuggcuaaacaacaauacgcaauucugcauuaaagugcucaauccauacaugcccaguguaauagagaagauggaaacgcuccagagaaaguauggcggagcccuagugcgaaacccccucaguaggaacuccacccaugagauguacugggucucgaacgcgaccggaaauauugucucgaguguaaacaugaucucaaggaugcuaaucaacagguucacaaugaaacacaaaaaggccacguacgaacccgaugucgacuugggauccggcacacgcaauauuggaauugaaaacgaaaucccaaaucuagacauaaucggaaaacggauagagaaaauaaagcaggagcaugaaacgagcuggcacuacgaccaggaccauccguauaaaaccugggccuaccacgggucguaugaaacaaaacaaacaggcagcgccagcuccauggucaacggggucgugaggcuguuaacuaagccaugggacguggugcccauggucacucaaauggcaaugacagacacgacgccguuugggcaacaacgaguuuucaaagagaaaguggacacgcgaacgcaggagccgaaagagggaaccaaaaagcuaaugagaauaaccgcugaauggcucuggaaggaacucggcaagaagaaaacaccccgaaugugcacaagggaagaguucacacgcaaaguaaggaguaaugccgcgcucggagcaauauucacugaugagaauaaauggaaaagugccagagaggcugucgaagacagccgcuucugggaacuuguagauagggaaaggaaccuccaccuggaaggcaagugcgaaacaugcguguauaauaugauggggaaacgagagaagaaacuaggagaguucgguaaagccaaagggucccgagccauaugguacauguggcuaggggcaagauuucucgaguuugaggcacucggguuccuaaacgaggaccacugguuuagcaggaggaacagccugucuggggucgagggcgaaggccuucauaagcuagguuauauccucagggacgugaguaagaaagagggaggagcaauguacgcagacgacacagccgggugggacacacggaucacacucgaggaccugaaaaacgaagagauggucaccaaucacaugaaaggagaacauaagaaacuagcagaagcuauuuucaagcuaaccuaccagaacaaagucguccgagugcaacgaccaacaccgaggggaacggugauggauaucaucucgagaaaagaucagcgcggcagcgggcagguagguacguacggguugaauaccuucacgaacauggaggcgcaacuaaucaggcaaauggagggcgagggaaucuucaaauccauacagcggcugacaguaacagaggagaucgcaguacaaaacuggcuagcgagagucggaagagaacgacucucgcgaauggcuaucagcggagacgacugcgugguaaaaccccucgaugacagguucgccagcgcccuaacagcguuaaacgacaugggcaagguaaggaaggacauccaacaaugggagccaucgcggggguggaacgacuggacacaaguacccuucugcucacaccacuuucacgaauugguaaugaaagacgggaggguccuggucguacccugucggaaccaagacgaacuaaucggcagagcacggaucagucaaggugccggguggucgcuaaaagagaccgcgugccuaggaaaaagcuacgcucaaauguggacccucauguacuuccauagacgggaccuacgccuggcagccaacgcaauuugcagcgcugucccuagucauugggugccaaccagccgcacaacguggucgauccaugcaaagcacgaguggaugacaaccgaagauaugcucgcgguuuggaaccgaguauggauccaagaaaacccguggauggaagacaaaacgcccguugaaucgugggaggagguuccauaccuaggaaagagggaggaccaauggugcggaucccuaauaggucuaacaagccgggcaacaugggcgaagaacauacagacggccauuaaccaagugcguucguuaauuggcaaugaggaauacacggacuacaugccaaguaugaaacgauucagaaaagaagaggaggaagcuggaguccucugguga

SEQ ID NO: 25257 - RNA, 9876 nt, Artificial Sequence
  derived and/or modified CDS sequence (opt11) from DENV-2__EU482731__SS-prME
accgccggugugaucgucaugcugaucccuacugugauggccuuccaccucaccaccaggaacggggagccacacaugaucgugggccgccaggaaaaaggaaagucccugcuguuuaagaccgaggacggcgucaacaugugcacacucauggcgaucgaucugggggagcugugcgaggacaccaucaccuacaagugccccuuacugcggcagaacgagcccgaggacaucgacugcuggugcaauagcaccagcaccugggugaccuaugguaccuguaccacgacgggcgagcaccgccgcgagaagcguagcguggccuuggucccucacguggggaugggccucgagacccggacagagaccuggaugagcuccgagggggcguggaagcacguacagcggauagagaccuggauccugcgccacccgggcuucaccaucauggccgccauccuagccuacaccaucgggacgacgcauuuccagcgggcccucaucuuuauccugcugaccgcugucgcccccagcaugaccaugcgcugcaucggcauuuccaaccgggacuucguggagggugugagcgggggcuccugggucgacaucguguuagagcacgggagcugcgugaccacgauggcgaaaaacaagcccacccuggacuucgaacugaucaaaaccgaggccaaacagcccgcgacccuccgcaaguacugcauugaggccaagcugacgaacaccaccaccgagucccggugcccgacgcagggcgagcccucgcugaacgaggagcaggacaagcguuuuaucugcaagcauuccaugguagaccggggcuggggcaacggcuguggucuguucggcaagggcgggaucgugaccugcgccauguucacgugcaagaagaacauggaggguaaaaucguccagcccgagaaccuggaguacaccaucgucaucacaccccauagcggggaggagcacgcggugggcaacgacaccgggaagcacggcaaggagaucaagaucaccccgcaguccagcaccaccgaggccgagcugacgggauacggcaccgugaccauggaauguagcccacggaccggccucgacuucaacgagaugguucugcuacagauggaggacaaggccuggcuggugcaccggcagugguuccuggaccugccccuacccuggcugccgggggccgacacgcagggcagcaacuggauccagaaggagaccuuggugaccuucaagaacccccacgccaagaagcaggacgucgugguacucgggucccaggagggcgcaaugcacaccgcccugacgggggcgaccgaaauccagaugagcagcggcaaccuccuguucacaggccaucugaagugucgccugcguauggacaaguuacagcugaaggggauguccuacagcaugugcacuggcaaguucaaaaucgugaaagagauagccgagacccaacacgggaccaucgugauccgcguccaguacgagggcgacggcucacccugcaagauccccuuugagaucaccgaccuagagaagcggcacguguuggggcgccugaucaccgugaacccgaucgucacggagaaggacgcccccgugaacauagaggcggagccgcccuucggggacucuuacaucaucgugggaguugagcccggccagcugaagcucaacugguucaagaagggguccagcaucggccaaauguucgagaccaccaugcgcggcgccaagaggauggccauccugggugauacagccugggacuucggaucccucggaggggucuucacgucaaucgggaaagccuugcaccagguguucggggccaucuacggcgccgccuucuccggggucagcuggaccaugaagauccugaucggcgugaucaucaccuggaucgggaugaacucccgcagcaccucccugagcgugucccugguacucgugggcguggucacgcuguaccugggggccauggugcaggcggacagcggcugcguggucagcuggaaaaacaaggagcucaaguguggcagcggcaucuucaucacggacaacgugcacaccuggaccgagcaguacaaauuccagccagagucccccagcaagcuggccagugccauccagaaggcccacgaagagggcaucugcgggauccggucggugacgcgccuggagaaccucauguggaagcagaucacacccgaacugaaccacauucucagcgagaacgaggucaaguuaaccauaaugaccggugacaucaaggggaucaugcaggccggcaaacggucccugcgaccccagcccacggagcugaaguacagcuggaagaccuggggcaaggcgaagaugcucuccaccgagagccacaaccagaccuucuugaucgacgggcccgagacggccgagugcccgaacaccaaccgggcauggaacagucuggagguggaggacuacggcuucgggguguucacgaccaacaucuggcucaagcugcgcgagaagcaagacgucuucugcgacagcaagcuuauguccgccgcaaucaaggacaaucgggcgguccacgccgacaugggcuacuggaucgagucugcccucaaugacaccuggaagauggagaaggccuccuuuaucgaggucaagucuugccacuggcccaaaagucacacguuauggagcaacggcgugcuggaguccgagaugauaaucccaaagaacuucgccgggcccgugagccagcacaauuaucgcccggguuaucacacacagacggcggggcccuggcaccucggcaagcuggagauggacuucgacuucugcgaggggaccacgguggucgugacugaggacugcggcaaccggggccccucccugcgcaccaccaccgccucugggaagcucaucacugaguggugcugccggagcugcacccugcccccacugcgcuaccggggcgaggaugggugcugguacggaauggagauccgacccuugaaggaaaaggaggagaaccuggugaacucccuggucacggccgggcauggacagauugacaacuucagccucggcgugcuggggauggccuuauuucuugaggagaugcugcggacgcgcgugggcacuaagcacgcgacacugcucgucgcacucuccuucgucaccuuaauuacugggaacaugagcuuccgggaccuuggccgcgucauggucauggugggggccaccaugacagacgacaucggcaugggcgugacguaccuggcccugcucgccgcguucaagguccgccccacguucgccgcagggcugcugcuccgaaaacugaccuccaaggagcugaugauggcaaccaucggcaucgcccuccugagccaguccacccugcccgaaacgauccucgagcuuaccgacgcgcuggcccucgguaugauggugcugaagaucgugcgcaacauggagaaguaucagcuggccgucaccaucauggccauuagcugcgugccgaacgccgugauucuccagaacgcuuggaaggucuccugcacuaucuuagccgccgugagcgucagcccacugcuccugacaagcucccagcagaaggccgacuggaucccccuagcgcucaccauaaagggccugaaccccacugccauuuuccugaccacgcucagccggaccucgaagaagcgcucuuggccucugaaugaggccauaauggccgugggcaugguuuccauccuggccagcucccuucugaaaaacgacauccccaugaccgggccccuggucgcgggcgggcuccugacagugugcuacgugcugacgggacggucugcagaccucgagcuggagcgcgccgccgacgucaagugggaggaccaggcggagaucagcggguccagccccauccucuccaucacuaucucagaggacggcuccaugagcauaaagaacgaggaggaagagcagacccucacaauacuuaucaggaccggccugcucgugaucuccgggguguucccggucagcauaccuaucacggcggccgcuugguaccugugggaggugaagaaacagcgcgccggcgugcugugggacguccccagcccgcccccgguggggaaagccgagcucgaggacggcgccuaccggaucaagcaacgcgggauccugggauacagccagauuggugccgggguguacaaggagggcaccuuucacaccauguggcacgucacccgcggcgccgugcugaugcaucgcggcaagcggaucgagcccaguugggccgacgugaagaaggacuuaaucagcuacgggggcggcuggaagcuggagggggaguggaaggagggcgaggagguccaggugcuagcccucgagccggggaagaacccacgcgcggugcagacgaagccaggcauauuuaagaccaacaccgggaccauaggugccgucuccuuggacuucagccccggcacgagcggcagccccaucguagaccggaagggcaagguggucgggcuguacggcaacggcguggugacccgcuccggggccuacguuagcgccaucgcgcagaccgagaaguccaucgaggacaaccccgagaucgaggacgacaucuucaggaaaaagaggcucaccaucauggaccugcaccccggcgccgggaagacgaagcgguaccugcccgccaucgugcgggaggccaucaagcgcggccugcgcacacucauccuggcccccacgagaguagucgcggccgagauggaggaggcccugcggggacucccaauccgcuaccagacccccgccauccgggccgagcacacgggccgcgaaaucguagaccugaugugccacgcgaccuucacaaugcggcuguugagccccgugcgcgucccgaauuacaaccugaucaucauggacgaggcccacuuuaccgaccccgcgucuaucgccgccagaggcuacauuuccacgcgcguggagaugggggaagcggccggcaucuucaugaccgcgacgccgcccgggagcagagacccguucccccaguccaacgcccccaucaucgacgaggagcgcgagauccccgagcgaagcuggaacuccggucacgagugggugaccgacuucaaggggaaaacgguaugguucgugccgagcaucaaggcgggaaacgacauagccgccugccugcgcaagaauggcaagaaggugauccagcucucccggaagaccuucgacucagaguacgucaagaccagggccaacgacugggauuucguagucaccacggacauauccgagaugggagccaacuucaaagccgagcgggucaucgauccccgccggugcaugaagcccgugauucugaccgacggcgaggagcgugugauccuggccgggcccaugccggucacccacagcuccgccgcgcagcggcggggccgcaucgggcggaaucccaagaacgagaacgaccaguacaucuacaugggagagccccucgagaacgacgaggacugcgcccacuggaaggaggcgaaaaugcugcuggacaacauuaauacacccgagggcaucauccccagcauguuugaaccagagcgcgagaagguggacgccauugacggggaguaccggcuccgaggcgaggcccgaaagacguuuguggaccuaaugcgucgcggggaccugcccgucuggcuagccuacaagguugccgcggagggaaucaacuacgccgaccgcaaguggugcuucgacgggaucaagaauaaccagauccuggaggagaacguggaggucgagaucuggaccaaagaaggcgagcggaagaagcugaagccacguuggcucgacgcccggaucuacuccgacccccuggcccugaaggaguucaaggaguucgcggcgggccgcaagagccuaacgcuaaaccuuaucaccgagauggggcgucuccccacguucaugacccagaaggccaggaacgcccuagauaaccuggccgugcuccacaccgcggaggucggcgggcgggcccacaaucacgcccuguccgagcugccagaaacucucgagacccuguuacuucugacucugcucgccaccgugaccggcggcaucuuccuguuucugaugucagggaagggcaucgggaagaugacccucggcaugugcugcaucaucacggccuccauccuguugugguacgcgcagauucagccgcauuggaucgcggccagcaucauccucgaguucuuccuaaucgugcugcucauccccgagcccgagaagcagcguacgccccaggacaaccagcugaccuacgucgugaucgccauccugacgguggucgccgccacgauggccaaugagaugggauuccucgagaagaccaagaaggaccugggcuucggcuccaucaccacccaggagagcgagaguaacauccuggacauagaccuacggccggccuccgccuggacgcuguacgccguggcgaccacuuucguuacccccaugcugcgccacagcaucgagaacuccagcguaaacgugagccucacggccaucgccaaccaggccaccgugcuaaugggccugggcaagggguggccccucaguaagauggacaucggcgucccccugcucgcaaucgguugcuacagccaagugaacccgaucacccucaccgcagcccugcugcuccugguggcccauuaugccaucaucggccccggccuucaagcgaaggccacucgggaggcccagaagcgagccgccgcggggaucaugaagaaccccaccgucgacggcaucaccgugauagaccuugagcccaucccguacgaccccaaguucgaaaagcagcugggccaggugaugcugcuaauacugugcgucacccaagugcugaugaugcggacgaccugggcccuuugcgaggcccugacccuugccaccggcccgaucucuacgcucugggaagggaacccuggacgcuucuggaacaccaccaucgccguguccauggcgaacaucuuccgaggcagcuaccuggcaggggccggccuccuguucuccaucaugaagaacacaacuaacacccggcgcgggaccggcaaugucggcgagacgcucggugagaaguggaagucccggcugaacgcccucggcaaguccgaguuccagaucuacaagaaguccgggauccaagagguggaccgaacgcuggcgaaggagggcauaaagcgcggagagaccgaucaccacgccgugucccgcggcuccgccaagcuacggugguuugucgagcgcaacauggugacaccggagggcaagguggucgaccucgggugcggccgcggugggugguccuacuacugcggcgggcugaagaacgugcgcgaggugaagggguuaaccaaaggggggcccgggcacgaggaacccauccccaugagcacguacggcuggaaccucguaagacugcaguccgggguggacguguucuucaccccgccagagaagugcgacacccugcucugcgacaucggcgagagcagucccaaccccaccaucgaggccggccgcacccugcguguccucaaccucguggagaacuggcugaacaacaacacgcaguucugcauuaaggugcuaaacccguacaugcccuccgucauugagaagauggagacccuccagcgcaaguacggaggcgcccugguaagaaacccccugagccgcaauuccacacacgagauguacugggugagcaacgcgacugggaacaucgucuccagcgugaacaugaucucccggaugcugaucaaccgcuucacgaugaagcacaagaaggccaccuacgagccagacguggaccucggcagugggacacggaauauaggaauugaguccgagauccccaaccuggacaucaucggcaagcgcaucgagaaaaucaagcaggagcacgagaccagcuggcacuacgaucaggaccacccauacaagacuugggccuaccacgguagcuacgagacaaagcagaccgggucugcuuccagcauggucaacgggguggugaggcugcucaccaagcccugggacgucgugccgauggugacccagauggccaugaccgacaccacccccuucggccagcaacgggucuucaaggagaagguggacacgcgcacccaggaaccaaaggagggcacgaagaagcuaaugaagauaacugcggaguggcuguggaaggagcucgggaagaagaagacgccgcgcaugugcacccgcgaggaguucacacggaaggugcgcuccaacgccgcccugggcgccaucuucaccgacgagaacaaguggaaguccgcccgagaggcggucgaggacgggcgcuucugggagcugguagaccgggagcgcaaccuccaucuggaggguaagugcgaaaccugcgucuacaacaugauggggaagcgggagaagaagcugggcgaguucgggaaggcuaagggcucccgcgccaucugguauauguggcucggcgcccgguuccuagaguucgaagcgcuaggguuccuuaacgaggaccacugguucagucgcggcaacucccugagcgggguggagggcgaagggcugcaccggcucggguacauucugcgcgaggugggcaaaaaggaggguggcgccauguacgcugacgacaccgccggaugggacacccggauuacccucgaggaccucaagaacgaggagauggucacgaaccacaugaagggcgagcacaagaagcuggccgaggccaucuucaagcugaccuaccagaacaaggugguacgcguacagcggccgacgccccggggcaccgugauggacauaaucagcagaaaggaccagcguggguccggccaggucgggacguacggccucaacacguucaccaacauggaggcacagcuuauccgccaaauggagggcgaggggauuuuuaaaagcauccagcaucugacagcgacggaggagaucgccguucagaacugguuagcccggguaggccgugagcggcugucccgcauggcgaucagcggggacgacuguguggucaagcccaucgacgaucgguucgccuccgcccugacugcccucaacgacaugggcaaggugcgcaaggacauccagcagugggaacccagccggggguggaacgacuggacgcaggugccguucuguucccaucacuuccaugagcuggucaugaaggacggccgcgugcugguagucccgugccggaaccaggacgagcucauaggccgcgcccggaucagccagggcgccggcuggucccugaaagagaccgcaugccugggcaagagcuacgcccagauguggacccucauguacuuccaccgccgggacuuaagauuagccgccaacgcgaucugcuccgcaguccccagccacugggugcccacguccagaacuaccuggagcauccacgccaagcacgaguggaugaccacggaagacaugcuggccgucuggaaccguguguggauccaggagaacccguggauggaggacaagacccccguggaguccugggaagaagucccuuaccugggcaagcgugaggaccaguggugcgggagccugauaggccucacgucccgcgcaaccugggccaagaacauccagacugcuaucaaccaagugcggucgcugaucggcaacgaggaguacacagacuauaugccaagcaugaagcgcuuccgccgcgaggaggaggaagccggggugcugugguaa

SEQ ID NO: 25258 - RNA, 9876 nt, Artificial Sequence
  derived and/or modified CDS sequence (opt11) from DENV-2__EU482732__SS-prME
accgugggaguaaucaucaugcugauccccaccgccauggccuuccaccugaccacucgcaacggggagccgcauaugauagugggccgucaagagaaggggaagucgcugcuguucaaaaccgaggacggcgugaacaugugcacccucauggcgaucgacuuaggggagcugugcgaggacaccaucaccuacaagugcccccuacugcggcaaaacgagcccgaggacaucgacugcuggugcaauagcaccagcacuugggucaccuaugggaccugcaccaccacgggcgaacaccggcgugagaagcgcucgguggcccugguuccccacguugggaugggccucgagacccgcaccgagacuuggaugagcagcgagggggccuggaagcacgugcagcggaucgaaaccuggauccugcgccacccgggcuucacaaucauggcggcgauccuggcguacaccaucgggaccacgcacuuccagcgggcacuaauuuucauucugcugaccgccguugcccccagcaugaccaugcgcugcaucggaaucuccaaucgggacuucgucgagggcgucagcggcggcucgugggucgacaucguccucgaacacgggucaugcgugaccacgauggcgaaaaacaagcccacgcucgacuucgaacugaucaaaaccgaggccaagcaacccgccacccugcgcaaguacugcauugaggccaagcugacuaacaccaccaccgagucccgaugcccgacgcaaggcgagcccucucugaacgaggagcaggacaagcgcuucaucugcaagcacuccaugguggaccggggcugggggaacggcugcggucuguucggcaagggugggaucgugacgugcgccauguuuacgugcaagaagaacauggagggcaaggucguguuacccgagaaccuagaguacacuauuguuaucaccccccacagcggggaggagcacgccgugggcaaugauacggggaagcaugguaaggaaaucaaaaucaccccgcaguccagcaucaccgaggcggagcucaccggguacggcacggugaccauggagugcagccccaggaccggauuagacuucaacgaaaugguccugcuccagauggaggauaaggccuggcuggugcaccggcaaugguuccuggaccucccccugcccuggcugccgggggccgacacccagggaagcaauuggauccagaaggagacgcuagugaccuucaagaacccccacgccaagaagcaggaugucgugguccucgggucccaggagggcgcuaugcacacagcucugaccggggccacggagauccagaugagcaguggcaaccuccucuucaccggccaccugaagugucgccuacggauggauaagcuacagcugaaggggaugaguuacagcaugugcaccggcaaauucaagaucguuaaggagaucgccgagacccaacacgggacgaucgugauccgcgugcaguacgagggcgacggcuccccaugcaaaauccccuucgagaucauggaccucgagaaacgucacgugcucgggcggcugauuaccgugaacccgaucgucacagagaaggacagccccgugaacaucgaagcggagccgcccuucggugacucuuacauaaucaucggcguggaaccgggccagcucaaacugaacugguuuaagaagggaagcagcauuggccagauguucgaaaccacgaugcgcggggcgaaacggauggccaucuuaggggauaccgccugggacuucggcagccucgggggcgcauucacauccauagggaaggcacuccaccaggucuucggcgcuauauacggcgccgccuucaguggggugucuuggaccaugaagauucugaucggcgugaucauuacguggaucggcaugaacagucgcucaaccagccuguccgucagccuugugcuugugggcguggugacccuguaucucggggugaugguccaggccgacuccgguugcguggugaguuggaagaacaaggagcugaagugcggcuccgggaucuucauaacagacaacguacauacauggaccgagcaguacaaguuccagcccgagagccccagcaaacuggcgagugcaauccagaaggcccaugaggaaggcaucugugggauccggagcgugacccgccucgagaaccugauguggaagcagaucacccccgagcugaaccacaucuuguccgagaacgaggugaagcugacgauaaugaccggcgacaucaaagggaucaugcaggccggcaagcggagccugcgcccgcagcccacggagcucaaauacuccuggaagaccuggggcaaggccaagaugcugagcacggagucccacaaucagaccuucuugauagacggaccagagaccgccgagugcccgaacaccaaccgggccuggaacucuuuagaggucgaggacuacggcuucgggguguucaguaccaauauauggcuuaagcugcgggagaagcaggacguguucugcgacucgaagcucauguccgccgccaucaaggacaaccgagccguacacgcggacaugggcuauuggauagagagcgcccugaaugauaccuggaagauggagaaggccuccuuuaucgaggucaaaaguugccacuggcccaagucccacacccuguggagcaacggcgugcucgaguccgagaugaucaucccgaagaacuucgccggacccgugagccagcacaacuaccgcccagguuaccacacccagaccgcuggucccuggcaccuugguaagcucgagauggacuucgauuucugcgaggggacgaccgugguggucaccgaggacuguggcaaccggggccccucccuccgcacuacgaccgcgaguggcaagcugaucaccgagugguguugccgaagcugcacccugcccccgcuccgguaccggggcgaggacgggugcugguacgguauggagauccgcccccugaaagagaaggaggaaaacuuagugaacagccuugugaccgccgggcacggccagaucgacaacuucucacugggggucuuggggauggcucucuuccuggaagagaugcugagaacucgugugggcaccaagcacgccaucuuacugguggccgucuccuucgugacccugaucacggggaacaugagcuuccgggauuuaggccgcgugauggucauggugggggccaccaugacggacgacaucggcaugggcgugaccuaucuggcccuccucgccgcuuuuaaagugcgccccacauucgcugcugggcugcugcuccguaaguugaccuccaaggagcugaugauggcuacaauuggcaucgcccuccugagccaguccacaauccccgagacgauccuggagcucacagacgcgcuggcguuggggaugauggugcucaagauugugcggaacauggagaaauaccaacuggcugucacgaucauggccaucucuugcgugccuaacgccgugauccugcagaacgccuggaagguguccuguaccauccucgcggccgugagcguaagcccccugcugcucacuagcucccagcagaaggccgacuggaucccccuggcguugaccaucaagggccucaaccccaccgcaaucuucuugaccacgcugagccggacauccaaaaaacggagcuggccgcugaacgaggcugucauggccgugggcauggucuccauccuggcguccucgcuacuuaagaacgacaucccaaugaccgguccccugguggcgggcgggcuuuugaccgugugcuauguccugacggggcgguccgcggaccuggagcucgagcgcgccgccgacgugaagugggaggaccaggcagaaaucucuggauccagccccauccuguccauuaccaucucagaggauggcuccaugagcaucaagaaugaggaggaggagcacacccugaccauccucauccggacggguuuauuagugaucagcgggguauucccggugagcauccccaucacggcagcggccugguacuugugggaggugaagaagcagcgcgccggcguccucugggaugugcccucaccgccucccguggggaaggccgagcuggaggacggcgccuaccggaucaagcagcgcgggaucuucggcuacagccagaucggcgcgggggucuacaaggaggggacguuccacaccauguggcacgugaccaggggugccgugcucaugcaccggggcaagcggauugagcccucaugggccgaugucaagaaggaccugaucagcuacggcggcggcuggaaacuggagggggaguggaaggagggcgaggagguccagguccucgcccuggagccggggaaaaacccccgcgcuguccagacgaagccgggucuguucaagaccaacaccggaaccauuggcgcggucucccucgacuucagccccgggacguccgggagcccgauaguggacaggaagggcaaggucguggggcucuacgguaacggcgucgucacccgcuccggggcuuacgugagcgccaucgcccagacggagaaguccaucgaggacaaccccgaaaucgaggacgacaucuuucguaagaagcgacugaccaucauggaccuccaucccggcgcggggaagacgaagcgguacuuacccgccauugugagggaagccauuaaaagaggccuacgcacccugaucuuggccccgaccagggucguggccgcugagauggaggaagcccugcgggggcuucccauccgcuaccagaccccugcuauccgggccgagcacacgggacgagagaucguggacuuaaugugccacgccaccuucaccaugcggcugcugucccccgucagagugccgaacuacaaccuaaucauuauggacgaggcgcacuucaccgaccccgccagcaucgccgcccggggcuacaucucuacgcgcguggagaugggggaagcugcugguauuuuuaugacggccacgccgcccgggagccgugacccguucccacaguccaacgccccgauuauggacgaagagcgcgagauacccgagcggaguuggaacucaggccacgagugggucaccgacuucaaggggaagacggugugguucgugccgagcaucaaggccgggaacgacaucgcggccugccugcgcaagaacggcaaaaaggucauccaguuguccaggaagacguucgauagcgaguacgugaagacccgcgccaacgauugggacuucguugugacaacggacaucuccgagaugggugccaacuuccgggccgagcgcgugaucgauccccgucgcugcaugaaacccgugauccuaacugacggcgaggagcggguaauccuggccggaccgaugccggugacccauucuuccgcugcccaaaggcgcggccggaucgggcgcaaucccaagaacgagaacgaccaguacaucuacaugggugaaccccuagagaacgaugaagacugcgcccacuggaaggaggccaagaugcuccuggacaacaucaacaccccagagggcaucauccccagcauguucgagcccgagcgagaaaagguggacgcaaucgacggggaguaucgccugcggggcgaagcccguaagacauucgucgaccucaugcggcgcggggaccugcccguguggcuggcauacaggguggcugccgagggcaucaacuacgcggaccgccguuggugcuuugacgggaucaagaacaaccagauccucgaggagaacgucgagguggagauauggaccaaggagggagaacgcaagaagcugaagccgcguuggcuggacgccaggaucuacuccgaccccuuggcccugaaagaguucaaggaguucgccgcgggccggaagucccugacccucaaccugaucaccgagauggggcgccugcccacuuucaugacucagaaggcccgggaugcccucgacaaccuggcaguccugcacaccgccgaggugggcgggcgcgcguacaaccacgcccucucugagcugcccgaaacucuggagacgcuccugcugcucacccugcuggccaccgugacaggcggcaucuucuuguuccuuaugagcgggaagggcaucgguaagaugacgcugggcaugugcugcaucaucaccgcguccauacucuugugguacgcccaaauccagccgcacuggaucgcggccaguaucauccuggaguuuuuccucauuguccugcugauacccgaacccgagaagcaacgaacgccucaggacaaccagcucaccuacguggugaucgccauucugacggucguggccgccaccauggcgaacgagaugggguuccuggagaagaccaagaaagauuugggcuuggggucgauaaccacccaggagagugagagcaacauccuggacaucgaccuccgcccggccuccgccuggacgcuguacgccguggccaccaccuuugucacacccaugcugcggcacucgaucgagaauuccagcgugaacguguccuuaacagcgaucgccaaccaggccaccguucugauggggcugggccgaggguggccccucagcaagauggacaucggcgugccccugcuggccauugggugcuacucccaagugaacccgaucacgcucaccgcggcccugcuacuccuggucgcccacuacgcaaucaucggccccggccugcaggcuaaggcgacgcgcgaagcccagaaaagagcggccgccgggaucaugaaaaaccccaccguggauggaaucaccgugaucgaccuggaaccuaucccguacgaccccaaguucgagaagcagcuggggcaggucauguugcucgugcucugcgugacccaaguccugaugaugcgcacaacaugggcucucugcgaggcccugacccuggcuaccggccccaucuccacacucugggaagggaaucccggccgguucuggaacaccaccaucgccguguccauggccaacauuuuccguggcagcuaccuggcgggggccggccucuuauucuccaucaugaagaacaccacuaacacccggcgcgguaccgggaacauuggggaaacacugggggagaaguggaagagucggcuuaacgcucucggcaaauccgaguuucagaucuacaagaaguccgggauccaagagguugaccgcacgcuugccaaggagggcaucaagaggggcgagaccgaccaccacgccgucucccgcggcagcgccaagcucaggugguucguagaacgcaacauggugaccccggagggcaaagucguggaucuugggugcggccgcggugggugguccuacuacuguggcgggcuaaagaaugugcgcgaggugaaggggcugaccaagggcgggccagggcacgaggaaccgauccccaugagcacguacggauggaaccucgugcggcugcagucagggguggacguguucuucaccccgcccgagaagugcgacacccugcucugugacaucggcgaguccucccccaaccccaccaucgaggccggccgcacgcugcgggugcuaaaccucguggagaauugguuaaacaacaauacccaguucugcauaaaaguucuaaacccuuacaugcccagcgugauagagaaaauggagacgcuacaacgcaaguacgggggcgcacugguccguaaccccuuaagccgcaacucgacccaugagauguacuggguaagcaacgccacuggcaauaucgugucaagcgugaacaugaucucccgcaugcugaucaaccgguucacgaugaaacacaagaaggcgacguacgagccggacguggaccucggcagcgggacccgcaacauaggcauagaaaacgagauuccuaaccuggacaucaucggaaagcggauugagaagaucaagcaggagcacgagaccuccuggcacuacgaccaggaccacccuuacaagacgugggccuaccaugggucuuacgagaccaaacagaccggcagcgccagcuccauggucaacgggguggucaagcuucucaccaagcccugggauguggugccgauggucacgcagauggccaugaccgacaccacccccuucggacagcagcgcguguucaaggagaagguagacacgagaacccaggagcccaaggagggcaccaagaagcuuaugagaaucaccgccgaguggcuguggaaggagcucgggaagaaaaagacgccccggaugugcacccgcgaggaguucacccggaaggucaggagcaacgccgcccugggugccauauucaccgaugagaacaaguggaaguccgcacgggaggccguugaggacucucgcuucugggagcucgucgaccgggagcgcaaccuccaccuggaagguaagugcgagacuugcguguacaauaugaugggcaagcgggagaagaagcugggggaguucggcaaggcgaagggcucccgcgcuaucugguacauguggcucggggcccgguuccuggaauucgaggccuugggcuuccucaacgaagaccacugguucagccgcgggaacucgcuguccggcguggaaggggagggccugcacaaacuagguuacauccugagggaugucucgaagaaggagggcggcgcgauguacgcggacgacacggccgggugggacacccgcauaacccuggaggaccucaagaacgaagagauggugacgaaccacaugaaaggcgaacacaagaagcuggccgaagcaaucuucaaguugaccuaccaaaacaaggugguccgggugcagcgccccacaccccgggggaccgugauggacauuaucucccggaaggaucagcgcggcucuggccaggucggaacguacggccucaacaccuucaccaacauggaggcucagcugauacggcagauggagggggagggcauauucaaguccauccagcgccugaccgugacggaggagaucgccguacagaacuggcucgcccgggucggacgcgagcggcugucgcgcauggccaucuccggggacgauugcguagugaagccccuggacgaccgguucgccagcgcgcucaccgcacugaaugacaugggaaagguccgcaaggacauacagcaaugggagcccucccggggguggaacgacuggacccaggugccguucuguagccaccauuuccacgaacuggugaugaaggacggccgcgugcucguggugccaugcagaaaccaggacgaguugaucgggcgcgcccgcaucucccagggcgccggcuggucacugaaggagaccgccugccucggcaaguccuacgcgcagauguggacgcugauguauuuccauagacgggaucugcgucuggccgccaacgccaucuguuccgccguccccucccauugggugcccaccagccgaacuaccugguccauccacgccaaacacgaguggaugacgacggaggacauguuagccguguggaaccgcgucuggauacaggagaacccguggauggaggacaagaccccaguugagagcugggaggaggugccauaccugggcaagcgcgaggaccaguggugcggcucccuaauagggcugaccucccgggccaccugggccaagaacauccagacggcaauaaaccagguccgcagccuaaucggaaacgaagaguacaccgacuacaugcccuccaugaagcgguuccgcaaagaggaggaggaggccggcgugcuaugguga

SEQ ID NO: 25259 - RNA, 9876 nt, Artificial Sequence
  derived and/or modified CDS sequence (opt11) from DENV-2__EU482733__SS-prME
accgccggcgugaucaucaugcugauacccaccgcuauggcauuccaccucacgacccggaacggggaaccccacaugauagucggccgacaggaaaaagggaagucguugcuuuucaaaacugaggacggcgugaacaugugcacccucauggccauagaccugggggagcugugugaggacaccaucaccuauaagugcccccuacugcggcagaacgagccggaggauauagacugcuggugcaauaguaccagcaccugggugaccuacgggaccugcacgacgacuggugaacaccggcgcgagaagcgguccgucgccuuagugccccacgugggcaugggccucgagacaaggaccgaaaccuggauguccagcgagggggccuggaagcacguccagcggaucgagaccuggauacugcgccacccgggguuuacgaucauggcggcgauccucgcuuauaccaucgguacaacgcauuuucagcgcgcccucaucuuuauacugcugaccgcuguggcgccgagcaugaccaugcgcuguaucgggauuuccaaccgugacuucguagaaggggucaguggaggguccuggguagacaucguacucgagcacgggucgugcgugacaacaauggccaaaaacaagcccacguuagacuucgaauugaucaaaaccgaggccaagcagcccgccacccuccgcaaauacugcaucgaagcuaaauuaacgaacaccaccacggaaucaagaugcccuacgcagggcgagcccagccugaacgaggagcaagauaagcgcuuuauuugcaagcauuccaugguggaccgcggcugggggaacgggugcgggcuguucgggaaaggcgggauuguuaccugcgcgauguucacgugcaagaagaauauggaggggaagguagugcugccggagaacuuagaguacacgauaguaaucacgccucacagcggugaggagcacgccgugggcaacgacacagggaagcacggcaaggaaaucaagaucacaccgcaguccagcaucacagaggccgaacucaccggguacggcacggugaccauggaaugcagcccccgaacgggccuggacuucaaugaaaugguguuacuucagauggaggauaaagccuggcugguccaccgacaaugguucuuggaccucccccugcccuggcugccgggcgccgauacccagggaaguaacuggauccaaaaggagacgcucgugacuuucaaaaacccccacgcgaagaaacaggacguggucguacuggguucgcaggagggcgcuaugcacacagcauuaacuggcgccacggaaauacaaaugagcucugguaaccucuuauucaccggccaccugaagugccgccuccggauggacaaguugcaacucaaagggauguccuauagcauguguaccggcaaguuuaaaaucgucaaggagaucgccgagacacagcacgggacgaucgugaucagggugcaguaugagggcgacggcucucccuguaagauucccuucgaaauuauggacuuagaaaagcggcacgugcuugggcgucugaucaccgugaaccccaucgugacugagaaggacucucccgugaacaucgaggcggaacccccguucggcgauucauauaucaucauuggcguggaaccgggacagcucaagcuaaacugguucaagaagggaucauccauuggacagauguucgaaaccacgaugcgcggggcaaaacggauggccauccuuggggauaccgcuugggacuucggcagccucgggggcgucuuuacauccaucggaaaggcccugcaucaggucuucggcgcaaucuacggggcugccuucagugguguguccuggacgaugaaaaucuuaauaggcgugaucauaaccuggaucgggaugaacagccgcagcacuagccuguccgugagccucguacugguaggcguugugacacuguaccugggggugaugguccaagccgacuccgggugcgugguaagcuggaagaacaaggagcuuaagugcggcuccgggauauuuauuaccgacaacguccacacguggaccgaacaguauaaguuccagcccgagagccccucuaaguuggcguccgccauacaaaaagcucacgaggaaggaauaugcgggauacggagcgugacccgccucgagaaccuaauguggaagcaaaucacucccgagcugaaccauauacucuccgagaacgagguaaaguuaaccauuaugaccggcgauaucaaggguauuaugcaggccgggaagcgcucacuacgcccgcagccuacugaguugaaguacuccuggaagacguggggcaaagcuaaaaugcuguccacagagagccacaaucagacauucuugauugacgggcccgagaccgcagaauguccuaacaccaaccgggcuuggaacagccuggagguugaggacuacggcuucgggguguucuccacuaacauauggcugaaacugcgcgagaaacaggacgucuucugcgacaguaaauuaaugucagccgccaucaaagacaacagggccguccaugcggacaugggguacuggauugagagcgcccugaacgacaccuggaaaauggaaaaagccucuuucauugaggucaagagcugccacuggcccaagucccacacccugugguccaacggcguccucgaauccgagaugaucauccccaagaauuucgcggggccaguaucucaacacaacuaucgcccgggcuaucauacccagacugccgggccauggcaccugggcaagcucgagauggacuuugacuucugcgaagggacgacgguuguggucaccgaagauugcggcaacagagggcccagccucagaacgacaaccgcgagcggaaagcuaauaacggaguggugcugccggucaugcacccugccuccuuugcgcuaccggggcgaggacgggugcugguacggcauggagauucgcccccugaaggagaaagaagagaaccuggugaacucucucgugacggcugggcacggccaaaucgacaacuucaguuugggcguccuggggauggcccuguuccuggaggaaaugcugcggacccgcguuggcaccaagcacgcaauuuuacugguggcggucucguucguaaccuugaucacggguaacaugagcuuucgggaucucggccgggugauggucauggugggcgcgacaaugaccgaugacauagggaugggcguuacuuaccuggcccugcuggcggcguucaaaguccgccccaccuucgcggccggccugcugcuccggaagcugacguccaaggaauugaugauggccacaaucggcauagcccuccugagccaguccaccauacccgagacgauucuggagcucacggaugcccuugcgcuaggcaugauggugcucaagaucguucgcaacauggaaaaguaccaacuggccgucaccaucauggcaauaagcugcgugccgaacgccguuauccugcagaacgccuggaaggucuccugcacgauucucgcggcaguuucuguuagcccgcuacugcucacuuccucccaacagaaggccgauuggaucccccuggcguuaaccaucaaaggccucaauccuacagccauuuuucuuaccacguugucgcggaccucaaagaagcgcagcuggccguugaacgaggcugugauggcggucggcaugguguccauucuggccagcagcuugcucaagaacgacauccccaugaccggaccccuggucgccggaggguuguuaacuguuugcuauguucugaccggccgguccgcggaccuggagcuugagcgcgccgccgacgugaagugggaggaccaagccgagaucagcggguccucgccaauccugucaaucacaaucagcgaagacgguuccaugagcaucaagaacgaggaggaggagcagacccugaccauacucauucggacgggccuguuggugaucagcgguguguuuccuguuucgauaccuauaacagcggcagcaugguaccugugggaggugaagaagcagagagcuggcguccugugggaugugccgagcccuccucccguggggaaggcagaauuggaggacggcgcuuaccguauuaaacagcgugggaucuucgguuacagccaaaucggcgcgggugucuacaaggaggggacguuccauaccauguggcacgugacacgaggggcggugcuuaugcacaggggcaagaggaucgagcccuccugggccgacguuaagaaggaccugaucucguaugggggcggcuggaaacucgagggagaguggaaggagggugaggagguccaggugcuugcccuggagcccgggaagaacccccgcgccguccagacuaagcccggccucuucaagacgaacaccgggaccauaggcgcugugucccucgacuucagccccgguacguccgggagccccauaguugaccggaagggcaaggucguaggccuguacggaaacggcguggucacacguuccggggccuacgugucagccaucgcccagaccgagaagucuaucgaggacaacccggaaauugaggacgacauauuccgcaagaagcgccugaccauuauggaccuccaccccggagcgggcaagacgaagcgguaccuucccgccaucgugcgugaggccaucaaacgaggguuacgcacccugauacucgcccccacccgugucguggccgccgagauggaggaagcucuccggggucugccuaucagauaccaaacacccgcuauacgggcugagcacacgggucgagaaaucguggaccugaugugccacgcgacguucaccaugagacugcucuccccgguucgcgugccgaacuacaauuugaucauuauggacgaagcacacuucaccgauccugccucgauagcagcucggggcuacaucuccacucgaguugaaaugggggaggcugcgggcauuuuuaugacugccacaccgccugggagccgcgauccauucccccaguccaacgcacccaucauggacgaggagcgcgagauucccgaacggagcuggaacuccggacacgagugggucaccgacuucaagggcaagaccgugugguucgugccgucaauaaaggccggcaacgacaucgccgccugccugaggaagaacggcaagaaggucauccagcugucccggaagaccuucgacucggaguacgucaagacccgcgccaacgacugggauuucguggucaccacggacaucuccgagaugggagccaacuuccgggccgagcgcgugauagacccccggaggugcaugaagccaguuaucuugaccgacggugaggagagaguuauucuugccgggcccaugccgguuacccacagcuccgccgcccagcgcaggggccgaaucgggcgaaaccccaaaaacgagaaugaccaguacaucuacaugggggagccauuggagaaugaugaagacugcgcccauuggaaggaggcuaagauguuacuggacaacaucaauaccccagagggaaucaucccgagcauguucgaaccugaaagagagaaaguagaugcgaucgacggggaguaucgcuuaagaggcgaggcuagaaagacguuuguagaccuaaugcggcgcggggaccugcccguuuggcuggcguacagaguggcagccgagggaauaaacuacgcugaccgccgguggugcuuugacgguauuaagaacaaccagauccuagaagaaaauguagaaguggaaaucuggaccaaggagggggaacgcaagaaguugaagccgcgguggcuggacgcaagaaucuacagcgacccccuggcccugaaagaguucaaggaguuugccgcgggacggaagucccuaacccuaaacuugauaaccgagaugggccguuuacccacguucaugacccagaaagcgagagacgcccuagacaacuuagccgucuugcauacugccgaaguaggagggagagcguacaaccacgcacuguccgagcugcccgagacacuggagacacuccuacuacucacgcugcuggccaccgugacuggaggcauuuuccucuuccugaugagcgggaagggcaucggcaaaaugacgcucggcaugugcuguaucauuaccgcgucaaucuuacuuugguaugcccagauccagccgcacuggauagcugccagcaucauccuggaguucuuccucaucguacugcugauccccgagccagagaagcagcggacgccucaggacaaccagcucacauacguggucaucgccauccucaccgucguggcggcgacaauggcgaaugagaugggguuccuggagaaaaccaaaaaggaucucggacugggcucgaucaccacgcaagagucugagagcaauauucuggacaucgaccugcgcccagcauccgccuggacuuuauaugccguggccaccaccuucgucacgcccauguugagacacaguauagaaaauuccagcgugaauguguccuuaacggcgaucgccaaccaggccacagugcucauggggcugggucgcggauggccccuuagcaagauggauaucggggugccacuguuggccauaggcugcuacagccaagugaacccgaucacguuaaccgcugccuuacuguuacuggucgcgcacuacgccaucaucggaccuggccugcaggccaaggcgacucgagaggcucaaaaacgcgccgccgccggaauaaugaaaaaccccacgguggacggcaucacuguuaucgaccucgagccuaucccguacgauccgaaguuugagaaacagcugggucaagucaugcugcucguccugugugugacccagguccugaugaugcgcacuacuugggcucucugcgaggcucugaccuuggcgacuggcccuaucagcacccucugggaagggaaccccggccgauuuuggaacaccaccauagccgugucaauggccaauauuuuuaggggcagcuaccuggccggggccggccuacucuucuccaucaugaagaacaccacgaauacccgccgcgggaccggcaacauuggugagacccuuggggagaaguggaagaguaggcugaacgcguugggcaagucagaguuccagauauacaagaagucgggcauccaagagguggaccggacguuagccaaggaggggaucaagcgcggagaaaccgaccaccacgcggucucccgcggcagcgccaagcugcggugguuuguggaacgcaauauggugaccccggagggcaaagucguggaucucgggugugggcgcggcgggugguccuacuacuguggcggguugaagaacguacgggaggucaagggacugaccaaaggagggcccggacacgaggagccuauccccaugagcacguacggauggaaccucgugcggcugcagucgggggucgaugucuucuucacaccacccgagaaaugcgacacccuccucugcgacaucggcgaguccagccccaaccccacgaucgaggccggccguacccugcggguucugaaccucgucgagaauuggcugaacaacaacacccaauucugcaucaagguccugaacccguauaugcccuccgugauugagaaaauggagacccuucagagaaaguacgggggagcccuggugcggaacccccugagccgcaacuccacacacgaaauguauugggucagcaacgcgacugggaacaucguguccagugugaacaugaucucgagaaugcugaucaauagauucacaaugaaacacaagaaagcgacauacgaaccagaugucgaucucggcagugggacccguaacaucggaaucgagaacgagauucccaaucuggauauuaucggcaagcggauagagaaaauaaagcaagagcacgagaccucguggcacuaugaucaagaccaccccuacaaaacgugggccuaucaugggagcuacgagacaaagcagacugguuccgcgagcuccauggugaacggggugguccgccugcugacaaagccgugggacguggugccgaugguuacgcaaauggccaugacagacacaaccccauucggccagcagcggguguucaaagagaaaguggacacccgcacccaggaacccaaggaagguaccaagaaacuuaugcgcaucaccgccgagugguuauggaaggaguuggggaagaagaaaacgccccgcaugugcaccagggaagaguucacccgcaagguccggagcaacgcggcccugggcgccauauucacagacgagaacaaguggaaaagcgcccgggaagccguggaggacucgcgguucugggagcuugucgaccgcgagcggaaucuccaucuggaggggaagugcgaaacgugcguguauaacaugaugggcaagcgcgaaaagaagcugggggaguucgggaaggccaagggcucccgggcgauaugguacauguggcugggggcuagguuccuagaguuugaggcucugggcuuccucaacgaggaccacugguucagccgggggaauagccuaucugguguagagggggagggccugcauaaguuaggguauauucugcgcgacgucucgaaaaaggaaggcggugcgauguacgccgaugacacagcgggcugggacacacggaucacccuggaggacuugaagaacgaggagauggucacgaaccauaugaaaggcgagcacaagaagcuggcugaggccaucuucaaacuuaccuaccagaacaagguaguccgcgugcaacgcccgacgccccgugggacggugauggacaucaucagucgcaaggaucagcgggggagcggccagguggggaccuacgggcucaacaccuucaccaacauggaggcucaacucauccgccagauggagggggagggcaucuuuaagucaauucagcgcuuaacugugacggaggagauagccgugcagaacuggcucgcacgcgucgggcgcgagcgccugucuagaauggccaucucaggcgaugauugcgugguuaaaccccuggacgaccgcuucgccagcgcccucaccgccuuaaacgacaugggcaagguccggaaagacauccagcaaugggagccgucacgcggguggaacgauuggacacaggugccguuuuguucucaccacuuucacgaguuggugaugaaagacggucguguccucgugguacccugcaggaaccaagacgaacugaucgggagagcccgcauuucccagggagccggguggagcuugaaggagaccgccugccucggaaaauccuacgcacaaauguggacgcugauguacuuccaucggcgcgaucugcggcucgccgccaacgccaucugcucagcaguucccagccacuggguaccaacaagccgcaccacauggagcauccacgcgaagcacgaguggaugaccacagaggacaugcuggccguguggaaccgcgucuggauacaagagaacccguggauggaggacaagacgccaguagagagcugggaggaggugcccuaucugggaaagcgggaggaccaguggugcgggucgcucaucggccugaccagccgcgccaccugggccaagaauauccaaacggccaucaaccagguccgcagccugauuggcaaugaggaguauaccgacuacaugcccuccaugaaacgcuuccggaaggaggaagaggaagccggagugcucugguga

SEQ ID NO: 25260 - RNA, 9876 nt, Artificial Sequence
  derived and/or modified CDS sequence (opt11) from DENV-2__EU482734__SS-prME
acggccggagucaucgucaugcugauacccacggccauggcguuccaccucaccacccggaacggggaaccgcacaugaucgugggccggcaagagaagggaaagucccugcuguuuaagaccgaggauggcguuaauauguguacccucauggccaucgaccugggcgagcugugcgaagacacaaucacauauaaguguccacuccugcggcagaacgagcccgaggacaucgauugcugguguaacucaaccagcaccugggucaccuacgggaccugcaccaccacgggcgagcaccgaagggaaaagcgguccguggcccuggugccccacgucgguaugggucucgagacccgcaccgagaccuggaugagcagcgagggggccuggaagcacgugcagcggaucgagaccuggauacuucgacacccggguuucaccaucauggccgcuauccuggcauacaccauuggaaccacucacuuccagagagcccuaaucuucauucuccugaccgccguggcgcccagcaugaccaugagaugcaucggcaucaguaaucgggauuucgucgagggcgugucagggggcucgugggucgacaucguccucgagcacgggagcugcgugaccacuauggccaagaacaagcccacccuggacuucgaacucaucaagaccgaagccaagcagcccgccacccuccgcaaguauuguauagaggccaaacuuacaaacacuacuaccgagucaagaugcccuacgcagggugagccguccuuaaacgaggaacaagacaagcgcuucaucuguaagcacuccaugguggaccggggcugggggaacggaugcggucuguucgggaagggcgggaucgugaccugcgcgauguucacgugcaagaagaacauggagggcaagauagugcagcccgagaaccuagaguacaccaucaugauuaccccccauagcggagaggaacaugcugugggcaacgacaccgggaagcacggcaaagaaaucaaaauuacaccgcaguccucgaucaccgaagccgagcugaccggcuacggcacggucaccauggagugcagccccaggaccggccucgacuucaaugagauggugcugcuucagauggaggacaaggccuggcucgugcaccggcagugguuccuagaucugccccuccccuggcugccaggcgccgacacgcaggguucaaacuggauccaaaaggagacgcugguaaccuucaagaacccacacgcgaagaaacaggacguugugguccucggaucccaggagggugcuaugcacacggcacugaccggggccacggagauucagaugagcagcggcaaccuguuauuuacgggccaccugaagugccgccugcgcauggauaagcuccagcuaaaggggauguccuacucgauguguaccggcaaguuuaagaucgugaaggagaucgcagagacucagcacgggaccaucgucauccgcguucaauacgaaggcgacggcucgcccugcaagauccccuucgaaaucauggaccuggagaaaagacauguccucgggcgccuuaucaccgucaacccgaucgugacugagaaggacagccccguuaacauugaggccgaaccgcccuucggugacuccuacauaaucaucggagucgaacccggucagcuaaagcuuaacugguucaagaagggauccuccaucggccagauguucgagaccacgaugcgaggcgccaagcggauggccauccugggugacaccgccugggacuucgggagccucggaggaguguucaccuccguggggaaggcccuccaccagguauucggcgcgaucuacggcgccgccuucuccggaguguccuggaccaugaagauccugaucggcgugaucaucacguggauuggaaugaacagccgcuccaccagucuuuccgucucccugguucucguuggcgucgugacucuguaccugggggccauggugcaggcugacaguggcugcgucgugagcuggaagaacaaggaacugaagugcggcuccggcaucuucaucaccgacaacguccauaccuggacugagcaguacaaguuccagcccgaaagcccgagcaagcuugcauccgccauccaaaaggcccacgaggaggguaucugcggcauccguagcgucacacgccuggagaaccucauguggaagcagaucacaccagagcugaaccacauccucuccgaaaacgagguuaagcucacgauuaugacaggagacaucaaggggauaaugcaggccggcaagcggagucugcgcccucagcccaccgaacugaaauacucauggaagaccuggggaaaggcgaaaaugcucagcacggagucccacaaccagaccuuccugaucgacgggccggagacagccgaguguccaaacaccaaccgcgcguggaacagccuggaaguagaggacuacggcuucggggucuuuacgaccaacauaugguugaagcuucgcgagaagcaggacguguucugugauuccaagcucaugagcgcggcaaucaaggauaaccgggcggugcacgccgacaugggcuacuggaucgagucggcgcuaaacgacaccuggaaaauggagaaagccuccuucaucgagguuaaguccugccauuggcccaagagccacacccugugguccaacggcguccuugagucugagaugaucauacccaagaacuucgccggucccgugucccaacacaacuaccgcccgggcuaucauacccagacggcagggcccuggcaccucggcaagcuggagauggauuucgacuucugcgaaggcacaacagucgucgugaccgaggacuguggcaacaggggccccucauuacgcacgaccaccgccucuggaaagcucaucaccgaauggugcugccgcagcugcacgcugcccccacugcgcuaccggggcgaggacgggugcugguacggcauggagauccgcccccucaaggagaaggaggagaaccuggucaacagccuugucaccgccgggcacggccaaauagacaacuucucucucggcgugcugggcauggcgcuguuucuggaggagaugcuccggacccgcgugggcacgaagcacgccauccucuugguagcggugagcuucgucacgcugauaaccggaaacaugagcuucagggaccuaggccgcgugauggugauggucggagccacgaugaccgacgacaucggcaugggcgugacguaccucgcgcuccuggccgcguucaaaguacgcccaaccuuugccgccggucugcugcugcggaagcucaccucaaaggagcugaugauggccaccaucggaaucgcacugcucucgcagagcacgauccccgagaccauccuggagcugaccgaugcguuggcccugggaaugauggcccugaagaucgucaagaacauggagaaguaccagcucgccgugaccaucauggccauuaguugcgugccaaacgcagucauacugcaaaacgccuggaagguguccugcacgauccuggcugccguguccgucucuccccuccuauuaaccagcagccagcagaaggcggacuggaucccccucgcccugaccauaaagggccugaacccuaccgccaucuuccucacaacccugucacgcacaagcaaaaaacgguccuggccgcugaacgaggcuaucauggccgugggcaugguuuccauccuugcguccaguuuacugaagaacgacaucccuaugacagguccccucguggccggcggacugcugacggugugcuauguauuaaccggccgaagcgccgaccuagagcuggagcgcgccgccgacgugaagugggaggaccaggcggagaucuccgguagcucccccauacucagcaucaccaucuccgaggacggcucuaugucuauacgcaacgaggaggaagagcagacccugacgauccugauacggaccggucuccuggugaucagcggcguguuccccguguccauccccgucacugcagccgcaugguaccugugggaggucaagaagcagagagccggcgugcucugggacgugccgagcccgccgcccguggguaaggcggaacuggaggacggcgccuaccggaucaaacagcgcgggauccugggcuacucccagaucggcgccgggguguacaaggagggcacguuucauacuauguggcacgugacgcgcggggccguacucaugcaucgcggcaagcggaucgagccgagcugggcugacgugaagaaggacuuaguguccuauggggggggcuggaaacuggaaggggaauggaaggagggugaggagguccagguucucgcgcuggaacccgggaagaacccccgcgcggugcaaacaaagccagggaucuuuaaaaccaacaccgggacgauuggcgccgucucauuagacuucucccccggcaccucuggcuccccuaucguggaccgcaagggcaagguagucgggcuuuacgguaaugguguugugacacgcagcggggccuacgucuccgcgaucgcgcaaaccgagaaauccauugaggauaacccggagaucgaggacgacaucuuccguaagaagcgccugaccaucauggaccuacacccaggcgccgggaagaccaagcgauaccuucccgccaucgugcgcgaggccaucaagagaggccugcgcacccugauccuggcgccgacccgcguggucgccgccgagauggaggaggcccuccgggggcugcccauccgcuaccaaacgcccgcaauccgugcggaacauacaggccgugagaucguagaccuaaugugccacgccaccuucacgaugcgucucuugaguccaguccguguaccuaacuacaaccugaucauuauggaugaagcccauuucacggaccccgccuccaucgccgcccgaggcuacauuagcacccgcguggaaaugggggaggccgcuggcaucuucaugaccgcuacuccucccggcucgcgagacccguucccacagagcaaugcgcccaucauggacgaagagcgcgaaauccccgagcgaucauggaacagcggccacgagugggugacggacuucaaggguaagaccguuugguucguuccguccaucaaggccggcaacgacauagccgcaugucuccgcaagaacgggaagaaggugauccagcugagccggaagaccuucgacagugaguacgucaagacacgcgccaacgacugggacuucguggugaccaccgacaucucagagaugggggcgaauuucaaggccgagcggguuaucgaucccagacggugcaugaagccgguuauacugaccgacggagaagagcgcgugauccucgccggcccgaugccggucacccacuccagcgccgcccaacggcgcggucgcaucgggcggaaccccaaaaacgagaaugaccaguacauuuauaugggggagccccuugagaacgaugaggacugcgcgcacuggaaggaggccaagaugcugcucgacaacaucaacacgccagagggcauaaucccuuccauguucgagcccgagagagagaagguggacgccaucgacggggaguaucggcugcgcggcgaggcucggaagaccuuuguggaccuuaugcgccgcggggacuuacccguuugguuggccuacaagguggcggccgaggggauaaacuacgcagaucgccgguggugcuuugaugggauaaaaaauaaucagauuuuagaggagaacguggaggucgagaucuggacuaaagagggcgagcgcaagaagcuaaagcccagguggcuggaugcgcgcaucuauagcgacccccuggcguuaaaggaguuuaaagaauucgcagccggccggaaguccuuaacccugaaucucauuacggaaauggggcgccugccgacauucaugacccagaaggcccggaacgcccuggacaaccucgccguccugcacacggcggaagccggcgggaaggcauacaaccacgcccuguccgagcuccccgaaacgcuggagaccuuacuccuacugacucuccuugcuaccgugacgggcggcauuuuccuguuucucaugucuggcaagggcaucgggaagaugacacugggcaugugcugcaucauuacugccagcauccuccucugguacgcccagauccagccucacuggaucgccgccuccaucauccuggaguucuuucugaucgugcuccugauccccgagcccgagaagcagcgaacgccccaggacaaccagcugaccuacguggucauugccauccucacggugguggcagccaccauggccaacgagaugggcuuccuugagaagaccaagaaggaccugggccugggcagcauuaccacgcaggagagugaaucgaauauucuugacaucgaccuccggcccgccagcgcguggacccucuacgcugucgccaccaccuucgugacgcccaugcugcgccauuccauugagaauucguccguuaaugucagccugaccgccaucgccaaccaggcuacagugcuaaugggguuaggcaaaggguggccccuuuccaagauggacaucggugugcccuuacuugccaucgggugcuacagccaagugaacccgauuacccugacggccgcccuccugcuguugguggcgcacuaugcgaucaucggucccggccugcaagcaaaggccacccgggaggcccaaaaacgcgcggccgcugguaucaugaagaacccaaccguggacggcaucaccgucaucgaccuggagcccaucccuuacgaccccaaguucgaaaagcagcucgggcaggucaugcuacugauccucugugugacgcagguccucaugaugcggaccaccugggcacugugcgaggcgcucacccuggcgacgggcccaauauccacccugugggaggggaaccccggccgcuucuggaacaccaccaucgccgucaguauggccaacauuuuccgcggcucauaccuugcgggggcugggcuguuauucagcaucaugaagaauacgaccaacacucgccgcggcaccgguaacauuggcgagacgcucggggagaaauggaagucccggcugaaugcccuggggaagagcgaauuccagaucuacaagaaguccggcauccaagagguggaccgcacacuggccaaggaggggaucaagcgcggggagacugaccaccacgccgucagccggggcucagccaagcugcggugguuuguggagcgcaauauggugaccccggagggaaagguaguggaccuggggugcggccgcgguggcuggagcuacuacugcgggggccuaaagaacgugcgcgaaguuaagggccugacgaaggguggccccgggcacgaggagcccaucaccaugucuacuuacggcuggaaccuggugagguuacagagcgggguggaugucuucuucacgccucccgaaaagugcgacacgcugcuaugcgauaucggcgagucgucccccaacccgaccaucgaggcaggccgcacccuccgggugcugaaccugguggagaauuggcucaacaacaacacgcaguucugcaucaaaguccugaacccuuacaugcccagcguaaucgagaagauggagacauuacagagaaaguaugggggugcucucgugcggaacccccugucccgcaacagcacgcacgagauguacugggucucuaacgcaaccgggaauauagucagcuccgugaacaugaucagccggauguugaucaaccgcuucacgaugaagcauaagaaggcaacuuaugagccagaugucgauuugggguccgggacgcggaacaucggcauagagagcgagaucccaaaccucgacaucaucgggaagcgcaucgagaagauuaagcaggagcacgagaccuccuggcacuacgaucaggaccaccccuacaagacgugggccuaucacgggucuuacgagaccaagcagacuggcucggcgucgucgauggugaacggugucguacgccugcugacgaagcccugggacgucgugcccauggucacccaaauggccaugaccgacacuacucccuucggccagcagcggguguuuaaggagaagguggacacucgcacccaggagcccaaggaaggcacgaagaagcucaugaaaaucaccgccgaguggcuauggaaggagcuggggaagaagaagacgccucggaugugcacccgcgaggaguucacgcgaaagguacgcagcaacgccgcacucggcgcgauuuucacggacgagaauaaguggaaguccgcccgagaagccguggaggaugggcgcuucugggagcugguggaucgggagcgcaaucugcaccucgaagguaagugcgagacgugcguauacaacaugauggggaagcgggagaagaagcugggcgaguucgggaaggccaaggggagccgcgcgauuugguacauguggcuuggcgcccgcuuccucgaguucgaggcccugggauuccucaacgaagaccacugguucucccgcggcaacagccuuagcggagucgaaggagagggccugcaccgcuugggguauauucucagggacgucuccaaaaaggagggcggugccauguacgccgacgauaccgcaggcugggacacgcggauaaccuuggaggaucugaagaacgaggagauggugacuaaccacaugaagggggagcauaagaagcuugccgaggccauuuucaagcugacuuaccagaacaaagugguucgcgugcagcgucccacgccgcgcgggaccgugauggauaucaucagccgacgggaccaaagaggcuccggacagguuggcaccuacgggcugaacacguucacaaauauggaggcccaacuaauccggcagauggaaggcgagggcaucuucaaauccauucagcaccugaccgugacugaggagaucgccguccaaaacuggcuggcgcgagucgggcgggagcgccuguccaggauggccauaagcggcgacgacugcguggugaagcccaucgacgaucgcuucgccuccgcccugaccgcccugaacgacauggggaagguacgcaaggacauccaacagugggagccgagccgcgguuggaacgacuggacgcaggugccguucugcagccaucacuuccacgagcucgugaugaaggaugggcgggucuuagugguuccaugccggaaccaagacgaacugaucggccgagcgcgcauaagccagggcgccggguggucccucaaagagaccgccugccuggguaagagcuacgcacagauguggacccugauguacuuccaccggcgcgaccuacgacuggccgccaaugccauuugcuccgcaguucccagccacuggguaccgacgaguagaacuacguggagcauccacgccaagcaugaguggaugacuaccgaagacaugcuggcgguguggaaccgggucuggauccaggagaacccauggauggaggacaagacuccgguggagucgugggaggaggugcccuaccucggaaagagagaggaccaguggugcgggagccugaucgggcucacgagccgagccaccugggcaaaaaauauccaaaccgccaucaaccagguccgcucccucauuggcaacgaggaguacaccgacuauaugcccagcaugaagcgcuuccggcgcgaggaggaggaggccggcguguuaugguga

SEQ ID NO: 25261 - RNA, 9876 nt, Artificial Sequence
  derived and/or modified CDS sequence (opt11) from DENV-2__EU482735__SS-prME
accgccggcgucaucgucaugcugauccccaccgccauggcguuccaccugaccacccggaacggggagccccacaugaucguggggcggcaggagaaagggaagucccuacuguucaaaaccgaagacggggugaacaugugcaccuugauggccaucgaccuaggggagcuaugugaggacaccaucaccuacaaaugccccuugcugagacagaacgaacccgaggacaucgacugcugguguaacagcaccagcaccugggucaccuacgggaccugcaccacuacgggugagcaccggcgggagaaacgguccguggcccugguuccccaugucgggaugggccucgagacccgcacagagaccuggaugagcagcgagggggcauggaagcaugugcaacguaucgagacauggaucuuacggcacccgggauucaccauaauggccgcaauacucgccuacaccaucggcacaacgcacuuccagcgugcccucauuuucauccugcugaccgcgguggcgcccucaaugacaaugcgcuguaucggaauuuccaaccgggacuucgucgagggcgugagcgggggcuccugggucgacaucguccuggagcacgggagcugcguuacuacgauggccaagaacaagcccacccuggacuucgagcugaucaagacagaggccaagcagccugcgaccuuacggaaauacugcaucgaggccaagcuaacgaacaccaccaccgagucgagaugcccgacgcagggcgagcccagccugaacgaagaacaggauaaacgcuucaucugcaaacacaguaugguagaccggggcugggggaauggcugcgggcuguucggcaaaggcgggaucgugaccugugcgauguucacgugcaagaaaaacauggagggcaagaucgugcagccugagaaucuggaguacacgauaaugaucacgccacauagcggugaggagcaugccguuggcaacgacacugggaagcacggcaaagagauuaagaucaccccgcaguccagcaucacugaggccgaacuaaccggguacggcaccgucacgauggaguguagcccccggaccggccucgauuuuaacgagauggugcuguugcagauggaagacaaggccugguuagugcaucggcagugguucuuggaccugccccugcccuggcugccgggagcggauacacaaggcagcaauuggauucagaaggagacgcucgugaccuucaagaacccucaugcgaagaagcaggaugugguggugcuugggucccaggagggcgccaugcauaccgcguuaacuggugcgacggagauccagaugagcagcggcaaucuccuauucaccggucaccugaagugccgccugcggauggauaagcuccagcugaaaggcaugucguacagcaugugcacgggcaaguuuaaaaucgugaaggaaaucgccgagacccagcacggcacaaucgucaucagagugcaguacgagggcgacggguccccgugcaaaauccccuucgagaucauggaccuggagaagcggcacgugcuuggccgccucaucaccguaaacccgaucgucacugagaaggacaguccgguuaacauagaggcggaaccgccguucggcgauuccuacaucauuaucggugucgagccgggccagcugaagcugaacugguucaaaaagggauccuccaucggccaaauguuugagaccacgaugcgaggcgcaaaaaggauggccauccugggggacacugccugggacuuuggcucucucgggggcgucuucaccuccguggggaaagcucuacaucaggucuucggagcgaucuauggcgccgccuucagcggggugagcuggacgaugaaaauacucauuggcgugaucaucacguggaucggaaugaacaguagaucgacgagccuguccgucagcuuaguccucgugggcgucgugacccuauaccugggggccauggugcaggcugacuccggcugcguugugagcuggaagaacaaggaguuaaagugcggauccgggaucuucaucacggacaacgugcacacguggaccgaacaguauaaguuccagccggagucgcccucgaagcuagccuccgccauccagaaggcccacgaggaaggcaucugugggauccggucggucacccgccuggaaaaccucauguggaagcagaucacccccgagcugaaccauauauuauccgaaaacgaggugaagcucacgaucaugacuggcgacaucaagggaaucaugcaagccggcaagcggagcuugcgcccacaaccaaccgagcuaaaguacuccuggaagacuuggggcaaggcgaagaugcucagcacggagucccacaaccaaaccuuccugaucgaugggcccgaaaccgccgagugcccgaacaccaaccgggccuggaacagccuagaaguggaggauuacgguuucgguguguucaccaccaauaucuggcucaaguugcgcgagaagcaggacguguucugcgauuccaaacugaugagcgccgcuaucaaggauaaccgggccguccacgcggacaugggcuacuggauugaauccgcguuaaaugacacuuggaagauggagaaggccagcuucaucgaggugaaguccugccacuggccgaagagccacaccuugugguccaaugguguacuugaguccgagaugaucaucccaaaaaauuuugcaggucccgugucccagcacaacuaccgcccggguuaccacacccaaacggcggggccuuggcaucucggcaagcuggagauggacuucgauuucugugaggggacuacgguaguggugacagaggacugcggcaaccggggccccucacuccgcacgacgaccgccucggggaagcucaucacagaguggugcugucgguccugcacgcugccaccgcugcgcuaccgcggggaggaugggugcugguacggcauggaaauucgcccucucaaagagaaggaggagaaccuggucaacagccucgugaccgcaggucacggccagaucgacaauuucucccuuggcguguuggggauggcccuuuucuuagaggaaaugcugcgcacacgggugggcacuaagcacgcgauccugcucguugccgugagcuuugugacccuaauuacugggaacaugucauucagagacuuaggucgcguaauggucauggucggagcuaccaugacggacgauaucggcaugggggugacauaccuggcacuucuggccgcguucaaggugcgacccaccuuugccgcugggcuacugcugcggaagcucaccagcaaagagcuaaugauggcaaccaucggcauugccuugcucucacaaucgacgauccccgagacaauuuuagagcugacagacgcguuggcacuggggaugauggcccugaagaucgucaaaaauauggaaaaguaucagcuggccgucaccaucauggcaaucaguugcgugccuaacgcggucauccuucagaacgccuggaaggucagcugcacgauccuugcagccguguccgucuccccgcuccuacugaccucuagccagcagaaagcggacuggaucccccucgcucugaccaucaagggacucaaucccaccgccaucuucuugacaacacuguccagaacuagcaagaagagguccuggccgcugaacgaagccaucauggccgugggcauggucagcauacucgcgucuagccuucugaagaaugacauccccaugaccgggccccucguagccggagggcugcugacggugugcuacguccuaaccggccgcagcgcagaccuggagcucgaacgggccgccgacgugaagugggaagaccaagcagaaauauccgggucuucccccauucucagcaucaccaucucagaagacggcagcauguccauucgcaacgaggaggaggaacaaacccugacgauccucauccggacaggcuuauuggucaucucuggggucuucccagucuccauucccgugaccgccgccgcaugguacuuaugggaggucaagaaacagagagccggagugcucugggacgugccgucuccgccgcccguagggaaggcggagcuggaggauggcgccuaccggaucaagcagcgcgggauccugggcuacucccagaucggggccggggucuacaaggagggcaccuuccacaccauguggcaugucacacgcggagccguccucaugcaccgaggcaagcggaucgagcccagcugggcugacguaaaaaaggaucugguaucuuacgggggcgguuggaagcuggaaggggaguggaaagagggcgaggaaguccagguuuuggcgcuagagccuggcaagaacccccgcgccguacagaccaaacccgggaucuucaagaccaacaccggaacgauuggcgccgucagccuggacuuuuccccuggcaccagcggguccccuauuguggacaggaagggaaagguggucgggcucuauggcaacggaguggucacccgcagcggagccuacgucucugccauagcccaaaccgagaaguccaucgaggacaacccggagaucgaagacgacauauuccgaaagaagcggcugacaaucauggaccugcacccgggcgcugggaagaccaagcgguacuuacccgccauaguccgcgaggccaucaagcggggccugcgcacgcuaauccuggcgccgacgcgcguggucgccgcugaaauggaagaggcccuccgggggcugcccauccgcuaccagaccccagccauacgcgcggagcacaccggccgcgagauuguggaucugaugugccacgccaccuuuacuaugcgacuccugagccccguccgcgugccgaacuacaacuuaaucaucauggacgaggcucauuucacugaccccgcuuccaucgccgcgcggggguacaucaguaccagaguagagaugggugaggccgccggcauauucaugaccgccacgccacccgggucccgcgacccuuucccacagagcaaugcacccaucauggacgaggagcgcgagaucccggagcgguccuggaacagcggccacgagugggugaccgauuucaaggggaagacggucugguucgugccguccaucaaggcgggcaaugauauugccgcuugcuuacgcaagaacggcaagaaggugauccaacugagccggaagaccuucgacuccgaauaugucaagacccgcgccaacgacugggacuucguuguaacgaccgauaucagcgagaugggggcgaacuucaaggccgagcgggucauagacccucgccggugcaugaaacccgucauccugaccgacggcgaggagcgggugauacucgcugggcccaugccgguuacccacucgagcgcugcacaacgucgcggucgcaucggacggaaccccaagaacgagaacgaucaauacaucuauaugggggagccgcuggagaacgacgaagauugcgcacauuggaaggaggccaagaugcugcucgacaacaucaacacuccugaaggcauaauuccgucuauguuugagccagagcgcgagaagguggacgcgauagauggggaguacagauuacggggagaggcccggaagaccuucguggaccugaugcgccgcggcgaccucccagucuggcuggccuauaagguggcugccgaggggaucaacuacgcggaccgccgguggugcuucgacgggaucaagaauaaccaaauccuggaggagaacguggaggucgagaucuggacaaaggagggcgagcggaagaagcuaaagccgcgcuggcuagacgcgaggaucuauagcgacccccuggcgcucaaagaguucaaggaguucgccgccggccgcaagucccugacacugaaccuuaucacggaaauggggaggcuucccacauucaugacccagaaagcccggaacgcgcuugacaaucucgcgguucugcacaccgcggaagccggcgggaaggccuauaaccacgcucuaagcgagcuccccgagacgcuggaaacccuguugcuccuaacccuccuagcgacagucacgggaggcaucuuccuguuucucaugagugggaagggcaucgggaagaugaccuugggcaugugcugcaucaucaccgccucgauccuguuaugguacgcccagauacagccccacuggaucgccgcguccaucauucuggaguuuuuccugaucguacuacugauccccgagcccgagaagcagcgcacgccccaggauaaccaacugaccuacgugguuaucgcgauucucacggugguugcugccacgauggccaaugaaauggguuucuuagagaaaaccaagaaggaucugggccugggcagcauuaccacgcaggagucagagaguaacauucuggauaucgaccugcggccggccagcgcguggacccuuuacgcuguggcgaccaccuucgucacgcccaugcugcgacacuccaucgagaacagcuccgugaacgucagccugaccgccaucgcgaaccaggccacgguucucauggggcugggcaagggguggcccuuauccaaaauggauauaggggugccacuucuggccauagggugcuacucucagguaaacccgaucacucucacggccgcucuccuacugcuaguagcccacuacgccaucaucggucccggcuugcaggccaaagcuacucgggaggcgcagaagcgcgcggccgccgggauuaugaagaaccccaccguggacggcaucacugucaucgaccuggagcccaucccguacgaucccaaauuugagaaacagcucggacaggucauguugcuuauccucugcgugacgcagguccugaccaugcggaccaccugggccuugugcgaggccuuaacacuggcgaccggacccaucuccaccuuaugggaggggaaucccggcagauuuuggaacaccacaaucgccgugaguauggccaacaucuuuaggggcuccuaccucgccggagcgggccugcucuucucgaucaugaagaauaccaccaacacgcggagggggacgggcaacaucggggagacccucggagaaaaguggaagagucggcugaacgcacugggcaagagcgaguuucaaaucuauaaaaaguccgggauccaggaaguggaccgcacccucgcgaaggagggcauuaagcgcggggaaacagaccaucacgccgucuccagggguuccgccaagcugaggugguucguggagcgcaacauggugacgccggaggguaaggugguggaccuagguugcgggcgcgggggcuggucauauuacugcgggggacuuaagaacguucgcgaggucaagggcuuaacgaaaggcggccccgggcacgaggagccaauccccauguccacuuacgguuggaacuuaguucggcuccagagcgggguagacgucuucuucacuccgccagagaagugcgauacgcugcuaugcgauaucggcgagagcucccccaacccaaccauagaggccggacgcacccuccgagugcugaaucuaguagagaacuggcucaacaacaacacccaguucuguaucaagguccugaacccguacaugccgagcgugaucgagaagauggagacacugcaacgcaaauaugguggcgcccucgugaggaauccccugucccgcaacagcacucacgagauguacugggucucaaaugcuacugggaauaucgugagcuccguaaacaugaucagccgaaugcuuaucaaccgcuucacgaugaagcacaagaaggccaccuacgagccggacgucgaccuggguuccgggacgcggaacauaggcauugagagugagauacccaaccucgacauaaucggcaagcgcaucgagaaaaucaagcaagaacacgaaaccuccuggcacuacgaucaggaucacccuuauaagaccugggccuaccacggaagcuacgagaccaagcagacggguucggcguccaguauggugaauggggugguucggcuguuaaccaagccgugggaugucgugccgauggucacgcagauggcaaugaccgacacgacccccuucggccagcagcggguguucaaggaaaagguggauacccgcacccaggaaccaaaggaaggaacuaaaaagcucaugaagauuacggccgaguggcucuggaaggaguuagggaagaagaaaacgccgaggauguguacccgugaggaauucacccggaagguccgcaguaacgccgcccucggcgcuaucuucaccgacgagaacaaguggaaguccgcccgggaggccguagaggacggacgauuuugggagcuuguggaccgggagcgcaacuuacaccuggagggcaagugugaaacaugcguguacaacaugauggggaagcgggagaagaagcugggcgaguucggaaaggcgaaaggcucgcgcgcgauuugguacauguggcugggcgccagguuucucgaguucgaagcccucggguuccugaacgaagaccacugguucucccgggggaacagccucagcgggguggaaggcgagggacugcaccgacugggguacauccuccgagaugugucgaagaaggaagguggggcaauguacgccgacgauacugcgggcugggauacucggaucacccuugaggaccugaagaacgaggagaugguuaccaaccauaugaagggggaacacaagaagcucgccgaggccaucuucaagcugacguaccagaauaaggugguccgggugcagcggccgacgccccgcggcaccgugauggacauaaucagccggcgcgaccagcgcggcuccgggcaggucggcaccuacggucugaacaccuuuacgaacauggaggcccagcucauccggcaaauggagggcgagggcaucuucaagagcauacagcaccugaccgugaccgaggaaaucgccgugcagaacuggcuugcgcgcguggggcgggagcgccuuucucguauggccaucagcggcgacgauugcguagugaagcccaucgacgaucgcuucgcuagcgcccugaccgccuugaacgauauggggaaaguccggaaggacauccagcagugggagcccucccgcgguuggaacgacuggacccaggugcccuucugcucccaccacuuucacgagcucguuaugaaagacgggcggguccugguggugccuugccgcaaccaggacgaguugaucggcagagcgcgaaucucucagggcgccggguggucgcuaaaggagaccgccugccugggcaagagcuaugcacagauguggacccuuauguacuuccaccggcgagaccuccggcuggccgccaacgcgaucugcuccgccguacccagccacuggguacccaccucccgcaccacguggaguauacacgcuaagcacgaguggaugaccacagaggauaugcuggccguuuggaaucggguauggauacaggagaauccguggauggaagacaagacccccgucgaaaguugggaagagguaccauaccucgggaagcgcgaggaccaguggugcggcagccuaauugggcugacgagccgcgccacuugggcaaagaacauccaaacugcgauuaaucaggugcgcagccucauaggaaacgaggaguacaccgacuacaugcccagcaugaagcgcuuccggcgagaggaggaagaggccggcgugcugugguga

SEQ ID NO: 25262 - RNA, 9876 nt, Artificial Sequence
  derived and/or modified CDS sequence (opt11) from DENV-2__EU482736__SS-prME
accgcgggugucauaaucaugcugauccccaccgcgauggcguuccaccucaccacccgaaacggggaaccucauaugauugucggucggcaggagaaggguaagucccuacuguucaagaccgaggacggugugaacaugugcacucucauggccauagaucugggggagcugugcgaggacaccaucaccuauaaguguccccuccugcgccagaacgaacccgaggacaucgacuguuggugcaacucgaccagcacaugggugaccuacgggaccugcaccaccacgggggagcacaggcgcgagaagcgguccgucgcccuggugccucacguggggaugggccuagagacgcguaccgaaaccuggaugagcuccgaaggggccuggaagcacguucagcggaucgagaccuggauccuccgacacccgggauucaccaucauggccgcgaucuuggccuacaccauagggaccacccacuuccaacgggcccucauuuucauccugcugaccgcaguggcgcccaguaugaccaugaggugcaucggcaucagcaaccgugauuucguggagggagucucagggggcuccuggguggacaucguacucgagcacgggagcugcgucaccacgauggccaagaacaagcccacauuagacuucgagcugauuaaaaccgaagccaagcagcccgcuacccucaggaaguacugcaucgaggccaaacugacgaacaccaccaccgagucucgguguccgacucaaggggagcccagcuuaaaugaggagcaagauaagcgcuucgugugcaaacacuccauggucgaccggggcugggggaauggcuguggucuguuugggaagggcggaaucgugaccugcgccauguucacgugcaagaaaaacauggagggcaagguggugcugcccgagaaccuggaguacaccaucgugaucacgccccacagcggggaggagcacgccgugggcaaugacaccgggaagcacggaaaggagaucaagaucacaccgcaguccagcauaaccgaggccgagcugaccgguuacggcacggugacuauggagugcagcccccgaaccggucuggacuuuaacgagauggucuugcuccagauggaggacaaggccuggcuggugcaccgacagugguuuuuggaccucccgcugcccuggcugccgggggcugacacccagggcucgaacuggauccagaaggagacgcucgugaccuuuaaaaacccccacgcgaagaagcaagaugucgugguccucgggucccaggagggagccaugcacacggcccugaccggggcaacggaaauccagaugagcuccggcaaccuccuguucaccggccaccugaagugccgccuccggauggacaagcugcagcugaaagggauguccuacagcaugugcaccggaaaguuuaagauagugaaggagaucgcugagacccagcaugggacaaucgugauacguguccaauacgagggcgacggcuccccuuguaagauccccuucgagaucauggaccuagagaagcggcacguguuaggccgccugaucacugugaacccuaucguggcggagaaggacagccccgugaacaucgaggcagagccgccuuucggcgacaguuacaucauuaucggggucgagcccggccaacucaagcugaacugguucaaaaaggggucguccaucggccagauguucgagaccacuaugcgcggcgccaagcgaauggccauccugggggauacggccugggacuucggcagccucgggggcgucuucaccucaaucgggaaggcgcugcaccaaguguucggcgccaucuacggcgccgcuuuuuccgggguuucuuggacuaugaagauauuaaucggugucaucaucaccuggauugguaugaacagcagguccacgucacuguccguaagccugguguuggucggcgugguuacccuuuaccucggggcgaugguucaagccgacuccgguugcguggugucuuggaagaguaaggagcugaagugcggaagcgguaucuucaucaccgacaacguccauaccuggaccgagcaguacaaguuccagcccgagagccccuccaagcuagcguccgccauccagaaggcccacgaggagggcauuuguggcaucaggagcgugacccgccucgagaaccugauguggaagcagaucaccccugaauuaaaucacauccuuagcgagaacgaggugaagcucaccauuaugacgggcgacaucaaggggauuaugcaagcgggcaagcggucccugcguccgcagccuaccgaacuuaaguacaguuggaagaccuggggcaaggcaaagaugcuguccaccgagagccacaaccaaacauuucugaucgaugggcccgagacagccgagugcccgaacaccaaccgggccuggaacucacucgaggucgaggacuacggcuucgggguguucacgacgaacaucugguuaaaauugcgcgagaagcaagacguauucugugacagcaagcuaaugagugcugcgauaaaggacaaccgugcagugcaugccgacaugggcuacuggauagagagcgcccugaacgacacuuggaagauggagaaggcgagcuucaucgaggucaaauccugccacuggcccaaaagccacacccuguggagcaacggcgugcucgaguccgagaugaucaucccaaagaacuucgcugggcccguaucucagcacaauuaccgcccgggguaccacacccagaccgccggaccauggcaccuuggcaaguuggaaauggacuucgacuucugcgaggggacgacugucguggucaccgaggauugcgggaaccgggggccaucucucaggacaaccaccgccuccgggaagcugauuaccgaguggugcugcagaagcugcacgcugccuccgcuccgcuaccgcggggaagacggcugcugguauggcauggaaauccggccgcuuaaggagaaagaggagaacuuggugaacucccucgucacggccggccauggccagaucgacaacuuuagccugggcguucuggggauggcccucuuucuggaggagaugcugagaacgcgcgugggaaccaaacacgccaugcuccugguggucgucucuuucgugacccugaucaccgggaauaugaguuuucgggaucucggcagggucauggugauggugggugccacgaugaccgaugacaucgggaugggcaucacguacuuggcucugcucgcggcguuuaagguccgacccacguucgcggccgggcugcugcugcggaagcugaccuccaaggagcugaugauggccacaaucggcaucgccuugcugagccagagcaccauuccggagacaauccuggagcuaaccgacgcgcuagcuuuaagcaugauggugcugaagauagugcgaaacauggagaaguaccagcuugccgucaccaucauggccauauccugugugcccaacgccgugauccugcagaacgcguggaaagucagcugcaccauccucgccgcgguauccgucagcccccugcugcucacuucaucccagcaaaaggcggacuggaucccccuggcucuuaccauuaaggggcucaaccccacugccaucuuccugacaacacugucccggaccucaaagaagcgcuccuggccacucaacgaggccaucauggccguaggcauggugagcauccucgcuucgucccugcuaaagaacgacaucccgaugaccggcccccuggucgccgggggcuuacuaacagugugcuacguguugacggggcggucagccgaccuggagcuggagcgcgccgccgacgucaagugggaggaccaggccgagauauccgggagcucccccauccuaagcauaaccauauccgaggacggcagcauguccaucaagaacgaagaagaggagcaaacacugaccauccucauccgaacgggucugcuggucaucagcggcgucuucccggucuccauccccauaaccgcugccgccugguaccucugggaagugaagaagcagagggccggggugcugugggacgucccuuccccgccgcccgugggaaaggccgagcuggaggacggggccuaucggaucaagcaacgcggcauucucggguacucccagaucggcgccggcguguacaaggaagggaccuuccacaccauguggcacgucacuagaggcgccgugcugaugcaccgggggaaaagaaucgaacccagcugggccgacgugaagaaagauuugaucuccuacggcgggggcuggaaacuggaaggcgaguggaaggaaggggaggagguacaagugcuggcucucgagccaggcaagaacccccgcgcgguucagacgaagcccggccucuucaagaccaacaccggcaccauuggugccgucagccuggacuucucccccggcacgagcggcagccccaucguagaucggaaggggaagguggugggccuguaugggaacggcguggugacccgcagcggcgccuacgucagcgccaucgcgcaaaccgaaaaguccaucgaagacaaccccgagaucgaggacgacaucuuccggaagaagcgccuaaccaucauggacuuacacccgggggccggcaagacgaagcgguaucugcccgccaucguacgcgaggccaucaagagggggcugcgcacccucauccucgccccuacccguguggucgcggccgagauggaggaggcccuccggggccuucccaucagguaccagacccccgccauccgggccgagcacacggggcgggaaaucguggaucugaugugucacgccacauucacuaugcgucugcucagcccuguucgcgucccgaacuacaaccugauaaucauggacgaggcucacuucaccgaccccgcuuccaucgccgcccgaggcuauaucagcacccgcguggaaaugggagaggcggcagggaucuuuaugaccgccacgccacccggcucccgcgacccuuuuccccagagcaacgcgcccaucauggacgaggagcgcgagauucccgagcggucguggaacucuggucaugagugggugacagauuucaagggcaagacgguuugguuuguucccagcaucaaggcggggaacgacaucgccgcuugccugcgcaagaacggcaagaagguaauccagcucagccguaagaccuucgauuccgaguacgucaagacacgcgccaacgacugggacuucguggugacaaccgacaucagcgagaugggcgccaacuucaaggcugagcgugucauugacccucgccggugcaugaagcccgugaucuugaccgacggggaggagcgugugauccuggccggccccaugccggugacccacuccagcgccgcccagcggcgcggccguauugggcggaacccgaagaacgaaaaugaucaguacauauauaugggggagcccuuggagaacgacgaggacugcgcccacuggaaggaggcaaaaaugcugcuggauaacaucaacacgcccgaagguauaaucccguccauguucgagcccgagcgugaaaagguggaugccaucgacggcgaguaccgucucagaggggaagcccggaagacuuucguggaucugaugcgcaggggcgaccugcccgucuggcucgccuaccgcguggccgcggaagggaucaacuacgcugaccggcgcuggugcuucgacggcaucaaaaauaaccagaucuuagaggaaaacguggaggucgagaucuggaccaaagagggggagcgcaagaagcugaagccgaggugguuggacgcucgaaucuacagcgaccccuuggccuuaaaagaguucaaggaguucgcggcgggccgcaagucccucacucugaacuugauuacugaaaugggccggcuucccacuuucaugacccagaaggccagggacgcccuugacaaccuggccguacuccacaccgcggaggccggaggcagggccuacaaccacgcccuuagcgaguuacccgaaacgcucgagacguuauugcucuugacccugcucgcuacgguuaccgggggaaucuuucuguuccugauguccggcaaggggauaggcaaaaugacgcucgggaugugcugcaucauaacggcgagcauauuacugugguacgcccagauccagccgcacuggaucgccgcuagcaucauucuugaguucuuccugaucgugcugcugauccccgagcccgagaagcaacgcacgccccaggacaaccagcugacuuacgugguuaucgccauccugaccgugguugcggcaacgauggcaaacgagaugggcuuccucgaaaagacgaagaaggaccuggggcucggauccaucgcaacccaagagucagaaucgaacauccuugauauagaccugcguccugccuccgcguggacauuguaugcaguagccacgaccuucgugacccccauguugcgccauuccaucgagaacucuagcgugaaugucucgcugacagccaucgcgaaccaagccaccguacugaugggccucggcaaggguuggcccuuauccaagauggacaucggggucccccugcucgccauagggugcuacagccaggucaacccgaucacccugaccgcagcacugcuccugcugguggcgcauuacgccaucauugggcccggucuccaggccaaggccacacgggaggcccagaagcgcgcggccgccggcaucaugaaaaaccccaccguggacggaaucaccguaaucgaccucgaaccuaucccguacgaccccaaguucgagaagcagcugggccaaguaaugcuccugauccugugugugacccagguccucaugaugcggaccacaugggcccugugcgaggcccugacccuugcgacaggucccauuagcacccugugggagggcaaccccgggcgguucuggaauacgacuaucgcugugagcauggccaacauauuccgcggcuccuaucuggccggcgcggggcuccuauucagcauuaugaagaacaccaccaacacucgccguggcaccgggaacaucggggagacccugggcgagaaguggaagucccgucucaacgcccuggggaaaagcgaguuucagaucuacaagaaguccgguauccaagagguggaccgaacccuggccaaggaggggaucaaacggggagagacagaccaccaugccgucagccgcggguccgccaagcuccguugguuuguggaacgcaacauggucaccccugagggcaaggucguggaccugggcugcggucggggaggguggagcuacuacugcggcggguugaagaacguucgcgagguaaagggacucaccaaggguggccccggacacgaggagcccaucccaaugucgaccuacggguggaaccuggugcggcuccaguccggaguggacguauucuuuacgccgccggagaaaugcgacacccuccugugcgacaucggggagagcagcccaaaucccaccaucgaggcgggccgcacucugcgggugcucaacuugguggagaacuggcugaacaacaacacgcaguucugcaucaagguccugaacccguacaugcccagcguuauagagaaaauggaaacccugcagcgaaaauacggcggagcccugguacggaacccuuuaagccgcaacagcacccacgagauguauugggucuccaacgccacggggaacauugugucguccgugaacaugaucagccggaugcucauaaaccgcuucacaaugaagcacaagaaagcuacauacgagccagacguggacuuaggcuccggcaccagaaacaucgggaucgagagcgagauacccaaccuggacaucaucgguaagcggaucgaaaagaucaagcaagagcacgagacuuccuggcacuacgaccaggaccacccauacaaaacuugggccuaucauggcuccuacgaaacgaagcaaaccggguccgcaagcucaauggugaacggcgugguacgccuccugaccaagcccugggacguggugccuauggucacccagauggcaaugacugacaccacccccuucgggcagcaacggguguucaaggagaagguggauacccggacgcaggagcccaaggagggcacgaagaaguugaugaagauuaccgccgaaugguuauggaaggagcugggcaagaagaagacgccgcggauguguacucgcgaagaguuuacaagaaaggucagaagcaacgccgcccucggagcgauauuuaccgaugagaauaaguggaaguccgcccgggaggcgguggaggauagccguuucugggaacuuauugaccgggagcgcaaccugcaccuagaaggcaaaugugaaaccugcgucuacaacaugaugggaaagagagagaagaaacucggcgaguucgggaaagccaagggcagccgugcuaucugguacauguggcugggcgcccgguuccuggaguucgaagcccucggguuccugaaugaggaccacugguuuucccgcggcaacagccugaguggagucgagggcgaggggcuccaccggcugggauacauccuccgugacgugagcaagaaggagggcggggccauguacgccgacgacaccgcgggcugggacacccgcaucacccuagaggacuugaaaaacgaggagaugguuacgaaccauaugaagggggagcacaagaaacucgccgaggccauauucaaacucacguaccaaaacaagguggugagaguccagcggcccacgccccgcggaaccgugauggacaucauuucgagacgggaccagcgggggagcggccaggucggcaccuacgggcuaaacacguucaccaacauggaagcccagcugauccggcagauggaaggcgaggggaucuucaagagcauacagcaccucaccgucacugaggagauugccgugcagaacuggcuggcgcgcguuggucgggagcgccugagccggauggcgaucuccggcgacgacugcgucguaaagccucucgacgaccgguucgccagcgcccugacggccuuaaaugacauggggaagguccggaaagacauccaacagugggagcccucucgggguuggaacgacuggacccaggucccguucugcagccaccacuuccacgagcucgugaugaaggauggacgggugcuaguugugccuugccgcaaccaagaugagcugaucggccgggcgcgcaucucccagggagccggcuggucucuaaaggagacagccugucuaggcaaauccuacgcacagauguggacccugauguauuuccaccggcgcgaccuccgguuggccgcgaacgccaucugcagcgcggugcccucgcacuggguccccacgucucgaacgacguggagcauacacgccaaacacgaguggaugaccaccgaggacaugcuggcgguguggaaccggguguggauccaggagaacccguggauggaagauaagacgcccgucgaguccugggaggaggugcccuaccucggcaagcgcgaagaccagugguguggcagccugaucgggcugaccagucgugccacaugggcaaagaacauccagaccgcuaucaaucaggugcggucucucaucggaaacgaggaguauacggacuauaugcccuccaugaagcgcuuucggcgggaggaagaggaggccgguguauuaugguga

SEQ ID NO: 25263 - RNA, 9876 nt, Artificial Sequence
  derived and/or modified CDS sequence (opt11) from DENV-2__EU482737__SS-prME
accgcgggagugaucgucaugcugauccccaccgcgauggcauuccaccugaccacucgaaacggggagccgcacaugaucgucggcaggcaggagaaggguaaaucucugcuguucaagaccgaggauggggugaacaugugcacacucauggcuaucgaccugggagaauuaugcgaggauaccaucaccuacaagugcccccuguuaaggcagaacgagcccgaggacaucgacugcuggugcaacuccaccagcaccugggucacguacgggaccugcaccaccacgggugagcacagacgcgagaaacggaguguggcccuugugccccacgucgggaugggcuuagagacccgaaccgaaaccuggaugucaagugagggggccuggaaacacgugcagcggaucgagaccuggauccuacgccacccgggauucacgaucauggccgcgauccuagcauauaccaucgguaccacccacuuccagcgggcccucaucuuuauccuucugaccgccguggcgcccagcaugacgaugcgcuguauagggaucagcaaucgggacuuugucgagggcgugagcgggggauccuggguggacaucgugcucgagcaugggucuugcgugaccacgauggcaaagaacaaaccgacccuggacuucgagcugaucaagaccgaggccaaacagcccgccacccuccgcaaguacuguaucgaggcuaaacugacgaacaccaccacggagucccggugcccgacgcagggcgagcccagccugaacgaggagcaggacaagcgcuucgugugcaagcacuccaugguggaucguggcuggggcaauggcugcggucuguucggcaagggcgggaucgugaccugcgcgauguucacgugcaagaaaaacauggagggcaagguggucuugcccgagaaucuggaguacaccaucgucauaacgccccacagcggggaagagcacgcggugggcaacgacaccggcaagcacgggaaggagaucaagauuacgccgcaguccagcauaaccgaggcagaacuuaccggguacggcacugucacaauggaaugcuccccucgcaccggcuuggacuucaaugagauggugcugcuccagauggaggacaaggccuggcuggugcaccggcaaugguuccuagaccucccccugcccuggcugccgggggccgacacucaaggcaguaacuggauucagaaggaaacgcucgugaccuucaagaacccccacgcgaagaaacaggacguugucgugcuggggucccaagagggcgccaugcacaccgcccugaccggggccacggagauucagaugagcagcggcaaccucuuauuuaccggccaccugaagugccgccugcgaauggacaaacuucagcugaaggggauguccuacagcaugugcacaggcaaauucaagaucgugaaggagaucgccgaaacccagcaugggacgaucgucauccggguacaguacgagggcgacgggucccccugcaagauuccauucgaaaucauggaccucgagaagcggcacgugcuggggcgccuaaucaccguuaacccgaucguggcggagaaggacagccccgugaacauugaggccgagccgccauucggugacuccuauaucaucaucgggguugaaccgggccagcucaagcuaaacugguucaagaaagggucaucgaucggccagauguucgaaaccaccaugaggggggcuaagcggauggccauacugggggauacggccugggauuucgggagccucgggggcguuuucaccuccaucgggaaggcgcugcaccagguuuuuggcgccaucuacggcgccgccuuuucgggggucuccuggaccaugaagauacugauuggugucaucaucaccuggauagggaugaacucacgauccacgagccuguccguuagccucguccuggugggcguugucacucuguaccucggagcuauggugcaggccgacuccggaugcguggucagcuggaagagcaaggagcugaaaugcgggucagggaucuucaucacagacaacguacacaccuggacggagcaauacaaguuccagcccgagucacccuccaagcuggccagcgccauccagaaggcccacgaggaaggcaucugugggauccggucagugacuaggcuggagaaccugauguggaagcagaucacacccgagcugaaucacaucuugagcgagaacgaggucaagcugaccaucaugacgggcgacaucaaggggauaaugcaggcgggcaagcggucccugagaccgcaacccacggaguugaaguacuccuggaagacguggggcaaggccaagaugcugagcaccgagagccauaaccagacauucuuaaucgacgggcccgagaccgccgaaugcccgaacaccaaccgggccuggaacucccucgaaguggaggauuacggauucgggguguucaccacuaauaucuggcugaagcuacgcgagaagcaggacgucuuuugcgacagcaagcugaugagugcugcgaucaaggacaauagagccguccaugccgacaugggauacuggaucgaaucggcccugaaugacaccuggaagauggaaaaggcguccuucaucgaggucaagagcugccacuggccgaagucccacacccuguggaguaacggcguacucgaaagugaaaugaucauccccaagaacuucgccgggcccgucagccaacacaauuacagaccgggcuaccacacccagaccgcgggucccuggcaccugggcaagcuagagauggacuuugacuucugugaggggacgaccguggucgugaccgaggacugcgggaaccgaggcccaagccucagaaccacgaccgccuccggaaagcugaucaccgaguggugcugucggagcuguacccuacccccacugcgcuaucggggggaggacgggugcugguacggcauggagauccgcccacugaaagagaaagaggagaaccuggugaacucacucguuacggccgggcacggccagaucgacaauuuuagccugggcguucuaggaauggccuuauuccuggaggagaugcugcggacacgcguggguaccaagcaugccaugcucuuagucgugguauccuuugucaccuuaaucacggggaacaugagcuuccgggaccucgggcgcgugauggucaugguaggggcaacaaugacggacgacaucggcaugggaaucaccuaccuggcccugcucgccgcguucaaggugcgccccacguucgccgccgggcugcuguuacggaaacuuaccaguaaggagcugaugauggccacuaucggcaucgcccuccugucccaguccaccauccccgagacgauccuggagcucaccgacgcguuagcccugagcaugaugguguuaaagauaguccgcaacauggagaaguaccaacucgccgugacuaucauggccaucaguugcgugccgaacgcuguaauacugcagaaugcguggaaggugaguugcaccauccucgccgccgucuccgugucaccccugcugcucacguccagccagcagaaggcggacuggaucccccuggcguugacgaucaaagggcucaaccccaccgccaucuuccugaccacgcugucccggaccagcaagaaacgcuccuggccgcucaacgaggcgaucauggccguaggcaugguaagcauccuggccucgucccuacucaaaaaugacaucccuaugaccggcccccugguggccggugggcucuugaccgugugcuacguguugacggggcggagcgccgaccuggagcucgaacgcgcugcagacgugaagugggaggaucaggcagagauuuccggaagcucccccauccugagcauaacuaucuccgaggacgggagcaugagcaucaagaacgaggaggaggaacagacccugacaauccucauccggacgggcuuacuggugaucagcggcgucuuccccguguccauccccaucaccgccgccgccugguacuugugggaagugaagaagcagcgcgccgggguccugugggacgugcccagcccgccuccuguaggcaaggccgagcuggaagacggggcguauagaaucaagcagcgcgggauucucgguuacucccagaucggcgccggagucuacaaggaggggacauuccacaccauguggcaugugacccggggcgccguucugaugcaccgagggaagcggaucgagcccagcugggccgacguaaaaaaggaccuaauuuccuacggcggaggcuggaagcuggagggugaguggaaagagggggaggagguccagguguuggcccuggaacccggcaagaacccucgcgcgguccagaccaagcccggccucuucaagaccaacaccggcaccaucggggccguuucgcuggacuucucccccggcaccagcggcagccccauaguggacagaaaggguaaggucgugggcuuauacgggaacggcgugguuacgcgcagcggcgcuuacgugagcgccaucgcccagaccgaaaaguccaucgaggacaaccccgagauugaggacgacauauuccggaaaaaacgcuuaaccaucauggaccugcaccccggggccgguaagacgaagcgguaucugcccgcgaucgugcgcgaggccauaaagcgggggcuccgcacccucauacuggccccgacgcgcgucgucgcggcggaaauggaggaggcccugcggggacuccccauucgcuaccagacccccgcuauaagagccgagcacacagggcgcgagaucgucgaucugaugugucacgccaccuuuaccaugcggcugcucagccccgucagaguaccgaacuauaacuuaauaaucauggaugaggcccacuucacagaccccgccucaaucgccgcucggggcuacaucagcacgcguguggagaugggggaagcugccgggaucuucaugacugccaccccgccggggagucgggacccguuuccccagagcaacgccccuaucauggacgaggaacgcgagauccccgaacggucuuggaacagcgggcacgagugggucaccgacuucaagggcaaaaccgugugguucgugccauccaucaaggcugggaacgacaucgccgccugccugcgaaagaacggcaagaaggucauccagcucagccggaaaacguucgacagugaauacgugaagacgcgcgccaacgauugggauuucguggucacgacugacauauccgagaugggcgccaacuucaaggcggagcgggugaucgacccacgcaggugcaugaagcccgugauccugaccgacggggaggagcgcgugauccuggcgggcccaaugccggugacgcacuccagcgccgcccagcgccgagggcgcaucggccggaaccccaaaaaugagaacgaccaguacaucuacaugggggagccccucgagaaugacgaggacugcgcccacuggaaggaggcgaaaaugcugcuggacaauaucaauaccccugagggcaucaucccgucuauguucgaaccggagcgcgaaaaggucgaugccaucgacggugaguaccgccuucguggggaggcucggaagaccuuugucgauuugaugcgcaggggcgaccugcccgugugguuagccuaucgcgucgcggcggagggcaucaacuacgccgaccggagauggugcuucgacggaaucaagaacaaccagauacuggaggagaauguggaggucgagaucuggaccaaggagggggaacggaagaagcugaagccaaggugguuggaugcccgcauuuacagcgauccccuggcccugaaggaguuuaaggaguucgcugccggccguaagucauuaacuuuaaaccugaucaccgagaugggaaggcugcccacguucaugacccagaaagccagggacgcccuggacaaucuggccgugcuccacaccgcggaggccggaggccgggccuacaaccacgccuuaucagaguugcccgagacccuugagacgcugcugcugcucacccuguuagcgaccguuaccgggggcaucuuccuguuccugaugagcgggaaggggaucggcaaaaugacgcucgggaugugcugcauaaucaccgcgagcaucuugcugugguacgcccagauacagccccacuggaucgccgccagcauaauccuggaguucuuccugaucguguuacucaucccagaacccgaaaagcagcguaccccucaggauaaccagcuuaccuacguagugaucgccaucuugaccguggucgcagccacgauggcuaacgagauggguuuccucgagaagaccaagaaggaccuggggcucggcuccaucgcuacccaagagucugaauccaacauccucgauaucgaccugcggccggccucagcguggacgcuguacgccgucgccacgaccuucgugacucccaugcuccgccacuccaucgagaacagcuccgucaauguuagccugaccgccaucgcgaaccaggccacggugcugaugggacucgguaagggcuggccccuguccaagauggauaucggagucccccuucuggccaucggcugcuacucucaggucaacccgaucacucugaccgccgcccugcucuuacugguagcgcacuaugccaucaucgggcccggacuccaggccaaagcaacccgggaggcacagaagcgcgccgccgccggcaucaugaagaacccaacggucgacgggauaaccgugaucgacuuggaaccgaucccguacgaccccaaguuugagaagcaguugggccaggugaugcugcugauccugugcgucacccaggugcucaugaugcgcacaacgugggcccugugugaggcccugacccucgcgaccggccccauaucaacccugugggaagguaaccccgggagauuuuggaacacgaccaucgccgugagcauggccaacaucuuccguggauccuaccuggccggcgcggggcucuuauuuagcaucaugaagaauacuaccaacacccggcgcggcaccgggaacaucggcgagacguuaggcgaaaaguggaagucccgucucaacgcccugggcaagagcgaguuccagaucuacaagaaguccggcauccaagaggucgaccguacccuggcuaaggaagggaucaagcggggggagacggaccaccaugccgugucucgcggguccgcgaagcugcggugguuuguggagcgcaauauggucacgccugaaggcaaagucguggaccugggcugugggcgggguggguggagcuacuauugcggcggucugaagaauguccgagaggugaagggccucacaaagggcgguccaggccacgaggaaccaauaccuaugagcaccuacgguuggaaccuugugcgguuacaguccggcgucgacguguucuucacgccgcccgagaagugugacacgcugcugugcgacaucggggaaagcucccccaacccaaccaucgaggcgggcagaacccugcgggugcucaacuuggucgagaacuggcuaaauaacaacacgcaauucugcaucaaaguguugaauccguacaugccgagcgugaucgagaagauggagacucugcagcgcaaguacggcggggccuuaguccggaacccccucucccgcaacagcacacacgagauguauugggugucuaacgccaccggcaacaucgugagcuccgucaacaugaucagccggaugcucauaaaccgcuucaccaugaagcacaagaaggccacguacgagccagauguggaccuggggucagguacacgcaacaucgggauugaaagcgagauccccaacuuggauaucaucgggaagcggaucgagaagauaaagcaggagcacgagaccuccuggcacuaugaccaggaccacccguacaagaccugggcguaccacggcucuuacgaaacgaagcagaccggauccgcgagcuccauggugaacggcgucguccgccucuuaacaaagcccugggacguggucccgauggucacccagauggccaugacggauacaacccccuucgggcagcagcggguguucaaagagaaggucgacacccgcacgcaggagcccaaggaggggaccaagaagcugaugaaaaucaccgcagaguggcuguggaaggagcugggcaagaagaaaacuccccggauguguacaagagaggaguucacccggaaaguccgcucaaacgccgcacugggcgcgaucuucaccgacgagaacaaauggaagagcgcccgggaggccguggaggacagccguuucugggagcucaucgaucgggagcgcaacuuacaccucgaaggcaaaugcgaaaccugcgucuauaacaugauggggaagcgggagaagaagcucggcgaguucgggaaggcgaagggcagcagagcgaucugguacaugugguuaggcgcccgguuucuggaguuugaggcccucggcuuccugaacgaggaccauugguuuagccgcggcaacucccuguccgggguggaaggcgaagggcuccaccgacucggcuacauccugcgcgacgucagcaaaaaggagggcggagccauguacgccgacgacacagcggggugggacacucggaucacccucgaggaccugaagaaugaggaaauggugaccaaccacaugaagggggagcacaagaagcuggcagaagccauuuucaaguuaacuuaucagaauaaggugguccgcgugcagcggccgacgccccgcggcaccgugauggacaucaucucccgccgggaccagcgcgguagcggccaggucggcaccuacgguuugaacaccuucacgaacauggaggcccagcugauccgucaaauggagggagaggggaucuucaaguccauccaacaucuaaccgugaccgaggagaucgccgugcagaacuggcucgcgcgcgucggcagggagcgccugucucggauggccaucuccggcgacgacugcgucgugaagccccucgacgaccgcuucgcuagcgcccugaccgccuugaacgacauggggaagguccgaaaagacauucagcaaugggaaccaucgcgcggcuggaaugacuggacucaagugccguuuuguucacaucauuuccacgagcucgugaugaaagacgggcggguacugguggugcccugccgcaaccaggacgagcucauuggccgggcgaggaucucccagggggccggguggagccucaaggagaccgcuugccugggaaagagcuacgcccagauguggacccugauguacuuccaccggcgcgaccuccgguuagccgcgaacgcgauauguagcgcaguccccucccacugggugcccaccucccgcaccacguggagcauccacgccaagcacgaguggaugaccacagaggacaugcuggcgguguggaaccguguguggauccaggagaacccguggauggaggauaagacgcccguggaguccugggaggaaguacccuaccucggcaaacgcgaggaccagugguguggcucauuaaucggguugaccagucgcgcgaccugggccaagaacauccagacggccaucaaccagguccggucccucauaggaaacgaagaguacacggacuacaugccuucuaugaagcgcuuucggcgcgaggaggaggaggccggggugcugugguag

SEQ ID NO: 25264 - RNA, 9876 nt, Artificial Sequence
  derived and/or modified CDS sequence (opt11) from DENV-2__EU482739__SS-prME
accgccggggugaucaucaugcugauccccaccgccauggcguuccacuuaacgacgcgcaacggagagccccacaugaucgugggcaggcaggagaagggcaaaucccugcuauucaaaaccgaagauggcgucaauauguguacccucauggcgaucgaccugggggagcugugcgaggacacgauuaccuauaaauguccccuucugagacaaaacgagccggaggacaucgacugcuggugcaacagcaccucaaccugggugaccuacgggaccugcacuaccacgggggagcaccgucgcgagaagcgguccgucgcccuggugccccacgugggaaugggccucgagacccgcacagagaccuggaugagcagcgaaggggccuggaagcacguccagcggauugagaccuggauccuaagacacccgggguucaccauaauggccgcaaucuuagcauacaccaucgggaccacccauuuucagcgggcgcucaucuucauccuacugaccgcaguggcgccaagcaugaccaugcgcuguaucggcauaagcaaccgggacuuuguggagggugucagcggggggucuuggguggacauugugcucgagcacgggagcugcgucaccacgauggcuaagaacaagcccacgcuagacuucgaacugauuaagaccgaagcuaagcagcccgccacccuccgcaaguacugcaucgaggccaagcugacuaacaccaccacagagagucggugccccacgcagggcgagccaagucugaacgaggagcaggacaagcgcuucauaugcaaacacuccaugguagaccgcggcuggggcaacggaugcgggcucuucggcaaaggcgggauagucaccugcgcaauguucacgugcaagaagaacauggagggcaaggucguguuaccugagaaccuggaguacaccauagugauuacgccccacucaggggaagagcacgccgucggcaacgacacugggaagcacggaaaggagaucaagaucaccccgcaauccagcaucacugaggcugagcucaccggguacgggacagugaccauggagugcagcccccguacgggcuuagacuucaacgaaauggugcugcugcagauggaggauaaggcauggcuuguucaccggcaaugguuccuagaccuccccuugcccuggcugccgggggcagacacucagggaagcaacuggauucagaaggagacguuggugacauucaaaaauccccacgcaaagaagcaggauguggucguguuagggagucaggagggugccaugcacacugcacuuaccggcgccacugagauucagaugagcucagggaaucuacuguucacaggccauuuaaagugucggcuacggauggacaagcugcagcugaaagggaugagcuauucuaugugcaccggaaaguucaagaucgucaaggagaucgccgagacccagcacggcacgaucguaauacgcgugcaguacgagggcgacggaucccccugcaagauaccuuuugagauuauggaccucgagaagcgacacguccuggggcgccuaaucaccgugaacccgaucgugaccgagaaggacagccccgucaacaucgaggcggagccgccuuucggggacagcuacaucaucaucgggguggagccaggccagcucaagcugaauugguucaagaaggguucauccauuggccagauguucgaaaccacgaugcgcggcgccaagcggauggccauccuaggugauaccgccugggacuucggcagccucgggggcguguucacguccaucgggaaggcccugcaccaggucuuuggcgccaucuacggcgccgcuuuuuccgggguguccuggaccaugaagauccuaaucggugugaucaucacguggaucgggaugaacagcaggucaaccucccuguccgugagccucgugcuuguuggcgucgugacucucuaccucgggguuaugguccaagccgacucuggaugcguggugagcuggaagaacaaagagcugaagugcgguucggggaucuucaucaccgacaauguccacacguggacugagcaguacaaguuccagcccgagagccccuccaaauuagcgucagccauccagaaagcccacgaagagggcaucugcgggauccggagcguuacaaggcucgagaaccugauguggaaacaaaucacuccagaauugaaccacauccucuccgagaaugaggucaagcugacgauaaugacaggcgauaucaaggguaucaugcaggccggaaagcggucucugcgcccgcagcccaccgagcucaaguacaguuggaagaccuggggcaaggcaaagaugcuuagcacggagucccacaaccaaacuuuccuaaucgacgggcccgagaccgcggagugcccgaacaccaaccgggccuggaacagccuugaggucgaggauuacggcuucgggguguuuucaacgaauauuuggcugaagcugcgcgaaaagcaggacguguucugcgacucgaagcucaugagcgcugcaauaaaagacaaccgggccguccacgcagacaugggcuauuggaucgaaucugcccugaaugacaccuggaagauggagaaggccucuuucaucgaggucaaaagcugucacuggcccaagucucacacucuuugguccaacggaguacuagagagcgagaugauuauucccaagaauuuugcuggaccugugagccagcauaacuacagaccgggcuaucacacucagacugccggacccuggcaccugggcaagcuggagauggacuucgacuucugugaagggacgacagugguggucacugaggacugcggcaaccgaggccccucucugcguaccacgaccgcgucagggaagcuaaucaccgaguggugcugcaggucaugcacccucccuccgcugcgcuaucggggcgaggacgggugcugguauggcauggagauccguccccugaaggagaaggaggagaaucuggugaacucccuugugacggcugggcacggacagaucgacaacuuuucgcugggcguccuggggauggcccucuuccuggaagaaaugcuccggacccgcgugggcaccaagcacgccauccuauugguggccgucuccuuugugacgcucaucacggggaacaugagcuuucgggacuugggcagagugaugguaauggugggggccaccaugaccgacgauauuggcaugggcguuaccuaccuggcuuuacucgccgccuucaagguucgccccacguucgcggcggggcugcugcuccggaagcugaccuccaaagagcuuaugauggcaaccaucggcaucgcgcuccugucgcaaucgaccauccccgagacaaucuuggagcucacggaugcccuggcgcugggaaugauggugcuuaagaucguacgaaaucuggagaaguaucagcuggcagucaccaucauggccaucucaugcgugccgaacgccgugauccuccagaacgccuggaagguauccuguaccauccuggccgccguguccgucagcccccugcuccugacgagcucucagcagaaggccgacuggaucccacuagcacucaccauaaagggacugaaucccaccgcaaucuuccucaccacgcuuagccggaccuccaagaaaaggagcuggccgcugaacgaggccgugauggcggugggcaugguauccaucuuggccagcaguuugcugaagaaugacauccccaugaccgggccccugguagccggcgggcuccugacgguaugcuacgucuugacaggccgguccgcggaccucgagcuggagcgugccgccgacgugaaaugggaagaccaggccgaaauaucggguuccagccccaucuuguccaucaccaucagcgaggacggcuccaugagcaucaagaacgaggaagaggaacaaaccuuaacuauccugauccggacuggucugcucgugaucuccggggucuuccccgugagcauccccaucaccgcagcugcgugguaccugugggaaguaaagaagcagcgcgccggcguccuuugggacguucccagcccgccgcccgucgggaaggcggaguuggaggacggcgccuaccguaucaaacagcgcgggauuuucggcuacagccagaucggcgcgggggucuacaaggagggcacauuucauaccauguggcacgugacccgcggcgccguguugaugcaucgcgguaagcggaucgagcccuccugggcggacgugaagaaagaccugaucagcuacgggggcggcuggaagcucgaaggggaguggaaggagggcgaggagguccaggugcuagcccucgagcccgggaagaacccgcgcgccguucagacuaagcccgggcuguucaaaaccaacacugggaccauuggcgcggucucccuagauuucagccccggcacgagcgguucgcccaucguggaccggaagggcaaggucgugggacuguaugggaacggcguggucacccgcuccggggccuacgugagcgcaaucgcccaaacggagaaguccauugaggacaaccccgagaucgaggacgacauauuccggaagaagcgccucacgauaauggauuuacaccccggcgcgggaaagacaaagagauaccugcccgcuaucgugcgcgaggcgaucaaacggggccugcgcacgcucauuuuggccccuacccgcguaguggccgccgagauggaggaggcacuccgggggcuuccaauccgcuaccagacacccgcgauccgggccgagcacacgggccgcgagaucgucgaccugaugugucacgccaccuucaccaugcggcugcucucccccguccgugugccgaacuacaaccugaucaucauggacgaggcgcacuucaccgacccggccucaauugccgcccggggcuacaucuccacgcgcguggagaugggggaggccgcgggaaucuucaugaccgcgacaccgcccgggagcagagauccauucccccaguccaacgcacccauaauggacgaggagcgcgagauccccgagcggagcuggaauucuggccacgagugggucacagacuuuaagggcaaaacaguaugguucgugccguccaucaaggcuggcaacgacaucgccgccugccugcgcaagaacggcaagaaagucauccagcucucccgcaaaaccuucgacagcgaguacgugaagacccgcgcaaacgacugggacuucguggucaccaccgacaucagcgaaaugggggccaacuuccgggccgagcgcgugaucgacccccggcgaugcaugaagcccgugauccugacggacggcgaggagagagucaucuuggcggguccaaugccggugacccacagcagugcugcccagcgccgcgguagaaucgggcgcaaccccaagaacgagaacgaucaauauaucuacaugggcgagccucucgagaacgacgaggauugcgcccacuggaaagaggccaagaugcugcuugacaacauaaacaccccggagggcauuaucccaaguauguuugagcccgagcgggagaagguugacgcgaucgacggcgaguaccgccuuagaggcgaggcccgcaaaacguucgucgaccugaugcggcgcggggaccugcccguguggcucgcguaccggguugccgcugagggcaucaacuacgccgaccgccgguggugcuuugacgggaucaagaacaaccaaaucuuggaggagaacguggaggucgagaucuggaccaaagagggcgagcgcaagaagcugaaaccccgguggcucgacgcccgcaucuacuccgaccccuuggcccugaaggaguucaaggaauucgcugcgggccggaagucccucacacugaaucugauaaccgagaugggccgccucccaacguucaugacccaaaaggcccgggacgcccuggacaaucuggccguccuccacaccgccgagguggguggacgcgcguacaaccaugcccuauccgagcuucccgagacccuagagacacugcugcuccugacccuacucgccaccgugacugggggcaucuuccuuuuccugaugucagggaagggaaucgguaagaugacgcugggcaugugcugcaucaucacagcuuccauccugcugugguaugcccagauccaaccgcacuggaucgcagccagcaucauccucgaauucuuccugaucguacugcucauccccgaacccgagaagcagcggacgccccaggacaaccaacugacuuacguggugaucgccauucucaccgucgucgcggccacgauggccaacgagaugggguuucucgagaagaccaagaaagaucugggccugggcagcauuaccacccaggaguccgagagcaacauccuggacaucgaccugcgcccggcuucugccuggacgcuguacgccguggcgacgaccuucgucacgcccaugcuucgucacagcauagagaauagcuccgugaacgugucucugacggcgauugcgaaccaagccaccguccucaugggguuaggccguggguggccccugaguaagauggacauuggcguaccccugcucgccaucgggugcuacucccagguaaauccgauuacucugaccgcggcacugcuacugcuggucgcgcacuacgccauuauaggccccggccuccaggcuaaggcgacacgcgaggcccagaagcgggccgcagcuggcaucaugaagaaccccaccgucgacgggaucaccguaauagaucuggagccgauucccuacgaccccaaguucgagaagcaguugggacaggucaugcuccugguauuaugcguaacccagguccucaugaugaggaccacaugggcccugugcgaggcccuuacccuugcaaccggcccgaucagcacgcugugggaggggaaccccggacgcuuuuggaacaccacgaucgccguguccauggcaaacaucuuccguggcagcuaucuggcgggggccggucuuuuguucuccauuaugaagaacaccacgaacacgcgucgcgggaccgguaacaucggugagacccugggggagaaguggaagucccggcucaacgcccugggcaaguccgaguuccagacguacaagaaguccgggauccaggagguggaccgcacccuggccaaggaaggcaucaagcgcggagagaccgaccaccacgcggucucccgcggcagcgccaaacuccggugguucgucgaacgcaauauggugacaccugagggcaaggucgucgaccuagguugcggcaggggagggugguccuacuacugugguggccugaaaaacguucgcgagguuaaagggcucacgaagggcgggcccgggcaugaggagcccauuccaaugucaacauacggcuggaaccuagugcggcugcagagugggguagacguguuuuucaccccgcccgagaagugcgacacccuacugugcgauauuggcgaguccagcccgaacccaaccaucgaggccgggaggacccugcggguguugaaccugguggaaaacugguuaaacaacaacacccaauucugcaucaagguccucaauccguauaugcccuccgugauagagaagauggagacccugcagcguaaguacgggggcgcucuggugcggaacccccugaguaggaacuccacccacgagauguacugggucucuaacgcgacgggcaacaucguauccagcgugaacaugauuucccgcaugcuuaucaaccgguucacuaugaagcacaagaaggcaaccuaugagccagacgucgauuuaggcagcgggacucgcaacaucggcaucgaaaacgagaucccaaaccuggacaucauuggcaagcggaucgagaagaucaagcaggagcacgagacguccuggcacuacgaccaggaccaucccuacaagacgugggccuaccacgggagcuacgagacuaagcagaccggcuccgccagcuccauggugaacggggugguacgacugcugacuaaaccaugggacguggugcccauggucacccagauggccaugaccgauaccacgcccuucggccaacagcggguguucaaggagaagguggacacccggacacaggagccaaaggaaggcaccaagaagcugaugcggaucaccgccgaguggcucuggaaggagcuggggaagaaaaaaacgccccggaugugcacccgggaggaguucaccaggaagguacggagcaacgcggcccugggcgccaucuuuacggacgagaacaaauggaaguccgcccgcgaggcagucgaggauagccgguucugggagcucgucgaccgcgagcggaaccugcaccuggagggaaagugcgagaccugcguguacaauaugaugggcaagcgcgagaagaagcugggcgaguuuggcaaggccaaaggcagccgcgcaaucugguacauguggcugggggcuagguuccuggaguucgaggcgcucggcuuccugaacgaggaccauugguucagccgggggaacucccuuuccggaguagagggggagggccuccauaagcuaggauacauccuccgcgacgucagcaagaaggagggcggcgcgauguaugcagacgacaccgcugggugggacacgcggaucacgcuggaggaccugaagaacgaggagauggugaccaaccacaugaagggcgagcauaagaagcuggcugaggccaucuucaaacucaccuaucaaaacaaggugguccgugugcagcgcccuaccccgagggggaccgugauggacauaauuuccaggaaagaccagcggggcagcggccaagucggaaccuacggacuuaacaccuucaccaauauggaggcgcaacuaauccgccagauggagggggagggcaucuucaaaagcauccagcaccuuaccgucacagaggagaucgccgugcagaauugguuagcgcgggucggccgggagcggcugucacgcauggccauauccggugacgacugugugguaaagccccucgacgaccgguucgccucugcgcugaccgcgcugaacgacauggggaagguccgcaaggacauccagcaaugggagccuucccggggcuggaacgacuggacccaggugccguucugcagccaccacuuccacgaguuggugaugaaggauggccguguucucguaguaccgugccggaaccaggacgagcugauaggacgcgcccggaucucccaaggcgccgguuggucccucaaggagacggccugccuggggaaguccuacgcgcagauguggacccugauguacuuccaccgccgggaccuccgccuggccgccaacgccaucugcagcgccguccccucucacugggucccgaccagccgcaccaccugguccauucacgccaagcacgaguggaugacgacagaggacaugcuggccguguggaaccgcgucuggauucaggagaacccguggauggaggacaagacccccguugagagcugggaggagguacccuacuuaggaaagcgggaggaccaguggugugguucucugauuggucugaccucccgggcuacgugggccaagaacauucagaccgcgaucaaccagguucgaagccucaucgggaaugaggaauauaccgacuacaugccaucgaugaagagguuccgaaaggaggaggaagaggccggcguucugugguga

SEQ ID NO: 25265 - RNA, 9876 nt, Artificial Sequence
  derived and/or modified CDS sequence (opt11) from DENV-2__EU482740__SS-prME
accgcgggggugaucaucaugcugauccccaccgcgauggcguuccaccucaccacucguaacggcgagccucacaugaucguuggacggcaggagaaggggaagucucuacuguucaaaaccgaagacggcgugaacauguguacccuaauggccaucgacuugggagaacugugcgaggauacuaucaccuauaagugcccacuccugcgccagaaugagcccgaggacaucgacugcuggugcaacucuaccaguacuugggugaccuacgggaccugcaccaccacgggugagcaccgacgcgagaagcgguccgucgcccuggugccccacguggggaugggacuugagacucgcaccgaaaccuggaugagcuccgagggggccuggaagcacguccagcggaucgagacguggauccugcgccaccccgguuuuaccaucauggccgcgauauuggccuacaccauaggaaccacgcacuuccagcgggcccucauuuuuauacugcugacggccgucgcgccuuccaugacaaugcgcugcauuggcaucaguaaccgggacuucguggagggcguuagcggaggguccuggguggacaucgugcucgagcacgguagcugcguuaccacgauggccaagaauaagcccacgcuggacuucgagcugaucaagacugaggccaagcaacccgccacgcuccgcaaguauugcaucgaggcuaagcuuacgaacaccaccaccgaaagccgcugcccgacgcagggugagccuagccugaacgaggaacaggauaagcgcuucgucugcaaacacuccaugguggaccgaggcuggggcaacggcugcgggcucuucggcaagggugggaucgucacgugcgcgauguucacgugcaagaagaacauggagggcaagguggugcugcccgagaaccuugaguacaccauugucauuacgccccacagcggggaggagcaugccgugggcaacgacaccgguaagcauggcaaggagaucaagaucaccccgcaauccagcauaacggaggccgagcucaccggcuacggcacuguuaccauggagugcagcccccgcacgggccuugauuucaacgagaugguccugcuccagauggaagacaaggccuggcugguacaucggcagugguuccuggaccucccccugcccuggcucccgggugccgacacccaaggcagcaacuggauccagaaggagacgcucgugaccuucaagaacccgcacgcgaaaaagcaggacgucgugguccuggggucgcaggagggcgccaugcacacagcucuaaccggggccacggagauccagaugucgucaggcaauuuacuguucaccggccaucugaagugucgcuuacggauggauaagcugcagcuaaaggggauguccuauagcaugugcaccggcaaguucaaaaucgucaaagagauugccgagacccagcacggaacaaucguaaucaggguccaguacgagggcgacggcagcccaugcaagaucccguucgagauaauggaccucgaaaagcggcacgugcugggccgccugaucaccgugaauccgaucgucaccgagaaggauagccccguuaacaucgaggcggaaccgcccuucggcgacagcuacaucaucauuggaguggagccgggccaacucaagcugaacugguucaagaaggggagcaguaucggacagauguuugagaccacgaugagaggcgccaagcggauggcaauccugggggacaccgccugggacuucggcagcuuagggggggucuucaccuccaucgggaaagcccuccaccaagucuucggcgcgaucuacggggccgccuucagcggcgucaguuggaccaugaagauauugaucggagugaucauuacguggaucgggaugaauagcagauccaccagucuguccgucucucucgugcuugucggcgugguuacgcuguaccuaggggccaugguucaggcggacuccggcuguguagugagcuggaagucgaaggagcugaagugcggcagcgggaucuucauuaccgauaacguccacaccuggaccgagcaguacaaauuccagccggaaagcccuuccaaguuagccagcgccauccagaaggcccacgaggaaggcaucugcgguauacggucagugacacgccucgagaaccugauguggaagcagaucacccccgagcugaaucacauccucagcgagaacgaggugaagcugacgauuaugacgggcgacaucaaggggaucaugcagccgggcaagcggucccugcgcccccagcccaccgagcucaaguacuccuggaaaacguggggcaaggccaagaugcuguccacggagagccacaaccagaccuuucugaucgacgguccggagaccgcggagugucccaauaccaaccgggccuggaacucccucgaggucgaggacuacgguuucgggguauuuacgaccaacaucuggcugaagcugcgcgaaaagcaggacguguucugcgacagcaagcucauguccgccgccaucaaggacaaccgggcgguccacgcggacaugggcuacuggaucgaaagcgcccugaacgacaccuggaaaauggaaaaggcgaguuucaucgaggucaagagcugccacuggcccaagucccacacccuguggagcaacggcgugcucgagucggagaugaucaucccgaagaacuucgccggcccgguuagccagcacaacuaccgccccggcuaccacacgcagacggccggaccuuggcaccuggguaagcuggagauggacuuugacuuuugcgaggggaccaccguaguggucaccgaggacuguggcaaccgggggcccagccuccguacgaccaccgcguccgggaagcugaucaccgaguggugcugcagaucuugcacgcugccgccgcuacgguaccggggggaggacgggugcugguaugggauggagauucgcccccugaaggagaaggaggaaaaccuggugaacucccucgugacagccgggcacggccagaucgauaauuucagccugggcguccuggguauggccuuguuccuggaggagaugcugcgaacccgcgugggcaccaagcacgccauacuacuggucgcuguauccuucgugacgcugaucacugggaacaugucguuccgugaccucggccgcgugaugguuauggugggggccacaaugaccgacgacaucgguaugggcgugacguaccuggcccugcucgccgccuucaagguccgacccaccuucgccgccgggcuccuguugcggaaguuaaccuccaaggagcugaugauggccaccaucggcaucgccuuauugucacaauccacgauaccggagaccauccuggagcucaccgacgcccuggcguuggggaugauggucuugaaaaucgugcguaacauggagaaguaccaguuggcagucaccauuauggccaucagcugcgugcccaacgccguaauacugcagaaugccuggaaggucuccuguacuauccucgcgguagucucggucagccccuuacugcucacuagcucccagcaaaaggccgacuggauuccccuggcccuaacaaucaaaggccuaaauccgacggccaucuuccugacuacccuuagccggacuuccaagaagcggagcuggcccuuaaacgaggcgauuauggccgucggcauggucuccauccuagcuagcagccuucucaaaaacgacaucccaaugaccgggcccuugguggcuggcgggcuucucacggugugcuacgucuugaccggccgguccgccgaccuggagcucgagcgcgcggccgacgugaagugggaggaucaggccgagaucuccgggucaagcccgauuuuaucuaucacaaucagcgaggacggcucgaugucaaucaagaacgaggaggaggaacagacccugacgauccucauucggaccggcuugcucgugaucuccggugucuuucccgugagcaucccaaucaccgcggcugcgugguaccucugggaagucaagaagcagcgcgccggcguccugugggacgugccuuccccgccgcccguugggaaggccgagcuggaggacggcgccuaccggaucaagcagcgcgguauccuaggcuauagccagaucggggccggggucuacaaagagggcaccuuccacacgauguggcacguuacucgcggggcgguguugaugcaccguggcaagcguaucgagccuuccugggcggacgucaagaaggaccugaucagcuacgggggcggguggaagcucgagggggaguggaaagaaggcgaggaggugcaggugcuggcccuggaacccgggaagaacccccgcgccguccagaccaagcccggccucuuuaagaccaacaccgggacgaucggcgccgugucccuggacuucagcccgggcaccucggggagcccaauuguggaccggaagggcaagguuguggggcuguacggcaacggaguugucacccgcuccggggcauacguuagcgcuaucgcccagacggagaaauccaucgaggacaacccagaaaucgaggacgacaucuuccggaagaaacggcucacaaucauggacuuacaucccggcgccgggaagaccaagcgguaccugcccgcgaucgugcgcgaggcaaucaaacgaggucugcgcacccucauccuggcccccacccgcgucguggccgccgagauggaggaggcgcuccgggggcuccccauccguuaccagacgcccgcuauccgggccgagcacaccggccgcgagauaguggaccugaugugccacgccaccuucacaaugcggcugcucuccccgguccgcgugcccaacuacaaucugaucaucauggacgaagcccacuuuacggaccccgcgagcaucgccgcccggggcuacaucuccacccgcgucgagaugggggaggccgccggcauuuucaugaccgcgaccccgcccgguagccgggaccccuucccucaguccaacgcccccauaauggaugaggagcgcgagaucccggagcggagcuggaacuccggucacgagugggugacggacuucaagggcaagaccgugugguucguacccagcaucaaggccggcaacgacaucgccgcgugcuuacgcaagaacggcaagcgggucauccaguugucccgcaagaccuucgacuccgaguacgugaagacacgggccaacgacugggacuucguggucacgaccgacaucuccgagaugggagcuaauuucaaggccgagcgggugaucgacccccggcggugcaugaaaccagugauccucaccgacggcgaggagcggguaaucuuggccgggccgaugcccgugacacacagcagcgcggcucagcgccgcggcaggaucgggcgcaaccccaagaacgaaaaugaccaguacaucuacaugggcgaaccgcucgagaaugacgaggacugcgcccacuggaaggaggcgaagaugcugcuggacaacauaaacacaccggagggaaucaucccaagcauguucgagcccgagcgggagaaaguggacgccaucgacggggaauaccgccuccggggggaggcgcgcaagacguuuguagaccugaugcggcggggggaccugccgguguggcucgccuaccgaguggcagcggagggcaucaacuacgcggaccgcagauggugcuucgacggcaucaagaacaaccaaauccuggaggagaacgucgagguggaaaucuggaccaaggaaggcgagcggaagaagcugaagccccgguggcucgacgcgcgcaucuacuccgacccccuggcccugaaggaguucaaagaguucgccgccggccggaagucgcuaacccugaaccugaucacggaaaugggccggcuccccaccuucaugacccaaaaggcgcgggacgccuuagacaaccuggcggugcuucacaccgccgaggccggcgggcgcgcguacaaccaugcccuuagugagcuuccugagacgcucgagacccugcugcuccuaacacugcucgccaccgugacaggcggcauuuuccuguucuugaugucgggaaagggcaucgggaagaugacccucggcaugugcugcaucaucaccgcauccauccugcugugguacgcccaaauacagccgcacuggaucgcggccagcaucauccucgaauuuuuccugaucgugcugcucauccccgagcccgagaaacagcggaccccgcaggacaaccagcucaccuacgucgugaucgccauccugacggugguagccgcaacaauggcgaacgagaugggguuucucgagaagacaaagaaggaccugggccugggcuccaucaccacgcaggaguccgagaguaacauccucgacaucgaccugcgccccgcguccgccuggacccuguacgccguggcgaccaccuucgugacgcccaugcucagacacagcauugaaaacuccagcgucaaugugucacuaacagcgaucgccaaccaagccaccguucugauggggcucggcaaaggguggccccugucaaagauggacaucggcgucccgcugcuggccaucggaugcuacucccaggugaaccccaucacccugacggcggcccugcuccugcugguggcccacuaugccauuaucggccccggcuugcaggccaaggcgacucgcgaggcgcagaagcgcgccgccgccgggaucaugaagaaccccacggucgacggcauaaccgugaucgacuuggaaccgauccccuacgacccgaaguucgagaagcagcugggccaggugaugcuacugauccugugcgugacccaggugcucaugaugcggaccaccugggcgcugugcgaggcccucacccucgccacuggccccaucaguacccugugggaggggaauccgggucgcuuuuggaacacgaccauagcugugagcauggccaacaucuuccggggcaguuacuuggcgggcgcgggccuccuguucuccaucaugaagaacaccacgaacacccgccgggggaccggcaacaucggcgaaacgcugggggagaaauggaagucccgccucaacgcucugggcaaguccgaguuucagaucuacaaaaaguccggcauccaggaagucgaccggacccuagcaaaggagggcaucaagcgaggggaaaccgaccaccaugcgguuucccgggguuccgcuaagcuccgcugguucguggagcggaacauggucaccccggagggcaaggucguggacuugggcugcggccgcggcgggugguccuacuacugcgggggacugaaaaacguccgggaggugaagggccugacgaagggcgggccagggcaugaggagcccaucccgaugagcaccuacggcuggaaccucgugcgccuacaaagcggggucgacguuuucuucacgccgccggaaaaaugcgacacgcuauugugcgacaucggcgaguccagcccuaacccgaccaucgaggcgggccggacccuacgcgugcucaacuuggucgagaauuggcugaacaauaacacccaguucugcgugaaaguucucaaccccuacaugcccucggucaucgagaagauggagacucugcagcggaaguacggaggugccuuagugcgcaauccucugagccggaacuccacccacgagauguacugggugagcaaugccacggggaacauugucuccagcgugaacaugaucucccgcaugcucaucaaccgcuucaccaugaagcauaagaaggcuacuuaugagccggacguggaccuaggcagcgggaccaggaacauuggcauugagucagagauccccaacuuggacaucaucggcaagcgcaucgagaagaucaagcaggagcacgagacuucuuggcacuacgaccaggaccacccauacaagaccugggcguaccacggguccuacgagaccaagcaaacgggaagcgcauccagcauggucaacgggguggugcgguugcugacgaagccgugggacgucgugcccauggugacccagauggccaugaccgacaccacgcccuuuggccagcagcguguuuucaaggagaaaguggacacaagaacacaggaacccaaggagggcaccaagaagcugaugaagaucacggcugaguggcucuggaaggaacugggaaagaaaaagaccccgcggaugugcacccgggaggaguucacccgcaaggugcgguccaacgcggcacugggcgcuauauucacggacgagaacaaauggaaguccgcccgcgaggcuguagaggauucccgguucugggaacugaucgaccgcgagcggaaccugcaucuggaggggaagugcgagacaugcgucuacaacaugaugggcaagcgcgagaagaagcucggggaauucggcaaggcgaaaggcucucgggcuaucugguacauguggcuuggggcccgcuuccuugaguucgaggcccucggcuuccugaacgaagaccauugguucucacgggggaacuccuuaaguggcguggagggggagggauuacaccggcugggauacauccuucgggacguauccaagaaggaggguggggcgauguacgccgacgacacggccgggugggacacccgaaucacgcucgaggaccugaagaacgaggagauggugacuaaucacaugaagggagaacacaagaagcuggccgaggccaucuucaagcucaccuaccagaacaaggucguacggguacagcgccccacgcccagagggacagucauggacaucaucagucggcgcgaccagcggggcagcggacaaguggggacauauggacugaacaccuucaccaauauggaagcgcagcugauacgccagauggagggagaaggcauuuucaagagcauccaacaccucacuguaacagaagagaucgccguccagaacuggcuggcccgagugggccgcgagcggcugucccgcauggccaucagcggggacgacugcguggucaagccccucgacgaucgguuugcuuccgcgcugaccgcccugaacgacaugggcaagguccgcaaggacauccagcagugggagccgagccggggguggaacgauuggacccagguacccuucugcucacaucacuuccacgagcucgucaugaaggacggucgcguacuggugguucccugcagaaaucaggaugagcugauuggucgcgcccggaucagccagggcgcugggugguccuuaaaagagacggcgugccugggcaagagcuacgcgcagauguggaccuugauguacuuccaccgacgcgaccuccgccuggccgcgaacgcaauaugcuccgccgugccuagccauuggguacccaccucccggaccacauggucuauccaugcgaagcacgaguggaugacgaccgaggauaugcucgccgucuggaacaggguguggauccaggagaaccccuggauggaagauaaaacccccguggagagcugggaggaaguccccuaucucgguaagcgcgaggaccaguggugugggagccuaaucggcuugaccucccgggccacgugggccaagaacauccagaccgcgaucaaccaagugcgcucccucaucgggaacgaggaguacacagacuauaugccuagcaugaaacgguuccgccgggaggaggaagaagcuggcgugcugugguga

SEQ ID NO: 25266 - RNA, 9876 nt, Artificial Sequence
  derived and/or modified CDS sequence (opt11) from DENV-2__EU482741__SS-prME
accgcaggggucaucaucaugcugaucccaaccgccauggccuuccaccucaccacccgcaacggagagccccacaugaucgucggccgacaggagaaggggaagucccugcuguucaagaccgaggacggcgugaacaugugcacccucauggccaucgacuuaggggaacuaugcgaggacaccaucaccuacaagugcccccuccugagacagaaugagcccgaggacaucgacugcuggugcaacagcaccagcaccugggugaccuauggaaccuguaccaccacgggugaacaccggcgugagaagcgguccgucgcccuggugccccacguggggaugggcuuggaaacucgcaccgagacauggaugaguagcgaaggggccuggaagcauguccagcggaucgaaaccuggauucugcgccacccuggcuucaccaucauggccgcgauccuggccuacacaaucgggaccacccacuuccagcgggcccucauauucauccuguugaccgcgguggcgccuagcaugaccaugcggugcaucggcaucagcaaccgagacuucguggagggcgucagcggagggucguggguggacauugugcucgaacaugggucgugcgucaccacgauggcaaagaacaagcccacccuggacuuugagcugaucaagacugaggccaagcagccugccacccuccgcaaguacugcaucgaggccaagcugacuaacacaaccacagagucccggugcccgacgcagggcgagcccagccugaacgaggagcaggauaagcgcuucgugugcaaacacucuaugguagaccggggcugggguaacggcugcgggcucuucggaaagggcgguauagugaccugugccauguucacgugcaagaaaaacauggagggaaagguggugcugcccgagaaccuggaguacaccaucgucaucacgccccacagcggggaggagcacgccguaggaaacgacaccggcaaacauggcaaggagauuaagaucaccccgcagucaucaauaaccgaggccgagcucacgggguacgguacggugaccauggagugcaguccccgcaccggccuggauuucaacgaaauggugcugcuccaaauggaggacaaggccugguuggugcaccgucaaugguuccuggaccugccccugccauggcugccgggggccgacacucaaggcagcaacuggauccaaaaggagacgcucgugaccuucaagaacccccacgcgaagaagcaggacgucgugguccuugggucccaggagggugccaugcacaccgcccugaccggggcgaccgagauacagaugagcagcggcaaccuccuguuuaccggccaccugaagugccgccuccguauggauaaguugcagcugaaggggauguccuacagcaugugcaccggcaaguucaagaucgugaaggagauagccgagacccagcacgggacgaucgugauccgcguccaguacgagggggacgguuccccgugcaagaucccauucgagauuauggaccucgagaagcggcaugugcuggggcgccugaucacggugaacccgauagucgcggaaaaggacagcccagugaauaucgaggcugaaccgcccuuuggcgauagcuacauuaucaucggaguggagccgggccagcucaagcugaacugguucaagaaggggagcuccaucggccagauguucgagaccaccaugcgcggcgccaagcgcauggccauucugggggacacggccugggacuucgggucccuagggggcgucuucacuucuauuggcaaggcgcugcaccagguuuuuggcgccaucuacggcgcggccuucucgggggucuccuggaccaugaagauccugaucggcgucaucauaacuuggauugggaugaacagcagguccacgucauuauccgugagucucgugcuggucgguguggugacccuguaccucggggcgaugguccaggcagacucaggaugcguggugagcuggaaguccaaggagcucaagugcggcagcggaauuuuuauuaccgacaacguccauaccuggacggagcaguacaaguuccagcccgaaucacccuccaagcuggccagcgccauccagaaagcccacgaggagggcauaugcgggaucagauccgugacucgccucgaaaaucugauguggaagcagaucacacccgaguuaaaccauaucuugagcgagaacgaggugaagcugaccaucaugacuggcgauauuaaggggauuaugcaggcgggcaagcggagucuaagaccgcagcccacugaacucaaguacagcuggaagaccuggggcaaggccaagaugcuguccaccgagagccacaaccaaacguuucuaaucgacgggcccgagaccgcggagugcccgaacaccaaucgggcguggaacagccucgaggucgaggacuacgguuucgggguguucacuacgaacauauggcugaaguuacgcgagaaacaggacguguucugcgacaguaagcucaugucugcagcgaucaaagacaaucgggccguccacgcggacaugggcuacuggaucgaaagcgcccugaacgacaccuggaagauggagaaggccucauucaucgaggucaagagcugccacuggcccaaaucccacacucuguggagcaacggcgugcucgaguccgagaugaucauccccaagaacuucgcggggccagugucucagcacaacuaccgcccaggcuaccauacccaaacggccggucccuggcaccugggcaaacuggagauggacuuugacuucugugaggguacaacggugguggucaccgaggacugcggcaaccgggggcccagcuugcgcacgacgaccgccuccgggaaacugaucaccgaguggugcugccgguccugcacgcuacccccgcuccgcuaccgcggcgaggacgggugcugguacggcauggagaucaggccacugaaggaaaaggaggagaaccuggugaacucccucgugacugccggucacggccagaucgacaacuucagccuggggguccuggggauggcccucuuccuggaggagaugcugcggacccgcgugggcaccaaacacgccaugcugcuggugguuguguccuucgugacgcugauuacuggcaacaugagcuucagagaccucggucgcgucaugguaauggugggggccaccaugaccgacgacaucggcaugggcaucaccuaccucgcccuccuagcggcguucaaggucagacccacguuugccgccgggcuucugcuccggaaacugacuuccaaggaguugaugauggccacgaucggcaucgcccuccugagccaauccaccauacccgagacgauccuggaacucaccgaugcguuagcccuagggaugauggugcucaagaucgugcgcaacauggaaaaguaucagcuggccguuaccaucauggccauuagcugcgugccaaacgccgugauccugcagaacgcguggaaggucuccuguaccauccucgccgccgugagcgucagcccccuucugcucacgagcucccagcagaaggccgacuggauaccccuggcucugacuaucaagggccucaauccaaccgccaucuuccugaccacgcugucacggacauccaaaaagcgcagcuggccucucaacgaggccauaauggccguaggcauggugaguauuuuagccagcucacugcucaagaacgacaucccuaugaccgggccccucgucgcggguggauuguugaccgugugcuacgugcugacgggccgguccgccgaccuggagcuagagcgugccgcugacgucaagugggaggaccaagccgagaucagugguuccucaccgauccugucgaucaccaucucggaggacggcuccaugagcaucaagaacgaggaagaggagcagaccuugaccauccucauccggacgggucuguuggugauuuccgggguguucccugucucgauccccaucacagcagccgccugguaccucugggaggugaagaagcagcgggccggcgugcugugggacguccccagcccgccgcccguggagaaggccgagcucgaagacggggcguacagaaucaaacagcgcggcauccucgguuacucucagaucggcgccggcguguacaaggaggggaccuuccacaccauguggcacgucacacggggcgccgugcuuaugcaccgcgguaagagaaucgagcccuccugggccgaugugaagaaggaucugaucagcuacggugggggcuggaagcucgaaggcgaauggaaggagggggaagagguccaggugcuggcccuugaacccgguaagaacccccgcgcggugcagacgaagcccggccucuucaagaccaacaccggcaccauaggggccgucucccuggacuucagccccggcacguccggcagccccaucguggaccggaaggggaagguggucggccuguacgggaacggcguagucacccgcucaggcgccuacgucucugcaaucgcgcagacggaaaagaguaucgaggacaaccccgagaucgaagacgacaucuuucggaagaagcgccuaacaaucauggaccugcacccgggagcaggcaagacgaagcguuaccuacccgccaucguccgcgaggccaucaagcggggucugcgcacauuaauucuggccccgacccgcguggucgcggccgagauggaggaggccuugcggggcuuacccauccgcuaccagacucccgccauccgggcagagcauacggggcgcgagaucguggaccuuaugugccacgcaaccuucacaaugcgccugcucucccccgugcggguccccaacuacaaccugaucaucauggacgaagcgcacuuuaccgaccccgccagcaucgcugcccggggcuacaucuccacgcgcguggagaugggggaggcggcagggaucuucaugaccgccacgccgcccggaagccgggacccguuuccgcaguccaacgcacccaucauggaugaagagcgcgagauccccgagcggagcuggaauucggggcaugagugggugaccgacuucaagggcaagacggucugguucgugcccagcaucaaggcggggaacgacaucgccgccugccuacgcaagaacggaaagaaggugauccagcucucccgcaagacguucgauagcgaguacguaaagacccgcgccaacgacugggacuucgucgugaccacggacauuuccgagaugggagccaacuucaaggcagaacgggucaucgacccccgucguugcaugaagcccgugauacugaccgacggggaggagcgcguaauacuggcaggucccaugccggucacacacagcuccgccgcacagcgacgugggcgcauaggucggaaccccaagaacgagaacgaccaauauaucuauaugggggagccccucgagaacgacgaggacugcgcccauuggaaggaggccaagaugcugcuggauaacauuaacacccccgaggggaucaucccgagcauguuugagcccgagcgcgagaaaguagacgcuauugacggcgaguaccggcuccgcggggaggcgcgaaagacguucguggaccugaugcgccggggcgaccugccugucuggcucgccuaccgcguggccgcggaggggaucaacuacgccgaccggcgcuggugcuucgacggcauuaagaacaaccagauccuggaggagaacgucgagguugaaaucuggaccaaggagggggagagaaagaaacugaagccgcgcuggcucgacgcuagaaucuauuccgacccccuggcccugaaggaauucaaggaauucgcggcugggcggaagagccucacccugaaccugaucaccgaaaugggcaggcuccccacuuucaugacccagaaggcaagagacgcccuagacaaucuggcggugcuccacacagcggaggcugggggccgggcauacaaccacgccuuauccgagcugcccgagacccucgagacguugcugcuccugacgcuguuggccacagucaccggggguaucuuccucuuccugaugagcggaaaggggauuggcaagaugacgcucgguaugugcugcaucaucaccgcgagcauccugcugugguacgcccagauccaaccgcacuggaucgcggccagcaucauucucgaauucuuccugauaguacugcucauccccgaacccgaaaagcagcgaacgccccaggacaaucagcugacguacguggucaucgcaauucucacugugguggccgccacaauggcgaaugagaugggcuuccuagagaagaccaagaaggaccuggggcuaggcucaaucgcuacccaggaguccgaauccaacauccucgauaucgaccugcggccggccucggcguggacccuguacgccgucgccacgaccuucgugacccccaugcuccgccacucaaucgagaacuccagcgugaaugucucccugacugccaucgcgaaccaggccacggugcucaugggccucgggaagggguggccacugucaaagauggacauugggguaccucugcuugcgaucggcugcuacucgcaagucaacccgaucacucugaccgcggcccuacuccugcugguggcgcacuacgcuaucaucgggcccggccuccaggccaaggccacgcgggaggcccagaagcgcgcggccgcuggcaucaugaagaaccccacgguggacgggauuaccgugaucgaccuagagcccaucccauacgacccgaaauucgaaaagcagcugggucaggugaugcuccugauccugugcgugacccaaguccucaugaugcgcaccacuugggcgcugugcgaagcccugacacucgcgacggggccaaucucuacccugugggagggcaacccaggccgguucuggaacacuacaaucgccguguccauggccaacaucuuccgcggcagcuaucuggccggcgccgggcuccuguucagcauaaugaagaacaccaccaacacccggcgcggcaccgggaacaucggggagaccuuaggcgagaaauggaagucucgucucaacgcacuagggaaguccgaguuccaaaucuacaagaaguccgggauccaagagguagacaggacccuggccaaggagggaaucaagcggggcgaaacggaucaccacgccgugucccgcgggucagccaagcuccggugguucguggagcgcaauauggugaccccagagggcaaggucguggaccugggcugcgggcggggcggguggucauacuacugcggcgggcugaagaacgugcgcgaggugaaaggccucacgaagggagggcccggucacgaggaacccauccccaugucgaccuacggguggaauuuagugcggcugcagagcggaguggaugucuuuuucacgccccccgagaagugcgacacccuccugugcgacauuggggaauccagccccaaccccaccaucgaggcgggccgcacauugcgggugcucaaccugguggagaacuggcugaauaacaauacgcaguucuguauaaagguccuaaaccccuacaugcccuccgugaucgaaaagauggagacccugcaacgcaaguacggcggagcccuuguacggaacccccucagccgcaacucgacccacgagauguauugggucagcaacgccaccgguaacaucguaaguagcgugaacaugaucuccaggaugcucaucaaccgcuucaccaugaagcauaagaaggccacguacgagccggacguugaccuagggagcggcacccgcaacauugggauagaaucagagauccccaacuuggacaucaucggcaagcggaucgagaaaaucaagcaggagcacgagaccucguggcacuacgaccaggaccaccccuacaagacaugggccuaccacggcuccuacgaaacgaagcagaccggcagcgcguccagcauggugaacggggugguccguuugcugaccaagcccugggacguggugccgauggucacccagauggccaugacugauaccacccccuuugggcaacagcgggucuucaaggagaagguggacacccgcacgcaggaacccaaggaggguacgaagaagcugaugaagaucaccgccgaguggcucuggaaagagcugggcaagaagaagacgccccgaaugugcacucgcgaggaguucacccggaagguccgcaguaacgccgcccugggggcgaucuucacugacgagaacaaguggaaguccgccagagaagccguggaagacucaagguucugggagcucaucgaccgugaacgcaaucugcacuuagaaggcaagugcgagaccuguguguacaauaugauggggaagcgggagaaaaaacucggcgaguucgggaaggccaagggcagccgagcgaucugguacauguggcugggagcccgguuccuggaguucgaggcccucggguuccugaacgaggaucacugguuuagccgcggcaacucccugagcgggguagagggcgaagggcuucaccggcugggcuauauucuucgcgauguguccaaaaaggaggguggggcaauguacgccgacgacacggcgggcugggacacgcggaucacccucgaggacuuaaagaacgaggagauggugaccaaccacaugaagggggagcacaagaagcuggcagaggccaucuucaagcucacguaucagaauaagguggugcgcguccagagaccaaccccccgcggcaccgugauggacaucaucagccgccgggaucaacgcggguccggccagguuggcacuuauggauugaacacguucaccaacauggaggcccagcugauccggcagauggagggcgaggggaucuucaagagcauucaacaucucaccgucaccgaggagaucgccgugcaaaacuggcuggcgcgcguuggccgggagcgacuuucccggauggcuaucagcggcgacgacugcgucgugaagccccucgacgaccgcuucgccuccgcccuuacggcccugaaugacauggggaaggugcggaaggacauucagcagugggagcccagccgcggcuggaacgacuggacccagguaccguucugcucccaccacuuccacgagcuugugaugaaggacgggcgggugcuggucgugcccugucgcaaucaggacgagcugauuggccgugcacggaucagccagggggccggcuggucccugaaggagaccgccugcuugggcaagagcuacgcccagauguggacucugauguacuuucaccggagagaccuccggcuggccgcgaacgccaucugcagugcugugcccagccacuggguccccacuucucgcaccaccuggagcauccacgccaagcacgaguggaugacaaccgaagauaugcuggccgucuggaaccggguguggauccaggagaacccguggauggaggacaagacgcccgucgagagcugggaggaggugcccuaccucgguaaacgggaagaccaguggugcggcucccuaauagggcugaccucgcgcgccaccugggccaagaacauccagaccgccauaaaucaggugcggucccucauuggcaacgaggaguauacggacuauaugcccagcaugaagcgcuuccggagggaggaggaggaggccgggguccugugguag

SEQ ID NO: 25267 - RNA, 9876 nt, Artificial Sequence
  derived and/or modified CDS sequence (opt11) from DENV-2__EU482742__SS-prME
accgcaggggucauaauaauguuaaucccaacagcaauggcuuuucaccuaaccacccgaaacggagaaccacacaugaucguaggccgacaagaaaaagggaaaucauuguuguucaaaacggaagacggcguaaacaugugcacccucauggcgauagaccugggagaacuuugugaagacacaauaacguacaaaugcccacuucugcggcagaaugaaccagaagacaucgacugcuggugcaauucgacaucaaccuggguuaccuacggaacgugcacaacaacaggggaacaccgacgugaaaagcgcucugucgcacucguaccccacgugggcauggggcucgaaaccagaaccgaaacauggauguccucagagggagcguggaaacacguacaaagaauugagaccuggauccucagacacccgggcuuuacgaucauggccgccauuuuggcauacacgaucggcacgacacauuuccaacgagcgcuaauauuuauacuccugacagcugucgcgccguccaugacgaugcgaugcauaggaauaaguaacagggacuucguggagggagugucaggaggaucgugggucgauauuguacuagagcacggcucaugcgugacuacgauggccaaaaacaaaccuacccucgacuucgaauuaauaaagacagaagcgaagcagcccgcgacacuuaggaaauacuguaucgaagcaaaacuaaccaacacgaccacggagucacgaugccccacgcagggcgagcccucacugaacgaagaacaagacaaacgauucguauguaaacacuccaugguggaccggggcuggggaaacggcugcggucucuuuggaaaaggcgguauaguaaccugcgcgauguuuaccuguaagaagaacauggagggcaaaguagugcugcccgagaaccucgaauauaccauagugauaacgccacacucaggcgaggagcacgcagucgggaacgacacagggaaacacgggaaagaaaucaaaauuaccccacagucaagcaucacggaggcggagcucacgggcuacggaaccguuaccauggagugcuccccgagaaccggccucgacuucaacgaaaugguacuacuccaaauggaagacaaggcauggcugguccaccgacagugguuccuagaccuaccgcucccauggcugccaggagccgauacccaagguagcaacuggauacaaaaagagaccuuagugaccuucaagaacccccaugccaagaaacaggaugucgucguacuuggaagucaggagggagcgaugcauacggcgcuaacuggagcucccgaaauccaaaugagcagcggaaaccuauuauucacaggacauuuaaaaugcagauuacgaauggauaaacugcaacugaaagggaugucauacucaaugugcacuggcaaauucaagaucguaaaagagaucgcagaaacucaacacgguacgauagugaucagaguccaauaugaaggagacgggucuccgugcaagaucccauucgagauaauggaccuggaaaaacgacacguccuaggaaggcucauaacgguuaacccaauaguuacagaaaaggacucaccagucaauaucgaagcggaacccccauucggugacaguuauaucauaauuggaguggagcccggucaacuaaagcucaacugguuuaaaaaggguuccagcauaggccagauguucgaaaccacaaugagaggagcaaagagaauggcaauacucggggacacugccugggacuucgggucccuaggaggggucuucaccuccauagggaaggcccugcaccaggucuucggggcgauauauggggcugccuuuagcggagugagcuggaccaugaaaaucuuaaucgggguuauaauaacguggaucggcaugaacucaaggucaacaucgcuaucagucagcuugguacucgucggcgucgugacccuguaccucggcgcuaugguacaagcugauuccgggugcguagucagcuggaaaucaaaagagcucaaaugcgggaguggcauauuuaucacagacaacguacacacuuggaccgaacaauacaaguuucagccagagucaccgucaaagcuagccucagcgauacaaaaagcucacgaagaaggaaucugcggcauucgaaguguuacacgacuagaaaaucucauguggaaacaaauuacaccagagcugaaccauauccucucugaaaacgagguuaaacugaccaucaugacaggagauauuaagggcauaaugcaggccggaaagcgcucacugcguccccaaccgacggagcuaaaauacucauggaaaacuuggggaaaggcaaaaaugcuaucgacggagagccacaaucagacuuuccucauagacggcccagaaacggcagaaugcccaaacacgaaucgagcuuggaauagccucgaggucgaagauuacggcuucggcguauucacgacaaauaucuggcucaagcuccgcgagaaacaagacgucuuuugugacagcaaguuaaugagugccgcaauaaaagauaacagggccgugcaugcagacaugggcuauuggaucgagucggcgcucaaugacacauggaaaauggagaaagccuccuucauagaaguaaaaucgugucauuggccuaaaucucacacgcugugguccaacgggguacucgaguccgagaugaucauccccaaaaauuucgcaggacccgucagccaacacaacuauaggccaggauaccacacgcagaccgcaggcccuuggcauuugggcaagcuagaaauggacuucgacuuuugcgaaggaaccacugucguggugacagaagacuguggaaaucgaggucccucgcuuagaacaacaacggcuagcggaaaauugauaaccgaaugguguugccgcagcugcacgcucccuccacuucgcuaccgcggagaagacggaugcugguacggaauggagaucagaccucucaaagaaaaggaagagaaucucgugaacagcuuagucacugccggacacggccaaaucgacaacuuuucauuaggcguccucggaauggcccuauuccucgaggagaugcuccguacccgggucggaacaaagcacgccauccuccuaguagcgguaucauucguaacacuaauuacaggcaacaugucguuccgagaucuggggcggguuaugguaauggucggagcgacgaugacggaugauauaggaaugggaguuacuuaccuugcccuacuagcggccuucaaaguccguccgacguucgcugccggccuccuccugagaaaacugacguccaaagaacuaaugauggccaccauaggcaucgcgcuccuaucucaaagcaccauacccgaaacaauacuagaacuaacagaugcacuggcacuuggcaugaugguauuaaaaauaguucgaaacauggaaaaguaccaacuagcggugacgauaauggccauaucuugcgugcccaacgccgucauauugcaaaaugccuggaaagucaguuguacuauccucgcggcaguaucgguaucgccccuacuacugaccuccagccaacaaaaagccgacuggauaccauuggcguuaacaauuaaggggcucaauccgacggcaauauuccucaccacucugagccguaccagcaagaaacgcucauggccccucaacgaggccaucauggcaguaggaaugguaucgauauuggccaguaguuuacucaaaaacgacauaccaaugacgggaccuuuaguagcuggaggacuccugacaguuugcuacguacucacaggccgaagcgcagaccucgaacuggaacgcgccgcagacgugaaaugggaagaccaagcagaaaucucgggaagcuccccaauauuguccauaacaaucucagaagauggcucaauguccaucaaaaacgaagaggaagaacaaacgcuaacaaucuugauccggaccggucucuuagucauaagcggaguguuccccgugucaauacccaucacagcagcagcaugguaucugugggaggucaagaaacaacgcgcgggaguacuuugggauguaccgucaccaccaccggucggcaaagcugagcuggaagacggagccuauagaauaaagcaacgcgguauccuaggcuauucacaaauaggagccgggguguacaaagagggcacauuccauacgauguggcacgucacccgcggcgcggucuuaaugcaccggggaaaaagaaucgaacccuccugggcagacgucaagaaagaccuaauauccuacggaggggguuggaaacuugagggcgaauggaaagaaggagaagaggugcaaguauuagcacuggagccaggcaaaaacccccgggcaguccaaacaaagccaggccucuucaaaaccaacaccgggacgaucggagccgugagucucgacuucagcccagggacauccggauccccuauaguagaccggaaagguaagguaguaggacuguacggaaacggugucgugaccaggaguggggccuaugugagcgccauagcgcaaacagagaaaucuauagaggacaaccccgagaucgaggacgacaucuucaggaagaaacgucuuacuaucauggaccuacacccaggagcaggcaagacgaagagguaccuaccagcaaucguccgcgaagcgaucaaacguggccuacgaacgcuaauuuuggcccccacgaggguagucgccgcagaaauggaggaagcguugagagguuugccgaucagguaccaaacaccagccauacgugccgaacacacgggaagagaaaucguagaccugaugugucaugccacuuucacgaugagacuucucagcccugucagagugccgaauuauaacuuaaucauaauggacgaggcccauuucacagaccccgccucaauugcagcaagaggcuacauauccacacgaguagaaaugggcgaagcagccggaauauuuaugacugcgacacccccuggaagcagagacccguucccccaaaguaaugcucccaucauggacgaagaacgagaaaucccagagcgcucguggaacagugggcacgagugggucaccgacuucaaaggaaaaaccgucugguucguaccaagcauuaaggcaggcaacgacauagcagccugcuuacgcaaaaacggaaagaaagucauccagcuuaguagaaaaacuuucgauagcgaauacgucaaaacucgagcgaaugauugggacuuuguagugacgacagacaucuccgaaaugggcgcaaauuucaaagcugagagagugauagauccuaggagauguaugaaacccguaauacugaccgacggcgaggaacgagucauccucgcaggaccaaugccaguaacacauuccuccgcagcacagcgacgcgggagaauaggacgcaacccgaaaaacgagaacgaucaauauaucuacaugggagaaccccuggaaaacgaugaagacugugcgcacuggaaagaagccaaaaugcuccucgacaauaucaauacaccggagggcaucaucccaucuauguuugagccagaacgggagaaggucgacgcgauagacggugaauaucgucuacgcggcgaagcacggaagacuuucgucgaccucaugaggcggggagaccucccgguuuggcuagccuaccgggucgcagccgaagguauaaacuacgccgacagaagguggugcuucgacggcaucaaaaacaaccagauacucgaagagaacgucgaggucgaaauauggaccaaagagggagaacggaagaagcuaaagccuagguggcucgacgcgcgcaucuacuccgauccgcuggcacugaaagaguuuaaagaguucgcggcaggacguaagucgcugacccucaaccucaucacugaaauggggcggcuuccgacauucaugacgcaaaaagcucgcgaugcuuuggauaaccucgcaguucuccauacagccgaagcuggggguagggcguacaaucacgcccucucggagcugcccgagacgcuugaaacccuuuuacuccuuacucuccucgcagcagucaccggggguaucuucuuauuucucaugagcggaaagggaaucggcaaaaugacgcugggaaugugcuguauaauaacagccagcauacuccugugguacgcccagauucagccgcacuggauagcagcuuccauaauucuugaguucuuccuaaucgucuuacucaucccagaacccgagaaacaacgcaccccacaggauaaccaacucacauacgugguaauagcuaucuuaaccgucguugcggcgacaauggccaacgagaugggauuucuagagaagacaaagaaggaccucggccuggggucgaucaccacgcaagaguccgaaaguaacauacuagacauagaccuacggccggcaagugcuuggacacuguacgcggucgcaaccaccuucguaacgcccaugcugcgacacagcauagaaaacucgagugucaacguuagccucacagcaauagccaaccaagccacagugcuaaugggucucgggaaaggcuggccacucagcaaaauggauauuggugucccacuccuugcaauaggcugcuacucacaggucaacccgauaacacucacagccgcgcugcugcugcuagucgcgcacuacgcgaucauagggccaggacuccaagccaaagcuaccagagaggcccaaaagagagcagcagccggcaucaugaaaaacccuacgguugacggaauaaccgugauagaccuagaacccauacccuaugaccccaaguuugagaaacaacuuggacaggugaugcuacucauacucugcguaacacaagugcuuaugaugagaacaacgugggcacucugugaagcacuaacacuugccaccggacccauaaguacucugugggagggaaacccagggagguuuuggaacacaacgauagccgugaguauggcaaacaucuuucguggguccuaccuugcuggcgcagggcuccucuuuucaauaaugaaaaacacuacgaacacacgccggggcaccggcaacauaggggagacauuaggagaaaaauggaaaucacggcugaaugcccuuggaaagagcgaguuccaaaucuauaagaaaucuggcauccaagaaguggacagaacucucgccaaggaggggauaaaacgaggagaaaccgaucaucacgcagugucacgggguagcgcaaaauuacgcugguucguagaaagaaacaugguaaccccugaaggaaaagucguugaccuggggugcggcaggggaggcuggucguauuacuguggaggccuaaagaacguaagagaagucaaaggcuuaacaaaaggaggacccggucacgaggaacccaucccuauguccacauacggauggaaccucguucgccugcagagcggcguggaugucuucuucacacccccagaaaaaugcgacaccuuacuaugcgacauaggagaguccuccccgaaucccacgaucgaagccgggcgcacacuucggguacuaaaccuaguggaaaacugguuaaacaauaacacacaauucugcauaaaaguacuaaacccauacaugccaagcguuauagagaaaauggaaaccuuacagcguaaauacgguggggcucuagugcgaaacccacuuaguagaaacagcacccacgaaauguauugggucagcaaugcgaccgggaacaucguuucgucagugaacaugauuagccgcauguuaaucaacagguuuaccaugaaacauaaaaaggcaaccuacgaacccgaugucgacuuaggcuccgggacucgaaacauagggauugagucggaaauucccaaccucgauauaauuggcaagcggauugagaaaauaaaacaagaacacgagaccucguggcacuacgaccaagaucauccuuauaagaccugggcguaccauggguccuacgagacuaaacaaacugguucggcgagcucgauggugaacggagucguacgacugcugacuaaacccugggacguaguuccaaugguaacacagauggcgaugaccgacacuacgcccuucggacagcaaagagucuucaaagaaaagguggacacgcgaacgcaggaaccuaaagaggggacaaagaaacuuaugaaaaucacagcggaauggcucuggaaagaacucgguaaaaagaaaacgccacguaugugcacucgggaagaguucacuagaaaaguccgguccaacgcagcgcugggcgcaauauucacagacgagaacaaguggaaaucggccagggaagccguggaagacagccgcuucugggagcuaaucgaccgcgaaagaaaccuucaucuggaagguaaaugcgaaacaugcguauacaacaugaugggaaagagagaaaagaaauuaggagaguucggaaaggcgaagggcucucgcgccauaugguacauguggcucggagcgcgauuucucgaguucgaagcacucggauuccuaaacgaagaccacugguucuccagaggcaauucccuaucuggggucgagggcgaaggucugcacagacuaggauauauccuccgcgacgucagcaagaaagaaggaggagcaauguacgcggacgacaccgcggguugggauacacggauaacacuugaagaccucaaaaaugaagaaaugguaacaaaucacaugaaaggggagcacaagaagcuagcagaagcgauauuuaaacucacauaccaaaauaagguaguacgcguacaaaggcccaccccacggggcacgguaauggauaucauaucucgacgagaccaaagggguaguggucagguaggcacuuacggacucaacaccuucaccaacauggaagcgcaauugaucaggcagauggagggcgaaggcauauucaaauccauccagcaucuaacagucaccgaggagaucgcgguccagaacuggcucgcacgcguagguagagagcgguuaagcaggauggccaucucgggcgaugauugcgugguaaaaccguuggaugaucgcuucgcgucagcauuaaccgcacugaaugauaugggaaaaguacgcaaggacauacaacaaugggaaccgagccggggauggaacgacuggacccaggugcccuucugcucacaccacuuccacgaacugguaaugaaggauggacguguccuagucguaccaugccguaaucaggacgaacugauaggacgcgcacgaauaagccaaggagccggcuggucucuaaaagaaacggcuugccucgggaaaagcuacgcccaaauguggacccucauguacuuccaucgacgagaccugcgacuugcggccaacgcgaucugcucagcuguacccucccacugggucccaacuucacgcacaacguggucgauacaugcgaaacacgaauggaugacaacggaagacaugcuagcgguauggaaccgaguguggauacaagaaaacccuuggauggaagauaaaacgccuguagagagcugggaagaagugccuuaccuuggcaagagggaagaccaauggugcgggucauuaauaggccucacgagccgagcgacgugggccaaaaacauacagacugcuauaaaucaagugaggagucuaaucgguaacgaagaauacacagauuacaugccauccaugaaaagauuccgccgggaagaagaagaagcaggagugcugugguaa

SEQ ID NO: 25268 - RNA, 9876 nt, Artificial Sequence
  derived and/or modified CDS sequence (opt11) from DENV-2__EU482744__SS-prME
acagccggcgugaucaucaugcuaauaccaacugccauggcguuccaccuuaccacacgcaacggggagccgcacaugauagucggucggcaggagaaggggaagucccugcuguucaagaccgaggacggcguuaacaugugcacccucauggccauagaccugggggagcuuugcgaggacaccaucacauauaagugccccuugcugaggcagaacgagcccgaagacaucgacugcuggugcaauaguaccagcacuuggguaaccuacggaaccugcaccaccacgggggagcacagacgcgaaaagcgauccgucgcccuugugccccacguaggcaugggccucgaaacccguaccgagaccuggaugagcagcgagggggccuggaagcacguccagagaaucgagacuuggauccuccgacacccgggcuucacgaucauggccgcgauccuggccuacaccaucggcaccacacacuuccagcgggcccuuaucuuuauucugcugaccgccguagcgccuagcaugacgaugagaugcaucggcaucucgaaccgcgacuucguggagggcgucagcgggggcuccuggguggacaucguucucgagcacgggagcugcgucaccacgauggccaagaacaagcccacccuggacuucgagcugauaaaaaccgaagccaagcagcccgcuacccuccgcaaauacugcaucgaggcuaagcugacgaacacuaccaccgagagucggugcccuacgcagggcgagcccagccugaaugaggagcaggacaagcgguucgugugcaaacauaguaugguggaccggggaugggggaauggcugcggccuuuucggcaagggcgggaucgugaccugugcgauguuuacuugcaagaagaacauggagggcaagguggugcugcccgagaaucuggaauacaccauuguaaucacaccccacucgggggaagagcacgcaguugguaacgacacaggcaagcacgguaaggagaucaagaucaccccgcagucgagcaucaccgaagccgagcucacgggguacggcacggugaccauggagugcagcccccggacuggccuggacuucaaugagaugguccugcuccagauggaggauaaggccuggcugguucaucggcagugguuucuagaccucccccugcccugguugccgggggcugauacccaaggcagcaacuggauccagaaagagaccuuagugacuuucaagaacccacaugccaaaaagcaggacgucgugguccucgggucccaggagggagccaugcacaccgccuugaccggggcgaccgaaauccaaaugagcuccgguaaccuccuguucacaggucaccuaaagugccgccuccggauggacaagcugcagcuuaaagggauguccuacagcaugugcaccggcaaguucaagaucgugaaggagaucgccgagacgcagcacgggaccaucgugauccguguccaguacgagggugauggcucccccugcaaaauacccuucgaaaucauggaccucgagaagaggcacguguuggggcgccugauaacugucaacccgaucgucacggagaaggacucccccgugaacaucgaggcggaaccgcccuucggcgacaguuauauaaucaucgggguggagcccggccagcucaagcugaacugguucaagaaggggagcucaaucggccaaauguucgagaccacgaugcgcggcgcgaagcggauggcgauccuuggggacaccgcuugggacuucgguagccucggaggcgucuucaccuccaucgggaaggcccugcaccaaguguucggggcgauuuacggagccgccuucagcggaguguccuggaccaugaaaauccugaucggcgucaucaucacguggaucgggaugaacagucgcuccacaagccuguccgucagcuugguacuggucggcguaguaacccuguaucuaggggccaugguccaggcugacuccggcugcgugguguccuggaaaaacaaggagcugaaguguggcaguggaaucuucaucaccgacaacguccacacguggaccgagcaguacaaauuccagcccgagagccccagcaagcuggcauccgccauccagaaggcucacgaagagggcaucugcggcauccggucggugacccgccucgagaaccugauguggaaacagaucaccccugagcuuaaccauauucucagugagaacgaggugaagcugacgaucaugaccggggacaucaaggggaucaugcaggccggcaagcggagccugcgcccccaaccaaccgagcucaaguacuccuggaagacaugggguaaggcgaagaugcugagcacggagagucacaaccaaaccuuccugauugaugggcccgagacagccgagugcccgaacaccaacagagcuuggaacagccucgaagucgaagauuacgguuucgguguguuuacgaccaauaucuggcugaagcugcgcgagaagcaggacguguucugcgacucgaagcucaugagcgccgccauaaaggacaacagggcggugcaugccgacaugggguauuggaucgagucugcccugaacgacacuuggaagauggagaaggccagcuucaucgaggugaagucuugccauuggccgaagagccauacucuuugguccaauggggugcuugaaagcgagaugaucauaccuaagaauuuugccggacccgucucccagcacaacuaccgcccgggcuaccacacccagacggcggggccauggcaccugggcaagcuugagauggacuuugacuuuugcgaggggaccaccgugguggucacagaggacugcgguaaccggggccccagccuucgcacaacgaccgcuagcgggaagcugaucacagaauggugcugccggucgugcacucugcccccacuccgcuaccggggcgaagacgggugcugguauggcauggagauucgcccccugaaggagaaggaggagaaccuagugaacagccucgugaccgccggacauggacagaucgacaacuucucccugggcguccuuggcauggcauuauuccuggaggagaugcugcggaccagggugggcaccaagcacgccauccuccugguggcggucucguucgugacgcugaucaccgggaacaugucauuccgggaccuuggccgcgugauggucauggugggugccaccaugacagaugacaucggcaugggcgucacguaccuggccuuguuagccgcauucaagguccggccuacguuugccgcggggcugcugcuccgaaagcucaccucuaaagagcugaugauggccaccaucggcaucgcauuacugucccagagcacgauucccgagaccauccuggagcucaccgacgcgcuggcguuagggaugauggugcugaagaucgugcgcaacauggagaaguaccaacucgccgucucaaucauggcgaucagcugcguuccgaacgccgugauucugcagaacgcguggaagguauccuguaccauccucgccgccguaagcgucucaccgcugcugcucacgagcucacaacagaaagccgacuggauuccccuggcucugacgaucaagggccucaaccccaccgccaucuuccugaccacgcucagccggaccuccaagaagcgcagcuggccucucaacgaggccaucauggccguuggcaugguuuccauccuggccagcagccugcucaagaacgacauccccaugaccgggccccuagucgcuggcggacugcucaccgugugcuacguccugacgggccgguccgcugaucuggaauuagagcgcgccgccgacgucaagugggaggaccaggccgagaucagcggcuccagccccaucuuguccaucaccaucucggaggacggcagcauguccauuaagaacgaggaggaggagcagacccugaccauccucauucggacgggccugcuggucaucuccgggguuuucccgguaagcauccccaucaccgcggccgccugguaucucugggaggugaagaagcagcgcgccgggguacucugggacguccccagcccgccgcccguggggaaagccgagcuggaggacggcgcguaccggauuaagcaacgcggcauacucggcuacagccaaaucggcgccgggguuuacaaggaggggacuuuccauacuauguggcaugucacccgcggugccguucucaugcaccgcgggaagcggauagaacccuccugggcugacgucaagaaggaccugauaagcuacggcggcggcuggaaguuggagggggaguggaaggagggcgaggagguccagguccuggcccucgagcccgggaaaaacccccgcgcuguccagacgaagcccgguuuauucaagacuaacaccgggaccaucggcgccgucucccuggacuuuagccccgggacguccgguagucccauugucgaccgaaagggaaaaguggucgggcuguacggcaauggcguggugacccgcagcggggccuauguauccgcuauugcccagacggagaagucuaucgaggacaaccccgaaaucgaggacgacaucuuucggaaaaagcgccucaccaucauggaucuccaccccggcgcgggaaagacaaaacgguaccugccugccaucgugcgcgaggccaucaagcggggccugcggaccuuaauccuagccccgacccgcgucgucgccgccgagauggaagaagcccugagagggcuccccauacgcuaccagacuccagccaucagggccgagcacacgggccgagagaucguggaucugaugugucacgcgaccuuuacgaugaggcugcucucccccgugcgcguaccgaacuacaaccugaucaucauggacgaggcucacuucaccgaucccgcaagcauagcggcacgaggcuacaucagcacgaggguggaaaugggggaggcggccgggaucuucaugaccgcaacgccuccagguucacgggacccuuucccccaguccaacgcacccaucauggacgaggagcgcgagauccccgagcgcucguggaacucuggccacgagugggugacggacuuuaaggggaaaacuguuugguucgugccgaguauuaaggcggguaacgacaucgccgcaugcuuacgcaagaacggcaagaaggugauccaguugucgagaaagaccuucgacagcgaguacgucaagacucgugcgaacgacugggacuuuguggucacgacggacaucuccgagaugggggccaauuucaaggcugagcgggucaucgacccucgccggugcaugaaacccgugauccugaccgauggugaggagagagucauccuggccgggcccaugccagucacccacagcuccgccgcacagagacgcggcagaaucgggcggaaccccaagaacgagaacgaccaguacaucuacaugggggagccccucgaaaacgacgaggacugcgcccacuggaaagaggcgaagauguuacuggacaauaucaacacccccgagggcauaaucccgagcauguuugagccggagcgcgagaagguggacgccaucgacggcgaguaccggcuacgcggcgaggcccgaaaaacguucguggaccugaugcguaggggggaccugccggucuggcucgcauaccgggucgcugcugaggggaucaacuacgccgacaggagguggugcuucgacgggaucaagaacaaccagauccuggaggaaaauguggaggucgagaucuggaccaaggaaggagagcggaagaagcugaagccgcgcuggcucgaugcccggaucuacuccgacccccuggcgcugaaggaguucaaggaguucgcggccggccgcaagucgcucacccugaaccugauaaccgagaugggucggcugccaacguucaugacacagaaggcccgcgaugcccuggauaaccuggcggugcuccacaccgcggaggccggcgggcgagccuacaaucacgcucugucagagcugccugaaaccuuagagacgcugcugcuguuaacccugcucgccaccgugaccggcggcauauuccuauuccugaugaguggaaaaggaauuggaaagaugacacucggcaugugcugcauaauuaccgcgucaauccucuuaugguacgcacagauacagccgcacuggaucgcggccucaauaauccucgaguuuuuccuuaucgugcugcucauucccgagcccgagaagcaacgaacgccccaggacaaccagcuuaccuauguggucaucgccauccugaccgucguggcggccacgauggccaaugagaugggguuccuagagaaaaccaagaaggaccuggggcugggcagcaucaccacccaggaguccgagagcaauauccucgauaucgacuugcggccggccuccgccuggacgcuguaugcugucgccaccacguucgucaccccaaugcuccgccacagcaucgagaacucgagcgugaacguuucccucacggccauugccaaccaggcgaccgugcugauggggcucgggaagggauggccccugagcaagauggauauuggcgugccucugcucgcgaucgggugcuauagucaagucaacccgaucacccugacggccgcccuauuacugcugguggcccacuaugccaucaucggccccggccuccaggcuaaggccacgcgggaagcccaaaagagggccgcggccgggaucaugaagaacccuaccguggacgguaucaccgucaucgaccuggagcccauucccuaugacccuaaguuugagaaacagcucgggcaggucauguugcucauacugugcgucacacagguccucaugaugcgcacgacaugggcgcugugcgaagcacugacucucgcaacgggccccauuuccacguuaugggaggggaaccccggccgguucuggaacaccaccaucgcaguaaguauggccaauauauuccgcggaaguuaccuggcaggggccggccugcuguucuccaucaugaagaacaccacaaauacccggcgcgggaccggcaacaucggggagacccugggggaaaaguggaagagucggcucaacgccuuaggcaaguccgaguuccagaucuacaaaaaaucggggauccaggagguggaccgcacgcuggccaaggaggggaucaaaaggggggagaccgaccaccacgcagucucccgaggcagcgcgaagcuccggugguucguggagcgcaacauggugacaccggagggcaaggucguggaccuugggugcggccgcggcgggugguccuacuacugcggcgggcugaagaacgugagagaagucaaggggcucacaaagggagggccugggcacgaagagccgauccccaugagcacguauggcuggaaccuggugaggcuacagagcggcguggaugucuucuucaccccgcccgagaagugcgacacccuccuuugcgauaucggggaguccagccccaaccccaccauugaggccggccgaacacugagagugcucaaccugguggagaauuggcugaacaacaacacccaguuuuguaucaaaguccucaacccguacaugccuuccgucaucgagaagauggaaacccugcagcgcaaauaugggggagcgcucgugcggaacccacugucacgcaacagcacccacgaaauguacugggucagcaacgcgacaggaaacaucgucucuagcgugaacaugaucucccggaugcucaucaaccgcuucacuaugaagcacaagaaggcuaccuaugagccggacgucgaccuggggagcggcacucgcaacauaggcaucgagagcgagauacccaaccuggacaucaucgggaagcggauugagaagaucaagcaggagcacgagaccagcuggcacuacgaccaagaccauccuuacaaaacgugggcauaucacgggaguuaugagacgaagcagacaggcagcgccuccagcauggucaaugggguugucaggcuccuuacgaagcccugggacguugugcccaugguaacgcagauggccaugaccgacacaaccccguuuggccagcaacggguuuucaaggagaagguggacacucgaacccaggaaccaaaggagggcaccaagaagcugaugaaaaucacugccgaauggcuguggaaggaacuggggaaaaagaagacgccucgcaugugcacccgcgaggaguucacgcggaagguccgcuccaacgccgcccugggcgcaaucuuuacugaugagaauaaguggaagucugcgcgggaggccgucgaggacucccgcuucugggagcucaucgaccgggaacgcaaccugcaccuggagggcaagugugaaaccuguguguacaacaugaugggcaagcgggagaagaaacucggagaguucgguaaggccaagggcagccgcgccaucugguacauguggcugggcgcgcgguuccucgaguucgaggcccuuggguuccugaacgaggaccauugguucagccgcgggaacucccuauccggcgucgagggggagggcuuacaccgucugggcuacaucuuacgcgacguuuccaagaaagagggcggggccauguaugccgacgauacagcggggugggacacccgcaucacccucgaggaccugaagaacgaagagauggucacaaaccacaugaagggagagcauaaaaaguuagcugaggccaucuucaagcucaccuaccagaacaaaguggugcgcguccagcgaccgacgccacgugggaccgugauggacaucaucagccgccgggaucagcgcgguuccggccagguggggacguacggccugaacaccuucaccaauauggaagcccaacugauacgccagauggagggggagggaaucuucaagagcauccaacacuugaccgucacugaagaaaucgcgguccagaacuggcuggcccggguggggcgugagcgccugucccgaauggcgaucagcggggacgacugcgucguaaagccccucgacgaccguuucgccuccgcgcugacugcccugaacgacaugggcaagguccggaaggauauccaacaaugggagcccagccgcgguuggaacgacuggacccagguccccuucugcucccaccacuuccacgaacucgugaugaaggacggccgggugcuggucgugccgugccgcaaccaggaugagcugaucgggcgggcccgcaucucccaaggcgcuggcuggagccucaaagaaacagccugccuuggaaaauccuacgcccagauguggacgcuuauguacuuccaccggcgcgacuuacggcuggccgcgaacgcgaucuguagcgcagugccuucccacugggugccgaccuccaggaccaccuggucgauccacgccaagcaugaguggaugaccacggaggacaugcuggcaguguggaaccgaguguggauccaggaaaacccguggauggaggacaagaccccgguagagagcugggaagaggugcccuaccucggcaaacgcgaggaccaguggugcgguuccuuaaucgggcugaccagccgcgcgaccugggccaagaacauccagacggcaaucaaccagguucguucccucaucggaaacgaggaguacaccgacuauaugcccagcaugaagcgcuucaggaaggaagaggaggaggccggagugcugugguga

SEQ ID NO: 25269 - RNA, 9876 nt, Artificial Sequence
  derived and/or modified CDS sequence (opt11) from DENV-2__EU482745__SS-prME
acagccgggguuaucaucaugcugauccccaccgccauggcauuccaccucaccacaagaaacggggagccccacaugaucgucgggcggcaagagaagggcaagucccuucuuuucaaaaccgaagacggcgugaauaugugcacacucauggccauugaccugggugaauugugcgaagacaccaucaccuacaagugcccacuccugcgucagaaugaacccgaggacaucgauugcuggugcaacaguaccagcacaugggugaccuacgggaccugcaccacuacgggggagcaccggagagagaagcgcuccgucgcgcuggugccucauguggguauggggcucgagacccgcaccgagaccuggaugagcagcgaaggggcuuggaagcacguccagcguaucgagaccuggauucugcgccacccgggcuucaccaucauggcagcgauccuggccuacacuaucgggaccacgcauuuucaacgcgcgcucaucuuuauccugcuaacggccguggcgccuagcaugaccaugagaugcaucggcauuagcaacagagacuucguagagggcgucagcggaggcucguggguagacaucgugcucgagcacggaagcugcgucaccacgauggccaagaacaagccgacacuggacuucgagcugauaaagacggaggccaaacagcccgccacccuucgcaaguacugcaucgaggccaagcugacgaacacuaccacagagagucgguguccgacgcagggcgaacccagccugaacgaggagcaggacaagagguucguuugcaagcacaguaugguggaccgggguugggggaacggcugcggccuauucggaaagggcgggauuguaaccugcgcgauguucacgugcaagaagaacauggaggguaaggugguacugcccgaaaaccuggaguauaccaucgucauuacgccccacagcggcgaggagcacgccguaggcaacgacacggggaagcacggcaaggaaaucaagaucaccccgcaguccagcaucaccgaagccgaauuaaccggguacggcacuguaaccauggagugcaguccccggaccggccuugacuucaaugagaugguccuucuccagauggaggacaaggccuggcuggugcaucggcagugguucuuagaucucccacugcccuggcugccuggcgcugauacucagggcuccaauuggauccagaaggagacgcucguaacuuucaagaauccccacgcgaagaaacaggacgucgugguccuggggucccaggagggcgccaugcauaccgcccugaccggugccacggaaauacagaugagcagcggaaaccuccuguuuaccggccaccugaagugcaggcuccggauggacaagcugcagcuaaaggggauguccuacucgaugugcacaggcaaguucaaaaucgugaaggagaucgccgagacccagcacgggaccauaguuauacgcguucaauacgagggcgacggcucccccugcaagauccccuucgagauuauggacuuagaaaagcggcacgugcuggggcgccugauuacagucaauccgaucgucaccgagaaggacucucccgugaacaucgaggcggagccgcccuucggugacuccuacaucaucauuggaguugagccgggccaacugaagcugaacugguucaaaaaggggagcuccaucgggcaaauguucgagaccacaaugcgcggcgccaaacggauggccauccugggggacaccgccugggacuucggcagccucgggggugucuucaccuccauagggaaggcccugcaccagguguucggcgcgaucuacggcgccgccuucagcggggugaguuggaccaugaagauuuugaucggcguuaucauaacguggauugggaugaacagccgcaguaccagccugagcgucucuuuagugcugguuggcguggugacccuguaccuuggggcaaugguccaggcggacagugggugcguggugagcuggaaaucaaaggaacugaagugcggcagcgggaucuucaucacugauaacguucacacauggaccgagcaguauaaauuccaacccgagagcccauccaagcuagccucugccauccagaaggcccacgaggaaggcaucugugggauucgguccgugacucgacuugagaaccugauguggaagcagaucacccccgagcugaaccacaucuuaagcgagaacgaggugaaguugacgaucaugaccggagacaucaaggggauaaugcaagccggcaagcgguccuuacgcccgcaacccaccgagcuuaaguacagcuggaagaccugggggaaagccaagaugcuguccacggagagccacaaccgaaccuuucugaucgacggacccgaaacagccgagugcccgaauaccaaccgcgcuuggaacucucucgaaguugaggacuauggauuugggguguucacgaccaacaucuggcugaagcugagagaaaagcaggacguuuucugugacagcaaguugauguccgcugcuaucaaagauaaccgcgcuguccaugcugacauggguuacuggaucgagagcgcgcugaacgacacuuggaagauggagaaggccucguucaucgagguuaagagcugccauuggccaaagucccacacgcuguggucgaacggcgugcuagaguccgagaugaucaucccuaagaacuucgccggccccguaagccagcauaacuaccggccgggcuaucacacacagaccgcggggccauggcaccugggcaagcuggagauggacuucgacuucugcgaggggacuaccgugguggucaccgaggauugcggcaaccgcggccccagccuccggaccaccaccgccuccgggaagcugauuaccgaguggugcugccguucaugcacgcuucccccgcuccgcuaccggggcgaggacggguguugguacggcauggaaauccggccauugaaagaaaaggaggaaaaccuggugaacucccucgugacagccgggcacggucagaucgacaauuuuagccugggcguccuggggauggcacucuuccuggaggaaaugcugcgcacccgagugggcaccaagcacgcgauucuccugguagccgucuccuucgugacgcugauaaccgggaauaugagcuuucgcgaccucggacgagugaugguuauggugggcgccaccaugaccgacgacaucggcaugggcgugacguaccuggcccugcucgccgcguucaagguccggcccacguucgccgccgggcuacugcuucgcaaacugaccaguaaggaguugaugauggccaccauugggaucgcccuccugagccaauccacgauccccgagacaauccuagagcucaccgacgcccuggcacuggggaugaugguacucaagaucgugaggaacauggagaaguaccagcuggccgucacaauuauggccaucagcugcgugccgaacgcugugauccugcagaacgcguggaaagucucaugcacuauccucgcugccgugagcgucucuccccugcugcucaccagcucccaacagaaggcugauuggauuccccuugcguugacaauaaagggucucaaucccacugccaucuuccugaccacccugagccgcacauccaaaaagcggagcuggccgcucaacgaggccaucauggccgugggcaugguguccauccuggccagcagccugcucaagaaugacaucccaaugaccgggcccuuagucgcgggcgggcuguuaacggugugcuacguucugacuggccgcucugccgaccuggagcucgagcgggcggcugacgucaagugggaggaucaggcggaaauaucaggguccagcccuauacuguccaucacaaucucugaagacggcuccaugucaaucaagaacgaggaggaggaacagacuuuaacgauucucauacgcaccggccuucuggugauauccgguguguuuccuguguccauacccauuacagcggccgccugguaccugugggaggugaaaaagcagcgcgcgggcguccugugggacguccccagcccgccgcccguggggaaggccgagcuggaagauggcgcguaucgcauaaagcagcggggcauccucggauacucucaaauuggcgcggggguguacaaagagggcacauuccacaccauguggcacgucacacgaggggccgugcucaugcaccggggcaagcgcaucgagccuuccugggcggacgugaagaaggacuuaaucagcuaugggggcggcuggaagcuagagggggaauggaaggagggggaggagguccaggugcuggcucuggaacccgguaagaacccccgggcggugcaaaccaagcccggccuauucaagacuaacacagggacgaucggagcggucagucuagacuucagccccgggaccucagguagccccaucguagaccgcaagggcaaagugguagggcuguacggaaacggcgugguuacacggagcggggcuuacgucagcgcaaucgcgcaaaccgaaaaguccaucgaggacaaccccgaaaucgaagacgacaucuuucgcaagaagcgacugacgauuauggaccugcaucccggcgccgggaagacgaagcgcuaccugcccgccaucgugcgagaggcuauuaagcgcggacugcgcacccugauccuggccccuacgcggguagucgcggcggagauggaggaggcgcugcgcggcuugcccauccgguaccagacgcccgcgauucgcgcagagcauaccggcagggagaucguggaccugaugugccacgcgaccuucacuaugcgccuucuuucccccgugagagucccgaacuacaaccugaucaucauggaugaggcccacuucacggaccccgccagcauagccgcccgcggcuauauauccacccguguagagaugggggaggcggccggcauuuuuaugacagcgacgccacccgggagccgcgacccguucccccaguccaaugcgccgaucauggaugaggagcgggaaauccccgagcgcagcuggaacucgggccacgagugggugacggacuucaaggggaagaccgucugguucgugccgucuaucaaggcggguaacgacauugccgcgugucugcggaaaaacggaaagaaaguuauccagcucucacgcaaaaccuucgacagcgaguaugucaaaacccgggccaaugacugggacuucguggugacgaccgacaucucugagaugggggccaacuuuaaggcagagagggucaucgacccccggcgguguaugaagcccgugaucuugacagacggcgaggagcgugucauccuggccggucccaugccggugacccacucguccgccgcccagcgccgcggccggaucggacggaacccgaagaacgaaaacgaccaguacaucuacaugggagagccccucgagaacgacgaggauugcgcccauuggaaagaggcgaagaugcuucuggacaacauaaacacgcccgagggcaucaucccgagcauguucgagcccgaacgggagaagguggacgcgauugacggagaguaccgccuccggggcgaggcccgcaagacguucgucgacuugaugcggcgcggugaccugccugucuggcuagccuaccggguggcugcggagggcaucaauuacgcagaccggcgguggugcuucgacgggaucaagaacaaccagauccuggaggagaacguggaggucgagaucuggacaaaggagggcgagcgcaagaaguuaaagccgcggugguuggacgccagaaucuauuccgacccccuggcucugaaggaguucaaggaguucgcagcaggccggaaguccuuaacgcugaaucugauaacggagauggggcggcucccaaccuucaugacgcagaaagcacgggacgcucuggauaacuuggccgugcuccauacggccgaggcgggugggcgcgccuacaaccacgcauuaucugagcugcccgagacgcucgagacgcuacugcuccugacccugcucgccacagucacuggcggcaucuuccucuucuugaugagcggcaaaggcauagggaagaugacucucggcaugugcugcaucauuacggcgucgauccuccugugguacgcccaaauccagccgcauuggaucgccgccucuaucauccuugaguucuuccuaaucguucuguuaauaccggagcccgagaagcaaaggacgccacaggacaaccagcugacguacgugguaaucgcuauccuuacggugguagcggcuaccauggccaacgagaugggguuucuugagaagacaaagaaagaccucggcuuaggcagcauuacuacgaaggaguccgaaagcaacauccucgauauagaccugcgcccggcuuccgcguggacccuuuacgcgguagccacuaccuucgugacgcccauguuaagacacagcaucgagaacaguucggucaacgucagcuugaccgccauagcaaaccaggcgaccguguugaugggacucggcaagggguggccacugagcaagauggacaucggcgugccgcugcucgcaaucgggugcuacucccaggucaacccgauuacucugacggccgcgcugcuccuacugguggcacacuacgcgauaaucggccccggccuccaggcuaaagccacccgcgaggcccaaaagcgcgcugcugcagggauaaugaaaaacccgaccguugacgggaucaccgucaucgaucuagaaccgauacccuacgaucccaaauucgagaagcaacuggggcaggucaugcuacucauacugugcgugacgcaagucuugaugaugagaacaaccugggcccugugugaggcccugacccuugccacgggcccgaucucgacccugugggaggggaaccccggcagguucuggaacaccacuaucgcgguguccauggcgaacaucuuucggggcagcuaucuggccggggccggccuccuguucuccauuaugaagaauacaacgaacacccgccgggguaccggcaacaucggcgagacguuaggggagaaguggaagucccgccucaaugcgcugggcaaguccgaguuucaaaucuauaagaaauccgggauccaggagguggaccggacccuugccaaagagggaaucaagcgcggugagaccgaucaccacgccgucuccaggggcucggcgaaacuucgcugguucgucgaacggaacauggugaccccggagggcaagguaguggaccuagggugcggcaggggaggguggagcuacuacugcgggggacugaagaacgugcgggaggucaaagggcucacgaagggcgggcccggacacgaggagcccauccccauguccaccuacggcuggaaccugguucgacugcagagcgggguugacguguuuuucaccccgcccgagaaaugcgacacccuccugugugacauaggcgaguccagccccaaccccacgaucgaggccggccggacgcugcgcguguugaaccugguggagaauugguugaacaacaacacacaauucuguaucaaaguacuuaacccguauaugcccuccgugauugagaagauggaaacccuucagagaaaguauggcggagcgcuggugcgcaacccucugagccguaacaguacccaugagauguacugggucucuaacgccacggggaacaucguguccagcgugaacaugauuucccgcaugcucaucaauagauuuaccaugaagcacaagaaggccaccuacgagcccgacgucgaccuggggagcgggacccggaacaucggcaucgaauccgagauccccaaccuggacaucaucggcaagcgcaucgagaagaucaagcaggaacacgaaacgucuuggcacuacgaccaggaccaccccuacaaaaccugggccuaccaugggucuuacgagaccaagcagaccggcagcgccucuagcauggucaacgguguuguacgccucuuaacgaagcccugggacguuguaccaaugguuacccagauggcgaugaccgacaccacgcccuucggccagcagagaguauucaaggaaaagguggacacccggacccaggagcccaaggagggcacgaagaagcugaugaagaucacggccgaguggcucuggaaggaauuggggaaaaagaagacgccccgcauguguacccgggaggaguuuacccgcaagguccgaagcaacgccgcccugggcgcuaucuucacggacgagaacaaguggaaguccgcgcgcgaggccgucgaggauucccgguucugggagcucaucgaccgcgagcggaaccugcaccuggaagggaagugugagaccugcguguacaacaugaugggcaaacgcgagaagaaguugggggaguucgguaaggccaaggguucgcgggccaucugguacauguggcugggggccagauuccuugaguucgaggccuuaggcuuccugaacgaggaccacugguuuucccgugguaacucucugagcggugucgagggagagggccuccaccgccuaggcuacauccugcgugacgugaguaagaaggagggcggggcaauguaugccgaugacaccgcggguugggauacgcgcauaacgcuugaggaccuaaagaacgaggagauggucaccaaccacaugaagggcgagcacaagaaguuagcggaagccaucuucaagcucaccuaucaaaacaagguggugcggguccagcgcccaacgccucgcgguacggugauggauaucauuagccggcgcgaccagcggggcuccggccagguggguaccuacggccugaacaccuucaccaauauggaggcccagcugaucaggcaaauggagggggaaggaaucuucaagagcauccaacaccucacgguuaccgaggagaucgccguccagaacugguuagcccguguggggcgcgagaggcugucccgcauggcgauuagcggggacgauugcguugugaagccauuggacgaccgguucgccuccgcccuaaccgcccuuaacgacaugggcaaggucaggaaggacauucaacagugggagcccagcaggggguggaacgacuggacccaagucccguucugcucccaccacuuucacgaacucgugaugaaggauggccgcgugcuggugguacccugcaggaaccaagacgagcugaucgggagggcccggaucagccagggcgcuggcuggagccuaaaggaaacggccugccugggaaaguccuacgcccagauguggacccugauguacuuucaccggcgggaccugcgccuagcggccaacgcuaucugcucugcgguaccaagccacuggguacccaccucccggacaaccuggagcauucacgccaagcaugaguggaugacgacugaggacauguuggccguguggaaccgcguguggauccaggaaaauccguggauggaggacaagacccccgucgaguccugggaggaaguccccuaucuaggcaagcgcgaggaccaguggugcgggagucugaucggucugacaagccgcgcgacuugggccaagaacauucaaaccgccaucaaccagguaaagagucuuaucgggaaugaggaguauaccgacuacaugcccagcaugaagcgauucaggcgcgaggaggaagaggcagggguucucugguga

SEQ ID NO: 25270 - RNA, 9876 nt, Artificial Sequence
  derived and/or modified CDS sequence (opt11) from DENV-2__EU482746__SS-prME
acugcgggggugauaaucauguuaaucccgacagcuauggcauuccacuugacaacccgaaauggcgaaccccauaugauugucgggcgacaggaaaaaggaaaaucgcugcuguuuaaaacagaagauggcgugaacaugugcacgcucauggcuaucgaccugggggaacucugcgaagacaccauaacauauaaaugcccgcuuuugcggcagaacgaaccagaagacaucgacuguuggugcaacucaaccucuacgugggugaccuacggaacaugcacgacgacgggagaacacagacgugaaaaacgaagugucgcucuggucccacacguggggaugggccuugagacuaggaccgaaacguggaugaguuccgagggcgcguggaaacauguacaaagaauugagacguggauauuacgacacccaggauucacgaucauggcagcaaucuuagcauacacaauaggcaccacucacuuucagagggcucugauauuuauccuccuuacggcaguggcacccagcaugaccaugcgaugcaucggaaucucaaacagagacuuuguagagggagugucaggagggucauggguggacauagugcuggagcacggaaguugcgucacaacgauggccaaaaacaaaccgacuuuagacuucgagcugaucaaaaccgaagcuaagcaacccgccacgcuacgcaaguacugcaucgaggccaagcuaacaaacacgaccacagaaagucgcugccccacgcagggcgagcccucacugaacgaagaacaagacaagagauucguuuguaaacauuccaugguggaccgaggcuggggaaacggcugcggucuauucggaaagggcggaaucgucacgugcgcaauguucacuugcaagaaaaacauggaaggaaaaguaguucugcccgaaaaccucgaauacacgauaguaauaacgccacauuccggagaagaacaugcaguaggaaacgacaccggaaaacacgggaaagaaaucaagauuacgccccaaagcucaaucaccgaagccgaacucacgggguacggcacaguuacaauggagugcucaccacgcaccggacucgauuuuaacgagaugguuuugcuccaaauggaggacaaagcgugguuaguccaccgacagugguuccucgaccuaccccuucccuggcugccaggggccgacacgcagggaagcaauuggauacaaaaagaaacgcucgugacauuuaagaacccccacgccaagaaacaggaugucgucguuuuagggucccaagagggagccaugcauacagcauuaacgggggcaacagagauacaaaugucaucgggaaaccuguuguucacuggccaccucaaaugccgacuuaggauggacaagcugcaacuaaagggcaugagcuacaguaugugcacagguaaguucaaaaucgucaaagaaauagcagaaacucaacacgggaccaucguaauaagaguacaguacgagggcgacggaaguccgugcaagaucccguucgagauaauggaccuggaaaagcgacacguccucggacggcuaauaacgguaaacccgaucgucacagagaaggacagcccgguaaacauugaggcagaaccacccuuuggagacagcuacauaauaauagggguagagcccgggcaguuaaagcuaaauugguuuaagaaagggagcucuaucggacaaauguuugagaccacaaugcgcggagcgaagcggauggcaauacucggcgacacagcaugggauuuugggagcuuaggaggcguauucaccucuaucggaaaggcacugcaccagguuuuuggcgcaauauacggggccgcauuuucgggagucucauggacgaugaagauacuaaucggagucaucauaacauggauaggaaugaacagcagaagcacaagccucucggugucacuggugcuaguaggaguggugacacuauauuugggcgcaaugguacaagccgauagcggaugcguggugaguuggaaaagcaaagaacuuaaguguggaucagguauauuuauaacagacaacguccacaccuggacugaacaauauaaguuccaacccgaaagcccaucaaaacuagcuucagcgauccaaaaagcccacgaggaaggcauuugcggcauacgcagcgugacuagauuagaaaaccuaauguggaaacagauaacgcccgaguuaaaccauauccugucagagaacgaagugaaauugacuauaaugaccggugacauaaaggguauaaugcaagcaggcaaacgaucacugcgcccacaaccaacggagcucaaauacagcuggaagaccuggggcaaagccaaaaugcugagcacagaaucccauaaccgcacauuuuugauagacggacccgaaacagcagagugcccaaacacuaaucgagcauggaacagccuagaggucgaggacuacggauucggcguguuuacaaccaacaucuggcuaaaacuacgugagaaacaagauguguucugugauagcaaauugauguccgcggccaucaaagacaaccgcgccguacacgcagacaugggguacuggauugaaagcgcccugaacgauacauggaaaauggaaaaggccagcuuuaucgaggugaaaagcugucacuggccgaagucccacacgcuauggaguaacggagucuuagaaagcgaaaugauaaucccuaagaacuucgcuggucccgucucacaacacaacuauaggccuggauaucacacacagacggccggucccuggcaccugggaaagcucgaaauggacuucgacuuuugcgagggcacgacgguagucguaacggaagacugcggcaacagagggccgagccucagaaccaccaccgcaagcggcaaacuaaucacugaguggugcuguagaucguguacacuaccgccgcuucgguacagaggggaggacggcuguugguacggcauggagauccggcccuuaaaagaaaaagaggaaaacuuggugaacucccucguaacugccggacacgggcagauagauaacuucagccuaggaguauugggcauggcacuuuuucucgaagagaugcuaagaacgagaguagguacuaaacacgcaauccuuuuagucgccgucucauucgugacccucaucacgggcaacaugagcuuccgggaccucgggcggguaauggucauggugggggcaacgaugacggacgacauagggaugggaguaaccuaccuggcccuacuugcugcauucaaaguacggccgacauucgcggcgggccuacugcucagaaaguuaacuucaaaagaacucaugauggcaacgauaggaauagcacuucugagccagagcaccauccccgaaacgauauuagaguugacagacgcacuagcucuaggcaugaugguccuaaaaauaguccggaacauggaaaaauaucagcucgcagucaccauaauggcuauauccugcguaccaaaugcugucauccuccagaacgcauggaaggucagcugcaccauuuuagcggcagucuccgugagcccccuucuucucacaagcucacaacaaaaggcggacuggauacccuuggcacucaccauaaagggccuuaaucccacugcgaucuuccugaccacacucucgaggacaucgaaaaagcgaucuuggccacugaacgaagcgauuauggccguggggauggucucaauacucgcgucaagccuguugaagaaugacauccccaugaccggaccgcuggucgcaggagggcugcucaccguguguuacgugcugacggggcgcucugccgaccuggaacuagaacgagcugcggacgugaaaugggaagaccaggcagaaaucaguggguccuccccuauacuuagcaucaccaucuccgaggaugggucgauguccaucaagaacgaggaagaagaacagacucuaacaauccugauacgcacgggccuuuuggugauauccggaguauucccagugagcauccccauaaccgcggccgcuugguaccugugggaggugaagaagcaacgcgcaggcguacuaugggaugucccguccccaccacccgugggaaaggcugaacucgaagacggggcguauagaauaaagcaacgaggaauacucgguuacagccagaucggggccgguguauacaaagaggggaccuuccacacuauguggcacgugacaaggggcgcagucuugaugcacagagguaaaagaaucgaacccucaugggcggacguuaagaaagaucucauuucguacggcgggggauggaaacuggagggcgaauggaaagagggugaagagguucagguauuagcacuggagcccgggaaaaacccccgggcaguccaaaccaaaccgggauuguucaaaaccaacacgggcacaaucggcgcaguaucauuggauuucagcccgggcacaucaggauccccgauaguagacagaaaggguaaaguaguaggacuguacggaaacggcguugugacgaggucuggagcguacguuagcgcgauagcucaaaccgagaaaagcauagaagacaacccagaaaucgaggacgauauauuccgcaagaaacgccugacaaucauggaucuacaccccggggcaggaaagacaaaacguuaccuaccugcgaucguacgcgaggcuauuaaaaggggacucaggacgcucauacuggcgccuacgcgagugguagcagcagaaauggaagaagcacuaagaggacucccaauacgcuaucaaacccccgccauccgcgcggaacacacaggacgcgaaaucguagaccuuaugugucacgcgacguucaccaugcgacugcugucucccguacgcgugccaaauuacaaccuaauaauaauggacgaagcccauuucaccgacccggcgagcauagcagcgagagguuacauaagcacgagaguugaaaugggcgaagcagcgggaaucuucaugacggcaaccccuccagguagccgcgauccauucccccagucgaacgcccccauaauggacgaagagagagagauaccggagaggagcuggaacaguggccacgaaugggucacagacuucaagggaaagaccguuugguucguacccaguaucaaggcgggcaacgacauagcagcaugccucaggaaaaacgguaaaaaggugauacaauuaucacgaaaaacauucgacagcgaauacgucaagacgcgcgccaacgauugggacuucguugucacgacggacaucagcgaaaugggagcaaacuuuaaggcagaaagggucaucgaccccagaagauguaugaaaccgguaauccucacagauggagaagaaagggucauacuagcgggaccgaugcccgugacccauagcagcgccgcacaaagacgcgguagaaucggacgcaacccgaaaaaugaaaacgaucaguacaucuacaugggagaaccgcuggagaacgacgaagacugcgcucacuggaaagaggccaagaugcuccuggauaacauaaauacaccagaaggaauaauccccucaauguucgagccggaacgcgaaaaaguagacgcaauagauggcgaguauagacuccgaggcgaagcaagaaaaaccuucguggaccuaaugaggagaggggaccuccccguauggcuggcauaucggguggccgcggaaggcauaaauuacgcggauagaagauggugcuuugacggaaucaagaacaaccaaauccuagaggaaaacguagagguagagaucuggacaaaggagggcgagagaaagaaauuaaaacccagguggcucgacgcacguaucuacagugacccgcuggcucuaaaggaguucaaagaguucgccgccgggcggaaaagucuaacccugaaccugaucacagaaaugggacgauuaccaacauucaugacacagaaagcacgugaugcacucgacaaucuagcgguccuacacaccgccgaggccggcgggcgcgcuuacaaccacgcacuuuccgaacuucccgaaacacuagaaacucuacuccuccucaccuuauuagccacugucacaggggguaucuuucuguuccugauguccggcaagggaaucgggaagaugaccuuaggaauguguugcaucaucaccgcgaguauuuuacuuugguacgcgcaaauccaaccccacuggaucgcagcuucaaucauccucgaguucuucuuaaucguccugcucauacccgagccagaaaagcagaggacaccacaggauaaccaauuaaccuacgucgugauagcaauacucacggucguagcugccacaauggcgaacgaaaugggauuccuugagaaaacgaaaaaggaccuuggcuuagggucaauaaccacacaagaaagcgaaaguaauauccuggauaucgaccuacgaccggcaagugccuggacgcucuacgcugucgcaacaaccuucgucacgccaaugcuaagacacucgauugagaacucauccguaaacgucagccuuacagccaucgcuaaccaggccaccguccugauggggcuagguaaaggauggccccuaaguaaaauggacauugggguaccgcuacuggcgauugguugcuacucacaaguaaacccgaucacacuaaccgccgcccuccuccuccuugucgcucauuacgccaucaucggcccagggcuacaggccaaagccacacgggaagcacaaaagcgggcagcagcgggaaucaugaagaaucccaccguagauggaauuacagugaucgaccuagagccaaucccauacgacccgaaauucgaaaaacagcugggccaagugaugcugcuaauacugugcgugacucaaguacucaugaugcgaacaaccugggcacucugcgaggcccugacccuggcgacgggccccauaaguacccuaugggaagggaaucccggcagauuuuggaacaccaccaucgccguaaguauggcuaacauauuccgaggaaguuaccuggcaggcgcaggacucuuguucucuauaaugaagaacaccaccaacacccggagaggaacuggaaacauuggcgaaaccuuaggggagaaauggaaaagccgcuugaaugcacugggaaaaagcgaguuccagauuuacaagaaaagcggaauccaagaagucgaccgcacacucgccaaagaaggaaucaaacgcggggagaccgaccaccacgcaguaagcagaggaagugcuaaauuaagaugguucguggaaagaaacaugguaacgcccgagggaaaggucguggaucuugggugcggaaggggaggcuggagcuacuauugcggagggcucaaaaacguccgggaagucaaaggucuaacaaagggcggccccggacacgaggaaccuaucccaauguccacauauggauggaaccuaguucgccuacaaagcggaguagacguuuucuucacgccaccugagaagugcgauacucuacuaugcgacauaggagaaucgagcccgaauccgacgauagaagcuggacgcacacuccgugugcucaaccuagucgaaaauugguuaaacaauaacacccaauucugcauaaagguguuaaacccguacaugccgucuguaauugagaaaauggaaacccugcagagaaaguacggaggggcacucgugcgaaauccccucucacggaacaguacccacgaaauguauugggucuccaaugcaacuggcaacauagugagcaguguaaacaugauaagccgcaugcugaucaacagguucaccaugaagcacaagaaggcaacauaugagcccgacgucgaccuaggaagcgggacccguaacaucgguauugaaucagaaauaccgaaccuggauauaaucggcaaaagaaucgagaaaauaaagcaagaacacgaaacaaguuggcauuacgaccaggaccacccguacaaaacaugggcauaccacggcuccuacgagacgaaacaaaccgggucagcuucaucaaugguaaacggaguaguccgccuucucaccaaaccgugggacgucguaccgauggugacacagauggcgaugaccgacaccacuccauucgggcaacagagaguguucaaggaaaaagucgauacaagaacucaagaaccaaaagaaggcacgaagaagcucaugaagauaacugcagaauggcuguggaaggaacuggguaagaagaaaacgccccggaugugcacacgugaagaguucacgcgaaaagucaggagcaaugccgcccuuggagccauuuucaccgacgagaauaaauggaaaucagcccgcgaagccguggaggauucgcgcuucugggaacugauagauagagaacgaaaccuacaccuggagggcaagugcgaaacaugugucuacaauaugaugggcaagcgggagaagaaacucggcgaguucggcaaagcgaaaggcagccgagcgaucugguacauguggcucggcgcaagauuccuggaguuugaggcacuaggcuuccuuaacgaagaccacugguuuucccgcggcaauagccugagcgggguagaaggagagggccugcaccgacucggauacauauugagggauguaucgaagaaagaaggaggggccauguacgccgacgacacggccgggugggauacccggaucacauuggaagaucucaaaaacgaggaaauggucaccaaccacaugaaaggugagcacaagaaacuagcggaagccaucuuuaaacuuaccuaccaaaauaaagucguacggguacaacgcccaacgcccagagggaccguaauggacauuaucagccgucgggaccagcgaggaagugggcaagugggcacuuacggacuaaacaccuuuacaaacauggaagcucaacuaauaagacaaauggaaggcgaaggcaucuucaaaagcauacaacaccugacggucacagaagaaauugccguucagaacuggcuugcucgugugggccgcgaaagguuaucccgaauggccaucucgggagacgacugcguggugaaaccccuggacgacagauucgcaucugcacugacggcauuaaacgacaugggcaaaguaagaaaagauauacaacaaugggagcccucccggggcuggaaugacuggacacaggucccauucugcucccaccauuuccaugaacucgucaugaaggacgguagagugcucguagucccuugccggaaccaagaugagcuaauaggacgggccagaaucagccaaggagcgggguggagucuaaaagaaacggcaugccugggaaaaagcuaugcgcaaauguggacacuaauguauuuccacaggagagaccuacgcuuagcagccaacgccauaugcagugcagugccgagccauuggguacccaccaguagaacgacguggucaauucacgccaagcacgaauggaugacaaccgaagacaugcuggccgucuggaaccgcguguggauacaagaaaaccccuggauggaagauaaaaccccuguggagucaugggaagaagugccuuaucuggggaagagggaagaccaguggugcggguccuuaaucggccucaccucgcgcgcaacuugggcuaaaaacauccaaaccgccauaaaucaggucaggagccugauagguaacgaagaauacacagacuauaugccgagcaugaagcgcuuucgacgcgaagaagaagaagccggaguacugugguga

SEQ ID NO: 25271 - RNA, 9876 nt, Artificial Sequence
  derived and/or modified CDS sequence (opt11) from DENV-2__EU482590__SS-prME
acugcggggguaaucauaauguuaauaccuaccgccauggcauuccaccucaccacgcgcaacggggaaccccacaugaucguggggaggcaagaaaaaggaaaaagccuucuuuuuaaaacagaagacggaguaaacaugugcacgcugauggccaucgaccucggagaacuaugcgaagacaccaucaccuacaaguguccacuauugaggcaaaaugaaccagaagacauugacuguuggugcaauagcaccuccacauggguaacauacgggacgugcacuaccaccggggaacaucgucgagagaaaagaucaguggcucugguuccacacguaggaaugggguuggaaacaaggacggaaacauggauguccucagaaggagcauggaagcacgugcaaaggaucgaaacguggauucuaagacacccaggcuuuacgauuauggcagcgauauuagcauacacaauaggaacaacacacuuucagcgagcccugaucuucauauuguuaacagcaguagcaccgucgaugaccaugagaugcaucggcaucaguaacagagacuucguagagggagucaguggcggcucauggguagacauaguauuggagcaugggagcugcguaacaacaauggcgaaaaauaaaccaacacuagacuucgagcugauuaaaacugaggcaaagcaaccggcaaccuuaaggaaauacugcaucgaggcaaagcuaacaaacacaacaacggagaguagaugccccacacagggggaaccgucccuaaaugaagaacaagacaagcgguucgucugcaaacacagcaugguagaccgcggauggggcaauggcugcgggcucuuuggaaaagggggcaucguaacgugcgccauguucacauguaagaaaaacauggaaggaaaggucguccugccugagaaccuagaguauacgaucguuauaacaccgcauagcggcgaagaacaugccguaggaaaugacaccgguaagcacgggaaggaaauaaagaucacgccgcaaagcucaaucaccgaagccgaauugaccggcuacgguacaguaacaauggaaugcaguccccgcacaggccuggacuucaaugagaugguccuccuacaaauggaagacaaagcauggcucgugcauagacagugguuccuugaucucccauugccguggcugcccggggcagacacccaaggauccaacuggauucaaaaagagacacuugucacguucaaaaacccucacgccaagaagcaggauguaguaguguuaggaagucaagagggagcgaugcacacggcgcucacaggcgcaacggaaauacaaauguccuccggaaaccuauuguucaccggacaccugaaaugcagguugcguauggacaaacuucaacucaagggcaugucguacagcauguguacgggaaaauucaagaucgugaaagaaauagcggaaacccaacacggcacuauaguaauucggguacaguacgagggcgacgguucuccguguaagaucccuuucgagauaauggaccuugagaaacgccacguauugggccgauugauaacaguaaacccaauagugacggagaaggacuccccugucaacaucgaagcagagcccccguucggggauucauacaucauuauagggguagagcccggacaacucaaacugaacugguucaagaaaggguccagcauagggcagauguucgaaaccacuaugagaggggccaaaagaauggccgugcugggggacaccgcgugggauuucggcagccugggaggcguguucacaaguaucggaaaggcgcuccaccaaguguucggggccaucuacggcgccgcauucaguggagucucguggaccaugaagauacucauuggagucaucauaaccuggaucggaaugaacuccagaagcaccucccuaucgguaagccuaguccuaguagguguggugacacuauaccugggcgccaugguccaagcagacucgggcuguguaguauccuggaaaaacaaggaacugaagugcggaaguggcauauucauuacagacaacguacauacauggacggagcaguauaaauuccagcccgaauccccgucgaaacuugccucggccauucaaaaggcgcacgaagaaggaauaugcggaauccguucaguuacccgucucgagaaucuaauguggaaacaaaucacgcccgaauuaaaccacauuuugagcgaaaacgaggucaaacuaacgauaaugacgggagacauaaagggaauaaugcaagcgggcaagaggagccugagaccacagccaacagagcugaaauacuccuggaagacuugggguaaagcaaagaugcugaguacagagccacacaaucaaaccuucuugauagacggccccgagacugcggagugucccaauaccaaccgcgccuggaacagccuggagguagaagacuacggauucggaguuuucacgaccaauaucuggcuaaaauuacgcgagaagcaggaugucuuuugcgauagcaagcucaugagugcagccauuaaagauaacagagcaguccacgccgauaugggguacuggaucgaauccgcauugaacgacaccuggaaaauggagaaagcaucguucauagaaguaaaauccugccauuggccuaagagccacacuuuauggagcaauggaguacuagaaagcgaaaugauaauccccaagaacuucgcaggcccaguaagccagcacaacuaccguccaggguaccacacacagacagcuggaccauggcaccuaggcaaacuagaaauggauuucgacuuuugcgaagggacaacgguaguggugaccgaagacugcgggaaccgcggccccagcuuacguaccacgacagccucgggaaaacugaucacagaauggugcugccgaucauguacguugcccccgcugcgauaccgaggggaagauggcugcugguacgguauggaaauaagaccacugaaagagaaggaagagaaucucguaaacucccucguuaccgcggggcacggucaaauagauaacuucagcuuaggcguacucggcauggcccucuucuuagaagagaugcuacggaccaggguuggaacgaagcacgcgauauuacucguggcggugagcuucgucacacucaucacugggaacaugagcuuucgggaccuuggccgcguaaugguaauggugggggcuaccaugacggacgauaucggaaugggaguaaccuaccuggcccuacuggccgcguucaagguuagacccacauucgcagcaggauuguuauuaaggaaacucacaaguaaagaguugaugauggcuaccaucggcauugcacuacucagccagagcaccauacccgaaaccauacuagaacuaacggacgcccuagcucuuggcaugaugguauuaaaaaucguaagaaauauggaaaaauaucaacuagccguaacaaucauggccaucagcugcguuccgaacgcaguaauucuacaaaacgcguggaaggugagcuguacgauccucgcagcggucucagucuccccacuccugcucaccagcucccaacaaaaagccgauuggauaccccucgcgcugacaauuaaaggacuaaaucccacggcgauuuuucucacgacgcucagucggacaagcaagaagagaaguuggccacuuaacgaggcaaucauggccguagggauggucucuauacuagccagcucgcugcucaaaaaugacaucccgaugacgggaccccuaguagcaggcggacugcugacuguaugcuauguacugacagggagaagugcagauuuagaguuggaacgggcggccgacgugaaaugggaggaccaggcggaaauaaguggaucuuccccgauacuaucaauaaccauaagugaagauggaagcaugagcaucaagaacgaagaagaagaacaaacccuuacuauauuaaucagaacgggacugcucgugauuucagggguauucccggucucaauccccauuacugcagcugcaugguaccuaugggagguaaagaaacaacgcgccggcguacugugggacgugccuaguccaccacccguuggaaaagcagagcuggaagauggggccuacaggauuaaacaaagaggcauacucggauacucccaaauaggagcgggcgucuacaaagagggaacauuccauacuauguggcaugucacgcguggcgccguacuaaugcaccgcggcaaacgaauagaaccaagcugggccgacgucaagaaagaucuaauaucuuacggcggcggcuggaaacucgagggcgaauggaaagagggcgaggaggugcaagugcuggcacuagaacccgggaaaaacccacgcgccguccaaaccaaacccggucuguucaaaaccaacaccggcaccauaggagcugucagcuuagacuucagccccggaaccaguggaucacccauaguagauagaaaagggaaaguagucggcuuguacgggaacggcgugguuacacgaagcggagcauaugucucagccauagcccagaccgagaaaucaauagaagacaaccccgaaauagaggacgauauauuuaggaagaaaagacuuacuaucauggaccuccaccccggcgcagguaaaaccaagagauaucugccagccauaguccgagaggcuaucaaaaggggucuacgcacacuaauucuggcacccacccgcgugguagccgccgagauggaggaagcacuccgcggccuacccauuagguaccaaacaccggcaauccgagcagagcacacagggcgggaaauuguugaucugaugugccaugccacuuucaccaugaggcuccuauccccaguccggguaccaaacuauaaucuaauuauuauggacgaagcgcacuucacagacccagcuagcaucgcagcacgcggcuacaucaguacucgagucgaaaugggagaagcugcuggcaucuucaugaccgccaccccgccuggcagccgcgacccauucccacagagcaacgccccuauucuugacgaagagagagagauucccgaacgcuccuggaacaguggccacgaaugggucacagacuucaaggggaagaccguaugguucguacccucaaucaaggccggaaacgacauugccgcgugucuaaggaaaaacggaaagaaagucauccaacucucacgaaaaacuuuugacucagaguacgugaaaacgcgcgccaacgauugggacuuugucgugacaacggacauaagcgagaugggugcgaacuuuaaagcugaacgugucauagacccacgccgcuguaugaaaccaguaauacuuacggauggggaagaacgcguaauccucgcuggaccaaugccggucacgcacaguucggcggcccaacggcgcgguagaauaggacggaaccccaagaacgaaaacgaccaauauauauacaugggugagccucuggaaaacgacgaggacugugcacauuggaaggaggccaaaaugcugcuggacaacaucaacacccccgaaggcauuaucccgagcauguucgaaccggagcgugagaaaguggacgccaucgacggcgaguacaggcugagaggcgaagccagaaaaacuuucguggauuugaugcguagaggagaccuacccgugugguuagcuuauagaguggccgccgaggguauaaacuacgcagacaggagguggugcuucgauggaaucaaaaacaaccaaauauuagaagagaacguagaagucgaaauauggacuaaagagggggaacgaaagaaacucaaaccgagauggcuggacgcccggauauacagugacccgcuggcgcuaaaagaguucaaggaguucgcagcugggcgaaaaagucucacacuaaaccuaauuacugaaaugggacgccucccuacguuuaugacccagaaagcgcgagacgcguuggacaaccuggcagugcuucacaccgccgaagugggcggccgcgccuacaaccacgcgcuaagugaauugccagagaccuuggagacacucuugcucuuaacccugcucgccacagucacuggagggaucuuccuuuuccuuaugucgggcaaggggaucgggaagaugacuuugggaaugugcugcauaauaaccgcaucaaucuugcuaugguacgcccaaauacaaccccacuggaucgcggcgucaauaauacuggaguucuucuuaauaguuuugcuaauacccgaaccagagaagcagcggacaccccaagacaaccagcucacauaugucguaaucgccaucuugaccguugucgccgccacuauggcgaaugaaaugggauuccucgagaaaacgaaaaaggacuugggacuaggcagcauaacuacccaagagagugagucaaauauacucgauauagaccuuaggccagccuccgcauggacguuauacgccgucgcaacaacauucgucacucccaugcugagacacagcauugaaaacaguuccgucaauauaagucugaccgcgauagcaaaccaggccacaguacucaugggauuagggaagggguggccccucagcaaaauggacaucggcgugccacuauuagcgaucggcuguuacagucagguaaaccccauaacgcugacugccgcccuccugcucuuaguagcgcauuacgccaucauaggaccuggguugcaggcuaaagcuacccgcgaagcacaaaaacgggcagccgccgguauuaugaaaaaccccacaguagacggaauuaccguaaucgaucucgaaccaauaccuuacgacccgaaguucgaaaaacagcugggacaggucaugcugcugauacugugcguaacccaaguacucaugaugagaacgacaugggcacucugcgaagcacuaacucucgccacggggccaauuagcacccucugggaggggaacccuggccgauucuggaauacaaccauagcaguaagcauggcgaacauauucagaggcagcuaccuagccggagccggccuacuauucagcauaaugaaaaauacgacaaacacucggagggguacaggaaacaucggcgagacccuuggagaaaaauggaaaagccggcuaaacgcacugggaaagagcgaguuccaaauauacaagaaaucggggauucaagagguagaccgaaccuuggccaaagaagggauaaagagaggggaaacagaccaccacgcggugagccgagggucggcuaaacucaggugguucguggaacgaaacaugguaacaccggaggggaagguaguagacuugggaugcggcagaggaggauggucauauuacuguggcggccuuaaaaauguccgagaggucaaagguuuaacaaaaggagggccaggacacgaggagccgauacccaugucaacauacggauggaaccucgugcgcuuacagagcggagucgacgucuucuucacacccccagagaagugugacacgcuccuuugcgacauaggggaaagcucacccaauccgaccauagaagcgggacggacccuaagaguacugaaccucgucgaaaauuggcuaaacaauaacacacaauucuguaucaaggugcugaacccauacaugccuuccgucaucgagaaaauggaaacgcuucaacggaaauacggaggggcccuagugcgcaacccccuaagcagaaacucgacccacgaaauguacugggucaguaacgcaaccggcaacaucgugucgucagucaauaugauaagcagaauguugauaaacagauucaccaugaaacacaagaaggcaacauacgagccagacguagaccucggcucgggcacgcggaauaucggcauagagucagagaucccgaaccuagacauuauaggcaagaggauagagaaaauaaagcaagagcacgaaacuuccuggcacuaugaccaagaccacccauacaagacgugggcauaccaugggucauacgagacaaaacagacuggaucugccucgagcaugguaaacggggucguaagacucuuaacaaagccaugggacguagucccgaugguaacacaaauggcaaugaccgacaccaccccauuuggccaacagcggguauucaaagagaaggucgacacuagaacgcaagaaccgaaggagggcacaaagaagcugaugaagaucacggcagaauggcuuuggaaggagcuggggaagaagaaaacaccccgcaugugcacucgcgaagaguuuacuagaaaaguaagaagcaacgcugcgcuaggggccaucuucacagaugagaacaaauggaaaagcgcaagagaggcagucgaagacucacgauuuugggagcucauagacagagaacgaaaucuccaccuugagggcaaaugugaaacgugcgucuacaacaugauggguaagagagagaaaaaguuaggcgaguucggcaaggcaaaagggagccgggcaaucugguacaugugguuaggcgcccgauuucucgaguuugaagcgcuaggauuccuaaacgaggaccacugguucucucgagggaauagcuuauccgggguagagggcgaaggacuacaccgccuugguuacauccuaagagauguuagcaagaaagagggaggagcgauguacgcggacgacacggcagggugggacacaagaauuacacuggaggauuugaaaaacgaagaaauggucacuaaucacaugaagggagagcauaagaaacuagcugaggccauauucaagcugacguaccagaacaaagucgugcggguacaacggccgacacccagaggcacgguuauggacauuaucagccgccgcgaccagcgaggaaguggucaagugggaaccuacggauuaaauaccuucacgaauauggaagcgcagcugauuaggcagauggagggagagggcauuuuuaaaucaauccagcaucugaccgucacagaagagauagcaguacagaauuggcuagcccgcguaggcagagaacgcuugagccgaauggccaucagcggcgacgacugcgucguuaaaccacuggacgaucgguucgccagcgccuuaacugcccuuaacgacaugggcaaaguccggaaggacauacagcaaugggaaccaucaaggggauggaaugacuggacccagguacccuuuugcucccaccacuuucaugagcucgucaugaaagacggucggguccuagucguaccaugcagaaaccaagaugaacugaucggucgcgcacgaaucucgcagggggccggaugguccuugaaggaaacagcaugucugggaaaaagcuacgcccagauguggacccuaauguauuuccaucggcgggaccuaaggcuugcagccaacgccauaugcuccgccguacccucccacugggugccgaccagucgcacaacguggucgauucacgccaagcacgaauggaugaccacggaagacaugcuagcgguguggaaccgaguauggauccaggagaauccauggauggaagacaagacgcccguagagucuugggaagagguuccauaucuuggcaaaagggaagaccaaugguguggcucccugaucggacucacaucccgggccacuugggcgaaaaauauacagaccgcaauaaaccaggugaggucccugaucggcaaugaagaauauacagacuacaugccaagcaugaagagauuccgccgcgaggaagaggaggcugguguucucugguag

SEQ ID NO: 25272 - RNA, 9876 nt, Artificial Sequence
  derived and/or modified CDS sequence (opt11) from DENV-2__EU482594__SS-prME
accgcgggggucaucaucaugcugauccccaccgccauggcguuccaccucaccacccgcaacggggagccccacaugaucguuggccgacaggagaaggguaagucccugcuguucaagaccgaggauggcgugaacauguguacccucauggccaucgaccugggggagcuuugugaggacaccauaaccuacaaaugcccccuccugcgccagaacgagcccgaggacaucgacuguuggugcaacagcacaagcaccugggugaccuauggcaccuguacuaccacgggcgagcaccggcgcgagaagcggagugucgcccuggugccccacguggggaugggucucgagacccggaccgaaacauggaugagcagcgagggggccuggaagcauguccagcggaucgagaccuggauccuccgccacccgggcuucacgauaauggccgcgauccuggcauacaccauagggaccacccacuuccagcgggcccucaucuucauccugcugaccgccguggcgccuagcaugaccaugcgaugcauagggaucagcaaccgcgacuucguggagggcguuucuggcggcuccuggguggacaucgugcucgagcacgggaguugcgucacaacgauggccaagaacaagccaacgcuggacuucgaguuaaucaagaccgaggccaagcagcccgcaacccuccgcaaguacugcaucgaggccaagcugacgaacacaaccacugagucccggugcccgacgcagggcgagcccagccugaacgaggagcaagauaagcgcuucgugugcaagcacuccaugguggaccggggcugggggaacggcugcggcuuauucggcaagggcgggaucgugaccugcgcaauguucacgugcaagaagaacauggagggcaagguugugcugcccgagaaucuggaguacaccaucguaaucacgccccacagcggggaggagcaugccgugggcaacgacaccgggaagcacggcaaggagaucaagaucaccccgcaguccagcaucaccgaggccgagcucacaggguaugggacggugaccauggagugcagcccccgcacgggccuggacuucaacgagaugguccugcuccaaauggaggacaaggccuggcuggugcaccgucagugguuccuggaccuuccccugcccuggcugccgggggcugauacacagggcagcaacuggauccagaaggaaacgcucguuaccuucaaaaacccccacgcgaagaagcaggaugucgugguccuggguucccaagaaggcgccaugcacaccgcccugaccggggccacggagauccagaugucguccggcaaccuccuguuuaccggccacuugaagugccgccucaggauggacaaauugcaacugaaggggauguccuacagcaugugcaccggcaaguuuaagaucgugaaggagaucgccgagacucagcacgggacgaucguaauccgcguccaguacgagggcgacggcucccccugcaagauccccuucgagauuauggaccucgagaagcggcacgugcuggggcgacugaucaccgugaauccgaucgucgcugagaaggacagucccgugaacauagaggccgaaccgcccuucggcgacuccuacaucaucaucgggguggagccgggucagcuaaagcugaacugguuuaagaaaggguccuccaucggccagauguucgagaccaccaugcgcggagccaaacggauggccauccugggggauacugccugggacuucggcucgcucgggggcgucuucacaucgaucgguaaggcucugcaccagguguucggcgccaucuacggcgccgccuucagcgggguguccuggaccaugaagaucuugaucggcgucaucauuacauggaucgggaugaacagccgcuccacgagucugucagucagccucguauuagucggcgugguuacccuguaucucggggcgaugguccaggccgacuccggcugugugguuagcuggaaguccaaggagcugaagugcggcagcgggauauucaucaccgacaacguccauaccuggaccgagcaguacaaguuccagcccgaaagccccagcaagcuggccucugccauucagaaagcccacgaggagggcaucugcgguauccgguccgugacccgacucgagaaccucauguggaagcagaucacccccgagcugaaccacauccucagcgagaacgaggugaagcuuacaauaaugacgggcgacaucaaggggaucaugcaggcgggcaagcggucccugcgcccgcagcccaccgaacucaaguacagcuggaagaccuggggcaaggccaagaugcuguccaccgagagccacaaccagacguuucugauagacgggcccgaaaccgccgagugcccgaacaccaaccgggccuggaacucccucgaggucgaggacuacggcuucgggguguucaccacgaacauaugguuaaaguuaagagagaagcaggacguguucugugacuccaagcugauguccgccgcgaucaaggacaaccgggccguccacgccgacaugggcuacuggaucgagagcgcccugaacgacaccuggaagauggagaaagccuccuucaucgaggucaaaagcugucacuggcccaagucccacacccuguggagcaacggcgugcucgagucggagaugaucauccccaagaacuucgcggggcccguuucgcagcacaauuaucgcccaggcuaccacacccagaccgccgggcccuggcaucugggcaagcuggagauggacuucgacuucugcgaggggacgacaguaguagucacagaagacugcggcaaccggggccccagccuccgcaccacgaccgccuccgggaagcugaucaccgaguggugcugcaggagcugcacacugccuccgcucagguacagaggcgaggacgggugcugguacggcauggagauacgcccccugaaggagaaggaggagaaccuggugaacuccuugguaacggccgggcauggccagaucgacaacuuuagcuuggggguccuggggauggcccucuuccuggaggaaaugcugcggacccgcguggggaccaagcacgccauccuccugguggccgucuccuuugugaccuuaaucacgggcaacaugagcuuccgggaccucggacgcgugauggucauggugggggccaccaugaccgacgacaucgggaugggcaucaccuaccuggcccugcucgcggccuucaaggugagaccgacguucgcugccggucugcugcucaagaagcugaccuccaaggagcugaugauggccaccaucggcaucgcgcuccugagccaguccaccauccccgagacgauccuggaauugaccgacgcccuggcccuggggaugaugguucucaagaucguccggaacauggagaaguaccaguuggccgugaccaucauggccaucagcugcgucccgaacgcggugauucugcagaacgccuggaagguguccugcaccauccucgccgccgucagcgugagcccccuuuuauugacgagcucccagcagaaagcagacuggauuccccuggcccuaaccaucaagggccucaaccccaccgcuaucuuccugaccacgcugagccgcaccuccaagaagcggaguuggccgcucaacgaggcuauaauggccgucggcaugguguccauacuggcgagcagcuuacucaagaacgacauccccaugaccgggccccugguggccggcgggcugcucaccgucugcuacgugcugacgggccgcagugccgaccuggagcucgagcgcgccgccgacguaaagugggaggaccaagcggagaucagcggguccagccccaucuuauccaucaccauuagcgaggauggcuccaugaguaucaaaaacgaggaggaggagcagacccugaccauccucauccgcacgggccugcugguaaucuccggaguguucccggugagcauccccauaacggcagcggccugguaccucugggagguuaagaagcagcgggcaggcgugcugugggaugugcccagcccuccgcccgucgggaaggcggagcuggaagacggcgccuaccgcaucaagcagcgggggauccucggauacagccaaaucggcgccgguguguacaaggagggcaccuuucauaccauguggcacgugacccgcggggccguccugaugcaccggggcaaacgcauagagcccuccugggcugacguuaaaaaagaccugaucagcuacgggggugguuggaagcucgaaggggaguggaaggagggcgaggaggugcaaguccuggcgcuggagcccgggaaaaacccgcgggccgugcagacgaaacccggccucuucaaaacaaacaccgggaccaucggcgccgugucccuggacuucagccccggcacguccgggagccccaucguugaccgcaagggcaaggugguggguuuauacggcaauggcgucgugacccgguccggggcuuaugugagcgcgaucgcccagaccgagaaguccaucgaggacaaccccgagaucgaggacgauauauuccgcaagaagcggcucaccaucauggaccugcaccccggcgccgguaagacgaagcgcuaccugcccgccauuguccgggaggccaucaagcgcggccugcgaacccucauucuggcaccgacccgcguaguggccgccgagauggaggaggcccugcgcggguuaccgauccgguaccagaccccggccauccgcgcggagcacacgggccgggagaucgucgaccugaugugccacgccacuuucaccaugcgccuguugucccccgugcggguuccuaacuacaaccugaucaucauggacgaggcccauuucaccgaucccgccagcaucgccgcccgcggcuauaucuccacucgggucgagaugggggaggccgccggcaucuucaugaccgccacgccgcccgggagccgcgauccuuucccgcaguccaaugcgcccaucauggacgaggagcgggagauccccgagcgcagcuggaacaguggccacgagugggugacagacuucaaggggaagacggugugguuugucccgagcaucaaggccggcaacgacaucgccgccugucugcggaagaacggaaagaaggugauccagcucucccgcaagaccuucgacagcgaguacgugaagaccagagccaacgacugggacuucguugugacuacggacaucuccgagaugggggcgaacuuuaaggcagagcgcgugaucgacccccggcgcuguaugaagccggucauccuaaccgagggcgaggagcgggugauccuggccgggcccaugccgguuacccacagcuccgccgcccagcgccggggcagaauugggcgcaaccccaagaacgagaacgaccaguacaucuacaugggcgagccccucgagaacgacgaggacugcgcgcacuggaaagaggccaagaugcugcuggacaacaucaauacccccgaagguaucauccccagcauguucgagcccgagcgggagaaggucgaugccaucgauggggaguacagacuccggggcgaggcccggaagacguucguggacuuaaugcggcgcggggaccugcccguguggcucgccuaccggguggcggccgagggcaucaacuacgccgaccgucgguggugcuucgacgggauaaagaauaaccaaaucuuggaggagaacguggagguggaaaucuggaccaaagagggcgagcguaagaagcugaagccgcgguggcucgacgcccgcauuuacuccgacccccuggcguugaaggaguucaaggaguucgccgccggccggaagucucucacccugaaccuaaucaccgagaugggacgccuccccacauucaugacccagaaggcucgggaugcccuggacaaucuugcgguucuccauaccgcggaggccggcggacgcgccuacaaccacgcccuguccgaacugcccgagacccucgagacucuguugcuccugacccuucucgcgaccgugacgggcgggaucuucuuauuccugaugagcgggaagggaaucgggaagaugacgcuggguauguguugcaucaucaccgccuccauccuacugugguacgcccagauccagccgcacuggaucgccgccagcaucauccucgaguucuuccugaucguacugcuuauccccgagcccgagaagcagcggacgccccaggacaaccagcugaccuacguggugauagcgauccugaccgucguggccgccacgauggccaacgagauggguuuccucgagaagaccaagaaagaccugggccugggcaguauagccacccaagagagcgagagcaacauacucgacaucgaccuucgcccggcauccgcuuggacccuguacgcuguggccacgacauucgucacgcccaugcuccggcacuccaucgagaacuccagcgugaacgugucccugaccgcuaucgcuaaucaagccacggugcugauggggcucggcaagggguggccccugaguaagauggacaucggcgucccccugcuggccaucgggugcuacucccaggugaacccgaucacccugaccgccgcgcugcucuuacuggucgcccacuacgccaucauuggccccggccuucaggccaaggcgacucgggaagcgcagaagcgcgccgcagccgggaucaugaagaacccgacaguggacggcaucacugugaucgaccuggagcccauuccguacgaccccaaguucgagaagcagcuggggcaggucaugcuccugauccugugcgugacccaggugcucaugaugcguaccacgugggcccugugcgaggcgcucacccucgccaccggccccaucagcacccucugggaggggaaccccggccgcuuuuggaacacgaccaucgccgucuccauggccaacauauuccggggcagcuaccuggcaggggccggccuccuguucaguaucaugaagaacacaacaaacacgcgccgcggcaccggcaacaucggcgagacgcugggggagaaguggaaaucccgccucaacgcgcugggaaaguccgaauuccagaucuauaagaaguccgggauccaggagguggaccgcacccuugccaaggagggcauaaagcgcggggaaacggaccaucaugccgugucgcgggguagcgcgaagcuccgcugguucguggagcggaacauggucacucccgagggcaagguggucgaccuggggugcggccgagggggcugguccuacuacugcgguggccugaagaacguacgggaggugaagggccucaccaagggcggucccgggcaugaagagcccauacccaugagcaccuacggcuggaaccugguccgccuacagagcgggguggacguguucuucacgccaccugaaaaaugcgacacccugcugugcgacaucggcgaauccagccccaaccccaccaucgaggcuggccggacccugcgcguccucaaccugguggagaacuggcugaacaacaacacgcaauucugcaucaaggugcuaaauccguacaugcccuccgugaucgagaagauggagaccuuacagagaaaguacgggggcgcccuggugcgcaacccucugagcaggaacucuacgcacgagauguacugggugaguaacgccaccgggaacaucguuucuagcgugaacaugaucucccgcaugcucaucaaccgauucaccaugaagcacaagaaggccacguacgagccggacguggacuugggaagcgggacccgcaacaucggcauagaguccgagauccccaaccuggacaucaucggcaagcgcaucgagaagaucaagcaagagcaugagaccagcuggcacuaugaccaagaccaccccuauaagacaugggcguaccacggguccuacgagacgaagcagaccggcagcgcauccagcauggucaacgggguggugcgguuacugaccaagccgugggacguggugccgauggugacccagauggccaugacggacaccacccccuucggccagcagcgcgucuucaaggagaagguggacacacggacgcaggagcccaaggaggguaccaagaagcugaugaagaucacggccgaguggcucuggaaggagcuagggaagaagaagacgccccgcaugugcacucgggaagaauucacccgcaaggugagauccaacgccgcgcugggcgcuauauucaccgacgagaacaaguggaaguccgcccgcgaggccgucgaagacucccgguucugggagcucaucgaucgcgaacggaacuugcaccuggaggggaagugcgagaccugcguguacaacaugaugggcaaacgcgagaagaagcucggggaguucggcaaggcgaagggcagccgcgccaucugguacauguggcugggggcccgcuuccuggaguucgaggcuuugggcuuucugaacgaggaccacugguucagccgggguaacucccugagcggcguggagggggagggcuuacaccgccugggcuacauccuacgggacgucuccaagaaggagggcggggccauguacgcggacgacacggccgggugggacacccgcaucacccucgaggaccuaaagaaugaggagauggucaccaaucacaugaagggggagcacaagaagcuggcagaggccaucuucaagcugacguaccagaacaagguagugcgggugcagcgcccgaccccccggggaaccgugauggacaucauaagccgccgcgaccagcggggcuccggccagguggggaccuaugggcugaacacguucaccaauauggaggcacagcugauacgccagauggaaggggagggcaucuucaagucuauccaacaucucaccgugaccgaggagaucgcggugcagaacuggcuagcccgggugggccgcgagcggcugucccgcauggccaucagcggcgacgauuguguggugaagccccuggacgaccgguucgccuccgcccugacggcgcuaaacgauaugggcaagguccgcaaggacauccaacagugggagcccagcagaggauggaacgacuggacccaggugccguucugcucccaccacuuccacgagcucgucaugaaggacggccgcgugcuggugguccccugccggaaccaggacgagcugaucgggcgcgcccggaucagccagggcgcaggcuggucccucaaggagaccgcgugccuagguaagucuuacgcgcagauguggacccugauguacuuucaccgccgggaccuacgccuggcggcgaacgccauuugcuccgcagugcccagccacugggugcccacaucccggaccacguggagcauccacgccaagcacgaguggaugaccaccgaggacaugcuggccgucuggaaccgcguguggauccaggagaacccguggauggaggacaagacgcccguggagagcugggaggagguccccuaccucggcaagcgggaggaccaguggugcgggucucugaucggccuaaccucacgcgccaccugggccaagaacauccagaccgccaucaaccaggugcggucccucaucgggaacgaggaguacacggauuacaugcccagcaugaagcgguuccgccgggaagaagaggaggcgggcgugcugugguga

SEQ ID NO: 25273 - RNA, 9876 nt, Artificial Sequence
  derived and/or modified CDS sequence (opt11) from DENV-2__EU482604__SS-prME
acggccggcgugauaauuaugcugaucccuaccgcgauggcguuucaccucaccacccggaacggggaaccccacaugaucguugggcggcaggagaaagggaagucccugcuguucaaaaccgaggacggcgucaacaugugcacccucauggcgaucgacuuaggggaacugugcgaagacacaauaacauauaaaugcccccuccugcgccagaacgagcccgaggacaucgacugcuggugcaacucgacaagcaccugggugacauacggaaccugcaccaccacaggcgagcaccggcgcgagaagaggucugucgcccuuguuccccacgugggcaugggccucgagacccggaccgagacuuggaugagcucggagggggccuggaaacacgugcagcggaucgagacuuggauucuccgccacccgggcuucaccauuauggccgcgauccuggcauacaccaucgggaccacgcauuuccagcgagcguugauuuucauccuguugacggccguggcgcccucgaugaccaugcgcugcaucggcaucagcaaccgggacuucguugagggcgucagcgggggcaguuggguugacauugugcucgagcacgggaguugugucaccacgauggccaaaaauaagcccacccuggacuucgaacugauuaaaaccgaagccaagcagcccgcaacucuccggaaguacugcaucgaagccaagcugaccaacaccaccacagagucgaggugccccacgcagggugaacccagccuuaacgaggagcaggauaaacgauucaucugcaagcacuccaugguggaucggggcugggggaacggcugcgggcuguucgggaagggcgggaucgugacaugcgcgauguucacuugcaagaagaacauggaggguaaggucgugcagcccgaaaaccuggaguacaccaucgugaucacgccccacagcggugaagaacaugccgucggcaaugauaccgggaagcacggcaaggagauuaaaaucaccccacagucgagcauaaccgaggcagagcuaaccgguuacggcacggugacaauggagugcagcccuagaaccggucucgacuucaacgagauggugcuacugcagauggaggauaaggcuugguugguccaucggcaaugguuccuggaccuaccccuccccuggcugccuggggccgacacacagggcaguaauuggauccagaaggagacgcugguuacguucaagaauccccacgcgaagaaacaggacguggucgugcucgguucccaggagggcgccaugcacacggcccucaccggcgccacggaaauccagaugagcagcggcaaccuccuguucaccggucaucugaaaugucggcuucggauggacaagcuccagcugaaggggauguccuacagcaugugcaccggcaaauuuaagaucgucaaagagaucgccgaaacccagcacgggacgaucgugauucgaauccaguacgaaggcgacggcucccccugcaaaauacccuucgagaucaccgaucuggagaagcggcacguguugggacgccuaaucaccgucaaccccaucgugauagaaaaagauagcccuguaaauaucgaggcugagccgcccuucggcgacuccuauaucauuaucggggucgagccaggccagcugaagcucaauugguucaaaaaggggagcucgaucggccaaauguucgagaccacaaugcgcggcgccaagcggauggccauccugggggacacugcuugggacuucggcagccucggcgggguguuuaccucgaucgggaaagcacuacaccagguuuucggggcgaucuauggagccgccuucagcggggucuccuggacuaugaagauucugauaggcguggugaucacguggaucgguaugaauagcagguccaccagccugagcgucagccuggugcucgugggcgucgucacccuguaccugggagccaugguucaggcagacaguggcugugucgugagcuggaagaacaaggaacuaaagugcggcuccgggaucuuuauaaccgacaacgugcacacguggaccgagcaguacaaguuccagcccgagagccccucuaagcuggccuccgccauccaaaaggcccacgaggagggcauaugcgggauccggagcguaacccgucuggaaaaccucauguggaaacagaucacaccagagcucaaccacauccugagugagaacgaagugaagcucaccauaaugacuggcgacacaaagggcaucaugcaggccggcaaaagaagccuucgcccucagcccaccgagcugaaguacaguuggaaaacguggggcaaggcgaagauguuaagcacagagagucacaaucagaccuuccugaucgacgggccugagacagccgaguguccaaacacgaaccgggccuggaacagccuugaaguggaggacuacggcuucggggucuucacgaccaauaucuggcuuaaacugcgcgagaagcaggacguguucugcgauucuaagcugaugagcgccgccaucaaggacaacagagcaguccacgccgauaugggcuacuggaucgaguccgcccucaacgauacuuggaagauggagaaggccagcuucauagaggucaaguccugccacuggccuaagagccacacccuuugguccaacggcgugcuggagagcgagaugaucaucccuaagaacuuugccgggcccgucucccaacacaauuaccggccgggcuaccacacacagaccgcggggccguggcaccuuggcaagcuggagauggauuucgauuucugcgagggcaccacgguaguggugacggaggauugcggcaacagaggcccuagucugcgcaccaccaccgccucggggaaacucaucacggaguggugcugccgauccugcacucugccaccucuccgcuaccggggcgaggacgggugcugguacggcauggaaauccgcccccuaaaggagaaggaagagaaucuggucaacagccuggugaccgcggggcacggccagaucgacaacuuuuccuuaggcguacuggggauggcccucuuccuagaagaaaugcugcggacgcgcgugggcacgaagcacgcaauucucuugguggccguuucuuucgucacacugauaacggggaauaugucguuccgcgaccugggccgcgugaugguuauggucggggccacaaugacggacgacaucggaaugggcgugaccuaccucgcgcugcuagccgcguuuaaggugcgccccaccuucgccgcggggcuccuccugcggaagcuaacaagcaaggagcucaugauggccacgauagguaucacacugcucucccagagcacgauacccgaaaccauuuuagagcugacggaugcccuagcgcuggggaugaugguccuuaagaucgugcgaaacauggagaaguaucaauuggccgugacgauuauggcaauaucuugcgucccgaacgccgugauucuacggaaugccuggaaagugucaugcacgauccuggccgccguauccguauccccgcuccugcuaaccaguagccagcagaaggccgauuggaucccccucgcccugacaaucaagggccuuaacccuacagcgaucuuucucaccaccuuguccagaacuagcaagaagcgguccuggccgcugaaugaggcuauaauggccgucggcaugguaagcauacuugcuuccucccugcuaaagaacgacauaccuaugacggggccuuuaguggccggcggccugcugacggucugcuacguguuaaccggccgcagcgcagaccuggagcuggaacgggcggcggacgugaagugggaggaccaggccgagaucuccgggagcucccccauauuaucuaucacgaucucugaagacggauccaugucaaucaagaacgaggaggaggagcagacgcugacgauucugauccgcacaggccuccucgucaucagugggguguucccgguguccauuccgaucacggcugcagccugguaccugugggaggucaagaagcagcgggccggcgugcucugggacgugcccagucccccucccgucgggaaagccgaguuggaggacggcgcauaccgcaucaagcagcgcgggauccuuggauacucccagauuggcgcggggguguacaaggagggcacguuccacaccauguggcacgugacacgcggggccguccucaugcaccgagggaagaggaucgagcccagcugggcagacgugaagaaggaccuuauaagcuacgguggcggcuggaaacuggagggagaguggaaagaaggcgaggaggugcaaguccucgccuuagaacccgggaagaaccccagagccgugcagacuaaacccgggaucuucaaaacgaauacagguaccaucggcgcggugucguuagacuucuccccuggcaccagcgggucccccaucgucgacagaaagggcaagguuguagggcuauacggcaacggcgucgugacaagaucgggggccuacgugucagccauugcccagaccgagaagucuaucgaggacaaccccgagaucgaggacgacaucuuucgcaagaaacgguuaaccauaauggaccugcaccccggcgcggggaagacuaaacgcuaucuccccgccauuguccgggaggccaucaagcgcggccugaggacgcuuaucuuagcuccgacucgggugguggccgcagagauggaggaggcccuccgcgggcugcccauucgguaccagacacccgccaucaaggccgagcacaccggccgcgagauaguggacuuaaugugccaugccacguucaccaugaggcuccucagucccgugagaguaccgaacuacaaccugaucaucauggacgaagcgcauuucaccgaucccgcuuccaucgccgccagaggcuacaucagcacgcgagucgagaugggggaggccgcgggcauuuucaugaccgcaacgccacccgggucacgggacccguucccccaaagcaacgcgcccaucauggacgaggagcgcgagauccccgaacgguccuggaacagcggccacgagugggugaccgacuuuaaggguaagaccguaugguucgucccguccauaaaggcuggcaaugacaucgcggcuugcuugcgcaaaaacggcaagaaagugauacaacugagccggaagacguucgacuccgaauacgucaaaacccgcgcgaacgauugggacuucgucgugaccaccgauaucuccgagaugggcgccaauuucaaggcagagcgagugaucgauccccggagguguaugaaacccgucauucugacagacggcgaggagcgcgugauucuagcggggcccaugccggugacgcacagcagcgcugcccagcggcgcggccguaucgggcggaacccaaagaacgagaacgaucaauauaucuauaugggcgagccccuagagaacgaugaggauugcgcccacuggaaggaagccaagaugcuucucgacaacauaaauacccccgaaggcauaaucccguccauguucgagcccgagcgcgaaaaggucgacgcgaucgacggggaguaccggcugagaggggaagccagaaagaccuuuguggaccugaugcgccguggggaccuccccgugugguuagccuacaaggucgccgccgaggggaucaacuacgcggaccgcaaguggugcuucgaugggaucaagaauaaccagaucuuagaggaaaacguggagguggagaucuggacgaaagagggcgagcggaagaagcucaagccgagauggcuggaugcucggaucuacagcgacccacuggcacucaaggaguucaaggaguucgccgcaggccgcaagagucugacgcugaaccucaucaccgagauggggcgucugcccacguucaugacgcagaaggcgcgcaacgcgcuugacaaccucgccguacugcacaccgccgaggcuggcggacgcgccuacaaccacgcccugagcgagcuccccgagacccuagagacccugcuucugcugacgcucuuagcaaccgugacagguggcauauuccucuucuuaauguccgggaagggaaucgggaagaugacgcugggcaugugcugcauaaucaccgcuagcguacugcucugguacgcgcagauacagccucauuggauagcagccuccaucauccuggaguucuuucugauuguauugcuaauaccagagcccgaaaagcagaggacgccccaagacaaccaacugaccuauguggucaucgccauccucaccguggucgccgcgacaauggccaaugagaugggguuccuggagaaaacaaagaaagaccugggucucgguucuauaaccacccaagagagcgaauccaacauccuggacaucgaccuacggccagcaagcgccuggacccucuacgccgucgcuacgaccuucgugaccccaaugcugcgccacucaaucgagaacagcuccgugaacgucagucugaccgcgaucgccaaccaagcaacgguguugaugggacuugggaaggguuggccucuuuccaaaauggauauuggcgugccccuccuggccaucggguguuacucccagguaaacccaaucacccugaccgccgccuugcugcugcucguagcccacuaugccauuaucgggcccggacuucaggcgaaggccacccgggaggcucagaagcgugccgccgcggggaucaugaaaaaccccaccguggacggcaucacugucauagaucuggagcccaucccguacgacccgaaguucgagaagcagcuuggccaggugaugcugcugauucucugcgugacucaggugcugaugaugcguacaacgugggccuuaugugaagcucucacccuggccaccggccccaucaguacguugugggaggggaacccaggccgcuucuggaacacgacuaucgccgugagcauggcgaacauuuuccgaggcuccuaucucgccggggcuggacuacuguucagcauuaugaagaacacaaccaacacgcgccgugguaccggcaacaucggcgagacccuaggggaaaaguggaagucacggcugaacgcccugggcaaaucggaguuccagaucuacaagaaguccgggauccaggaggucgaccgcacucucgcgaaggagggcaucaagcgcggggagacugaccaccaugcugucagucgcggcuccgccaaacugcggugguuuguugagcgcaacauggugaccccagagggaaaggucguggaccugggcuguggccgcggagggugguccuacuacugcgguggacucaaaaacguccgcgaggucaaggggcugaccaagggcggccccgggcacgaagaaccgaucccuauguccaccuacggcuggaaucucguccggcuacaguccggcguggacgucuuuuucacuccgcccgagaagugugauacgcugcugugugacaucggcgaaucaaguccaaaucccacaaucgaggccggccgcacacuccgggugcugaaccuaguggagaacuggcugaauaacaauacccaguucugcaucaaagucuuaaauccauauaugcccagcguuaucgagaagauggagacucugcaacgcaaguacggcggcgccuugguacgaaauccccugucccgcaauagcacccacgaaauguacuggguguccaaugcuaccgggaacauagucagcuccgugaacaugaucagccggaugcugaucaaccgcuucaccaugaagcacaagaaggccacauacgagcccgacguugaucugggcuccgggacccguaacaucggcaucgagucagagauccccaauuuggauaucauaggcaagcgcaucgagaagaucaaacaggagcaugagaccucguggcacuacgaccaagaccacccguauaagacuugggccuaccacgguagcuacgaaacgaagcaaaccggguccgccucauccaugguaaacggggugguucgcuugcugaccaaaccaugggaugugguaccaauggucacucagauggcuaugacugacacaacccccuuuggccaacaacggguguucaaagaaaaaguugauaccaggacgcaggaacccaaagagggcaccaagaaacucaugaggaucacggcggaguggcuguggaaggagcugggcaagaaaaagacaccgcggaugugcacccgggaggaguucaccagaaaggugcggagcaacgccgcacucggcgccaucuucaccgacgagaacaaguggaaguccgcccgcgaggcaguagaagacgggcgguucugggaguugguugacaaggaacgcaaucugcaccucgaggguaagugcgagacgugcgucuacaauaugaugggaaagcgggaaaagaaacugggcgaguucggcaaggcaaagggcucucgcgccauuugguauauguggcugggcgcuagguuccucgaguuugaggcgcugggguuuuuaaacgaggaccauugguucucccgcggcaacucccucuccggugucgagggcgagggccugcaccggcugggguacaucuuacgcgacgucggcaagaaagaagggggagccauguacgccgacgacacugccgggugggacacccggaucacucuggaggaucugaagaacgaggaaaugguuaccaaccacaugaaaggagagcauaagaagcucgccgaggcgauuuuuaaguuaaccuaucagaacaagguuguccgcgugcaacggccuacgccccgcggcaccgucauggacaucaucucccgccgcgaccagagaggaagcggccagguugggaccuacggccucaacacguucaccaacauggaggcccagcucauccggcagauggaaggggagggaaucuucaaguccauacaacaccugacagccaccgaggagauagccgugcaaaacuggcuagcgcgcgucggcagggagcgccucucgcggauggcgaucuccggagacgacuguguagucaaaccuauugacgaccgcuucgccucugcccugacggcccugaacgacaugggcaaagugcggaaagacauccaacagugggagcccucccgaggguggaacgacuggacccaggucccguucugcagccaucauuuccacgaguugguuaugaaagauggccggguccuggucgugccguguaggaaccaagacgaacugauaggccgggcccgcaucucccaaggggccggauggucgcucaaggagaccgcgugcuuagggaaguccuacgcucagauguggacccugauguacuuccaccgucgcgaccucagguuagccgccaacgcgaucugcagcgccgugcccucccacuggguucccaccagucgcacgaccugguccauccacgcgaagcacgaauggaugacgaccgaggacaugcuagccguguggaaccggguguggauccaggagaacccuuggauggaggacaagacccccguagaaagcugggaggagguccccuaucucggcaagcgcgaagaccaauggugcgggucacugaucggucugaccagccgcgcgaccugggcuaagaauauucagaccgccaucaaccaggugcgcagccucauuggcaaugaggaauacacugauuacaugccaaguaugaagcgcuuccggcgcgaggaggaagaagcagggguccugugguga

SEQ ID NO: 25274 - RNA, 9876 nt, Artificial Sequence
  derived and/or modified CDS sequence (opt11) from DENV-2__EU482605__SS-prME
accgccggcgucaucaucaugcuaauccccaccgccauggcguuccaccucaccacccggaacggggagccccacaugaucgucggccggcaggagaaggguaaaucccuccucuucaagaccgaggauggagugaacaugugcacucucauggccaucgaccugggggagcugugcgaggacaccaucaccuacaagugcccccuccuacgccagaaugagcccgaagacaucgauuguuggugcaacagcacaucaaccugggugacauacgggaccugcaccaccacgggcgagcaccggcgcgagaagcgguccgucgccuuagucccacacgugggcaugggcuuggagacccggaccgagaccuggaugucaagcgagggggcauggaagcauguccagagaaucgagacguggauccugcgccacccuggcuucaccaucauggccgcgauccuggccuacacgaucggcacaacgcacuuccagcgggcccucauuuuuauucuucugaccgcaguggcgccuagcaugacuaugcgcugcaucggcaucagcaaccgggacuucguggaaggcgucagcgggggcagcuggguagacaucguucucgagcacggguccugugucacaacgauggccaaaaacaagcccacccucgacuucgagcuuauuaaaacugaagccaagcagccugccacacugcgcaaguacugcaucgaggccaagcugacgaacaccaccacagagucucggugcccgacacagggcgagccgagcuuaaacgaggagcaggacaagcgcuucaucugcaagcacucuaugguggaccggggcuggggaaacggcugcggcuuauuugggaagggcgguauagugaccugcgcgauguuuaccugcaagaagaacauggagggcaagguggugcaacccgagaaucuggaguacaccauugugaucacuccccacagcggggaggaacacgccguuggcaaugacaccggaaaacacggcaaagagaucaagaucaccccgcaauccagcaucaccgaagccgagcugacuggguacgguacggugaccauggagugcagcccccggaccggccucgacuucaacgagauggugcugcugcaaauggaggacaaagccuggcucguccaccggcagugguuccucgaccugcccuugcccugguugccgggggcagacacccagggcagcaacuggauccaaaaagagacgcuggugacguuuaagaacccccacgcgaagaagcaggacguggucgugcucgggucccaggaaggcgcaaugcauaccgcucuaacgggggccacggagauccagaugagcagcggcaauuuacucguuaccggccaucugaagugccgccugcggauggauaaacuccagcugaaagggaugucuuacagcaugugcaccggcaaguucaagaucgugaaggagauugccgaaacccagcacggcacaaucgugauccgcauucaguaugaaggagacggcuccccuugcaaaauaccauucgagaucaccgaccuggagaagcggcacguccucgggcgcuugauuacggugaacccaaucgugaucgaaaaggacucucccgucaacaucgaggcggagccucccuuuggcgacuccuacauaaucaucggcguggagccggggcagcugaagcucaauugguuuaagaagggaagcuccaucggccagauguucgagaccacgaugcgcggcgccaagcggauggccauacugggggacaccgccugggacuucggaagccugggcgggguauuuacaaguauuggcaaggcccuccaccaggucuucggggcgaucuacggcgccgccuucagcggggugucuuggaccaugaagauccugaucggagugguuaucacguggauaggaaugaacucgagguccaccagccuuucagugagccuggugcucguuggcguaguuacccuuuaccuaggagcuaugguucaggcugacuccggcugcguggugagcuggaagaacaaggaguuaaaaugcggcucggggaucuucaucaccgauaacguccacacguggaccgaacaguacaaguuccagcccgagagucccagcaagcuggcuuccgccauccagaaggcccacgaggagggcaucugcgggauucggagcguuacccgccuggagaaccuuauguggaagcagaucacacccgagcugaaccacauccugagcgagaaugagguuaagcucacgaucaugaccggcgauacaaaggggaucaugcaggcgggcaagcggagucugcgcccgcagcccaccgaacugaaguacuccuggaagacguggggcaaggcgaagaugcucagcaccgagagccacaaccaaacauuccuaauugaugggcccgagaccgcggagugcccgaacacgaaccgggcauggaacagcuuagaggucgaggacuacggcuucgggguguuuaccaccaacaucuggcucaaacugcgcgagaagcaagaugucuucugcgacuccaaacuuaugagcgcagccauaaaggacaaccgggcgguccacgcugacaugggauauuggaucgaguccgcccucaaugacaccuggaagauggagaaggcgagcuucaucgaggugaaauccugucauuggcccaagagccauacccugugguccaacggcgugcuggagagcgagaugaucauccccaagaacuucgcagggcccgucucccagcacaacuaccgcccgggcuaccauacgcagaccgcaggccccuggcaccuaggcaagcuggagauggacuucgacuucugcgaagggaccaccgugguggucacggaggauugcggaaaccggggaccuagccugcgcaccaccaccgccagcgggaagcuaaucacggaguggugcugcagauccugcacccugcccccgcugcgauaccguggcgaggacggaugcugguacgguauggaaauccgaccguugaaggagaaggaagagaaucuggugaacagccucgugaccgccgggcacggccaaaucgacaacuucucccuaggcgugcuggggauggcucuguuuuuagaggagaugcuccggacccgcgugggcacgaagcacgcgauccugcucguggcugucagcuucgugacucugauuaccgggaacaugucauuccgggaccugggacgcgugauggucauggugggugcgaccaugacggacgauaucggcaugggcgugaccuacuuggcccuucuggccgcauucaaaguacgccccaccuucgccgcugggcugcugcuccggaaguuaacuagcaaggagcugaugauggccacuauaggaauaacccugcucucccagagcaccauacccgagaccauccucgagcugacggacgcccucgcgcucgguaugaugguccugaagauuguccgcaacauggaaaaguaucagcucgccguuaccauuauggccauauccugcgugccgaacgcgguaauccugcgaaaugccuggaaagucagcugcacgauccucgcggccgugucgguaucaccgcuccugcugaccuccagccagcagaaggccgacuggaucccccuggcccugacgauuaagggccuaaaccccaccgcaaucuuucucaccacccugucccgcacgucuaagaagagguccuggccgcugaacgaggccaucauggccgugggcaugguaagcauccuagcguccagccugcugaagaacgauauaccgaugaccggcccccucgucgcgggaggucugcugaccgugugcuacgugcucacaggccgcagcgcagauuuggagcuagagcgcgcagccgaugugaagugggaggaccaagcugagauauccgggagcucccccauuuuaagcauaacgaucuccgaggacggcagcauguccaucaagaacgaggaggaggaacagacuuugaccauccugauacgcaccgggcuccuggugaucucagggguguucccggucuccauccccaucaccgccgcagccugguaccugugggaggugaagaaacagcgggccggcguguugugggacguccccagcccaccgcccguugggaaggccgagcuggaagacggcgcguaccgcaucaagcagagagggauacuaggcuacucccagaucggcgcggggguguacaaggaaggcacauuucacaccauguggcacguuacccguggggcggugcuaaugcacaggggcaagagaauagagcccucuugggccgacgugaagaaagaucugaucuccuacggggguggauggaaauuggagggagaguggaaggagggcgaggagguccagguucucgcacuggagcccgguaagaacccacgugccgugcagaccaagcccggcaucuucaagacgaacaccggaaccauaggcgcggucagccuggacuucuccccgggcacuucagggucccccaucguggaccgcaaaggcaaggugguugggcucuacggaaacggugucgucacucggucuggggccuacgucuccgcaauugcccagacugagaaguccauugaagccaaucccgagaucgaggaugcgauauuccguaagaagcggcugaccaucauggaccugcacccaggcgcggguaagcccaaacgcagccugccggcgaucguucgggaggccaucaagcgcggucugcgcccccucauccuagcaccgccccgggugguuccggcagagauggaggagcccuugcgcgggcuacccauuagguaucagacgccugccaucaagccggaccacaccggccgcgagaucgucgcccugaugugccacgcccccuucaccaugcgccuccucucccccguccguguccccaacuacaaccugaucauuauggacgaggcgcacuuuaccgacccggccagcaucgcugcucggggcuacaucucaacccgcguggagaugggggaggccgcuggcauauucaugacagccacgccgcccgggucgcgugaucccuuuccgcaguccaaugcccccauuauggacgaggagcgcgagauacccgagcggagcuggaacuccggucacgaguggguaaccgacuucaaagggaagaccgucugguucguccccagcaucaaggccggcaacgauaucgcggcgugccugcgcaagaacgggaagaaagugauccagcuaucccggaaaacauucgacucggaguacgucaagacgcgcgccaacgacugggacuucguggugaccaccgacauuagugagaugggggcuaauuucaaggccgagcggguaauagacccucgccggugcaugaaaccugugauuuuaacggacggcgaggaacguguuauccucgcgggaccaaugccaguuacccacucauccgccgcccagcggcguggcaggaucgggagaaaccccaaaaacgagaacgaccaguacaucuacaugggcgaaccccuggagaacgaugaggacugcgcccacuggaaggaggccaagauguuacuugacaauauaaacacccccgagggcaucauaccgagcauguucgagcccgagcgcgagaaaguggacgcgaucgauggggaguaccggcugcgcggcgaggcucggaaaaccuuuguggaccugaugcgucgcggggaccuccccgucuggcuggccuacaagguggcggccgaggguaucaauuaugcagaccgcaagugguguuucgaugggaucaagaacaaucaaauccuggaagagaacgucgagguggagaucuggacgaaggagggggagcggaagaaauugaagccccgcuggcuggacgccagaaucuacuccgacccuuuagcccucaaagaguuuaaggaguucgccgcgggcagaaagagccugaccuuaaaccucaucaccgagaugggccgcuugccgacauucaugacacagaaggcccgcaaugcccuggacaaucuggcgguccuucauacagccgaggcaggcgggcgggccuacaaccacgcccuguccgaacucccggagacucuggagacucugcuccugcugaccuuguuagcuaccguaacaggcggcaucuuccuguuccucaugagcggaaaggggaucgggaagaugacccuuggcauguguugcaucaucacggccuccguacugcucugguacgcucagauccagccccacuggaucgccgccagcauaaucuuggaguucuuccugaucgugcuacugauaccggaaccggagaagcagcgcacgccccaggacaaccagcugaccuaugucgugaucgccauccucacgguagucgccgcgaccauggcuaaugagaugggguucuuggagaaaacgaagaaggaucugggccucggcagcaucaccacccaggaauccgagagcaacauacuggacaucgaccuucguccugcuuccgcguggacgcuauaugccguggcgacgaccuuugugacgccgaugcugcgacacagcaucgagaacucgagcgucaaugugucccugaccgccauugccaaccaggccacgguccucauggggcugggaaaggguuggcccuuaagcaagauggacaucggcgucccccuucuggcgauagggugcuacucccaggugaacccaaucacauuaacagccgcauuacugcugcucguggcucacuacgccauaauaggcccgggccugcaggcgaaggccacacgggaggcccagaagcgcgccgcagccgggaucaugaagaacccuacggucgacggcaucacugugaucgaccuggagcccauccccuacgacccgaaguucgagaagcagcucggacaggugaugcugcugauccucugcgucacccagguacugaugaugcgcaccacgugggcccuuugcgaggcccuuacccuggccaccggccccaucagcacccugugggaggggaaccccggccgauucuggaacacaaccaucgcaguauccauggcgaacaucuuccgcggcucauacuuagcaggagccggccugcuguuuuccaucaugaagaacaccacaaacacgcggcgcgggacuggcaacaucggcgaaacucuaggcgagaaguggaaaucccggcugaacgcccuaggcaagagcgaguuccaaauauacaagaaguccgggauccaggagguagaucgcacccuugcgaaggagggcauaaagcgcggggaaaccgaucaccaugccgugucccgcggcagcgcaaaguuacggugguucguggaacgcaacauggucacccccgagggaaagguuguugaccugggguguggccgggguggguggagcuacuacugcggcgggcucaagaauguccgcgaggugaaggggcugaccaagggcgggccggggcacgaggaacccauccccaugucgaccuauggcuggaacuuggugcggcugcagagcggugucgauguguuuuucacgccgcccgagaagugcgauacccuacugugcgacaucggcgagucuagcccaaaccccaccauagaggccggccgcaccuuacgggugcugaaccuggucgagaacuggcucaacaacaacacgcaguuuuguauaaaggugcugaacccauacaugccauccgugauugaaaagauggagaccuuacagcggaaguacgggggcgcgcucguccggaauccacugucccgaaacuccacgcacgaaauguacuggguuuccaacgcgaccggcaacaucguuaguagcgucaacaugaucucccggaugcugauaaacagauucaccaugaagcacaaaaaggccacguaugagcccgacgucgaccugggcagugggacccggaauaucggcaucgaguccgagauuccgaaccucgacaucaucggcaagcgcauugagaagaucaagcaggagcaugagacuucuuggcacuaugaccaggaucacccguacaagaccugggcguaccacgggucguacgagacgaagcagaccggaagcgccuccagcaugguaaacggggucgugcgccugcugaccaagcccugggacguggucccaauggugacccaaauggcuaugacggacacuacaccguuuggccaacagcgugucuucaaagagaaagucgacacccguacgcaggagcccaaagagggcacgaaacggcucaugcgcaucaccgcggaguggcuguggaaggaguuagggaagaagaagacgccgcggaugugcacgcgugaggaguucacccguaaaguccgcuccaacgcagcccucggcgcuaucuuuaccgacgaaaacaaguggaaguccgcccgggaggcaguugaggacgggcguuuuugggagcuggucgacaaggagcggaacuugcaccucgagggcaagugcgagaccugcguguacaacaugauggggaagagggagaagaaacugggcgaguucggcaaggccaaggggucccgggccauaugguacauguggcuaggcgcccgcuuccuagaguucgaggcgcucggguuccugaacgaggaccacugguucagccguggcaacagccucucaggggucgagggugaaggccugcaccgccugggguacauauugcgggaugugggcaagaaggaagggggugccauguacgccgaugacacggccggaugggacaccaggaucacgcuggaagaccugaagaacgaggagaugguuacuaaccacaugaagggugagcacaagaagcucgcggaggccaucuucaagcugacuuaccagaacaaggucgugcggguccagcgccccaccccgaggggcaccgucauggacauaaucagccgucgggaucaacggggauccggccagguggggaccuacgggcugaacacuuucacuaacauggaggcgcagcucauccgccagauggaaggcgaggguauauucaagagcauccaacauuuaaccgccacugaggaaauagccgugcagaauuggcuggcccgggucggcagggagcgguuguccagaauggcgaucagcggggacgacugcguggugaagcccaucgaugaccgguucgccucugcuuugacggcucugaacgacaugggcaaggugcggaaggacauucagcagugggagcccagccggggguggaacgacuggacccaggugccauucugcagucaucacuuccacgagcucgugaugaaagacgggcgcgucuuaguugugcccugucgaaaccaggacgagcugaucgggcgcgcccggauuucgcagggagcgggcuggucccucaaggagacugccugccugggcaagagcuacgcgcagauguggacccugauguacuuccaucggcgugacuuacgccuggccgcaaacgcgaucugcucugcagucccgagccacuggguacccacgucccggaccaccuggagcauucacgccaaacaugaguggaugaccaccgaggacaugcuggccgucuggaaccgcguauggauccaagagaaccccuggauggaggacaagacgccggucgagaguugggaggaggugcccuaccucggcaaacgggaggaucaauggugcgggagccugauaggcuugaccucaagagccaccugggcuaagaacauccagaccgccaucaaccagguccgcucccucauaggcaaugaggaguacacggacuacaugccgagcaugaagcgguuccgacgggaggaggaggaagcagggguacugugguga

SEQ ID NO: 25275 - RNA, 9876 nt, Artificial Sequence
  derived and/or modified CDS sequence (opt11) from DENV-2__EU482606__SS-prME
accgccggcgugaucaucaugcugauccccaccgccauggcuuuucaucugacgacccgcaacggggagccccacaugauagucggccggcaggagaaagggaagucccugcucuucaagaccgaggauggcgugaacaugugcacccuaauggccauugaccugggugagcugugcgaggacacuaucacuuauaagugcccucuccugcggcagaaugaaccggaagacauagacuguuggugcaacagcaccagcacgugggugaccuacggaacguguaccaccacgggcgagcaucggcgcgagaagcgguccgucgcccucgugccccacguagggaugggucucgagacucgcacagagaccuggauguccuccgagggagccuggaagcacguccagcggaucgaaacguggauccuacgccacccgggcuucaccauuauggccgccauucuagccuacaccauuggaacaacccacuuucagcgggcccucaucuucauccugcugaccgccguggcgcccucaaugaccaugcgcugcaucggcaucuccaaccgggauuucguggagggugucagcggugggucaugggucgacaucgugcucgagcacggaagcugcguuaccacgauggccaagaacaagccgacauuagacuucgagcuaaucaagaccgaagccaagcaaccggccaccuugaggaaguacugcaucgaggccaagcugacgaacaccaccacggagucucgcuguccaacgcagggcgagccuucucuaaacgaggagcaggacaagcgcuucaucugcaagcacucgaugguggaucgugggugggggaauggcugcggacucuucggcaaaggaggaauagugaccugcgcgauguucacguguaaaaagaacauggagggcaagguugugcaaccugagaaucuggaguacacaauugugaucacgccacacagcggggaggagcacgcagucggcaacgacacuggcaagcacggcaaagaaauuaagaucaccccgcaguccagcaucaccgaggccgaguuaaccggguacggcacggucaccauggagugcagcccccggaccgggcucgacuucaacgagauggugcuguuacagauggaggacaaagcauggcucguccaccggcaaugguucuuggaccugccccucccguggcugccaggcgcugacacgcaaggcagcaacuggauccagaaggagacguuggugacauuuaagaacccccaugcuaagaagcaggacguggucguucuggggucccaggagggcgcaaugcacaccgcccuuacuggggccacagaaauccagaugagcagcggcaaccuccuguucaccggucaccugaaaugccgccugcggauggacaagcuccaacuuaaggggauguccuacagcaugugcaccgguaaguuuaagaucgucaaggagauagcggaaacucaacacggaaccaucguuauucgaauccaguacgagggcgaugguagccccugcaagaucccauucgagaucacagaccuggagaaacggcacgugcucgggcgcuugaucacugucaacccgaucgugauagagaaggacagccccgugaacaucgaagcugagccacccuuuggagauaguuacaucaucaucggcguggagccgggucaacugaagcuaaauugguucaaaaaggggucuuccaucggccagauguucgagaccaccaugcgcggcgcgaagcggauggcuauacuuggcgacacagccugggacuucggcagccucggugguguguuuaccucaauaggcaaggcccuccaccaaguguucggggcgaucuauggugccgccuuuucgggagucuccuggaccaugaagauacucaucggcgucgugaucacguggaucgggaugaacucgcgcucgaccucgcuaagugucucgcugguguuggugggcguaguuaccuuguaccugggggccauggugcaggcagauuccggcugcgucgucucauggaagaacaaagagcucaaguguggcuccgggauuuucaucacagacaauguacacacguggaccgagcaauacaaguuccagcccgagucucccagcaagcuggccuccgccauccagaaggcgcacgaggaagguaucugugggaucaggucaguaacccgccuggagaaccugauguggaagcagauuacccccgagcuaaaccacauucugucugagaaugagguuaagcucacgaucaugaccggggacaccaaagggaucaugcaggcaggcaagcgaagccugagaccgcagccaaccgagcuuaaguauucguggaagacgugggggaaggcgaaaaugcucagcaccgagucccauaaccagaccuuccugaucgacgggccggagacugccgagugcccgaacacgaacagggccuggaacagccuggagguagaggacuacggcuucgggguuuucacaaccaacaucuggcucaagcuucgcgaaaaacaagacguguucugcgacuccaagcugaugagcgcagcaaucaaggauaaccgggcugugcacgccgacaugggcuacuggaucgaauccgcucuuaacgacaccuggaagauggagaaggccucauucaucgaagucaaguccugucacuggcccaagagccauacgcugugguccaauggcgugcuggaaagcgagaugaucauccccaaaaauuucgcugggccagugucccagcacaacuaccguccgggcuaccacacucagaccgcggggccguggcaccugggcaagcuugaaauggacuucgacuucugcgaggggaccacagucguagugacggaggauugcggaaacagaggcccaagccugcgaaccaccacagccagcgggaagcucaucaccgaguggugcugcagaaguugcacccugcccccgcugcgcuaucgaggagaagacgggugcugguacggcauggagauccgcccgcucaaggagaaggaggagaacuugguaaacucacuagugacagccggacacggccagauugauaacuucucacucggcguucugggaauggcgcuauuccucgaggagaugcugcggacccgcgucggcacuaaacacgcgauccuucucguggcugugagcuucgugacccugaucacaggaaacauguccuuccgggaucugggcagaguaauggugauggucggcgcgaccaugacggacgacaucggcaugggagugaccuaccucgcccuucuggcggcguucaaggugcgucccacauucgcagccggguuacuccugcgaaagcuaaccagcaaggagcugaugauggccacgauuggaaucacgcugcuaucccagucuaccauccccgagaccauccuggaguugacggaugcccuugcacuggggaugaugguccugaagaucgugcgcaacauggagaaguaccagcucgccgucaccaucauggccaucuccugcgucccgaacgccgucauacugcggaacgccuggaagguuagcugcacuauccucgccgcugucucagucagccccuugcugcugacaucaagucagcagaaagccgacuggauaccgcucgcacugacgaucaagggccugaaccccaccgcuauuuuccucacgaccuugucccgcacgaguaagaaacgguccuggccguugaacgaggcuauuauggccgugggcaugguuagcauccucgccuccucacugcugaaaaacgacaucccgaugaccgggccccuaguggccggugggcugcuaaccgucuguuacguacuaacggggcgcagugcggaccuggagcucgagcgugccgcagacgugaagugggaagaccaggccgagaucucugggucgucgcccauccucaguauuacuaucuccgaggacggaagcauguccaucaagaaugaggaggaggagcagacccugaccauccugauccgcaccggccugcuggucauaagcgggguguuccccgucuccauccccaucacugccgccgcgugguaccugugggaggucaagaagcagcgugccggcgugcuaugggacguacccuccccgccgcccgucgggaaggccgagcuggaggauggagcuuaccgcaucaagcagcgcgggauuuugggcuacucccagauuggugcggggguuuauaaggagggcacuuuccauaccauguggcacgugaccaggggugcaguccugaugcaccggggcaagcgcaucgaaccaagcugggccgacgugaaaaaggaucuaaucagcuacgggggcgguuggaaacuggagggagaauggaaggagggagaggaggugcaaguacucgcacuggaaccuggaaagaauccccgggcugugcaaacaaagccaggcaucuucaagacgaacaccgggacgaucggcgcggugagccuggacuucucccccggcaccucuggaucgcccaucguggaucgcaaggguaaagugguggggcucuacgguaacggugucguaacccggagcggggccuacgucucugccaucgcucagaccgagaaguccaucgaggacaauccagaaaucgaggacgacaucuuccgcaagaagcggcugacuauaauggacuuacaccccggcgcggggaagaccaaaagguaccuccccgccauuguccgggaggccaucaagcgcggccugcgcacguugauauuggccccgacccgaguggucgccgcggagauggaggaggcccuccguggucugccaauuagguaccagaccccggcuaucaaggccgagcacaccgggagagagaucgucgaccuuaugugucaucccacguucacaaugcggcuccugagcccggugcgcgugccgaacuacaaccugaucauaauggacgaggcacacuuuacggaccccgcguccaucgcagcucgaggcuauauaucuacccgcguagagaugggggaggccgcuggcaucuucaugacggcuacgccgcccgggucccgggaccccuucccccagucuaacgccccgaucauggacgaggagcgcgaaaucccggaacgguccuggaacagcggccacgagugggugaccgacuucaaggguaagacaguaugguucguccccuccaucaaggccgggaacgacaucgcugcaugucuccguaagaauggcaagaaagugauccaacugucgcggaagacguuugauagugaguacgugaaaacacgcgcaaacgauugggacuucgucgugaccaccgacaucagcgagaugggugccaacuuuaaagccgagcgggugauugacccccgccguugcaugaagccggucauccuaacggacggcgaagagagagugauacuagccgggccgaugcccgugacccauaguagcgcggcccagcggcgcggacgcauugggcgcaaccccaagaacgagaacgaccaguacauuuacaugggcgaaccucucgagaacgacgaagacugcgcccauuggaaagaggccaagaugcugcucgacaacaucaacacaccggagggcaucaucccauccauguucgaaccggagagggagaaggucgaugcgaucgacggugaguacagacugcguggcgaagcgcgaaagaccuucguggauuugaugcgccgcggugaucucccaguguggcuggccuacaaggucgccgccgagggcaucaacuacgcggaccgcaaguggugcuuugacggaaucaagaacaaccagauacuggaggagaacguggaagucgagaucuggacgaaggagggcgagcggaagaagcucaagccccgcuggcuggaugcgcguauuuacagcgauccccuggcucuaaaggaguuuaaggaguucgccgccggacgcaagucccugacccugaaucuuaucaccgagauggggcggcugccgaccuuuaugacgcagaaagccagaaacgcccuugacaaccuagcaguucuacacaccgccgaagcgggcggucgggccuacaaccacgcccugagugagcucccggagacccuggagacucugcuccugcugacgcuccuggcgaccgugacugggggaaucuuccuguuccucauguccgguaagggcaucggaaagaugacccugggcauguguugcaucauaaccgcuuccguacugcuaugguacgcccagauccagccccacuggaucgcggcguccaucauucuggaauucuuccugaucgugcuucuaauaccugagccagagaagcaacggacgccgcaggauaaccagcucaccuacguggucaucgccauccuuacugugguugccgccaccauggcgaacgagauggguuuccuggagaaaacgaagaaggaucugggacucggcagcaucaccacccaggagagcgaauccaacauccuggacauugaccugcggccugccagcgccuggaccuuauacgccgucgcuacgaccuuugugacgcccaugcugcgccauuccauugaaaacagcagugugaacgucagccugacagcgauagccaaucaggccacggugcucauggggcugggcaagggguggccccugucuaagauggacauaggcgugccgcuccuggccaucgggugcuacagucaggucaaccccaucacucugaccgcugcgcugcugcugcucgucgcacacuaugccauuaucggccccggccuucaagccaaggcgacccgggaggcccagaaaagggcggccgcggggaucaugaagaaccccaccguggacggcaucaccgugaucgaucuggagccgaucccguacgauccuaaguucgagaagcaguuaggacaagugaugcugcugaucuugugcgugacacagguccugaugaugcggaccaccugggcccugugcgaagcauuaaccuuagcuaccggccccaucuccacccugugggaaggaaacccgggccgauucuggaacacgaccaucgccgugagcauggcaaacauuuuccgcggcuccuaccucgcgggggccggauugcuauucagcaucaugaagaacaccaccaacacgcggcgcgggaccggcaacaucggcgagacccucggcgagaaguggaaaucccggcucaaugcccucggcaagucagaguuccagaucuacaagaagaguggcauccaggagguugaccgcacccucgccaaggaagggaucaagcgcggagagacggaccaccacgcggucagccggggcuccgcuaaacuacggugguuuguagaacguaacaugguaacccccgaagggaagguaguugaccugggauguggccgcgggggguggagcuacuacugcggcgggcuuaagaauguacgggaagucaaggggcucaccaaggguggcccggggcacgaggaaccgauuccgauguccacauacggcuggaaccuggugcgccuccagucagguguggacguuuucuucacgccgccagagaagugcgacacccugcugugcgacaucggcgaaagcuccccgaacccgaccaucgaggccggacgcacucuccggguucugaaccugguggagaauuggcucaauaauaacacgcaauucuguaucaagguccuuaacccuuacaugcccagcgucaucgaaaagauggaaacacuacagaggaaguacgguggcgcccuaguucguaauccgcuuagucgcaacuccacccacgagauguacuggguaagcaacgccacugggaauaucgugucguccgugaacaugaucagucgaaugcugaucaaccgcuucacaaugaaacacaagaaggcgacguaugagcccgauguggaccugggcucggggacccggaauaucgguauagagucggagauccccaaccucgacaucaucggcaagcgcauugagaagaucaagcaggaacacgaaaccucguggcauuacgaccaggaccauccuuacaaaacgugggcuuaccaugggagcuacgagaccaagcagaccggcucggccagcuccauggugaauggcguugucagacugcugaccaagccgugggacguuguucccauggugacccagauggccaugacagacacuacccccuucggacagcagcggguuuucaaagagaagguggacacccgcacgcaagagcccaaggagggcacaaaaaaacucaugcggaucacugccgagugguuguggaaggaacuggggaagaagaaaacgccgcggauguguacgagagaggaguucacccggaagguccgcucgaacgcggcauugggcgccaucuuuaccgaugagaacaaguggaagucugcccgugaggcuguggaagacggccgguucugggaacugguagauaaagagcgaaacuuacauuuggagggcaagugcgaaaccugcgucuacaauaugaugggaaagcgugagaagaagcugggcgaauucggcaaggcgaaggggagcagagcgaucugguacauguggcuuggcgcacgguuccucgaguucgaggcccugggcuuccugaacgaagaccacugguucucccgcggcaacucauuaagcgggguggaaggcgagggccugcaccggcugggguauauacuccgcgaugucggcaagaaggagggcggcgcgauguaugccgacgacacggcggggugggacacgagaauuacccuggaggaccugaaaaacgaagagauggugaccaaucacaugaagggggagcauaaaaaguuagcugaggccaucuucaagcuuacguaucagaacaaggugguucgaguacaacggcccacgccccgggguaccguuauggacauuaucucccggcgcgaccagcgugguagcggccagguuggcaccuacggccugaacacguucaccaacauggaggcccaauugauccggcagauggagggggaggggauuuucaaauccauucagcaccugaccgccacggaggagauagccguucaaaacuggcuggcacgcgugggacgcgaacgucucagccggauggcaaucucgggggacgacugcgucgugaagcccaucgacgaccgcuuugcaucugcccugacggcccugaaugacaugggcaaggugcguaaggacauucagcagugggaaccgucgcgaggguggaaugacuggacccaggucccauucugcucgcaccauuuccaugaacuagugaugaaagacggcaggguccuggucgugccuugucgcaaccaagacgaacucauaggccgggcucgcaucucucagggggccggcuggucgcugaaagagacggcgugccugggcaaauccuacgcucagauguggacccucauguacuuccaucggcgugaucuccggcuggccgccaacgccaucugcagcgcggugcccucucauugggucccuaccagccgcacgaccuggagcauccacgccaagcacgaguggaugacuaccgaagacaugcucgccguuuggaaucggguguggauacaggagaaccccuggauggaggacaaaacgcccguugagaguugggaagaagugcccuacuugggcaagcgcgaggaucaguggugcgggucacugaucggccugaccagcagggccaccugggcgaagaacauccagaccgcuaucaaucagguaagaagccucauuggaaacgaagaguacacggacuacaugccguccaugaagcgcuuccggcgcgaggaggaggaggccgggguccugugguga

SEQ ID NO: 25276 - RNA, 9876 nt, Artificial Sequence
  derived and/or modified CDS sequence (opt11) from DENV-2__EU482607__SS-prME
accgcaggcgugaucgucaugcugauaccuaccgccauggcauuccaccucaccacgcggaacggggaaccccacaugaucguggggcggcaggagaaggggaagucucugcuguucaagaccgaggauggcguuaacaugugcacgcucauggcgaucgaccugggugagcugugcgaagacacgauaaccuauaagugcccucuccugcgccagaacgagcccgaggacauagacugcuggugcaacagcaccagcaccugggucaccuacgggacaugcaccaccacgggcgagcaucggcgcgagaagcgguccguggcacuggucccccacgucggcauggggcuggaaacacgcaccgagaccuggaugagcuccgaaggggcguggaagcacgugcaacggaucgagaccuggauacugcgccacccgggcuucaccaucauggcagcuauccuggccuacaccaucgggacgacacacuuucagcgggcccucauauucauccugcugacugccguggcgcccagcaugaccaugcguugcaucggcgucuccaaccgggacuucguggagggcgugagcgggggcuccuggguggauaucguguuggagcacgggagcugugugaccacgauggccaagaacaagcccacccuggauuucgagcugaucaagaccgaggccaagcagcccgccacccucagaaaguacugcaucgaggccaaacugacgaacacuaccacagagucccggugcccgacgcagggcgaacccagccugaaugaggagcaggacaagcgcuucaucuguaagcacuccauggucgaccggggcuggggcaacgggugcggucuguucggcaaaggagggaucgugaccugcgcgauguucacgugcaagaagaacauggaaggcaagguuguccagccagagaaucuggaauacaccaucgugaucacgccccauagcggagaggaacaugccgugggcaacgacaccgggaagcacggcaaggagaucaagaucacaccgcaguccuccauuaucgaggcggaacugaccggguacggcaccguuacgauggaaugcucuccuaggacgggccuggacuucaaugagaugguccuucugcagauggaagacaaagcguggcucguacaccggcagugguuuuuagaccugccccucccuuggcugccgggugccgacacccagggcagcaacuggauccagaaggagacccugguaacguucaagaauccccaugcuaagaaacaagacgucgucgugcucgggucccaggagggagccaugcauaccgcccugaccggggccaccgagauccaaaugagcagcggcaaccuccucuucacagggcaccuuaagugccgccuuaggauggacaagcuccagcugaaggggauguccuacagcaugugcaccggcaaguuuaagaucgugaaggagaucgccgagacucagcacgguaccauugucauccgcguacaguacgagggggauggcagccccugcaagauacccuucgaaauaacggaucuugagaagcggcacgugcuagggcgucugaucacugucaacccgaucguaaccggcaaagacagcccugugaacaucgaggcggaaccgccguucggggacuccuacaucaucaucggaguugagccugggcagcugaaacuuaacugguucaagaaggggucguccaucggccagauguucgagaccacgaugcgcggggccaagcggauggccauccugggcgacaccgccugggauuucgggagccuaggaggggucuucaccuccaucggcaaggcccuccaccagguuuucggcgcgaucuacggagccgccuucucgggcgucuccuggaccaugaagauccugaucggggugauaaucacguggaucggcaugaacagcaggaguaccagccugagugugagccugguccuuguagggguggucacccuguaccugggcgccauggugcaggcggacuccggaugcguggucagcuggaagaacaaggagcucaagugcggguccggcaucuuuaucaccgacaacgugcacacguggacugagcaguacaaguuccagcccgaaagccccagcaaacucgccuccgccauccagaaggcccaugaggaagggaucugcggcauccggagugugacacgccuggagaaccucauguggaagcaaauuacccccgagcugaaccacauccuguccgaaaacgaggucaagcucacgaucaugaccggggacaucaaggguaucaugcaggccggcaaacggagccugcguccccagcccaccgagcugaaguauuccuggaagaccugggggaaggcgaagaugcucagcacggaaucccauaaucagaccuuccuaaucgauggcccggagaccgccgagugcccaaacaccaaccgggccuggaacagccucgagguagaggacuacggguucggaguguucacaaccaauaucugguuaaaacuucgcgagaagcaggaugucuucugcgacuccaagcugaugagcgcggccaucaaggacaaucgcgcggugcacgccgacaugggcuauuggauugaguccgcccugaaugacacguggaaaauggagaaggccagcuucaucgaggugaaguccugccacuggccaaagagccacacccuuugguccaacgggguucuggagagcgaaaugaucauacccaagaacuuugccggcccugugucucaacauaacuaccgcccgggguaccacacccagacggcgggccccuggcaccucgggaagcuggagauggacuucgacuucugugagggcacgaccgugguugugaccgaggacugcggcaaccggggacccagccuccgcaccacaacagccagcggcaagcucaucaccgaguggugcugccgguccugcacgcugcccccgcugcgcuaccgcggcgaagacggcugcugguacgggauggagauccgcccccucaaagagaaggaggagaauuuggucaacagccugguaaccgccggacacggccagaucgacaacuuuucucucggggugcuggguauggcccuguuccucgaggagaugcugaggacccgaguggggaccaagcacgcgauacuauuaguagccgugagcuucguuacguugaucaccgggaacauguccuuccgggaccuuggacgcguaauggugauggugggcgccaccaugacggacgacaucggcauggggguuacguacuuggcccugcuggccgcuuucaaggugcgccccaccuucgccgcuggccuccuccugcggaagcugaccagcaaggagcugaugauggccacaaucgggaucgcccugcucucccagagcacgauccccgagaccauccuggagcugaccgaugcgcuggcccugggcaugauggugcugaagaucguccgcaauauggagaaguaccagcuagccguaaccgugauggcgaucuccuguguuccgaaugccgugauacugcagaacgcguggaaagucucaugcacgauacuggccgccgugucggugagcccccucuugcuaaccuccagccagcagaaagcugacuggaucccccucgcgcugaccaucaagggccugaacccuaccgccaucuuccucacgacccugucccggaccagcaagaagcgcuccuggccgcugaacgaagcgaucauggccgucggcauggucucgauccucgccuccagccugcucaagaacgacauccccaugaccgguccccucguagccggcggucugcuaacgguaugcuacgugcucaccgggcggucagccgaccuggagcuggagcgcgccgccgacgugaagugggaggaccaggccgagaucuccgggagcuccccgauacucagcaucacgaucuccgaagacggaagcaugucaaucaagaacgaggaggaggagcaaacacugacgauccugauccggacuggacuccuagucaucuccggcguguucccggugaguauccccaucaccgcggccgccugguaccugugggaagucaagaagcagcgugcugggguguugugggacgugcccagcccgccgcccgucggcaaggcugaacuggaggacggggcguaucggauaaagcaacgcggcauccugggcuacucccagaucggugccgggguguacaaggagggcacauuccacaccauguggcacgugacacgcggcgccguccucaugcaccgcgggaagcguauugagcccagcugggccgacgugaagaaggaccugaucuccuauggcggcggguggaagcuggagggcgaauggaaggaaggggaggaggugcagguauuggcccuggagcccgggaagaauccccgcgccguacagaccaagcccgggaucuucaagacugauaccggcacgauaggcgcagugagccuggauuucuccccugggacuagcggcucccccauugucgaucggaagggaaagguugugggccucuaugggaacggggucgugaccagaucuggugccuacgugucagccaucgcgcagacggaaaagagcaucgaagacaaccccgagaucgaagacgacaucuuccggaagaagcgcuugacgauuauggaccugcaccccggggccggcaagaccaagcgguaccuccccgccaucguccgugaggccaucaagcgggggcugcggacccugauccuagccccaacccgcgugguggcggcagagauggaggaggcccuccgggggcugccuauccgcuaccagacgcccgccauuaaggcagagcacaccggccgggagaucgucgaccugaugugccacgcgacauucacuaugcgccuccugagccccguacggguuccgaacuacaaucugauaaucauggacgaggcccacuucacggaucccgccuccaucgcugcccgcgguuauaucagcacccgggucgagaugggcgaggcggccgggauauucaugaccgcuacgccgcccggcucucgcgaccccuucccccagagcaacgcccccaucauggaugaggagcgagagauccccgagcgcucguggaacucggggcacgaauggguuaccgacuucaagggcaagaccgugugguucgugccguccaucaaggcuggcaaugauaucgcagccugccuccggaaaaaugggaagaaagugauccagcugucucgcaagaccuucgacagcgaguacgugaagacucgggcuaacgauugggacuucgucgugacgacggacaucuccgagaugggggcgaauuucaaagcagagcgcguuaucgaccccaggcgcuguaugaaaccaguuauccugaccgauggggaggagcgggugauccucgcuggccccaugccggucacccacuccagcgccgcucagcgacgggggcguaucggccgaaacccaaagaacgagaacgaccaguacauauacaugggggagccccuggagaacgacgaggacugcgcccacuggaaagaagcgaagaugcugcuggacaauaucaauacccccgaggggauuauuccuuccauguuugaacccgagcgggagaaggucgacgccaucgacggugaguaccgccugcgcggggaggcacgcaagaccuucguagaucugaugcggcgcggcgaccuccccgucuggcuugccuauaaagucgcugcggaagggauuaacuacgccgaccgaaaauggugcuucgacggcaucaagaacaaccagauacuggaggagaacguggaggucgagaucuggaccaaggagggcgaacgcaagaaacucaagccgcgauggcuggacgcacgcaucuacucagaccccuuagcacuaaaggaguucaaggaguucgccgccgggcggaagucccuggcccugaaccucaucacagagauggggcgccugcccacguucaugacucagaaggcccguaacgcccuggacaaccucgcgguacugcacaccgccgaggcagggggccgcgcguacaaccacgcccugagcgagcuccccgagacccuggaaacguuacucuugcugacccugcuggcgaccguaaccggagggaucuuccuguuccucauguccggcaaggggaucggaaagaugacccuggggaugugcugcaucaucacugccagcguccuguuaugguacgcucagauccagccgcacuggauugccgccucuaucauccuggaguucuuccucaucgugcuccugauccccgagcccgagaagcagcggacgccccaagauaaccagcugacauaugucgucaucgcgauacucaccgugguagccgccacgauggcaaacgagaugggcuuccuggaaaagaccaagaaggaucugggccucgggucgaucaccacccaggagagcgagagcaacauccuggacauugacuugcgcccggccuccgcguggacacucuacgccguggccaccaccuuugugacucccaugcuucggcacuccaucgagaacuccucggugaacgucagccugacagcaaucgcgaaccaagccaccgugcuaaugggccugggcaagggguggccccugagcaagauggacaucggggugccccuccuggccaucgggugcuacagccaggucaacccgaucacccucaccgccgcccuccugcugcucguagcacacuacgcuaucauagggcccggacugcaggccaaggccacacgcgaggcgcagaaacgggcggcugccgguauaaugaagaacccuaccguggacgggaucaccguuauagaccuggagcccauuccauacgacccaaaguucgagaagcaguugggucaggugaugcuuuugauccucugcguuacccaaguacugaugaugcgcacuaccugggcccuuugugaggcccucacccuggcgaccggccccaucuccacgcugugggagggcaaucccgggcgauucuggaacaccacgaucgccgucagcauggcaaacaucuucagagggaguuaccuagccggcgccgggcuucuguucagcaucaugaagaacacuaccaacacccgacggggcacggguaacaucggggagaccuugggcgagaaauggaagucccgccugaacgcccugggcaagagcgaauuucaaaucuacaagaaguccggcauccaggagguugacagaacucucgccaaagaggggaucaagcgcggcgaaaccgaccaccacgccgucagccggggcucggcaaagcugcgcugguucguggagcggaacauggugaccccggagggcaaggucguggaccugggaugcgggcgcggcggguggagcuacuacugcggcggacucaagaacgugcgggaggucaaggggcugaccaagggagggccuggccacgaggagccgauaccaaugagcacguauggguggaaccugguucgccuccagagcgggguggacgucuucuucaccccgccugagaagugugacacccugcugugcgacaucggggagagcucgcccaaccccaccaucgaggcgggacggacguugcgcgugcugaaccuuguggagaacugguugaacaauaacacccaguucugcaucaagguccugaacccguacaugcccagcgugaucgagaagauggaaacccugcagcggaaguacggcggcgcucucguacguaacccccugucccggaacagcacccacgagauguauugggucucgaaugcuacgggcaacaucgugucaucgguuaacaugaucagcaggaugcugaucaaccguuuuacgaugaaacacaagaaggcaaccuaugaaccggauguagaccuuggguccggcacccgcaacauaggaaucgagagcgagauccccaaccucgacauuaucggcaagcggaucgagaagaucaagcaggagcacgagaccuccuggcacuacgaccaggaucauccuuauaagacgugggccuaccacggcagcuaugagacaaaacagaccggguccgcgaguaguauggucaacggcgugguccgucugcuuaccaagccaugggacguggugccgauggucacgcagauggccaugaccgacaccacccccuucggccagcagcgcguauucaaggagaagguggauacgcggacccaggagcccaaggaggggaccaagaaacucaugaagauuaccgccgaguggcuguggaaagagcugggcaagaagaagacgccccgcaugugcacccgggaggaguuuaccaggaagguccggagcaacgccgcccucggggcaaucuucacggacgaaaauaaguggaaguccgcccgcgaggccguggaggacggcagguucugggagcuggucgaucgcgagcggaacuugcaccucgaggggaagugcgagacguguguguacaacaugaugggcaaaagggagaagaagcugggggaguucgggaaggcaaaggguagcagggcgaucugguacauguggcugggggcccgcuuucucgaguuugaggcucugggcuuccugaacgaggaccacugguucuccagagggaacagccucagcggcguggaaggcgaggggcugcaccgccugggcuacauccuccgggacguagggaagaaggagggcggggccauguaugcggaugauacagcgggcugggauacccgcaucacccuggaggaccugaagaacgaggagauggugacaaaccacaugaaaggcgagcacaagaagcucgccgaggccaucuucaagcugaccuaccagaacaaggugguccgugugcagcgcccgacgccccgggggaccgugauggacaucauaucccgcaaggaccaaagaggcagcgggcagguuggcacguacggacuuaacaccuuuaccaauauggaggcccagcucauccgccagauggagggggaggguaucuucaagagcauccagcauuugaccgccacggaggagaucgcggugcaaaacugguuaacccgcguggggcgggagcgcuuaucgcggauggccaucuccggcgaugacugcguugugaagcccaucgacgaucgcuuugcuagcgcccugaccgcgcugaacgacaugggcaaggugcggaaggacauucagcagugggagcccucccggggcuggaacgacuggacccagguccccuucugcagccaccacuuccacgaacuggugaugaaggauggcagggugcuggucgugcccugccgcaaccaggacgagcugaucgggcgggcucgcaucucccagggagccggguggagccucaaggagacggcuugccuggggaagaguuacgcccagauguggacccuuauguacuuccaccggcgcgaccuccgucuggccgcgaacgccaucugcagcgcugugcccucacauuggguccccacaagcagaaccaccugguccauccacgcuaagcacgaguggaugacgaccgaggacaugcuggcgguauggaaccggguguggauccaggagaauccguggauggaagacaaaaccccugucgaguccugggaagaggugccauaucuaggcaaaagagaggaccaguggugcgguucccugaucggccugaccagccgggccacgugggccaagaacauccagaccgccaucaaccaggugcgcagccucaucgggaacgaggaguacaccgacuacaugcccuccaugaagcgguuccgccgcgaggaagaggaggccggcguccuuugguga

SEQ ID NO: 25277 - RNA, 9876 nt, Artificial Sequence
  derived and/or modified CDS sequence (opt11) from DENV-2__EU482608__SS-prME
accgccggcgugaucauaaugcugaucccgacggccauggcguuccaucuuaccacccggaacggggaaccccacaugaucgucggucggcaggagaagggcaagucccugcucuuuaagaccgaggauggcgucaacauguguacccucauggccauugaccuaggugagcucugcgaggacaccaucacguauaagugcccccuccugcgucagaacgagcccgaggacaucgacugcuggugcaacucaacguccaccugggugacuuacgggaccugcaccaccacgggagagcaccggcgcgagaagcgguccgucgcucuggugccccacguggggaugggucuugagacccggaccgagacguggaugagcagugaaggggccuggaagcacgugcagcggaucgagaccuggauuuugcgccacccuggcuucaccaucauggccgcgaucuuagccuacaccaucggaaccacgcacuuucagcgggcccucaucuuuauccugcugaccgccguggcgcccagcaugaccaugcgaugcaucgggaucuccaaccgagacuucgucgagggcgucucugguggauccuggguggauaucgugcuugagcaugggagcugcgucaccacgauggcuaagaauaagcccacccuggacuucgagcugaucaagacggaggcgaagcaaccagccacuuuacgcaaauacuguauugaggccaaguuaacgaacaccacaaccgagucccggugcccgacgcagggagagccgucgcugaaugaggagcaggacaagcgcuuuaucugcaagcacuccaugguggaccggggcugggguaacggcugcgggcuguucggcaagggcggcaucgugaccugcgcgauguucacgugcaagaagaacauggagggcaaggucgugcagcccgagaaccuggaguacacuaucgugaucacaccacauagcggggaggagcacgccguuggcaacgauaccgggaaacacgguaaggagaucaaaaucacuccgcaguccagcaucaccgaggccgagcugacgggcuacgguacggugaccauggaguguagcccaaggaccggccucgacuucaacgagauggugcugcugcagauggaagacaaggccuggcucguucacagacagugguuccuggaucugcccuugcccuggcugccaggggccgacacacaaggcagcaacuggauacagaaagagacgcugguaaccuucaagaacccccacgcgaagaagcaggacguggucguacuaggcagucaggagggugccaugcacaccgcucugaccggcgcgacagagauccagaugagcagcggcaaccuccuguucaccggccaucucaaaugccgccugcggauggacaagcuucagcugaaggggauguccuacagcaugugcacgggcaaguucaagauagucaaagagaucgccgaaacgcagcacgggacgaucgugauccgcauccaguacgagggcgacggcucccccugcaagaucccguucgagauaaccgaccuggagaaaagacaugugcucggcagacugaucaccgucaacccgauugugaucgagaaggacucgcccgugaacaucgaggcggagccgcccuucggcgacuccuacaucaucaucggggucgagccgggccaacugaagcucaacugguucaaaaaggggagcagcaucggccagauguuugagaccaccaugcgcggcgccaagaggauggccauccugggggacaccgccugggacuuuggcucauuaggagggguguuuaccuccaucgggaaggcccuccaccagguguucggagcgaucuacggcgccgccuucucgggagucagcuggacaaugaagauacugaucggcgucgugaucacguggaucgggaugaacagccgcucuaccucucuguccgugagccuaguucucgugggcgucgugacccuguaccugggggccaugguacaagcggacuccggcugcgucguuucauggaaaaacaaggaacuuaagugcgguucugggaucuucaucacggacaacgugcacacguggaccgagcaguacaaguuccagccugagagccccucaaaacuugcgucagccauccagaaagcccacgaggagggcaucugcgggauacggagcgucacacgccuggagaaccucauguggaagcagaucaccccugagcugaaccacauccuuuccgagaacgaggugaagcucaccauuaugacuggcgauaccaaggggaucaugcaggcagggaagcggagccugcgcccucaacccacagaacugaaguacuccuggaaaacguggggcaaggcuaagaugcucagcacggagucccacaaccaaaccuuucugauugacgggccggagaccgccgaaugcccgaacacgaaucgggccuggaauagccuggagguggaagacuauggguucggcgucuucaccaccaacauuuggcucaagcugcgcgaaaagcaggacguguucugcgacuccaagcuaaugucagcugccaucaaggacaaucgggcgguccacgccgacaugggcuacuggaucgaauccgcccugaaugacaccuggaagauggagaaggcaagcuuuaucgaggucaagucaugucacuggcccaaaagccacacccugugguccaacggcgugcucgagagcgagaugauaaucccaaagaauuucgcagggcccgugucccagcacaacuaccgcccaggcuaccacacgcagaccgcaggucccuggcaccucgggaagcuggagauggacuucgauuuuugcgaggguaccacggucgugguuacggaggacugcggcaaccggggcccaucccugcgcacuacgaccgccagcgggaagcuaauaacggaguggugcugccgauccugcacccugcccccgcugcguuaccggggcgaggaugggugcugguauggcauggagauccgcccccuuaaggaaaaggaagagaaccuggugaacagccuggucaccgcuggccacggccaaaucgauaauuucuccuuaggaguguuagggauggcccuguuucuugaggagaugcugcggacucgcguuggcacgaaacacgccauccuauugguagccgugucauuugugacauugaucaccgggaacaugucguuccgggaccuaggccgcguaaugguuauggucggggcgaccaugacggacgacaucgguaugggcguaaccuaccuggcccugcuggcagcguucaaggugcgucccaccuucgcggccgggcuguuacugcggaaacucaccagcaaggagcucaugauggccacaauugggauuacacuacucucccagagcaccauacccgagacgauccuggagcugacggacgcccuugccuugggcaugaugguguugaagaucgugcgcaacauggagaaauaccagcucgccgugaccauaauggccaucuccugcgucccgaacgccgugauacugcggaacgccuggaagguguccugcacuauacuggccgccgucuccgugucgccccuccugcugaccagcagccagcagaaggccgacuggaucccgcucgcccugacgaucaagggccugaaccccacggcgaucuuucucacgacccuuucccgcacgagcaagaagagaagcuggccgcuuaacgaggccaucauggccguuggcauggugucgauccucgccuccagcuugcugaagaaugacauccccaugaccggcccguuaguggcaggaggucugcugacugucugcuacgugcucaccggccgcagcgcagaccuagagcuggaacgagcggccgaugugaagugggaggaucaagccgagaucuccggaagcucccccauccucucgauuacgaucuccgaggaugguagcauguccaucaagaacgaggaggaggagcagacccugaccaucuugauccgaaccggucuccuggucaucaguggcguguucccgguguccauccccaucaccgcugcugccugguaucugugggaggucaagaaacagcgggccggcgucuugugggauguucccagcccuccgcccguugggaaggccgagcuggaggauggcgccuacaggaucaaacagagagggauccuuggcuacucccaaaucggugcgggagucuacaaagaaggcacguuccacacaauguggcacgugacccggggggccguccucaugcaccggggcaagcgcaucgagccguccugggccgacgugaagaaggaccugauuuccuacggcggcggauggaagcuggagggagaguggaaagagggggaagaggugcaggucuuggcccuggagcccggcaaaaacccccgggccgugcagaccaagccuggcauauucaagacgaacacggggaccaucggagcggugagccuggacuucucccccggcaccucugggucccccauagucgaccgcaagggcaaaguaguaggccucuacggcaacggggucgugacgcggagcggggcauauguguccgcgauagcccagaccgaaaagucgauagaggacaacccugagauagaggacgauaucuuccgcaagaagcgucugacuauaauggaucugcaccccggcgcggggaagaccaagcgcuaucugcccgccaucguucgggaggcgaucaagcgcggccugaggacgcugauucuggcccccacacgcgugguugcggcggagauggaggaagcccuccgcgggcuucccauccgguaccagaccccagccaucaaggccgagcacaccgggcgcgagauaguugaccucaugugccaugcuacguucacuaugagauuguugagcccaguuagggugccgaacuacaacuuaaucaucauggacgaggcgcacuucacugaccccgcauccauugccgcccggggcuacauuagcacccgcguagaaaugggcgaggcggccggcaucuuuaugacggccacgccgcccgggucccgggacccguucccccagagcaaugcccccauuauggacgaggagcgcgagauacccgaaagguccuggaacagcggccacgagugggugacggauuuuaaggggaagacagucugguucguuccguccaucaaagccggcaacgacaucgcggcuugccuccgcaaaaacgggaagaaggugauccagcuaagucggaagacuuucgacuccgaguacguuaagacccgcgccaaugacugggacuuugucgugacgacggacaucagcgaaaugggggcgaauuucaaggccgagcgggugaucgacccccgccgguguaugaagcccgucauccucacggacggcgaggagcgcgugauccucgccgggcccaugccggugacccacuccagcgccgcccagcgccgcggccgcaucgggcggaacccuaagaacgaaaacgaccaguacaucuacaugggcgagccccuggaaaacgacgaggacugcgcccacuggaaggaggccaaaauguugcucgacaacauaaacaccccugaaggcaucaucccgaguauguucgagcccgagagagagaaggucgacgcgaucgacggggaguaccggcugcgcggggaggcccggaagaccuucguggaucugaugcgccgcggagaccuuccuguguggcuggcuuacaaaguugccgcggagggcaucaacuacgcagaccgcaagugguguuuugacgguaucaaaaacaaccagauacuggaggagaauguagaaguggagaucuggaccaaggaaggcgagcggaagaagcucaaaccucgcuggcuggacgcccggaucuacagcgaccccuuagcccucaaggaguucaaggaguucgcugcgggaaggaaaucccugacccugaaccugaucaccgagauggggcggcugccaacguuuaugacacagaaggcccgcaacgcccucgacaaccucgcagucuuacacaccgccgaggcgggugggagagccuacaaccacgcccugucggagcuccccgagacccucgagacccugcuccugcucacccuccuagccacuguaaccggcggcauuuuccuguuccucauguccgggaagggcaucgggaagaugacccucggcaugugcugcauuaucaccgccucuguccugcuuugguaugcucaaauccaaccgcacuggaucgccgccucgaucauccuggaguucuuccugaucgugcuccucauccccgagcccgagaagcagcgcacuccccaggauaaccagcugaccuaugucgucaucgccauccucaccgugguggcagcgaccauggccaacgaaauggguuuccuugagaagacgaagaaggaccugggccuuggaagcauuaccacccaggaauccgaaaguaacauacuggacauagaccugagaccggccagcgccuggacccucuacgccgucgcgacgaccuucgucacccccaugcugcgccacagcaucgagaacagcucggugaacgucagccugaccgccaucgccaaccaagccacuguacucauggggcugggaaaaggcuggccucuguccaagauggacaucgggguaccccuccuugcaaucgggugcuacucccaagucaacccgaucacacugaccgccgcccuccuguuguugguggcccacuacgcuaucaucggccccgggcugcaggcgaaagccacccgggaggcccagaagcgcgccgccgccggaauuaugaaaaacccaacgguggacggcaucaccgucaucgaucuggagcccaucccguacgaucccaaguucgagaagcagcucggccagguuauguuacugauccugugcgugacccagguucugaugaugcggaccaccugggcgcugugcgaggcacucacucuggccacgggccccaucuccacccucugggaagggaaccccggucgcuucuggaacacgaccaucgccguguccauggcgaauaucuuccggggcuccuaccucgccggggccggccuccuguuuucgaucaugaagaauacuaccaacacccggcgugggaccggcaacaucggcgaaacucucggggagaaguggaagucccgguugaacgcccugggcaagucugaguuccagauauacaagaagucgggcauacaggaaguggaccggacccucgcgaaggagggcauuaagcgcggggagacugaccaccacgccgucucccgcggcuccgccaagcugcggugguuuguggagcgcaacauggugaccccggagggcaaggucguugaccuugggugcggccgcggcgguuggagcuauuauuguggcgggcugaagaacguacgcgaggucaaggggcuuaccaagggcggccccgggcacgaagagcccaucccgaugucuacauacggauggaaucuagugcggcuccaguccgggguggaugucuucuucacgccgcccgagaaaugcgacacccugcugugcgacaucggugagagcucccccaaccccaccaucgaggccggccgcacccuccgggugcugaaccuuguggagaacugguugaacaacaacacccaguucuguaucaagguccugaauccguacaugcccagcgugaucgagaagauggagacguugcaacguaaguacgggggcgcccucguccgcaacccccugucccguaauagcacccacgaaauguacuggguaucaaacgcgacagggaacaucgugucguccgugaacaugaucagccggaugcugaucaaccgcuuuacaaugaaacacaaaaaggccacuuacgagccggacgucgaccugggcaguggcacccgaaacauuggcauugagagcgagaucccgaauuuggacaucaucggcaagcgcaucgagaagaucaagcaagagcacgagaccuccuggcacuacgaucaggaccaccccuacaagaccugggccuaccacgggagcuacgagacgaaacaaacaggaucggccagcaguauggugaacggugugguccggcugcugacaaaacccugggauguugugccgauggucacgcagauggcuaugacggacaccacgcccuucgggcagcagcggguguucaaggagaaaguugacacccgcacccaggagccuaaagagggcaccaagcggcucaugcgcauaaccgcggaguggcuguggaaggaacuggggaagaagaagaccccccggaugugcacgagggaggaguuuacccggaaggucagaaguaacgcggcccugggggcgaucuucaccgacgagaacaaguggaagucagcccgggaggcgguggaagacgggcgcuucugggaguuaguagacaaggaacggaaccugcaccucgagggcaaaugcgagaccugcguuuacaacaugauggguaagcgcgagaagaaacugggagaguucggcaaggccaagggcaguagggcuaucugguacauguggcugggcgcccgcuuccucgaguucgaagcguugggcuuucugaacgaggaccauugguucuccaggggaaacagucuuuccgggguagagggcgagggccugcaucgccucggguacauucucagggacgugggcaagaaggaggguggcgcuauguaugccgacgacacggccgggugggacacucgcaucacgcuggaggaucugaaaaacgaggagauggugaccaaccacaugaaaggugagcacaaaaagcucgccgaagcgauuuucaagcucacguaccagaucaagguggucagagugcagcgcccaacuccccggggcaccgugauggacaucaucucccgccgggaccaacgaggaagcggccaggucgguaccuacggccugaacacguucacaaacauggaggcccagcucauccgccagauggagggcgaggggauauucaagucgauccaacaucugaccgccacggaagagaucgcgguccaaaauuggcuggcacgggugggccgcgagcgucucagccggauggcgaucaguggugacgacugcgugguuaaacccauugacgaccgguuugccagcgccuuaacggcucugaacgacaugggcaaggugcgaaaggacauccagcagugggaacccucccgggguuggaacgacuggacccaggucccauucugcagccaccacuuccaugagcucgucaugaaagacggccgcguucucgucgugcccugccggaaccaggacgagcugaucggccgcgcccggaucucccagggugcuggcuggucgcucaaggagaccgccugccuggggaaguccuacgcacagauguggacccugauguacuuucaccgccgggaccuccgccuggccgccaacgcgaucugcagcgcagugcccucccacugggugcccaccagccggacaacaugguccauccacgccaaacacgaguggaugaccaccgaggacaugcuggccguguggaaccgaguguggauccaagagaauccguggauggaagacaagacgcccguagaaucgugggaagaggugcccuacuuaggcaagcgggaggaccaauggugcggaucacugaucggccugacaagcagagcuacuugggccaagaauauccaaaccgccaucaaccaggugcgcucccucauaggcaacgaggaguauacugacuauaugccguccaugaagcgauuucgacgggaagaggaggaagccgggguccuaugguga

SEQ ID NO: 25278 - RNA, 9876 nt, Artificial Sequence
  derived and/or modified CDS sequence (opt11) from DENV-2__EU687220__SS-prME
accgccggcgugaucaucaugcugauccccaccgccauggccuuccaccugaccacccgcaacggggagccccacaugaucgucggccggcaggagaaggggaagucccugcuguucaagaccgaggauggcguuaacaugugcacacuaauggccaucgaccugggcgagcugugcgaggacaccauaaccuacaagugcccgcuccugcggcagaacgaacccgaggauauugacugcuggugcaacagcaccagcacguggguuaccuacgggaccugcaccaccacgggcgagcaccggcgcgagaagcgguccgucgcccuuguaccacaugugggcauggggcucgagacccgcaccgagaccuggaugagcagcgaaggggccuggaaacacguccagcggaucgagacauggauccugcgccacccgggcuucgccaucauggcggcaauacuagccuacacuaucgggacuacacacuuucagaaggcccucaucuuuauccugcuuaccgcugucgcccccagcaugaccaugcggugcaucggcaucucgaaccgcgacuucguggagggggugagcggcggguccuggguggacaucgugcucgagcacgguagcugcgucacgacgauggccaagaauaagcccacccuggacuucgaacugauaaagacagaagccaagcagcccgcuacccuccguaaguacuguaucgaggcgaagcuaaccaauaccaccacagagagucgaugcccuacccagggggaacccucacugaaugaggagcaggacaagcgguucaucugcaagcacuccaugguggacaggggcugggggaacggcugcggccuguucgggaagggcggcaucguaacgugcgccauguuuacguguaagaaaaacauggaggggaaggucguccugcccgagaaccuggaguauacgaucgugaucacgccacauucaggggaggagcaugcggucgggaacgauacggguaagcacggcaaggagaucaagaucaccccccaguccagcaucaccgaggccgaguugaccggguacgggaccgucacuauggagugcucaccccggaccggccuugauuucaacgaaaugguacugcuucagauggaggagaaggcaugguugguccaccgccagugguuccuagaccucccucugccaugguugcccggcgccgacacgcagggcuccaacuggauacagaaagagacccucguuaccuucaagaauccccacgccaagaagcaggauguggucguguuagguucccaggagggcgccaugcauaccgccuugaccggggccaccgaaauccagaugucuucugggaaucuucuguucacgggccaccugaagugccggcuuaggauggacaaacugcagcuuaaagggauguccuacucuaugugcaccggaaaauucaaaaucgucaaggaaaucgcugagacccagcacgggaccauugucauccgggugcaguaugaaggcgacggcuccccgugcaaaauccccuucgagauuauggaccucgagaagcgccacguccucgggcggcugaucacggugaacccgaucguuaccgagaaggauagcccuauuaacaucgaggccgagccacccuucggcgacuccuauaucaucauaggggucgaaccgggccaguuaaagcugaacugguucaaaaagggaagcuccaucggacaaauguucgagacuaccaugcgcggcgccaagcgcauggccauccugggggauacagccugggacuucgggagccugggugguguguucacguccaucgggaaggcccugcaccaaguguuuggcgccaucuacggggccgccuucucgggugucuccuggacuaugaaaauccugauuggcgugaucauaacauggaucgggaugaacagccgguccacuagucuguccgugucccugguccuggugggcguggucacccucuauuuaggcgcgauggugcaggcagacuccggcugcgugguuagcuggaaaaacaaggagcuuaaauguggcucugggaucuucauuaccgacaaugugcacaccuggacggagcaguacaaguuccagcccgaaagccccuccaaacucgccucugcaauacagaaggcccacgaggaggguaucugcgggauccgcagcguuacacggcucgagaauuuaauguggaagcagauaaccccugagcugaaucacauccucucagagaacgagguaaaacuaaccaucaugacuggagauaucaagggaauuaugcaggcaggcaagcguagccugcggccgcaaccuaccgagcucaaguacuccuggaagaccuggggcaaggcuaagaugcugagcaccgagucccacaaccagacguuccugaucgacgggcccgagaccgccgagugcccgaacacuaaccgcgccuggaacagccuagagguggaagacuacggcuucgggguguucaguacgaacauuuggcugaagcugcgggagaagcaggacguguucugugauagcaagcucaugucagcggcgauuaaggacaaccgcgccgugcacgccgacaugggauacuggaucgagagcgcccugaacgauacguggaaaauggagaaggcguccuucaucgaggucaagaguugccauuggcccaagucgcauacccuguggagcaacggcguguuggaauccgagaugaucauccccaagaacuucgccgggcccgugagccaacacaauuaucggccgggcuaucacacucaaaccgccgggccauggcaucuaggcaagcuggagauggacuuugacuucugcgaggggaccacaguggucgugaccgaggauugcggcaaccgggggcccagccuacggaccaccacggcauccgggaagcugaucaccgaguggugcugccgcagcuguaccuuaccaccgcuccgguaccgcggggaggacggguguugguauggcauggaaauacggccccugaaggagaaggaagagaaccuggugaacuccuugguuaccgcgggacauggccaaaucgauaauuucagcuugggcgugcuggggauggcuuuguuccuggaggagaugcugcgcacgcgcgugggaaccaagcacgccauucugcuggucgccguaaguuuugugacccugaucaccgggaacaugagcuuucgcgaccucggccggguaauggugauggugggggccacgaugaccgaugacaucggcaugggcguuaccuaucuggcccuccucgccgcguucaaggugcgcccuaccuucgccgccgggcugcugcuccgcaaacuaacauccaaagagcugaugauggccacgauuggaaucgcgcuguugagccaguccaccaucccagagaccauucucgaacucaccgacgcccuggcccuggggaugauggugcucaaaaucgugcggaacauggagaaguaccaacuggccguaaccaucauggcgauauccugcguuccgaaugcgguaauucugcucaacgccuggaagguguccugcaccauccuggccgccgugagugucagcccccugcuacugaccagcagccaacagaaggcggacuggaucccgcuggcccucaccauaaagggccugaauccaaccgccauauuccuaaccacccucagccggacguccaagaagcggagcuggccgcugaacgaggccgugauggcugucggcaugguguccauccuggccagcagccuccugaaaaacgacaucccuaugaccggacccuuaguggccggcgggcuccugaccgucugcuacgugcugaccggccgguccgccgaccucgagcucgagcgggccgccgacgugaagugggaagaccaugcagaaauaagcgggagcagccccauccuuuccaucacaaucagcgaggacggcuccaugagcaucaagaacgaggaggaggagcagacgcucaccauacugauccgcacaggucugcucgucauaagugggguguuuccggucaguauccccauaacggcagcugcuugguaccugugggagguaaaaaaacagcgggccgguguccugugggacgugccuagcccgccacccgucgggaaggcggagcuggaagacggcgccuaccgcauuaagcagcgagggauccugggcuacucucagaucggugcgggcguguacaaggagggcaccuuccacacaauguggcacgucacccgaggggcggucuugaugcaccguggcaagcgcaucgagcccuccugggcggacgugaagaaggaucucaucagcuacgggggcggcuggaagcuggagggggaguggaaggagggcgaagaggugcagguccuggcucuugaacccggcaagaauccccgggcugugcaaacgaagcccgggcuguucaagacgaauaccgggacaaucggcgcugugucccuagacuucagucccggcacguccggcucccccauaguugaucgcaagggcaaggugguugggcucuauggcaacggcgucgugacgagauccggggccuacguaagcgcgaucgcccagacugagaaguccaucgaggauaaccccgagaucgaggacgacaucuuucgcaagaagaggcugaccauaauggacuuacaccccggcgccggcaagacgaagcgcuaccugcccgccauugucagagaggcuaucaagcgcgggcuccggacgcuaauccuggccccgacucgagugguggcggcugaaauggaggaggcacuccgcgggcugcccauaagguaccagacccccgccauucgcgccgagcacaccggccgggagaucguagaccugaugugccacgcuacguucaccaugcgccuccugucccccgugagggugccaaacuacaaccuaaucaucauggacgaggcccacuucacugaccccgcgagcaucgcugcgcgcggcuacauauccaccagagucgagaugggcgaggccgccggcaucuucaugacggccacaccacccggaagccgugaccccuucccacaguccaaugcgccgaucauggacgaggagcgugagauccccgagcguucuuggaacuccggccacgaguggguaacagacuucaaggggaagacugucugguucguuccgucgauaaaagcaggcaacgacaucgccgccugccucaggaagaacggcaagaaggugauccagcugucccguaagacguucgacucggaguacgugaagacccgggccaacgauugggacuucguuguuaccaccgacaucuccgagaugggggcaaacuuccgcgccgagcgggugauagacccccgccggugcaugaagcccguuauacuuacggauggugaagagcgggugauccucgccgguccuaugccugugacccacucauccgccgcccagaggcgcggccgcaucggccggaaccccaaaaacgagaacgaccaguacaucuacaugggcgaacccuuagagaaugacgaggacugcgcgcacuggaaagaggccaagaugcuacucgacaacaucaacacccccgaaggaaucaucccgucgauguuugagcccgagcgcgagaaggucgacgcgauugauggcgaauaccgguugagaggcgaggcccggaagaccuucguggaucugaugcgccgcggggacuugcccgugugguuggcguaccgcgucgcggccgagggcauaaauuacgccgacagaagguggugcuucgacgggaucaagaauaaccagauccuugaggaaaacguugagguggaaaucuggacgaaggaaggagagcggaaaaagcucaagccgcgguggcuggaugccaggaucuauuccgacccauuggcgcucaaggaguucaaggaauucgccgcgggucgcaagagccuaacccugaaccucauaacagagauggggcgacugcccaccuuuaugacgcagaaggcccgugacgcccuggacaaccucgcaguacugcacaccgccgaggcgggcgggcgggcguacaaccacgcucucuccgagcugcccgagaccuuagaaacccugcuccugcucacccuccuggcuaccgucaccgguggcaucuucuuauuuuugaugagcggaaaggguauugguaagaugacccugggcaugugcugcaucaucacggcuuccauccugcucugguacgcccagauccaaccccacuggaucgcugccuccaucauccuggaguucuuccugaucguauuauugauccccgagcccgagaagcagcgcacaccccaggacaaucagcugaccuacguggugaucgcgauccugaccguaguggccgcaaccauggccaacgagauggguuuccuggaaaagacgaagaaggaccugggccuaggcucaaucacgacccaggaguccgagucaaacauccuggauauugaccugcggccggccucugcguggacucucuacgccguggccacaacauucgucacgccgaugcugcggcacagcaucgaaaacuccagcgugaacgugaguuugacggccaucgcgaaucaggcuacgguccuuaugggucucggcaaggguuggccccugucaaagauggauaucggcgucccccucuuagccaucgggugcuacucccaggugaacccgaucacccugacagccgcccuccugcuacucgucgcgcacuacgccaucaucggcccgggccugcaggcgaaggccacucgggaggcucaaaagcgcgcggccgccggcauaaugaagaaucccacgguggauggcaucaccgugaucgaccuagaaccuaucccguaugaccccaaguuugagaagcagcucggucaagucaugcugcugaucuuaugcguaacccaggugcugaugaugcggacaacgugggcccugugcgaagcguuaacccuggcgaccggccccaucagcacacugugggaaggaaacccuggaagguuuuggaacacgaccaucgcgguuuccauggccaacaucuuccggggcucguaccucgccggggcgggccugcuguuuaguaucaugaagaacaccacuaacacacggcgggggaccggcaacaucggcgagaccuuaggggagaaguggaagucacgucugaacgcacugggcaaguccgaguuccagaucuacaagaaguccgggauucaggaaguggaucgcacgcucgccaaggagggcauaaagcgcggggaaacggaccaccacgccgugucaaggggaagugccaagcugcggugguucgucgagagaaacauggucaccccggagggcaaggucguggaccuggggugcggcagaggcgggugguccuauuacugcggugggcucaagaacgugcgugaagugaaggggcugacuaagggcgggcccgggcaugaggagccaauccccaugagcacuuacggcuggaaccugguacggcuccagagcgggguggauguauuuuucacuccgcccgagaagugcgauacacucuugugcgacaucggagaguccagccccaacccaaccaucgaggcgggccgcacccuccgcguucugaaccuuguugagaauuggcucaauaacaacacgcaguucugcaucaagguguuaaacccauacaugcccagcgugaucgagaagauggagacccugcaacgcaaguauggaggcgcuuuagugcggaaccccuuaagccgcaauagcacucacgagauguacugggugagcaaugccaccgggaacaucguaaguagcgugaacaugaucucccggaugcugaucaaccgcuucaccaugaagcacaagaaggccacuuacgagccggacguagaccugggcagcgggacccgcaacaucgguaucgaguccgagauccccaacuuggacaucaucgguaaacggaucgagaagaucaagcaggagcacgagacaucuuggcacuaugaccaggaccaccccuauaagaccugggcuuaucacgggucguacgagacuaagcagaccggauccgcguccagcauggucaacgggguugugcgccuguugaccaagccaugggauguaguuccgauggugacacagauggccaugacggauacgacccccuucggccagcagcgggucuucaaggagaagguggacacccgcacgcaggagcccaaagagggcacuaaaaagcucaugcggaucacggccgaguggcuguggaaggaacugggcaagaagaagacgccccggaugugcacgcgagaggaguucacacgcaaggugagauccaacgccgcccucggcgcuaucuucaccgaugagaacaaguggaagagugcccgggaggcugucgaggacucccgguuuugggagcugguugaccgcgagcgaaaccuucaccucgaggggaagugcgagacaugcguguacaacaugauggggaagcgagagaagaagcuaggggaauuuggcaaggccaagggcagccgggccauuugguauaugugguugggggcccgcuuccucgaauucgaggcccugggcuuccugaacgaggaccacugguucagccggggcaacucccucagcggcguagagggcgagggccugcaccgguuaggcuacauccuccgggacguguccaaaaaggagggcggggcgauguacgccgacgacacggcggggugggauaccagaaucacccuggaggaucucaagaacgaggagauggucaccaaucauaugaagggcgaacacaaaaaacucgccgaggccauauucaagcucacauaccagaacaaggugguucggguccagcgcccgacgccccgugggacggucauggacaucaucagccgucgagaccagcggggcuccggccagguugggaccuacggccugaacaccuucaccaacauggaggcccagcucauccgccagauggagggugagggcaucuucaagagcauacagcaccugaccguuaccgaggagaucgcugugcaaaacuggcugguucgggucggccgcgagagacucucccguauggccaucagcggggacgacugcguggugaagccccuugacgaucgguucgccucugcccugacggcccucaacgauaugggaaaagucaggaaggacauccagcagugggagccaagccggggguggaacgauuggacacaggugccguuuugcucacaccacuuccacgaacuugugaugaaggacggccguguccuggugguucccugccggaaccaggacgagcucauugggcgcgcuagaaucucacagggcgcuggcuggucccugaaggaaaccgcuugccucggcaagagcuaugcccagauguggacucucauguacuuccaccgccgcgaccuccgguuagccgccaaugcaaucugcucggccguccccucucacugggugcccacaucucgcaccacuuggagcauccacgccaagcacgaguggaugaccaccgaggacaugcuagcuguguggaaccgcgucuggauccaggagaacccguggauggaggauaagacucccguggaaagcugggaagaggugcccuaccugggcaagcgcgaggaccaguggugcggcucacugaucggccucaccagccgggcuacuugggccaagaauauccagaccgcuaucaaccagguccgcucccuuaucgggaacgaggaguacacggacuauaugcccagcaugaagcgguucaggagggaggaggaggaggcaggcgugcugugguga

SEQ ID NO: 25279 - RNA, 9876 nt, Artificial Sequence
  derived and/or modified CDS sequence (opt11) from DENV-2__EU726775__SS-prME
accgccggcguaauagucaugcugauccccaccgcaauggcguuccaccucaccacccgcaacggggaaccccacaugaucgucggccggcaggaaaaggggaagucccuccuguucaagaccgaagacggcguuaacaugugcaccuuaauggccauugauuugggggaacugugcgaggacacaauaaccuauaaauguccacugcugcggcagaacgagcccgaggacaucgacugcuggugcaacucaacgucuaccugggucacguacggaacaugcacgaccacgggcgagcaccggcgugagaagcgguccguggcccucgugccgcacgugggaaugggccuagagacaagaaccgagaccuggaugagcucggagggggcauggaagcacguucagcggaucgagacguggauccugcggcacccgggcuucaccauaauggccgcgauccuggccuacacuaucggaacaacgcacuuccaaagggcccuaauuuucauccugcugacugcgguggcacccagcaugacaaugcgcugcaucggcauaagcaacagggauuucguagaaggagugagcgggggcuccuggguggauauaguacucgagcacgggagcugcgugacgacgauggccaaaaacaagcccacccuggacuucgagcugaucaagaccgaggccaagcagcccgccacccuccgcaaguacugcaucgaggccaagcugaccaacaccaccaccgagucccggugcccgacgcagggcgagcccuccuuaaacgaggaacaggacaagcgcuucauaugcaaacacuccauggucgaccgggggugggggaacggcugcggacucuucgguaagggcgggauugugaccugcgcuauguuuaccugcaagaaaaacauggaaggcaaggugguacagcccgagaacuuggaguacaccauuguaaucacaccccacagcggggaggagcaugcgguuggcaacgacacagggaagcacggcaaggagaucaagauuacaccgcaauccucuaucaccgaggccgaacugacuggauacgggacgguuaccauggagugcagcccgcggaccggacucgauuucaacgagaugguccuucugcagauggaggauaaggccuggcucgugcaccggcagugguuuuuagauuuaccccucccaugguuaccgggggcugacacccagggcucgaauuggauccagaaggagacgcuggugaccuuuaagaacccucaugcgaagaagcaggacgucgugguccugggaagucaggagggcgcuaugcacaccgcacuuaccggugcgacagagauucaaaugaguagcggcaaucuccuuuucacaggacaccuuaagugucguuugcggauggacaagcuccagcugaaggggaugucuuacagcauguguaccgggaaguucaagaucgugaaggagaucgcagagacccaacacgggacgaucgugauccgcgugcaguacgagggcgacgggucgcccugcaaaaucccguucgagaucaccgacuuagagaaaaggcacgugcucgggcgcuuaauuacugugaauccgaucgugaccgagaaagacagccccgugaacaucgaagcggaaccaccauucggcgauuccuacauuauaaucgggguggagccgggccaauuaaagcucaacugguucaagaaggggucguccauaggccagauguuugagacgaccaugcguggcgcaaagcggauggcuauuuugggagacaccgccugggauuucggcagccucggcggggucuucaccucaaucgggaaagcacuacaucaggucuuuggggcaaucuauggugccgcauucagcggggugucauggacgaugaaaauacugaucggcgugaucaucacguggaucgggaugaacagucgcucgaccagucugucugugagccuaguucucgucggcguuguuacccuguaccugggagccaugguccaagcugacaguggaugcguggugaguuggaagaacaaggagcucaagugcggcucggggaucuucauuacagacaacguacauaccuggacugagcaguauaaguuccaacccgagagccccaguaagcuggccuccgccauccagaaggcgcacgaggagggcaucugugggauccggagcgugacccgacuagagaaccucauguggaagcagaucacgcccgaacugaaccacauccuaucagagaacgagguaaaacugaccaucaugacuggcgacaucaaggggaucaugcaagccggcaagaggucucugcggccacagcccacagagcugaaauacuccuggaaaacguggggcaaagcuaagauguuaucuacugagucucacaaccagaccuuucugaucgacgggcccgaaaccgccgaaugcccaaacacgaaccgggccuggaacagccuggaggucgaggacuacgguuucgggguuuuuaccacaaacaucuggcucaagcugcgggaaaagcaagacguguucugcgacuccaaacuaaugagcgccgccaucaaagacaaccgggccgugcacgcagacaugggcuauuggauugaguccgcccucaacgauaccuggaagauggagaaggcuagcuucaucgaaguuaagagcugccacuggcccaagagccauacccugugguccaacgguguguuagaaagugagaugauaaucccuaagaacuucgccggacccgucucccagcacaauuaccgcccgggcuaccacacgcaaaccgcugggccguggcaucucggcaagcuggaaauggacuuugacuucugcgagggcaccaccgucguggucacggaggacugcgggaaccggggccccagccugcgcaccacuaccgccagcgguaagcucaucacagaaugguguugccgguccugcacgcugcccccgcugagguacagaggcgaggacgggugcugguacggcauggaaauccgaccccucaaggagaaggaagaaaacuuggugaacucacucgugaccgccgggcacggacagaucgacaacuucuccuuaggcgucuuaggcauggcacuguuccucgaggaaaugcugcggaccagggugggcacgaaacacgcaauccugcucguggccgucagcuucguuacccugaucacugguaacaugucuuuccgggaucucggccgcgugaugguaauggugggggcgaccaugacggaugacaucggcaugggcgugaccuaucucgcccugcuggccgcguuuaagguucgcccaaccuucgccgccggacuccuguuaagaaaacucacuucuaaggagcuaaugauggcgacuaucggcaucgccuugcucucccaaagcaccaucccugagaccauacuagagcugaccgacgcgcucgcccuagggaugaugguacugaaaaucgugcgcaacauggagaaauaucaacuagcggucacuaucauggccaucuccugugugccgaacgccgugauccugcagaacgcauggaaagucuccugcaccauccuggccgccgucucagucucuccccucuugcuuaccaguucccagcagaaagcagacuggaucccccucgcgcuuaccaucaaaggcuugaaucccacggccaucuuccucacuacccuuucccggaccagcaagaagagguccuggccgcugaacgaggccaucauggcaguaggcauggugucaauccucgccuccaguuugcuaaagaacgacauuccaaugacgggaccccucguagcgggcggguuacugaccgugugcuacgugcugacaggccggagcgcugauuuggaacuagaacgagcggcagacgucaagugggaggaucaggcugagaucuccgggucauccccuauccucagcaucaccauuuccgaggacgggucuaugucgaucaagaacgaggaggaggaacagacguuaaccauauuaauaaggaccggcuuauuggugaucagcgggguguucccagucuccauccccaucaccgcggcggcgugguaccuuugggaggugaagaaacagcgcgccggcguguugugggacguccccagcccaccgccaguugggaaagcugagcuggaagacggggccuaccggaucaagcagcgagggauccugggauacucccaaaucggugccgggguguacaaggagggcaccuuucacacgauguggcauguaacccgcggagccguguuaaugcaccggggcaaacggaucgagcccuccugggccgacgucaaaaaggacuuaauuuccuacgggggcggcuggaagcuggagggggaguggaaggaaggcgaggagguccagguacucgcccuggagcccgggaagaacccccgcgcggugcaaaccaaaccgggcaucuuccgcaccaacacgggcacuaucggcgccaucagcuuagacuucucucccggaacaagcgggucccccaucgucgaccgcaagggaaaagugguggggcucuacgguaacggugucgugacgaggagcggagcuuacgucucagcgauugcgcaaacggaaaaguccaucgaggacaaccccgagaucgaggacgacaucuuccgcaagaaacggcugaccauaauggaccuucacccgggcgcagggaagaccaagcguuaccucccagccaucguccgggaggcaauaaaacgcggucugcgcacacugauucuggccccgacucgggucguggccgccgagauggaggaagcccuccgcggguuaccuauuagguaccagacgcccgcgaucaaggccgagcacaccggacgcgagauagucgaccugaugugccaugcgacguuuacuaugcggcuccugagccccgugcgcgugccuaacuauaaccucaucaucauggacgaggcacacuucaccgacccagccuccaucgccgcccgaggcuacaucagcacccgcguggagaugggggaagcggccgggaucuucaugacggcaacgccucccgggucccgagauccuuuuccccagagcaacgcgcccauuauggaugaggagcgagaaauccccgaaaggucuuggaacucgggccacgagugggugacugacuucaagggaaaaaccgugugguuugucccguccaucaaagcgggcaacgacauagccgcaugucuccguaagaacggcaagaaggugauccaguugucacggaagaccuuugacuccgaguaugucaaaacgcgcgccaacgacugggacuuuguagugacaaccgacauuucagaaaugggggccaauuucaaggcugagcgcgugaucgacccucgccggugcaugaaacccguuaucuuaacagacggagaggaacgcguaauccucgccggacccaugccugugacgcacuccagcgcugcccagcggcgcggccgcaucgggcgcaaccccaagaacgaaaacgaccaauacaucuacaugggggagccccuugagaacgacgaggacugcgcccauuggaaggaggcgaagaugcugcuggauaauauuaauacucccgagggcaucauccccuccauguucgaaccggagcgcgaaaaggucgacgccaucgacggggaguacaggcugcgcggggaggcccggaagaccuuugucgaccuuaugcgucgcggugaccuacccguguggcuugcuuacaagguugccgcggagggcaucaacuacgccgaccguaaguggugcuucgacgguaucaagaacaaccagauccuggaggaaaacguggagguagagauauggaccaaggagggcgagcggaagaaguugaagccgagauggcuggacgcacgcaucuacagcgacccucuugcucuaaaggaguucaaggaguucgcggccggccgcaagucccugacccugaaccuaauuacugagauggggcggcugcccaccuucaugacccaaaaggcccggaaugcacuggacaaucucgccgugcugcacacugcggaggcagggggccgcgccuacaaccaugccuuaagcgaacuccccgagacccuggaaacccuuuuauuacugacccuccuggccacugugacgggcggcauuuuucuguucuugauguccgguaagggcauagggaaaaugacucugggaaugugcugcaucaucaccgcgucaauccuguuaugguacgcacagauccaaccccacuggaucgccgccagcaucauccuugaguucuuccuaaucguccuccugaucccugagcccgagaaacagcgcaccccacaggacaaccagcuuacguacgugguuauagccauccucaccgucguggcggcgacgauggcaaacgagaugggcuuccuggagaagaccaagaaggaucugggauuggguagcaucacgacucaggaaagugaguccaacauccuggacaucgacuuaagaccagcgagcgccuggacgcucuacgcgguugccacuacguucgugacccccaugcugcgccacuccauugaaaacagcuccgugaacguuagccugaccgccaucgccaaccaagcgaccguccucauggggcugggcaagggcuggccccuguccaaaauggauaucggggugccucucuuagccaucggcuguuacagccaagugaacccgaucacccugacggccgcccuccugcuguugguggcccacuacgcuaucauaggccccggccugcaggccaaggccacccgagaggcccaaaagcgcgcugcggccggaaucaugaagaauccgaccguagaugguaucaccgugauugaucuggagccaaucccguacgaucccaaauucgagaagcagcucggucaagucauguugcugauccucugugugacgcagguuuuaaugaugcggaccaccugggcccugugugaggcccuuacguuagcaaccggccccaucuccacccugugggaagggaaccccggacgcuucuggaauacaacgaucgcgguaagcauggccaacaucuuccgcgguucauacuuggccggggccggcuuacuguucuccaucaugaaaaacaccaccaacacucgccgcgggacuggcaacaucggcgagacccuuggggagaaguggaagucccggcugaaugcacuaggcaagucagaguuccagaucuacaagaaaucggguauccaggagguggaucgcacccucgccaaggagggcauaaaacgcggggagacggaccaccacgcuguuagccgcggcuccgccaaguuacggugguuuguggaacgcaacaugguaacgccggaaggcaaaguggucgacuuaggguguggcagagggggcuggagcuauuacugcggaggcuuaaagaacgugcgcgaggugaagggucugaccaagggcggucccgggcaugaggaaccaauccccauguccacuuauggguggaaccugguacgguugcagagcgggguggauguuuucuucacgccgcccgagaagugcgauacgcugcuuugcgacauuggggagagcucacccaaccccacaauugaggccggacguacacuccgggucuuaaaccuaguggagaacuggcuaaauaacaacacccaguucugcaucaaggugcugaacccguacaugccaagcgucaucgagaagauggaaacccugcaacgcaaguacgguggggcgcucgugcguaaccccuuaucacgcaauucgacgcacgagauguacuggguguccaacgccaccggaaauauugucagcucugugaacaugauuagccggaugcugaucaaucgauucaccaugaagcacaagaaggccaccuacgagccggacguugaccugggguccgggacgcggaacaucggcaucgagagcgagauccccaaccucgacaucauagguaagcgcauugagaagaucaagcaggaacacgaaaccuccuggcauuacgaccaggaccacccguacaaaacaugggccuaccacgggagcuacgagaccaagcagacgggcuccgcuagcuccauggucaacgggguggugcgacuccuuacaaaacccugggacgucgugccuaugguaacccagauggcgaugaccgacacgaccccauuuggacagcagcggguguucaaggagaagguggacacccgcacccaggagcccaaggaaggcacgaaaaagcucaugaagauaaccgccgaguggcuguggaaggaacuagggaagaagaagacgccccguaugugcacgcgcgaggaauuuacgcggaaggugcgcagcaaugccgcccucggggccauauucaccgaugagaacaaauggaaauccgcgcgugaggcggucgaggaugggcgcuucugggaauugguggaccgggagcggaaccugcacuuggagggcaagugcgagaccugcguguacaacaugauggggaaacgggagaagaagcugggagaguucggaaaggcaaaggggagccgcgccaucugguauauguggcugggcgcgcgguuccucgaguucgaagcccugggguuccuuaaugaggaccauugguucucccgcggcaacucgcucuccgggguugagggcgagggccugcacagacugggguacauacuccgcgacgugggcaagaaagagggaggcgcuauguacgccgacgacaccgcugguugggacacuaggaucacccuggaggaccugaagaacgaggagauggucacuaaccacaugaagggagagcauaagaagcucgcagaggcgaucuucaaacugaccuaccaaaacaagguagugcguguccagcguccaacaccccgcggcaccgugauggacaucaucucgcggcgcgaccagcgcgggagcggacagguggggaccuacgggcugaacaccuuuacuaauauggaggcccagcuaauuagacagauggaaggcgaggggaucuuccgguccauacagcaccuaacggcuacggaggagaucgcgguacagaauuggcuagcgcgggugggccgcgagcggcucucaaggauggccaucuccggcgacgacugcguggucaaaccgaucgacgaccgguuugcaagcgcccugaccgccuuaaacgacauggguaagguccgcaaggacauucaacagugggagcccucccggggcuggaacgacuggacucagguccccuucugcagccaccacuuccacgagcuagucaugaaagacggacgagugcucgugguuccaugcaggaaccaagacgagcugaucggccgcgcgcgcaucagucagggggccggauggagccuaaaagaaaccgcaugccuggggaaauccuaugcccagauguggacgcugauguacuuccaccgucgggaccuuagguuagccgcgaacgccaucugcagcgccgucccuucccacugggugccuacgucacgaaccacuugguccauccacgccaagcacgaguggaugaccacggaggauaugcuggcaguguggaaccgcguguggauccaggagaacccguggauggaggacaagacgcccguugagucuugggaggagguccccuaccucggcaaacgggaggaccaguggugcgggucccuuaucggcuugacaagccgcgccacuugggccaagaacauucaaacugccauaaaccaggugcgcagccucauuggcaacgaggaguacaccgacuacaugcccucgaugaaacgguuccgccgagaggaggaggaggccggcguacugugguga

SEQ ID NO: 25280 - RNA, 9876 nt, Artificial Sequence
  derived and/or modified CDS sequence (opt11) from DENV-2__FJ639732__SS-prME
acagccggagugauugucaugcugauaccaaccgcuauggcguuccaccucaccacccgcaacggggagccucauaugauugugggucggcaggaaaaagggaaauccuugcuguucaagacagaagauggcgugaacaugugcacccucauggcuaucgaccuuggggaguugugcgaagacacaauuacuuacaaguguccgcuccuucggcagaacgagcccgaagacauagacugcuggugcaacucaacgagcacgugggucaccuauggcacauguaccaccacgggcgagcauaggcgcgagaaacgguccgucgcgcuagugccccacgucggcaugggucucgaaacccgcaccgaaaccuggaugagcucagaaggggccuggaagcacgugcaacgcauagaaacauggauccugcggcauccgggcuucacaaucauggccgccauccuggccuacacaaucgggaccacacacuuccagcgugcccucauuuucaucuugcugaccgccguggcacccucuaugacaaugcgcugcaucggcauuuccaaccgggacuucgucgaagggguuucagggggauccuggguggacaucguacuggagcacggaagcugcguuacgacgauggcaaagaacaaaccuacuuuggauuucgagcugaucaagacagaagcgaagcagccggccacgcucaggaaguacugcaucgaggcgaagcuaacgaacacgaccacagagucacggugcccgacgcaaggcgaaccuagcuuaaaugaggaacaagacaagcgcuucauaugcaagcacuccaugguggacaggggcuggggcaacggcugcgggcuguuuggcaaaggcgggauagugaccugcgcuauguucacuugcaagaaaaacauggagggcaaggugguacagcccgagaaucucgaguacacuaucgucauuacgccccacucuggggaggaacacgccguggguaacgacaccggcaaacacgguaaagaaaucaagaucaccccgcagaguucuauaaccgaggcggaacugacgggguacgguaccgugacgauggaaugcucucccagaacuggccuggacuucaacgagaugguccugcugcagauggaagacaaggccugguuaguacaccggcagugguuccucgaccuaccccuuccuuggcuaccuggggcugacacccagggcucuaacuggauucagaaggagacgcuugugacuuuuaagaacccucacgcgaagaagcaagacguagugguccuagggucacaggaaggcgcgaugcacacugcccugacaggugccacggagauccagaugagcaguggcaaucuccuguuuaccggucaccugaaaugccgccugcggauggacaaauugcagcuuaaagguaugaguuacaguaugugcacagguaaguuuaagaucgugaaagaaaucgcggagacccagcacgggacuauagugauccgcguccaauacgagggcgacggcuccccaugcaagaucccuuucgagaucacggaccucgaaaaacggcaugugcucgggcgauugaucacugugaauccgauugucaucgaaaaggacagccccgucaacauugaggcggaaccgcccuucggugacuccuacaucauaaucgggguagagcccgggcaacugaagcucaacugguuuaagaaggggagcuccaucggacagauguuugaaacgacaaugcgcggcgcgaagaggauggccauccugggagacaccgccugggacuucggcagucucggagggguguucacuucgaucgggaaagccuuacaucagguguucggagcgaucuacggcgccgccuucagcggcguguccuggaccaugaagaucuugaucggggucgugaucacuuggaucgguaugaauagccgcuccaccucccuaucagucagccuaguccucgugggcguggucacccuguaccugggggccaugguucaggcugacuccggcugcgugguuagcuggaagaauaaggaguuaaaguguggcuccgguauauucauaaccgacaacgugcacacguggaccgagcaguacaaguuucaacccgagagcccaagcaagcuagcgucagcgauccagaaggcgcacgaagaaggcaucugcgggauacggagcgugacacgacuggaaaaccucauguggaagcaaaucacgcccgagcugaaccacauccuguccgaaaacgaggucaagcugaccauuaugaccggcgacaccaagggcaucaugcaggcugguaaacggucccugcguccgcaacccaccgagcugaaguauuccuggaagacgugggggaaagcgaagaugcucucuaccgaaucacacaaccagaccuuccuuaucgacggccccgagaccgccgagugcccaaacacgaauagagcauggaauucacucgaaguugaagauuacggcuucgguguguucaccaccaacauauggcucaagcugcgcgagaaacaagauguauucugcgacucgaagcucaugagcgccgccgugaaagacaaccgggcggugcacgcggauaugggguacuggauugagucggcgcuaaaugauacuuggaagauggagaaggccagcuucaucgaggucaaauccugucacuggccuaaaagccacacucuguggagcaauggcgugcucgaguccgagaugaucauccccaagaacuucgccgggcccgugucccagcacaacuaccgcccgggguaccacacacagaccgcugggcccuggcaccucggcaagcuggagauggacuucgacuucugcgaggggaccaccguggugguuacggaagacuguggcaaccggggccccagccugcguaccacaaccgccucagggaaauuaauuacagaguggugcugccguucgugcacgcugccuccgcugcgcuaccgaggugaagacggaugcugguacggcauggagaucaggccucucaaggagaaggaggagaaccuggucaacucccuggugacggcgggacaugggcaaaucgacaacuucucacugggcgugcuggggauggcccuuuuucuugaggagaugcugcgaacccgcgucggaaccaagcacgcgauucugcuuguugcagugagcuuugucacccuaauuacugggaacauguccuuccgggaccucggccgcgugaugguaaugguuggcgcuaccaugacugacgacaucggcaugggcgugaccuaccucgcucugcuggccgcguucaaggugcggcccaccuuugccgccggccuacugcugcggaaacucaccucgaaggaacucaugauggcuacgauagggaucacgcugcucucccagaguaccaucccggagacuauuuuagagcuuaccgacgcccucgcgcuggggaugaugguucugaagauagugcgcaacauggaaaaauaucagcuugcgguaacaaucauggccaucucgugcguccccaacgccgugauccuccggaacgcauggaaggucagcugcaccaucuuggcggccguguccguaagcccauuacugcugacguccagccagcagaaggccgacuggauuccgcuugcccugacgauuaaggggcugaauccgaccgccauauuccucaccacccugucccguacuagcaagaaacggucauggccgcugaaugaggccauaauggcggucggcauggugucgauacucgccuccagcuugcuuaagaaugacaucccgaugaccggaccccucguggcuggggguuuacuuaccguuugcuacguguuaaccggacgcagcgcggaccuggagcucgagcgggccgcugacgugaagugggaagaccaggccgaaaucuccgggagcucccccauccucagcaucacgaucuccgaggauggaucgauguccaucaagaacgaagaggaggagcagacucugaccauccuuauccgcacuggccuccuggucauuagcggcguguucccgguguccauuccaaucaccgccgccgcuugguaccugugggagguaaaaaaacaacgcgccggcgugcucugggacgugcccucaccgccaccagucgggaaggccgagcuagaagacggcgccuaccgaaucaagcagagggggauacugggcuacagucagauuggcgcgggcguguacaaggaggguaccuuccacaccauguggcacguuacccgcggggcaguacucaugcaucguggcaagcguaucgagcccaguugggccgauguaaagaaagaccugauauccuacgggggaggcuggaagcuugaaggugaguggaaggagggcgaggagguccagguucuagcucuugagcccgggaagaaccccagagccguacaaacgaagccagggauuuucaagacgaauaccgguaccauuggcgcggugucacuggacuuuagucccggcaccagcgggucccccauagucgaccgcaagggcaaggugguaggucucuacgguaacggagucgugacgaggucaggggccuacguaucggcuaucgcccagacagagaagucgauagaagacaauccugagauagaggacgauaucuuccgcaagaagcgacugacgaucauggaccuccaucccggcgcgggcaagaccaagcgcuaccuccccgccaucguacgggaagccauaaagcgcggacugcgaacacugauacuggcaccgacucgaguuguugccgcggagauggaggaagcucuccgcggguuacccauccgguaccagacccccgccaucaaggccgagcauaccggccgcgaaaucguagaccucaugugccacgcgacguucaccaugcggcuucugucgccugugcgcgugccgaauuacaaccuuaucaucauggaugaggcgcacuucaccgacccggccuccaucgcggcccgaggguauauuagcacccgcguggagaugggagaagcagcgggaaucuuuaugacagcgacgccgccaggguccagagacccguucccacagagcaacgcaccgaucauggacgaggagcgcgagauccccgaaagaucuuggaauagcggccacgagugggugaccgacuucaaaggcaagaccgugugguuuguaccguccaucaaggcgggcaacgacaucgcggcaugccuccgcaagaacggcaagaaggugauccaguuaagccggaagacguuugauuccgaguacguaaagacccgcgccaaugacugggauuucguggucacgacggacauuagcgagaugggggcaaacuuuaaagcggagcgagugaucgacccuaggcggugcaugaagcccgucaucuugacggacggugaggagcgcguaauucucgcggguccgaugccggugacccacucuagcgccgcgcaacggcgggggcgcaucgggcggaaccccaagaacgagaacgaccaguacauauauaugggcgagccuuuagaaaacgaugaggacugcgcccauuggaaggaagccaagaugcuccucgauaacaucaacaccccggagggcauuaucccgagcauguucgaacccgaacgcgagaagguggaugcgaucgacggggaguaccggcugcgcggcgaggccagaaaaaccuucgucgacuuaaugcgccgcggcgaccuucccgugugguuagccuacaagguggccgccgaggguaucaauuacgcggaccgcaaguggugcuucgacgggauaaagaauaaccagauccuggaggagaacguggagguggagaucuggacgaaggagggcgagcguaagaagcuuaagccacgcuggcuggaugcccggauuuacucagacccccuagcccucaaggaguucaaagaguucgccgcgggccgcaagucucucacccuaaaccucauuacagagauggggcgauugcccacuuucaugacgcagaaggcacguaacgcauuagacaaucucgcuguacuacacacugccgaggcgggcgggcgggccuacaaccacgcucugagcgagcuccccgaaacccuggaaacccuccuccuucugacgcuccuggccaccguaaccggcggcauauuccuguuccucaugucaggaaaaggcaucggaaagaugacccuggguauguguugcaucaucaccgccagcguacugcuaugguacgcacagauccagccucacuggaucgccgccucaaucauccuugaguuuuuccuaauaguccugcuaauccccgagcccgaaaaacaacgcacgccccaggacaaccaauugaccuauguggucaucgcuaucuugaccguaguggcggcgaccauggccaaugagaugggauuuuuagagaaaacgaaaaaggaccugggccucggcucgauuaccacccaggagagugagucuaacaucuuagacauugaucugcggccugcgucggccuggacucuauaugcuguggcgaccaccuucgugacccccaugcugaggcacaguaucgaaaacuccucgguuaaugucucauugaccgcuauugcgaaucaggccacggugcucauggggcuggguaagggguggcccuuauccaagauggacauaggcgugccuuugcuggcgauuggguguuacagccaggucaacccgaucacccucaccgccgccuugcuccugcucguggcgcauuaugcaaucaucggucccggacugcaggcuaaggccaccagggaagcacagaagcgcgccgccgcggggauaaugaagaacccuacaguggacggcaucacagucaucgaccuggagcccaucccguacgaucccaaguuugagaagcaacucggacaggucauguuauuaauccuuugcgugacgcagguucugaugaugcguacuacaugggcccugugugaggcgcucacccuggccacaggccccaucucuacccugugggagggcaaucccggcagauucuggaacacgaccaucgccgugagcauggcaaacaucuuuagggggucguaccucgccggggccggccuccuuuucagcaucaugaaaaacaccacgaacacgcggcgagggaccggcaacaucggcgaaaccuugggggaaaaauggaagucccggcuuaacgcacucgguaagagcgaguuccagaucuacaagaaaucuggcauccaggagguggaccgcacccucgcgaaggaggggaucaagcgcggggaaacagaccaccacgccgucagcagaggcuccgccaagcugcgcugguucgucgagcgcaauaugguuacaccggagggcaaggucguggaccuggggugcggccguggcggcuggucguacuacugcggcggacucaagaacguccgagagguaaaaggccuuaccaagggcgggccagggcacgaggaacccauccccauguccaccuacggcuggaaccuaguucggcuccaguccgggguugacguguuuuuuacuccucccgagaagugcgacacccugcugugcgauauaggugagagcagccccaacccgaccaucgaggccggacgcacccuccgggugcugaaccucguggagaauuggcucaacaauaacacccaguucugcaucaagguccuuaauccguacaugcccagcgugaucgagaaaauggagacgcugcaacguaaguaugggggcgcccucgugagaaacccccugucccgcaacagcacccaugagauguauugggucuccaacgcgacagguaacauugugagcagugugaauaugaucucacggaugcugauuaaucguuucacgaugaagcacaagaaggccacguacgagccggacgucgaucucggcuccgguacccggaacaucggcauugaaagcgagauccccaaccucgacauaaucggcaagagaaucgagaagaucaagcaggagcacgagaccucuuggcacuaugaucaagaccaccccuacaaaaccugggccuaccaugggucguacgagacgaagcagaccggcuccgccucguccauggucaacggaguggucaggcuccugaccaaaccgugggauguggugcccauggucacccagauggccaugacggacacgacccccuucggccagcagcgaguguucaaggaaaagguggauacacgcacgcaggaacccaaggagggcaccaaaaaguuaaugcggauaacagccgaguggcuguggaaggagcuggggaagaagaaaacgccaaggaugugcacucgggaagaauucacccgaaagguccgaagcaacgccgccuuaggcgccauauucacggacgagaacaaguggaaaagugccagagaggccguggaagacgggagguucugggagcuggucgaccgcgagcgcaaucuucaccucgaggguaagugcgagaccuguguauacaacaugauggggaaacgcgagaaaaagcugggagaguucgguaaagccaaggguucuagagccauaugguacaugugguuaggcgcccgcuuccuggaguucgaggcgcugggguuccugaaugaagaccauugguuuucucggggcaacagccugagcgggguugaaggugagggcuugcacagacugggguacauccuucgagauguuggcaagaaagaaggcggcgcgauguaugccgacgacacggccgggugggacacccgcaucacacuggaagaccugaaaaacgaggagaugguuaccaaucacaugaagggcgagcacaagaaacuugccgaggcgaucuucaaguugacauaccagaacaaggugguccggguccagcggccaacgccccggggcaccgugauggacaucaucucccgccgcgaucaaagagggagcgggcaggucgggaccuauggccugaauacguuuaccaacauggaggcccagcucauccgccagauggaaggcgaggggaucuucaaguccauccagcacuugaccgccaccgaggagaucgccguacagaacuggcuggcccgggugggacgagaacggcucagcagaauggcgaucuccggcgacgacugugucgugaagcccaucgaugaccguuucgcaagcgcuuugaccgcgcuuaacgacauggguaaaguuaggaaggauauccagcaaugggagcccucgcguggguggaacgacuggacccaggucccguucuguagccaccacuuccaugaacucguuaugaaggauggccggguuuuggucgugccuugccgcaaccaagacgaguuaauagggcgcgcucguauaucccagggggcgggcuggagcuuaaaggaaaccgccugccuggguaaguccuacgcgcagauguggacccugauguacuuccaccgccgagaccuccgcuuggccgcuaacgcgaucugcagugcggugccaucccacugggucccuaccagucgaacuaccuggaguauacaugccaaacacgaguggaugaccaccgaagacaugcuggccguguggaacagaguuuggauccaagagaacccguggauggaggacaagacucccgucgagagcugggaggaagugcccuauuuggggaagcgggaggaccaguggugugggucgcugauaggacugaccagcagagcgacgugggccaagaauauccagacugccaucaaccaggucagaagucucaucgggaacgaggaguauacggacuacaugccuaguaugaaacgguuccgccgggaagaggaggaggcuggcgucuuaugguaa

SEQ ID NO: 25281 - RNA, 9876 nt, Artificial Sequence
  derived and/or modified CDS sequence (opt11) from DENV-2__FJ639733__SS-prME
accgcaggcgugaucaucauguugaucccaacagccauggcguuccaccucacgacccgaaacggggaaccucacaugaucgucggccggcaggagaaaggaaagucacucuuauucaagacugaggacggcgugaacaugugcaccuugauggccauugaccuuggcgaacugugcgaggauacuaucaccuacaaguguccccuccuucggcaaaacgaaccagaagacaucgauugcuggugcaacucgaccucgacauggguuaccuacgggaccugcaccaccacgggcgagcacaggcgugaaaaacggaguguggccuugguaccccacgugggaaugggccucgagacccggaccgaaacauggaugagcuccgagggugcauggaagcauguccaacggauugagacauggauacugcgccaccccggcuucaccaucauggccgcgauccuggccuacaccaucgggaccacucacuuucaacgagcccucaucuucauacugcugaccgcgguggcgcccuccaugaccaugcgcuguauaggcauauccaaccgagacuuuguggagggcgucucgggcggcuccuggguggacaucgugcuugagcaugguucaugcgucacuacgauggccaagaacaagcccacuuuggacuucgagcucaucaaaacugaggccaagcagcccgcgacgcuccgcaaguauugcaucgaggccaaacucacaaauacaacgaccgagucgcggugcccgacgcagggcgagccaagccugaacgaagagcaagacaagcgcuuuauaugcaaacauuccauggucgaccgagguuggggcaacggaugcggacuguucggcaaaggcgggauuguaacuugugcgauguucacgugcaagaagaacauggaaggcaaaguugugcagcccgagaaccucgaguacaccaucgugaucacgccccacucaggggaggagcacgccguugggaaugauaccgggaagcauggaaaggagaucaagaucaccccgcaguccagcaucacggaggccgagcugaccggauacggcacggugacuauggagugcucuccucgaaccggccucgauuuuaaugagaugguccugcuucagauggaggacaaggccuggcucguccaccggcaaugguucuuggacuugccccuccccugguugccgggugccgacacgcagggcagcaacuggauccagaaggaaacucugguuacguuuaagaauccccacgcgaagaagcaggacguggucguccucggcucccaggagggcgccaugcauacggcccugaccggggcgacggagauccagaugagcagcggaaaucuccuuuucaccggccaccugaagugccgccugcgcauggacaaacuucaguuaaaggguaugaguuacagcaugugcacuggcaaguucaagauagugaaggagauagccgagacccagcacgggaccaucgugauucgcgugcaguacgagggcgacgguucccccugcaaaaucccuuucgagaucaccgaccuggagaagcgacacguccuaggucgccugaucaccguuaacccaaucgugaucgagaaagacagcccugucaauaucgaagcugagccgcccuucggugacuccuacauuaucaucggaguggagcccggccaauuaaaguugaacugguucaagaaggguucuaguauagggcagauguucgaggcgacaaugcgcggggccaagcggauggccauccugggggacacggcaugggauuucggaaguuugggcggagcguucacgucgaucgggaaagcacuacaccaaguguucggggccaucuacggcgccgccuucucuggcguauccuggaccaugaaaauccugauaggcguggugauaacuuggauuggaaugaacagccgcuccacuagccugagcgugagccucguacucgucggcgucgugacacuuuaucugggugcuauggugcaagccgacuccggaugcgucgugagcuggaaaaacaaggaguugaaaugcggaaguggaaucuucaucaccgacaacguccacaccuggacggagcaguacaaguuucagccagagucgcccagcaagcuggccuccgccauccagaaggcgcacgaggaggguaucugcgggauccggagcguaaccaggcuugaaaaccucauguggaaacagaucacccccgaacuaaaucacauccuguccgaaaaugaagugaagcucacgauaaugacgggggauacgaaggggaucaugcaggccggaaaacggucuuugcgcccacagccaacagaacugaaguauucauggaagaccugggggaaggccaagaugcucagcacggaaucccacaaucagaccuuccugaucgacgggccugagacagcagaguguccuaacacuaaccgggccuggaacagccuggagguggaggacuacggauucgggguauucacaacaaacauauggcucaagcugcgcgagaagcaggacguguucugugacuccaaauugaugagcgccgccaucaaggacaaccgcgccgugcaugcugacaugggcuacuggaucgaguccgcacucaacgacaccuggaagauggagaaggcgucguucauugaagucaaguccugccauuggcccaaaagccacacccuauggaguaacggcguccucgagagcgagaugaucauccccaagaacuuugcgggacccgugucccagcacaacuaccggccgggguaccauacacagacggcugggcccuggcaccugggcaagcuggagauggacuucgacuucugcgaggggaccaccgucguuguaaccgaggauugcggcaacaggggccccucgcuaagaacuaccaccgcuucagggaaguugauuaccgaauggugcugucgguccugcacguuacccccccugagguaccgaggugaggacggcugcugguacggcauggagauacgcccccucaaggagaaagaggagaacuugguuaacucacucgugacagcggggcacggacagaucgauaacuucucauugggcguguuggggauggcccuauuccuggaggagaugcugaggacccgcgucggcacaaagcacgccauucuacucguggcuguuucuuucgucacgcugaucaccgggaauauguccuuucgugaccugggucgggugauggugauggucggcgccaccaugaccgaugacauuggcaugggcgucacguaucucgcgcugcuagccgccuuuaagguaaggccaacauucgcugccgggcuccugcuccggaagcuaaccagcaaggagcugaugauggccaccauuggaaucacgcugcucucucagagcacgauacccgagacaauccuggaguuaacggacgcccucgccuuaggcaugaugguccugaagauugugcgcaagauggagaaguaucagcucgccgucacgaucauggccaucuccugugucccgaacgcggugauccugcggaacgccuggaagguuuccugcacuauucucgccgccgucucggugagcccacuccuucugacauccagucagcagaaagcggauuggaucccccucgcccugacaauaaagggccuaaaccccacugccaucuuccucaccaccuugucacgaacgagcaagaagcgauccuggccgcuaaacgaagccaucauggccgucggaauggugucaauacucgcguccucacugcuaaagaacgacaucccgaugacgggcccccuaguggcaggcggccugcugacugucugcuacgugcucaccggccgcagcgccgaccuggaacuggagcgggccgccgauguuaagugggaggaccaggccgagaucucaggguccagucccauacucucgauuacgaucuccgaggaugguagcauguccaucaagaacgaagaagaggagcagacucugaccauccuuauccgcacuggucuacugguuaucagcggggucuucccaguguccauacccaucaccgcugcggccugguaccugugggaggucaagaagcaacgggccggcguucuuugggacgugccuagcccgccgcccgucgggaaagcggagcuggaagacggcgcguaccgaaucaagcaaagagggauccuggguuacucgcagauuggcgccgggguuuacaaggagggcaccuuccauacgauguggcacgugacucgcggcgcagugcucaugcaccgggggaagcguaucgagcccagcugggcagacgugaagaaagaccugauaagcuacgggggcggauggaagcuagagggcgaauggaaggagggcgaggaggugcaaguccuugcgcuggagcccgggaaaaacccgcgggccgugcaaaccaaaccagggaucuucaaaacgaacacugggacgauaggcgccgugagccuggauuucagucccggcacaagcgggucccccauagucgaucgcaagggcaaggugguaggucuauacggcaacggggucgucacccggucuggagccuauguauccgcgaucgcccagacugagaagucaaucgaggacaaccccgagaucgaggacgacauuuuccggaagaagcggcugacuaucauggaccuucacccaggcgcagguaaaacgaaacgcuaccucccugccauuguucgugaggcuaucaagcguggccuucgcacucugauccuggcgcccacgcgcguaguggccgcugagauggaggaggcucuccgcgggcugcccauccgauaccagaccccggccaucaaggcggagcauaccggccgcgagaucguugaucugaugugccacgcuaccuucacgaugcggcucuuaucccccguccgcgucccuaauuacaaccugaucaucauggaugaggcccacuucaccgaccccgccucaaucgcggcucguggcuacaucagcacuagggucgagaugggggaggccgccggcauauucaugacggcuacgccgcccgggucucgggacccguuuccgcagagcaacgcgcccaucauggacgaggagcgcgagauccccgaaagaucguggaacagcggccacgaguggguuaccgacuucaaggggaaaacugugugguucgucccuuccaucaaggccggcaacgacauagccgccugccuccgcaagaacgguaagaagguaauccaacugucacggaaaacauucgacuccgaguacguuaagacacgagcgaaugauugggacuucgucgugaccacugacaucagcgagaugggagcuaacuucaaggccgagcgggugauagacccgcgccguugcaugaagccggucauucuuaccgacggcgaggagcgcgugaucuuagccgggccgaugccaguaacgcacuccagcgccgcgcagcgucguggccgcauaggaaggaaccccaagaacgagaaugaccaguauaucuacaugggcgagccccuggaaaacgacgaggacugcgcacacuggaaagaggcgaagaugcugcucgacaauaucaacaccccggaggggaucauaccguccauguucgagccggagcgggagaagguggacgccaucgauggggaauaccgacugcgcggcgaggcccggaagacuuuuguggauuuaaugagacgcggggaccugcccguuuggcuggccuacaaagucgcagccgagggcaucaacuaugccgaccgcaaauggugcuucgacgggauaaagaauaaccagaucuuggaagaaaacguggagguggaaaucuggaccaaggagggcgaacggaagaaacucaagccucgcuggcucgacgcgcggaucuacuccgacccgcuggcgcucaaggaguuuaaggaauucgccgccgggagaaagucacucaccuuaaaccuuauaaccgaaauggggcgacugccaaccuuuaugacccagaaggcccgcaacgccuuagacaaccuugcgguccugcauacggcugaagccggcgggcgggccuacaaucacgcccugagcgaacuccccgagacccucgaaacccuucuccuccugacccucuuggcuaccgucaccgggggcauauuccuguucuugaugagcgggaagggcaucgggaaaaugacacuggggaugugcugcauaauaaccgccagcguacuguuaugguacgcccagauucaaccgcacuggauugccgccuccaucauccuagaguuuuuccugaucgugcuccugauccccgagcccgagaaacaacgcacgccccaagacaaccagcuaacguacguugucauugcgauccucaccgugguggccgcaaccauggcgaaugagaugggguucuuagagaaaaccaagaaagaccucggcuuaggaagcaucacaacccaggaaagcgagucuaauauucuggacaucgaccuccggccggccagugcguggacgcucuaugcugucgcaacaacguucgugacccccaugcugcgacauucgaucgagaacagcuccguuaacguaucacugaccgccauagcgaaccaggcuaccgugcucauggggcugggcaagggguggcccuuguccaagauggacauugggguuccauugcuggcaauugggugcuacucucaggucaacccaaucacgcugaccgcagcccuucuccuguuaguggcgcacuaugcgauuaucggcccuggauugcaggcgaaggccacacgggaggcccagaagcgcgcggccgccgggaucaugaagaaccccacuguugacggcaucaccgucauagaccuugagcccauccccuacgacccaaaguucgagaagcagcugggucagguaaugcuguugauacucugcgugacccagguccugaugaugcggacaacuugggcccuaugcgaggcccucacgcuugcaacaggccccaucuccacccugugggaggggaaccccgggagauuuuggaacacuaccauagccguaagcauggcaaacaucuuccgcgguuccuaccucgccggagcgggccugcuguucagcauuaugaaaaacacaacaaacacccggcgcgguacgggcaacauaggggaaacccucggugagaaauggaagucacgccugaacgccuuaggcaagagcgaguuccagauauacaagaaauccggaauacaggaaguggaccgcacucucgccaaggaaggcaucaaacgcggggagaccgaucaccacgccguuagccgcggcagcgcaaagcuucguugguuugucgagcggaacaugguaacgccggagggcaaaguaguugaccuggggugcgggcgagggggguggucuuauuacugcggggggcugaagaacgugagagaggucaaagggcugaccaagggcggaccuggccacgaagaacccauccccauguccacuuauggcuggaaccuggugcggcuccagucaggaguugacgucuucuucaccccgccggaaaagugcgacacgcuucuaugugacauaggcgaaagcagucccaaccccaccaucgaggcgggccggacguugcgugugcuaaacuuaguagagaacuggcucaacaacaacacccaguuuugcaucaaaguccucaacccauacaugcccagcguaaucgagaagauggagacccugcagcgcaaguacgggggcgcccucgugcggaacccacugucccgcaacagcacgcacgaaauguacugggugucuaaugccacggggaacauagugagcuccguuaauaugaucucacguaugcugaucaaucgcuucaccaugaagcauaagaaagccaccuacgagccggaugucgaccugggcuccgggacgcggaacaucggcaucgagagcgagauucccaaucuugacaucaucggaaagcgcaucgagaaaaucaagcaggagcacgagaccuccuggcacuacgaccaagaucaccccuauaaaacaugggcuuaucacgggagcuaugagacaaagcagacggguuccgccaguaguauggugaacggcgucgugcgauugcugacgaagcccugggauguagucccgauggucacucagauggccaugacugacacgacgcccuucgggcagcagcgugucuucaaggagaagguggauacccggacgcaggagcccaaggaaggcacaaagaaacucaugaggauuacggccgaauggcuguggaaagagcugggcaagaagaaaacgccccggauguguacccgggaggaguuuacgcgcaagguccggagcaaugccgcccucggcgcaaucuuuaccgacgagaacaaguggaaguccgcccgcgaggcaguagaggaugggcgguucugggaacugguggauaaggaacgcaaccugcaucucgagggaaaaugugagacgugcgucuacaauaugaugggaaagcgggagaagaagcugggcgaguucgguaaggcuaaggggagcagagcgaucugguacauguggcugggggcccgauucuuagaguuugaggccuugggguuccuuaacgaagaccacugguucucgaggggcaacagccuuucggggguagagggcgaaggacugcacaggcuuggguacauccuccgagacgucgggaaaaaggagggcggggccauguacgcagacgacaccgcugguugggacacacggaucacgcuggaggaccugaaaaacgaggagauggucaccaaucauaugaagggcgaacacaagaaguuagccgaggccaucuucaagcucaccuaccagaacaaggucgucagggugcagcggccgacgccccgcggcaccgugauggauauaauaucccggcgcgaccagcgcgggagcggccaggucggaaccuacggccuaaacaccuucacgaacauggaggcacaguuaauacggcagauggagggugaagggauauuuaagucaauacagcaccugaccgccacugaggagaucgcgguucaaaacuggcucgcccgcguaggccgggagagacucagccgcauggccauaaguggggacgauugcguggucaagccaauagaugaucgcuuugcgagcgcacucacagcccuuaacgacaugggcaaagugcggaaggauauucaacagugggagccgucccgcggguggaacgacuggacacagguaccguucugcagucaccauuuccacgaguuggucaugaaggacgggcggguuuuggucguuccuugccgaaaccaggacgaacugaucggccgugcucgcaucucucagggcgccggguggagcuuaaaagaaaccgcuugccugggaaaguccuaugcccaaauguggacgcucauguauuuccauaggcgcgaucuacggcuggcagcaaacgccaucuguagcgccgugccaucccacugggucccaaccagccguaccacuugguccauccacgcgaaacacgaguggaugacaaccgaggacaugcucgccgucuggaaucggguguggauacaggagaacccguggauggaggacaagaccccuguagaaagcugggaggagguccccuaccucgguaagcgagaggaccaauggugcgggucccugaucggccugacgagccgggccaccugggccaagaacauucagaccgccaucaaccagguuagaagccuuaucggcaacgaagaauacacagacuacaugcccuccaugaagcgcuuccggcgcgaggaggaggaagcggggguacugugguga

SEQ ID NO: 25282 - RNA, 9876 nt, Artificial Sequence
  derived and/or modified CDS sequence (opt11) from DENV-2__FJ639734__SS-prME
acggccggggucauaguaaugcugauccccaccgcuaucgcguuccaccucaccacccggaacggggaaccccauaugaucgucggucggcaagagaaagggaagagucuguuguucaagaccgaggauggcgugaacaugugcacguuaauggccaucgaucuaggggagcuuugcgaagacacaaucaccuauaagugcccccuauugcggcagaacgagcccgaggacaucgacugcugguguaauagcaccagcaccuggguuacguacgggaccugcacgaccacgggagagcaucgcagggaaaagcggucaguggcccugguaccccacgugggaaugggccucgagacccgcaccgagacguggaugucgagugaaggggccuggaagcacguucagcggaucgagaccuggauccuccgacacccaggguucaccauaauggcggcgauccuggccuacacaaucggcacaacgcauuuccagagagcccucauuuucaucuuacugaccgccguagcgcccagcaugaccaugcguugcaucggcauaucgaaccgagacuucguggagggcgugucagggggcuccugggucgauaucguccuggagcacgggagcugcgucaccacgauggccaagaacaagccaacgcuggacuucgaauuaauaaagaccgaagcuaagcagcccgccacuuugcgcaaauauuguauagaggccaaacugacaaacacaaccacugagucccggugucccacccagggcgagcccucuuugaacgaggagcaagacaagcgcuucaucugcaagcacuccaugguggaccgggguugggggaacggcugcggccuauucgguaagggcgggaucgucaccugcgcgauguuuacgugcaagaaaaacauggaaggaaagguagugcaaccugaaaacuuggaguacaccaucgucauuacgccgcauagcggagaggaacacgccgucggcaacgacaccgggaaacacggaaaggaaauuaagaucaccccgcaguccagcaucaccgaggccgagcugaccggguacggcaccgugaccauggaaugcagcccccggacggggcucgauuuuaacgagaugguauugcugcagauggaggacaaagccuggcugguccacagacaaugguuucuggaccugccccucccguggcugccgggcgccgacacgcaaggcagcaacuggauucagaaggaaacgcuggugacguucaaaaauccccaugcgaagaagcaggauguagucguucucgggucccaagagggugcuaugcauaccgcccugaccggggcgacggagauccagaugagcagcggaaacuugcuguucaccggccaccucaagugccgccugcgaauggauaagcuccaacuaaaagggauguccuacucaaugugcacaggcaaguuuaagaucgucaaggaaauagccgagacccaacacgggacaauagugauccgagugcaguacgagggagacggcucccccugcaagauccccuucgagaucacggacuuagagaaacggcacguucucggucgccugaucaccgugaacccgaucguaaccgaaaaggauaguccggugaacauugaggccgagccgcccuuuggcgacuccuacauuauuaucgggguugagccgggccagcuuaagcuaaacugguucaagaaggguucuucgaucggccagauguucgagacgacuaugcgcggcgcaaaacggauggccauucugggggauaccgccugggacuucggcagccucggaggcguauucaccucgaucgggaaggcccuccaccagguguucggggcaaucuacggcgcagccuucagcgggguuucuuggacgaugaagauccugaucggggucguaaucacuuggaucggcaugaacagccgcuccaccagccugucugucagccugguucugguaggcgugguaacacuguaccuuggagccauggugcaggcggacuccgggugcguugucagcuggaaaaauaaggagcucaagugcggcuccggcaucuucauaacggacaacguucauacuuggacagagcaguacaaguuccaaccagaaagcccuucgaagcuggccuccgccauccagaaggcucaugaagaaggcaucugcggaauccggagcgucacgcgcuuagaaaaucucauguggaaacagaucacgccggagcugaaccauaucuuauccgagaacgaggucaaacucaccauuaugaccggugacacuaaggggauaaugcaggccgguaagcguucuuuacgcccgcaacccacggagcugaaauacucuuggaaaaccugggguaaagcgaagauguuauccaccgagucgcacaaccaaacguuccugaucgacggacccgagacggcggagugcccgaacacuaacagggcguggaacagccuugaggucgaggacuacggguuugggguguuuaccacuaauaucuggcucaagcuccgagagaagcaagauguuuucugugauucgaagcugaugagcgccgcaauuaaggacaaccgggcuguucacgccgacaugggcuacuggaucgaguccgcccuaaacgacaccuggaaaauggagaaggccagcuuuaucgagguaaagucaugucacuggccgaagagccauacgcugugguccaacggcgugcuggagagcgagaugaucauuccaaagaauuucgccgggccggugagccaacacaacuacagaccgggcuaccauacgcaaaccgcggggcccuggcaucucggaaagcuggagauggacuucgaucuuugugaggggacaacgguggucgugacugaggacugcgguaaccgaggccccagccuccgcaccaccacggcuagcgggaagcugaucacagaguggugcugccgguccugcacccugcccccacuccgcuaccggggcgaggaugggugcugguacggcauggaaauucgcccgcuaaaagaaaaggaggagaaccuggugaacagccucguuacugccgggcauggccagaucgacaacuucuccuugggcgugcugggaauggccuuguuccuugaggagauguugcgcacgcgcguuggcaccaagcacgcuauccuccuggucgcagugagcuuugugacccuaauuaccgggaacaugaguuuccgggaucucggucgcguuauggugauggugggcgccacgaugacggaugacauaggcaugggcgucacauauuuggcgcuguuagccgcguucaaaguccgcccuacguuugcagccggucugcugcuccggaagcugacuucuaaggagcugaugauggccaccaucgggaucgcccuccucucccaguccaccauacccgagaccaucuuagagcucacagacgcgcuggcccuggguaugauggugcucaagaucguccggaacauggagaaguaccagcuagccgugacgauaauggccaucuccugcgugccgaacgccgugauccugaggaacgcguggaaaguuagcugcaccauacuagcugcggucuccgugucuccccugcuccuuaccucgucccagcagaaggccgacuggaucccccuggcucugacgauuaaggggcuuaacccaaccgcuaucuuucucaccacauuaucccgcacaagcaagaaacggagcuggccucucaacgaggccaucauggccgucgggaugguguccauacuggcaagcagucuccucaagaaugacauccccaugaccgguccucugguagcuggagggcugcucacuguguguuauguccuaaccggccggagcgccgaccuggaguuagagcgggcugccgaggugaagugggaagaccaggcggagauaucgggaagcagcccaauccugucgaucacaauuuccgaagauggcuccauguccauaaagaacgaggaggaggagcagacccucacuauacucauccgcacaggccuacucgugauaagcggggucuucccggugucgauccccauuaccgccgccgccugguaccucugggaggugaagaagcaacgggccggaguccugugggaugugcccuccccuccgcccguagggaaggccgagcucgaggacggcgcguaccgcaucaagcagcgcgggauccucgguuacucccagaucggcgccggcguauauaaagaggguaccuuccauacuauguggcacgugacuaggggggcgguguugaugcaucguggcaagcgcaucgagcccagcugggccgaugucaaaaaggaccugaucuccuaugggggcggcuggaaguuggagggagaguggaaagagggcgaggagguccaggugcuggcccuggagcccgggaaaaaccccagggcgguucagaccaagccuggcauuuucaaaacgaacaccgguacaaucggcgccgugucgcucgauuucucccccggaacuagcgguucccccaucguggaccgcaagggaaaggugguggggcuguacggaaacggaguggugacgcggagcggggcauaugucagcgcaauagcccagacggaaaagucgaucgaagacaaccccgagaucgaggaugauaucuuucguaagaagagacugaccaucauggaccuccaccccggcgccgggaagacuaagcgcuaccugccugccaucguccgcgaggcaaucaagcgcggucugaggacacugauccuggcaccgacucgaguuguugcggccgagauggaggaggcccuucggggguugccaauucgguaccagaccccagcuaucaaggccgagcacacaggacgcgagauuguggacuugaugugucaugcgacguucacgaugaggcugcuuagccccguucgcgugccgaacuacaaccugauuauaauggacgaggcccacuucaccgaccccgccuccauagcugcccggggcuacauuaguacccgcguggagaugggggaggcggcgggcaucuuuaugacggcuacgccgcccgggagcagggacccguuuccccaaagcaacgcacccaucauggaugaggaacgcgagauaccagaacgcucguggaacagcggucacgagugggucaccgacuucaaggggaagacugugugguucgugccguccaucaaggcgggcaacgacaucgcugccugccugcgcaagaacggcaagaaaguaauccagcugucucgaaagacguucgacagcgaauacgugaagacgcgggccaaugacugggacuucgugguuaccaccgauaucagcgagaugggggccaacuucaaggcggaacgggugaucgauccccgccggugcaugaaaccugugauuuuaaccgauggcgaagagcgcgucauccuggccgguccuaugccagugacccacuccagcgccgcgcagcggagagggagaaucgggcgcaacccuaagaaugaaaacgaccaguacaucuacaugggcgaacccuuagagaaugaugaggacugcgcacauuggaaagaagcaaagaugcuccuagacaacauuaauacaccggagggaaucaucccguccauguucgagcccgagcgcgaaaagguggacgcuauagacggagaguaccgguuacgcggcgaggcuagaaagacguuugucgaccucaugcgacgcggggacuugccugucuggcuggcauauaaggucgccgcggaggguauaaacuacgccgaccgcaagugguguuucgacgggaucaagaacaaccagauacucgaggaaaacgucgagguggaaauauggacuaaagaaggcgaacggaaaaagcugaaaccucgcuggcuggacgcccggaucuacuccgacccauuagcccugaaggaauucaaggaguucgcggccggcagaaagucccugacacucaaucucaucacugagaugggucguuugccgacguucaugacgcaaaaggcccgcaacgcacucgacaaccuggccguccugcacaccgccgaagccggcggccgggcuuauaaccacgcacucuccgagcugccggaaacuuuagagacccuucugcugcucacccuacuagccaccgugaccggaggcaucuuccuguuccugauguccgggaagggcauugguaagaugacccuggggauguguugcaucaucaccgcgagcguacuccuaugguacgcacagauccagccucauuggaucgcggcuagcauuauucuggaguucuuccugauugugcugcugaucccugaaccggagaagcaacgcacaccccaagauaaccagcucaccuacguuguaaucgccauccugaccgucguggcugccaccauggccaacgagaugggguuccucgagaagacaaagaaggaucucgggcugggcagcaucaccacccaggagagcgaguccaacauccuggacauagaccucaggccggcaagugccuggacccuguacgcgguggccacuaccuucgugacccccaugcucaggcauuccaucgagaacagcucggugaaugugagccucaccgcgaucgccaaccaagcuaccguacucaugggguuaggcaaggguuggccccuguccaaaauggacaucggcguaccccugcucgcaauagggugcuacagccagguaaacccgaucacccucaccgccgcgcuacugcucuuagucgcgcacuacgccauuaucggccccggccuucaggcgaaggcaaccagagaggcccagaagagggcagcggcggguaucaugaaaaaccccacgguggacggaaucaccgugaucgaccuggaacccauuccauaugaccccaaguuugaaaagcagcuggggcaggucaugcugcuuauacugugcguaacccagguguuaaugaugcguacaacuugggcccucugcgaggcccugacacuggcaacaggacccauuucgacccugugggaggggaaucccggccguuucuggaauacgaccaucgcgguuucgauggccaacaucuucaggggcagcuaucuggccggggccggccuucuauuuaguaucaugaagaauaccaccaacacgcggagaggcaccggcaacaucggcgaaaccuuaggggagaaguggaagagccggcuuaacgcguuaggcaaaagcgaguuucagaucuauaagaaguccgggauacaggagguugacagaacauuagcuaaagaggguauuaagaggggagaaacggaccaucacgccgucucacgcggcuccgccaaacugcggugguuuguggaacgcaacauggugacucccgaaggcaagguggucgaccucgggugcggccgggggggauggagcuauuacugcgggggccuuaagaacgugcgcgagguuaagggacuuaccaagggugggccuggucacgaggagccgauacccauguccacauacggcuggaaucuuguccgacuacagucggggguggacguguucuucacuccgcccgaaaagugcgauacccugcugugcgacaucggcgagagcucccccaacccaaccauagaggccggccgcacccugagaguccugaaccuaguggagaacuggcuaaacaacaacacucaauucugcauuaaagugcugaauccguacaugccuagugucaucgagaaaauggagacgcuacagcgcaaauacgggggcgcgcugguacggaauccucugucccgcaacagcacccacgagauguacuggguguccaacgccaccgggaauaucguuagcagugugaacaugauaagccggaugcugaucaauagauucaccaugaagcauaagaaagccacuuaugagccggaugucgacuugggcucugggacccgcaacaucgggaucgagagcgagaucccaaaccuggacauaaucggcaaacgcauagagaagaucaagcaggagcacgagaccuccuggcauuacgaccaggaucaccccuacaagaccugggccuaccacggaucguacgaaacaaagcagaccggcuccgccucguccauggucaacggggucgugcgccuucugacgaagccaugggacgugguuccaauggugacacagauggccaugacggacaccacccccuucggccagcagcgcguauuuaaggagaagguggacaccaggacccaggagcccaaggagggcaccaagaagcugaugaagaucacggcagaauggcuguggaaggaacucgggaagaagaaaacgcccaggaugugcacaagggaggaguucacccgcaagguacgcagcaacgccgcccugggcgccauauucacugacgaaaacaaguggaagucagcacgggaggccgucgaggacgggcgguuuugggagcugguagaccgggagaggaaccuccacuuggaggggaagugcgagacgugcgucuacaacaugauggggaagcgggaaaagaaacucggggaguucgguaaggccaaagggagccgagcgaucugguacauguggcuaggugcuagauuccuggaguucgaggcccuaggguuccucaacgaggaccauugguucucccggggcaacagccugagcgggguggagggugagggccugcaccggcucgguuacauccugcgcgaugugucgaagaaggaaggcggcgccauguacgcagacgacacggccggaugggacacccgaauuacccuagaggaccucaagaaugaggaaauggucacaaaccacaugaagggggagcauaaaaagcuagccgaggccaucuucaagcuaacauaucaaaacaagguggugcgcguccagcggccgacgccccguggcaccgugauggauaucauaucacgacgugaccagcgugguuccggacaggucggaacuuacggauuaaacacguucaccaauauggaggcucaacugauccggcagauggagggugagggcauauucaaaaguauucagcaccuuaccgccacugaagaaauugcaguccaaaacuggcuggcucgcguagggagagaacgccucucacggauggcaaucucuggugacgacuguguggucaagcccauugacgaccgcuucgccuccgcccuaacggcgcucaacgauauggguaaggugcggaaggacauucagcagugggagcccagcaggggcuggaacgauuggacccaggugccguucugcagccaccacuuccacgagcuggucaugaaggacgggcgggcgcugguggugcccugccgaaaccaagacgagcucaucggccgggcgaggacuucccagggugcgggcuggucccugaaggagaccgccugccugggcaagaguuacgcccaaauguggaccuugauguacuuccaucggcgagaccugaggcuggccgcuaacgccaucugcuccgccguuccuagucacuggguuccuacgucacgcaccaccuggagcauacacgcgaagcacgaguggaugaccacggaggacaugcucgccguuuggaacagggucuggauccaggaaaacccuuggauggaggauaagacacccguggagucuugggaagaggugcccuaccugggcaagcgcgaggaccaguggugcgguagccugaucgggcucaccagccgugcgacaugggcuaagaacauccaaacggcaaucaaccagguccgcucccuaaucggcaacgaggaguacaccgauuacaugcccuccaugaagcgcuuucgaagagaggaggaggaggcaggcguacugugguga

SEQ ID NO: 25283 - RNA, 9876 nt, Artificial Sequence
  derived and/or modified CDS sequence (opt11) from DENV-2__JN819408__SS-prME
accgccggcgugaucguuaugcugauccccaccgccauggccuuccaccucaccacaagaaacggggagccccacaugaucgugggacgacaggaaaaggggaagucccugcucuucaagaccgaggacggcgugaauaugugcacccuuauggccauagaccugggggagcugugcgaggacaccaucaccuacaaaugcccccuccugcggcagaacgagccggaagacaucgauugcuggugcaacagcaccagcacaugggucacguacgguaccuguacgaccacgggcgagcaccggcgugagaagcgguccguggcgcuggugccacacgucgggauggguuuggagacccgcaccgagaccuggaugagcuccgagggagcuuggaagcacgugcagcggaucgaaacguggauccuccggcacccgggcuuuaccaucauggccgcgauccuggccuacacuauugggaccacgcacuuccagcgggcccucaucuucauccugcucaccgcaguggcgcccucuaugaccaugcgcugcauaggcaucagcaaccgggacuuugucgaaggggugagcgggggguccuggguggauaucguccuagagcacgggagcugcguuaccacgauggccaagaacaagcccacccuggacuuugagcugaucaagacagaggcgaagcagccagccacccuccgcaaguacugcaucgaagccaagcugacgaacaccaccaccgagucgcgguguccgacgcagggugagcccagccugaaugaggagcaggacaaacgcuuuaucugcaagcacucgaugguggacagaggcuggggcaauggcugcggucuguucggaaagggugggaucgugacaugugcgauguucacgugcaagaagaacauggagggcaaggucgugcaacccgaaaaccuagaguacacgaucgucauaacgccacacucaggugaggagcacgccgugggcaacgacacagggaagcacggcaaggagauaaagaucaccccgcaguccagcaucaccgaggccgagcugaccggcuacggcacggugaccauggaguguucaccgcggaccggccucgacuucaaugaaaugguccuccugcagauggaggacaaggccuggcucgugcaccgacagugguuccuggaccugccacucccuuggcugccgggggccgacacccagggcucaaacuggauacagaaagaaacgcuggugaccuucaaaaacccccacgccaagaagcaggacguaguggugcuugggucccaggagggcgccaugcacacagcccugaccggggccaccgagauccagaugaguagcggcaaccuccuguuuacgggccaccugaagugccgccugcggauggacaagcuccagcugaagggaaugucuuauagcaugugcaccggcaaguucaagaucgugaaggagaucgccgagacgcagcacgggacgaucgucauucgcguccaguacgagggagacggcuccccuuguaagaucccguuugaaaucaccgaccuggaaaaacggcacgugcucgggcgucucaucaccguuaacccgaucgucaccgagaaagauagccccgugaacaucgaggcagaaccacccuuuggcgacuccuacaucaucaucgggguggagccgggucagcugaagcucaacugguucaaaaagggcagcucuaucggccagauguuugagacgaccaugcguggcgccaagcggauggccauccugggggauacagccugggacuucgggagccucgguggggucuucaccuccaucgggaaagccuugcaccaaguguucggggcgaucuacggcgccgccuucagcggcgugucuuggacgaugaagauacugaucggcgucaucaucaccuggaucggcaugaacagccgcuccacgagccuguccguuagccuagugcucgucggcguggugacgcuguaccugggggccaugguccaggcggacuccgguugcgugguguccuggaaaaacaaggagcucaagugcggcuccgggaucuucaucacggacaacguccacaccuggaccgagcaguacaaauuccagcccgagucucccagcaagcuggccuccgccauccagaaagcccacgaggagggcaucugcgggaucagguccguaacccgccuggagaaccucauguggaaacaaaucacgcccgaacugaaccacauccuguccgagaacgagguuaagcucacaaucaugacaggggacaccaagggcaucaugcaggccggaaagcggaguuugcgcccgcaacccacggagcugaaguacuccuggaagaccuggggcaaggcgaagaugcucuccacagagagccacaaccagaccuuccugaucgacgggcccgagacggcugaaugcccgaacaccaaccgggccuggaacagccuggaggucgaggacuacggcuucgggguguucacuaccaacaucuggcucaagcugcgcgagaaacaggacaucuucugcgacucaaaacugaugagcgcagccaucaaggacaaccgggccgugcaugccgacaugggcuacuggaucgaguccgccuugaaugacaccuggaagauggagaaggccagcuucaucgaggucaagucgugucacuggcccaaaagccacacgcuguggucgaacggcguguuagaaagcgagaugaucaucccuaagaacuucgccgggcccgugagccagcacaauuaucgcccggguuaccacacccagaccgcagggcccuggcauuugggcaaguuagagauggacuucgauuucugcgaggguaccacggucguggugaccgaggacugcggcaaccggggccccagucuuaggaccaccacggccagcgggaagcucaucaccgaguggugcugucggucuugcacccugccaccacugcgcuaccggggcgaggacggcugcugguacggcauggagauccgcccccuuaaggagaaggaggaaaaccuggucaacagccugguuacagcgggucacggccagauugacaacuucucccucggcgugcuggggauggccuuauuccucgaggagaugcugcggacccgcgucggcaccaagcaugcgaucuuacucguagccguauccuucgucacgcugaucaccgggaacauguccuuccgggaucugggccgcgugauggugauggugggggcuacaaugaccgacgacauuggcaugggcgugaccuaucuagcacugcuggcagccuucaagguccgccccaccuucgccgcugggcuacugcugcggaagcucacgagcaaggaacugaugauggcgacgaucggcaucgcccugcuaucccaguccacaauuccggaaaccauccuggagcugacggacgcgcucgcgcuggggaugauggcccuuaagaucguccgcaacauggagaaguaccaacucgccgugaccauaauggccaucuccugcgugccgaacgcggucaucuuacagaacgccuggaaagucagcugcaccauccuggccgccgugagugucagcccacuccugcugaccuccagccagcagaaggcggacuggauuccccuggcccugacgaucaagggcuuaaaucccacagcgaucuuucucaccacucugucccgaacgagcaagaagcguagcuggccgcugaacgaggccaucauggccguggguauggucagcaucuuagcuuccagccuguugaagaacgacauccccaugaccgggccccucguggccggcgggcugcugaccgucuguuacguccucaccggccggagcgcugacuuggagcuggagcgcgccgccgacgugaagugggaggaccaggcggagaucagcgggagcuccccaauccucagcaucacgaucucugaggacggcagcaugagcauaaagaacgaggaggaggagcagacccuuacuauucugauccggaccggccuccuggugaucagcggagucuucccgguuuccauucccaucaccgcggccgcuugguaccugugggaggucaagaagcagcgcgcaggcguccuuugggacguccccagccccccgcccguaggaaaggcggagcuggaagacggugccuaccggaucaagcaacgcgggauucugggauacagccagauaggggcaggagucuauaaggagggcacguuccauacuauguggcacgugacacgcggggccgugcucaugcaccgaggcaagcggaucgagccuucgugggccgaugucaagaaagaucugaucucuuacgggggaggcuggaagcuggagggugaguggaaggagggggaggagguccaggugcucgcuuuggagcccgggaagaacccccgcgcgguccagacgaagccaggcaucuuccggacgaacaccgggaccaucggcgccgugagccuugacuuuucccccggcacaagcgggucacccaucguggaucgcaagggaaaggucgugggguuguacgguaauggcgucgugacacggagcggugcuuacgucuccgcgaucgcccagacagagaagucuaucgaagauaaucccgagaucgaggaugacauauuccgcaagaagcggcugaccauuauggaccuucacccgggcgccgggaagaccaaacgcuaccugcccgccaucguacgggaggccaucaaacgcggccugcgcacgcugauccuggcgcccacccgggucguggccgcugagauggaggaggcgcuccgcgggcuccccauucgguaccagacucccgccaucaaggcggagcacaccggccgugagauaguggaucugaugugccaugccaccuucaccaugcggcuccugagccccgucagaguuccuaacuacaaucugauuaucauggacgaggcccacuucacagacccagccuccaucgcggcgcggggcuacauuuccacccggguggagaugggugaggcggccggcaucuuuaugacggccacgccgcccgggucccgggacccguucccccagucgaacgcgcccauuauggaugaggagagggagaucccagagcgguccuggaacagcggccacgagugggucaccgacuucaaggggaagaccguaugguucgugccguccaucaaggccggcaacgacaucgccgccugccuccgcaaaaacgggaagaaggucauccagcugagccggaagacguucgauuccgaguacgugaaaacccgggccaaugauugggacuucguggucaccacugacaucagcgagaugggcgcgaacuucaaggccgagcgagugaucgacccccgccgguguaugaaaccugugauccucacggacggcgaagagcgagucauccuggccgggccaaugccugucacacacuccagcgccgcccagcggcggggccgcaucgggcggaacccuaagaacgagaacgaccaguacaucuacaugggcgagccccuggagaacgacgaggacugcgcgcacuggaaggaagcaaagaugcugcucgacaacauuaacaccccggagggcaucauaccguccauguucgagcccgagcgcgaaaagguggacgccaucgacggggaguacagacugcgcggcgaagcccggaagaccuucgucgaccugaugcgucgcggggaccuccccguguggcuggccuauaagguggcggccgagggcaucaacuacgccgaccgcaaguggugcuucgacgggaucaagaacaaccagauccuagaggagaacgucgagguggagauuuggacgaaggagggcgagcgaaagaagcucaagccgagauggcuugacgccaggaucuacagcgacccccuggcccucaaggaguucaaggaguucgccgccggccgcaaaucccuuacccugaaccucaucaccgagauggggcggcugccuaccuucaugacgcaaaaggcccgaaacgcccuggacaacuuggcggugcuccacacugccgaggccggcgggcgggcguacaaccacgcccugagcgagcuccccgagacccuggagacucuacuccuccugacgcucuuagcaaccgucaccggcggcaucuuccuguuccugauguccgggaagggaaucgggaagaugacgcugggcaugugcugcaucauaaccgcgucgauccuucucugguacgcccaaauccaaccgcacuggauugccgcuuccaucauccuggaguucuuccugaucguucuccucauccccgagcccgagaagcagcgcacgccucaggauaaccagcugaccuacgucgugaucgcgauccucacggugguugcggccaccauggccaaugagaugggcuuccuggagaagaccaaaaaggaccugggccucgguagcaucaucacucaggagagcgagaacaacauccuggauaucgaccugcggccggccuccgcguggacccuauaugccguggccaccacguuugugacgcccaugcugcgccacagcaucgaaaacuccagcgugaacgugagccugaccgcaauagcgaaccaggccacuguucuuaugggucugggcaagggguggccuuugagcaagauggacaucggcgucccccuccuggccauagggugcuacucccaggugaauccgaucacgcugaccgccgccuuacuccugcucguggcgcacuacgccaucaucggcccuggccugcaggccaaggccacccgggaggcucaaaagcgcgcggcagcagggaucaugaagaaccccacagucgacggaaucacggugaucgaccuggagcccauaccguacgaccccaaguuugagaagcagcucggacaggugaugcugcugauuuuaugcgucacccaggucuuaaugaugcggaccaccugggcccugugcgaggcccucacgcuggcgaccggccccaucagcacccugugggaggguaaccccggucgcuucuggaauacgacgaucgccguguccauggccaacauauuccgcgguagcuaccuugccggggcgggccugcuguucucaaucaugaagaauacgaccaacacgcggcgcgggacgggcaacaucggggagaccuugggggaaaaauggaagucccggcugaaugcccugggaaaguccgaguuucagaucuacaagaagagcgggauccaggaggucgaccgcacccucgccaaagagggcaucaagagaggagagaccgaccaccacgccgugucucgcggcagcgccaaauugcggugguucguggagcgcaacaugguuacgccggagggcaaggugguggaccugggcugcggccgcggcgggugguccuacuacugcggugggcucaagaacguccgcgaggugaagggguugaccaagggcggcccugggcacgaggagcccauccccaugucuacauacggcuggaaccuggugcgccuccagucuggagucgauguguucuucaccccucccgagaagugcgacacgcuucugugcgacaucggcgaguccucacccaaccccaccaucgaggcgggccgcacccuccggguccugaacuuagucgagaacuggcuuaacaauaacacccaauucugcauaaaggugcugaacccuuacaugcccuccgugaucgagaagauggaaacccugcaacgaaaguacgggggggcccuaguccggaacccccugagccgcaacuccacgcacgagauguacugggugagcaacgcaacugggaacaucgugucuucggucaacaugauaagccgcaugcugaucaaccguuucacuaugaagcacaagaaggccaccuacgaaccggacguggaccugggcagugguacgcggaacaucggaaucgagggcgagauaccuaaucuugacaucaucgggaagcgcauugagaaaaucaagcaggagcacgaaaccucauggcacuacgaccaggaccaccccuacaagaccugggccuaccacggcagcuacgagaccaagcagacggggagugccagcuccaugguaaacgguguaguacgcuugcugaccaagcccugggacguggucccgauggugacccagauggccaugaccgacacgaccccuuucgggcagcagcggguguucaaggaaaaggucgacaccagaacccaagagcccaaggaggggacaaagaaguuaaugaagauuaccgccgaguggcuguggaaagagcugggaaaaaagaagacgccccggaugugcaccagggaggaguucacgaagaaggugcggagcaacgccgcccucggagcgauuuucaccgacgaaaacaaguggaagagcgcgcgagaggcaguggaagacggccgguucugggaguuagucgaccgcgagcggaaucugcaccuagaggggaagugcgagaccugcguguauaacaugaugggcaaacgagagaagaagcugggagaauucgggaaggcgaagggcagccgggcgauuugguauaugugguuaggggcucgcuuucucgaguucgaggcccuuggcuuccugaacgaggaccacugguucucccgggggaacagccucuccggcguugagggcgaggggcugcaccgacugggcuauaucuuaagagacguagggaagaaggaggguggggcuauguaugcugacgacaccgcgggcugggacacgcgcaucacccuggaagaccugaagaacgaagagaugguuaccaaccacaugaagggagagcauaagaagcucgccgaagccauuuucaagcugaccuaucagaacaaggucguucgggugcagcgaccuacuccccgggguacagucauggacaucaucagucgcagggaccagcgcgguagcggccagguggggaccuacggcuuaaacacauucacgaauauggaggcccagcucauucgccagauggagggugagggcaucuucaaguccauucagcaccugaccgccaccgaggagaucgcgguacagaacuggcuggccagagucgggcgcgaacggcucucacgcauggccaucuccggugacgacugcgucgugaagcccauagacgaccgguucgcgagcgcccugaccgcgcugaacgacaugggcaagguccgcaaggauauacagcagugggagcccucacggggguggaacgacuggacucaagugccguucuguagccaccauuuccacgagcucgugaugaaggacggacgcguucugguggugcccugccggaaccaggacgagcucauugggcgagcccggaucucccagggcgccggguggagccucaaggagaccgccugccugggcaaauccuacgcccagauguggacgcugauguacuuccaucgccgggaccugcgccuggccgcuaacgccaucugcagcgcuguccccucccacugggugccgaccagccggacgacuuggucaauccacgcaaagcacgaguggaugaccaccgaggacaugcuggccguguggaaccgcguuuggauccaggagaacccguggauggaagacaagacgcccgucgagagcugggaggaggugcccuaucuagggaagcgggaggaccaauggugcggcucccugaucggucugacgagccgcgccaccugggccaagaacauccagacugccaucaaucaaguccggucccucauagggaacgaggaguacaccgauuauaugcccagcaugaagcgcuuccgccgggaggaggaggaggcgggggugcugugguga

SEQ ID NO: 25284 - RNA, 9876 nt, Artificial Sequence
  derived and/or modified CDS sequence (opt11) from DENV-2__FJ639783__SS-prME
accgccggcgugaucgucaugcugauccccaccgcaauggcguuucacuugacaacccgcaacggggaaccccacaugauuguagggcggcaggagaaggguaagucccugcuguuuaagaccgaggacggggugaacauguguacccucauggccaucgaccugggugaguugugcgaggacacaaucaccuacaagugcccccuccuccgccagaacgagcccgaggacaucgacugcuggugcaacagcaccagcacaugggucaccuacgggacguguaccacaacgggugagcaucggcgcgagaaacgaucaguugcccuggugccccacgucgggaugggccucgaaacccgcaccgagaccuggaugaguuccgagggggccuggaagcacgugcagcggaucgagacguggauacugcggcacccgggcuucaccaucauggccgcgauuuuggccuacacgaucgggaccacgcauuuucaacgggcccucaucuucauccuccugaccgccguggcgcccagcaugaccaugcgcugcaucggggucuccaaucgggacuucguggagggcgugagcggcggcuccugggucgacaucguauuggagcacgggucuugcguuacuacgauggcuaagaacaagcccacauuggacuucgaacugaucaagaccgaagcgaagcagcccgcuacccuacgcaaauacugcaucgaggccaagcugacgaacaccacaacggagaguaggugcccgacgcagggagagcccagccugaaugaggaacaagacaaacgcuuuaucuguaagcauuccaugguugaccguggcugggggaacggcugcggacuguucgggaaaggcgggaucgucacgugcgcuauguucacguguaagaagaacauggaaggcaaggugguccagcccgagaaccuagaguauaccaucgugaucacgccccacucuggcgaggagcaugccgugggcaacgacaccgggaagcacggaaaggaaaucaaaaucaccccgcaguccagcaucaccgaggccgagcugaccggguacggcaccguaaccauggagugcagcccccggaccgggcuugacuucaacgagaugguguuguuacagauggaggacaaggccuggcucguccaccgacagugguuucuggaccugccucuccccuggcugccgggggcugauacccaggggagcaacuggauccagaaggagacccuggucaccuucaaaaacccgcacgccaagaagcaggacguggucgugcucggcagucaggaaggcgccaugcacacagcccugaccggggccacagagauccagaugagcagcggcaaccuccuguucaccggccaccucaagugccgccugaggauggacaagcuccagcugaaagggauguccuacagcaugugcaccggcaaguucaaaaucgugaaggaaaucgccgagacccagcacgggacgauagucauccgagugcaguacgagggcgacggcuccccgugcaagauccccuucgagaucaccgaccuggagaagcggcaugugcucggucgccugaucaccguuaacccgaucgugaccgagaaggauagucccgugaacaucgaggcggagccacccuucggcgacuccuacaucaucauuggggucgagccgggccagcugaagcucaacugguucaaaaaggguagcuccaucggccagauguucgagacgaccaugcguggcgccaagcggauggccauuuuaggugacaccgccugggacuucgggucacuagguggggucuuuaccuccaucgggaaagcccuccaccagguguucggugcuaucuacggcgccgcauucagcggcgucucuuggaccaugaagauucugaucggggucaucaucaccuggauaggcaugaacuccagguccaccagccugucggugagccugguccugguuggugugguuacucuguaccuuggggccaugguucaagccgacuccggcugcguggucuccuggaagaauaaggagcucaagugcggcucggggaucuuuaucacggauaacgugcacaccuggaccgaacaguacaaguuccagcccgaaagccccagcaagcuggccuccgccauucagaaggcccaugaggagggcauuugugggauucggagcgugacccgccuggaaaaucucauguggaagcaaauuacgcccgagcugaaccauauccuguccgaaaacgaggucaagcuaacaaucaugaccggcgauaucaaggggaucaugcaggcggguaagcggagccuucgcccgcagccaaccgagcucaaguacuccuggaagacguggggcaaggcgaagauguugagcaccgagucccacaaccaaaccuuccugaucgacgggcccgagacugccgaaugcccgaacacaaaccgagccuggaacagucuagagguggaggacuacgguuuugggguguucacgaccaacaucuggcucaagcugcgcgagaaacaagacguuuucugcgacucaaaacugaugucggccgccauuaaagacaaccgggcggugcacgccgacaugggguacuggaucgagucugcccucaacgauaccuggaagauggagaaggccagcuucaucgaagugaaguccugccacuggcccaagagccacacgcuguggucuaacggcguccuggagucagagaugaucauucccaagaacuucgcugggcccguuucccagcacaacuaccgcccgggcuaccacacgcagaccgccgggccuuggcaccucggcaagcuggagauggacuuugacuucugcgaagggacuacgguagucguuacggaggauugcggaaaccgggguccuucuuuacgaacuaccaccgccagcgggaagcucaucacugaguggugcugccggagcugcacccuacccccguugcgcuaccgcggggaggaugggugcugguacggcauggaaauaaggccccucaaagagaaggaggagaaccuggugaacagccugguuaccgccggccacggccagaucgacaacuucucccucggcguguugggaauggcgcuauucuuggaggaaaugcuccggacacgcguuggcaccaagcacgcgauucuacucguugccguaucguucgugacccugaucacugggaacaugagcuuccgggaucugggacgcgucauggucauggugggggcuacuaugacggacgacauuggcaugggugucaccuaccucgcccugcuugccgcguucaaaguacgccccaccuucgcagccggacuccugcugcggaagcucaccagcaaggagcugaugauggccacgaucgggaucgccuugcucucccagagcaccauccccgagaccauccuugagcugaccgacgcguuagcccugggaaugauggugcuaaagaucguaaggaacauggaaaaguaccagcucgccgugaccguaauggccauuuccugcgucccgaaugccguuauccugcagaacgcauggaagguaagcugcacgauccuagccgccguguccguuagcccacuucugcugaccuccagccagcagaaggccgacuggaucccccuugcgcugaccaucaagggccugaaccccaccgccaucuuccucaccacacugucgcggaccagcaagaagaggucauggccgcugaacgaggccaucauggccgucggcauggugucuauccucgcauccagucugcugaagaacgauauccccaugacggggcccuugguggcgggagggcuccuaaccguuugcuacguccucaccggucggagugccgaccuugagcucgagcgcgccgccgacgugaagugggaggaccaggccgaaaucuccgggagcuccccgauccucagcaucaccauuucugaggacggaucgauguccaucaagaacgaggaggaggagcaaacauuaacuauccugauccggaccggccuccuagucauuucggguguguuccccguguccauccccauuaccgcggccgccugguaccugugggaggucaagaaacagagggccggcguguugugggacgugccgagcccgccgcccgucgggaaggcugaacuggaagacggcgcguaccgaauuaagcagcgggggauucugggguacucacagaucggcgcgggaguguacaaggagggcacauuucauacgauguggcaugugaccagaggggccguccucaugcaccgggguaagcggaucgagcccagcugggccgacgugaagaaggaccugaucucguacgggggcggguggaagcuagagggggaguggaaggagggcgaggaggugcagguccucgcccucgagcccggaaagaacccccgcgcugugcagaccaagccuggcaucuucaagaccaacacggggacaaucggcgccgucagccucgacuucucccccggcaccagcgggucccccaucgucgaccgcaagggaaagguaguggggcucuaugggaacggcguagugaccagguccggggcuuacgugucagccauugcgcagacggagaaguccauugaagacaacccagagauugaagaugacaucuucagaaagaaacgcuuaaccaucauggaucugcaucccggcgccggcaaaaccaagagguacuugcccgcgaucgugcgcgaggccaucaagcgcggccugcgcaccuugauccuggccccgaccagggugguggcggccgaaauggaggaggcuuuacggggacugccgauacgcuaccagacccccgccauuaaggccgagcauaccggucgggagaucguagaccugaugugccacgcgaccuuuaccaugagacuccugagcccagugcgggugccgaacuacaaccugaucauuauggaugaagcccacuucaccgaccccgcaaguauagccgcucgaggcuacauuagcacccgcgucgagaugggggaggcggcgggcaucuucaugaccgccacgccgcccggcucccgcgacccguucccccaaagcaacgccccgaucauggacgaggagagagagauccccgagcgcuccuggaacuccggucacgagugggugacugacuucaaggggaaaaccgugugguuugucccguccaucaaggcggggaacgauaucgcggccugccuccggaagaauggcaaaaaggugauccagcugagccgcaagacauucgacuccgaguacgugaagacgcgggcaaacgacugggacuuugucgugacaaccgacaucucugagaugggggccaacuuuaaggcagagcgcgucaucgacccccggagguguaugaagcccgugauccugacugauggcgaggagcgggugauccucgcaggcccuaugccggugacgcacucgagcgccgcccagagaaggggccgcaucgggcgcaaccccaagaacgagaacgaccaguacaucuacaugggugaaccccuugagaacgacgaagacugcgcacacuggaaggaagcgaagaugcugcucgauaacauuaacacaccugagggcauaauuccgaguauguucgagcccgagcgggagaaagucgacgccaucgacggggaauaccgccuccggggcgaggcccgcaaaacauucguggaucucaugcggagaggugaccuccccguuuggcuggcguacaaggucgccgcugagggcauaaacuaugccgaccggaagugguguuucgaugggauuaagaacaaucagauacuggaagagaacguggaagucgagaucuggaccaaggaaggcgagcguaagaaauugaagccgcgguggcuggacgcccgcaucuacagcgacccccuggcccucaaggaguucaaggaguuugcggccggcagaaagagcuuaacgcucaaccuuaucacagagauggggcgguugcccaccuucaugacacagaaggcccggaacgcccuggauaauuuagcuguccugcauacagcggaggccggagggagggccuacaaccacgcccucagcgagcuccccgaaacccuggaaacccugcuccugcugacacuccuggcaacugugaccggcggcaucuuccuguucuugauguccgggaagggcaucgggaagaugacauuaggaaugugcugcaucauuaccgcgagcguucugcucugguacgcccagauacagccucacuggaucgccgcguccaucauccuggaguucuuccugaucguguuacugauccccgagccugagaagcaacggacuccccaggauaaccagcucacguacguggucaucgcuaucuugacugugguggcugccaccauggcaaacgagaugggauuccuugagaagaccaagaaggaccuggggcucggcucuaucacgacacaggaaagcgaguccaacauccuggacauugaccuccgcccggcuagcgccuggacucucuaugcggucgccaccacguucgucaccccgaugcugcggcacuccauagagaacagcuccgugaacgucucauuaaccgccauugcaaaccaggcgacagugcucauggggcugggcaagggguggccccuguccaagauggauaucggugucccccuccuggccaucgggugcuacagccaggucaauccgauaacgcugaccgccgcccuccuacugcucguggcgcacuacgcgaucaucggacccgggcugcaggccaaggccacccgcgaggcccagaaacgugcggcggccgggaucaugaagaaccccacgguggacggcauuacggucauugaccucgaacccaucccauacgaccccaaguuugagaagcagcucgggcagguaauguugcugauccucugcgugacgcaaguccugaugaugcggaccaccugggcccugugcgaggcccucacacuggcgacggguccuaucuccaccuugugggaggggaaccccggccgcuucuggaacaccaccauagcggugagcauggccaacaucuuccgcgguuccuaccucgccggggccggauugcuguucagcaucaugaagaacaccaccaacacccgccgggggacaggcaacauaggcgagacccucggggagaaguggaagucccgccugaaugcacugggcaagagcgaguuccaaaucuauaagaaguccgggauccaggaaguggaccggacgcucgccaaggaaggcaucaagcgcggcgagaccgaccaccacgccgucucgcggggcagcgccaagcuacgcugguucguggagcguaacauggugacgccggagggcaaggucguggaccuggggugcggacgcgggggcuggucguacuacugcgggggccucaaaaacgugcgggaggucaagggccuuaccaagggagggcccgggcacgaggagcccaucccaauguccaccuacggguggaaccuggugcgccuccagucagggguggacguauucuucaccccgccagagaagugcgacacgcugcugugcgacaucggcgaaucuucgcccaaccccaccaucgaggccggccggacccuacgcguacugaaccugguggagaacuggcucaacaacaacacccaguucuguauuaagguucuuaacccguacaugccgagcgugauugagaagauggagacucugcaacggaaguaugggggcgcucucgugcgcaacccccugucccgaaacagcacgcacgaaauguacugggucuccaacgcaacagggaacaucgugaguuccguaaauaugaucucaagaauguuaauaaaccgauucaccaugaagcacaagaaggcuacguaugagccugacgucgacuuaggcuccgggacgcgcaauaucgggaucgagucugagaucccgaaccucgacaucaucggaaagcggaucgagaagaucaagcaggagcaugagacuucuuggcacuacgaccaggaccaucccuacaagaccugggccuaucaugggagcuacgagaccaagcagacgggguccgccucguccauggugaacgggguggugcgccuguugacuaagccaugggauguggugccgauggucacccagauggcgaugaccgauacgacccccuucggccagcagaggguguucaaagagaagguggacacccggacccaggagccuaaggagggcacgaagaagcucaugaaaaucaccgccgaguggcuguggaaggaguuagggaagaagaagacgccccgcaugugcacccgcgaggaguucacgcgcaagguccggucgaacgccgcccuuggggcgaucuuuaccgacgagaauaaauggaagucggcgagagaggccguggaggacgggcgguucugggagcugguugaccgcgagcggaaccuccaccuggagggcaaaugcgagaccugcguguacaacaugauggggaaacgagagaagaagcucggcgaguucggcaaagcgaaggggucccgcgccauuugguacauguggcugggcgcgcgcuuccucgaguucgaggcgcugggguuccugaacgaggaccacugguucuccagggggaacagccucagcggggucgaaggcgagggacuccaccgcuugggguacauccuccgggacgucggcaaaaaggagggcggcgccauguaugccgaugacaccgccgguugggauacgcgcaucacacuggaggaccugaaaaacgaggagauggugaccaaucacaugaaaggcgagcacaagaagcucgcggaggccaucuucaagcugaccuaccaaaacaagguaguucgggugcagcgcccuacgccccgaggcaccguuauggauauaaucagucgccgcgaccagcgcgguucuggccaggucgggaccuacggccugaauacguucacgaauauggaggcacaguugaucagacaaauggagggagaggggauauucaagucuauacagcaccugacugccaccgaggagauugccgugcagaacuggcuagcgcgaguaggacgagagcggcucagucggauggcgauuuccggggacgacugugucgucaagcccaucgacgaccgguuugccagcgcgcugaccgcccugaacgacaugggcaaggugcgcaaggauauccaacagugggagccaucacggggguggaacgacuggacgcaggucccguuuugcagccaucauuuucacgaacucgugaugaaggacggccgcgugcuggucgugcccugccggaaccaagacgagcugaucggccgcgcgcggauaucgcagggugccggcuggagucucaaggaaacugccugucucggcaaguccuacgcccaaauguggacccugauguauuuccaucgccgggaccuccgcuuagccgcgaaugccauuugcagugccgugcccucccauugggucccgaccucgcggaccacgugguccauccacgccaagcacgaguggaugacaaccgaggacaugcuggccguguggaaccgcguguggauacaggagaauccguggauggaggacaagaccccuguagagagcugggaagaggugcccuaccucggcaaacgggaggaccaauggugugggucccucauuggccugacgagcagagccaccugggccaaaaacauccagaccgccaucaaccaggugcggagccucaucggcaacgaggaguacacugacuacaugcccuccaugaaacgcuucaggcgugaggaggaggaggcgggcguacuuugguga

SEQ ID NO: 25285 - RNA, 9876 nt, Artificial Sequence
  derived and/or modified CDS sequence (opt11) from DENV-2__FJ639788__SS-prME
acugccggcgugaucgucauguuaauccccacugccauggcguuucaccucacgacucgaaacggcgagccccauaugaucgugggacggcaggagaaggggaagucccugcuguucaagaccgaggacggcgugaacaugugcacccucauggccaucgaccugggugaacugugcgaggauaccaucaccuauaagugcccacuccugcgccagaacgaacccgaggauaucgauugcuggugcaauaguaccagcacaugggucaccuacgggaccugcaccaccgcaggagagcaccggcgcgagaagcggaguguggcccuggucccccacgucgggaugggucucgagacccgcacugagaccuggaugagcagcgaaggggcauggaagcauguucagcggauagagaccuggauccugcgccacccgggcuucaccaucauggcggccauccuggccuauaccaucgggaccacucacuuucagcgggcccucaucuucauccugcugaccgcgguggcccccagcaugaccaugcgcugcaucggcgucuccaaccgugacuuuguagagggcgugucagggggcuccuggguugauaucgugcucgagcacggguccugcguaaccaccauggcaaagaacaagcccacgcuggacuuugagcugaucaagaccgaggccaagcagccagcuacccuccgaaaguacugcaucgaagcaaaacugaccaacacgaccaccgagucucggugcccaacccagggagagccaagccugaaugaagagcaggacaaacgcuucaucugcaagcacucgauggucgaccgaggcugggggaacggcugugggcuuuucgggaaaggcggcauugugacgugcgcuauguucacuugcaagaagaacauggagggcaaagugguacaacccgagaaccuggaguacaccaucguaaucacgccacauagcggggaggagcacgccgugggcaacgacacuggcaagcacgggaaggagaucaagaucaccccgcagucaaguaucaccgaagccgagcugaccggguacggcaccgucacgauggaguguagcccccggaccggccucgacuucaacgagauggugcugcuccagauggaggacaaggcuuggcucgugcaccggcagugguuccuugaucuuccccucccguggcugcccggagcggacacccagggcagcaacuggauccagaaggagacccuggucacguucaagaacccccacgccaagaagcaagacguggucguguuggggucccaggagggcgccaugcauaccgccuuaaccggggccaccgagauucaaaugagcagcggcaaccuccuguucacaggucaccugaaaugucgccugcggauggacaagcuccagcugaaagggauguccuacagcaugugcacgggcaaauucaagauagugaaggagaucgcggagacccagcacggaaccaucgugauccgcguucaguacgaaggcgacggaucacccuguaagauccccuuugagaucacggaccuggagaagcggcacgugcucgggcgccugaucacagucaacccgaucgucaccgagaaggacagccccgugaacaucgaggccgagccgccauucggcgacuccuauaucaucaucggggucgaaccgggccagcugaagcuaaacugguucaagaaggggagcaguaucggccagauguucgagaccacgaugcgcggcgccaagcggauggccauccugggggacaccgccugggacuuuggcagccucggcgggguguucacuuccaucgguaaggcgcuccaccagguguucggggccauauacggcgccgccuucagcgggguuuccuggaccaugaagauccugaucggugucauaaucacguggaucggcaugaacagccgcuccaccagccuauccgugucucuggugcugguggguguggucacccuauaccuaggggcaauggugcaggcagacucgggcuguguugucagcuggaagaacaaagagcucaagugcggcuccggcaucuucaucaccgacaacgugcacacguggaccgagcaguacaaguuccaacccgagagccccagcaagcuggccagcgccauacaaaaggcccaugaggagggcaucugcgggauccgaagcgugacccgucuggaaaacuugauguggaagcagaucacgccggaacugaaccacauccuguccgagaacgaggucaagcucaccaucaugacgggcgauaucaaggggauuaugcaggcgggcaaacggagccugcgcccgcagccuaccgaacuuaaguacuccuggaagacuugggggaaggccaagaugcucagcacggagucccacaaccagaccuucuugauagacgggcccgagaccgccgagugcccuaacaccaaccgugcguggaacagccuggagguggaggacuauggcuucgggguguucacgaccaacaucuggcucaagcugcgcgagaagcaggacgucuucugcgacuccaagcugaugagcgccgcgaucaaggacaacagagcggugcacgcggacaugggauacuggauagagucugcccuaaacgacaccuggaagauggagaaagccagcuucaucgaggugaaguccugccacuggcccaagagccacacccuguggucuaacggcguccuggagagcgagaugaucauccccaagaauuucgcuggucccguaucccagcauaacuaccgcccgggcuaccacacccagacggccgggcccuggcaccucggcaagcuggagauggacuucgacuucugcgaggggacuaccguggucgugaccgaggacugcggcaaccggggccccagccugcgcacaaccacggccucggggaagcucaucacugaguggugcugccgguccuguacccuacccccgcugcguuaccggggugaagacgggugcugguacggcauggagaucagaccacucaaggaaaaggaggaaaaccuggucaacucgcuggucaccgccgggcacggccagaucgacaacuucucccucggcguguuggggauggcgcucuucuuggaggaaaugcugcggaccagagugggcaccaagcacgccauacuguuagucgccgugagcuucgucacgcugaucaccgggaacauguccuuucgggaucugggcagagucauggugauggucggggccaccaugaccgacgauaucggcaugggcgucacguaccucgcccuguuagcggccuucaaggugcgccccaccuucgccgcuggccuccuccuacggaagcucaccucuaaggaacugaugauggccacuaucggcauugcgcugcucucccagagcacuauccccgagaccauccuggagcugaccgacgcccucgcccucgggaugauggugcugaaaaucguuaggaacauggagaaguaccagcucgccguaacggugauggccaucaguugcgucccgaacgcggugauccugcaaaacgccuggaaggucagcuguacgauccucgccgccguguccguuagcccccuucugcugaccuccagccagcagaaagcggacuggauccccuuggcucugaccaucaagggccugaaccccaccgccauauuccuaacgacacugucccgaaccagcaagaagcgauccuggccgcugaaugaggccaucauggccgugggcauggugagcauccucgcuuccagccuacugaagaacgacauccccaugaccgggccccuaguggcgggcggguuacugacgguuuguuacgugcucaccggacguagcgccgaccuggagcuggagcgcgccgccgacgugaaaugggaggaccaggcugagaucuccgggagcucccccauccucagcauuaccaucuccgaggauggcagcauguccaucaaaaaugaggaggaggagcagacucugacgauacuuaucaggacgggccuccuggucaucagcgggguguuccccgugucaauccccaucaccgcugccgccugguaccugugggaggucaagaagcagcgcgccggcguacucugggacgugccgagcccgccgccagucgggaaggcggaacuagaggacggcgcuuaccguaucaaacagcgcgggauccugggcuacucucagaucggcgccgggguguacaaggagggcaccuuccacacaauguggcauguuacgcgcggggccguccucaugcaccgcgguaagcggaucgaacccagcugggcugacguuaagaaggaccugaucuccuacgggggaggcuggaaguuagagggggaguggaaggagggcgaggaggugcagguccucgcgcuggagccggggaagaauccccgcgcggugcagaccaagccaggcauauucaaaaccaacaccgggacgaucggagccgugagccuggauuucucccccggcaccagcggcucccccaucgucgaccguaagggcaagguggugggccucuacggcaauggagucgugacccgcaguggggcauacguguccgcgaucgcccagaccgaaaaguccaucgaggacaaccccgagaucgaggacgacaucuuccggaagaagcgucugaccaucauggaccuucaccccggcgccgggaagaccaaacgguaucugcccgccaucguucgugaggcuauaaagcggggccugcgcacccugauccuggcgccgacccgcgugguggccgccgagauggaggaggccuugcgaggguuacccauccgcuaccagacucccgcaaucaaggcggagcacaccggccgggagaucgucgaccucaugugccaugcuaccuuuacuaugcgacuccugagccccgugcgggugcccaacuacaaccugaucauuauggacgaggcccauuucacggaccccgccuccaucgccgcgcgcggguacaucaguaccagaguagagaugggggaggccgccggcaucuucaugacagccacgccuccagggucgagggacccguucccccagucuaacgcgccgaucauggacgaggagcgggagaucccggagcgcuccuggaacagcggccaugagugggucacagacuucaaggggaagaccgucugguuugucccguccaucaaggcggggaacgauaucgcggcaugucuccggaagaacggcaagaaggugauccagcuaagccggaagaccuucgacuccgaguacguaaagacccgggccaacgauugggacuucgucgugacgacggacaucucggagaugggggcgaacuucaaggccgagcgcgugaucgacccccggcgauguaugaagccggucaucuugaccgacggcgaggagcgggucauccucgcagggcccaugccggugacacacagcagcgccgcccagcggcggggccguaucgggcggaaucccaagaaugagaacgaccaauauaucuacaugggcgagccccuggaaaacgacgaggacugcgcucacuggaaagaggccaagaugcugcucgacaacaucaacacgccugagggcaucaucccguccauguucgagcccgagcgggagaagguugacgccauugacggagaguaccgccugcggggugaggcacgcaagacuuucguugaccugaugcguagaggggacuugcccguguggcuggccuacaaggucgcggccgagggcaucaacuaugccgaccggaaguggugcuucgacgggaucaaaaacaaccagauccuggaggagaacguggaagucgagauauggaccaaggagggcgagcgcaagaagcucaaaccgcgguggcucgacgcgcgcauauacagcgacccccuggcuuuaaaggaguucaaggaguuugccgccggcagaaagucccugacacugaaccucauuacggaaauggggagguuacccaccuucaugacacagaaggcccggaacgcucuggacaaccucgcggugcugcacaccgccgaagccggcgggcgagccuacaaucacgcccugagcgaguuacccgaaacgcuggagacccugcuccuacugacuuuacuggcgaccgugacgggcggcaucuucuuguucuugauguccgggaaaggcaucgggaagaugacccugggcaugugcugcaucaucaccgccagcguccugcucugguaugcccagauccaaccgcauuggaucgccgccucgaucauccuggaguucuuccugaucgugcuccugaucccagagccugagaaacagcggacuccccaggacaaccagcucaccuacgugguaaucgcgaucuuaacgguaguggccgcuaccauggccaacgagauggguuuccuggagaagaccaaaaaggaccugggccucggcagcauuacgacgcaggaaagcgaauccaacauccuggacauugaucugcgcccggccagcgcguggacuuuguacgcagucgccaccaccuuugugacgcccaugcugcggcauuccaucgagaacucuuccgugaacgucagccucaccgccaucgcgaaccaggccaccgugcucaugggucuagggaaaggauggccccuguccaagauggacauuggcguaccgcuccuggccaucgggugcuacagccaggucaauccaaucacccugacagcagccuugcugcuguuaguggcgcacuaugcuaucaucggcccaggccugcaagccaaggccacccgcgaagcccagaagcgggcagccgccgggauuaugaagaaucccaccguagacgggaucacuguuaucgacuuagagccaaucccguaugaccccaaguucgaaaagcagcucggccaggugauguugcuaauccucugcgugacgcagguacugaugaugcggaccacaugggcgcugugcgaagcccucacccuggcuacgggucccauuucuaccuuaugggaggggaacccgggucgguucuggaacaccacgaucgccguguccauggccaacaucuuccgcgguuccuaccuugccggggcgggccuacuguucagcaucaugaagaacacaaccaacacgcgccgggggacgggcaacaucggggagacgcucggggagaaguggaagucccgccugaacgcccugggcaagagcgaguuucagaucuauaagaaguccggaauccaggagguugaccggacccucgccaaagagggcauuaagcgcggggagaccgaccaucaugcgguaagccgggguuccgcgaagcugcgcugguucguggagcgaaacauggugaccccagagggcaaggucguggacuugggguguggccgggggggcuggagcuacuacugcgggggccucaaaaacguuagagagguaaagggacugacgaagggagggcccggucacgaggaacccauccccauguccacauacggcuggaaccuggugcgccuccagucugggguggaugucuucuuuaccccccccgagaagugcgacacccugcugugcgacaucggggagagcucgcccaaccccacgaucgaggcgggacggacucuccguguucugaaccugguagagaacuggcucaacuacaauacccaguucugcauaaagguccugaacccguacaugcccagcguaaucgagaagauggagacacugcagcggaaguacgggggcgcucuugugcgcaacccccugucccggaacucuacccacgagauguauugggucuccaacgccacggggaacaucgugagcuccgugaacaugaucucacgcaugcuaaucaacagauucaccaugaagcacaagaaggcaaccuacgagccggacguugaccugggcuccgggacccgcaacauaggcaucgaaagcgagauccccaaccucgacaucaucggcaagcggaucgagaagauuaagcaggagcacgagacgucauggcacuacgaccaggaccacccauauaaaacuugggccuaucacggaucguaugagaccaaacagacuggcuccgcgagcuccauggugaaugggguaguccgccugcuaacgaagcccugggacguggugccaauggucacccaaauggccaugaccgacaccacgcccuucgggcagcagcgcguguucaaagagaagguggacacccggacccaggagcccaaggagggcaccaagaagcugaugaagaucacggccgaguggcucuggaaggagcuggggaagaagaagacgcccagaaugugcacaagagaggaguuuacccggaagguccggagcaacgcugccuugggcgcgaucuucacggacgagaacaaguggaaguccgcacgcgaagccguggaagaugggcgguuuugggagcugguugaccgcgagcggaacuuacaccuagagggcaagugcgagaccugcguguacaacaugauggggaaacgcgaaaagaagcugggcgaguucggcaaggccaaagggagccgggcuaucugguauauguggcuaggugcccguuuccucgaguucgaggcccugggguuccugaacgaggaucacugguuuucccggggcaauucucucagcgggguggagggcgagggacugcaccgccugggguauauccuccgggacgugggcaaaaaggagggcggcgccauguacgccgacgauaccgcaggaugggacacaaggaucacccuggaggaccugaagaacgaggagaugguuaccaaccacaugaaaggcgagcacaagaagcucgccgaggccauuuucaagcuuaccuaccaaaauaaggugguccgagugcagcgcccuacgccacgggggacggugauggacaucaucuccagaagagaccaacgcggaucgggucaggucgggaccuacggccugaacaccuucaccaacauggaggcccaacucauacgccaaauggaaggugagggaaucuucaaguccauccagcaucugaccgccaccgaggagaucgccgugcagaacuggcuggcccgggugggcagagagcgacucucgcgcauggcaaucuccggggacgacugcgucgugaagcccauugacgaccgguucgccagcgcccugaccgcgcugaaugacaugggcaaggugcgcaaggauauccagcagugggagcccucccgggguuggaacgauuggacccaggucccguuuuguagucaccacuuccacgagcucguaaugaaggauggccgcguccuggucgucccuugccggaaucaggacgaacugaucggccgcgcccggaucucacagggggccggauggagccucaaggagacggccugccuggggaaauccuacgcccagauguggacccugauguacuuccacaggcgggaccugaggcucgcggcaaacgccaucugcagugcuguaccaucccacugggucccgaccucccggacuacaugguccauacacgcgaagcacgaguggaugacgaccgaagauaugcuggcaguguggaaccgcguauggauccaggagaacccguggauggaggacaagaccccggucgagagcugggaggaggugcccuaccucggcaaacgugaggaccagugguguggaucccugaucggccugacaagccgcgccaccugggcgaagaacauucaaaccgccaucaaccaagugcggucgcucaucggcaacgaggaguacacagacuacaugcccuccaugaagcgcuuccgccgggaggaagaggaggcggggguucugugguga

SEQ ID NO: 25286 - RNA, 9876 nt, Artificial Sequence
  derived and/or modified CDS sequence (opt11) from DENV-2__FJ639822__SS-prME
accgcgggcgugaucguaaugcugauccccaccgcuauggcguuucaccugaccacccggaacggggaaccucacaugauagugggccggcaggaaaaggguaagucccugcuuuucaagaccgaagacggcgugaacaugugcacccucauggccaucgaccugggggaacugugcgaagacacuauaaccuacaaaugccccuuacugcgccagaacgagcccgaagacauagacuguugguguaacagcaccagcaccugggucaccuacgggacuugcacgaccacgggcgagcaccggcgcgagaagcgguccguggcgcuggugccacaugucgggaugggccucgagacucgcacugagacuuggaugagcucugagggggccuggaagcacguucagcggaucgagaccuggauccugcgccacccuggcuucacaaucauggccgcgauccuggccuacaccauagggaccacgcauuuccaacgggcccucaucuucauccugcugaccgccguugcgccaagcaugaccaugcgcuguaucggcgucuccaaccgcgauuuuguggagggcgugucuggcggguccuggguagacaucgugcucgagcauggguccugugugaccaccauggccaagaacaagcccacgcuggacuucgagcugaucaaaaccgaggccaaacaacccgccacccuccgcaaguauugcaucgaagccaagcugacuaacaccaccaccgagucccggugcccgacgcaaggggagccaagccugaacgaagaacaggacaagcgcuucaucugcaagcacucuauggucgaccggggcugggggaacggcugcgggcuguucggcaaaggcgggauaguaaccugcgcgauguucacgugcaagaagaacauggagggcaaggugguccagcccgagaaccuggaguacaccauugugaucacgccccacucgggggaggagcacgccgugggcaacgacaccgggaagcacggcaaggagaucaagaucacaccgcaguccagcaucaucgaagcugagcugaccggguacgggaccguuacgauggaguguucgcccaggaccgguuuggacuucaacgagauggugcugcugcagauggaggacaaggcuuggcucgugcaccgacagugguuucuugaccucccccuccccuggcuuccgggggcugacacccagggcagcaauuggauacagaaggagacucucguuacguucaagaauccccaugcuaagaaacaggacguggucgugcucgguucccaggagggagcgaugcacaccgcccugacuggggccaccgagauccagaugucgagcggcaaccucuuguucacgggccacuugaagugcaggcugcgcauggacaagcuccagcucaaggguaugaguuacucuauguguaccggcaaguuuaagaucgugaaggagaucgccgagacacagcacgggaccaucgucauccgugugcaguacgagggcgaugggucccccugcaagauccccuucgagaucacagaccuggagaaacgucacguacucgggcggcugaucaccgugaacccgaucguuacgggcaaggacagccccguuaacaucgaggcggagccgcccuucggggauuccuacaucauuaucggcgucgagccgggucaguugaaacucaacugguuuaagaagggcucauccaucggccagauguucgagaccacgaugcgcggggccaagagaauggccauccugggcgacaccgccugggauuuugggucccuaggggguguauucacuuccauugggaaggccuugcaccagguguucggcgccaucuacggggccgcauucaguggcgucuccuggaccaugaagauccugaucgggguuaucaucacguggaucggcaugaacagcagauccaccucacuuuccgugucguuaguccucgugggcguggucacgcuauaccugggcgccauggugcaggcggacuccgguuguguagucagcuggaagaauaaagaacucaagugcggguccggcaucuucaucacagacaaugugcauacguggaccgagcaguauaaguuccagcccgagagcccgaguaagcuggcguccgccauccagaaggcccaugaggaggggaucugcgguauccggagcgugacccgucucgagaaccucauguggaagcaaaucaccccugagcugaaccacauccuguccgagaaugaggucaaguugaccaucaugaccggcgacaucaaggguauuaugcaggcggggaaacggagccugagaccgcagccgaccgaacugaaauacuccuggaaaacuugggguaaagccaagaugcuguccacggagucccacaaccagaccuucuuaaucgacggccccgagaccgccgagugcccgaacacaaaccgcgcauggaacagccuagagguggaggacuacgguuucggcguguucacgaccaacaucuggcuuaagcugcgugaaaagcaagacguuuucugcgacuccaaacugaugagugccgccaucaaggacaauagagcgguucacgccgauaugggcuacuggaucgaguccgcacucaacgacaccuggaagauggagaaagccucguuuauagagguaaagucaugccauuggccgaaaucacacacgcugugguccaacggcguccuggagagcgagaugaucaucccaaagaacuucgcuggccccgugucacaacacaacuaccgcccgggguaccacacccagacggcgggacccuggcaucuggguaaguuagagauggauuucgauuucugugagggcaccacgguggucgucaccgaggacugcggcaaccgggggcccagccugaggaccaccacagccucugguaagcucaucaccgaguggugcugccgguccugcacgcugcccccgcugcgcuaccguggggaagacggaugcugguacgggauggagaucaggccccucaaggagaaggaggagaacuuggugaacagccuggucaccgcgggccacggucagauagacaacuucuccuugggcgugcugggaauggcgcuguuccucgaggagaugcugcggacccgcgucgggaccaagcacgccaucuugcucgucgccgugagcuuugugacgcugauaaccggaaacaugucguuccgagacuuagggcgcgucauggugauggugggcgcuaccaugaccgacgacaucgguaugggggucaccuaccucgcacuucuggccgcguuuaagguacgccccaccuucgccgccggccuacugcugcggaagcucacguccaaagagcucaugauggccaccaucgggaucgccuuacucucccagagcacgauacccgagacgauccuggagcugaccgacgcgcucgccuuaggcaugaugguacugaaaaucgucagaaauauggagaaauaccagcucgccgugaccgugauggccaucuccugcguaccgaacgccguuauccuacagaacgcguggaagguuucguguacgauccuggccgccguguccgugagcccacuccugcugaccucuagccagcagaaagccgauuggauaccccucgcccugaccaucaagggccuaaacccgaccgccaucuuccucacgacccugagucguaccagcaagaagcgauccuggccucuaaaugaggccaucauggcugucgguauggugucgauccuagccuccucccugcugaagaacgacaucccuaugaccggaccccucguggccggagggcugcugacggucugcuauguucucaccgggcguagcgccgaccuggagcuagaacgagccgcagacgugaaaugggaggaccaggccgagaucuccgggagcucccccauucugagcauaaccaucucugaggauggcucgauguccaucaagaacgaggaggaggagcagacuuuaaccauccugauccguaccggccuucuggucaucagcggcguguucccgguguccauacccaucaccgcggccgccugguaucugugggaggucaagaagcagagggccggggugcucugggacguucccucgccgccgcccgucggcaaggcagaacucgaagacggggcguaccgcauaaagcagcgcggcauacugggcuacucccagaucggggccggcguguauaaggaggggaccuuccacaccauguggcacgugacgcggggcgccgugcucaugcaccguggcaagcggaucgaacccagcugggccgacgugaagaaagaccugaucuccuacggcggaggcuggaaguuggagggcgaguggaaggaaggagaggaaguccagguccucgccuuagagcccggcaagaauccccgcgcugugcagaccaagcccggcaucuucaagaccaacaccgguacgauaggcgcagucagccuagacuuuucccccgggaccucaggcucucccauugucgaccggaagggaaaaguggugggccucuacggcaacggcgucgugacccgcagcggggccuacguguccgccaucgcucagacugagaaguccaucgaggacaaccccgagaucgaggacgacaucuuccgcaagaagaggcugacgaucauggaucugcauccuggggcaggcaagaccaagcgcuaccuuccagcgaucgucagagaggccaucaagcgggggcugcguacccugaucuuggccccgacccgcgugguggcggccgagauggaggaggcacuucggggccugcccauccgauaccagacccccgccaucaaggccgagcacaccggacgggagaucgucgacuugaugugucacgcgaccuucaccaugcgcuugcugagcccagugcgggugcccaacuacaaucugaucaucauggaugaggcccacuucacggaucccgccucaaucgccgccagaggauacaucaguacccgggucgagaugggcgaggcggccgggaucuucaugaccgccacgccgcccgguucccgcgauccguucccccagucuaacgcgcccaucauggacgaagagagagagauaccugagcgcucauggaacagcgggcaugagugggugacagauuucaaaggcaaaaccgugugguucguaccguccauaaaggcaggcaacgacaucgccgccugccuccggaagaacgggaaaaaggugauucaguuaucucgcaagaccuucgauucggaguacgucaaaacgcgcgccaacgacugggacuuugucgucacgaccgacaucucagaaaugggcgcaaacuucaaggcggagcgcgugaucgacccccgacgcuguaugaaacccgucauauuaacugauggggaggaacgggugauccucgccggccccaugccagugacacacagcagcgccgcccagcgccgggggagaaucggccgcaaucccaaaaacgagaacgaucaguauaucuacaugggcgagccccuggagaaugacgaggauugcgcccauuggaaagaggcaaagaugcugcucgauaacaucaacacgcccgaggguaucauuccguccauguuugagcccgagagagagaagguagacgccauagauggugaguaccgccuacgcggggaggcccgcaagacuuucguggaccugaugcggcgcggugaccuccccguguggcuggccuacaaggucgccgcggaggggauaaacuacgccgaccggaaaugguguuucgacggcaucaagaacaaucagauccuggaggagaacgucgagguugagauauggaccaaggagggcgagcgcaagaaacuuaagccccggugguuagacgcccguauuuacagcgacccccuggcccugaaagaguucaaggaguucgcggccggucggaagucccucgcucugaaccucauaacagagaugggcaggcugcccaccuucaugacacaaaaggccagaaacgcccuggacaaccuggcggugcugcacaccgccgaagcugggggcagagccuauaaccacgcccucagcgagcucccggagacccucgagacauugcuccugcugacccuccuagcgaccgugaccggcgggaucuucuuauuccucaugucaggcaaggggaucggcaagaugacacuggggaugugcugcaucaucaccgcaucgguguuacucugguacgcccagauucaaccgcacuggauugccgccuccaucauccuggaguucuucuugaucgugcuccugauacccgagcccgagaagcagcggacgccccaggacaaccagcugacuuacgugguuauagcgaucuuaacugugguggcggccaccauggccaaugagauggguuuccuggaaaagaccaagaaggaccugggccuugggagcaucaccacacaggagagcgaguccaacauuuuggacaucgacuuacgcccggcgagcgcguggacucucuacgcggucgccacaaccuucgugaccccuaugcugcggcacucaaucgagaacagcuccgugaacgucagcuuaacugccauugccaaccaagccacggugcucaugggacuggggaagggcuggcccuuauccaagauggauaucggugugccccuccuggccauaggcugcuacucgcaggucaacccaaucacucugacagccgcccuccugcugcuuguugcgcacuacgccaucauaggcccggggcugcaggccaaggcuacgcgagaggcccagaaacgggccgccgccggcaucaugaagaaccccaccgucgacgggaucaccgucaucgaccuggagcccauacccuacgaccccaaguucgagaagcagcucggacaggugaugcuacugaucuugugcgugacccagguccugaugaugcgcacgaccugggcccugugcgaggcccucacccuggcaacuggacccaucagcacgcugugggagggcaaccccggacgcuucuggaacaccaccaucgccgucuccauggccaacaucuuccggggauccuacuuagccggcgcgggguuacuguucuccaucaugaaaaacaccacgaacacgcgccgagggaccggcaacaucggggagacccucggcgagaaauggaagucgcgccugaaugcccuuggcaaaagcgaguuccagaucuauaagaaaucuggcauccaggagguggaccggacccuggccaaagaggggaucaagcguggcgagacagaccaccacgccgucagccggggcuccgccaaacugcgcugguucguggagcggaauaugguuaccccggaggggaaggucgucgaccugggcugugguagaggcggauggagcuacuacugcgggggccucaagaaugugcgggaagugaagggccuaaccaaaggugggcccggccacgaggagcccauccccaugagcacguauggguggaaccuggugcgccuccagagcggcguggaugucuuuuucaccccgccagaaaaaugcgacacccuucuuugcgacaucggcgagagcucccccaaccccaccauugaggcugggcgcacgcuucgcgugcucaaucugguagagaacuggcucaacaacaauacccaguucugcaucaaagugcugaauccuuacaugcccagcgugaucgagaagauggagaccuugcagcgaaaguacggaggggcccucgugcgcaacccccugucccggaacagcacccacgagauguacuggguuaguaaugcaaccggcaacaucgucaguuccgugaacaugaucagccggaugcugauaaaucgguucacaaugaaacacaagaaggccaccuacgagccggaugucgaccugggauccggaaccaggaacaucggaauagaaagcgagauccccaaccucgacaucaucggaaagcggaucgaaaagaucaagcaggaacacgaaaccuccuggcauuacgaucaggaccaucccuacaagacgugggccuaucauggcagcuacgagacuaagcaaaccggguccgcguccuccauggucaacggcguggugcgccuguuaacuaagcccugggauguggugccuauggucacgcagauggccaugaccgacacuacucccuuuggccaacagcgcguguucaaggagaaggucgacacgcggacccaggagcccaaggaggggaccaagaagcucaugaagauaacagcggaguggcuguggaaggaacucggcaaaaagaagacgccuagaaugugcacccgggaggaguucacccggaaaguccggagcaacgccgcacucggggcgauuuucaccgacgagaacaaguggaaguccgcccgcgaagccgucgaagauggccgguucugggagcuggucgaccgcgagcggaaccugcaucucgaggggaagugcgagacgugcgucuacaauaugauggggaagcgcgagaagaagcuaggcgaguucgggaaagccaagggcagccgagcgaucugguacauguggcugggggcccgcuuccucgaguucgaggcccucggguuccugaacgaggaccacugguucucccgggguaauagcuugucagggguggagggcgaggggcugcaccgccuuggcuacauccuccgggacgucggcaagaaggagggcggggcaauguacgcagacgacaccgcuggcugggacaccagaauaacccuggaggaccugaaaaacgaagagauggugaccaaccacaugaagggcgagcacaaaaagcucgcagaggccaucuucaaacugaccuaccagaacaagguuguuaggguucagcggccgacaccccgggggaccgugauggacaucauaucccgcaaggaucaaagagggagcggacagguggguacguacgggcugaacaccuuuaccaauauggaggcccagcucauccgccagauggagggagagggaaucuucaagucaauccagcaccugaccgccacggaggagauagcggugcaaaacuggcugacgcguguugggcgggagcgcuugucccggauggccaucucuggcgacgacugcguggugaagccuaucgacgacagauuugcgagcgcccugaccgccuugaacgauaugggcaagguacggaaggacauccaacagugggaacccucccgcggcuggaacgacuggacucagguuccuuucugcagccaccacuuccaugaguuagugaugaaggacggaagggugcuaguagugcccugccgcaaucaggacgaguugaucgggagagcgcgcaucucucagggcgcgggguggagccuaaaggaaacagcuugccuaggcaaauccuacgcccagauguggacccugauguacuuccaccgucgcgaccuucggcuggccgcgaacgccaucugcuccgccgugccaucucacugggucccgacaagcagaacuacgugguccauccaugcuaagcacgaguggaugacuaccgaggacauguuggcgguguggaaccgggucuggauccaggagaacccguggauggaggauaagacccccguugaauccugggaagaggugcccuaccucgggaagcgcgaggaccaguggugcggcucgcugauuggccugacuagccgggccacgugggcaaagaacauccagacugccaucaaccagguucgcagccucaucggcaacgaggaguauacugacuacaugccuucgaugaagcguuuccggagagaagaggaagaagccggcgucuugugguga

SEQ ID NO: 25287 - RNA, 9876 nt, Artificial Sequence
  derived and/or modified CDS sequence (opt11) from DENV-2__FJ850112__SS-prME
accgccggggugaucaucaugcugauccccaccgcgauggcguuucaccuaaccacgcguaacggggagccccauaugauagucggcagacaggagaaggggaagucccuccuguuuaagaccgaggacggcgugaacauguguacccucauggccaucgaccugggggagcugugcgaagacaccaucaccuacaagugcccccuccugcgccagaacgaacccgaggacaucgauugcuggugcaacucgacgagcaccuggguuaccuaugguaccugcaccaccaccggcgagcauagacgcgagaagcggagugucgcccucgugccccacguggggaugggccucgagacacgcaccgagacuuggaugagcucggagggggccuggaagcacguucagcggaucgagacguggauccugcgacacccaggcuucaccaucauggcggcgauccuggcauacacaaucggcaccacgcacuuccagcgggcccucaucuuuauccugcugaccgccguggcgcccagcaugaccaugcggugcaucggcaucuccaaccgggacuuuguggagggcgugagcggaggguccuggguggacaucgugcucgagcacgggagcugcgucaccacgauggccaagaacaagccuacacuggacuuugaguuaaucaagaccgaggcaaagcagccggccacucuccgcaaguacugcauugaagccaagcugacgaacaccaccaccgagucccggugcccgacgcagggcgaacccucacuaaacgaggagcaggacaagagguucaucuguaagcacuccaugguggaccggggcugggggaacggcugugggcuguucggcaagggcgggauugugacaugcgcgauguucacgugcaagaagaacauggaggggaaggucgugcagcccgagaaccuggaguacacuaucguaaucacgccccacucuggggaggagcacgcugucggcaaugacacagggaagcacggcaaggagaucaagaucaccccgcagucgagcauaaccgaggcagaguugaccggguacggcaccgugacaauggagugcaguccccggacgggccucgauuucaacgagauggugcugcugcagauggaggacaaggccuggcucguccaccggcaaugguuucuggaccuuccccuuccauggcugccgggggccgacacccaggguagcaacuggauccaaaaggaaacgcugguuaccuucaagaacccccacgcgaagaagcaggacgugguggugcuggggucccaggaaggcgccaugcacaccgcccugacuggcgccacugagauccagaugagcucagggaacuuacuguucaccggccaccugaaguguagacugcggauggacaagcuccagcugaaggggauguccuacucaaugugcaccggcaaguucaagaucgucaaggagaucgccgaaacccagcaugggacgaucguaauccgcgugcaguacgagggcgacggaucccccuguaagauucccuucgagauuaccgaccuggagaagcggcauguccuuggccgccugaucaccgugaacccgaucguuaucgagaaggacagccccgucaacaucgaggccgagccgccauuuggcgacaguuacauaauuaucggcguggagccgggccaacugaagcucaacugguucaagaaggggagcuccaucgggcagauguucgagaccacgaugcgaggcgccaagcggauggccauccugggggacacggccugggacuucgggagccucggaggggccuucaccuccaucggaaaagcguugcaccaaguguucggggccaucuacggcgcggccuucucgggugucuccuggaccaugaagauccugaucggcgugguaaucacguggaucgggaugaacagccgcuccaccagccuguccgucagccugguucugguuggcgucgugacccuguaccugggcgcgaugguccaggccgacuccggcuguguggugagcuggaagaacaaagagcugaagugcggcagugggaucuucaucaccgacaauguccacacuuggaccgagcaauacaaguuccaaccagagagcccgucuaaacuugccuccgccauucagaaggcccacgaggagggcaucugcgggauacggagcguuacgcgccuggaaaaccucauguggaagcagaucacccccgagcugaaccacauccugagcgagaacgaggugaagcucacgauaaugaccggcgacaccaaggggauaaugcaggcgggcaagcggagccugcgcccgcagcccaccgagcugaaguacuccuggaagacguggggcaaggcgaagaugcucagcaccgagucccacaaccagaccuuccugaucgauggccccgagacugcugaaugcccaaacacuaaccgggcuuggaauagucuggaaguugaggacuauggcuucgggguuuucaccaccaacaucuggcucaagcuccgagaaaagcaggacguguucugcgacucgaaacuuaugagcgcagccauuaaggacaaccgagccgugcaugccgacaugggcuacuggaucgaguccgcccucaacgacaccuggaagauggagaaggccagcuucaucgaggucaaauccugccacuggcccaagagccauacccugugguccaacggcgugcuggagagcgagaugaucauacccaagaacuuugcggggcccgugucccagcacaacuaccggccggguuaucacacucagaccgccgggcccuggcaccuaggcaagcuggagauggacuuugauuucugcgaggggaccacugucgucgugacggaggacugcggcaaccggggccccagccugcggaccaccaccgccagcgggaagcucauuacugaguggugcugccggaguugcacccugcccccgcugagauaccggggagaggacgggugcugguacggcauggaaauacguccccucaaggaaaaggaggagaaccuggugaacucacuggugaccgcugggcacggccagauagacaacuucucccucggcgugcuggggauggcgcuguuccucgaagagaugcugaggacccgcgucgguacgaagcacgccauccugcucguggccgugagcuucgugacccucauaaccgggaacauguccuuucgggaccuaggccgcgugauggugauggucggggccaccaugacggacgacauuggcaugggcguuaccuaccucgcccuucuugcagcauucaaggugcgccccacuuucgccgcuggucuccugcugcgaaagcucaccagcaaagaacucaugauggccacuauugguaucacccugcucucccaaagcaccauccccgagaccauccuagagcugacggacgcgcucgcccuggggaugaugguccugaagaucguucgcaaaauggagaaguaccaacucgccgucaccaucauggccaucuccugcguaccgaacgcugugauccugcggaacgcuuggaaagugagcugcaccauccuggccgccgucuccgugagcccccugcuucugaccuccagccagcagaaggccgacuggaucccgcucgcgcugacgaucaagggccugaaccccaccgcgauuuuccucaccacccugucccgaacguccaaaaagagauccuggccgcuuaacgaggccauaauggccgucggaaugguaagcauccuugcguccagcuuacugaagaacgacaucccgaugaccgggccccucguagcgggagggcugcugaccgucugcuacgugcuaaccggccgcagcgccgauuuagagcucgagcgggccgcugacgugaagugggaggaccaggccgagaucuccgggagcucaccaauccuuagcauuacgaucuccgaggacggcagcauguccaucaagaacgaagaggaggagcagacccuaaccaucuugaucagaacggggcuccuggucaucagcgggguguucccgguguccaucccuaucaccgcggcggccugguaccugugggaggucaagaagcagcgagccggcgugcuaugggacgugcccagcccuccgcccgucgggaaggcggagcucgaggacggcgcguaccgcaucaaacagcgcgggauauuaggauacucccagauuggagccggggucuacaaggagggcacuuuccacaccauguggcacguuacccgcggggcaguucucaugcaccgagggaagcgcaucgagcccagcugggccgacgugaagaaggaccugaucucguacggcgggggauggaaacucgagggagaguggaaggagggcgaggaagugcagguccucgcccuggagccagggaagaacccccgggcggugcagaccaagcccgggaucuucaagacgaacaccgggaccaucggcgcgguuucgcuggacuuuucuccuggcaccagcgggucccccauugucgaccggaaaggcaagguugugggguuguacggcaacggcgucgugacgcgguccggggccuacguguccgccauagcgcagaccgagaaaaguaucgaggacaaccccgagaucgaagaugacaucuuccgcaaaaagcggcucacgauuauggaccuacaccccggcgccgggaagaccaaacgcuaccucccugccaucguccgggaggccaucaagcgcggccugcgcacgcugauccuggccccgacccgggugguggcggccgagauggaggaagcccuucgagggcugcccauccgguaccagacccccgccaucaaggccgaacacaccggccgcgagaucguggacuugaugugucacgcgacguucaccaugcggcuccugagcccagugagagugccgaacuacaaucucaucaucauggacgaggcccauuucaccgacccggccuccaucgccgcgcggggcuacauuagcacucgcgucgagaugggagaggcugccggcaucuucaugacggccacgccgccugggucccgggacccauucccccagucgaacgccccuaucauggacgaagaacgcgagauccccgagcgguccuggaacagcggccacgagugggugaccgacuucaaggggaaaaccgugugguucgucccguccaucaaggcgggcaacgacaucgcggccugccucaggaagaacggcaagaaggugauccagcugagccguaagacguuugauucugaguacgugaagacccgcgccaacgacugggacuuugucgucaccaccgacaucagcgagaugggggccaacuuuaaggcggagcggguuaucgacccccgacggugcaugaagcccgucauccugaccgauggcgaggagcgcgugauacucgccgggcccaugccggugacccacuccagcgccgcccagcggcgcggccgcaucgggcggaaccccaagaacgagaacgaccaguauauauacaugggcgaaccccuggagaaugacgaggauugcgcccacuggaaggaggcgaagaugcuccucgacaacaucaacaccccagaggggauaaucccguccauguucgagccagagcgcgagaaggucgacgcuaucgacggggaguaucgucugcgcggcgaggcccggaagaccuucguugaccugaugcgacgcggggauuuacccgugugguuggccuacaaggucgccgcggagggcaucaauuacgccgaccgaaaguggugcuucgacgggaucaaaaacaaucaaauccuggaggagaacguggagguggaaaucuggacgaaggagggcgagagaaagaaacuuaagccgcgcuggcuggacgcgagaaucuauagcgauccgcuggcccuuaaagaguucaaggaguucgccgccgggcgcaagucccuuacucuuaaccucaucaccgagauggggcgucugcccaccuucaugacacagaaggcccgcaacgcccuggacaacuuagcgguccugcacaccgcggaggccggugggcgggccuauaaccacgcccugagcgagcuccccgagacccuggagacccuacuucugcugacgcuccuggccacugugacgggcggcaucuuccuguuccucauguccgggaagggcaucgggaagaugacccugggcaugugcugcaucaucacagcgagcguccugcuuugguaugcccagauccagccucacuggauugccgcgucuaucauccuggaguucuuccugaucgugcuacucauacccgagcccgaaaagcagcggacgccccaggacaaccaacuaaccuacgucgugaucgcuauccucaccgugguugcggccacaauggccaacgagaugggguuucuggagaagacgaagaaggaccuggggcucggcagcauuaccacccaggagucugaaucuaacauccuggacaucgaccugagaccggccagcgccuggacccucuacgcggucgccacgacuuuugugacccccaugcugcgccacuccaucgagaacagcuccguaaacgucagccugaccgccaucgccaaccaggcgacggugcucauggggcuggguaaaggguggccccuauccaagauggauaucggcgugccccuccuggccaucgggugcuacucucaggucaacccgaucacccugaccgccgcccuccugcuccuaguggcccacuaugcuaucaucggccccggccugcaggccaaggccacgcgggaggcccagaaaagagccgcggccgggaucaugaagaaccccacgguggacggcaucaccgucauagaccuggagcccauaccguaugauccgaaguucgagaaacagcuuggacaggugaugcugcugauccuaugcgucacucaggucuugaugaugcggacgaccugggccuuaugcgaggcccuaacccuggccaccggccccaucucaacccugugggaggggaaccccggccgcuuuuggaauacgaccaucgcggugucaauggcuaacaucuuccggggcagcuaccuggcaggagccggccugcuguucagcaucaugaaaaacacaaccaacacgcggcgcgggaccggcaacaucggcgagacuuugggugaaaaguggaaaucgagacucaacgcgcucggcaagagcgaguuccagaucuauaagaaauccggcauccaggagguagaccgcacccuugccaaggagggcauaaaacgcggagagacggaccaccacgccgucagccgcgguuccgccaaacugcggugguucguagaacgcaauauggugaccccggagggcaaaguuguggaccuggguugcggccgcggcggguggagcuacuacugcggcgggcucaagaaugugcgcgaaguuaaggggcugaccaagggcggccccgggcacgaggagcccaucccaaugucuacguacggcuggaacuuggugcggcuacagagcgggguggacgucuucuucacgccucccgagaagugugacacccuacugugcgacauaggcgagagcagucccaaccccaccaucgaagcgggcaggacgcuccgggugcugaaccugguggaaaacuggcucaacaacaauacacaguucugcaucaaggucuuaaacccguacaugcccagcgucaucgaaaagauggagacucuacagcgcaaguauggaggggcgcucgugcggaacccccuuucccgcaacagcacccacgagauguacugggucuccaaugccaccgggaacaucgugagcuccguuaacaugaucuccagaaugcugaucaacagauucaccaugaagcacaagaaggcuacguacgagccggacgucgaucugggcuccgggacccggaacaucggcaucgagagcgagauccccaaccuggacaucaucggcaagcgcaucgaaaagaucaagcaggagcacgagaccuccuggcacuacgaucaggaucaccccuauaagaccugggcauaccacgggagcuacgagacgaagcagaccggcucagccagcaguauggugaacgggguggugcgccuguugaccaagcccugggacguugugccgaugguuacccagauggcgaugacagacacuacccccuucggacagcagcggguguuuaaagagaaaguagauacucggacgcaggaacccaaagaaggcaccaagaagcucaugcggaucacggccgaguggcuguggaaggagcuugggaagaagaaaacgccccggaugugcacgcgggaagaguucacacgcaagguccggaguaacgccgcccucggcgccaucuucaccgacgagaacaaauggaagucagcgcgcgaggccguggaggacgggcgguucugggagcugguggacaaggagcguaaccugcaccucgagggcaagugcgagacaugcguuuacaacaugauggggaagcgggagaagaaacuuggcgaguucgggaaggcaaagggaagccgcgccaucugguacaugugguugggcgcgcgauuccucgaguucgaggcacugggguuucugaacgaagaccacugguucucccgcgggaacucacuuagcgggguggaaggggagggccugcauagacugggauacauccucagagaugucggcaaaaaggagggcggcgccauguacgccgacgacacggccgguugggacaccagaaucacucuugaagaccugaagaacgaggagaugguaaccaaccacaugaagggcgagcacaagaagcucgcggaggccauuuucaagcuaacguaccagaacaagguggucaggguccagcggccgacgccccgcggcaccgugauggacaucauaucccggcgcgaccaacgcggaagcggccagguggggaccuacggccugaacacguucacgaacauggaggcccaacucauccggcagauggaaggcgaggggaucuuuaaguccauccaacaccugaccgcaacagaggaaauugccgugcaaaacuggcuggcgcgcgugggacgggaacgucucagucggauggccaucuccggugacgacuguguugugaagcccaucgacgaucgcuucgccagcgcccucacggcgcugaacgacaugggcaaaguacggaaggauauccagcaaugggagcccuccaggggguggaacgacuggacccaggucccguuuuguagccaccacuuccacgagcucgugaugaaggacggccgggugcuggucgucccaugccgcaaccaggaugagcugaucggccgggcgcgcaucucccagggggccgguuggagccucaaggagaccgcaugccuaggaaagagcuaugcgcagauguggacucugauguacuuccaccgucgugaccuccggcuggccgcgaacgcaaucugcagcgccgugcccucccacuggguccccaccagccgcacgaccuggaguauccaugccaagcaugaguggaugaccaccgaggacaugcuggcuguuuggaauagaguguggauccaagagaauccguggauggaagacaagacgcccgucgagagcugggaggagguacccuauuugggcaaacgcgaagaccaguggugcgggucccugaucggccugacaagccgggccaccugggccaagaacauccagaccgccauaaaucaggugcgcagccuaauuggcaacgaggaauacacagacuacaugcccagcaugaagcgcuuccggcgcgaggaggaggaagcgggggucuugugguga

SEQ ID NO: 25288 - RNA, 9876 nt, Artificial Sequence
  derived and/or modified CDS sequence (opt11) from DENV-2__FJ850105__SS-prME
accgccggcgugaucaucaugcugauccccacagccauggcguuccaccugacaacccggaacggagagccucauaugaucguuggcagacaggaaaaggggaagucccugcuuuucaaaaccgaggacggcgugaacaugugcaccuugauggccaucgaccucggagaguuaugugaagacaccauaaccuacaagugcccccuccugcgccagaacgagcccgaggacaucgacugcugguguaauagcacuagcaccugggugaccuacgggaccugcacuaccacgggcgagcacagaagggagaagcgauccgucgcgcugguaccgcacguugggaugggccucgagacccgcaccgagaccuggaugagcuccgaaggggcauggaagcacguccagcggaucgagaccuggauccuccgccauccgggcuucaccaucauggccgcaauucuggccuacacuaucgguacaacgcacuuucagcgggcccuuaucuucaucuugcugacggccguggcgcccagcaugaccaugcgcugcaucggcaucuccaaucgagauuuuguugagggcgucagcgggggcuccuggguggacaucgugcucgaacacgggagcugcgucaccacgauggccaagaacaagcccacccuggacuucgagcugaucaagaccgaggcaaagcagcccgccacccuccgcaaauacuguaucgaggcuaagcugacaaacacuaccaccgagucccgcugcccgacgcagggcgaaccgagccuaaaugaggaacaggacaagcgguucaucugcaagcacucgaugguggaccgggguugggggaacggcuguggacuuuuuggcaagggcggaaucgugacgugcgcgauguuuacgugcaagaagaauauggaggggaaggucgugcagccugaaaaucuggaguauaccauugugaucacuccacacucaggggaggagcaugcaguaggcaacgauaccgggaaacacggcaaggagaucaagaucacuccgcagagcagcauuacagaggccgagcugacgggauauggcaccgucacuauggaauguagucccagaaccggccucgauuucaacgagauggugcugcugcagauggaggacaaggccuggcucguccaccggcaaugguuccuggaccuaccgcucccguggcugccgggggccgacacccagggcucgaacuggauccagaaagagacgcuggugaccuucaagaacccccacgcgaagaagcaagauguagucguccucggcucccaagaaggcgccaugcacacagcuuugaccggggccacggagauccagaugagcucaggcaaccuccuguucaccggccaucucaagugccgccugcggauggauaagcuccaguuaaaggggauguccuacagcauguguaccggaaaguucaagaucgucaaggaaaucgccgagacccagcacgggaccaucgugauccgcauccaguacgagggggacggcucccccuguaagauuccauucgagaucaccgacuuagagaagcggcacgugcuggggcgccugaucaccgucaaccccaucgugaucgagaaagauagccccgugaacaucgaggcggagccuccguucggcgauuccuacaucaucaucggagcagagcccggacaguuaaagcugaauugguucaagaaggggucauccaucggccagauguucgagacaaccaugaggggcgccaagcgaauggccauucugggugacaccgccugggacuucggcagccucggcggggucuucaccuccaucgggaaggcacuucaucagguguucggugcgauuuauggcgccgcauucagcgggguuuccuggaccaugaagaucuugaucggugucgugaucacguggaucgguaugaacucgcgcuccacuucucuguccgugagccugguccucguggggguggucacccucuaccugggagcgauggugcaggccgauaguggcugcguggucucguggaagaacaaggagcucaaaugcggcuccgggaucuucaucaccgacaauguccacacguggaccgagcaguacaaguuccagcccgaaagccccucgaagcuggccuccgcaauccagaaggcccaugaagagggcaucugcggcauccggagcguuacccgcuuggagaaccuaauguggaaacagauuaccccggaguuaaaccacauccuguccgaaaacgaggucaagcucacuaucaugaccggcgacaccaagggaaucaugcaggcgggaaagcggucgcuucgcccgcagcccaccgagcugaaguacuccuggaaaacguggggcaaagccaagaugcucagcaccgaaucccacaaccagaccuuccugaucgacgggcccgagaccgccgagugcccaaacacgaaccgggccuggaauagcuuggagguugaggauuacggcuucggaguguucaccaccaacaucuggcucaagcugagggaaaagcaggacgucuucugcgacuccaagcuaaugagcgccgcuaucaaagauaaccgggccgugcaugccgacaugggcuacuggauugaguccgccuuaaacgacaccuggaagauggaaaaggccagcuucauagaggucaaguccugccacuggcccaaaagccacacccugugguccaacggcguuuuggagagcgagaugaucauacccaaaaauuuugcaggccccgugucacagcacaacuaccgcccgggguaccacacccaaacugccgggcccuggcaccucggaaaguuggagauggacuucgauuucugcgaggggaccacuguggucguuacugaggacugcggcaaccgaggucccagccugcggacgaccacugccagcgguaaacuaauuacggagugguguugucgguccugcaccuugccaccgcugcgcuaccggggcgaagauggguguugguauggcauggaaaucagaccgcugaaggagaaggaagagaaccuugugaacagccuggucaccgccgggcacggccaaauagacaacuucucgcucggcguucugggaauggcuuuguuucucgaggagaugcugcguacgcgcgugggcacgaagcacgccauacugcucgucgccgugagcuucgugacgcugaucaccgggaacaugucauuccgggaccugggcagggugauggugaugguaggggcaacaaugacggacgacaucgguaugggaguaaccuaccucgcccuguuagcggccuucaaggugcgacccaccuucgccgccgggcuccugcugaggaaacucaccucaaaggagcugaugauggccacuaucggcauaacacugcucucccagagcaccaucccggagaccauccuggaacugacggacgcgcucgcacugggaaugaugguccugaagaucguccgcaacauggagaaauaccaguuggcggugacuauaauggcaauaucuuguguuccgaacgccgugauucuccggaacgcguggaagguuucaugcaccauccuagccgcggugagcgucagcccccuccugcugaccuccagccagcagaaggccgacuggaucccccucgcgcugacuaucaagggccugaaccccaccgccaucuuccucaccaccuuaucccgcacguccaagaagcguucuuggccgcucaacgaggcaauuauggccguggguauggucucaauccucgccuccagccugcugaaaaaugacauccccaugaccgggcccuugguggcggguggguuacugaccgugugcuauguccucaccggccgcagcgccgaucuggagcuggaacgggcagccgacguaaaaugggaggaccaagccgagaucuccggcagcuccccgauccucagcaucaccaucuccgaggauggcuccauguccaucaagaacgaagaagaggagcagacccucacuauccugauccgcaccggccuccuggugaucagcggggucuucccggugucgaucccuaucaccgcagccgccugguaccugugggaagugaaaaagcagcgggcgggcgugcugugggacguacccagcccgccgccaguggggaaggccgagcuagaggacggcgcguaccggaucaagcaacguggaauccugggauacucccagauuggcgccggggucuacaaagagggcacauuccacaccauguggcacgugacgcgcggcgccguacucaugcaccggggcaagcgaaucgagcccagcugggccgacgucaagaaggacuugauuuccuaugggggcggauggaagcuugagggggaguggaaggagggcgaggaaguccaggugcucgcccuggagcccgggaagaaccccagagcgguucaaaccaagccaggcaucuucaagacaaauaccggaaccaucggcgccgucucccuggacuucucccccggcaccagcgggucccccaucguggaucggaagggcaaagugguggggcuguacggcaacggcguggucacccggagcggggccuacguguccgccaucgcccagaccgagaaguccaucgaggacaaccccgagaucgaggacgacauauuccgcaaaaagcggcugaccaucauggacuuacaucccggcgcggguaagacuaagcgcuaccuccccgcuaucgugcgggaggccaucaaacgcggccugcgcacgcugauacuggccccaacccgggucguggcggccgagauggaagaagcccuccgcgggcugcccauccgguaccagacccccgccauaaaggccgagcacaccggacgcgagaucguggaccugaugugccacgcgacguuuaccaugcggcucuugagccccgucaggguucccaacuacaaucugaucaucauggacgaggcccacuucaccgacccggccuccauugcugcccggggcuacauaagcaccagaguggagaugggggaggccgccgguaucuucaugacggccacgccgccggggucccgggacccuuucccccaauccaaugcucccaucauggaugaggaaagggagauccccgagcgguccuggaacuccggccacgagugggucacagacuuuaaggggaaaaccguaugguucgugcccucgaucaaagcgggcaacgacauugccgccugccuccgcaagaacggcaagaaggucauccaguuaagccgaaagacguucgacuccgaguacguaaagacccgcgccaacgacugggacuucguggucaccaccgacaucucugagaugggggccaacuucaaggcugagcgggugaucgacccaaggagaugcaugaagcccguuauccuuacggauggugaggaacgcgucaucuuggcggggcccaugccugugacccacuccagcgccgcccaacggcgcgggcgcaucgggcggaaccccaagaacgagaacgaccaguacauuuacaugggugagccccuugagaacgacgaggacugcgcccauuggaaggaggcgaaaaugcuacucgacaauauaaauacccccgagggcaucaucccgucgauguucgagccugagcgcgagaagguggacgccaucgacggugaauaucggcugcgcggcgaggccagaaagaccuucgucgaccugaugcggcggggggaccuccccgucugguuggcauacaagguggccgcggagggaauuaauuacgccgacagaaaauggugcuucgacgggaucaagaauaaccagauucucgaagagaacgucgagguagaaaucuggacaaaggagggcgaacggaagaaguugaagccgcgauggcuggacgcccggaucuacagcgacccccuggcccucaaggaguucaaagaguucgcugccggucguaagucccugacccugaaccucaucaccgagauggggagacugcccaccuucaugacgcaaaaggcccgaaacgcccuggauaaccucgccgugcugcauaccgcggaagccggggggcgggccuacaaccacgcccugucggagcuccccgagacccuggaaaccuuacuccuguuaaccuuacuggcuaccguaacugggggcauuuuccuguuccucaugucaggcaagggcaucggcaagaugacccugggcaugugcugcaucauuaccgcaagcguucugcucugguaugcccagauccagccgcacuggaucgccgccagcaucauccuggaguucuuccugauuguucuccugauccccgagcccgagaagcagcggacaccccaggauaaccagcugaccuacguggugaucgccauucucaccgucguggcugccaccauggccaacgagaugggauuccuggagaagacgaagaaggaccugggguugggcagcaucacaacccaagagagcgaguccaacauccuagacaucgaccugcguccggccagcgccuggacccucuacgcgguggccacgaccuucgucacccccaugcugcgccauuccaucgagaauagcuccgugaacguaucccucaccgcaauugcaaaccaagcgacggugcuaaugggguugggcaagggguggccacuguccaagauggacauuggcguaccuuugcuggccaucgguuguuacagucaaguaaauccgaucacccugacggccgcguuacugcuguuaguggcccacuacgccaucaucggccccggcuuacaagccaaggccacccgggaggcccaaaagcgcgccgcugcggguaucaugaagaaccccacggucgacggcaucaccgugaucgauuuggagcccauuccguacgaccccaaguucgagaagcaacuggggcaggucaugcugcugauucucugcgugacgcaggugcugaugaugcgaaccacaugggcucugugcgaggccuuaacccuagcuaccggccccaucuccacccugugggaggggaacccuggccgcuucuggaacacgaccauugccgucagcauggcgaacaucuuccgagggucauaccucgcuggagccggccugcuguucagcaucaugaagaauacgacgaacacgcgccgcgggaccggcaacaucggagagacucucggggagaaguggaagucccgacucaacgcacuaggcaagagcgaguuccagaucuauaaaaaguccgggauacaagagguggaccgcacucucgccaaagaaggcaucaagcgcggugagacagaccaccacgccgugagccgcggcagugccaaacugcggugguucgucgagcgcaacauggugaccccggagggcaaggugguagaccuggggugcggucgcgggggguggagcuacuacugcggcggccucaagaacgugcgcgaggugaaaggccugaccaaggguggccccgggcaugaagagccuaucccgaugaguaccuacgguuggaaccugguccggcuccaaagugggguagacguguucuucaccccgcccgaaaaaugcgacacccugcugugcgacauuggggagagcucccccaacccuaccaucgaggccggccgcacccuccgaguucugaaccucguggagaacuggcucaacaacaacacccaauucugcaucaaagugcugaacccguacaugcccagcguaaucgagaagauggagacucugcagcgcaaguacgggggcgcgcucgugcggaacccccugucacgcaacagcacgcacgagauguacugggugagcaacgccacagguaacaucgucucgucgguaaacaugaucucgcggaugcuaauaaaccgcuuuacgaugaagcauaaaaaggcaacguacgagcccgacguggaucugggcuccggcacaaggaauaucgguaucgaaagcgaaauccccaaccucgacaucaucggcaagcggauagagaagauuaaacaagagcaugaaaccucuuggcauuacgaccaagaccacccuuacaagaccugggcuuaucacgggagcuacgagacgaagcaaacgggcuccgccagcuccaugguaaacgggguggugcgcuugcugacgaagcccugggacgucgugccaauggugacccagauggcgaugacggacaccacucccuucggccagcagcggguguucaaagaaaaaguggacacaaggacacaagagcccaaagagggcaccaaaaagcucaugcggaucaccgccgaguggcuguggaaggaguuggguaaaaagaagacgccccggaugugcacgcgggaggaguucacccgcaaggugcggagcaacgccgcccuuggcgccaucuuuacggacgagaacaaauggaagucagcgcgcgaggccgucgaggacgggcgguuuugggagcugguggacaaggagcgcaaccuucaccucgagggcaagugcgagaccugcguguacaacaugauggggaagcgggaaaagaaacuaggcgaguucggcaaggcuaaggggagccgcgccaucugguacaugugguugggcgcgcgauuccucgaguucgaagcucuaggauuucugaacgaagaucacugguucucgcgcggcaauagccucagcggagucgaaggggagggccugcaucggcuaggguauauucuccgcgacgugggcaagaaagagggcggcgccauguacgccgacgacacagccgggugggacacccggauuacccuggaggaucugaagaaugaagagauggucaccaaccacaugaagggugagcacaaaaaguuagcggaggccaucuucaaacugacguaccagaauaagguggugcgcguccaacggccgacuccucgcggcaccguuauggacaucaucuccagacgcgaccaacgugggagcggucagguggggaccuacggcuuaaacacguucaccaacauggaggcccagcucauucggcaaauggagggggaggggaucuuuaaguccauucagcaccugaccgccaccgaggaaaucgccguucagaacuggcuggcgcgcgugggccgugagcgccucagccguauggcgauuaguggggacgacugcguggucaagcccaucgacgaccgcuucgccucugcccugacggcccugaacgacaugggcaaaguacggaaggacauacagcagugggagcccucacgcggguggaacgacuggacucaggugccguucugcagccaucacuuccaugagcuuguuaugaaggacggcagggucuuggugguccccugccgcaaccaggacgagcuuaucggccgggcacgcaucucucagggggcgggcuggagccucaaagagaccgccugcuuggggaagaguuaugcucagauguggacccuuauguauuuccaccggcgcgaccuccggcuggccgccaacgcaauuugcagcgccgugcccagucacuggguucccaccucccggacgaccuggagcauucaugccaagcacgaguggaugaccaccgaggacaugcuggccgucuggaaucgaguguggauucaggagaacccauggauggaggacaagacgcccguggagucuugggaggagguccccuacuugggcaagcgagaagaccaguggugcgguucccugaucggccugaccagccgggccacuugggccaagaacauucagaccgcuaucaaccaggugcgcucacucaucggcaaugaggaauacacggauuacaugccuuccaugaagagguuccgccgcgaggaggaggaagcuggggugcugugguag

SEQ ID NO: 25289 - RNA, 9876 nt, Artificial Sequence
  derived and/or modified CDS sequence (opt11) from DENV-2__FJ850106__SS-prME
accgccggcgugaucaucaugcugaucccuaccgcuauggcguuccaccucacgacucgcaacggggaaccucauaugaucgugggccggcaagagaaagguaaguccuuacuguucaagacagaagacggcguaaacaugugcacccucauggcgaucgaccuuggcgagcugugcgaggacaccaucacauacaaaugcccccuccugaggcagaacgagccugaggauaucgacugcuggugcaauucaaccuccaccugggugaccuacgggaccugcacgaccacgggggagcaccggcgugagaagcggucugucgcacugguaccucacguaggcaugggccucgagacucgaaccgagacauggauguccuccgaaggggccuggaagcaugugcagcgcauagagaccuggauccuacgccacccgggcuucacgauaauggccgcgauccuggccuauaccauaggcaccacgcacuuccagcgggcccuaauauuuauccugcugaccgccguggcgcccucgaugaccaugcgcugcauaggcaucuccaaucgggacuucguggagggagucagcgggggauccuggguggacaucguacucgagcaugguagcugugucaccacaauggccaagaauaagcccacccuggacuucgagcugaucaagaccgaggccaagcaacccgcgacgcuccgcaaguauugcaucgaggccaagcugacgaacaccaccaccgagucccggugccccacgcaaggcgaacccagcuuaaacgaggaacaggacaagagauucaucugcaagcacuccaugguggaccggggcugggggaacggcugcgggcuguucggcaaggguggcauagugaccugcgcgauguuuacgugcaagaagaauauggagggcaaagucguccaacccgagaaccuggaguacaccaucgugaucacgccccauagcggggaagagcacgccgucggaaacgacaccgggaagcacggaaaagaaauuaagaucaccccacaauccucgauuaccgaggcggagcugaccgguuacggcacggugaccauggagugcagcccgcggaccggccucgauuucaacgagaugguacuucugcaaauggaggacaaggcauggcucguccacaggcaaugguuccuggaccugcccuuacccuggcugccgggggccgacacgcagggcagcaacuggauucagaaggagacgcuggugaccuuuaagaacccccaugcgaagaagcaagacguggucguguugggaagucaggagggcgccaugcacacagcgcucacgggggccacggagauccagaugagcagcggcaacuugcuuuucacuggacaucuaaagugucgccugcggauggacaagcuccagcuuaaggggauguccuacagcaugugcaccggcaaguucaagauagucaaggagaucgccgagacgcagcacgggacaaucgugauccgcauccaauaugagggcgacggcuccccguguaagaucccguucgagaucaccgacuuggagaagcggcacguguuaggacgcuuaaucacugugaacccgaucgugaucgagaaggacagcccggugaacaucgaggcggagccgcccuucggcgacucauacaucaucaucggugucgagccgggacaauugaagcucaacugguucaagaaagggagcuccaucggccagauguuugaaaccacaaugcgcggcgccaagaggauggcaauccugggggacaccgccugggauuuugguagccucggcgggguguuuaccucgaucgggaaggcccuccaccaaguauucggggcaaucuacggcgcagccuucucggguguuuccuggacaaugaagauacugaucggcgugguaaucacguggaucgggaugaacagccguuccaccagccuaucagucagccucgugcucgucggcgugguuacccuguaccucggcgcgauggugcaggcggacuccggcugcgucgugucguggaagaacaaagagcucaaaugugguucagggauuuuuaucaccgacaacguccacacguggacagagcaauacaaguuccaacccgagagccccagcaagcuggcguccgccauucagaaagcccacgaggaggggauuugcgggauccggagcguuacccgccuggagaaccucauguggaagcagaucacccccgagcuuaaucacauccuguccgagaaugaggugaagcucacgauuaugaccggcgacaccaagggcauuaugcaggccggcaagcggucucugcgcccucaaccuaccgaacugaaguacuccuggaaaacguggggaaaggcgaagaugcucagcaccgagucccacaaccaaaccuuccugaucgaugggcccgagaccgccgagugccccaauacgaaccgggccuggaacucccuugaaguggaggacuacggcuucggcguuuucaccaccaacauauggcucaaacugcgagagaagcaggacguuuucugcgacuccaagcugaugucggccgccaucaaggauaaccgggcggugcacgcggacaugggcuauuggaucgaguccgcgcugaacgacaccuggaaaauggagaaggccuccuuuaucgaggucaagaguugucauuggcccaaaagccacacccuguggaguaauggagugcuagaguccgagaugauaauacccaagaauuucgccgggccugugucccagcacaacuaccgcccaggcuaccacacgcaaaccgcgggccccuggcaccuaggcaagcuggagauggacuucgacuucugcgagggaacaaccgucguggugacggaggacugcgggaaccgggggcccucgcugagaaccacaaccgccagcgggaaacucaucaccgaguggugcugucgguccugcaccuugcccccguugagauaucggggcgaagacgggugcugguacggaauggagauccgcccuuugaaggaaaaggaggagaaucuggugaacagccuggugaccgccgggcacgggcaaaucgacaauuuuucccugggagugcuggggauggcccuguuccucgaagagaugcucaggacccgcgucggcacgaagcacgcgacccugcucguagcggccucuuucgugacccugaucaccgggaacaugucauuccgggaucuaggacgcgucauggugaugguuggugcgacgaugaccgacgauaucggcaugggagugaccuaccuagccuuacuggcggcauuuaagguccgccccacauucgccgccgggcuccugcugcggaagcucacgagcaaggagcugaugauggccacgaucgggaucaccuuacucucccaaagcaccauaccggaaacgauccuggagcugaccgacgcccucgcccuggggaugauggugcugaagauuguccgcaacauggagaaguaccaacucgcaguuaccaucauggccaucucgugcgugccgaacgcugucauccuucguaacgcguggaaggugagcugcacaauccuugccgccguguccguuucgccccuacugcugacgucaagucaacagaaagccgacuggaucccacucgcgcucaccaucaagggucucaaccccacagccaucuuccucaccacgcugucccgcacaagcaagaaaagguccuggccguugaaugaggccaucauggcugugggcauggucucgauccucgccagcagccugcucaagaacgacauucccaugaccggaccccucguagcgggcggucugcugaccgugugcuacguucucacuggccgcagcgcagaccuggaguuggagcgggccgcagaugugaagugggaggaccaggcggagaucucggguucgucucccaucuugagcaucaccaucuccgaagacgguagcauguccaucaagaacgaagaggaggagcagacccugacuauccugauucgcaccggcuuacuaguaaucucgggggucuucccgguguccauucccaucacggcggcagccugguaccuaugggaggugaagaaacagcgggcagguguccucugggacgucccuucaccgccgcccgugggaaaggccgagcuggaggacggcgcguaccgcauuaaacagagggggauacugggauacucccaaauaggugccggggucuauaaggagggcaccuuccacaccauguggcacguuacccgcggagccgugcucaugcaccggggcaagaggauugagcccucuugggccgaugucaagaaggaccugaucucauacgggggcggcuggaagcuggagggagaguggaaggagggagaggagguccaggugcuagcccuggagcccgggaagaaccccagagcuguccagaccaaaccggggaucuucaagaccaauaccggcaccauaggcgccguuagccuggacuucucccccggcacgagcggcucuccuaucguggaccgcaaaggcaaggucguagggcucuauggcaacggcguaguaacgcgaagcggggccuacguguccgccaucgcacaaaccgagaagaguaucgaggacaaccccgagaucgaggacgauaucuuccgcaagaagcgguuaaccaucauggaccugcaccccggcgccgggaagacgaaacgcuaccuccccgccaucgugcgggaggccauaaaacgcggccugcgaacccugauccuggccccgacccgggucguggcagccgagauggaagaggcacuccgcggccugcccaucagguaccagacccccgccaucaaggccgagcacacgggccgggaaauuguggaccugaugugccacgcgaccuucacuaugcggcuucugagccccguccgugucccgaacuauaaccugaucaucauggacgaagcccauuucaccgaccccgccuccaucgccgcccggggcuacaucucgacccgugucgagaugggggaggcggccggcaucuucaugacggccacgccgcccgguagucgcgacccguucccccagucuaacgccccaaucauggacgaggagcgcgagauacccgagagauccuggaacagcggccacgagugggugaccgacuucaaggggaagacggugugguuugucccguccaucaaagcgggcaacgacaucgccgccugccugcggaagaacggcaagaaggucauacagcugagccggaagacuuucgacuccgaguacgugaaaacccgcgccaacgacugggauuuugugguuacgacggacaucagcgagaugggggccaacuuuaaggcggagagaguaaucgaccccaggcggugcaugaagcccguuaucuuaaccgacggugaagagcgggucauccuggcgggccccaugccggugacccacucaagcgccgcccagagacgcggccggaucgggcggaaucccaagaacgagaacgaccaguacaucuacaugggcgagccguuagagaacgacgaggauugcgcacacuggaaggaggcuaagaugcuuuuagacaacaucaacacaccugagggaaucauuccguccauguucgaaccugagcgcgagaagguggacgccauugacggggaguaccggcugcgcggagaagcccggaaaaccuucgucgaucugaugcgccgcggggaccuccccguguggcuggccuauaagguagccgcagagggcaucaacuacgccgaccggaaauggugcuucgacgggauaaaaaacaaccagauccuggaggagaauguugagguggagaucuggaccaaggaaggcgaacggaagaagcucaagccgcgcuggcuggaugcgaggaucuacucugaccccuuggcccugaaggaguucaaggaguuugcggccggccgcaaauccuugacccugaaccuuaucaccgagaugggacggcugccgacguucaugacccagaaagcccgcaacgcccuggauaaccucgcaguguuacacacugccgaggccggcgggcgugcauacaaucaugcccugagcgaacuccccgagacauuagagacgcuguuacugcugacccucuuagccaccguaaccggcggcauuuuccuguucuugaugucugggaagggcauugggaagaugaccuuagguaugugcugcaucauaacggcguccgugcuccucugguaugcgcaaauccagccgcauuggaucgccgcgaguaucauccuggaauucuuccugauuguccuccugauccccgagccugagaagcaacgcacgccucaggacaaccagcucaccuacguggugaucgccauccucaccguaguggccgccacgauggccaacgagauggguuuucuggagaagaccaaaaaggaucuuggacucggaagcaucaccacgcaggagagcgaguccaacauacuggacaucgaucugcgcccggcuuccgcauggacgcucuacgcggucgccaccaccuucgucacgcccaugcugcgccacuccaucgagaacagcagugugaacguaaguuuaacggcuauugcgaaccaggcgaccguccuuauggggcugggcaagggguggccccuguccaagauggacauuggcgugccccuccuggcgaucgggugcuacagccaggugaacccgaucacccugaccgcagccuuacugcuccugguggcacacuacgcgauaauuggccccggccuccaggccaaagcaacacgggaggcccagaagagagcggcggcagggauuaugaagaaccccaccguggacggcaucaccgugaucgaccuggagccuauacccuacgaccccaaauucgagaagcagcuugggcaggucaugcugcugaucuugugcguaacacaggugcucaugaugaggacgacuugggcacucugcgaggcccucacccuggccaccggcccuaucucgacgcucugggagggcaaccccggccgcuucuggaacaccaccaucgccgucagcauggcuaacaucuuccgcggcuccuaccucgccggggccggccuguuguucagcaucaugaagaacaccacuaacacccggcgcgggaccgguaacaucggugaaacccucggggaaaaguggaaguccagacugaacgcacuggguaaaagcgaguuccagaucuacaagaaauccgggauccaggagguggaccgcacgcucgcaaaggagggcaucaagcgcggggagacggaccaccacgccguuagccgcggcuccgccaaauugcggugguucgucgagcgcaacauggugaccccggaaggcaaaguggucgaccuaggcuguggcagaggaggcuggagcuacuacugcgggggccucaagaacgugcgcgaggucaagggccugaccaaggguggcccugggcacgaggagcccauccccauguccacguauggcuggaaccugguccggcuccagagcgggguggacguguucuucacaccgcccgagaaaugcgacacgcugcugugcgacaucggggaaucaucccccaaccccacgaucgaggcuggccgcacccuccggguccugaaccugguggagaacuggcucaacaauaauacgcaguucugcaucaaggugcugaauccguauaugcccaguguaauagagaagauggagacacuccagcgcaaguaugggggcgcguuggugagaaacccccugucccgcaacagcacacaugagauguacuggguguccaacgccacagggaacaucgucagcagcgugaacaugaucagccggaugcucaucaaccgcuucacgaugaagcacaagaaggccacauacgagccggacguugacuugggcuccgggaccagaaacaucggaaucgagucggagauaccaaaccucgacaucaucggcaagcgcaucgagaagaucaagcaggagcacgaaaccucuuggcauuaugaccaggaccaccccuacaagacgugggccuaccacgggagcuacgagaccaagcagacaggcuccgcgucgucaauggucaacggggugguacgccugcugaccaagccuugggaugucguaccgaugguuacucagauggcgaugaccgauacgacuccuuucgggcaacagcgggucuucaaagagaagguggauacuagaacucaggagcccaaggagggcaccaagaaacuaaugcggaucacugccgaguggcuguggaaggaauuggggaagaagaagacgccacgcaugugcacccgggaggaguucacccgcaaggugcggucgaaugccgcccucggcgccaucuucaccgacgagaacaaguggaagagugcgcgcgaggccguagaggacgggcgguucugggaacuuguggacaaggagcgcaacuugcaccucgagggcaagugcgagacaugcguauacaacaugauggggaagagagagaaaaaacuaggcgaguucggcaaggccaaggggagccgcgccauaugguauauguggcugggugcgcgguuccucgaguucgaggcccucggguuccuaaacgaggaccauugguucucccgcggcaacucgcucagcggggucgagggcgagggccugcacaggcugggguacauucucagagacgugggcaagaaggagggcggcgccauguacgcggacgauacggcugggugggacacccggaucacgcuggaagaccugaagaacgaggaaauggucacgaaucacaugaagggcgagcacaagaagcucgcagaagccaucuucaagcugacuuaucagaacaagguggugcgcguccagcggccgacgccccgugggaccgugauggacauuauuagccggcgcgaccagcgcgggagcggccagguggggacguacggccugaacaccuucaccaacauggaggcccagcucauccggcagauggaaggcgaggguaucuucaaguccauccagcaccugaccgccacggaggaaaucgccguccagaacuggcuggcucgggugggccgcgagcgccugagccggauggccaucuccggggacgacugcgugguaaagccaaucgaugaccgcuuugcuuccgcgcugaccgcccugaaugacaugggaaaggugaggaaggacauccagcagugggagcccucccgcggguggaacgacuggacccaggugcccuucugcagccaccacuuccacgagcucgucaugaaggacggacggguucuggugguaccuugccgcaaccaggacgaacugaucggccgugcgcgcauuucccagggggccggcuggagccuaaaagagaccgccugccuggggaaguccuacgcccagauguggacguugauguacuuccaucggcgcgaccuccggcucgccgcgaaugccauuugcuccgccgugcccucccacugggugccaacgucgcgcacuaccugguccauccaugccaagcacgaguggaugaccacugaggacaugcuugcggucuggaaccguguguggauccaggagaauccguggauggaggauaagacccccguggagucgugggaggagguccccuacuuaggcaaacgcgaggaccaguggugcggcucccugaucggccuuacgagcagggccaccugggccaagaacauccagacggcuaucaaccagguccgcagcuuaauugggaacgaagaguauaccgauuacaugcccuccaugaagcgauucagacgcgaggaagaggaagcggggguccuaugguga

SEQ ID NO: 25290 - RNA, 9876 nt, Artificial Sequence
  derived and/or modified CDS sequence (opt11) from DENV-2__FJ850107__SS-prME
accgccggugugaucaucaugcugaucccaaccgcgauggcguuccaccucacaaccaggaauggggaaccacacaugauuguggggaggcaagaaaaggggaagucccugcuguuuaaaaccgaagacggcgugaacaugugcacucucauggccaucgacuuaggggagcugugcgaggacaccaucaccuacaagugcccccuccugcggcaaaaugagccagaggacaucgacugcuggugcaacagcaccagcacauggguuaccuauggaaccugcaccaccacgggcgaacaccggcgagagaagagaucagucgcccucguuccacacguggguaugggucucgaaacacgcacugaaaccuggaugagcuccgagggggcauggaaacacguccagcggaucgagaccuggauccugcgccauccgggcuucacaaucauggccgcuauccuggcuuacaccaucgggaccacgcacuuccagcgugcacucaucuuuauccugcuuacggccguggcucccagcaugaccaugcggugcauagguaucaguaaccgagacuucguggagggcgucagcgggggcucauggguggacauugugcucgagcacggcagcugcgucaccacgauggccaagaacaagcccacccuggauuuugagcugaucaagaccgaggccaaacagcccgccacccuccggaaguacugcaucgaggccaagcugacgaacaccaccacggagucccggugcccgacgcagggcgagccaagccugaacgaggagcaggacaagcgcuuuauuugcaagcacaguaugguggaccggggcugggggaauggcugcgggcuuuucgggaagggcgggauugugaccugcgcaauguuuaccugcaagaagaacauggagggcaaggucguccagcccgagaaccuggaguacacaauagugaucacgccacacaguggggaagaacacgccgucggcaacgacaccgggaagcacggcaaggagaucaaaauuaccccgcaguccagcaucacagaggcugagcugaccggguacggcacgguaaccauggaauguucaccgaggacuggccucgacuucaacgaaaugguguuacugcagauggaagacaaggccuggcuuguacaccgccagugguuccuggaccuacccuugcccuggcugccgggggcagacacgcagggcucgaacuggauccagaaggagacgcuggugaccuuuaaaaacccucaugcgaagaagcaggacgugguaguacucgggagucaggagggugccaugcacacggcccugacaggcgccacugaaauacagaugagcuccggcaaccuccuguuuaccgggcaccuuaaguguaggcugcgaauggacaagcuccagcugaagggcauguccuacucuaugugcacaggcaaauucaagaucgucaaagagaucgcugagacccagcacgggacaauagugauacguauccaguacgagggcgauggcucgcccugcaaaauacccuucgagaucaccgaccuggagaagcgacacgugcucggucgccucaucacagucaacccgaucgugaucgaaaaggacagccccgugaacaucgaggcugagccgcccuucggcgacuccuacaucauuaucgggguggagccgggccaacuaaaauugaacugguucaaaaagggaagcuccaucggucagauguucgaaaccacgaugcgcggcgccaagcguauggcaauccugggggacaccgccugggacuucggcagccucggcggggucuucaccucaaucgggaaggcccuacaccagguuuucggugcgaucuacggcgcugccuucagcggggucucuuggaccaugaaaauccugaucggcgucgugaucacguggaucgggaugaauagccgcucuacaagccugagcguaagccuugugcucgugggcgucgugacccuguaccugggggccauggugcaagcggacuccggcugcguuguguccuggaagaauaaagaauuaaaaugcggcuccgggaucuucauuaccgacaaugugcacacguggaccgagcaguacaaauuccaaccugagucaccgagcaaauuagccuccgcaauccagaaggcccaugaggagggcaucugcgggauccggagcguaacccgccuagagaaccucauguggaagcagaucacccccgagcugaaccacauccuguccgagaacgaaguuaaacucacaauaaugaccggcgauaccaaagguaucaugcaggccgggaagcggagccuucgcccgcagcccacagagcugaaguacuccuggaaaacauggggcaaggcgaaaaugcucaguaccgaaucccacaaucagaccuuccugaucgacgggccggagaccgccgaguguccgaacacgaaccgggccuggaacagucuggagguugaggacuauggcuucggggucuucaccaccaacauuuggcucaaacugcgagaaaagcaggauguguucugcgauagcaaauugaugagcgcagccaucaaggacaaccgggcaguucacgcggacauggguuauuggaucgaguccgcccucaacgacacuuggaagauggagaaggccucauucauagaggucaaauccugccacuggcccaaaagccacacacugugguccaauggcgugcuggaaagcgagaugauuauucccaaaaacuucgccggucccguaucacaacacaacuaccguccuggcuaccacacgcagaccgcggggcccuggcauuuggguaaacuggaaauggacuuugacuuuugcgaggguaccaccguaguggugacggaggacugcgguaaccggggacccagccugcgcaccacaacugccucaggaaagcucaucacugaguggugcugccgguccugcacacuacccccgcugcgcuaucggggcgaggacgggugcugguacggcauggagauccgcccccucaaagaaaaggaggagaaucuagucaacagccuggugaccgccgggcauggccagaucgacaacuucucguugggcgugcuggggauggcccuguuccuggaagagaugcugcggacgagggucggcaccaaacacgcuauucugcucgucgccgugucauucgucacccuaaucaccgggaauauguccuuccgggaccucggccgcgugaugguuauggugggggccaccaugacggacgacaucggcaugggcgugacguaucucgcgcuguuagccgcauucaagguccgcccaaccuuugccgccgggcuccuuuuacguaagcucacaagcaaggaguuaaugauggccacaaucggcauuacccuucucucccaauccacuauuccugaaaccaucuuagagcucacggacgcgcucgcauuagggaugaugguauuaaagauaguccgcaacauggagaaguaccagcucgccgugaccaucauggcaaucucuugcguccccaacgcuguuauccuccggaacgcauggaaggugucuuguacuauucuggcggccgucucgguguucccccucuuacugaccagcucccagcagaaggccgauuggaucccccucgcccugacgaucaagggauuaaaccccacugccaucuuucugaccacccucagucgcacguccaagaaacggaguuggccgcuaaacgaggcaauuauggccgugggcaugguguccauccuagccucaucccugcugaagaacgacauccccaugacugggccacucguggcaggagggcuacuaacaguaugcuacgugcucaccggaagguccgcugacuuagaguuagagcgggcugccgacgugaagugggaggaucaggccgagaucagcgggucaucgccaauucucuccaucacgaucagcgaagacggguccaugucuaucaagaacgaggaggaggaacagacguugaccauccuaauccgcaccggacuguuggucaucuccggcguguuuccgguuaguaucccgauuacggcagcggccugguaccucugggaggucaagaaacagcgggcaggcgugcugugggacgugcccucaccaccgcccgucgggaaggccgaguuggaggacggcgcguaccgcaucaagcagcgggggauccugggauacagccagaucggcgcggggguguacaaggaaggcacguuccacaccauguggcacgugacccgcggggcugucuuaaugcaccgaggcaagcgcaucgagcccuccugggcagacguuaagaaggaucuaaucagcuacgguggcggcuggaagcuggagggcgaguggaaggaaggcgaggagguacaaguucucgcuuuagagcccgguaagaacccccgggccguccagaccaagccgggcaucuucaagacgaacaccgggacgauaggcgcggugucccuggacuucagccccggcaccuccggcagcccuauuguagaccgcaagggcaaggugguuggguuguacggcaacggggucgugacgcgguccggcgccuauguaagcgcaauugcccaaacggagaagaguaucgaggacaaccccgagaucgaggaugacauuuucagaaagaaacggcucaccauaauggaccugcaccccggcgccggaaaaaccaaacgcuaucuuccagcaaucguccgugaagccauaaagcgcggccugcgcaccuuaauucuggcccccacccgggucguugccgcggaaauggaggaagcccuccgcgggcugccaauccgguaccagacccccgccauuaaggccgaacacaccggcagggaaaucgucgaccuuaugugccacgccacguucaccaugcggcuccuuagccccgugagggucccaaacuacaaccuaaucaucauggacgaagcgcacuucacagaccccgccagcaucgccgcacggggauacaucuccacccgcgucgaaaugggcgaagcggcaggcaucuucaugacagcgacacccccuggaucacgggacccuuucccccaguccaaugccccgaucauggaugaggaacgcgagauccccgagcggagcuggaacuccggucaugagugggugaccgacuucaaggggaagacagugugguucgucccgagcaucaaggcgggcaacgacaucgcggccugucuccgcaagaacggaaagaaaguaauccagcuaucacggaagaccuucgacuccgaguacgugaaaaccagagccaacgauugggacuucgucgugacuaccgacauaucggaaaugggggccaacuucaaggcugagcgggucaucgacccccgccggugcaugaagccaguaauucugacggacggcgaggaacgcgugauacuugcggggccuaugccggugacccacagcuccgccgcccagcggagaggccgcaucgggcggaaucccaagaacgagaacgaucaguauauauacaugggcgagccacucgagaaugacgaggacugcgcacacuggaaggaggccaagaugcugcucgacaacauuaacacccccgaggggaucauaccgagcauguucgagcccgaacgcgaaaaggucgacgcgaucgacggggaauaccggcugcgcggcgaggcccggaagacauuuguggaccuuaugcgccgcggugaccuccccguguggcuugccuauaaggucgccgccgagggcaucaacuaugcugaccgcaaguggugcuuugacgguaucaagaacaaucaaauccuggaggagaacguugaagucgaaaucuggacgaaggagggcgaaagaaagaaguuaaaaccgcgcuggcucgacgcccggaucuacuccgauccccuagcccucaaagaguucaaggaguucgccgcgggucguaagagccuuacgcugaaccucauuaccgagaugggaaaacugcccaccuucaugacgcaaaaagccagaaacgcccuggacaaccucgcaguacugcacaccgccgaggccggagggcgggccuacaaucaugcccuguccgaguugcccgaaacccuggagacucugcuccugcugacgcuucuggccaccgugacgggcgggaucuuccuguuccucaugagcgggaaggggaucgggaagaugacccugggcaugugcuguaucauuaccgcuuccgucuuguugugguaugcgcaaauccagccgcauuggauugcagccagcaucauucuggaguucuuccuuaucgugcugcugauccccgaacccgagaagcagcgaacgccucaggauaaccaacugaccuacgugguuauugcaauccugaccgugguggccgcgaccauggcuaacgaaauggguuuccuggagaagacgaagaaggaccucggacucgguucgaucaccacccaagaaagcgagucgaacauccuugacaucgaccugcgacccgcauccgcauggacccucuacgcugucgcgacgaccuucguaacacccaugcugcggcacagcauugagaacagcucaguuaaugucucuuugaccgcaaucgcaaaccaagccacggugcucauggggcucggcaaggguuggccccugagcaagauggacaucggcgugcccuugcuggcgaucggcugcuacucccaagugaacccgaucacucugaccgcugcgcuccuguuacucguugcgcacuaugccaucauuggccccggccugcaggcgaaagccacccgcgaagcccagaaaagggccgccgcggguaucaugaagaaccccaccguugacgguaucacggucaucgaccuggagcccaucccguacgaccccaaguucgaaaagcagcucggccagguaaugcugcugauccuuugcgugacccagguccugaugaugcgcaccacgugggccuugugcgaggcccucacccucgccaccggccccauaagcacccugugggaagggaaccccggccgguucuggaacacgaccaucgccgugucaauggcgaacaucuuccggggcucuuacuuagcgggggcaggccugcuguuuuccauuaugaagaauacuaccaacacgcggcgggggaccggaaacaucggcgaaacccucggggagaaauggaagucccgucuuaacgcccugggcaaguccgaguuccagaucuacaagaaguccgggauucaagagguagacaggacuuuagccaaggaaggcaucaagcguggggagacggaccaccacgcaguaucccggggcagcgccaagcugcgcugguucguggagcggaacauggugacuccagaggguaaggucguggaccuggggugcggucguggcggcuggucuuacuauugugggggccuuaagaacgugcgggaggugaagggucugaccaaaggcggaccagggcaugaggagcccauucccauguccacauacggcuggaaccucguacgucuccaguccggggucgacgucuucuucacgccgcccgaaaagugcgacaccuugcuaugcgacaucggcgagagcucccccaaccccaccaucgaagcgggccggacccuccgcguccugaaccugguggaaaacuggcucaauaacaauacccaguucugcaucaagguucugaacccguacaugcccuccgugauagaaaagauggaaacgcugcagagaaaauacggaggggcccuugugcggaacccgcugucacggaacuccacucacgagauguauugggucucuaacgcgaccggcaacauaguguccagcguuaacaugaucucccgcaugcucaucaacagguucacuaugaaacacaagaaagccacguacgagccggauguagaucugggcagugggacucgcaacauagggaucgaauccgagauacccaaccucgacaucaucggcaagcggaucgaaaagauucgucaagaacacgagaccagcuggcacuacgaccaagaccauccauacaagacuugggccuaucacgguuccuacgaaacgaagcagaccggaagcgccuccagcauggugaacgggguggugaggcugcugacaaaacccugggaugugguaccaauggugacucagauggccaugacggacacuacucccuucggacagcagcgcguguucaaggagaagguggacaccagaacgcaggaacccaaggagggcacaaagaaacucaugcguauuacagcggagugguuauggaaggagcuggggaagaagaagacgccccgcaugugcacacgcgaggaguucacacgcaagguccgguccaacgcggcucucggcgcgaucuucacagaugagaacaaguggaaguccgcacgggaggcgguggaggacgggcgguucugggaacugguggauaaggagaggaaccugcaccuggagggcaagugcgagacgugcgucuauaacaugauggggaagcgggagaagaaguuaggcgaguucggcaaagcuaagggaucgcgcgccaucugguacauguggcugggcgcccgguuccucgaguucgaggcucugggguuucugaaugaggaucauugguuuagccgcggcaacucccucagcggggucgagggcgagggccugcaccgguuaggguauauccuccgcgaugucggcaagaaggagggcggggccauguacgccgacgauacugcuggaugggacacccggaucacccuagaggaccugaagaacgaggagauggugaccaaccacaugaagggcgagcacaagaaacucgcagaggcgauauucaagcugaccuaccaaaacaaaguggugagggugcagcgaccgacgccccgcggcaccguuauggacauaaucagccggcgggaccagcgcggcuccggacaggucgggaccuacggccugaacacguucaccaauauggaggcccagcucauccgacagauggaaggcgagggaaucuucaaguccauccaacaccugaccgcuacggaggaaaucgccgugcagaacuggcuggccagagucggucgggagcgccucucacguauggcgaucaguggggacgauugcgucguuaagccaaucgacgaccgcuucgccuccgcgcugacggcuuugaaugacaugggcaagguucggaaggacauacagcagugggagcccagccgcggguggaacgacuggacacaggugcccuucugcucucaucacuuccacgagcucgugaugaaagauggcagagugcuggucgugccuugccgcaaccaggaugaguuaaucggucgcgcaaggaucagccagggggcgggcugguccuugaaagagaccgccugccuggguaaaagcuaugcccaaauguggacucugauguacuuccaucggcgugaucuccggcuugccgccaaugcuaucugcuccgccguacccucgcacuggguacccacaucccgaacgaccugguccauccacgccaagcacgaguggaugaccacggaggacauguuggcgguguggaaccggguguggauccaggagaacccauggauggaggacaagacuccgguggaauccugggaggaggugcccuacuuggguaagcgcgaggaccaguggugcgggagccugaucggcuugacgagccgugcgacaugggccaagaauauccagaccgccaucaaccaaguacgcagccuaaucggcaacgaagaauauacggacuacaugccaucaaugaagcgcuuccggagagaggaggaagaagcgggaguccugugguga

SEQ ID NO: 25291 - RNA, 9876 nt, Artificial Sequence
  derived and/or modified CDS sequence (opt11) from DENV-2__FJ850108__SS-prME
acugcgggcguaauugucaugcugauccccaccgcuauggcguuccaucucaccaccaggaauggggaaccccacaugauagugggucggcaggaaaaggggaagucccugcuguuuaagacagaagacggcgucaacaugugcacguugauggcaaucgaccugggugaauuaugcgaggacaccauuaccuacaagugcccccugcugcgccagaaugagcccgaggacaucgacugcugguguaauagcacgucgaccuggguuacuuacggaaccugcacgacuacgggugaacaccggcgagagaagcgguccguggcccugguaccucacgucggaaugggccucgagaccagaaccgaaaccuggaugagcuccgagggggccuggaagcaugugcagcggauugaaacguggauccugcgccaccccggcuucaccaucauggcggccauccuggcuuacaccauagggaccacgcauuuccagagagcgcucauuuucaucuuauuaaccgcgguggcgccaagcaugaccaugaggugcauuggaaucagcaaccgggacuucguagagggcgugagcgggggcucauggguggacaucguuuuggagcacggaagcugcgugaccacgauggccaagaauaagcccaccuuagauuucgaacugaucaagaccgaggccaagcaaccggccacccuccgaaaguacugcaucgaggccaagcugacuaauacgaccacugagucccggugcccgacucaaggcgagccaagucugaaugaggaacaggacaagagguucaucugcaagcacuccaugguagaccggggcuggggcaaugguugcggguuguuuggcaagggcgggaucgugaccugcgcgauguuuacguguaagaaaaacauggagggcaagguggugcagcccgaaaaucuggaguacacgaucgucaucacgccgcacagcggggaggaacaugccguuggcaacgauaccggcaagcacgggaaggaaaucaagaucaccccgcaguccaguauuacugaagccgagcugacaggguacgggacggugaccauggagugcucuccacggaccggccuugacuucaacgaaaugguccugcugcaaauggaggacaaggccuggcucgugcaucgccagugguuucuggaccugccccucccauggcugccgggggccgauacccagggguccaacuggauccagaaggagacgcuggugacauucaaaaauccacacgcgaagaagcaagacgucguggucuuggggucacaagaaggcgcaaugcacaccgcccugaccggggccacagagauacagaugagcuccggcaaccuccuguucacaggacacuugaagugccgucugcguauggacaagcuccagcugaaggggauguccuacagcaugugcaccggcaaguucaaaaucgugaaggagauugcagagacacagcacgggacuaucgugauccgaguccaguacgaaggcgacggcucucccuguaagauccccuucgaaaucaccgaccuggagaagagacaugugcucggacgccugauaaccgugaauccgaucgugaucgagaaggacagcccaguuaacauugaggcggagccgcccuucggcgacagcuacauaaucaucggagucgaacccggccaguuaaaguugaacugguucaaaaagggaaguuccauaggucagauguucgagaccacuaugcgcggcgcaaagaggauggcgauucugggggacaccgcaugggacuucgggagccucggugggguguucacguccaucgggaaggcacuccaccaaguguuuggggcgaucuauggugcggccuucuccgggguguccuggacuaugaagauccugauaggcgucgugauuacguggaucgggaugaacucgcgcucaaccagccuguccgugagccuaguucucguuggcguggucaccuuguauuuaggggccauggugcaggccgauucuggcugcguggucagcuggaagaauaaggaacucaagugcggcucugggauauucauaacggacaaugugcacacguggacagagcaauacaaguuucagcccgagucacccagcaaacuugccuccgcuauccagaaggcccacgaggagggcauaugcgggauccggucagucacucgccuggagaaucucauguggaagcagaucaccccggagcugaaccacauacuguccgagaaugaagugaagcucaccauuaugaccggcgacaccaaagggauuaugcaggcgggcaagcggucccuccgcccgcagcccacugagcuuaaauacuccuggaagacgugggguaaggccaagaugcucagcaccgagucccacaaucagaccuuccucaucgaugguccugaaacugccgagugcccgaacacgaaccgggcguggaacagccuggagguggaggacuacggcuucgggguguucaccaccaauauauggcucaaguuacgugagaaacaggacgucuucugcgacuccaaacuuaugucagcggccaucaaggauaaccgggcggugcacgccgacauggguuacuggaucgaauccgcacucaacgauacguggaagauggagaaggccagcuucaucgaagugaaguccugccacuggcccaagagccacacucugugguccaacggcguacuggaaagcgagaugauaauccccaagaauuucgccgggcccgugucccagcacaacuacaggccgggcuaucacacgcaaaucgcugggcccuggcaucucgguaaguuggagauggacuucgacuucugcgaagggaccaccguggucgugaccgaggacugcgguaaccggggacccagccuacgaacgacgaccgccagcggcaaacuuaucaccgaguggugcugucggaguuguacgcugccuccucugcgcuauagaggagaagaugggugcugguacggcauggaaauucggccccuuaaggaaaaggaagagaaccuuguaaacagccuagucacugcuggacacggccagaucgacaacuuuucccuaggcgugcuggggauggcccuguuccucgaagagaugcugcggacuagagugggcacgaaacacgcgauccuacucgucgccgugucauuugugacgcugaucacagggaacaugucauuccgggauuuggggcgaaugauggucauggugggggccacuaugaccgacgacaucggcaugggcgugacguaucucgcccugcuggccgcuuucaagguccgcccgaccuuuguugcggggcucuugcugcggaaacugacaaguaaagaguugaugauggccaccauugggauuacccugcucucccaaagcaccauccccgaaaccaucuuagagcugaccgacgcccuugcccucggcaugauggugcuaaagaucguccgcaacauggaaaaguaccaguuagcggugacgaucauggcgauuucuugcgugccgaacgccgucauccuucggaaugccuggaaggugaguugcaccauccucgccgcugucuccguuagcccccuacugcugacaagcucgcagcaaaaggccgacuggaucccccucgccuuaacuaucaaaggccugaaccccacggccauuuuccucacuacccugucccgcaccagcaagaagcguucauggccacugaacgaggcaaucauggccguaggcauggucucuauucuugccuccagccuuuugaaaaacgacaucccgaugacgggaccgcuaguugccggugggcuccucaccgugugcuacguucucacaggccgcagcgccgauuuagagcuggagcgcgccgccgacgugaagugggaggaccaggccgaaaucagcgggaguagccccauccucagcaucacuaucuccgaggacggcagcauguccaucaagaacgaagaggaggaacagacgcugaccauacugauacgcacuggccugcucgugauaucuggggucuuuccgguuaguaucccuauaaccgccgccgcuugguaccugugggaggugaagaagcagagagccggcguucuaugggacgugcccaguccgccgcccgucggcaaggccgagcuggaggacggcgcguaccgcaucaagcagcgugggauccugggcuacagccagaucggcgcugggguauacaaggaggguaccuuccacaccauguggcaugugacucgcggugccgugcuuaugcaccgggguaaacgcauugagcccucaugggcugacgucaagaaggaucuaaucuccuauggcggcggcuggaagcuagaaggggaguggaaggagggcgaggagguccagguguuggcccuggagcccggcaagaacccgcgagcgguccaaacgaagccaggcaucuuuaagaccaacacggggaccaucggggccgugagccuugacuucucccccggcaccucagggucgccuaucguggaccgcaaaggcaaggucguggggcucuacggcaacggugucgucacacguagcggggccuauguguccgccaucgcucaaacggagaaguccaucgaggauaacccagaaauagaggaugauauuuuccggaagaagcggcugaccaucauggaccugcaccccggcgccggcaaaaccaagcgguaccuccccgcaaucguacgggaggccauaaaacgcggccuucgcacccugaucuuagccccaacgcgggugguggccgccgagauggaggaggcucucagggggcugcccauccgguaucaaacccccgcaaucaaagcagagcacaccggucgcgagauaguggacuuaaugugccacgcgacguucacgaugagacuccugagccccguccgagucccuaacuacaaccuaaucaucauggacgaagcucacuuuaccgaccccgcguccaucgcagccaggggauacauaagcacgcgcguggaaaugggggaggcagccggcaucuucaugaccgcgacuccgcccgguagccgagauccguucccccaaucgaacgcgcccaucauggacgaggagcgcgagauccccgagcgguccuggaacucaggccacgagugggucacugacuucaagggcaagaccgugugguucguaccguccaucaaggccggcaacgacaucgccgcgugccugcggaagaacggcaagaaaguaauacagcuuuccagaaaaaccuuugacagugaguacgugaagacgcgagccaacgacugggacuucgugguaaccacggacauuagcgagaugggugccaacuucaaggccgagcgggugauagacccccggcgguguaugaagcccgugauccugaccgacggcgaggagcgcgucauccuagccgggccaaugccggucacacauuccagcgcggcacagcggcgcggcagaaucgggcggaaccccaagaacgagaacgaccaguauauauacaugggcgaaccacuggaaaacgaugaggauugcgcgcauuggaaggaagcgaagauguuacucgauaauaucaauacgcccgagggcauuaucccuuccauguucgagccggagcgcgagaagguggaugccaucgacggagaauaccgucugaggggcgaagcuaggaagaccuucguugaccugaugaggcgcggagaccugccaguguggcuggccuacaagguugccgccgaggguaucaacuaugccgaccgcaaauggugcuucgacgggaucaagaacaaccagauucuagaggagaaugucgagguugagaucuggaccaaggagggugaaagaaagaagcugaaaccuagguggcuggacgcgcggaucuacucggacccccucgcccuaaaagaguucaaggaguucgccgccgggcgcaagucccugacgcugaacuuaaucacagaaaugggccgacugccgacguucaugacucaaaaggcgcguaacgcccuagacaaccucgcuguccuucacacggccgaggccggaggcagggcuuauaaucacgcccuguccgaacuccccgaaacccuggaaacccugcucuuacugacacuccuggcaacaguuaccggcgggaucuuccuguuccuuaugucugggaaggguaucgggaagaugacacugggcaugugcugcaucaucacggcuagcguccugcucugguacgcucagauccaaccccacuggaucgcggcuagcauaauccuggaguucuuucugaucguccuacugaucccugaacccgagaaacagcgcacgccccaggacaaccagcuuacguacgugguuaucgcuauccucacgguaguggccgccaccauggcgaacgagaugggguucuuagaaaagaccaagaaggaccugggauugggcagcaucacgacccaagagccggagaguaacauacuagacauagaucuucgacccgccagcgccuggacacucuacgcaguagccaccacguucgucacccccaugcugcgccauagcaucgaaaauuccagcgugaacgucaguuuaaccgcaaucgccaaccaggccaccguccucauggggcugggcaagggauggccccuuucuaagauggauauuggcgugccgcuccuugcgauagggugcuacucucagguaaaucccaucacgcugaccgcugcacuccuccuccucguugcccacuacgccaucauuggcccuggccugcaggcaaaagcgacccgggaagcccagaaacgcgcggcggccggaaucaugaagaaucccaccguagacggcauuacugugaucgaccuugaaccgauccccuacgaccccaaguucgaaaagcaguugggucaggucaugcugcugauacuuugcgugacccaggugcugaugaugcgcaccaccugggcacugugcgaggcucucacucuggcgacaggccccaucaguacccugugggaggggaacccgggccgcuuuuggaacaccacuauugccgucuccauggcaaauaucuuccgaggcaguuaccuugcgggggccgggcuacucuucuccauuaugaagaacaccaccaacacccggagggguacuggcaacaucggggagacccucggugagaaauggaagagucggcuuaacgcccugggcaaauccgaguuccagaucuacaaaaaguccggcauucaggagguggaccgaacccucgccaaggagggcauaaagcgcggggagacugaccaccacgcggugucuaggggcagcgccaaacugcguugguucgucgagagaaacaugguuacgcccgagggcaaggucguggaccuuggcugcggccguggugggugguccuacuacugcggcggccucaaaaauguacgcgaagugaaggggcugaccaagggcggcccugggcacgaggagccuaucccgaugagcacguauggcuggaaccuggucagacuccaauccgggguggacguguucuucacgccgccagagaagugugacacgcugcugugcgacaucggggagagcagcccuaacccuacaaucgaggccggccguacccucagaguccuuaaccugguugagaacuggcucaacaacaacacccaguucuguaucaaggugcugaaccccuacaugcccuccgugauagagaagauggaaacccugcagcgcaaguauggcggugcccugguacggaacccgcugagucgcaauucaacucaugagauguauugggugagcaacgccaccgggaacaucguuucuucagucaacaugauaucccggaugcugaucaaucgcuucaccaugaagcacaaaaaggcuacuuaugagcccgacguggaccuaggcagcggcacgcggaacauuggcauugagagcgagauccccaaccucgacauaauaggaaagcgcaucgagaagauaaagcaggagcacgagaccucuuggcauuacgaccaagaucaccccuacaagaccugggccuaccauggguccuaugagaccaagcaaacggguucggccuccucaauggucaacggcguggugcgccugcugaccaagccgugggacguggugcccauggugacccagauggccaugaccgacacgacccccuuuggccagcagcgggucuuuaaggagaagguggacacccgcacccaggagcccaaggaaggcacgaagaagcucaugaggaucaccgccgaguggcuguggaaggagcuggggaagaagaagaccccgagaaugugcaccagagaggaguuuacgcgcaaggugcggucuaacgcggcccucggcgccaucuuuaccgacgagaacaaguggaaguccgcgcgcgaggccguggaggacgggcgguucugggagcugguagaccgcgagcggaacuugcaucucgaggguaaaugugagaccugcgucuacaacaugauggggaagcgcgaaaagaagcugggggaguucggcaaggcgaaagggucccgggcaauaugguacauguggcugggcgcccguuuccucgaguucgaggcccugggauuccugaaugaggaccauugguucagucgggguaauucccucagugggguggagggggagggccugcauagacugggcuacaucuuaagggacgugggaaagaaggagggcggcgcgauguacgccgaugacaccgccgggugggacacccgcaucacccuggaggaccugaaaaacgaggagauggucacuaaucacaugaagggggaacacaagaagcucgccgaggccauauuuaaacuaacuuaccagaacaagguggugcguguacagagacccacuccuagaggcaccgucauggauauaaucagccgccgcgaccagcggggcucgggccagguagggacauacggguugaacacuuucacgaauauggaagcgcagcucauccgccagauggagggugaagggaucuucaaaagcauccaacaucugacgguaaccgaggaaaucgccgugcagaacuggcuggcccguguggggcgggagcggcucucccgcauggcuaucagcggggaugacuguguugucaagcccaucgacgaccguuuugcuuccgcguugaccgcccugaacgauauggguaagguaagaaaggauauccagcagugggagccgagccggggguggaacgacuggacucaaguccccuucugcucccaccacuuccacgaacucguaaugaaggacggccgcguguuagucgugccaugccggaaccaggacgagcugauaggccgcgcgcguauaagccaaggggccgguuggucacucaaggagaccgccugccugggcaagagcuaugcgcaaauguggacccugauguacuuccaccgcagagaccucaggcuggccgccaacgccaucugcuccgccgugccaagucacugggugccgaccucccggaccacguggucgauucacgcgaagcaugaguggaugaccaccgaggacaugcuggccguguggaaccgcgucuggauccaggagaacccguggauggaggacaagacccccguagagucgugggaggaggugcccuaccugggcaagcgggaagaccaguggugcgggucgcugauaggacugacgucccgcgcuaccugggccaagaacauccagacagcgaucaaccagguucggucacucaucggcaacgaagaguacaccgacuacaugccgagcaugaagcgguuuaggcgagaggaggaggaggccggggucuuaugguaa

SEQ ID NO: 25292 - RNA, 9876 nt, Artificial Sequence
  derived and/or modified CDS sequence (opt11) from DENV-2__JN819407__SS-prME
accgccggugugaucgucaugcuaauucccaccgccauggcguuccaccucaccacccggaacggggagccccauaugaucguaggccggcaggaaaaagggaagucccuccuguucaagacggaggacggugugaacaugugcacccucauggccaucgaccugggggagcugugcgaggacaccaucacauacaagugcccccuacugcgccagaacgagcccgaggacauugauugcugguguaacuccaccuccaccugggucacguaugggaccugcaccacaacgggcgagcaccggcgcgagaaaagguccguggcccucgucccccacgucgggaugggacucgagacccggaccgagaccuggauguccuccgagggggccuggaagcacgugcagcggaucgagaccuggauucugcgccaccccggcuucacaaucauggccgcgauacuggccuacaccauaggcaccacucacuuccagcgcgcgcucaucuucauccugcucaccgccgucgcuccgagcaugaccaugcgcugcaucggcaucuccaaccgggacuucgucgagggcgucagcggggguuccuggguggauaucguccucgagcacgguucaugcgugaccacgauggccaagaacaaacccacccuggauuucgaacugaucaaaaccgaggccaaacagcccgccacccuccgcaaauauugcaucgaagccaagcuaacgaacaccaccaccgaaucccggugcccgacccaaggcgagcccagccugaacgaggagcaggacaagcgcuucaucugcaagcacuccaugguggacagaggcugggggaacggcugcggccucuucggcaagggcgggaucgugaccugcgccauguucacgugcaagaagaacauggaaggcaaggugguccagcccgaaaauuuagaauauaccaucgucaucacgccccacagcggggaagagcacgccgugggcaacgacacugggaagcaugggaaggagaucaagaucaccccacaguccagcauuaccgaggccgaauugacuggguacggcacagugaccauggagugcagcccccggaccggccucgacuucaacgagaugguacugcuccagauggaggauaaggcauggcucgugcaccggcagugguuccuggaucugccccuccccuggcucccgggggcagacacccaggggagcaacuggauccagaaggagacccuggugaccuuuaagaacccucacgcgaagaagcaggaugucguaguccucgggucccaggagggcgccaugcacacugcccugaccggggccacggaaauccagaugucgcugggcaaucuccuguucaccggccaccuuaagugccgccuccggauggacaaguugcagcugaaggggaugagcuacuccaugugcacgggcaaguucaagauagugaaggagaucgccgagacccagcaugggacuaucguuauucgcguccaguacgagggcgauggcagucccugcaagauccccuucgagaucaccgaccuggagaagcggcacgugcugggaagacugaucacugucaacccgaucgucaucgagaaggauucccccguuaacaucgaggcugagccgcccuucggcgacagcuauaucaucaucgggguggagccgggccagcucaagcuuaauugguucaagaagggguccagcaucggccagauguucgagacuacuaugcgcggcgcaaagagaauggccauccucggcgacaccgccugggauuucggcucccucggaggcgucuucacaagcaucgguaaggccuugcaccagguguucggcgcaauuuacggcgccgcauuuuccggggugagcuggaccaugaagaucuugaucggaguggugaucacguggaucggaaugaacucccgcagcacaucccugagcgucucucucguccuggugggcgugguaacccuguaccucggggccauggugcaagcggacagcggcuguguggucuccuggaagaacaaagaacugaaguguggcagcgggaucuuuaucacagacaacgugcacacuuggacagagcaguacaaguuccagccggagagucccagcaaacuggcuagcgccauccagaaggcgcacgaagagggcaucugugggauccguuccguuacgcgcuuagagaaccugauguggaagcaaaucacccccgaguugaaccacaucuugagcgaaaacgaggucaagcugacgauuaugaccggcgacaccaaagggaucaugcaggccggcaagcggucccuucgcccgcaaccgaccgagcucaaguacagcuggaagacguggggcaaggcgaagaugcucuucaccgagucucacaaccaaaccuuccugaucgacgggcccgagaccgccgaaugcccgaacacgaaccgggccuggaacagccucgagguggaggacuauggcuucgguguguucuccaccaacaucuggcugaaacugcgcgagaagcaggacgucuucugcgacagcaagcucaugagugcggccauaaaagacaaccgggcggugcacgccgacaugggcuacuggauugagagcgcccugaacgauacuuggaagauggagaaggccuccuucauugaagucaagaguugccacuggcccaagucccacacucucuggagcaacggcguguuagaauccgagaugauuauccccaaaaacuucgccggcccggucagccaacauaauuacagaccggguuaccauacucagacggcggggcccuggcaccucggcaagcucgaaauggauuucgacuucugcgaggggaccaccgugguaguaacugaggacugcggaaaccgggguccgucccuccgcacgaccaccgcgucagggaagcugaucaccgagugguguugccggagcugcacgcuccccccgcuccgcuaccggggcgaggacgggugcugguacggcauggagauacguccucugaaggagaaggaggagaaccuggugaacucccucguuaccgccggacacggccagauagacaauuucucauugggcguccuggggauggcccuauuccuugaggagaugcugcggaccaggguggguacgaagcacgcgauccucuuggucgccguguccuucgucacgcugaucaccggcaauaugagcuuccgggaccucggccgcgucaugguuauggugggcgccacgaugaccgacgacauaggcaugggcgucaccuaccuggcccuacuggccgcguucaaggugaggccaacuuucgcggccgggcugcugcuccggaagcugaccuccaaggaguugaugauggccaccaucgggauaacgcuacugagccaguccaccaucccugagaccauucuggagcucaccgacgcccuggcgcuggggaugauggugcucaaaaucguccgcaacauggagaaguaccagcuggccgugacgaucauggccauuucuugcgugccgaacgcugucauacugcgaaacgccuggaaagugucuugcacuaucuuggcagccgucucugugucaccccugcugcucacgagcucucagcaaaaggccgacuggaucccacucgcccuuaccaucaagggccucaaccccacggcgaucuuccugaccacccugagccgcacguccaagaagcggagcuggccacucaacgaggcuaucauggcuguuggcaugguauccaucuuggccagcucacugcucaagaacgacauucccaugacgggaccacugguggccggcggucugcucaccgugugcuacguccucacuggccgcagcgcugaucuggagcucgaacgggccgcagacgugaaaugggaggaccaggcggagaucaguggaagcagccccauccuguccauuaccaucagcgaggacggcucuaugagcaucaagaaugaggaggaggagcagacgcugaccauucucaucaggaccgggcugcuggugauuuccggggucuuucccguuagcauccccaucaccgccgcggcuugguaccucugggaggugaagaagcagcgggccggcguacugugggacgugccgagcccgccgccaguagggaaggccgagcuggaggacggcgcguaccgcaucaagcagcgggguauccucggcuacucccaaaucggcgcgggugucuacaaagaaggcacauuccacacgauguggcacgugaccagaggggccgugcugaugcaucgaggcaagcgcaucgagcccuccugggccgaugucaagaaggaccugaucagcuacgggggcggcuggaagcucgagggggaguggaaggagggcgaagagguccaggugcuggcccuggagcccgggaaaaacccccgggccguacagaccaagccuggcauauucaagaccaacacggggaccaucggcgcgguguccuuggacuucagccccgggaccucggggagcccaauuguggaucgcaagggcaaggugguggggcuguacgguaacggcgucgucaccagauccggggccuacguuagcgcgaucgcccagacggaaaagagcaucgaggacaacccggagauagaagacgacaucuuccgcaagaagcggcugacaaucauggaccuccaccccggggcgggaaagaccaagcgcuaccugcccgccaucgugcgggaggccauaaagcggggccugcguacguuaauccucgccccgacucgggucguggcagcggagauggaggaggcccugcgggggcugcccauacgguaucagacccccgccaucaaggccgaacacaccggccgcgagauagucgaccucaugugucacgccaccuucacgaugcgguuguugagccccguccgcgugcccaacuacaaccucaucaucauggacgaagcgcauuucaccgaccccgccagcaucgccgcccggggcuacauuuccacccgcguggaaaugggcgaggccgcgggcaucuucaugaccgccacuccgccugggagccgcgacccguucccucaguccaacgcccccaucauggacgaggagcgcgaaauccccgaacggagcuggaacaguggccacgagugggucacagacuucaaggggaagacggugugguucgugccuagcaucaaggccggcaacgacaucgcggccugccugcgcaagaacggcaaaaaggucauccagcugucccggaagaccuucgacagcgaauacgucaaaacgcgagccaacgacugggacuucgucgucaccaccgacaucagcgagaugggggcuaacuucaaggcugagcggguuaucgaccccaggcggugcaugaagcccgucauccucaccgacggcgaggagcgcgugauccuggcgggucccaugccggugacccauucauccgccgcgcagcggcgcggccgcauugggcggaaccccaagaaugaaaacgaccaguauaucuacaugggcgagccccucgagaacgacgaggacugcgcccacuggaaggaggcuaagaugcuauuagacaacaucaacacuccagaggguaucaucccgagcauguuugagcccgagcgcgagaagguggacgcgaucgacggggaguaccggcugcgaggcgaagcccggaagaccuucgucgaccugaugcgccgcggagaccugcccguauggcuggcauacaaaguggccgccgagggaaucaacuacgcggaccgaaaguggugcuucgacgggaucaagaacaaucaaauccuggaggagaaugucgagguggagaucuggaccaaggagggcgagcggaagaagcugaagccgcgcugguuagacgcccggauuuacuccgacccucucgcgcugaaggaauucaaagaguucgccgcgggccgcaagagccugacgcucaaccugaucaccgagauggggcggcugcccaccuucaugacccagaaggcccgcaacgcccucgacaaccuggccguucugcacacggccgaggcgggaggacgggcguacaaccacgcccucuccgagcuaccagagacccuggagacacuacuguuacucacccugcuggcgacggugacaggcggcaucuuccucuuccugaugagcggcaagggcaucgggaagaugacccugggcaugugcugcauaaucacggccuccgugcuccugugguacgcgcagauccagccgcauuggaucgcugccaguauaaucuuagaguuuuuccucauuguccugcugauacccgaacccgagaagcagcgcacgccccaggacaaccaguugacguacguggugaucgccauccucaccgucguugccgcgaccauggccaacgagaugggguucuuagagaaaaccaagaaggaccucgggcugggcuccaucacgacccaggagccagagagcaacauccucgacaucgaccuccgccccgcuucugccuggacccucuacgccguggcuaccacguucgucacccccaugcugcgccacuccauugagaacucauccgugaacguuagccucaccgcuaucgccaaccaagccaccgucuuaauggggcugggcaagggguggccgcucucaaaaauggacauaggcgugccccuguuggcgauugggugcuacagccaggucaaccccaucacgcugacugcagcccugcuccugcugguugcccacuacgcuauaaucggccccggccugcaggcgaaagcgacgcgggaggcccagaagcgcgccgccgcgggaauaaugaagaacccgaccguggacggcaucacggugaucgaucuggagccgaucccguacgacccaaaguucgagaagcagcuggggcaggugaugcugcucauccuaugcgugacccagguucugaugaugcggacgacuugggcucuuugcgaggcccugaccuuagccaccggcccuaucuccacgcucugggaaggaaacccgggccgcuuuuggaacaccaccauagccgugagcauggcgaacaucuuccgcggguccuaccuggccggggccggccuccuguucagcaucaugaagaauacuaccaauacccggcgagggacggguaacauuggcgagacccugggggagaaguggaagagucggcugaaugcccucggcaagucugaguuccagaucuacaagaaguccgggauccaggaaguggaccgcacccuggccaaggagggcauaaagcguggggagacugaccaccacgcagugucgcgcggaucugccaagcugcggugguuugucgagcguaacaugguuacucccgagggcaaagucgucgaccucgggugcggccgcggaggguggagcuacuacugcggcgggcucaagaacgugcgcgaggugaaggggcugaccaagggcggacccgggcacgaggagcccaucccgauguccaccuaugguuggaacuuaguccggcuccagagcgggguggacguuuucuucacuccgcccgagaaaugcgacacgcuauuaugugacaucggcgagucuagccccaacccaaccaucgaagcgggccgcacccugagggugcugaaccucguggaaaacuggcugaacaacaacacccaguucuguauuaaggugcuuaacccauacaugcccagcgucaucgagaagauggagacccuccagcguaaguacggaggugcccuggugcguaacccgcuaagccggaauagcacacaugagauguacugggugucgaacgcgaccgggaacaucgucagcuccgugaacaugaucucacggaugcugaucaaccgcuucaccaugaagcacaagaaggccaccuaugagccugauguggaccucggcuccgggacgcggaacaucggcaucgagagcgagauccccaaccuggacaucaucggcaagagaaucgagaagaucaagcaggaacacgagacguccuggcacuacgaccaagaccaccccuacaaaaccugggccuaccaugggagcuacgagaccaaacagacuggcagugccaguuccaugguaaacggcguggugcgccuacucacaaagccgugggacgucgugcccauggugacccagauggccaugaccgacacgacacccuucggccagcagcgggucuucaaggagaagguggacacccgcacccaagagcccaaggagggcacgaaaaaguugaugcgaaucacggcggaauggcuguggaaggagcucgggaaaaagaagacgccacgcauguguacccgggaagaguucacgcgcaaagugcggagcaacgccgcgcugggcgccauuuucaccgacgagaacaaguggaagagugcccgcgaggcagucgaggacgggcgauuuugggagcugguggaccgcgaacgaaaccuacaccuggagggaaagugcgagaccugcguguacaacaugauggggaagcgcgagaagaaauuaggcgaguuuggcaaagccaagggcagccgggcuaucugguacauguggcucggagcccgcuuucuagaguucgaggcgcugggauuccucaacgaagaccacugguucucccggggaaauagccuguccgguguggagggcgagggccuucaccgccucggguauauucugcgcgaugugggcaagaaggagggcggcgccauguacgccgacgacaccgccggaugggauacgcgcaucacccuggaggaccugaagaacgaggaaauggucaccaaucacaugaagggcgagcacaaaaagcuggccgaggcgaucuucaaacugaccuaucagaacaagguggugcgcgugcagcguccgacgccccgaggcaccgugauggacaucaucagccgucgcgaucagcgggggagcggccagguaggaaccuauggcuuaaacaccuucacgaauauggaggcccagcugauccgccagauggagggcgaggggaucuuuaaguccauacaacaccucaccgucaccgaggaaaucgccgugcagaauuggcuggccagggugggccgcgagcggcugagcagaauggccaucuccggggaugacugcgucgugaagcccaucgacgaccgauuugcaagcgcucugaccgcucucaacgacaugggcaaagugagaaaggauauccagcagugggagccgucccggggguggaacgauuggacgcagguccccuucugcagucaccacuuccacgagcucguuaugaaggacggccgagugcugguggugcccugccggaaccaggaugagcucauaggcagagcgcgaaucucccagggggccggcuggagccugaaagagaccgcgugccugggaaagucguacgcccagauguggacgcucauguacuuccaccgccgagaccugcgccuggcagcgaacgccaucuguagcgcggugcccucgcauugggucccgaccucaaggaccacgugguccauccacgccaaacacgaguggaugacgaccgaggauaugcucgcuguguggaaccgcguguggauccaggagaaccccuggauggaggacaagacacccgucgagagcugggaagaggugcccuaccugggcaagcgggaggaccaauggugcgggucccugaucggccugacgucucgggccacaugggcgaagaauauacagaccgccaucaaccagguacgcucccugaucggcaacgaggaauacaccgacuacaugccgaguaugaagcguuuccgccgggaagaggaggaagccgggguccugugguag

SEQ ID NO: 25293 - RNA, 9876 nt, Artificial Sequence
  derived and/or modified CDS sequence (opt11) from DENV-2__FJ898465__SS-prME
accgcggggguuauuaucaugcuuauccccaccgccauggcguuucaccuuacaacccgcaacggggagccccacaugauagucggccgacaggagaaagggaagucccuguuauucaagaccgaggacggcgucaacaugugcacccuaauggccaucgaccugggggaacucugcgaggacaccaucaccuacaagugcccccucuuacggcaaaacgaaccggaggacaucgauugcuggugcaacagcacgagcaccugggugacguacgggacuuguaccacuacgggcgaacaccggcgugagaagcggucagucgcccugguaccccacguggggaugggccuugagacccgcaccgagacuuggaugagcagcgagggggccuggaagcauguacagcgaaucgagaccuggauccuucgccacccgggcuucgccauaauggcagcgauccuggccuacaccauugggacgacacauuuccagaaggcccucaucuucauccugcugaccgcgguagccccgagcaugaccaugaggugcaucggcauauccaaccgggacuucguggagggcguuaguggcggcuccuggguggauauaguacucgagcauggcagcugcgucacaaccauggcuaagaacaaacccacccuggacuuugaacugaucaaaaccgaggccaaacaacccgccacccuccggaaauacugcaucgaagcuaaauugaccaauacuaccaccgaaucccguuguccgacccagggcgagcccucacugaacgaagagcaggauaagcgcuucaucuguaagcacuccauggucgaccgcgggugggguaacgguugcggccuauucggcaaaggcgggaucguuacgugcgccauguucacgugcaaaaagaacauggaaggcaaggucguguugccagagaacuuggaguacaccauaguuaucacgccccacucuggggaagagcacgccguaggcaacgacacggggaaacacggcaaggagaucaagaucacuccgcagucaagcaucaccgaggccgagcucaccggauauggcaccgucacgauggagugcucaccccggacuggccuugauuuuaacgagauggugcugcuccagauggaggaaaaggccuggcuuguccacagacagugguuccuugaccucccccugcccuggcugccgggugccgacacccagggaagcaacuggauccagaaagagacucuggugacguucaagaacccccacgcuaagaagcaggacgugguggugcuggggucccaggagggagccaugcacaccgcccugacgggggcaaccgagauccagauguccucuggcaaucugcuguucacgggccaccugaagugccggcuccgaauggacaagcugcagcugaagggcauguccuacagcaugugcacaggcaaguucaagaucgucaaggagauugcggagacccaacacggaaccaucgugauacgcgugcaguacgaaggagacgggucccccugcaaaaucccauuugagaucauggacuuagagaagcgccaugucuuagggcggcugaucacggugaacccgauagugaccgagaaggauagccccgucaacaucgaggccgaaccucccuucggagacuccuacaucauaaucgguguggaaccgggccagcucaagcuaaacugguucaagaaggggagcuccaucggccagauguucgaaaccaccaugcggggggccaaacgcauggcaauccuuggagacacagccugggauuucggcucccucggaggcguguucaccuccaucggaaaggcacugcaccagguuuucggcgccaucuacggcgccgccuucaguggggugaguuggacuaugaagaucuugaucggcgugaucaucacuuggauugggaugaacagccgguccacuagccuguccgugagcuuggugcugguuggcguggugacucucuaccucggcgcgauggugcaggccgacagugggugugucgugagcuggaaaaauaaggaguugaagugcggguccgggauauucaucacggauaaugugcacaccuggacggagcaauauaaguuccaacccgaaagucccagcaagcuggccuccgccauccagaaggcccacgaggaaggcaucugcgggauucgcuccguaacccggcucgagaauuuaauguggaagcagauaacccccgagcugaaucacauccuuuccgagaacgaggugaagcugaccauaaugacgggcgacaucaaggggauuaugcaggcgggcaaacgcagccugagaccccagccaacagagcucaaguacuccuggaagaccuggggcaaggccaagauguuaagcacggaaagucauaaccagacguuccugaucgacgggcccgagacugccgaguguccgaacacuaaccgcgcauggaacagccucgagguggaggacuacggcuucgggguuuucuccaccaacaucugguugaagcugcgggagaaacaagacguuuucugcgauucgaagcucauguccgccgccaucaaggacaaccgcgccgugcaugcugacaugggcuacuggaucgagagcgccuuaaacgacacauggaagauggagaaggcgucauucauugaggucaagagcugccauuggcccaagucccacacccuguggagcaauggcgugcuggaaucugagaugauaaucccuaagaauuucgcggggcccgugagccagcacaauuaccggcccggcuaucacacccagacugcugguccuuggcaccugggcaagcuggagauggacuucgacuucugcgagggaaccacuguuguggugacggaagacugugguaacagagggcccagccuccggacgacgacggccuccggcaagcugaucacagaguggugcugccgcagcugcacccugcccccacuccgguacagaggcgaggauggcugcugguacggcauggagauccgaccccugaaggagaaggaagagaaccuggucaacucccucguaacugcggggcacggccaaauugacaacuucagcuuaggcguacuggggauggccuuauuucuggaagagaugcuacgcacgcgggucggcacuaaacaugccaugcuccugguugccguguccuucgucacucuuauaacaggcaacaugagcuuccgagaucucggcagagugauggugauggugggcgccacaaugacugacgacaucggcaugggggugacauaucuggcccuguuagcagccuucaaggugcgccccacguuugccgccgggcugcucuugcgcaagcugacuuccaaggaacugaugauggcgaccaucggcaucgcucucuuaucccagucaaccauccccgagacaauucuagagcucacggacgcccuggcccuggggaugaugguucucaagaucgugcggaauauggagaacuaccaacuggcggugacgaucauggccaucagcugcguaccaaacgccgugauccugcucaacgcauggaagguguccuguaccauacuggcagccgucagcgucaguccucuacuccugacgucgucccagcagaaggcugacuggaucccccuggcccucacaaucaagggccugaacccaacugcaaucuuccugacaaccuugagccgcacguccaagaagcggucguggccguuaaacgaagccgucauggcugugggcaugguauccauccuggcgagcagccuccugaagaaugacauccccaugacagggccccuggucgccggcgguuugcugaccgugugcuauguucuaaccgggcguuccgccgaucucgaauuagagagggccgcugauguuaagugggaggaccacgcggagaucagcgggucaagccccauucugagcaucaccauaagcgaggacggcucuaugucaauaaagaacgaggaggaggagcagacuuuaacaauccugauccggaccggguuacucgugaucuccgguguguuuccggucucaauacccaucacggcggccgccugguaccugugggaggucaagaagcagagagccggugugcugugggauguccccucgccgccccccguagggaaggcggagcucgaggacggcgccuaccggauaaagcagcgggggauacuuggguacagccagaucggcgccggcguguacaaggagggaaccuuccauaccauguggcacgucacccgcggggcaguccugaugcaccggggcaaacgcaucgagcccucgugggccgacgugaagaaggaccucaucagcuacgguggcggcuggaagcuugagggggaguggaaggagggcgaggaaguacaggugcuggcgcucgaacccgguaaaaauccucgagccguccagacaaaacccggccuguucaagacgaacaccgggacuaucggcgccgucagccuggacuucagccccggaacguccgggagcccaaucguggaccgcaagggaaaaguagucggacucuacggcaauggcguagugacaagaucgggggccuacgucucagcaaucgcccagacagagaaguccauugaggacaaccccgagaucgaggacgacauuuuccgcaagaagcgccucaccauaauggaccuucaccccggugccgggaagacgaaacgcuaccuaccagccaucgugcgugaggccauaaaacgcggccuucggacucugaucuuggcuccaacccgcgugguggccgcggagauggaggaggcccucagagggcuuccaauccgguaccagacccccgccauccgugccgagcacaccgggcgggaaauaguggaccugaugugucaugccaccuuuaccaugcgccuccugucccccguucgggucccuaacuacaaucugaucauaauggacgaagcacacuucaccgaucccgcgagcaucgccgcgcgcgguuacauauccacccgaguggagaugggggaggcggcaggcaucuuuaugacagcuacgccccccgggagucgugacccguucccccagagcaacgcgcccaucauggaugaggagcgggagauccccgaacguagcuggaauuccggccaugaguggguaaccgacuuuaagggcaagacagucugguucgugccgaguaucaaggccggcaacgacauagcagccugccuccggaaaaacggcaagaaggugauccagcugucgcggaaaacguucgacagcgaauacguaaagacacgggccaacgacugggauuucguggugacuacggacauuagugagaugggggcgaauuuccgugccgagcgggucaucgacccccgccgaugcaugaagccuguuauccugacggacggugaggaacgcgugauccuggcuggacccaugccggugacccacagcagugccgcccagcgacgcggcaggaucggacggaaccccaagaacgagaacgaccaguacauuuauaugggggaaccccuggagaacgaugaggacugcgcacacuggaaggaggccaagaugcugcucgauaacaucaauacgcccgaaggcaucauccccagcauguucgaacccgaaagggagaagguagacgccaucgacggggaguaccggcugcgcggcgaggcgcggaagaccuucguggaccucaugagacgcggagaccugcccgucugguuggccuaccgcguugccgcggagggaaucaacuacgccgaccggcgauggugcuucgacgggauaaagaacaaucaaauucuggaggagaauguggaagucgagaucuggacgaaggagggcgaacggaagaagcucaagccucguuggcuugacgcccgaaucuacuccgacccgcuagcgcucaaggaguucaaggaguucgcggccggccgcaagagccugacccuaaaccucaucaccgagauggggcggcugcccacuuucaugacgcaaaaggccagagacgcccuggauaaucucgcgguccugcacaccgccgaggcuggagggcgggccuacaaccacgcacuguccgaacuccccgagacucuggagacgcuucucuugcugacgcuccuggcgaccgucacuggcgguaucuuccuauuucucaugagcgguaaaggcaucggcaagaugacccugggcaugugcugcauuaucacggcuuccauccugcucugguacgcccaaauucagccgcauuggaucgccgccagcauaauucuggaguucuuccugaucguccuccugauccccgaacccgagaaacagcgcaccccccaggacaaccagcuuaccuacguggucaucgcgauacucacagugguggcggccaccauggcgaacgagaugggguuccuggagaaaacgaagaaggaccugggccucggcagcaucaccacccaggagagcgagagcaauauccuugauauagaccugcggcccgccuccgccuggacccucuacgcagucgcaacgaccuuugugacccccaugcuccgccauagcauugagaauuccucagucaacgucucccuuaccgccaucgcaaaccaagccacggugcucaugggucuuggcaaaggcuggccccugagcaaaauggacaucggcguuccccuccuggcgauagggugcuauucccaggucaacccgaucacgcugacagccgcacugcugcugcucguugcacauuacgccaucaucggccccggccuccaggcgaaggccacccgagaggcccagaaacgcgcggccgccgggauaaugaaaaauccgacgguggacggcauuaccgucauagacuuagagccuauaccguacgauccaaaguucgagaagcaacucggccaggugaugcugcuuauccucugcgugacccagguccugaugaugcgcaccaccugggcccugugcgaggcccucacccuggcuaccgggcccauuagcacgcugugggagggcaaccccggccgguucuggaacacgaccaucgccguuuccauggccaacauauuccgcggcaguuaccucgccggggcgggguuauuauucuccaucaugaagaauaccaccaacacgcggcgcgguacugguaacaucggcgagacccucggggaaaaguggaagucccggcugaacgcccugggcaaguccgaauuccagaucuacaagaagucggggauccaggagguggaucgaacgcuugcuaaggagggcauaaagcgcggggagacggaccaucacgcugucucccgcggcagcgccaaacuaagaugguucguggaacgcaacauggucacuccggagggaaaggucguggaccugggguguggcagaggcgggugguccuacuacuguggcggucuuaagaacgugcgcgaggucaaggguuuaaccaagggugggccggggcacgaggagcccauccccaugagcaccuacggcuggaaccuagugcggcugcagagcgguguggacgucuucuucacgccgcccgaaaaaugcgacacccugcugugugacaucggcgaguccagcccgaaucccaccaucgaggcuggucgcacuuuacggguucugaaccuaguggagaacuggcucaacaacaauacccaguucugcaucaagguccugaacccuuacaugcccuccguaauagagaagauggagacucuccagcguaaauacgggggugcccugguccgcaacccucuaagccgcaacuccacccaugagauguauuggguaucuaaugccacagggaacaucgucuccagcgugaauaugaucucccggaugcugaucaacagauucacuaugaagcacaagaaggcuaccuacgagcccgaugucgaccuggggagcgguacccgcaacaucggcaucgagucggagauacccaaccucgacaucauaggcaagcggaucgagaagauaaagcaggagcacgagaccagcuggcacuacgaucaagaccaccccuauaagaccugggccuaccacgggucguaugagacuaaacagaccgguagcgcguccagcauggugaacggggugguccgccugcugaccaagcccugggacguggugccgauggucacccagauggcaaugaccgacaccacgcccuuuggccagcaacgaguauuuaaggagaaaguagacacccgaacgcaagagcccaaggagggcacuaagaagcucaugcggaucacggccgaguggcuguggaaggaacuugggaagaagaagacgccucggaugugcacccgggaagaauucaccagaaagguucgauccaacgccgcccucggcgcaaucuucacggacgagaacaaguggaaauccgccagagaggcgguggaggacucccguuucugggaguugguggaccgcgagcgaaaucuccaccucgaggggaagugcgagaccugcgucuacaauaugaugggcaagcgggagaagaaacugggggaauucgggaaggccaaaggaagccgcgcuauaugguacauguggcugggggcacgguuucucgaguuugaggcgcugggcuuucugaacgaggaccacugguucagccgggggaacucccucagcggagucgagggggagggccugcacagguuaggcuacaucuugcgggaugucuccaagaaggagggcggggccauguaugccgaugacacagcugggugggauacccgcauuacccuggaggaccugaaaaaugaagagauggugaccaaccacaugaagggggaacacaagaagcuagcggaggccaucuuuaagcugacguaccagaacaagguggucagagugcagcgcccgacgccccggggaacugugauggacauaauaucacggcgagaccagagaggcuccggucaggucgggaccuacggccugaacacguucaccaauauggaggcucaguuaauccgccagauggagggggagggcaucuucaagagcauacaacaccugacgguaacugaggaaaucgccguacagaacugguuggcgcgcguaggccgggaacggcucuccagaauggccaucagcggcgacgacugcguggugaagccccuggacgaucgguucgccuccgccuuaacugcucucaacgacauggggaaggugcgcaaggauauccagcagugggagcccagucggggguggaacgacuggacucaggugccuuucuguucccaccacuuccacgagcuggucaugaaggacggucgcguccugguggugcccugccggaaccaggacgagcucaucggucgggcccgcaucagccagggugccggcuggucccugaaagaaacugccugccugggcaagagcuacgcucagauguggacuuugauguauuuccaucgccgggaucucaggcuugccgcuaacgccauaugcuccgcggucccuagccacuggguccccacgagucggaccaccuggucgauccaugcgaagcacgaauggaugacgaccgaggacaugcucgcggucuggaaccgcguuuggauccaagagaauccguggauggaggacaaaacgccuguggagagcugggaggaagugcccuaccugggcaagcgcgaggaccaguggugcgggucccugaucggccugaccagccgggccaccugggcuaaaaacauccagaccgccauaaaccaggucagaucccugaucgggaacgaagaguauacggacuacaugcccucuaugaagcgguuucgccgggaggaagaggaggccggcguguugugguga

SEQ ID NO: 25294 - RNA, 9876 nt, Artificial Sequence
  derived and/or modified CDS sequence (opt11) from DENV-2__FJ898466__SS-prME
accgccgggguuaucgucaugcugauccccaccgccauggcguuucaucucaccacccgcaauggggaaccccauaugaucguaggccgacaggagaaggggaagucccugcuguucaagacugaggacggcgugaauaugugcacccuuauggccaucgaccugggcgagcugugcgaagauaccaucacauacaagugcccucucuuacgccagaaugagcccgaggacaucgacugcuggugcaauucgaccagcacauggguaaccuacgggaccugcaccaccacuggcgaacaucggcgcgagaagcgguccguagcccuggugccccacgucgggaugggucuagagacccgcaccgagaccuggaugagcagugagggggccuggaagcacgugcagcggaucgagacguggauucugaggcacccgggcuuuacgaucauggccgcuauccuggccuacaccaucgggaccacccacuuucagcgcgcccuaauauucaucuuacugacggcuguugcacccaguaugaccaugcgcugcauugggauauccaaccgggauuucgucgagggcgugagcggugggagcuggguagacauugucuuagagcacgggagcuguguaaccacgauggccaaaaacaagcccacgcuugacuucgagcugaucaagaccgaagccaagcagccagccacguuaaggaaguacugcaucgaggccaagcugacuaacaccaccaccgaaucccggugcccgacgcagggcgagccgagccuaaacgaggagcaagauaagcgcuucauuuguaaacacaguaugguggaccgggguugggggaacggaugcgggcuguucggcaagggcgggaucgugaccugcgcaauguuuacgugcaagaaaaacauggaaggaaaaguggugcagccggagaaccuugaguauaccaucguuauaacaccucauagcggggaggaacaugccguaggcaacgacaccgggaagcacgguaaggagaucaaaauuaccccgcagucuucuaucacugaggccgagcugaccggguauggaacggugaccauggaguguagcccccgcaccggccucgauuucaacgagaugguacuguugcaaauggaagacaaggcuuggcucgugcaccggcagugguuccuggaccugccccuccccuggcugccuggcgcggacacgcaaggcagcaacuggauccagaaggaaacucugguaaccuucaagaauccccacgcgaaaaagcaggacgucgucguccucgggucccaggagggcgccaugcacaccgcucugacgggcgccacggagauccagaugucuagcgggaaccuccuguucaccggccaccugaagugcagacugcgaauggacaagcuccagcugaaggguaugaguuacagcauguguaccggaaaauuuaagauagugaaggagaucgccgaaacccagcacggcacgaucguaauccgcguacaguacgagggagacggcucccccugcaagauaccuuucgaaaucaccgaccuggagaagcggcaugugcuagggcgcuugaucaccgugaauccgauagucacagagaaagacagucccgucaacauagaggcggagccgcccuucggcgacagcuauaucauuaucgguguggagccgggucagcugaagcucaacugguucaagaaggggagcuccaucggccagauguucgagacaaccaugcgcggcgcuaagcggauggccauccugggggacacagccugggacuucggcagccucggaggggucuucacuagcaucgggaaggcgcuccaucagguguucggcgcaaucuacggcgccgccuucuccggagugucguggacgaugaaaauccuaauaggcguuauaaucaccuggaucggaaugaacucccgguccacaagucugucgguuagccugguccuggugggcguggugacccuguaccugggggccaugguucaggccgacagcggcugcguagugaguuggaagaacaaggaacucaaaugcggcuccgggauauuuauaacggauaauguccacacguggacagagcaguacaaguuccagcccgagagccccagcaaauuagccuccgccauucaacgggcacaugaggagggcauuugcgggauccgcagcguuaccaggcuagaaaaccuuauguggaagcagaucacgcccgagcugaaccauauccucuccgaaaaugaagugaaguuaaccaucaugacaggugacaccaaggguaucaugcaggccgguaagcgcagccuacggccgcagccaacggaguugaaguauucauggaagaccuggggaaaggccaaaaugcucagcaccgagucgcacaaccagacauuccucaucgacggucccgagacggccgagugcccuaacaccaacagggccuggaacagccuggaggucgaggacuauggauucggggucuucaccaccaacaucugguuaaaguugcgggagaagcaggacaucuucugcgacuccaaacugaugagcgccgcgaucaaggacaaccgggcgguccaugccgauaugggcuacuggaucgaguccgccuuaaaugacaccuggaagauggaaaaggccucguuuaucgaggugaaguccugccacuggcccaaaagccacacguuguggucgaacggcguccuggagagugagaugaucauccccaagaacuucgccgggcccgucagucaacacaauuauagaccgggauaccacacccagaccgcggggcccuggcaucucggcaagcuagagauggauuucgacuucugcgagggaaccacggucguugucacagaggacugcgguaaucgcggccccagccugcggaccaccacggccagcgggaagcucauaacagaguggugcugccgcagcugcacuuugccacccuugcgcuaccgaggugaggacggaugcugguaugggauggaaauucggccccuuaaggagaaggaggagaaccucgucaacucacucgucaccgcugggcacggacagaucgacaacuucucccucggagugcugggcauggcccuguuccuggaagaaaugcugcgcacucgcgucggcaccaagcaugcgaucuugcucguagccgugagcuucgucacccugaucaccgggaacauguccuuccgcgaccuaggccgcguaaugguuauggucggugccacgaugaccgaugauaucggcaugggggucaccuaccucgcucugcuggccgcguucaaggugcgacccacguucgcugcagggcuccuguugcguaagcucaccucaaaagagcugaugauggccaccauuggaaucgcucugcuuucccagagcacuauccccgagaccauccuggaauugacggacgcacucgcccuggggaugauggcccugaaaaucgugagaaacauggaaaaguaccagcucgcagugaccaucauggccaucuccugcgugccgaaugcgguuauacuccaaaacgccuggaaggugagcugcaccauccuggccgcaguuucggucagcccccuccugcuuaccuccucccagcagaaagcagauuggauuccccucgcccugacgaucaagggccugaaccccacggcaaucuuccuaaccaccuuguccaggaccagcaaaaagcgguccuggccgcugaacgaggccauuauggccguuggcauggucagcauccucgcguccucacuucuuaagaaugacaucccaaugaccgggccccucguggcgggcgggcuacucacuguaugcuacguguuaaccggccgcagcgccgaccuggagcuggagcgggccgcagacgucaagugggaagaccaagcagagaucuccggguccucccccauccucagcaucacgauauccgaagacggcagcauguccaucaagaacgaggaggaggagcagacccugacaauccugauccgcaccggccuccuuguuaucagcggcguauucccggucucaauccccauuacugccgccgccugguaccuaugggaggugaagaagcaacgcgccggaguccucugggacgugcccagcccgccgcccguggggaaggcagagcuagaagacggugcauaccgcaucaagcagcgggguauccuggguuauagucaaaucggcgccgggguauacaaggagggaaccuuucacaccauguggcacgugacccgcggggccgugcucaugcaccggggcaaacgcaucgaacccagcugggccgacgucaaaaaggacuuaaucuccuacgggggcggcuggaagcuggagggagaguggaaagagggugaggagguccaggugcucgcgcuggagccugggaagaacccccgggccguccagaccaaacccggcaucuuccgaacgaacaccgguaccaucggcgccgugucgcuggauuucucgcccggcaccagugggaguccgaucguugaccggaagggcaaggucgugggucucuacgguaacggaguggucacgagaucgggggccuacguguccgcuaucgcccagaccgagaaguccaucgaggacaacccagaaaucgaagacgacauuuuccggaagaaacgccuaaccauaauggaccugcaccccggcgccgggaagaccaaacgguaccuccccgcaaucgugcgcgaggcuaucaagcgcggccugcggacucugauccuggcgccgacccgcgucguggcggcggagauggaagaggcauuacgggggcugcccauccgcuaucagacacccgcaauuaaggcggaacacacgggccgggagaucguggaccugaugugccacgccacauucacgaugcgccucuugagccccguacgggugccgaacuacaaccuaaucauuauggacgaggcacacuucaccgaucccgccucaaucgccgcgcguggcuacaucucaacccggguggagaugggcgaggccgcgggcaucuucaugaccgcgacaccgccggggagccgugacccguucccccagagcaacgcgcccaucauggacgaggaacgggagaucccagagcgcuccuggaacagcggccacgagugggugacugauuucaaggggaagaccgucugguucgugcccuccaucaaggccgggaacgacaucgcggccugccuccggaaaaacggcaagaaggucauccagcugucacgcaaaacguucgacucugaauacgugaagacacgggccaaugauugggacuuuguggucaccaccgacaucagcgagaugggcgccaacuuuaaggcugagcgcgugaucgacccacggcgaugcaugaagcccgugauccugacggacggcgaggagagagugauacucgccggccccaugccuguuacucauagcagcgcugcacagcgccgcggucggauagggaggaaccccaagaacgagaacgaccaauauaucuacaugggcgaaccccuugaaaacgacgaggacugugcgcacuggaaagaagcgaagaugcugcucgacaacauaaacacccccgagggcaucauccccuccauguuugagccagagcgggagaagguggaugccaucgauggggaguaccggcugcggggcgaggcucgcaaaaccuuugucgaccugaugcgacgcggggaucucccgguauggcuggccuauaaaguggcggccgagggcauuaacuacgccgaccguaagugguguuucgacgggaucaagaauaaccagauccuggaggagaacguagagguggagaucuggaccaaggaaggagagcggaagaagcucaagccgcgguggcuagaugcccgcauuuacucagacccgcuagccuugaaggaguucaaggaguucgccgccgggcgcaagucccuuacucugaaucucaucaccgagaugggacgucugccuaccuuuaugacgcagaaggcccgaaacgccuuagauaaccucgcggugcuucacacagcggaagccggcgggcgcgccuauaaucaugcucuuagugaacuccccgaaacccuggagacgcuacuccugcugacgcuacuagcgaccgucaccggcggcauauucuuauuccuuaugaguggcaaaggcaucggcaagaugacccugggcauguguugcaucaucacagccucuauucuauugugguacgcccagauacagccacacuggaucgccgcuucaaucauacuggaguuuuuccugaucguucuccugauacccgagcccgaaaagcagcgcacgccccaggacaaucagcugaccuacguagugaucgcgauccucaccgugguggcagccaccauggcuaaugagaugggguuccuggagaagaccaagaaggaucugggccugggcagcaucaccacccaggaauccgagaguaacauccuggacauugaccugcgcccugccucggcauggacccuauacgcgguggccacaaccuucaucacucccaugcugcgccacucgauagagaauagcuccgugaacgugucgcugaccgcgauugccaaccaggcaacggugcuuauggggcugggcaaaggauggccuuugucuaaaauggacaucggggucccccuccuggcuaucggaugcuacucccaggucaacccgaucacgcuuaccgccgcucuccuccuucucguggcgcacuacgccaucaucggccccggccugcaggcaaaggcuacucgcgaagcccagaagcgggcagcugcagggaucaugaagaaccccaccguggacgguaucacugucauagauuuagagccaaucccguacgacccuaaauucgagaagcagcucggccaagugaugcugcugauccucugugugacucaggucuugaugaugagaaccacaugggcccugugcgaagcccucacccuggcgaccgggcccauuuccacccugugggaaggaaaucccggccgguuuuggaauacuaccaucgcagucagcauggccaauaucuucagaggcaguuaccucgcgggggcaggacugcuguucagcauaaugaagaacacuacgaauacgcgccgggguaccggcaacaucggcgaaacccucggugagaaguggaagucucgccugaacgcacugggcaaaagcgaguuccagaucuauaagaaguccgggauucaagagguagaccgaacccucgccaaagaggguauaaagcgcggggagacggaccaccacgccguuucgcggggcuccgccaagcugcgcugguuugucgagagaaacauggugacaccggagggcaagguuguggaccuggguugcggccguggaggguggagcuacuacugcgggggcuuaaagaauguccgggaaguaaagggguuaacuaaaggagggcccggacacgaggaacccaucccuauguccacguacggauggaaccugguucgccuccaaucugggguggacguguucuucacaccucccgagaaaugcgacacccugcuuugcgacaucggcgaguccagcccuaacccuaccaucgaggcuggucgaacccuccgggugcugaaccugguugaaaacuggcucaacaauaauacccaguucugcauuaaaguccugaauccguacaugccuagcgugaucgaaaagauggagacgcugcagcggaaauacgguggcgccuugguacgcaacccccugucccgcaauagcacccaugagauguacugggucagcaacgccacugggaacaucguuucguccgucaacaugaucagccgaaugcucaucaaucgguucaccaugaagcacaaaaaggccacguacgagccugacgucgaccugggcuccggaaccagaaacaucggcaucgagagcgagaucccaaaucuagacaucaucggcaaaagaauugaaaagaucaagcaagaacacgaaaccucguggcacuacgaccaggaccacccuuauaagaccugggcguaccacgggucguacgagacaaagcagaccggcucagcuagcaguauggugaauggcguggugcggcugcugaccaagcccugggacgugguaccuauggucacccaaauggcuaugacagacaccaccccguucggacagcagcggguguuuaaagagaagguugauacccggacgcaagagcccaaggaggguacuaagaaacucaugaagauaacagccgaguggcuguggaaggaacugggcaagcggaagacaccccguaugugcacgcgcgaagaguucacaaagaaggucaggagcaacgccgcccucggcgcuaucuucaccgacgagaauaaguggaaauccgcacgcgaggcgguggaagacgggcgguuuugggagcuggucgacagggagcguaaccugcaccucgaaggcaagugcgagaccugcguuuauaacaugauggggaaacgcgagaagaagcugggcgaguuuggcaaggcuaaaggcagccgggcgaucugguauauguggcuaggagcucgcuuccuugaguucgaggcauugggguucuuaaacgaagaccacugguucucacguggcaacagccucucggggguggagggugagggucugcaccgccugggguauauccugcgggacgucggcaaaaaggaaggcggggcgauguacgcggacgauacugcgggaugggauacccggauuaccuuagaagaccugaagaaugaggaaauggucacuaaccauaugaagggagagcacaagaaguuagccgaggccauauucaaacuuacguaccagaacaaggugguccggguacagcggccgacaccccgaggcaccguuauggauaucaucucccgccgagaccagcgggggucggggcaggucgggacuuacggccugaacaccuucaccaacauggaggcgcaacucauccgccagauggagggugaggggaucuucaaguccauccagcacuugaccgccacggaagagaucgcggugcagaacuggcuggcccgagucggacgcgagcggcucagccgcauggccaucuccggggaugauugcgucgugaagcccauagacgaccgguucgccucugcccugacugcguugaacgacaugggcaaaguucgcaaggacauccagcagugggagcccucccguggguggaaugacuggacccagguccccuucugcucgcaucacuuccacgagcucgugaugaaggacggacgcgugcuugucgugcccugucgaucccaggaugaguuaaucggccgcgcccggaucucccagggugcggguuggucgcucaaggagacagccugccugggcaaaagcuacgcucagauguggacccugauguacuuucaccgccgggaccuacgccuggccgcgaaugcaauaugcuccgccgugcccucucacuggguccccaccucccgaacgaccuggagcauacacgcgaagcacgaguggaugacgacugaggacaugcucgccguguggaaccgcguguggauacaggagaacccguggauggaagauaaaacgccggucgagucuugggaagagguacccuaucucggcaaacgggaggaccaguggugcggaagccugauuggccugaccagccgcgcuacaugggcgaagaacauccagaccgcaauaaaccagguucgaucucucauaggcaacgaggaguacaccgauuacaugcccagcaugaagcgguuccgccgggaggaggaggaggcagggguccucugguga

SEQ ID NO: 25295 - RNA, 9876 nt, Artificial Sequence
  derived and/or modified CDS sequence (opt11) from DENV-2__FJ898467__SS-prME
acugccggcgugauaaucaugcugauccccacagccauggcauuucaccucaccacccgcaauggggagccccacaugaucguagggcggcaggagaaggggaagucccuguuauucaagaccgaggauggcgucaacaugugcacgcucauggccaucgaccugggggagcugugcgaggauaccaucaccuacaagugcccccuccuccgccagaacgagcccgaggacaucgacugcuggugcaacagcacgagcaccugggucacuuacgggaccuguaccaccacuggugagcaucggcgagagaaacggucgguggcccuggugccccacguggguaugggccucgagacccgaaccgagaccuggauguccuccgaaggggccuggaagcacguccagcggaucgagaccuggauucugcgccacccgggguucaccauuauggccgcgauacuggccuauacuaucgggaccacgcacuuccaacgcgccuugaucuucauacuucugaccgcuguggcccccagcaugaccaugcgcugcaucggcaucuccaaccgggacuucguggagggagucagcgggggcuccuggguggacaucgugcucgagcacgggucuugugucacgacgauggcgaagaacaagcccacccuggacuucgagcugaucaagaccgaggccaagcaacccgccacccuccgcaaguacugcaucgaggcuaagcugacgaacaccaccaccgaaucccgaugcccgacgcagggcgaacccucgcugaaugaggagcaggacaagcgcuucaucugcaaacauuccaugguggaucgugggugggggaacgggugcgggcuuuucggcaaaggagggaucgugaccugcgcgauguucacgugcaagaagaacauggagggaaaagucgugcagcccgagaaccuggaguacaccaucgugaucacgccccauagcggggaggaacacgccgucggcaacgacaccgggaagcacggcaaggagaucaagauaacaccgcaguccagcaucaccgaggccgagcugaccggguacggcacugugaccauggagugcagcccccggaccggccucgauuucaacgagauggugcugcugcagauggaggacaaggccuggcuaguccaccggcagugguuucuagaucucccccucccuuggcugccgggagccgacacccagggcagcaacuggauccaaaaggagacgcugguaaccuucaagaacccccacgcgaagaaacaggacgugguaguccucgggagucaggagggcgccaugcacaccgcccugaccggagccacggagauccagaugagcagcgggaaccuccuguucaccggucaucuaaagugccgcuuaagaauggacaagcuccagcuaaaggggaugagcuacucaaugugcacgggcaaguucaagaucgucaaggagaucgccgagacccagcacgggacgaucgugauccggauucaguacgagggugacggguccccuugcaagauccccuucgagaucacagaccuggagaagcggcacgugcucgggcggcugaucaccgucaacccgaucguuaucgaaaaggacucacccgugaacaucgaggcggagccgcccuucggcgacuccuacaucaucauaggggucgagccgggccagcugaaacucaauugguucaagaaggggagcuccaucgggcagauguucgagaccacgaugcgcggcgcaaagcggauggccauccugggcgacacugccugggacuucggcagccucggcgggguguucaccucaaucgggaaggccuugcaucaagucuucggggcgaucuacggugccgccuucagcgggguguccuggaccaugaagauccugauaggcguggugauuacguggaucgggaugaacagccgcuccacuagccuuuccgucucccugguccucgugggcguggugacccuguaccugggugccauggugcaagcggacuccggcugcgucgugagcuggaagaauaaagagcucaaguguggcucugggaucuucaucaccgacaacgugcacacguggaccgagcaauacaaguuccagccugagagccccucgaaacuggccucugccauccagaaggcgcacgaggagggcaucugcgggauccgguccguuaccagacuggagaaccucauguggaaacaaaucacccccgagcugaaccacauacuuuccgagaacgaggugaagcucacgaucaugaccggagacaccaaggggaucaugcaggccggcaagcgaagccugcggccgcagcccaccgagcugaaguacuccuggaagacauggggcaaggcuaaaaugcucagcaccgagagccacaaccaaaccuuccuuaucgaugggccagagaccgccgagugcccuaauacgaaccgggccuggaacagccuggagguggaagacuacggcuucggugucuuuaccaccaacaucuggcucaagcugcgcgaaaagcaggacguguuuugcgacuccaaacucaugucagcugccaucaaggacaacagagcggugcacgcugacauggguuacuggaucgaauccgcccucaacgacaccuggaaaauggagaaggccagcuucaucgaggugaagucaugucacuggcccaagagccacacccugugguccaauggcguacuugagagcgagaugaucauacccaagaacuuugcagggcccgugucgcaacacaacuaccgcccgggcuaucacacccagaccgcgggacccuggcaccucggaaagcuggagauggacuucgacuucugcgaggggaccacgguuguggugaccgaagacugcggcaaccggggucccagcuugcgcaccaccacugccucggggaagcucaucacggagugguguugucgcuccuguacccugcccccgcugcgauacaggggcgaggacgguugcugguacggcauggagauaaggccacucaaggagaaggaagagaaccuggucaacagccuggugacugccgggcacggacagaucgacaacuucucccucggagugcuggggauggcccuguuccucgaggagaugcugcggacccgggucgguaccaagcacgcgauccugcucguggcagugagcuuugucacccugaucacugggaauauguccuuccgggaccugggccgcgugaugguuauggucggggccaccaugacggacgacaucggcaugggcgugaccuaccucgcccugcuggcugcguucaaggugcgccccacauucgccgccgggcuccuguugcggaagcucaccagcaaggaguugaugauggccacgaucgggaucacucugcuuucccagagcacuauucccgagaccauucuggagcucacggacgcccucgcgcuggggaugaugguccugaagaucguccgcaacauggagaaguaccaguuagccguuaccaucauggccaucucgugcgucccaaacgccguaaucuugcggaacgccuggaaggugagcugcacaauucuugcugccgucuccgugagcccacuccugcugaccuccagccagcagaaggccgacuggaucccacuggcccugacgauuaagggccugaacccgaccgcgaucuuccucacuacccugucccgcacgagcaagaagcggagcuggccgcuuaacgaggccauuauggcggucggcauggugucgauccucgcuuccagccugcuuaaaaacgacaucccgaugacugggccccucguggccggcgggcuacucaccgugugcuacguauuaaccggccgcagcgcggaccuagagcucgagcgggccgccgacgugaagugggaagaccaagccgaaaucucugggagcuccccuauccucagcauaacgaucuccgaggacggcagcauguccauuaaaaacgaagaggaggagcagacccugaccauccugauccgcaccggguuacuggucaucagcgggguuuucccgguguccauacccaucaccgccgcggccugguaccugugggaggucaaaaagcaacgggcgggcguuuuaugggacgugcccagcccgccgccggucgggaaagcggaacuggaggacggcgccuaucgcaucaagcagaggggcauccugggcuacucccaaaucggugcggguguguacaaggagggcacguuucacacgauguggcacgucacccgcggggccguccucaugcaccgcgguaagcggauugagcccagcugggccgacgugaagaaggacuuaaucuccuacgggggcggcuggaagcuggaaggggaguggaaggaaggcgaggaggugcaaguucucgccuuagagcccggcaagaauccccgggccguucaaacuaaaccgggcaucuucaagaccaacaccgggaccaucggcgcaguuucguuagacuucucccccggaaccagcggguccccgaucgucgaucgcaagggaaaagugguggggcucuacggcaacggcgucgugacgcggagcggggccuacguguccgcuauugcacagaccgaaaaguccaucgaggacaaccccgagaucgaggacgacaucuuccgcaagaagcggcugaccaucauggacuuacaccccggugcggggaagaccaaacgcuaccuccccgcuaucgucagggaggccaucaagcgcggcuugcguaccuuaauccuggcuccgacccgggucguggccgcggagauggaagaggcccuccgcggguuacccaucagauaccagacccccgcuaucaaggccgagcacaccggccgcgagaucgucgaccugaugugccacgcgacauucaccaugcgucuacugagccccgugcgcgugcccaacuacaaucugaucaucauggacgaggcgcacuucacugaccccgccuccauugcagcccggggcuacaucagcacccgcgucgagaugggggaggcagcgggcauauucaugacggccacgccgccggggucccgcgacccguuuccucagagcaacgcucccauuauggacgaagaacgcgagauccccgagcggucguggaacucaggccaugagugggugaccgacuucaagggcaagaccgugugguucgucccuuccauaaaggccggcaacgacaucgcugccugccuccgcaagaauggcaagaaggugauccagcugagccggaagacguucgacuccgaauacguaaagacccgagccaacgacugggacuucgucgugaccaccgauaucagcgagaugggggccaacuucaaggccgagcgggugauagacccccgacggugcaugaagcccgucauccugacggacggcgaggagcgugugauccucgcggggcccaugccggucacccauuccagcgccgcucagcggcgcggccgcaucgggcggaaccccaagaaugaaaacgaccaguacaucuacaugggcgagccccuggagaacgacgaagacugcgcccacuggaaggaggccaagaugcuguuggacaacauaaacaccccggagggaaucauuccuuccauguucgaacccgagcgcgagaaagucgacgcgauagacggugaguaccgucugcgcggcgaggcccgaaagacuuucguggaccugaugagacgcggggaccuccccguguggcuggcauacaagguggccgccgagggaauuaacuacgccgaccgcaaguggugcuucgacggcauaaagaacaaccagauccuggaggagaacgucgagguggagaucuggacgaaggagggagagcggaagaagcucaagccgaggugguuggacgcccguaucuacagcgacccccuggcgcucaaggaguucaaggaguucgccgcaggccgcaagucccugacccugaacuugaucaccgaaaugggccggcugcccaccuucaugacgcaaaaggcccgaaaugcccuagacaaccuugccguccuccacaccgccgaggcgggcgguaaggccuacaaccacgcucugucggagcuacccgagacccuggagacucugcuccugcuuacgcuccuggccaccgugaccggagguaucuuccuguuccuaauguccgggaaggguaucggaaagaugacccugggaaugugcugcaucaucaccgccuccguccuauuaugguacgcucagauucagccgcauuggaucgcugccuccaucauccuggaguucuuccugaucgugcuccuuaucccugagcccgagaagcagcggacgccccaggacaaccaacuuaccuacguggucaucgccauccucaccgugguggccgcaaccauggccaacgagaugggauuccuggagaagaccaagaaggacuuaggcuuaggcucgaucaccacccaggagagcgaguccaauauccuggacaucgacuuacgcccggcuagcgccuggacccucuacgcagucgccacgaccuuuguuacgcccauguugaggcacuccaucgagaacuccuccguaaaugucagccugaccgccaucgccaaccaggcgacggugcucauggggcugggcaagggguggccccuguccaagauggacaucggcgugccccuccuggcuaucggcugcuacagccaagucaacccgauaacucugaccgccgccuuacugcugcucguagcccacuacgccaucaucggccccggccugcaggcuaaggccacccgcgaggcucagaagcgggccgcugcagggaucaugaaaaaccccacgguugauggcaucacggucaucgaccuggagccaaucccguacgaccccaaguucgaaaaacagcucggccaggugaugcugcuuauccuuugcgugacccagguucugaugaugcggacgacgugggcccugugugaagcccucacccuggccaccgggccuaucucgacccugugggaggggaaccccggacguuucuggaacacgaccaucgcuguuagcauggcgaacaucuuccgcggcucauaucuagccggggccggccuucuguucagcaucaugaagaacaccaccaacacgcgcagagggaccggcaacaucggcgagacccucggggagaaguggaagucccgccugaacgcccugggaaagagcgaguuccagaucuacaagaaguccggcauccaggagguggaccggacgcuggccaaagagggcauaaagcguggggaaacggaccaccacgccgucagccggggcuccgccaaacugcgcugguucguggaacgaaacaugguaacaccggagggcaaagucguggaccuggggugcgguaggggcggcuggagcuauuacugcgggggccucaaaaacgugcgggaggugaagggccuuaccaaaggcgggcccgggcacgaggagcccauccccaugucaacauacggauggaaccugguucgccuccagagcgggguagacgucuucuuuacgccgcccgagaagugcgacacccugcugugcgacauaggcgagagcucccccaaccccaccaucgaggcaggucguacccuucgcguauugaaccucguggagaauuggcucaacaauaacacccaguucuguaucaagguacugaacccguacaugcccagcguuaucgagaaaauggagacgcugcagcgaaaguacgggggcgcacucgugcgcaacccccugagccggaacagcacccacgagauguacugggucuccaacgcgaccgggaacaucgugagcuccguuaauaugaucagccgcaugcuaaucaaccgguucaccaugaaacacaagaaggcaacguacgagccggacgucgaccugggcuccgggaccagaaacaucggcaucgagagcgagauuccaaaucucgacauuaucgggaagcgcaucgaaaagaucaaacaggagcaugagaccuccuggcacuaugaccaggaccaucccuacaagacaugggcguaucacgggagcuaugagacgaagcagaccggcagugccagcuccauggugaacggggugguccgucugcugaccaagcccugggacguggucccgauggucacccagauggcuaugacggacaccacccccuuuggccagcagaggguguucaaagagaagguggacacccggacgcaggagcccaaggagggcaccaagaagcugaugcgcaucaccgcggaguggcuguggaaggagcuggggaagaaaaagacgccccggaugugcacgcgcgaggaguucacccggaaagucagaagcaacgccgcucucggcgccaucuucacagacgagaacaaguggaaguccgcacgggaggcaguggaggacgggcgguucugggagcugguggacaaggagcggaaccugcaccuggagggcaagugcgagaccugugucuacaacaugaugggcaagcgcgagaaaaagcugggcgaguuugguaaggccaaagggucacgggccauaugguacaugugguugggcgcccgcuuccucgaguucgaggcgcugggauuccugaacgaggaucacugguuuucccguggcaacucacucucggggguggagggcgagggccugcaccgccugggguacauccuccgugacgucgguaagaaggagggcggcgccauguacgccgacgacacagcagggugggacaccagaaucacccuggaggaucugaagaacgaggagauggugaccaaccacaugaaaggcgagcacaagaagcucgccgaggcgauuuucaagcucacguaccagaacaagguggucagaguacagcgcccaacgccccggggcacagugauggauaucaucucaaggcgggaccaacgcggcagcggccaaguugggacguauggccugaacacauucaccaauauggaggcccagcucauacgccagauggagggagaggggauauucaaguccauccagcauuuaaccgccacagaggaaauagccguccagaacuggcucgcccgggugggccgcgagcggcucucccgcauggcgaucuccggggacgacugugucguuaagccgaucgacgaccgguucgccucugcccugacagcccugaacgauaugggcaaggugcgcaaggacauccagcagugggagcccucucgcggguggaacgacuggacccagguuccguucugcagccaucacuuccacgagcucgugaugaaggacggccgcguuuuagucgugcccugucgaaaccaggacgagcugaucggccgagcccggauuucccagggggcgggguggagccucaaggaaaccgccugccuggggaaguccuacgcacagauguggacccugauguauuuccaccgccgggaccuccgccuggccgcuaaugcaaucugcagugccgugcccucccacuggguccccaccagccggacgaccuggucgauccaugccaagcacgaauggaugaccaccgaggacaugcuggccguguggaaccgcguguggauccaggaaaauccguggauggaggacaagacucccguugaaucuugggaagagguacccuaucucggcaaacgggaggaccaguggugcgggucccuuaucggccugaccucgagagcgaccugggccaagaacauccagaccgccaucaaucagguccggucacucauaggcaacgaggaguauacggacuacaugccauccaugaagcguuuccguagggaggaagaggaagccgggguccucugguaa

SEQ ID NO: 25296 - RNA, 9876 nt, Artificial Sequence
  derived and/or modified CDS sequence (opt11) from DENV-2__GQ868595__SS-prME
acagcaggaguuauaauaaugcugauacccacagcgauggcauuccaucuaacgacccggaacggagaaccgcauaugauagugagccgccaagaaaaaggaaaaucacuacucuuuaaaaccgaggacggagucaauaugugcacgcuuauggcaaucgaccucggggaacuaugcgaagauaccaucacauacaaaugcccccuacuaagacaaaacgagccagaagacauagacuguuggugcaauucuacaagcacauggguaacuuacggaacaugcaccacuacaggcgaacacaggcgggaaaaacgaucuguggcccuaguaccucacgucggaaugggucucgaaacacguacagagacguggaugagcagcgagggggcguggaaacauguucaacgaauugaaacauggaucuuaagacauccgggauuugccaucauggccgcuauucuagcguacacaauaggcacaacgcacuuccaacgggcacucauauuuauacuauuaacagcagucgcacccagcaugacaaugcguugcauaggcauaucaaacagagacuucguugaaggcgugagcggaggcuccuggguagacaucguucuagagcacggauccugcguaacaaccauggccaaaaacaaacccacucuggacuucgaacuuauaaaaacggaggcaaaacagccagccacgcuacgcaaauacugcauagaagcuaaauuaacgaacaccacaaccgaaagcagaugccccacacagggugaacccucgcuaaacgaggagcaggauaaacgauuuauaugcaaacacagcaugguggacaggggauggggcaacggcugcggucuguucggaaaaggaggaauuguaacuugcgcaauguucacaugcaagaaaaauauggaggguaaaguaguacuaccggaaaacuuggaauacaccaucgucaucaccccgcacagcggagaggaacaugcgguggggaacgacaccggaaaacacggcaaagaaauaaaaaucacaccccaaagcuccaucacagaagcggaauugaccggauacggcacaguaacgauggaaugcagccccaggacaggacuagauuucaaugaaaugguacuucugcagauggaagagaaagccuggcuagugcaucgccaaugguuucucgaucuuccccuccccuggcuacccggggcggacacacaaggcuccaacuggauucagaaagagacccuagucacauucaaaaacccccacgccaagaaacaggaugucguaguuuuagggucgcaggagggcgcgaugcacacggcacucacaggugcgacggagauacagaugucgucagggaacuuacuguucacgggccacuugaaaugccgcuuaagaauggacaaacuccaacuaaaagggaugagcuacaguauguguaccggaaaauucaaaauugucaaagaaauugccgagacgcaacacggcacgauaguaauaagaguccaguacgaaggagacggaucaccgugcaaaauccccuuugaaaucauggaccucgagaaaagacauguacucggacgccuaauaacaguaaaccccaucguuaccgaaaaagacucgccugugaacauugaggcagagccaccauucggggacucuuauauaaucauuggaguggagccaggacagcugaagcuaaauugguuuaagaaaggcagcagcauaggacagauguucgaaaccacgaugcguggagccaaacgaauggcaauccuaggcgacacagcgugggauuucgggucucucgguggaguuuuuacgucaaucggcaaggcauuacaccagguauucggggcuauauauggcgccgcauucucggguguuagcuggacuaugaagauucugauaggcguaaucauaacauggaucggaaugaacagcaggagcacgagcuuaagcgucucacucgugcucgugggagucgucacacuguacuuaggcgccaugguccaagcagacucagggugcguggugagcuggaaaaauaaagaacucaaaugcggaucagggaucuuuauaaccgauaacguucacaccuggacggaacaguacaaguuucaaccagagucgcccagcaaacucgcuagcgccauccaaaaggcccaugaggagggcauaugcggaauaaggucagucacaaggcucgagaaccugauguggaagcaaaucacgcccgaacugaaccauauacuaagugagaaugaagugaaacugacgauaaugaccggggauaucaagggaauaaugcaggcaggaaaacgcucacugcggccgcaaccgaccgaauuaaaauauagcuggaagacaugggggaaggcgaaaauguuaucgacagagucccacaaucaaacauuucuaaucgacggacccgagacagccgaaugcccaaauaccaaccgcgcauggaacagccucgagguggaagacuacggauuugguguauucacgaccaacauauggcucaaguugcgggagaaacaagacguauucugugacagcaagcuaaugagugccgcaaucaaggacaaccgagcaguacacgcagacaugggcuacuggauagaaagcgcgcugaacgacaccuggaagauggagaaggccuccuucauugagguaaaguccugccauuggccgaaaagccacacgcuauggagcaacggaguacucgagagcgagaugauuauaccaaagaacuuugcgggccccguaucgcagcacaacuaucgcccugguuaccacacccaaaccgcgggacccuggcaccucggaaagcuagagauggacuuugacuucugcgaagggacaaccguggucguaacggaagacuguggcaacagagggcccagucuacgaacaacaacggcaucuggcaaacucauaaccgaauggugcugccggagcugcacacuaccaccccuacgguaccguggcgaggacggcugcugguauggaauggaaauaaggccacucaaagagaaggaagagaauuuagucaauucccuaguaacggcaggacauggacaaaucgacaauuucagccugggggugcucggaauggcucuguuuuuagaagagauguugcgcaccagaguggggacaaaacacgcaauacuccuaguagccguaaguuucguuacccucauaaccggcaacaugucguuccgcgaccugggcagggugauggucauggucggggccacgaugaccgacgacauuggcauggggguaacguaccucgcccuucuagcugcguuuaaaguacggccaacguucgcggccgggcuacuccugagaaaguuaaccagcaaagaauuaaugauggccaccauaggcauagcguuacucagucaguccaccauaccagagacaauucucgaguugacugacgcucucgcacuagggaugaugguacuuaaaauaguccgcaacauggaaaaguaccaauuagcagugacaaucauggccaucagcugcgugccaaacgcgguaauauugcucaaugccuggaaaguaucaugcacaauccuggcagcaguaagcgugagcccccuacuuuuaacaaguagccaacaaaaagcagacuggaucccgcuugcccuaacgaucaaggggcucaacccuacugcgauauuccuaacuacacucucacgcacgucgaagaaaagaucguggcccuugaacgaagcgguuauggcagucgggaugguaucgauacuagcgucgagucuacucaaaaacgacauaccgaugaccggcccucuaguggcugggggacuacuaacgguaugcuacguauuaaccggacggagcgcggaccucgaacucgaacgagcagcagacguaaaaugggaagaccaggcagagauuagcgggagcucgccgauacucucaauuaccauaagugaagacggaaguaugucaaucaaaaacgaagaggaggaacaaacucugacaauccucauacggacggggcuucuagucauaaguggaguguucccggugucgaucccuauaacagcugcggccugguaucucugggaaguuaagaaacaacgagcgggcgugcuaugggacgugccaagucccccaccagucggaaaagcagaacuugaagacggugcguacagaauaaagcagagagggauacuggguuacucucaaauaggggcgggaguauacaaggaaggcaccuuccacacgauguggcacguuacacgaggugccguccuaaugcaccgugggaaaagaaucgagccaagcugggcagacgucaagaaagaccuaaucagcuacggcggaggcuggaaacuugaaggagaauggaaggaaggagaagaaguccagguccuggcgcuagaaccaggcaaaaacccgagagccguccagacuaagcccgggcuguucaagacgaauacgggcacgauuggugccgugucacuagacuucucacccgguacguccggaucaccuaucguggaccguaaggggaaagucgucggcuuguacggaaacggugucgugacuaggagcggggcauacgugucagccaucgcccaaacugagaagucuauagaggacaacccagaaaucgaagacgauaucuuccggaagaaacgacucaccaucauggaccugcaccccggagccggcaaaacaaagagauaucuccccgcaauagugagggaggcaauuaaaagaggucucaggacccuuauucuagcccccacucgcguggucgcagcagaaauggaggaggcgcuucgcggacuucccauccgauaucaaacgccugcaauacgggcagagcacaccgggcgagaaaucgucgauuuaaugugccaugcaaccuucaccaugcgacuccugagccccguacgaguaccgaacuacaaccuaauaauaauggacgaggcgcacuuuaccgacccagcgucgaucgcagcgaggggauacauaaguaccaggguagaaaugggggaggccgccgguauuuucaugacagcaacacccccuggaucucgagacccauucccgcagucgaacgccccgaucauggaugaggaacgagaaauaccagaacgcucauggaacuccgggcacgaguggguaacggauuucaaagggaaaaccgugugguuugugcccuccaucaaggcaggaaacgacauagccgccugcuuaagaaagaauggcaaaaagguaauacagcucuccaggaagacauucgacucggaguacguaaaaacucgggcaaaugacugggauuuuguaguaacaacugauaucucagaaaugggggcgaacuuccgcgccgagagaguuauagauccccgaagauguaugaaaccgguaauacuaacagacggggaggaacguguaauacuagcgggcccaaugccugucacacacucgagcgccgcacagagacguggccgaauaggccguaacccaaagaacgaaaacgaucaauauaucuauaugggcgaaccccucgaaaaugacgaagacugugcccauuggaaagaagcaaagaugcuccucgacaacauaaacacccccgaaggaauuauccccaguauguucgaacccgagcgcgagaaaguugaugccaucgacggggaguaccgccugcggggcgaagcucgaaaaaccuucguugaccucaugcggcguggagaccuacccguguggcuagcauaccgcgucgcugcggaaggcauuaacuacgcggauaggcggugguguuucgacggcaucaaaaacaaccagauacucgaagagaacgucgaaguggaaauuuggacgaaagagggcgaacggaagaaacucaagccacgcuggcuagaugcucgaaucuacagugaccccuuggcacucaaagaguuuaaagaauuugccgccgggcggaaaucccugacacuaaaucuaauaaccgagaugggaagacucccaaccuucaugacccaaaaggcgcgagacgcacucgauaacuuggcggugcugcacaccgccgaagcaggcgggcgagccuauaaucacgcccucucugagcucccagagacccuagaaacgcuccuccuccugacccuacuugcgacggugacgggcggaaucuuccuauucuuaauguccgguaagggaauagggaagaugacccucgguaugugcuguaucauaacagccucgauccuucuaugguacgcgcagauccagccccacuggauagcagccucaaucauccucgaguuuuuccucauaguucuucugauccccgaaccugagaaacaacgcaccccacaagacaaccaacuuaccuacguagucaucgccauucuuacuguaguagcggccacgauggcaaacgaaaugggguuucuagagaaaacuaagaaagaccugggcuuaggcucuaucacuacccaagaaagcgaguccaacauccuagauaucgaucuccgccccgcguccgccuggacccuuuacgcaguggccacuaccuucguaacuccgaugcuacggcacucuauagaaaauucuagcguaaacguuucccugaccgccauagcaaaccaggcaacggugcuaaugggccuugggaaaggguggccguuauccaaaauggauauuggcguuccgcuccuagcuauagggugcuacucacaggucaaccccauuacacucacagccgcgcuacugcuccugguagcgcauuacgcaauaauuggacccggacuucaggcgaaagcaacgcgggaagcccagaaaagggcagcagccggaauaaugaagaaccccacgguagauggcaucacaguuauagacuuagagccaauuccuuacgauccgaaauucgaaaagcagcuuggacaaguaauguuacuaauccuaugcguuacacaaguacucaugaugcgcaccaccugggcucucugcgaagcucugacuuuggcgacaggccccaucucaacgcuaugggaaggaaauccgggcagauucuggaacacuacgaucgccgucagcauggcaaacauuuuccgugggagcuacuuagcuggagccggucuccuauuuuccaucaugaagaacacgaccaacacgcgcagagggaccggaaacaucggagaaacucugggggagaaguggaaaagccgccuuaacgcucucggaaagucggaguuccagauuuacaagaaaagcggcauccaggagguagauaggacgcuugcgaaggaagguauaaaacgaggugaaaccgaccaccaugcagugucacgggguucagccaaacuaaggugguucguagagaggaacaugguuaccccggaaggaaagguaguggaucucggcugcggacgcggaggguggagcuacuacugcggaggacugaaaaaugucagggaggugaaaggacuuacaaagggcggacccggacacgaggagcccaucccaaugaguaccuauggguggaacuuggucaggcuucaaagcggcguagaugucuuuuucaccccucccgagaaaugcgacacgcugcuaugcgacauaggggaaucuucuccgaaccccaccauugaagcugguagaacgcuccgcgugcuuaaccucguagaaaacuggcucaauaacaauacccaauucugcauaaaaguccuaaacccuuauaugcccagcguaaucgagaaaauggaaacgcuccaacgcaaauauggaggcgcgcucgugcgaaauccguuaucuaggaauagcacucaugaaauguacugggucuccaacgccaccggcaacauagucucgaguguaaacaugauuucgaggaugcugaucaaccgauucacgaugaaacacaagaaagcgacguacgaaccggacgucgaccuggguagcggcacacggaacauugggauugagagugaaauaccaaaccuagacaucaucgggaagaggauagagaaaauaaaacaagaacacgaaacgucguggcacuacgaccaagaucaccccuacaaaacaugggccuaucacgggagcuacgaaaccaaacaaaccggcagcgcaucgucgauggucaacgggguaguccgguuacucacaaagccgugggacgugguacccauggucacccaaauggcaaugacggacaccacacccuuugggcaacaacgagucuucaaagaaaaggucgacacccgaacacaagaaccuaaagagggaaccaagaaacuaaugcgcauaacggcagaauggcuguggaaagagcucggcaagaagaaaacaccacggaugugcacacgggaggaauuuacgagaaagguccgaaguaaugccgcgcuuggagccauauucaccgacgagaacaaauggaagucagcacgagaagcuguagaagacagcagauucugggaacucguagaccgcgaaagaaaccuccaccucgagggcaaaugugaaaccugugucuacaauaugaugggaaagagggaaaagaaguugggagaauuuggaaaagcaaaaggcagcagggcuauaugguacaugugguugggcgcacgcuuccuagaguucgaagcccucggauuccucaaugaagaccacugguucucaagagggaacagccugaguggagucgagggagaaggccuacacaggcugggguacauccuacgagaugugagcaagaaagagggcggugcaauguacgcggacgauacugccgggugggacacgagaauaacuuuggaggaccucaagaacgaagaaaugguuaccaaucacaugcgcggcgagcauaagaaacuggcggaggcgauauucaagcucacuuaucagaacaaagucguacggguucagcggcccacaccucggggaacggugauggacauaauaagccgccgagaucaacgugguucgggccaagucggaacguauggauugaauacauucaccaauauggaagcccagcucauacggcaaauggaaggggaagguaucuucaaguccauaaagcacuuaacgguaacagaagaaauagcggugcagaacuggcuggcaagagucggccgcgaaagacugagcagaauggcgauaucuggcgacgauuguguagugaaaccacuagacgaucgcuucgcgagcgcgcuaacggcccuaaacgacaugggcaagguacggaaggacauccaacaaugggagccaucgagaggguggaaugacuggacgcaaguccccuucugcagucaccacuuccacgaacuugugaugaaagauggucgaguccuaguggugcccugucgaaaucaagacgaacucauugggagggcaaggauaucccagggugcgggguggucccugaaagaaacagcgugccuaggcaaauccuacgcgcagauguggaccuugauguauuuucaucgacgcgauuugcgauuagcagcgaacgccauuugcagcgcaguccccucucauugggucccgacaucccguacgaccuggucaauccacgccaaacacgaguggaugaccacggaagacaugcuagcgguauggaaccgcgucuggauacaagaaaaucccuggauggaagauaaaaccccaguggaaucaugggaagagguaccauacuugggcaaaagggaggaccaauggugcgggucccugauagggcugacauccagggcaaccugggcgaaaaacauacagacggcaaucaaccaaguaagaucauuaaucggcaacgaggaauacaccgacuacaugccaucuaugaaacgauucaggagggaagaggaagaggcaggggugcugugguga

SEQ ID NO: 25297 - RNA, 9876 nt, Artificial Sequence
  derived and/or modified CDS sequence (opt11) from DENV-2__GQ868540__SS-prME
acugccggggugaucaucaugcugauccccaccgccauggcguuccaccuaaccacccgcaacggcgagccacauaugaucgugggccggcaagagaaggggaagucccuguuauucaaaaccgaggacggugucaacaugugcacgcucauggccaucgaucugggggagcugugcgaagacaccaucacauacaagugcccacuccuucgccagaacgagccugaggacauagacuguuggugcaauagcaccaguaccugggugacauacggaaccuguaccaccacgggcgaacaccggagggagaagcgguccgucgcccuggugccccauguagggaugggucucgagacccguaccgaaaccuggaugagcuccgaaggggccuggaagcauguccagcggaucgagaccuggauccuucgccacccgggcuucgccauaauggcggcuauauuagcguacacaaucgggaccacccacuuccagagagcacucaucuuuauccugcucacggcgguggcucccagcaugaccaugcgcugcauuggcaucuccaaucgggacuucguggagggcgucucggggggcucguggguggacaucgugcuagagcacgggucaugcgucacgaccauggcgaagaacaagcccacgcuggacuucgaacugaucaagaccgaggcgaagcagcccgccaccuugcgaaaguacugcaucgaggcaaaguugacuaacacgaccaccgagucccggugcccgacccagggcgagcccucgcuuaacgaggagcaggacaagcgcuucaucugcaagcacucuaugguggacaggggcugggggaacggcugugggcucuucggcaagggcggcaucgugacgugcgccauguuuacaugcaagaaaaacauggaggguaagguugugcuccccgaaaaccuggaguacaccaucgugaucacgccccauucuggggaggagcacgccgucggcaaugauacggggaagcacggcaaggagaucaagaucacaccgcagagcagcaucacggaggccgagcugaccgguuauggaaccguaacgauggagugcucaccccgcacaggcuuggacuuuaacgagaugguccugcugcaaauggaggaaaaggccuggcugguccaucggcagugguuccuggaucucccacuuccguggcugccgggggcggacacccaggguagcaacuggauccagaaggagacccucguaacguucaagaacccacacgccaagaagcaggacguggucguccuggguagccaggagggugccaugcacacagcgcucacgggggcuacggagauccagaugagcagcggcaaccuacuguucacggggcaccugaaaugccgcuugcggauggacaagcugcagcugaaggggaugucuuacagcauguguaccggcaaauucaaaauuguuaaagaaaucgcggagacccaacacgggaccaucgucauacgcguucaguacgagggggacggcucuccaugcaagaucccguuugagaucauggacuuggagaagcggcacguccugggacgccugaucacagugaacccgaucgugaccgagaaggauagccccgugaacaucgaggccgagccgccguucggcgacagcuacaucaucaucgggguggagcccggccagcucaagcugaacugguucaagaaagggagcucuaucggccagauguucgagaccaccaugaggggagccaagcgaauggcgauccugggggacacggccugggacuuuggcucccucgguggcguguuuaccagcauugggaaggcgcugcaccaagucuucggcgcaauauacggagcagccuucagcggggucaguuggaccaugaagaucuugaucggcgugaucaucaccuggauugggaugaacagccgcucuacgucgcugagugucagccucguacugguggguguagugaccuuguaccuaggggcgauggugcaggccgauaguggcugcgucgugagcuggaagaacaaagaacugaaguguggcuccggaaucuucaucaccgacaacgugcacaccuggacggaacaguacaaauuccaacccgagagccccagcaagcuagcguccgcaauccagaaggcccaugaggagggaaucugcgggauacggagcgucacccgccucgaaaaccugauguggaagcagauaacccccgagcugaaccauaucuuaucagaaaacgaagugaagcugacuaucaugacgggcgacaucaaagggaucaugcaggcaggaaaaagaucacugcgcccucagcccacugagcucaaguauaguuggaagacguggggcaaggccaagaugcuguccaccgagucccacaaccagacguuccugguggaugggcccgagacugccgagugcccgaacaccaaccgggcuuggaacagccucgaggucgaagauuacggcuucgggguguucaccacgaacaucuggcucaagcugcgggagaagcaagauguguucugcgacagcaagcucaugagcgccgcgaucaaggacaacagagcaguccacgccgacauggguuacuggaucgaguccgcccugaacgacaccuggaagauggagaaggccagcuucaucgaagugaaguccugccacuggccuaagagccacacccucugguccaacggcgugcuagaaagcgaaaugaucauccccaagaauuucgcggggcccguaagccagcacaacuaccgcccgggcuaccacacgcagaccgccgggcccuggcaccucggcaagcuugagauggauuucgacuucugcgaagggacgaccguuguugucaccgaggacugcgguaaccggggccccagcuugcgcaccacgacagccagcgggaagcugaucacggaguggugcugucggaguugcacucugccuccccuccgcuaccggggcgaggacggcugcugguacggcauggagauccggccgcugaaggagaaggaggagaaccuggucaacucgcucgugacugccgggcacggccaaauugauaauuucagccucggcguccugggcauggcacucuuccuggaggagauguuacgaacucgcgugggcaccaagcacgccauuuuauugguggccguaucguuugugacguuaaucacggggaacauguccuuccgggaccucggccgagugauggucauggucggggccaccaugaccgacgacaucggcaugggcgucaccuaccuggcucugcucgccgccuucaagguccgccccacguuugccgccgggcuguugcuucggaagcugaccagcaaagaacuaaugauggccaccaucggcaucgcgcugcuuucccaaagcacuaucccugagacgauccuggaacucaccgacgcccucgcccugggcaugauggugcucaagaucgugcgaaauauggaaaaguaucagcucgccguaaccaucauggcgauuuccugcgugccgaacgcgguaauccuguuaaacgcguggaaggucucaugcaccaucuuagccgccguuuccgucucuccccuccugcugacguccagccagcagaaggcggacuggaucccccuggcccucaccaucaaggggcugaacccaaccgcaaucuucuuaacuacguuaucccggaccagcaagaagcgcuccuggccgcucaacgaggcugugauggccgugggcaugguaagcaucuuggcguccagccuccugaagaacgacauccccaugaccgggccccugguggccggugggcuauuaacggugugcuacguccugacuggccgguccgcggaucuugaacuggagcgcgccgccgacgugaagugggaggaccaggcggagaucuccggauccuccccgauucugagcaucaccaucuccgaggacggaagcaugucgaucaaaaacgaggaagaggagcagacucucacgauacugauccggacgggccugcuugucaucagcggggucuucccgguguccauccccaucacggcggccgccugguaucugugggaagugaagaagcagagagccgguguacugugggacgugccuagcccgccccccguggggaaggcugagcucgaggacggugcguaccggauuaagcagcgcgggauccugggcuacucucaaaucggugccggaguguacaaggagggcaccuuccacaccauguggcacgugacucgcggggcggugcugaugcauaggggcaagcgcaucgagcccagcugggccgacguuaagaaggacuuaaucuccuacgggggcggcuggaagcucgagggugaauggaaggaaggugaggagguccaggugcuggcgcucgaacccgggaagaaccccagagccguccagacgaagccgggccuguucaagacgaacaccggcaccaucggugcggugagccuagacuucucccccgguacgagcggguccccaaucguggaucggaagggcaagguaguggggcucuauggcaacggcguggucacccgcagcggggccuauguguccgcgaucgcccaaaccgaaaagagcaucgaggacaacccggaaauugaggaugacaucuucaggaagaagcgccugaccaucauggacuuacacccuggcgcagggaagacuaagagauaccugcccgcaaucgugcgggaggccaucaagcggggccuacgcacccuaauccucgcuccgacacgugucguggccgccgagauggaggaggcccuccgggggcucccgauccgguaccaaacacccgccauccgggcggagcacacgggccgcgaaaucguggaccugaugugccacgccaccuucacuaugcggcuccugagccccgugcgcgugccgaacuacaacuugauaaucauggacgaggcucacuucaccgaucccgccuccaucgccgcgcgcggcuacaucagcacucgcgucgagaugggggaggccgccggcaucuucaugaccgcaacgccaccggggucucgggaccccuuuccccagagcaaugcucccauuauggacgaggaacgcgagauccccgagcggucauggaacagcggccacgagugggucaccgauuucaaggggaagacagugugguucgugccuucaaucaaggccgggaacgacaucgccgccugucuucguaagaaugggaagaaggucauccaacugucgaggaagaccuuugacuccgaguacgugaaaacccgcgccaaugacugggacuucguggucaccacggacauaagugagaugggggcgaacuuccgagcagagcgcgugaucgacccccggaggugcaugaaacccguuauucugacugacggggaagaaagggucauccucgccggucccaugccugugacucacagcagcgccgcgcagaggcgcggccgcaucgggcgcaauccaaagaaugagaacgaccaguacauauacaugggcgagccacuggaaaacgacgaggauugcgcgcacuggaaggaggccaagaugcuguuagacaauauaaacacuccagaaggcaucaucccgucaauguucgagcccgagcgggagaagguggacgccaucgacggggaauaucgccuacggggcgaagcgcgcaagacguuugucgacuugaugaggcgcggggaccuccccguguggcuggcuuaccgaguggcggccgaggguaucaacuacgcugacagacgaugguguuucgacgggaucaagaacaaccagauccuggaggagaacauggaggucgaaaucuggacgaaggaaggcgagcgaaagaagcucaagccgagguggcuggaugcucgcaucuacagcgaucccuuagcacuaaaggaguucaaggaguuugcugccggccggaagucccugacccuuaaccuuaucaccgagauggggcgccugccgacuuucaugacacaaaaggcccgggacgcccucgacaaccucgcggugcugcacaccgcagaggcuggcggucgcgccuacaaccacgcccugagcgagcucccugaaacccuggagacguuguuacuucugacccugcuggcgaccgucaccggcggaaucuuccucuuccucaugucugguaagggcauagggaagaugacgcuggguauguguugcaucauaaccgccagcauccugcucugguacgcccagauccagccgcacuggaucgccgcuaguaucauucuggaguucuuccugaucgugcuccugauccccgagcccgagaaacagcggacgccucaggacaaccaauugacuuacgucgucaucgcgauccucaccgucguggccgccacgauggccaacgagaugggguuccuggagaaaaccaagaaggaccugggcuuaggcagcaucaccacacaggagagcgagagcaacaucuuggauauugaccugcgcccggccagcgcguggacgcucuacgccgucgccacgacuuucgugacucccauguugcggcauagcaucgagaacucguccgugaaugucagccuaacggccaucgccaaucaagccaccguucucaugggacuaggcaaaggguggccccuguccaaaauggacaucggcgugccccuccuggccauugggugcuacagccaagugaacccgaucacccuuaccgccgcucuccugcugcucguugcgcacuaugccaucaucgggccaggcuugcaagccaaggccacgcgcgaggcccagaaacgugcggcagccgggauuaugaagaaccccaccguugacggcaucaccguaaucgaccuggagcccauuccguacgauccgaaauucgagaagcagcugggccaagugaugcugcugauccucugcgugacccagguccucaugaugcggacgacaugggcccugugcgaggcccucacccuggcgaccggcccaauuuccacgcugugggaggggaaccccgggcgcuucuggaacaccacaauagccgugucuauggcuaacauauuccggggguccuaucucgcuggggcgggccugcuguucagcaucaugaagaauaccacgaacacccgucgagguaccggcaauaucggagagacccucggggagaaguggaaguccaggcugaacgcucuaggcaaaagcgaauuccagaucuauaagaaguccgggauccaagagguggaccggacgcucgcuaaggagggcauuaagcgcggggaaacagaccaccacgccgucagccggggcuccgccaagcugcgcugguucguggagcggaacauggugaccccggaggggaagguaguggaccuggggugcgggcgagggggcugguccuacuacugcgggggccuaaagaacgugcgggaagucaagggccugaccaagggcggucccgggcaugaagaaccgauccccaugucuacguacggauggaaccuaguccgccuccagucggggguggacgucuuuuucacuccgcccgagaagugcgacacccugcucugcgacauuggcgagagcuccccgaaucccacuauugaggcgggcagaacucuaagggugcuuaaccugguggagaacuggcuuaacaauaacacccaguuuugcaucaaaguccugaacccguauaugcccagcguaauagagaaaauggagacccugcagcguaaguacgguggcgcccucgugcgcaauccgcucucucggaacagcacacaugagauguacugggucucaaacgcgacggggaacaucgugagcuccgugaacaugauuucgcgcaugcugaucaaccgauuuacgaugaagcacaagaaggccaccuaugagccggacgucgaucugggcuccgggacgcggaacaucgggaucgagagcgagaucccgaaccuugacauuaucgggaagcggaucgagaagaucaagcaagaacacgagacguccuggcacuacgaccaggaccaccccuacaaaacgugggcuuaccacgggucauacgagaccaagcagaccggcuccgccucaucgaugguaaacgggguaguccgguugcuaaccaagcccugggacguggugccgauggucacucagauggccaugaccgacaccacccccuucggccaacagcgcgucuucaaagagaagguggauacgcggacccaggagccgaaagaaggcaccaagaagcucaugcguauuaccgcugaguggcuguggaaggagcuugggaagaaaaagacgccacggaugugcacgcgcgaagaguucacacguaaggugcgcagcaaugccgccuugggugcgaucuuuaccgacgaaaacaaauggaaguccgcccgggaggcaguggaggacagcagauucugggagcugguggaccgggagcgcaaccugcaccucgaggggaagugugagacgugcgucuacaacaugaugggcaagagagaaaagaagcugggcgaguuuggcaaggccaaggggucccgcgcgaucugguacauguggcugggggcccgcuuccucgaguucgaggcucuggguuuccugaacgaggaccacugguuuagccgugggaacucucucuccggcguggagggggagggccugcaccgguugggcuacauucuuagagauguaucgaagaaagaaggcggagcgauguacgccgaugacaccgcggguugggauacccggaucacccuggaggacuugaaaaacgaggagauggugacgaaccacaugaaaggcgagcauaagaagcuggcugaggccaucuucaaguuaaccuaccagaacaaggucguccgcguccagcgccccacgccccguggaaccgugauggauaucauaagccgccgggaccagcggggcucaggccaggucggcacguacggucugaacaccuucaccaacauggaggcccagcucauccgucaaauggagggcgagggcauauucaaguccauccagcaccuuacggugacggaggagaucgccguucagaacuggcuggcgcgggucggccgggagcgcuugucccgcauggccauaucaggcgacgacugcgugguaaagcccuuagacgacagauucgccagcgcccugaccgcccucaacgacaugggcaagguacggaaggacauccaacagugggaaccuucucgcgguuggaacgacuggacgcaggucccguucugcagucaccacuuccacgagcuggugaugaaggacggacgcguccugguggugcccugucgcaaccaggaugagcucaucgggagagcgcgcaucucucagggcgccggcuggucgcugaaagagaccgcuugucugggaaaaaguuacgcucagauguggacgcucauguauuuccaccggcgcgaccugcggcucgccgcuaacgccaucugcagcgccguccccucccacugggugcccaccagccgaaccacaugguccauccacgccaagcacgaguggaugacgacggaagauaugcucgcgguuuggaaccgcgucuggauccaagagaacccguggauggaggauaaaacucccguggaguccugggaagagaucccauaccuggggaagcgggaggaccaguggugcgggagccugauuggacucaccucucgcgccaccugggccaagaacauccagacggccauuaaccaggugcggucgcugaucgggaacgaggaauacacagacuauaugcccuccaugaagcgcuucaggagagaagaggaggaggccggcguuuuaugguga

SEQ ID NO: 25298 - RNA, 9876 nt, Artificial Sequence
  derived and/or modified CDS sequence (opt11) from DENV-2__GQ868541__SS-prME
accgccggagugauaaucaugcuuauccccacugccauggcguuccaccucacgacucguaacggagagccccacaugaucgucggacggcaggagaaggguaagucccuucuguucaagacagaggacggcgugaacaugugcacccucauggccaucgaccugggggagcuaugcgaggacaccaucaccuacaagugcccccuccugcgacaaaacgagcccgaagacaucgauugcuggugcaacagcaccaguacguggguaacguacgguaccugcaccaccacgggugagcaccgccgcgagaagcggagugucgccuugguaccccacgugggcaugggccucgagacccgaaccgaaaccuggaugagcucggagggggccuggaagcauguccaacggaucgagaccuggauccugcgccacccgggcuucgccaucauggcggccauccuggccuauaccaucgggacuacccacuuucaacgggcccucaucuucauccugcugacagcggucgcccccagcaugaccaugcgcugcauaggcaucuccaaccgggauuucguagagggcguaagcggggguuccugggucgacauaguccucgagcacggaagcugcguuaccaccauggccaagaacaagcccacacuggacuucgaacugaucaaaaccgaggccaagcagcccgccacccuccgcaaguacugcaucgaggcgaagcuaacaaauacgaccaccgagucccggugcccgacucaaggcgagccuucuuuaaacgaggagcaggauaaacgcuucaucugcaagcauuccaugguggaccggggcugggggaaugggugcgggcucuuugggaaaggcgguaucgugacgugcgccauguucacgugcaagaaaaacauggagggcaaggucgugcugcccgagaaccuugaguauaccaucgugaucacgccccacagcggggaggagcacgcugucggcaacgacacggguaagcacggcaaggagaucaagaucaccccgcaguccucaauuacggaggccgagcucaccggguacggcaccgugacgauggagugcagcccgcggaccggccuagacuuuaacgagauggugcugcuccagauggaggagaaggcauggcugguacaccggcaaugguuucucgaucucccccugcccuggcugccuggggcggacacccagggcagcaacuggauccagaaggagacccucguaacguucaaaaacccccacgccaagaagcaggacguugucguacuggggucccaggagggcgccaugcacaccgcccugaccggggccaccgagauccagaugagcagcgggaaccuucuguucacgggccaccugaaaugccggcuccggauggauaaacugcagcugaaagggauguccuacagcauguguaccggaaaauucaaaaucgugaaggagaucgcggagacccaacacgggaccaucgugauucgcgugcaguaugaaggagacggcucccccugcaagauccccuucgagaucauggaccucgagaagaggcacguccugggccgccugaucacggucaacccgaucgugacggagaaggacagccccguaaacaucgaagcugagccgcccuucggugacuccuacaucaucaucggaguagagcccggccagcugaaguugaacugguucaagaagggcagcuccaucggccagauguucgagaccacuaugcgcggcgcuaagcgcauggccauccugggggacacggcgugggauuucggcagccucgggggaguguuuaccucaaucgggaaggcgcugcaccaggucuuuggugccaucuacggcgccgcguucagcgggguguccuggaccaugaagauccugaucggcgugaucaucacuuggaucggcaugaacagccgcuccacgagcuuauccgucagccucguguuggugggcgucgugacccuguaccuuggggcgauggugcaagcugauuccgggugcgucgugucuuggaagaacaaagagcugaagugcgguuccgggauauucaucaccgacaacgugcacacauggacggagcaguauaaauuucagcccgagagucccagcaagcuggccuccgccauccagaaggcccacgaggaaggcauuugcgggauccggagcgucacgcgccucgagaaccugauguggaagcagaucacacccgaguugaaucauauccuuagcgagaacgaggugaaguugaccaucaugacgggcgacaucaaggggauaaugcaggcgggcaagcgcagccugcgcccgcagcccaccgagcucaaguauuccuggaaaacguggggcaaggccaagaugcugagcaccgagucccacaaccagacguuccugaucgacgggcccgagacagccgagugccccaacacgaaucgggccuggaacagccucgagguugaggacuaugguuuuggggucuucaccacgaacaucuggcugaagcuacgcgagaaacaggacguguucugcgacuccaaacucauguccgccgcuaucaaggacaaccgggccguacaugcggacaugggauacuggaucgaguccgcccuaaaugacaccuggaagauggagaaggccucguucauagaggucaaguccugccacuggccuaagucacacacccuguggucaaacggaguguuagagagcgaaaugaucauccccaagaauuucgcaggccccgugucccagcacaacuaccgcccgggcuaccacacacagaccgccgggcccuggcaccuggguaagcuggagauggacuucgacuuuugcgaggggacgaccgugguggugaccgaggacugcggcaaccggggcccgagccuccgcaccacgaccgcgagcgggaagcugaucaccgaauggugcugccgguccugcacccuuccaccgcuccgcuaccggggcgaggacgggugcugguacggaauggagauacgcccccugaaggagaaggaggagaaccuggucaauucacucgucacggccgggcacggccaaaucgauaacuucucccugggcguauuagggauggcccucuuucuggaggagaugcugcggacccgcguuggcaccaaacacgccauacuucugguggccguuagcuucgucacccugaucacggggaacauguccuuucgagaccucggccgcguaauggugauggucggggcuacgaugaccgacgacaucgggaugggcguaacuuaccuggcacugcucgcggcauucaagguacgccccacuuucgccgccgggcugcuguugcggaagcucaccagcaaagaacuuaugauggcuaccaucggcaucgcgcuccugucccagagcaccauccccgagacgauccuggaguugaccgacgcccuggcacuggggaugauggucuuaaagaucgugcgcaacauggagaaguaccagcuggccgugaccauuauggccaucuccugcgucccuaacgcgguaauccugcucaacgccuggaaggugucaugcacaauccuggccgcugucuccgucagcccccugcuccugacguccagccagcagaaggcggacuggaucccccuggcccuuaccaucaaaggccuuaaccccaccgccaucuuucugaccacgcucucgcgaaccagcaagaagcgcuccuggccucugaacgaggccgucauggccgucggcaugguuagcauccuggcauccucccuccuuaagaacgauauccccaugaccgggcccuuaguggccggcgggcucuugacugugugcuauguacugacaggccggagcgccgaucucgagcuggagcgcgcggccgacgucaagugggaagaucacgcggagaucuccggcaguucccccauccugagcaucaccaucagcgaggacggcagcauguccauuaagaacgaggaggaggaacagacccugacuauucuuauccggacgggucugcucgugauuuccggaguguuccccgucuccauucccaucaccgccgccgccugguauuugugggaggugaagaagcagcgcgccggggugcugugggacguacccucgccgccgccggucggaaaggcggagcucgaggacggcgcuuacagaaucaagcagcgcgggauccugggauauucacagaucggcgccgggguguacaaggagggcaccuuccacacgauguggcacgucacccgcggggcggugcugaugcacagagguaagcggaucgagcccuccugggcugacgugaagaaggaccuaauuagcuacgggggcggcuggaagcuggaaggggaguggaaagaaggcgaggagguccagguacuggcgcucgagcccgggaagaacccgcgcgcagugcagacgaagcccggccuguucaagacaaacaccgggaccaucggagccgucaguuuggauuucucccccggcacgagcggcucccccauuguugacagaaaggggaagguggucgggcucuacggcaacggcguggugacccgcagcggggccuacgucagugcgaucgcccagacggaaaaaucaauugaggacaacccugagaucgaggacgauaucuuccggaagaagcguuugaccaucauggaccugcaccccggggccgggaagacgaaacgguaccugcccgccaucgugcgagaggccaucaagcgagggcuccgcacccugauccuggcuccgacacggguggucgcggcagagauggaagaggcccuccggggucugcccauccgcuaccaaacgcccgccaucagggcggagcacacgggacgcgaaaucguggaccugaugugccacgcaaccuucaccaugcggcuccugagccccgugcgcgucccuaauuauaacuugaucauuauggacgaggcccacuucaccgaucccgcuuccaucgccgcgcggggcuauaucagcacgaggguggaaaugggggaggccgcgggcaucuucaugaccgccacgccucccggaucccgcgacccauucccccagagcaacgcgcccaucauggacgaggagagggaaauccccgaacgguccuggaacagcggccacgaauggguaacagacuucaaggggaagaccgucugguucgugccguccauuaaggccggcaaugacauugccgcaugccuccgcaagaacggcaagaaggugauccagcugagccgcaagaccuucgacuccgaguacguaaagacccgcgcuaacgacugggacuucguggugaccacggacaucagcgagaugggcgcgaacuucagagccgagcgcgucaucgacccccgacgcugcaugaagcccgugauucucaccgacggcgaagagcgggugauccucgccgggcccaugccggucacccacuccagcgccgcgcagaggaggggccggaucgggcgcaaccccaagaaugagaaugaccaguacaucuacaugggcgagccgcuggagaacgacgaggacugcgcgcacuggaaggaggccaagaugcugcuugacaacauuaacacacccgagggcauaaucccgagcauguucgagcccgaacgggaaaagguggacgccauugacggagaguaccgucuccggggcgaggcccgcaagaccuucguugaucugaugcggcgcggggaccucccggucuggcuggccuaucggguggcggcugaaggcaucaacuaugcggaccgcagauggugcuucgacgguaucaaaaacaaccagauacuggaagagaacguggaggucgagaucuggaccaaagagggugagcgcaagaagcucaaaccucgguggcuggaugcacgcaucuacagcgacccuuuagcacucaaggaauucaaggaguuugccgcaggucggaagucucuaacccugaaccucaucaccgagauggggcgccugcccacguuuaugacccagaaggcccgggaugcccuggacaaucuugcggugcugcacaccgccgaggccggcgggcgcgccuacaaccacgcccugagcgagcuccccgagacucuggagacgcuguugcugcugacccuccuggcgaccgucaccggcggcauauuuuuguuccuuauguccgggaagggcaucgggaagaugacgcugggcaugugcuguaucauuaccgccagcauccuucucugguacgcccagauccaaccgcacuggaucgccgcuaguauaauccuggaguucuuucugauuguguuacugauccccgagcccgaaaaacagcggacgccucaggacaaccagcugaccuacguggucaucgcgauccuaaccgugguggccgccacgauggcgaacgaaaugggguuccuggagaaaaccaaaaaggaucugggccucggaagcaucaccacccaggagagcgaguccaacauacuggacaucgaccuucgcccggccucggcguggacgcucuacgccgucgccacgaccuucgucacccccaugcugcggcacagcaucgagaacagcuccgugaacguuagccuuacagccaucgcuaaccaagccaccgugcucauggggcugggcaagggguggcccuugaguaagauggacauuggcgugccccuccuggccaucgggugcuacagccaggucaacccuaucacccugaccgccgcccugcuguuauuaguggcacacuacgcuauaaucggcccaggccugcaggccaaggccacgcgcgaggcccagaaacgcgccgcagccgguauuaugaagaaucccaccguggauggcauuaccgucaucgaccuagagcccauaccguaugacccuaaguucgagaagcagcucggccaggugaugcuacugauccucugcgugacccagguccugaugaugcggacgaccugggcccugugcgaggcccuaacucucgcgaccggccccauuuccacgcugugggaagguaaccccggccgauucuggaacacaacaaucgccgugagcauggccaacauauuccggggcuccuaccucgccggggcgggguuguuauucucuaucaugaagaacaccacgaacacccgccggggcaccggcaauaucggcgagacccucggggagaaguggaagagccgccugaaugccuuaggaaaaagugaguuccagaucuacaagaagagcggaauccaggagguggaccggacgcucgccaaggagggcauuaagagaggagaaacagaucaccacgccgucagccgggguuccgccaagcugcggugguucguggaacggaacauggugaccccggaaggcaaggucguagaccuggggugcggccgcgggggcuggagcuacuacugcgggggccucaaaaacgugcgggagguuaagggcuugacuaaaggggggccugggcacgaggagcccaucccuauguccaccuacggcuggaaccuggugcgccuccagagcggggucgacguuuucuucaccccgcccgagaagugcgacacgcugcugugcgacaucggcgagagcucccccaacccuaccaucgaggcgggccggacgcuccgaguacugaaccuggucgagaacuggcucaauaacaacacccaguucugcaucaaggugcugaauccguacaugcccucagugaucgagaagauggaaacuuuacagaggaaguacgggggugcccuggugcgcaauccccucucccguaacucaacccacgagauguacugggucuccaaugccaccggaaacaucgugucuuccgugaauaugaucucgcgcaugcugaucaaccguuucaccaugaagcacaagaaggccacauacgagccagacgucgaccugggauccgggacccggaacaucggcaucgagagcgaaauccccaaccucgauaucauuggcaagcgcauagagaagaucaagcaggagcacgagaccucauggcaccacgaccaggaccaccccuauaagacaugggccuaccacgggucguacgagaccaagcagaccgggucagcuucauccauggugaacggggugguccggcuuuuaaccaagcccugggacguggugccgauggugacgcagauggccaugacggacaccacccccuucggccagcaacgcguguucaaggagaagguggacacccggacccaggagcccaaggagggcaccaagaagcucaugcgaaucaccgccgaguggcuguggaaggagcuggggaaaaagaagacgccccggaugugcacccgcgaggaguucacccggaaagucagaagcaacgccgcccucggcgcgaucuucaccgacgagaacaaguggaaguccgcacgggaggcgguggaggacagccguuucugggagcugguggaucgggaacgcaaccugcaccucgaagggaagugcgaaacgugcguauacaacaugaugggcaaacgggagaagaagcugggggaguucggcaaggcaaaaggcucccgggcgaucugguauauguggcugggggcgcgguucuuggaguucgaggcgcugggcuuccugaaugaggaccacugguucagccgaggaaacucgcucuccgguguggaaggggaaggccugcaucggcugggcuauauccuccgggacgucaguaagaaggagggcggggccauguaugccgaugacacggcggggugggacacccggaucacccuggaggaucugaagaacgaggagauggugaccaaccauaugaagggggaacacaagaagcucgccgaggccaucuuuaagcugacguaccagaacaagguuguucgugugcagaggccuacgccucggggcaccgugauggauaucaucucccgccgggaccagcgcggcagcggccaggucgggacguacggccugaauacuuuuaccaacauggaggcccaguuaauccggcagauggagggggagggcaucuuuaaguccauccagcacuugaccguuacggaggagaucgccgugcagaacuggcuugcacgcgucggccgggagcgucugagccggauggcuaucuccggggaugauugugugguuaagccccuagaugaucgcuucgcuagcgcccugaccgcccugaacgauaugggcaaaguccggaaagacauccagcagugggagcccagccgcggguggaacgauuggacacagguuccguucuguucacaccacuuccacgagcucgugaugaaggacggccggguucugguggugccuugcagaaaucaggacgaacuaaucgggcgggcgagaaucucccagggcgccggcuggucucugaaggaaacggcaugcuuaggaaaguccuacgcccagauguggacgcucauguacuuccaccgacgcgaccugcgguuagccgcgaacgccaucugcagcgccguucccucccacugggugccuacgagccgcacgaccugguccauccacgccaagcacgaguggaugacaaccgaggacaugcucgcgguguggaaccgcgucuggauucaggagaacccguggauggaggacaaaacccccguagagagcugggaggaaguucccuaccugggcaagcgggaggaccaguggugcgggagccucaucggccuaacgucccgcgcgaccugggccaaaaacauacaaacggcgaucaaccagguccggagccugaucgggaacgaggaguacaccgacuacaugcccuccaugaagcgcuuccggcgagaagaagaagaggccggcgugcugugguag

SEQ ID NO: 25299 - RNA, 9876 nt, Artificial Sequence
  derived and/or modified CDS sequence (opt11) from DENV-2__GQ868603__SS-prME
acugccggggugauuauuaugcugaucccaaccgcgauggcuuuccacuuaaccacacgcaacggugaaccacacaugaucgucggaaggcaagagaaaggcaagucccugcuguucaagaccgaggacggcgugaacaugugcacccucauggccauugaccuaggggagcugugugaggacacuauuacguacaagugcccccuacugcgccagaacgagccagaggacaucgacugcugguguaacucgaccagcaccugggugaccuaugggaccugcacaacuacgggagagcaccgccgugagaagagauccgucgccuuggugccccacguggggaugggccucgagaccaggaccgagaccuggaugaguuccgagggagccuggaagcacguccagcggaucgaaacguggaucuuaagacacccgggcuucaccaucauggcugcaauccuagccuacaccaucggcaccacgcacuuccagcgggccuugaucuucauucugcuaaccgccguggcuccaagcaugacaaugcgaugcaucggcaucuccaaccgggauuucguggagggagucagcgguggcucguggguggauaucgugcucgagcaugggagcugcgugaccacgauggccaagaacaagccgacccucgauuucgagcuaaucaagaccgaggcaaagcaaccagccaccuugcgcaaauacugcaucgaggccaagcugacgaacaccaccaccgaguccagguguccgacgcaaggcgagccgagccugaaugaggagcaggacaagcgauuccucugcaagcacuccauggucgaccggggcugggguaacgguuguggacuguucggcaagggcggaaucgugacaugcgcgauguucacguguaagaagaauauggaagggaaggucgugcuaccggagaaucucgaauacaccaucguuauuacgccccacagcggggaggaacacgccgucggcaaugauaccgggaagcacggcaaggagauuaaaaucacgccgcagagcagcaucaccgaggccgagcugaccggguacgguacggugaccauggagugcaguccccgcaccggccuggacuucaacgaaauggugcuccugcaaauggaagacaaagccuggcuuguccaccggcagugguuucucgaccuaccacuucccuggcugccgggggccgauacccaaggcagcaacuggauccagaaggagacgcuggugacauucaagaacccucaugcgaaaaagcaggauguggucguguuagggucccaagagggcgccaugcacaccgcccucacaggggccaccgagauccagauguccagcggcaaucuacuauucacuggacaccucaagugccgccugaggauggacaaacugcagcucaagggcauguccuacagcaugugcacgggcaaguucaagaucgucaaggaaauagccgagacccagcacgggacgaucgugauacguguacaauacgagggcgacggcucucccugcaaaauucccuucgaaauaauggacuuagagaagcgucacguccuggggcgccucauaacugugaacccgaucgugaccgagaaggacagccccgugaacauagaggcggagccgccauucggggacuccuacauaaucaucgguguggagccgggccagcugaaacugaacugguucaagaaggggaguuccaucggccagauguucgagaccacgaugcggggugccaagcggauggcaaucuuaggggacaccgcaugggauuucggaucauugggcgggguguuuacuagcauugggaaagcccuacaccaggucuuuggggcgaucuacggcgcagcuuucucugggguguccuggacuaugaagauccugaucggcgucauaauuacguggaucggcaugaacagccgcuccacaucacuauccguuagccuggugcuggucggugucgucaccuuauaccugggggccaugguucaggcggacucgggaugcgucgugucguggaagaauaaggaacugaagugcggcuccggcaucuucaucacagacaacgugcacacguggaccgaacaguacaaguuucagcccgagagccccucuaaacuagccuccgcgauccaaaaggcccacgaggagggaaucugcgggauccggagcguuacccgccuugaaaaccugauguggaagcagaucacacccgagcucaaucacauccuguccgagaaugagguuaagcugacgauuaugacaggcgauaucaaggggaucaugcaagcaggcaagcggagccucagaccucagccuaccgaacugaaguacuccuggaagaccugggggaaggcgaagaugcugaguacggagucccacaaccaaaccuucuugaucgacggucccgagacugccgagugcccaaacaccaaccgcgcuuggaauucacuggagguugaagacuacggauucggggucuuuacgaccaauauauggcugaagcuccgcgaaaaacaagauguacuaugcgauaguaagcuaaugagcgcugcgaucaaggauaauagggcggugcaugcggacaugggcuauuggauugaguccgcacucaacgauacguggaagauggagaaggccagcuucaucgaagucaagaguugccacuggcccaaaucucacacucugugguccaauggagugcuggagagcgagaugaucauccccaaaaacuucgccgggccagugucccaacacaacuaccgcccaggcuaccacacucaaacggcggggcccuggcaccucggaaagcuggagauggacuucgacuuuugcgagggcaccaccgucguagugaccgaagacugcgggaaccgcggccccagccugaggacgaccacggccagcgggaagcucaucaccgaguggugcugucggucguguacuuugcccccgcugcgcuaccggggcgaggauggauguugguacgggauggagauccgcccccucaaggagaaggaggagaaccugguaaacagccuggugacggcagggcacggccagauagacaauuucucccucggugucuuaggcauggccuuguucuuggaggaaaugcugcguacucgugugggcacuaaacacgcaauauuacucgcagccgugagcuucgugacguuaaucaccgggaauauguccuuccgggaccucggccgcguaauggugaugguaggggccaccaugaccgacgacaucggaaugggugucacauaccuagcccuguuggcggcguucaaagugcgucccaccuucgccgccggccuccuccugcggaagcuaaccagcaaagagcugaugauggccaccaucggaaucgcgcugcucucccagagcacgauccccgagaccauccuggaacugacggacgccuuggccuuaggaaugauggucuugaagauuguccgcaacauggagaaguaccagcugguggugaccaucauggccaucucgugcguaccgaacgccgugaucuuacagaacgcguggaaagugagcugcacgauccuggccgccgucuccgugagcccccuccugcugacaucaagccggcagaaagccgauuggauuccccuggcgcugaccaucaaggguuuaaacccgaccgcaaucuuccucacgacccugucccgcaccucgaagaagagauccuggccgcugaacgaggccaucauggccguggggauggugagcauuuuagccuccagccugcugaagaacgacauccccaugacugggccccucguggccggcgggcugcugacggucuguuacgugcucacggggcggagcgccgaucuugaguuagagcgggccgcagaugugaagugggaagaucaggccgagauuuccgggagcucccccauacucagcaucacgauaucugaggacggcagcauguccauaaagaacgaggaggaggagcagacccugacuaucuugauccggaccggccuccuggucaucuccgggguauuuccaguuucuaucccgauuacggcggccgccugguacuugugggaagucaaaaagcagcgggccggcguccuuugggacgugccgagcccgccgccagucgggaaggcggagcuagaggacggagcguaccgcauaaagcagcgggggauccugggcuacucccagauuggugcagggguguacaaggagggcaccuuccauaccauguggcacgugacccgcggggcgguccucaugcaccgcggcaagagaaucgagcccagcugggccgacgugaagaaggaccugaucuccuaugggggcggcuggaagcuggagggggaguggaaggagggcgaggaggugcagguccucgcccuggagcccgggaagaaccccagagcgguccaaaccaagcccggccuguuuaaaaccaacaccgggacgaucggcgcgguuagccucgacuucagccccggcaccagcggaucccccaucguagaucgcaaagggaaggugguggguuuauacggcaacggcgucgugacacggagcggugccuacgugagcgccauagcacagaccgagaaguccaucgaggacaacccugagaucgaggacgacaucuucagaaagaagcggcucacgaucauggaccugcauccaggcgccgguaagaccaaacgcuaucuccccgccauaguccgugaagccaucaagcgaggacugcgcacccugauccucgcccccacgagggugguggcggccgagauggaagaggcccugcgcggccugccuauccgguaccaaaccccggcaauccgcgcugaacacacgggccgggaaaucguggauuugaugugccacgcgaccuucaccaugcgccugcuguccccggugcgggucccgaacuacaaccucaucaucauggacgaggcacacuucacagaccccgccuccaucgcggcccgcggcuacaucagcaccagggucgagaugggagaggcggcaggcaucuuuaugaccgcgacuccgcccgggucuagggacccguucccccagagcaacgcccccaucauggacgaggaaagagagauccccgagcgcaguuggaauagcggucacgaaugggugacugacuucaaggguaagaccguaugguucgucccguccauuaaagcuggcaacgacaucgcugccugccugcggaaaaauggcaagaaggugauccagcugagccgcaaaacuuuugacuccgaguacgugaagaccagggccaacgacugggauuuugucguuacgacagauauuucugagaugggggccaacuucaaggccgagcgcgugaucgaccccaggagaugcaugaagcccgugauacucaccgacggcgaagagcgggugaucuuagccgggcccaugccaguuacccacucaagcgccgcccagcgccgcggcaggauagggaggaaccccaagaacgagaacgaccaguacauauacaugggugagcccuuggagaacgacgaagauugcgcucacuggaaagaagcgaagaugcuucuggacaacaucaacacgcccgaaggaaucauucccuccauguuugagccggagcgagagaaggucgacgcuaucgauggggaauacaggcugcggggcgaggccagaaagacuuuuguggaucucaugcggcguggggaccugcccguuuggcuggccuaccggguggccgcggagggaaucaacuacgccgacagaagguggugcuucgacgggauaaagaauaaccagauccucgaggagaauguggagguggagaucuggaccaaggagggagagcggaagaaguuaaaaccccgguggcuagacgcgaggauuuauagcgacccccucgcccugaaggaguucaaggaguucgcggccggacguaaaucucugacacuaaaccugaucacggagaugggccgcuugcccaccuuuaugacgcagaaggcccgggaugcccucgacaaucuggccgugcugcacaccgcggaggccgguggucgcgcauauaaccacgcccugucugagcugcccgagacgcuggagacccuccuacuccucacccuguuagcgaccgugacgggggguaucuuucuauuucugauguccgggaagggcgucgggaagaugacacugggcauguguugcaucaucaccgcaucuauccugcucugguacgcccagauccagccccacuggaucgccgccuccaucauacuggaguucuuccucaucguacugcuuauccccgagccagagaagcagaggacgccccaggacaaucagcucaccuacguugugaucgccauccugacggugguggcggcaacaauggccaacgagaugggguuccuugagaagacgaaaaaggaucucgggcugggaagcaucaccacgcaagaaagcgaguccaauaucuuagacauugaucuccggccggcuagugccuggacacuguaugcgguugccaccaccuucuucacgcccaugcugcggcacuccauugagaacaguucggugaacgugucgcucacggccaucgccaaccaagcuaccgucuuaaugggguuaggcaagggguggcccuugagcaagauggauaucggagugccccugcuugccaucggguguuacagccaggugaacccgaucacccuaacggccgcccuguugcuccuggucgcccacuacgcgaucaucggccccggacugcaggccaaggcgacccgcgaggcccagaagcgugccgccgccgggaucaugaaaaaccccacuguagacggcauaaccguaaucgaccucgaaccgauuccguacgaccccaaauucgaaaagcagcuggggcaggucauguuacucauccugugcgugacccaggugcugaugaugcggaccacgugggcccuuugcgaagcccugacccuggccaccggccccauauccacuuuaugggaagggaaccccggcagguucuggaacaccaccaucgcgguuagcauggcaaacaucuuccggggcuccuaccuggccggggcgggccugcucuucagcauaaugaagaacacgacaaacacccgccgggggaccgguaacauaggcgagacguuaggagagaaguggaaaucccgccugaacgcgcucggaaagucggaguuccaaaucuacaagaagucugggauccaagagguagaccggacacuggccaaagagggcaucaagaggggggagaccgaccaccacgccgugagucggggcuccgccaagcugcgcugguucgucgaacggaauauggugaccccggagggcaagguugucgaccucggguguggccgcggugguuggucguacuauugcgggggcuugaaaaacgugcgggaggugaagggccugacgaaggggggucccgggcacgaggagcccauccccaugaguaccuacgguuggaaccuaguccgccuacagucgggcgucgauguguucuucacgccgcccgagaagugcgacacccucuuaugcgacaucggcgaguccucccccaaccccacuaucgaggcgggccggacgcugaggguccugaaccucguggaaaacuggcugaauaacaacacccaguucugcaucaaggugcugaacccuuacaugcccagcgucaucgagaagauggagacccugcagcggaaguaugggggugcucuaguacgcaacccacugucccguaacagcacccaugagauguacugggugucuaacgccacggggaacaucguauccuccgucaacaugauaucccgcaugcucaucaacagguucacuaugaaacacaagaaagcgaccuacgagccggauguggaccucggcuccgggacccggaauauuggcaucgagagcgagauucccaaccuggacaucaucggcaagcgcauagaaaagauuaagcaggagcacgagacguccuggcacuacgaccaggaucacccauacaagaccugggccuaucacgguagcuacgagaccaagcagaccggauccgcuagcuccauggucaacgggguggucagacugcucacgaaaccaugggacgucguaccgauggucacccaaauggccaugaccgauacaacccccuucggccagcagcgcgucuucaaggagaagguggacacgcggacccaggaacccaaggaggguaccaagaaacugaugaagauaacggcugagugguuguggaaggagcuggggaagaagaagaucccgagaaugugcaccagagaggaauucacccgcaagguacggagcaacgccgcccugggcgccaucuucaccgacgagaacaaguggaaguccgcucgcgaggccguggaggauagccgauucugggagcugguggaccgagagagaaaccuccaucuggaaggcaagugcgagacgugcguauacaacaugaugggcaaacgggagaagaaacugggggaguucggcaaagccaagggcucccgggccaucugguacauguggcucggcgcgcgcuucuuagaauuugaggcacuggguuuucucaacgaggaccacugguucagccgagggaauucacuguccggugucgaaggggagggucuucaccgacuaggcuacauccugcgggacgugagcaagaaagagggcggugcgauguacgccgacgacaccgccgggugggacacccggaucaccuuagaggaccucaagaacgaggagauggucacgaaccacaugaagggagagcacaagaagcuugcugaggcaaucuucaagcugacuuaccagaacaaggugguccggguccaacgcccgacgccccgugggaccgugauggauaucaucucccggcgcgaucagcguggcucaggacaaguggguacguacggccuuaacaccuucacuaacauggaagcccaacugauccgccagauggagggggaggggauauuuaaauccauacaacaccucaccgucacggaagagaucgccgugcagaauugguuggccagggugggccgcgagcgccugucucgcauggcaaucucgggcgacgacugugucgucaaaccccuggacgaucgguucgcaagcgcccucaccgcccugaacgacaugggcaagguacgcaaggacauccagcagugggagcccucccggggauggaacgauuggacacaggucccguucugcagccaucacuuccacgaacucgugaugaaagacggccgcgugcucgucgugcccugucggaaccaggaugagcugauagggcgcgcccgcaucucccaaggugcuggcuggagccugaaggaaaccgccugccucgggaagagcuaugcccagauguggacgcucauguacuuccaccgccgcgaccuccgccucgccgccaacgcgaucugcagcgcugugcccucgcacugggucccuaccucgcgaacuaccuggucaauccacgccaagcacgaguggaugacaacugaggacaugcuugccgucuggaaucgcguguggauucaggagaacccguggauggaggacaaaacccccgucgaguccugggaggaaguucccuaucuuggcaagcgcgaggaccaguggugcgggagccucaucgggcugaccucacgggcuaccugggccaagaacauccaaacggcuaucaaccaggugcgcagccugaucgggaacgaggaauauacagacuacaugcccuccaugaagcgguuucgacgggaggaagaggaggcugggguccucugguga

SEQ ID NO: 25300 - RNA, 9876 nt, Artificial Sequence
  derived and/or modified CDS sequence (opt11) from DENV-2__FJ898450__SS-prME
accgccggcgugaucaucaugcugauccccaccgccauggcguuccacuugacaaccagaaacggggagccccacaugaucgucggccggcaagagaaggggaaaucccuacuguucaaaaccgaggacggcgugaacaugugcacucucauggccaucgaccucggggagcugugcgaggacaccaucacguacaaguguccucuuuugcgccagaacgagcccgaggacaucgauugcuggugcaacagcaccucuaccugggucaccuaugggacuugcaccaccacgggagagcacagaagagagaagcgauccgucgcccuggugccccaugugggaaugggccucgagacccggaccgagaccuggaugagcuccgagggggccuggaaacauguccaacggaucgagacuuggauccugaggcacccuggcuucaccaucauggcagcgaucuuggccuacaccauagggaccacucacuuucaacgggcccucaucuuuauccugcugacagcuguggcgcccagcaugacuaugcgcugcaucggcaucucaaaccgggacuucguggagggcgucagcgggggcuccuggguggacaucgugcucgagcacggguccugcgugaccacuauggccaaaaacaagccgacauuggacuucgagcugaucaagaccgaagccaaacaacccgccacccuccgcaaguacugcauagaggccaagcugacgaacaccaccaccgagucccguugccccacgcagggcgagccuagcuuaaacgaggagcaggacaaacgcuucaucugcaagcacuccaugguggaccgcggcugggggaacggcugcggccucuucggaaaaggcgggaucgugacgugcgcgauguuuacaugcaagaagaacauggagggcaaggucguguuacccgagaaccuggaguacaccauugucaucacgccccacagcggggaggagcacgccgucggcaacgacaccgguaagcacggcaaggagaucaagaucaccccucaguccucuaucaccgaggccgagcucacgggguacggcacggugacuauggagugcaguccgcggaccggccuggacuucaacgagauggugcuguuacagauggaggacaaggccuggcugguccaccggcagugguuucuggaccucccccugcccuggcugccgggcgccgacacccagggcagcaacuggauccagaaggagacguuagugaccuucaaaaacccccacgcgaaaaagcaggauguggucgugcugggcucccaggaaggcgccaugcacaccgcgcugaccggcgccacggagauccagaugucaagcgguaacuugcuguucaccggucaccugaagugccgccuccggauggacaagcugcagcugaaggggaugucuuacucuaugugcacgggcaaguucaagaucgucaaggagaucgccgagacccaacacgggacgaucgucauccgaguccaguacgagggcgacggcucccccugcaagauccccuuugagaucauggaccuugagaaacggcacguccuggggcgccuuaucacggugaacccgaucgugaccgagaaggacucaccggucaacauagaggcggagccgcccuucggugauucuuacaucaucaucgggguggagccgggacagcucaagcugaacugguucaagaaggggagcuccaucggucagauguucgagacaacgaugcgcggcgccaagcggauggccauccugggggauaccgccugggacuucggaucucucggaggcguuuuuaccaguaucgguaaggcccugcaccagguuuuuggcgcgaucuacggcgccgccuucagcggggugucauggaccaugaagauccugaucggcguaaucaucacguggauaggcaugaacucacgcucgaccagccuguccgugagccucgugcugguaggcgucgugacccuguaccucggcgccauggugcaggcggacuccggcuguguagugucuuggaagaacaaggaacuaaagugcggcuccgggauauucaucaccgacaacguucacacguggacugagcaguacaaguuccagccugagagccccagcaagcuggccuccgcuauccagaaagcccacgaggagggaaucugcgguauacggagcgucacccgccucgagaaccugauguggaagcagauaacacccgaacugaaccauauacucagugagaacgagguuaagcugacgauuaugacgggagacaucaaagggaucaugcaggccggcaagcggagccugcgcccgcagcccaccgaacucaaguacuccuggaagacauggggcaaggcgaagaugcugagcacggagucccacaaucagaccuuuuugaucgauggccccgagaccgccgaaugcccgaacaccaaccgggccuggaauucccuugagguggaggacuacggcuucggggucuucacgacaaauaucuggcugaagcugcgagagaagcaggacgccuucugcgacagcaagcuaaugagcgccgcgaucaaagacaacagggccgugcaugccgauaugggcuacuggaucgaguccgccuugaaugauaccuggaaaauggagaaggccagcuucaucgagguaaaaucuugccacuggcccaagagccauacccuguggucaaacggcguccucgagagcgagaugaucauccccaagaacuucgcgggccccgucucccaacacaauuaccgcccgggcuaccacacacagacggccgggccauggcaucuggguaagcuggagauggacuuugauuucugcgaggggaccaccguugucgugaccgaggacugcggcaacagggguccaagccuccgcacgacuaccgccagcgggaagcucaucaccgaguggugcugucgguccugcacgcugccaccgcuccgcuaccggggagaagacgggugcugguacggcauggagauccgcccccucaaggagaaggaggaaaaccuggugaacagccuggucacugccggacacggccagauugauaacuuuagccugggagugcuuggcauggcccucuuccuggaggagaugcuacggacccgcgugggcaccaagcacgccaucuugcuugucgccgucagcuucgugacacugaucaccgggaauauguccuuccgcgaucucggccgcgucauggugauggugggggcaaccaugacugacgacaucggcaugggcgucacguauuuggcccuacucgcggccuucaaggugcggcccacauucgccgcagggcugcugcuccggaagcugaccagcaaggagcugaugauggccaccaucggcaucgcucuccugucccagagcacgauccccgagaccauccucgagcucacggacgcccuggcgcuggggaugaugguguuaaaaauaguccgcaacauggagaaguaccagcucgccgugaccaucauggccaucaguugcgugccgaacgcggucauccugcagaacgccuggaaggugagcuguacgauccucgcugccguguccguuagcccccugcugcugacauccagccagcagaaggcugauuggauaccacuggcccugaccaucaagggcuugaaccccaccgccauuuuccugacgacucugucccggaccagcaagaagcgcuccuggccgcucaacgaggccgugauggcagucggcaugguaagcauccuugcguccagcuugcucaagaacgacauacccaugaccgggccccuugucgccggcggauugcuaacagucugcuacgugcugaccggccggagcgccgaucucgaacucgagcgcgccgccgaugugaagugggaggaccaggcggaaaucuccgggucuucccccauccuaagcauaaccaucuccgaggacggcuccauguccaucaaaaacgaggaggaggagcagacgcugacgauccucauacggaccggccugcugguaaucagcgggguguucccgguguccauccccaucaccgccgccgcgugguaccucugggagguuaagaaacagcgcgccggcgugcugugggacgugcccagcccgccgcccgucgggaaggcggagcuggaggauggcgccuaccggaucaagcagcgcgggauccucggcuacucccaaauaggcgccgggguguacaaagagggcaccuuccacaccauguggcacgugacgcgcggggcgguccugaugcaccggggcaagcggaucgagccuagcugggccgacgugaaaaaagacuuaaucuccuacgggggaggcuggaagcucgagggggaguggaaggagggcgaggaaguacagguccuggcucuggagcccggcaagaauccccgcgccgugcagaccaagcccggucuauucaagaccaacaccgggacgaucggcgcggugagccuggacuucucucccggcaccucuggguccccgaucgucgacaggaaaggaaagguggugggguuguacggcaacggcguggugacccgcagcggggccuacgugucggcuaucgcccagaccgaaaaguccaucgaggacaaccccgaaaucgaggacgacauauuccggaagaagcgccucacgauaauggaccugcacccgggcgccgggaaaaccaagcgguaccugcccgccaucguccgcgaggccauaaagcggggccugcgcacacucaucuuagcgccuaccagagugguggcugcagagauggaggaggcccugcgggggcuccccauccguuaccagacacccgcgauccgggccgagcauacaggcagagagaucguagaccugaugugucacgcaaccuucaccaugcggcugcucucgcccgugcgcgugccaaauuacaaccuaauuaucauggacgaggcccacuuuacggacccggcuaguaucgccgcgcgaggcuacauuagcacccgcguugagaugggugaggccgccgguaucuucaugaccgccacgccgcccggaucccgggacccguucccucaaucuaacgcgcccauaauggaugaggagcgcgagauccccgagcgguccuggaacucgggacacgagugggugaccgacuucaaggggaagaccgugugguucguccccaguauaaaggccggcaaugacaucgccgccugccugcgcaagaacggcaagaaggugauccagcucagcagaaaaaccuucgacuccgaguacgucaagacccgcgcgaacgacugggacuucgucguuacaaccgacaucagcgagaugggggcgaacuuccgggccgagcgcgugaucgauccccggcggugcaugaaacccgucaucuugaccgacggcgaggagcgggucauccuggcagggcccaugccggugacacacuccagcgccgcccagcgccgcggccggaucggcaggaacccgaagaaugagaacgaccaauacaucuacaugggggaaccccucgagaaugacgaggacugcgcucacuggaaggaggccaaaaugcuucuggacaacaucaauacgccagagggcaucaucccguccauguucgagcccgagcgggagaaggucgacgccaucgacggggaauaccgccuccggggcgaggcccgcaagaccuucguggaucugaugcggagaggggaccugcccguguggcucgccuaucggguagcggcagaggguaucaacuaugccgaccgccgauggugcuucgacggcaucaagaauaaucagauucuggaggagaacguggagguggagauauggacaaaagagggcgagcggaagaaacugaaaccgcgguggcucgacgcucgcaucuacucagacccccuagcgcuuaaggaguucaaggaguucgccgcgggucggaagucccucacccugaaccugaucacggagaugggacgccuccccaccuucaugacccagaaggccagagaugcccuggacaaucuugcgguucuccacaccgccgaggcaggcggacgcgccuacaaccacgcccugagcgaacugcccgagacgcucgagacccugcugcugcuuacccugcucgcuaccgugacgggcggcaucuuucuguuucugauguccgggaaaggcauugggaagaugacccucgggaugugcugcaucauuacagccucaauccuccugugguacgcccaaauccagccgcacuggaucgccgccuccaucauccuagaguucuucuuaaucguccuguugauccccgagcccgaaaagcagcggacgccccaggacaaccagcugaccuacgugguuaucgcuauccugacgguaguggccgccaccauggccaacgagaugggguucuuagagaagaccaagaaggaccuaggccugggcaguaucaccacgcaggagagcgagucgaacauucucgacaucgaucugaggccggccagcgcguggacccuguacgccguggcgaccaccuucgucaccccaaugcuccgacauuccaucgagaauagcagcgucaacgugagccugacggccaucgcgaaccaggccacuguccugauggggcucgguaagggauggccccuauccaagauggacauuggcgugccccugcucgcuaucgggugcuacagccaagugaaucccauaacccugacagcagcccugcuccugcuggucgcucauuacgccaucaucggccccggccuccaggccaaagccacccgagaggcccagaagcgcgcggccgccggaaucaugaaaaaccccaccguggacggcaucaccgugaucgaccucgagcccauaccguacgacccgaaguucgagaagcagcuggggcaggucaugcuccugaucuuguguguuacccaagugcucaugaugcgaaccaccugggcuuuaugcgaagcccugacccucgcgacgggccccauuuccacccugugggaggggaacccaggcagguucuggaacaccaccaucgccgucucuauggccaacaucuuccggggcucauaccuggccggggcgggccuccuguuuagcaucaugaagaacacgaccaacacucgccgggggaccggaaacauaggcgagacgcucggugaaaaguggaagucccgccucaacgcucugggcaagagcgaguuccagaucuauaagaaguccgggauccaggagguggaccggacccucgccaaggaagggaucaagcgcggggagaccgaccaccaugccgugagccggggcuccgccaaguuacguugguucgucgagcggaauauggugacccccgagggcaagguggucgacuuagggugcggccgcgggggcugguccuacuacugcgggggccugaaaaaugugcgcgaagucaagggccucaccaagggcgggcccgggcacgaggagccgauccccauguccaccuacggcuggaaccuaguucgccuacagagcggaguggacguguucuucacucccccugagaagugcgacacccuccuuugcgacaucggcgagagcagccccaaucccacuauugaagcgggcaggacccugcgcguccucaaccuaguagaaaacuggcuaaacaacaacacccaguucuguauaaaggugcucaacccguacaugcccagcgucaucgagaaaauggagacccugcagagaaaauacgggggcgcgcucgugcgcaacccccugucccggaacagcacccacgagauguacuggguguccaacgccacuggcaacaucguaagcuccgugaacaugauuagccgcaugcucaucaaccgauucaccaugaagcauaagaaggcaaccuacgagccggacguggaccuugguuccggcacucggaacaucggcaucgagagcgagauccccaaccuggacaucaucggcaagcgcauagagaagaucaagcaggagcaugagacguccuggcacuacgaccaggaccaucccuaccggaccugggccuaccacggaagcuaugagaccaagcagaccggcucugcgagcucgauggucaacgggguggugcgccuccugacgaagcccugggacgucgugccgauggugacccagauggccaugaccgacaccacgccuuucggccagcaacggguauucaaggagaagguggauacucgaacccaggagcccaaggaaggcaccaagaaacugaugcggaucacugccgaguggcucuggaaggagcuggggaaaaagaaaacgccucgcaugugcacccgggaggaguucacccgcaaggugcggagcaacgccgcucugggagcaaucuucacggaugagaacaaguggaaguccgcccgcgaggccgucgaggacagccgcuucugggagcucguagaccgcgagagaaacuuacaccuggaggggaagugcgaaacaugcguguacaauaugaugggcaagcgcgagaagaaacugggggaguucggcaaggccaaaggcucccgggcgaucugguacauguggcugggggcccgcuuccuggaguucgaagcauugggcuucuuaaacgaggaccacugguucagccgggggaacagccuguccggggucgagggggagggccuccaccgccugggcuacauccugcgggacgugagcaagaaggaggguggggcgauguacgccgacgacacagccgggugggacaccaggaucacgcucgaggaucuaaagaaugaggaaauggucaccaaccacaugaagggcgaacacaagaaacuggccgaggccaucuucaagcucaccuaucaaaacaaaguagugcgcguccagaggccgacgccccgugggacggugauggauaucaucucucggcgcgaccagcgcggcuccggccagguugggaccuacgggcugaacacuuucaccaacauggaggcucagcugauccgccagauggagggggagggcaucuucaaguccauccaacaccuaacggucacugaggaaauagccgugcagaacuggcuggcgcgagugggucgcgagcggcugagccgcauggcaaucuccggugacgacugcgucgugaagccucucgacgaucgguuugcaagcgcccugacagcccugaacgacaugggaaaggugcgcaaggauauccagcagugggagcccucccggggguggaacgacuggacucaggucccguucugcagccaccacuuucacgagcucgugaugaaagacggucgcgugcuggucgugcccugccggaaccaagacgaacuuaucgggagagcgcggaucucccaaggcgccggcuggagccucaaggagacggccugcuuagggaaguccuacgcgcagauguggacccugauguacuuccaccgccgggaccuccgccuggcugcgaaugccauuugcagcgccgucccaucccacuggguccccaccagcagaaccaccuggucaauccacgccaagcaugaguggaugacgacggaggacaugcuggcaguguggaaucggguguggauucaggagaacccguggauggaagacaagacccccgucgaaagcugggaggaggugcccuaccucggcaagcgcgaagaccaguggugcgggucccugaucggcuuaaccucccgcgcaacgugggcgaagaacauccaaaccgcaauuaaccaagugagaucucucaucgggaacgaggaguacaccgacuacaugccauccaugaagcgguucaggcgugaggaggaggaggccggcgugcugugguga

SEQ ID NO: 25301 - RNA, 9876 nt, Artificial Sequence
  derived and/or modified CDS sequence (opt11) from DENV-2__FJ898453__SS-prME
accgccggcgugauagucaugcugauucccacggcaauggcguuccaccuuacaacccgcaacggggaaccucauaugauaguugggcggcaggagaagggcaagagcuuacuguuuaagacggaggacggcgugaacaugugcacccuuauggccaucgaccugggggagcugugugaagacaccauaaccuacaagugcccucuccuccgccagaacgagcccgaagacaucgauugcugguguaauagcacuagcacaugggugacguacgguaccugcaccaccacgggcgagcaccggcgagagaaacgguccguggcccucgugccucacgucggcaugggcuuagaaacacguaccgagaccuggaugagcagcgagggggccuggaagcaugugcagaggauugaaaccuggauccugcgucacccgggguuuaccaucauggcagcgaucuuagccuauaccaucgggacuacacauuuccagcgggcacucauauucauucuccugaccgccguggcgccgagcaugaccaugcgcugcauaggcaucuccaaccgugacuucgucgagggcgucagcggagggagcuggguggacauaguccucgagcacggaagcugcgugacgacgauggccaaaaacaagcccacacuggacuucgagcugaucaagaccgaggccaagcagccagccacccuccgcaaguacugcaucgaagccaaguugacaaacaccaccaccgagucucgcuguccgacccagggggagccuagccugaacgaggaacaggacaagcgcuuuauaugcaaacacuccaugguggaccgggggugggggaauggcugcgggcuauucgguaaggguggaaucgugacgugcgcuauguuuaccugcaagaagaacauggagggcaagaucgugcagcccgaaaaccucgaguacaccauagugaucacaccccacucuggugaggagcacgcagucgguaaugauaccgggaagcauggcaaggagaucaagauuacaccgcaguccucuaccaccgaggccgagcuaacggguuauggcaccgugacaauggaauguucgccccgcaccggccuugauuucaaugaaauggugcugcugcaaauggaggacaaagccuggcucguccaccggcagugguuucuggaccucccuuuacccuggcugccgggggcggacacgcagggaagcaauuggauccagaaggagacccuggugaccuucaaaaauccucacgcgaagaaacaggacguagucgugcucgggucccaggagggcgccaugcacacggcucugacaggggccacugagauucagauguccagcggcaaccuuuuauucaccggacaccuaaagugccgccuucggauggacaagcuccagcugaagggaaugucuuacucgaugugcaccggcaaauuuaagauuguuaaggaaaucgcggagacgcaacacgggacaauagugauccgcgugcaauacgagggugacgguucccccugcaagaucccuuucgaaaucaccgaccuagagaaacggcacguacuagggcgccugaucaccgugaacccaaucgugacggagaaggacagccccgucaacauugaggcggaaccuccguucggggacucguauauaaucguagggguugagccgggccaacucaaacuuaacugguucaagaaagggagcagcaucggccaaauguucgagaccaccaugcgcggugccaagagaauggccaucuuaggagacaccgcgugggacuuuggcucucucggcggcgucuuuaccuccaucggaaaggcccuccaccagguauucggggcgauauauggcgcggccuucagcgggguguccuggacaaugaaaauccugaucggggucaucaucaccuggaucgggaugaacagccgcuccaccagcuuguccgugagccuggugcucgucggagugguuacgcuguauuuaggggccaugguacaggcggacuccggcugcaucgugagcuggaaaaauaaggaacucaaguguggcuccgguauauucauaaccgauaacguacacaccuggaccgagcaguacaaguuccaacccgagucccccagcaagcuggccuccgccauccaaaaggcccacgaggagggcaucugcgggauccggucgguaacucgcuuagagaaccucauguggaaacagauuacccccgaacugaaccacauccuguccgagaacgaggucaagcucacuaucaugaccggcgacaucaaggggaucaugcaagccggcaagagaucucugcgcccgcagcccaccgagcucaaguauuccuggaagaccuggggaaaggcgaagaugcucagcaccgagucccacaaucagaccuuucugauugacgggcccgaaacugccgaauguccgaauaccaaccgggccuggaacagcuuagagguggaggacuacggcuucggggucuucuccaccaacaucuggcucaagcugcgcgagcggcaggacguguucugugacuccaaacugauguccgcagccauaaaggacaaccgcgcggugcacgccgauaugggauacuggaucgaaagcgcccuaaacgacacguggaagauggaaaaggccuccuucaucgaagugaaaagcugccauuggcccaaaucccacacccugugguccaacggcguucuugaguccgagaugaucauccccaaaaacuucgccggccccgugucccagcauaacuaucggccgggcuaccauacgcagaccgcggggcccuggcaccucggaaagcuggagauggacuuugacuucugcgagggcacuaccguagucguuacggaggacugcggcaaccggggcccgucguuacggaccaccaccgccuccgggaagcucaucacggaaugguguugccgcucaugcacccuacccccgcugagguaccgcggcgaagacgggugcugguacggcauggagaucagaccccucaaggagaaggaagaaaacuuagucaacucucuggucacugcggggcacggccagaucgacaacuucagccucggugugcuggggauggcccucuuccucgaagaaaugcugcgcacccgggucgguacgaaacacgcaauucuucucguggcgcugagcuucgucacguugaucaccgggaacaugagcuuccgcgaccucggccggguuauggugaugguaggugccacuaugacggacgacaucggaauggggguuacguaucuggcguuguuagccgccuucaaggugcggccaaccuucgccgcuggccuucuccuccgcaagcucaccuccaaggaacucaugauggcaacuauaggcaucgcccuccugucgcaaucuacccugcccgaaaccauccucgaacugaccgaugcacuggcccucgggaugaugguucugaaaauuguacggaauauggaaaaguaucagcucgcuguaacgaucauggccaucagcugcguaccuaaugccgucauccuccagaacgcuuggaaggugucguguaccauucuggccgccgugagcguuagccccuuacuccuuaccaguucccaacagaaggccgacuggaucccccuggcgcuaaccaucaagggcuugaaucccacggccauauucuuaaccacgcucaguaggaccucuaagaagcguaguuggccgcugaacgaggccauaauggccguaggcauggucuccauccuugccuccagcuugcucaagaacgacauccccaugacggggccgcuggucgcgggagggcuacuaacgguauguuauguccugaccggccgcagugcugaccuagagcuggagcgcgcggccgacguaaagugggaagaccaggccgagauuagcggguccucucccauucuguccaucacgaucagcgaggacgguuccauguccaucaagaacgaggaagaggagcaaacgcucacgauccugauccgaaccggccugcuuguuaucuccgggguguuuccagugucuauucccaucaccgcugccgccugguauuugugggagguuaaaaagcagagagccggcguucuaugggaugugccgagcccuccacccguggggaaggcugagcuagaagacggggucuaccgcauaaagcagcgggggauccuuggguacagccaaauuggcgccgggguguacaaggagggcacuuuccacaccauguggcaugucaccagaggggccguccugaugcaccgagguaagcgcaucgagcccaguugggccgacgugaagaaggaccuaaucucauacggaggcggcuggaaguuggagggagaguggaaagagggggaggagguucagguacucgcacuugaacccgggaaaaacccccgggccguccagaccaagcccggcauuuucaagacuaacacggggaccaucggagcggugucccuggacuucagccccgggaccucggggagcccaaucgucgaccguaagggcaagguggugggcuuguacggcaauggcgugguaacccgaucuggggccuacgugagcgcgaucgcccagacggaaaagagcaucgaggacaaccccgaaaucgaggacgacauauuucgaaagaaacggcugaccaucauggaccuccacccuggcgcggggaagaccaagagguaccugcccgccaucguccgagaagccaucaagcgcggcuuacgcacccugauucuggccccgacgcgugugguagcggccgagauggaagaggcucugcgggggcuccccaucagauaccagacacccgccauccgcgccgagcacaccggacgggagaucgucgaucuaaugugccacgccaccuuuacgaugcgccuucucuccccagugagggugccgaacuacaaccuuaucauaauggacgaggcgcacuucacggaccccgccagcaucgcugcucgcgguuacaucuccacccggguugagaugggggaggccgcagggaucuuuaugaccgccacgccucccgguagucgagacccauucccccaaucgaaugccccuauuauggacgaggagcgggagauccccgaaagaagcuggaacuccggccacgaaugggugacggauuucaaggguaaaacugugugguucgucccgucaaucaaagccgggaacgacauagcggccugccuucggaagaauggcaagaaggugauccagcucucccgcaagacauucgauagcgaauacgugaaaacgcgggcaaaugacugggacuucguggugaccaccgauauauccgaaaugggcgcaaacuuuaaggccgagcgcgugaucgauccgcggcgcugcaugaagcccgugauccuuaccgacggcgaggagcgggugauccuggcggggccgaugccggugacccacagcuccgcagcccagcgccgcggccggaucgggcgcaauccgaagaaugagaacgaucaguacauauacaugggcgagccccucgaaaaugacgaggacugugcccacuggaaggaggcgaagauguugcuggacaauaucaacacucccgagggaaucaucccgucaauguucgagcccgagcgggagaaaguugaugccauagacggggaguaucgccucagaggcgaggcccguaagacauuuguggaccugaugcggcguggugacuugcccguguggcuggccuacaagguugccgccgagggcaucaacuacgccgacagaaaguggugcuuugacgggaucaagaacaaccagauccucgaggagaacguggagguggagauauggacaaaggagggcgagcgaaagaagcugaagccgcggugguuggaugcgcgaaucuacuccgacccacuggcccugaaggaguucaaagaguucgccgcgggccggaagucacugacccugaacuuaaucaccgagauggggcgucuccccaccuucaugacucagaaggcuagaaacgcccuggauaaccuggccguccuucacacggcggagguaggagggcgcgcuuacaaccacgcccuuuccgaguugccagagacccucgagacccuguuacuccucacacugcucgcgaccguuaccggaggaaucuuucuguuccuaaugagcgggaagggcaucgggaagaugaccuuaggcaugugcugcauaaucacggccucuauacuuuuaugguacgcucagauacagccccacuggauagcggccagcauaaucuuggaguucuuccugaucgugcugcucauuccggagcccgagaaacagcgaacgccccaggauaaccagcuaacuuacguggucaucgccauccucaccgugguagccgccacuauggccaacgaaaugggauuucucgagaaaaccaagaaagaccugggcuucggcagcauuaccacccaggaaagugagucgaacauccuggacaucgacuugagaccggccucagccuggacauuguacgccgucgccaccaccuuugugacccccaugcugcggcacucaauagaaaacuccagcgugaacgucagccucaccgcgauugcuaaccaggcgacugugcugauggggcuggggaagggguggccacucagcaagauggacaucggagugcccuugcuggccaucggguguuauucccaggucaauccaaucacacucaccgcggcgcugcugcuccugguggcccacuacgccaucaucggucccggccuccaagccaaggcgaccagagaggcccagaagcgggccgccgccgggaucaugaagaacccgaccguggacggcauuacggucaucgaccucgagcccauuccguacgaucccaaauucgagaagcagcuagggcaggucaugcugcucauccugugcgucacacaaguccucaugaugagaacaacaugggcucucugcgaggcccugacacuugcuacuggacccauuagcaccuuaugggaagguaaccccggacgcuucuggaauacaacgaucgccguuuccauggcaaacauauuccggggcagcuaccuggccggugccggcuugcuguucagcauaaugaaaaacaccacaaacaccaggcggggcacaggcaauguuggcgagacccugggagagaaauggaagucccgccugaacgcacucggcaaaucggaguuccagaucuacaaaaaguccgggauacaggaggucgaccggacccuggccaaggagggcaucaaacgcggagagacagaucaucacgcggugucccggggcagcgccaaguuacgcugguuuguggagcgaaauauggucgccccggagggaaaggugguggaccugggaugugggcgcggugggugguccuauuauugcgguggccucaaaaacguccgggaagugaagggccugaccaagggaggcccagggcacgaggagcccauccccaugagcacauacggguggaaccuugugcgccugcagucaggggucgauguguucuucaccccgcccgagaagugcgauacgcuccugugugacaucggagagagcagccccaaccccacgaucgaggccggccguacgcugcgcgugcugaaccucgucgagaacuggcugaacaacaauacacaguucuguaucaaagugcugaacccguacaugcccuccguaaucgagaagauggagacccuccagcggaaguauggaggggccuuagugcgcaauccccugagccggaacuccacccacgagauguauugggugagcaaugcuacgggaaacauaguauccagcgucaacaugaucucccguaugcugaucaaccgguucaccaugaagcauaaaaaggccacuuacgagccggauguugacuuaggcagcgggacccgcaacaucggcaucgagucagaaauccccaaccuggacaucauuggcaagcgcaucgagaaaaucaaacaggagcacgagacgagcuggcauuaugaccaggaccaccccuacaagaccugggccuaccacggauccuaugagaccaaacagaccggcagcgcuuccucuauggugaauggggucgugcgucuccucacgaagcccugggacguggucccaauggugacacaaauggcaaugaccgacaccacgccauucggccagcaacgcguguucaaggagaaggucgacacucggacgcaggagcccaaagagggcacaaagaagcugaugaagaucacggcggaguggcuguggaaagagcucgggaaggagaagacgccgaggaugugcacccgggaggaguucaccaggaagguccgguccaaugcagcccucggggccaucuucacggacgagaauaaguggaagucugcccgcgaggcaguggaggacgggcgguuuugggagcugguggaccgcgagcggaaucugcaccuggaaggcaagugugaaaccugugucuauaacaugauggggaagcgcgagaagaaguuaggcgaguuuggaaaagccaaggggucgcgggcuauuugguauauguggcucggcgcucgcuuucuggaguucgaggcguuaggguucuuaaacgaggaccacugguucagccgggguaauucacugagugggguagagggcgaaggacuucaccgcuuaggcuauaucuugagagaggugggcaagaaggagggcggcgcuauguacgccgacgacacagccggaugggauacgcgcaucacgcuggaggaccucaagaaugaagagauggugacaaaccacaugaagggagagcacaaaaagcuggcggaggcgaucuucaaguuaacauaccagaacaaggucguucgugugcagcgacccacgccgcggggcacugucauggacauaaucucucgcaaggaccagcgcgguagcggacagguggggaccuacggccucaauaccuucaccaacauggaggcccagcugauccgacaaauggagggcgaggggauauucaagucaauccagcaccugacggugacagaggagaucgccguccagaacugguuagcccguguaggucgggaacgccugucgcgcauggcgauuucgggggacgacugcgucgucaagcccaucgacgaccgguucgcgagcgcucugaccgcucugaaugauaugggcaagguccgcaaggauauccaacagugggagcccagccgcggguggaacgauuggacccaggugccauucugcucccaucacuuccacgagcuggucaugaaggacggacgggugcuuguaguccccuguaggaaccaggaugagcucaucggucgagcccguaucagccagggggcuggcuggucccugaaagagaccgcgugccugggcaagaguuacgcccagauguggacccucauguauuuccaccggcgagaccugcgucuggccgccaacgccauuugcuccgcgguccccucccacuggguccccaccucucgcaccaccuggagcauacacgcuaagcacgaguggaugacuacugaggacaugcuggccgucuggaaccggguguggauccaagagaacccguggauggaggacaagaccccgguggagucaugggaggagguucccuaccugggcaagcgcgaggaucaguggugcggcagcuugauaggccuaacaagccgggccacaugggccaagaacauccagacugccauaaaccaagugcgcagccucaucggcaacgaggaguacaccgauuacaugcccagcaugaagcgcuuccggcgcgaggaggaggaggccggggugcugugguga

SEQ ID NO: 25302 - RNA, 9876 nt, Artificial Sequence
  derived and/or modified CDS sequence (opt11) from DENV-2__EU482445__SS-prME
agugccgggaugauaaucaugcugauaccuaccgugauggccuuccaccucaccacccggaacggugagccgcacaugaucguggggauccaggagaaggggaagucccuucuguucaagaccgaggacggcguuaacauguguacccucauggcgauggaccugggggagcuaugcgaggauaccaucaccuacaagugcccccugcuucgccagaacgagcccgaggacaucgacugcuggugcaacaguaccuccaccugggugaccuacgggacaugcaccaccaccggggaacaccgccgggagaagagaagcgucgcccuggugccccacguagggaugggacucgagacucggaccgagaccuggauguccagcgaaggugccuggaagcacgcccaacgcauagagaccuggauccugcgccaucccggcuucacgaucauggccgcaauccuugccuacacaaucgguacgacacacuuccagcgcguccugaucuucauccugcugacggccguggcccccucuaugaccaugcggugcaucggcauaucgaaccgggacuuuguggagggcgucuccggaggcagcuggguggacaucgugcucgagcacgggagcugcgucaccaccauggcgaagaacaagcccacgcuggacuucgaacugauuaagaccgaagcaaagcagcccgccacccuccggaaguauuguaucgaggccaaacugaccaacacgacaaccgagagccgaugcccuacccagggcgagcccucccugaaggaagagcaggacaaacgauucgugugcaagcacagcaugguggaccgcggcugggggaacggcuguggccuguucggcaagggcgggaucgucacuugcgccauguucacuugcaagaagaacauggagggcaagauugugcagcccgaaaaccuggaguacaccaucguggucacgccgcacucaggggaagagcacgcgguugggaacgauacgggcaagcacggcaaggaaaucaagguaacuccgcagagcuccauuaccgaggcggagcugaccggauacggcaccgucacaauggagugcucuccccggaccggccucgauuucaacgagauggugcuguugcaaauggagaacaaggcauggcuagugcaccgccaaugguuucucgaccugccccucccuuggcucccuggugcggacaaacaggaguccaacuggauccagaaggagacucucgucacuuucaagaacccccaugcaaagaagcaggacguggucgugcugggcucgcaggagggggcgaugcacacggcccugaccggcgccaccgagauccagaugaguuccgguaaucuccuguuuaccggacaccugaaaugucggcugcgcauggauaaacuccagcugaaagguaugucguacuccauguguacugggaaguucaagguggucaaggagaucgcagaaacccagcacggcaccaucguaauccggguccaguacgagggggacggcagccccugcaagauccccuucgagaucauggaccuggagaagcgcuauguccucggccggcucaucaccgucaauccgaucgugacggagaaggacuccccugucaauaucgaggccgagccgcccuucggggauagcuacaucauuaucggcguggagccggggcaacugaaacucaacugguuuaagaagggcuccagcaucggacagauguucgagaccacuaugaggggcgcgaagcgcauggccauacugggcgacaccgccugggauuucggaucccugggcgggguguucaccagcaucggcaaagccuugcaccaggucuucggggccaucuacggcgcagccuucuccggggugagcuggacccugaaaauccugaucgggguuauaaucaccuggauaggcaugaauucccggagcaccucccugagcgucucccucgugcuggugggcaucgucacgcuguacuuaggcgugauggugcaagcggauagcgggugcguagugucguggaagaacaaggagcugaagugcggcucaggcauauucaucaccgacaacguucauaccuggaccgagcaguauaaguuccagccggagagccccuccaagcuggccagcgcgauacagaaggcucaggaggaggggaucugcggcauaagaucugucacgcggcuagagaaccugauguggaaacagauaacccccgagcugaaccacauccuggcagaaaacgaggugaagcugaccaucaugaccggggacaucaaaggcaucaugcaggccgggaaacgcagccugcggccgcagcccacggaacucaaguacuccuggaaaacguggggcaaagccaaaaugcugagcaccgaguccuacaaccaaacauuccugauugacggccccgagacgaccgagugcccgaacaccaaccgcgcuuggaacucacuggagguggaggacuacgguuucggcgucuucacgacaaacaucuggcugaaacugaaagagaagcaagacgccuucugugacuccaagcucaugagcgccgccaucaaagacaaccgagccgugcaugcggacaugggguacuggaucgaguccgcgcugaacgacacuuggaagaucgagaaggcuuccuucaucgaggugaaaaacugccacuggccaaagucccacacucuuuggagcaacggcgucuuagagucggagaugaucaucccgaaaaaucuggccggccccgucucucagcacaacuaccgcccgggcuaccacacccagaucgcgggccccuggcaucugggaaagcucgagauggacuucgauuuuugcgacggcaccacggugaucgucaccgaggacugcgggaauaggggucccucccugcgcaccaccacggcgagcggcaagcugauuacggagugguguugccggagcugcacacucccgccccugagguaccgcggugaggacggaugcugguacggcauggagauccgcccccuaaaggagaaagaggagaaccucgugaacucccuggucaccgccggccauggccaggucgacaacuucagccugggcgugcuaggcauggcucuguuucuggaggagaugcuccggacgcguguggggacgaagcacgccauccugcugguugcgguguccuucguuacccugaucaccggaaacaugaguuucaaagacuugggccgggucguggugaugguuggcgcgacgauggccgacgacaucgggaugggcgugaccuaccuggcccucuuggccgcguucaaggugcgccccacuuucgccgccggccugcuccuccguaagcucacuagcaaggagcucaugaugacaaccaucgggaucguccugcugagccagagcaccauccccgagaccgugcucgaguugacagacgcccuggcccucggcaugauggugcugaagaucguccgcaacauggagaaguaccagcuggcggugacgaucauggccauccucugcgugcccaacgccgugauccugcagaacgcuuggaaagugagcugcaccaucuuagccgucguguccguuagcccccuccugcugaccuccagccagcagaagacggacuggaucccacucgcgcugaccaucaagggguugaaucccaccgccaucuuccucaccaccuuaucacgcaccaacaagaagcggagcuggccgcuuaaugaggcaaucauggccgucggcaugguuucuaucuuggccagcucccuccugaaaaaugacauccccaugaccggcccccucguggccgggggccuucugacaguuugcuacguccucacugggcgcagcgccgaccuggagcuagagagagccacugaugugaagugggaggaccaggcagagaucuccggcagcagccccauccuguccaucaccauuagcgaggacgggagcaugagcaucaagaaugaggaggaagagcagacccuaacgauucuaauccgaaccggccuccuggucaucuccggccuguucccgauaucaaucccgaucaccgcagccgccugguacuugugggaggugaaaaagcaacgggccggggugcugugggacguccccagcccuccgcccaugggcaaggcagagcuagaggacggggcguaccgcauuaagcagaagggcauccugggcuacagccagaucggggccggcguguauaaggaggggaccuuccauaccauguggcacguaacgcggggggcuguccugaugcauaaggggaagcgcauugagcccuccugggccgacgugaagaaggaccugaucucuuacggggggggcuggaagcucgagggcgaguggaaggagggggaggaggugcaaguacuggcccuggagcccggcaagaauccucgggcggugcagaccaagcccggccucuuuaagaccaacaccggcacgaucggggccguaagucuggacuuuucaccgggcaccuccggcagccccauuauugauaagaaggggaagguugucggccuguacgggaacggcguggucacucgcuccggcgcguacgugagcgccaucgcccagaccgagaaguccaucgaggauaaccccgagaucgaggacgacauauuccggaaacgccggcugacgauuauggaccuccaccccggugcgggcaagaccaagagauaccugcccgccaucgugcgggaggccaucaaaagagggcugcggacccucauccuggccccgacccgcgucguggcggccgagauggaagaggcccuccggggccuccccauucgcuaccagacgccugccauccgugcagagcacaccgggcgcgagaucguggaccugaugugccacgcgaccuucacaaugagacugcucagccccguacggguuccgaauuacaaccugaucaucauggacgaggcccacuucacggauccggcgucgaucgccgcccgaggguacaucagcacccguguagagaugggcgaggccgcggggaucuucaugaccgcgacgccgcccggcagccgcgacccguucccccaguccaacgcccccaucaucgacgaggaaagagagauucccgagcgcagcuggaacacugggcacgagugggucacagauuucaagggcaagaccguuugguucgugccuuccaucaaggccggaaacgacaucgcggcuugccugcggaagaacggcaagaaggucauccagcucagccgcaagacguucgacuccgaauaugugaagacgcgcaccaacgacugggacuuuguggucaccaccgacaucagcgagaugggcgccaacuucaaggccgaacgcgugauagacccccggcggugcaugaagcccgugauacugaccgacggggaggagcgggugauccuggcgggccccaugccggugacccacuccagcgccgcccagcgccgggggcggauaggacggaaccccaaaaacgagaaugaccaguauaucuacaugggggagccccuggagaacgacgaggauugcgcccauuggaaagaggccaagaugcugcuggacaacaucaauacccccgagggaaucauuccgagcauguucgagcccgagcgcgagaagguggacgccaucgacggcgaguaccggcuucgcggggaagcucggaagacauucguugaccuuaugcggcgcggagaccuaccuguguggcucgccuacaaaguggccgccgaggggaucaacuacgcggauagacgcuggugcuucgacggcaucaagaacaaucagauccuggaggagaaugucgagguggagauuuggacgaaggagggggagaggaagaagcuaaaaccgcgcuggcucgacgcccggaucuacagcgacccgcuggcccugaaggaauucaaggaguuugcagccggccgcaaaucccucacccugaaccugaucaccgagaugggccggcuccccaccuuuaugacgcaaaagacccgcgacgcccuggacaaccuggccguacuccauaccgccgaggcuggggguagggcguacaaccacgcccugagcgagcugcccgaaacccucgaaacgcugcugcugcuaacccugcucgccaccgugaccgguggcaucuuccuauuccugauguccggccgagggaucgggaagaugacccucgggaugugcugcaucaucacggcuucuauccugcugugguacgcccagauccagccgcacuggaucgccgccuccaucauccucgaguucuuucuaaucgugcuacucauaccggagcccgagaagcagcggacgccccaagauaaccagcuuaccuacgucgugaucgccauucugaccguggucgccgccacaauggcgaacgagaugggcuuccucgagaagaccaagaaagaccuggggcugggcagcauagccacccagcaaccugaguccaacauccuggacauagaccugcgucccgccagcgccuggacacuguacgcaguggcgacgaccuucgugacgccuaugcuccgccacuccaucgagaacagcagcgugaacguguccuugacagccaucgccaaccaagccacgguacugaugggcuuagggaagggcuggcccuugagcaagauggacaucggggucccucugcucgccauuggcuguuauucccaagugaaccccaucacucugaccgcggcacuucuucugcucguggcacacuacgcaaucaucgggcccggccuccaggcgaaggccacucgggaggcccagaagcgggccgcggcgggcaucaugaaaaacccaacgguugacgggauaaccgugauugaccuagacccgauccccuacgaccccaaguucgagaagcagcugggacaggugaugcuguugauccugugcgucacccagguccucaugaugcgcaccacgugggcucugugugaggcccugacccuugccaccgggcccaucucgacccucugggaggguaacccggggagauucuggaauacgaccaucgccgucuccauggcgaacauuuucagaggcagcuaucuggccggcgcaggccucuuauucuccaucaugaagaacaccacaaacacgcggcgaggcacugggaacauaggugaaacccugggcgagaaguggaagucccgccugaacgcccugggaaagagcgaguuccagaucuacaagaaaucggguauccaggaagucgaccggacccuggcuaaggagggaaucaaacgcggcgagacagaucaucaugcggugucccgggggagcgccaagcuccgaugguucguggagcggaauauggucacccccgagggcaaagucguggaccuagggugcggccgcggcggaugguccuacuacugcggcggccugaagaacgucagagaagugaaagggcucaccaagggcgggcccggacacgaggagcccaucccgaugagcaccuacggauggaacuuaguccgucugcaauccggcgucgacguuuucuucaucccgcccgagaagugcgauacgcuccugugcgacaucggggagagcucccccaacccgaccguugaggccggccggacccugcgcguccucaaccugguggagaacuggcugaacaacaacacgcaguucugcaucaaggugcugaaccccuacaugccaagcgucaucgagaagauggaggcucuacagagaaaguacggcggggcgcuggugcgcaacccgcugaguagaaacagcacccacgagauguauuggguuagcaacgccuccggcaacauugucucauccguaaacaugaucagucgcaugcucaucaaccgguuuacgaugcgccacaagaaggccaccuacgaacccgacguggaccugggauccggcacccggaacaucgguauugagagcgagaucccgaaccuggacauaaucggaaaaaggaucgagaagaucaagcaggagcacgagaccuccuggcacuacgaccaggaccaccccuacaagacgugggccuaccacggcagcuacgagacgaaacagaccggguccgcaagcuccauggugaacggcguggugagacuucugacgaagccgugggauguccugccuacggugacccagauggcgaugaccgacaccacccccuucgggcaacagcggguguucaaggagaaggucgauacccgcacccaggaacccaaggagggcaccaaaaagcucaugaagaucacggccgaauggcuguggaaggaacuaggaaagaaaaagaccccgcggaugugcacccgcgaggaauucacccggaaagugcgcagcaaugccgcauuaggggccaucuucacggacgagaacaaguggaaauccgcgagagaggccguggaggacucgagguucugggagcuagucgauaaggagcggaaccuccaccucgaaggcaagugcgagaccugcguguacaacaugauggggaaacgcgagaagaaacugggcgaauucgggaaggccaaggggagccgggccaucugguacauguggcugggcgcccgcuuccucgaguucgaggcgcugggguucuugaacgaggaucauugguucagccgggagaacucccucagcggcgucgagggggagggcuugcacaagcugggguacauccuccgcgacguguccaagaaggaggguggcgcaauguacgcggaugacacagccgggugggauacccggaucacgcuggaggaccucaagaacgaggagaugguaaccaaccauauggagggagagcacaagaagcucgcggaagccaucuucaagcugaccuaccagaacaaggucgugcgggugcagcggcccacgccccgcgggaccgucauggacaucauuagcagacgcgaccagcggggcaguggccaggugggaaccuacggacugaacacuuucaccaacauggaggcccagcucauccggcagauggagggcgagggcguguucaaaaacauccagcaccugacgguaaccgaggaaguggccguccagaacuggcuggcccgggucgggcgcgagagacuuucucgaauggcgaucagcggcgacgacugugugguuaagccucuagacgacagguucgccaacgcucugaccgcccucaaugacaugggcaagauucggaaggauauccagcagugggagccguccaaaggguggaacgacuggacccaagucccuuucugcagccaccauuuccacgagcuaaucaugaaggacggccgcguacugguuguccccugccggaaccaggacgagcucaucggucgcgcacggaucucgcagggcgccggcuggagccugagagagaccgccugccuggguaagucauacgcccagauguggucauugauguacuuccauaggcgcgaccugcgguuagcugccaaugcgaucugcucggccgugcccagccacugggugccgaccucacgaaccacauggagcauccacgcgaagcaugaguggaugaccacugaggacaugcucaccgucuggaaccgcguuuggauacgagagaacccuuggauggaggacaagacccccguggaguccugggaagagauccccuaucuagggaaacgggaggaucagugguguggcucacucauaggucucaccucccgcgccacgugggccaagaacauucaggcggccauaaaccagguccgaagccugaucgggaacgaggaguacaccgauuauaugccguccaugaagagguuccggcgcgaggaggaggaggcuggcgugcugugguga

SEQ ID NO: 25303 - RNA, 9876 nt, Artificial Sequence
  derived and/or modified CDS sequence (opt11) from DENV-2__EU482446__SS-prME
agcgccgggaugauaauaaugcugauacccaccgucauggccuuccaccuuaccacucgcaacggggagccacauaugauuguuggcauucaggagaaggggaaguccuuacuuuucaagaccgaggacggcgugaacaugugcacccucauggcaauggaccuaggcgagcugugcgaggacacaauaaccuacaagugcccccuccugagacaaaacgagccggaggacauugacugcugguguaacuccacgucgaccuggguuaccuacggaacguguaccaccacaggcgagcaccgcagggagaagcgaucugucgcccuggucccccacgugggcaugggucuugaaacccgaaccgagaccuggaugagcagcgagggugcguggaagcacgcccagcggauugagacauggauccuuagacacccgggcuucacgaucauggccgcgauccuggccuacaccauugggaccacacacuuccagcgcguacucauauucauccugcuaacggccguggccccauccaugaccaugcggugcauuggcauaagcaaccgcgacuucguggagggggucuccgggggcagcugggucgacauuguguuagagcacggguccugcgucaccaccauggcgaagaacaaacccacgcuggacuucgagcugaucaagaccgaagcuaagcagccugcgacccugcggaaauacuguaucgaggccaagcucacaaacacgaccacggagagccgcugucccacacagggagagcccucccugaaggaggaacaggauaagcgauucgugugcaagcacagcaugguggaccgcggcugggggaacggcugcggguuauucggcaagggcgguaucgugacaugcgcaauguuuacgugcaagaagaacauggaggggaagauaguccagcccgagaaccuggaguacacaauaguggucaccccccacuccggggaggaacacgcgguggggaacgacacggggaagcacggcaaggagaucaagguaacuccucaaucguccaucaccgaggccgagcucacaggguauggcacggucacgauggaguguucaccccggacaggacucgacuucaacgagauggugcugcuucagauggagaacaaggccugguuggugcaccgccaaugguuucuggaucuaccccuuccauggcugccgggggcugacaagcaggaguccaacuggauccagaaggagacucugguaaccuucaaaaauccccacgccaaaaagcaggacguggucguguuaggcagccaggagggcgcgaugcacacggccuuaaccggggccacugagauacagaugagcucggggaaccuucuguucacgggccaccugaagugccgguuacguauggauaaacuccaacugaaggggaugagcuauuccaugugcacugggaaguucaaggugguaaaagagaucgccgaaacccagcacgggaccaucguuauccgcgugcaauacgaaggugauggcagccccugcaagaucccuuucgaaauuauggaccuggagaaacgauacgugcucggccggcugaucaccgugaauccgaucgugacggagaaggacuccccagucaacauagaggccgaaccgcccuucggggacucguauaucaucauagggguugagcccgggcagcuaaagcucaacugguucaagaagggcucgagcaucgggcagauguucgagacuaccaugagaggcgcgaagagaauggccauauugggcgacacggcuugggacuucgguucgcuuggcgguguuuucacgagcauaggcaaggcucuccaccaagucuuuggagccaucuauggagcggccuuuuccggcgugucauggacaaugaagauccugauuggggugauuaucaccuggaucggcaugaacaguagaagcaccucgcugagcguaucccuaguauuaguggggaucgucacgcuguaccugggagugaugguucaggccgauagcgggugcgucguguccuggaaaaacaaagagcugaagugcggcagcggcaucuucauaaccgacaacgugcacacuuggaccgagcaauauaaguuccagcccgagaguccguccaagcucgccucugccauccagaaagcccaggaggagggcaucugcggcauccgcuccgucacaagacuggagaaucuaauguggaaacagaucaccccggagcugaaccauauacuagcggagaacgaggucaagcucaccaucaugacgggggacaucaaggggauuaugcaagccgguaaacgcucacuccggccgcagccuacagaacugaaauauuccuggaagacguggggcaaggcgaagaugcuaagcaccgaguccuauaaccagaccuuccugaucgauggccccgagacgaccgagugcccgaacaccaacagagcguggaacagccuggagguugaggauuacggguucggcgucuucaccacgaacauuuggcucaagcugaaggagaaacaagaugccuucugcgacaguaagcugaugagugccgccauaaaagacaaccgcgcaguccaugcggacaugggguacuggaucgagagugccuugaaugacacauggaagaucgagaaggcgagcuuuaucgaggugaaaaauugccacuggcccaaaucccauaccuuauggagcaacggcguguuagaaagcgagaugaucauacccaaaaaccucgccggaccagugagccagcauaacuaccgcccaggguaccacacccagaucgccggccccuggcaucuggggaagcuagagauggacuucgacuucugugauggcacuacagugaucgugacugaagacugcgggaaccggggcccgucacucagaaccacaacggcgagcggcaagcugaucaccgaguggugcugccggucaugcacccuacccccgcuccgcuaucgcggugaggacggcugcugguaugggauggagauucgcccccugaaagagaaggaggagaaccuggugaauucccucgugacagcgggucacggacaagucgauaacuuuagccugggcguacugggcauggccuuguuccuggaggaaaugcuucgaacgcgcguggggaccaagcacgccauccuccuggucgccgugucguuugugacccugaucaccgggaauaugucuuucaaggacuuagggcgggucgucgugauggucggcgccacuauggccgacgacaucggaaugggcgugaccuaccuggccuuacucgcugcguucaaaguucgcccuaccuucgcggccggcuuacugcuccggaagcugacguccaaagagcugaugaugacgaccauagggauaguucuccucagccaguccaccauacccgaaacagugcuugagcucacggacgcccuggccuugggaaugauggugcucaagaucguucgcaacauggaaaaauaucagcuugcugugaccaucauggccauccucugcgucccuaaugccgugauacuccagaacgcuuggaaggugagcugcaccauccuggccgucguguccgucagcccccugcuccugaccuccagccagcaaaaaacugacuggaucccccuggcucucaccaucaagggacugaaccccaccgccaucuuccugaccacccuauccaggaccaacaagaaacggagcuggccgcugaacgaggccauuauggccgucggcaugguuuccauccucgcgaguucguuacugaagaacgacauccccaugaccggcccgcuuguggccggaggacugcuuaccguaugcuacgugcugacggggcgguccgcugaucucgaguuggagcgggccacagacgucaagugggaggaccaagccgagaucucgggcuccagccccaucuuauccauaacgaucagcgaggacggauccaugucgaucaagaacgaggaggaggaacagacucucacgauccucauacguacuggccuccucgucauauccggccuguucccgaucagcaucccgaucacggcggccgccugguacuuaugggaggugaagaagcagcgugccggaguccucugggacgucccuagcccgccacccaugggcaaggcagaacuugaggacggcgcguaccgcauaaagcagaaggguauccugggguacucgcagauaggcgccggcguguauaaggaggggaccuuccacaccauguggcacgugacgcggggcgccguacucaugcauaaggggaagcgcauagagccuagcugggcggacguuaagaaagaccugaucagcuacggcgguggauggaagcuugaaggcgaguggaaggaaggggaggaggugcaggucuuagcucuagagcccggcaagaacccccgcgcagugcagaccaaacccgggcuguucaagacuaauacuggcacgauuggggccgugucgcuggauuucagcccagguacuuccggcagccccaucaucgacaaaaaggggaagguuguuggacucuaugggaacggcguuguaacaagauccggagccuacguuagcgccaucgcccagacagaaaagucaaucgaagacaaucccgaaaucgaggacgacaucuuccggaagcgccgacuaacgaucauggaucugcacccgggggccggcaagaccaagcgcuaucucccagcuaucgugagagaggccauaaagcgcgggcugcguacccucauuuuagccccuaccagggucguggccgccgaaauggaggaggccuuacguggccugcccauucgcuaccagacgcccgccaucagggccgagcauaccggucgcgagauuguggaccucaugugccacgcgaccuuuaccaugcgccugcugagccccguccgggugccgaacuauaauuugauuaucauggaugaggcucacuucaccgaucccgcauccaucgcugcccgaggcuacauaagcacucgaguggagaugggcgaggcggcggggaucuuuaugaccgccacgccgcccggcucucgcgacccguucccccaguccaacgcccccaucaucgacgaggagcgggagauccccgagaggagcuggaacacggggcacgagugggucaccgacuucaaggggaaaacgguuugguuugucccgaguaucaaggccggcaaugacauagcugccugccugcggaagaacgguaagaaggucauucagcuaucccgcaagaccuucgacucugaguaugugaagacaaggacaaaugacugggacuuugugguaaccacagacauaucagagaugggcgcaaacuucaaggcugagcgcgugaucgacccccgucgcugcaugaagcccguaauacucaccgacggggaggaacgggucauccuggcgggcccuaugccggugacgcacagcucugcggcccagcgccggggacgcaucggacgaaaucccaaaaacgagaacgaccaguacauuuauaugggggagcccuuagagaacgacgaagauugugcccauuggaaggaggcaaagaugcugcuggauaacaucaauacccccgaaggcaucaucccuuccauguuugagcccgagagggagaaaguggacgcgaucgacggcgaguacagacucagaggggaggcccgcaagaccuuugucgaccucaugcggcgcggcgaccugccaguguggcuggcauacaagguugccgccgaagggaucaacuacgcggaccgacgcuggugcuucgauggcauaaagaacaaccagauccucgaggagaacgucgagguggagaucuggaccaaagagggugagaggaagaagcugaagccucgcuggcuggaugcacggauauacagcgacccccuagccuugaaggaguucaaggaauucgcugccggccgcaagucccugacccucaaucugauaaccgagaugggccgccugcccaccuucaugacacagaagacucgugaugcgcuugacaaccuggccguguuacacacugccgaggcagguggccgggcguauaaccacgcccucagcgagcuucccgagaccuuagagacguuacuucugcucacacugcuggccaccgugaccggggguauuuuccuauuccucauguccggcagggggaucggaaagaugacccuggggauguguugcaucaucacugccuccauccuccugugguaugcgcagauccagccgcauuggaucgcggcauccaucauccuggaguuuuuccuuaucguacugcugauucccgagcccgagaagcagaggacaccccaagacaaccaacucacguacgucguaauagccauccugaccgugguugcggccacgauggcgaacgaaaugggcuuccuggaaaagaccaaaaaggaucucggguugggaagcaucgccacccagcaacccgaguccaacauccuagacaucgaccuccgccccgcgagcgccuggacucuguacgccguagcgacuaccuuugugacccccaugcugcggcauuccaucgagaauagcagcgucaaugugucucucaccgccaucgcaaaccaggcgacgguccugaugggccuggguaagggguggccccucagcaaaauggacauaggggucccacugcuggccaucggcuguuauucccaggugaauccgauaacccucaccgcggcucuuuugcuccugguggcccacuacgcgauaaucgggcccggccuacaagcaaaggcuacccgcgaggcccagaagcgagccgccgcgggcauuaugaagaaucccaccgucgacgggaucacggugaucgaccucgacccgauucccuacgaccccaaauuugagaagcagcuuggccaagugaugcugcuaaucuugugugugacucaggugcugaugaugcgcacaaccugggcucucugcgaagcgcugaccuuagcgacgggccccauauccacgcucugggagggaaaccccggucgguucuggaacacuacaauugcagugucgauggcgaacaucuuuaggggcagcuaccuggcaggcgccgggcuccucuuuuccaucaugaaaaauaccaccaacacucgacgagggaccgggaacaucggggagacccuaggcgagaaguggaagucccgccugaacgcccucgggaaguccgaguuccaaauauauaagaaaucgggaauccaggaggucgaccgcaccuuggccaaggaggggaucaagcguggcgagacggaccaucacgcugugucucgggggagcgccaaauuacgcugguucgucgagaggaauauggugaccccggagggcaaggucguggaucucggcugcggucgggggggguggucuuacuacuguggcgggcucaagaauguacgcgaggugaagggccugaccaaaggcggacccggccacgaggaaccaaucccgaugucuaccuacggguggaacuuggugcgccugcagucaggagucgacguguucuucaucccgcccgagaagugcgacacgcugcuuugcgacauaggggagucgucccccaacccuaccgucgaggcaggccggacccugcgcguacugaacuugguggagaauuggcugaacaacaacacccaguuuugcaucaaaguacugaaccccuacaugcccaguguaaucgagaagauggaggcccugcagcggaaguacggcggggcgcucgucagaaacccgcugucccgaaacagcacucacgagauguacugggugagcaacgcaucaggcaacauaguaagcucaguuaauaugaucagccggaugcuuauuaaccgguucacaaugcggcacaaaaaagccaccuacgaacccgacguugacuuggggaguggcacgaggaacaucgggauugagagcgagauucccaauuuagauaucaucggcaaacgcauugagaaaaucaagcaggagcacgagaccuccuggcauuacgaccaggaccaccccuacaagaccugggcuuaccacggcucauacgagaccaaacagaccggguccgccucguccauggucaacggagugguccggcuguugaccaagccuugggacguacuaccaacggugacccaaauggcgaugaccgauaccacccccuucggacagcagcgcguguucaaggagaaggucgacaccagaacccaagagcccaaagagggcaccaagaagcugaugaagaucacggccgaguggcucuggaaggagcuuggcaagaagaagaccccacggaugugcacccgcgaggaauucacccggaaggugcgcagcaaugcugcccugggggcgaucuucacggacgagaacaaguggaagucugcacgggaagccguugaggacagccgcuucugggagcucgucgacaaggagcgaaaccuccaccuugagggcaaaugcgagacauguguguauaacaugauggggaagcgcgaaaaaaagcucggcgaauuugggaaggcaaagggcucucgggccaucugguacauguggcugggugcccgcuuucuggaguucgaggcgcucggauucuugaacgaggaccacugguucagccgcgagaacucccugagcgguguagagggugaagggcuccacaaguugggguauauccuucgagacgugucaaagaaggagggcggcgccauguacgcugacgacaccgccgggugggacacgagaaucacacucgaagaucuaaagaacgaggaaaugguaacuaaccacauggagggggaacauaagaagcuugcggaggcgauuuucaagcucaccuaucaaaacaaggucgugcgcgugcaacggccaacgccccggggcacggucauggacaucaucagccggcgcgaccaacgggguagcggccagguaggaaccuacggccugaacaccuucaccaacauggaagcccagcugauucggcagauggagggggaggguguuuucaagaacauccaacaucucacggucacggaagagguggccgugcaaaacuggcuggcucgggucgggagggagcgccugucgcgaauggcgaucucgggagacgauugcgugguuaaaccccuagacgaccgcuuugccaaugcccugaccgcccuaaaugacaugggcaagauccggaaggacauacagcagugggagccguccaagggguggaacgauuggacccagguccccuucugcagccaccacuuucacgagcucaucaugaaggacggccgcgugcuggugguccccugcagaaaccaagacgagcugaucggacgcgcccguaucucccagggcgccggguggucauugcgggaaacggccugucugggcaaguccuacgcccagauguggagccucauguacuuccaccggcgcgauuugcgccuggcggccaacgcaaucuguagugccgugccuagccacugggugccgaccucccgcaccaccuggaguauccacgccaaacacgaguggaugacaacggaggacaugcuaaccguguggaaccggguuuggauacgcgagaaccccuggauggaggauaagacacccguagaguccugggaggagauucccuaccugggcaagcgggaggaucagugguguggaucccugauagggcugaccucccgagcgaccugggccaagaacauccaggcggccauuaaccaggucagaagccuuaucgggaaugaagaguauaccgacuacaugccguccaugaagcgcuuccgccgcgaggaggaggaggccggcgucuuaugguga

SEQ ID NO: 25304 - RNA, 9876 nt, Artificial Sequence
  derived and/or modified CDS sequence (opt11) from DENV-2__EU482448__SS-prME
ucagcggggaugaucauaaugcugauuccaacggugauggccuuccaccucaccacccgcaacggagagccccacaugaucgucggcauccaggaaaaagguaagagccugcucuucaagaccgaggauggcgugaauaugugcaccuugauggcgauggaccugggggagcugugcgaggacaccauuaccuauaagugcccguugcugcggcagaacgagccagaggacauagauugcuggugcaacuccaccuccaccugggugaccuacgggaccuguaccaccaccggcgagcaccgucgggagaagcgcucuguggcccuggugccccacguggggaugggccucgaaacacggacagagaccuggauguccagcgaaggagccuggaagcaugcgcagcgcaucgagaccuggaucuuaagacacccgggcuucaccaucauggcggcgaucuuggccuauaccaucgggacgacccacuuccagcgcguccucaucuucauccuacuaacugccguggcccccuccaugaccaugcggugcaucggcaucagcaaucgcgacuuuguggagggcguguccgggggcucuuggguggacaucgugcucgagcacggguccugcgucacaaccauggcgaaaaacaagcccacgcuggacuucgaacugaucaagaccgaggccaaacagccagccacccuccggaaguacugcaucgaagcuaaacugaccaacacgaccaccgagagccgcugccccacccaaggcgagcccucccugaaagaggagcaggacaagcgguucgugugcaaacacagcaugguggaccgcggcugggggaacggcugugggcuguucggcaagggggggauugucacgugugccauguuuaccugcaaaaagaacauggagggcaagaucgugcagcccgagaaccucgaguacaccaucguggucacgccacacuccggggaggagcaugcggugggcaacgacacggggaagcacgggaaagaaaucaaggugacuccccagucauccaucaccgaggccgaacugaccggguauggcaccgucacgauggagugcagcccccggaccggacucgacuucaacgaaauggugcugcugcagauggagaacaaggccuggcuagugcacagacagugguuccuagaccuaccccuccccuggcugccgggcgccgacaagcaagagucgaacuggauccaaaaggagacccuggucaccuucaaaaacccccacgcgaaaaagcaggacguggucguacuggguucucaggagggggcgaugcauacggcccugaccggagccacagagauccagaugagcuccggaaaccuccuguucacaggucaucuaaagugcagacuucgaauggacaaacuacaguugaagggcaugagcuacuccaugugcacgggaaaguucaagguagucaaggagaucgccgagacccaacacggcaccauaguaauccgggugcaguacgagggggacgggagcccuugcaagauucccuucgagaucauggaccuggaaaagcgcuacguccucgggcggcugaucaccgugaacccgaucgugacggaaaaggacucccccguaaauaucgaggccgaaccgcccuucggggacuccuacaucauaaucggggucgagccggggcagcugaaauugaacugguucaagaagggcuccagcaucgggcagauguucgagaccaccaugcgcggcgcgaaacggauggcuauccugggcgacaccgccugggacuucgggucccugggugggguuuucacgucaaucgguaaggcccuccaccaagucuucggugccauauacggcgcugcuuucuccggugugagcuggaccaugaagauucugaucggggugaucaucaccuggaucggcaugaacucccggucuaccucucugagcguuucacugguucucguggggaucgucacacuguaccugggagugauggugcaagcugauagcgggugcgucgucuccuggaagaacaaggagcucaagugcggcagcggaaucuuuaucaccgacaacgugcacaccuggacggagcaguacaaauuucagcccgaaagcccguccaagcuggccuccgcgauccagaaggcccaggaggaggggaucugcggcauacgcucagucacacggcuggaaaauuuaauguggaagcagauuacccccgagcugaaccacauccuggccgagaacgaggugaaacucaccaucaugacgggcgauaucaagggcaucaugcaggccgggaaacguagccugagaccgcagcccacugagcugaaguacagcuggaagaccuggggcaaagcgaagauguugagcacugaguccuacaaucagaccuucuuaaucgacggacccgagacgaccgagugcccuaacaccaaccgcgcuuggaacagucuggaaguggaggacuacggcuucggcgucuucaccaccaauauauggcucaagcuuaaggaaaagcaggacgccuucugcgacucuaaguuaaugagugcugccaucaaggauaaucgggccgugcacgcggacaugggguacuggaucgaguccgcccucaacgacaccuggaagauugagaaggcaagcuucaucgagguuaaaaacugucacuggcccaagucgcacacccuguggagcaacggcguccuagagagugagaugaucauccccaagaaccucgccggccccgugagucaacacaacuaucgcccgggguaccauacccagauagcgggccccuggcaccuggggaagcuggaaauggacuucgacuuuugcgauggcaccacuguaaucgucaccgaggacugcgggaaucggggaccguccuugcgcacaacgacugcgagcggcaagcugaucacugaguggugcugucgcucuugcacacugcccccacuccgcuaccgcggggaagacggcuguugguacgggauggagaucagaccccucaaggaaaaagaggagaaccucgucaauucccuaguaaccgcgggccacgggcaaguugacaacuucagucuuggggugcugggcauggcgcucuuccuggaagagaugcugcggacgcgcguggggaccaaacacgcuauccuccugguggcagucagcuucgugaccuugaucaccggcaauaugagcuuuaaggaucucgggcgggucguagugauggucggcgccacgauggccgacgauaucggaaugggcgugaccuaucuugcccugcucgccgcguucaaagugcgcccaacauucgccgccggacugcuccuccggaagcugaccuccaaggaguugaugaugacgaccaucgggaucgucuugcuuagccaguccaccaucccagagacagugcuggaauugacugacgcucuggcgcuggguaugaugguccucaagaucguccgcaacauggagaaauaccaguuggcggugaccaucauggcaauccugugcguaccgaacgccgugauccuccagaaugcauggaaagugagcuguaccauccuagccgucguuuccgugagccccuugcugcucaccuccagccagcagaagacggacuggauaccacuggcacucaccaucaaggggcugaaccccacagccaucuuccugaccacgcugucccgcacaaauaagaaacggucguggccgcugaacgaggccauuauggccgucggcaugguguccauccuggcgucgucccuccugaagaacgacauccccaugaccggcccccuagucgcugggggccuccugaccgucugcuacgugcugacggggcgaagcgccgaccuugagcuggagcgggccaccgacguaaaaugggaggaccaggccgagaucuccggcagcaguccaauacuuuccaucaccauaagcgaggacggguccauguccaucaagaacgaagaagaagagcagacccucacgauccugauacggaccggcuugcucgucaucucuggccuguucccgaucagcaucccuaucaccgcagccgcuugguauuugugggaagugaagaagcaacgggcaggcgugcucugggacgucccaagcccaccgcccaugggcaaggccgaguuggaggauggggcguaccgaauaaagcagaagggaauuuuaggguacagccagaucggcgccggcguguacaaggaagggaccuuccacaccauguggcacguaacacgaggugccguccucaugcacaaggggaagcgcauagaacccuccugggcagacgugaaaaaggaucucaucucuuacggggguggguggaagcuggaaggggaauggaaagagggggaggaagugcaaguucucgcucuggaacccggcaagaacccccgggcagugcagaccaagccggggcuguucaagaccaacaccgggacgauaggugccgugucccucgacuucucucccgggaccuccggcagcccuaucauugacaagaaggggaaaguugugggccuguacgggaaugggguagucacccgcuccggcgccuacgugagcgccaucgcccagaccgagaaguccaucgaggacaaucccgagaucgaggaugacauauuccggaagagacggcugacuaucauggaccugcaucccggggcgggaaagaccaagcgcuaccuccccgccaucgugagggaggccaucaaacgcgggcugcggacacuuauccuagccccuacccgcgucguggcggccgagauggaggaggcccugagaggccuucccauccgcuaccagacgcccgccauccgggcagaacacacaggccgcgagaucguggaccucaugugccacgcgaccuucaccaugcgccuguuaucgccgguaagaguaccgaacuacaaucucaucaucauggacgaggcccacuuuacagaccccgcguccauugcggcccgcggcuacaucucgacccggguggagaugggcgaggcugccgggaucuucaugacugcuacgccgcccggcagccgagacccguuuccccagucuaacgcccccaucaucgacgaggaacgggagauccccgagcgcaguuggaacacggggcacgagugggucaccgacuucaaaggaaagaccgugugguucgugccgucuaucaaggcugggaacgacaucgcagcuugccugcggaagaacggcaagaaggucauccaguuaucuagaaagaccuucgacucugaguacguaaagacgaggaccaacgacugggacuucguggucaccaccgacauuagcgagaugggugccaacuucaaagccgaaagagugaucgaccccaggcgcuguaugaagccaguaauacucacggacggagaggagcgcgucauccuugcuggacccaugccgguaacccauuccagugcggcacagcgccggggccgcauaggacggaaccccaagaacgagaacgaccaguacaucuacaugggggagcccuuagagaacgacgaggacugcgcccacuggaaggaggccaagauguuacuggacaacauuaauacucccgagggcaucauaccguccauguucgagccagaaagggagaaaguggacgcgaucgacggcgaguaccggcuaaggggggaggcuagaaaaaccuucgucgaccucaugcggcgcggcgaccugcccguguggcuggccuacaaaguggcggcugaggggaucaacuacgcggaccgcagauggugcuucgauggcaucaagaacaaucagauccucgaggagaacgucgagguagagaucuggacgaaggagggggagagaaaaaaguuaaagccgcguuggcuggaugcccggaucuacagcgauccccucgcccugaaggaguucaaggaauucgcagccggccguaaaucccugacgcucaaccuaaucaccgagaugggccgguugcccaccuucaugacacagaagacccgcgaugcgcucgacaaccuggccguacugcacacugccgaagccgggggccgggcguacaaccacgcacucucggaacugcccgagacccuggagacgcugcugcuacucacacugcuggccacagugacagggggcaucuuccucuuucugauguccggccgcgggauagguaaaaugaccuuggggaugugcugcaucaucacggccagcauucuccugugguacgcccaaauccagccgcauuggauugcggccucuaucauccuggaguucuuccucaucgugcugcugauacccgagccugagaagcagcggacaccccaggacaaccagcuaacuuacgucgugaucgccauccugacggugguagcggccacgauggcgaaugagaugggguuucuggagaagaccaaaaaggaucucgggcuggggagcaucgccacccaacagccugagucuaacauccuggacaucgaccugcggcccgccagcgccuggacacuguacgccguggcgacgaccuuuguuacccccaugcuucggcacuccaucgaaaacuccagcgucaacgugagccucaccgccaucgcgaaucaggccacggugcuaaugggccuggggaagggcuggccccucagcaagauggacaucggggucccgcugcuggcuaucggcuguuauucccaggugaauccuaucacgcucaccgcugcccugcugcuucuggucgcacacuacgccaucaucggacccggccuccaggcgaaggccacccgcgaggcccagaagcgggccgcagccgguauaaugaaaaaccccacggucgaugggaucaccgugaucgaucucgaccccauccccuacgaccccaaguucgagaagcaguugggccagguuaugcuucucauccuuugcgucacccaggugcugaugaugcgcacaacgugggcccucugcgaggcucugacgcuggccaccgggccgaucagcacccucugggagggcaauccgggucgguucuggaacacgaccaucgccguguccauggcaaacaucuuccgagguagcuaccuagccggcgccgggcuccuguucaguauaaugaagaacaccaccaacacgcggcgcggcaccgggaacaucggcgagaccuuaggugaaaaguggaagagcagacugaaugcccucgggaagucggaguuccagaucuacaagaagaguggcauucaggaggucgacagaacucuggcuaaagagggaaucaagcguggcgagacagaccaccacgcagugucccgggggagcgccaaacuucgaugguucguggagcggaacaugguaacacccgaaggcaaggugguggacuuagguugugggcgcggcggguggucuuauuauuguggcggacugaagaaugugcgggaggugaagggcuuaaccaagggcgguccuggccacgaggagcccaucccgaugagcacguacggguggaaccucgugcgccugcaaucgggagucgaugucuucuucauuccgcccgaaaagugcgacacccuucucugugacauaggggagagcucccccaaccccaccguggaggcgggacggacccugaggguucuaaaccuggucgagaacugguuaaacaacaauacucaguucugcaucaaggugcugaaccccuacaugccaagcguuauugagaagauggaggcccugcagcggaaguacggcggugcgcucguccguaacccacugucccggaacucgacccacgagauguacuggguaagcaacgcuucgggcaacaucgucucguccgugaacaugaucucccgcaugcuaaucaaccgguucacgaugcgccacaagaaggcuaccuaugagcccgacguagaccucggguccggcacacggaauauaggaaucgagucggagauccccaaucuggauaucaucggcaagcgcauagagaaaauaaagcaagagcacgaaaucuccuggcacuacgaucaggaccaccccuauaagaccugggccuaucacgguagcuacgagacgaagcagaccggaagcgccagcagcauggucaacggcguagugagauuacucaccaagccgugggacguccugcccaccgugacgcagauggcgaugaccgacaccaccccguucgggcagcagcguguguucaaggagaagguggacacucggacgcaggagccgaaggagggcaccaagaaacuuaugaagauaaccgccgaguggcucuggaaagaguuaggcaaaaagaagacgccgcggaugugcacccgagaggaguucacccggaaggugcgcucaaaugccgcccugggggcgaucuuuaccgacgagaacaaguggaaguccgcgcgggaggcuguggaggacagucgcuuuugggagcucgucgacaaggagcggaaccugcaccuugaggguaagugugagacgugugucuacaacaugauggggaagcgcgagaagaagcuaggcgaauucgggaaagccaagggaucccgagccaucugguacauguggcugggcgcccgcuuccuggaguucgaggcgcucggguuucugaacgaagaucacugguuuagcagagagaacucucugucaggcgucgagggggagggccuccacaagcuuggauacauucugagggauguguccaagaaggagggcggcgccauguacgccgacgacacggccgggugggacacacggaucacccucgaggacuuaaaaaacgaggagauggugaccaaccacauggagggcgagcacaaaaagcuggcggaggccaucuuuaagcucaccuaccagaacaagguggugcgcguucagagacccacucccagagggaccgucauggacaucaucucacggcgcgaccagagaggcucgggccagguggggacguauggccucaauaccuucaccaacauggaggcucagcugauucgccagauggagggcgagggcguguucaagaacauucagcacuuaaccguuacggaggaggucgccgugcagaacuggcuggccagggucgggcgcgagcgccugucgcggauggcgaucucuggcgacgacuguguggucaagccccuagacgaccgcuucgcaaacgcucugaccgcccucaacgacaugggcaagauccggaaagauauccaacagugggagccgaguaagggguggaacgacuggacccaggucccguuuugcagccaccacuuccaugagcucaucaugaaggauggucgcgugcuugugguccccugucggaaucaggacgagcugaucgggcgcgcacggaucucccaaggggcgggguggagccuccgcgagacugcgugccugggcaaguccuacgcacagauguggagcuugauguacuuucaccggcgcgaccuccggcuggcagccaacgcgaucugcucggccgugccaagccacugggugccgacgucccgcaccaccuggagcauccacgccaagcacgaguggaugaccacagaggacaugcugacugucuggaaccggguguggauccgcgagaaccccuggauggaagacaaaacccccguugaguccugggaggagauccccuaccucggcaagcgggaggaccaguggugugggagccuaaucggcuuaaccagucgcgccaccugggccaaaaacauccaggcugccaucaaccaggucaggagccucauugggaacgaggaauacacugacuacaugccguccaugaaacgcuucagacgcgaagaggaggaggccggggugcugugguag

SEQ ID NO: 25305 - RNA, 9876 nt, Artificial Sequence
  derived and/or modified CDS sequence (opt11) from DENV-2__EU482449__SS-prME
acagccggcgugauaauuaugcugaucccgacugcgauggccuuccaccucaccacccgcaauggggagccccacaugauugucggccgucaagagaaggggaagagucugcuguucaagaccgaggacggcgucaacaugugcaccuuaauggcuauagaccucggggaguugugcgaggacacgauuaccuacaagugcccccuccugcgccagaacgagcccgaggacauagacugcuggugcaacagcacaucgacuugggugacguacgggaccugcacaaccacgggcgagcaccggcgcgagaagcggucugucgcccuggucccccacgugggaaugggccuagagacccgcaccgagaccuggaugagcuccgagggggccuggaagcaugcccagcggaucgagacauggauccuucgccacccaggcuucaccauuauggcggcaauacuggcuuacaccaucggaacgacgcacuuccagcgggcccucauauucauccugcugaccgcaguagcccccagcaugaccaugcgcugcaucgguaucuccaaccgugacuucguggagggcgugagugggggcuccugggucgacaucgugcucgagcacgggucgugcgucaccacgauggccaagaacaagccaacgcuggacuucgagcugaucaagaccgaggccaagcaacccgcaacccucagaaaguacugcaucgaggcgaaacugacaaacaccacgacggaaucccggugcccgacgcagggagagcccagccugaacgaggagcaggacaagcgcuucgucugcaagcacuccaugguggaccgcggaugggggaacggcugcggucuguucggcaagggcgggaucgugaccugcgccauguucacgugcaagaaaaauauggagggcaagaucguccaacccgagaacuuagaguauaccaucgugaucacgccccacagcggagaggagcacgccgugggcaacgacacugggaagcacgguaaggagaucaagaucaccccgcaguccagcaacacggaggccgagcugaccggguauggcacggucaccauggagugcagcccccgcaccggucucgacuucaacgagaugguccugcugcagauggaggacaaggcuuggcucgugcaccggcagugguuccucgaccugcccuugcccuggcugccgggggcggacacccagggcucgaacuggauacagaaggagacguuggucacuuucaagaacccucacgccaagaaacaggacguggucguacucgggucccaggaaggagccaugcacaccgccuuaaccggggcgaccgagauccagaugagcagcggcaaccuccuguucaccggccaccuuaagugccgccugcggauggacaagcuccaguugaaggggaugaguuacagcaugugcacggggaaauuuaaaaucgugaaggagaucgcggagacucagcacgggacgaucgucauccgcgugcaauacgagggcgacggaucccccugcaagauacccuucgagaucauggaccuggagaagcggcacgugcucgggcgccugauuaccgucaacccgaucgugaccgagaaggauagccccgugaacaucgaagccgaaccgcccuucggggacagcuacaucaucaucgggguggagccgggccagcugaagcucaacugguucaagaaggggagcuccaucggccagauguucgagacuacgaugcgcggcgccaagcggauggccauccugggugacacugccugggacuucggcagccucggcgggguguucaccuccauugggaaggcgcuccaccagguauucggggccaucuacggagccgccuucagcggcgucucguggaccaugaagauccugaucggcgcgaucaucacguggauugggaugaacagccgcucaaccagccuguccgugagcuuagugcucgucggcgugaucacccuguaccugggggccauggugcaggcugacuccggcugcgucgugagcuggaaaaacaaggagcucaagugcggcuccgggaucuucauuaccgacaacgugcacaccuggaccgagcaguacaaguuccagcccgagucgcccagcaagcuggcguccgccauccagaaggcgcaugaggagggcaucugcgggauccggucggucacccgccuggagaaucugauguggaaacagaucacccccgagcugaaccacauccuguccgagaacgagguaaagcucacgaucaugacgggagacaucaagggaaucaugcaagcugguaagcggagccuucgcccgcagcccaccgagcugaaguacuccuggaaaaccuggggcaaggccaaaaugcuuagcacagagucccacaaccaaaccuuccugaucgacgggcccgagaccgccgagugcccgaacaccaaccgggccuggaacagcuuggagguggaggacuacggcuucggggucuucacgaccaacaucuggcucaagcugcgggagaagcaggacguguucugcgacuccaagcugaugagcgcggccaucaaggacaaccgggccgugcacgccgacaugggguacuggaucgaguccgcucuuaacgacaccuggaagauggagaaggcgagcuuuaucgaagucaagaguugccacuggcccaagagccacacccuguggucuaacggcgugcuggagucggaaaugaucauccccaaaaguuuugccgggcccgugucgcagcacaacuaccgcccggguuacuacacccagacugccgggccguggcacuuaggcaagcucgagauggacuucgacuucugcgaggggacuaccgucguggugaccgaggacugcggcaaucggggccccagccugcgcacgaccaccgccuccgggaagcucauuaccgagugguguugccggagcugcacgcugcccccgcuucgcuaccggggcgaggacgguugcugguacggcauggagauccgaccacucaaggaaaaggaggagaaccucgucaacuccuuagugaccgcggggcauggccagaucgacaacuucucucuaggcgugcuggggauggcccuguuccuagaagagaugcugcguacccgcgucggcaccaagcacgccauccugcucguggccgugaguuucaugacgcuaaucacugggaacaugagcuuccgggaccugggccgcgucauggugaugguuggggccaccaugaccgacgacaucggcaugggagucacguaccucgcgcugcuggccgcuuucaaagugcgccccaccuucgcagccggucuccugcugcggaagcucacuaguaaagagcugaugauggcgaccaucggcaucgcccuguugagccaguccacuauccccgagaccauccuggaacugaccgaugcgcuagcccuugggaugauggugcuuaagaucguccgcaacauggagaaguaccagcucgcggugacuaucauggcgaucagcugcguuccgaacgccgucauccuccagaacgccuggaagguguccugcacgauccucgcagccgugagcguuagcccccuccugcugaccagcucccagcagaaggccgacuggaucccccuagcgcugaccaucaagggccugaacccgaccgccaucuucuuaacgacccugagccggacuagcaagaaacgcaguuggccgcugaacgaagccaucauggccguuggcauggugucuauccucgcgagcagccugcugaagaacgacauccccaugaccgggccccucgucgccggcggccugcuuacagugugcuacguccucacaggccgguccgcggaccuggaauuagagcgcgccaccgacgugaagugggaggaccaggcggagaucagcggguccagccccauccucuccaucaccaucagcgaggacggcucaaugagcaucaagaaugaggaggaggagcagacccuaaccauccugauuagaaccggcuugcuggugaucuccgggcuguucccggugagcauccccaucaccgccgccgcaugguaccuaugggaggugaaaaagcagcgcgcgggcgugcuuugggacguccccagcccgccgcccguggggaaggcugaacuggaagacggcgccuaccggaucaaacagaaggggauccucggcuacagccagaucggcgccgguguguacaaggaaggcaccuuccacacgauguggcaugucacccguggggccgugcugaugcaccggggcaagcguaucgagcccuccugggccgacgugaagaaggaccugaucagcuacgggggcggcuggaagcuugagggggaguggaaggagggcgaggagguacagguucuggcacuggagcccgggaagaacccacgggccgugcagacaaagcccggccucuucaagaccaacacggggaccaucggcgccgucucccuggacuucagccccgggaccagcgggagccccaucguagaccgcaaggggaagguggucgggcuguaugggaauggcguggugacccgguccggggccuacgucucagcuaucgcccagacagagaaguccaucgaggacaaccccgagauagaggacgacauuuuccguaagaagcggcucaccaucauggaccugcacccaggcgccgggaagaccaagcgcuaccugcccgccaucgugcgcgaggccauaaagcgcggccugaggacccucauccuggcaccgacgcgcguggucgcagccgagauggaggaggcccugcgcggucucccuauccgguaccagacccccgccauccgcgcggagcacacgggccgggagaucguggaucugaugugucacgcgaccuucacgaugcgccugcucagucccguaagggucccgaacuacaaccugaucaucauggacgaggcccacuucaccgacccggccagcaucgcugcgcguggauacaucuccacccggguagagaugggggaggccgccggcaucuucaugaccgccaccccacccgggagccgcgacccguucccccaauccaacgcgcccaucauagacgaggagcgggagauacccgagcggagcuggucuuccggccacgagugggugaccgacuucaaggguaagaccgucugguucgugcccuccaucaaggccggcaacgauaucgccgccugccuccggaagaacggcaagaaggugauccaacucagccgcaagaccuucgacuccgaguacgucaagacccggaccaacgauugggacuucguggucaccacagacaucagcgaaaugggggccaacuucaaggcggagcgcgucaucgacccccggcgcugcaugaagcccgugauccuaacugacggcgaggaacgugucauccuggcggggcccaugccggucacacacuccuccgcugcccagcgccggggccgcaucgggcgcaaccccaagaacgagaacgaccaguacaucuacaugggcgagccccucgagaaugacgaggacugcgcccauuggaaggaagcgaagaugcuacuggacaacauuaacacgcccgagggcaucaucccgucuauguucgaaccugagcgggagaagguggacgccaucgauggggaguaccggcuccggggggaggcccgaaagaccuucguggaccugaugcggcgcggggaccugcccguauggcuggcauaucggguggccgcugagggcaucaauuacgccgaccgccgguggugcuucgacggggucaagaacaaccagauccuggaggaaaacgucgaagucgagaucuggacgaaagagggcgagcgcaagaaacugaaaccgcgguggcucgacgcacgcaucuacagcgauccccuagccuuaaaggaguucaaggaguucgcugccggccgcaagucacucacccugaaccugaucaccgagauggggcgccuccccaccuuuaugacgcagaaggcucgggacgcccuggacaaccuggccgugcuccacaccgcggaggcuggcgggcgcgccuacaaccacgcccugagcgagcugccugagaccuuggagacgcugcugcuccugacgcugcucgccaccgucaccggcggcauuuuccuuuuccugauguccgggaagggcguugggaaaaugacccucggcauguucugcaucaucacagcgucaauacugcugugguacgcccagauccagccgcauuggaucgccgccagcaucauccucgaguucuuccugaucgugcuacugauccccgagcccgaaaagcagcggacgccccaggacaaucagcugaccuacgucgugauugcaauccucacugucguagcggccaccauggcaaacgagaugggguuccucgagaaaacgaaaaaggaccugggccugggcuccaucgcuacccaggagccggagagcaacauccucgacaucgaccugcgccccgccuccgcguggacccuguacgccguggccaccacguuugucacgcccaugcuacggcacagcaucgagaacuccagcgugaacgucuccuuaaccgcuaucgcgaaccaggccaccguucugauggggcucggcaagggguggccccugagcaagauggacauaggcgugccgcugcucgccaucgggugcuacucacaggugaacccuaucacgcugaccgccgcgcuguuacuguugaucgcgcacuacgcaaucauaggccccggccuccaggccaaggccacccgggaggcacagaagcgggcggccgcugggaucaugaagaaccccacugucgacggcauaacgguuauugaccuggacccgauucccuacgacccaaaauuugagaagcagcugggccaggugaugcuccuaauccugugugucacccaggugcucaugaugcgcaccaccugggcccugugcgaggcccucacgcucgcgaccgguccuaucagcacccugugggaggggaacccaggccgcuucuggaacacgacgaucgccguguccauggccaacaucuuccggggcagcuacuuagccggggcgggccuccuguucuccaucaugaagaauaccaccaauacccgccgggggaccggcaacaucggcgagacccugggggagaaauggaagucccgccugaacgcccugggcaagucugaguuccagaucuacaagaaguccgggauccaagaggucgaucggacccuggcgaaggagggcaucaagcgcggggagaccgaccaccacgccguaagucggggcucugccaagcuacgcugguucguggagcggaauauggucacgcccgagggcaaggugguggaccuggggugcggccgagggggcugguccuacuauugcgguggcuuaaagaacguccgggaggugaagggccucaccaagggcggccccgggcacgaggagcccauaccgaugagcaccuacggcuggaaccuagugcgccugcagagugggguugauguguucuucacgccucccgagaagugcgacacgcuccucugcgacaucggcgaguccagcccgaacccgaccaucgaggcgggccggaccuugcgcgugcucucccuggucgagaacuggcugaacaacgacacccaguucugcaucaaggugcucaacccguacaugcccagugugaucgagaagauggagacccugcagcggaaguacgggggcgcccugguccgcaacccgcugucucgcaacagcacgcacgagauguacugggugucaaaugccaccgggaacaucguuaguagugucaacaugaucagccgcaugcucaucaaccgauucaccaugaagcacaaaaaggccaccuacgagcccgacguggaccugggcuccgggacacgcaacaucggcaucgagagcgaaaucccuaaccuggacaucaucggcaagcguaucgagaagaucaagcaggagcacgagaccuccuggcacuacgaccaggaccaucccuacaagacuugggccuaccacgggagcuacgaaaccaagcagacgggcuccgcaagcuccauggugaacggggucgugcggcuccugaccaagccuugggacgugguacccauggugacccagauggcuaugacugacacgacccccuucgggcaacagcgcguguucaaggagaaggucgacacccggacccaggagcccaaggagggcacuaagaagcugaugaagaucaccgccgaguggcucuggaaagaguugggaaagaaaaagaccccgcgcauguguacccgggaggaguucacaagaaagguccggaguaaugccgcccugggcgcgaucuucaccgacgagaacaaguggaaauccgcccgcgaagcaguugaggacagucgguucugggagcucguugacaaagagcgcaaccugcaccuggaggggaagugcgagacuugcguguacaacaugaugggaaagcgggagaagaagcucggugaguucggcaaggccaagggcagccgugcgaucugguacauguggcugggggcccgguuccuggaguucgaggcacucggcuuccucaacgaggaccacugguucucccgcgagaacagccugagugggguggaaggcgaggggcuccacaaguugggcuacauccugcgcgacgucagcaagaaggagggcggagccauguacgccgacgacacagcuggcugggacacgcgcaucacccucgaggaucuaaagaacgaggaaauggugaccaaucacauggagggggagcauaagcggcuggccgaggccauuuucaagcucaccuaccagaacaaggugguccgcgugcagcggccgacgcccagaggcacagucauggacaucaucucccggcgcgaccagcgcgggagcggccagguuggcaccuacgggcucaacacguucacgaacauggaggcccagcucauccggcagauggagggcgaggggaucuuuaaguccauacaacaccuuaccgugaccgaggagaucgccguacaaaacuggcuggcgcgcguggggcgggagcgccugagccggauggccaucagcggcgacgacugcgugguaaagccccucgacgacagauucgcuucagcccugaccgccuuaaacgacauggggaagguacggaaggacauccagcaaugggagccguccaagggcuggaacgacuggacccaggugcccuucugcagccaccacuuccaugagcucaucaugaaggacgggcgcguacuggucgugccaugccggaaccaggacgagcugaucggcagggcgcggaucucccagggggccggcuggagccucaaggagaccgccugccugggcaagucguaugcccagauguggagccugauguacuuucaccgccgggaucuccgccuggcagcgaaugcgaucuguuccgcgguccccagccauugggugccgaccagccggaccacgugguccauccacgcaaagcacgaguggaugacgaccgaggacaugcugaccguguggaaccgcguguggauacaggagaaccccuggauggaggacaagaccccuguggagucuugggaggagguucccuaccucggcaagcgggaggaccaguggugcgguucccugaucgggcugacuagccgcgccaccugggccaagaacauccagaccgccauuaaccagguucggucccucaucggcaacgaggaguacaccgacuacaugccgagcaugaagcgcuuccgccgagaggaggaggaggccggggugcugugguga

SEQ ID NO: 25306 - RNA, 9876 nt, Artificial Sequence
  derived and/or modified CDS sequence (opt11) from DENV-2__EU482450__SS-prME
uccgcggggaugaucaucauguuaauccccacuguuauggccuuccaccucacgacgcgcaacggcgaaccccacaugaucgucgggauccaggagaaggggaagucgcugcuguucaagacggaggacggcgugaauauguguacccuuauggcuauggaccugggggagcugugugaggacaccaucaccuacaagugcccccuccugcggcagaacgagcccgaggacaucgacugcugguguaacagcaccagcaccugggugaccuacgggaccugcacgaccaccggcgagcaccgcagagagaagcgauccgucgcguuaguuccccacgucgggaugggccucgaaacccggaccgagaccuggaugucgucggagggggccuggaagcacgcccagcgcauugagaccuggauccugcgacacccgggcuucacuaucauggccgcgauccuggcauacaccaucgggaccacccacuuccaacguguccucaucuucauccugcugacggccgucgccccuuccaugaccaugcggugcaucggcaucagcaaucgcgacuuuguggagggcgucuccgggggcagcugggucgacaucgugcucgaacacggguccugcgucaccaccauggcgaagaacaagcccacguuagacuuugagcugaucaagacugaggccaagcagcccgccacccuucggaaauacugcaucgaggccaagcugaccaacacgacgaccgagagccggugccccacacagggggagccuucucugaaggaggaacaggacaagagauucgucugcaagcacagcaugguggaccgagggugggggaacgggugcgggcuguucggcaaaggcgggaucguaaccugcgcuauguucacguguaagaagaacauggaggggaagaucguacaacccgagaaccuggaguauaccaucgucgugacgccccacuccggggaggagcacgcggugggcaacgacacggggaagcacggccaggagaucaaagugaccccgcagaguagcaucaccgaggccgagcugaccggguacggcaccgucacgauggagugcucuccccggaccggccucgacuucaacgagaugguucugcuucaaauggagaacaaggccuggcucguccaccgacagugguuucuggaccugccccucccguggcugccgggggccgacaagcaggaguccaacuggauacaaaaggagacccuggucaccuuuaaaaacccccacgccaagaaacaagaugugguuguucuggggucgcaagaaggugcgaugcacacagcacugaccggagccacugagauccagaugucuuccgggaaucuccuguucaccggccaccugaagugccggcugcgcauggacaaacuccagcugaagggcaugagcuacaguaugugcacggggaaguuuaaggugguuaaggaaaucgccgagacacagcacggcaccaucgugauccgggugcaguacgaaggggacggcagcccuugcaagauacccuucgagaucauggaccuggagaagcgcuacgucuuaggccggcugaucaccgugaacccgaucgugacggagaaggacagucccgucaacaucgaggccgagccucccuucggugacagcuacaucaucaucggcgucgagcccgggcaacuaaagcugaacugguucaagaagggcaguagcaucggacagauguucgagaccaccaugcgcggcgcgaagcgcauggccauccugggcgacaccgccugggacuucgggucccuaggagggguguucacgagcaucggcaaggcccuccaucaggucuucggggccaucuacggcgcggccuucuccggcgugagcuggaccaugaagauccugaucggggugaucauaaccuggaucggcaugaacucucgauccacgucccugagcgucucccuggugcuaguggggaucgucacgcuguaccugggcgugauggugcaggccgauagcggcugcguuguguccuggaaaaacaaggagcucaagugcggcagcggaaucuucaucaccgacaacgugcauaccuggaccgagcaguacaaauuccagcccgagagucccagcaagcuggccagcgcgauacagaaggcacaggaggagggaaucugcggcauccgcuccgucacgcggcuggagaaccucauguggaagcaaauuacucccgagcugaaccauauccuggccgagaaugaggugaagcuaaccauuaugaccggcgacaucaagggcaucaugcaggccgggaagcgcagccugagaccccagcccacggaguugaaguacuccuggaagaccuggggcaaagcuaagaugcucucgaccgaguccuacaaccagaccuuccugauagacggccccgagacggcggagugcccgaacacuaaccgcgcuuggaacagccuagagguugaggacuacggguucggcgucuucaccacuaacaucuggcucaaguuaaaggagaagcaggaugccuucugugauuccaagcugaugagcgccgcgaucaaggacaaccgggcggugcacgccgacaugggguacuggauagaguccgcgcucaacgacaccuggaaaaucgagaaggccagcuucaucgaggugaagaacugccacuggcccaagagccauacccuguggagcaacgggguccuggaguccgaaaugaucauccccaagaaccucgcgggccccgugagccagcacaacuacagaccggguuaccauacucagauagcggggcccuggcaccuggggaaacuggagauggauuucgacuucugcgauggcaccacgguggucgugacggaggacugcgggaaccggggccccucccuccgcacuaccaccgcgagcggcaagcugaucacugaaugguguugucggagcugcacgcugcccccgcuccgcuaccgaggagaagacggcugcugguacgggauggagauccggccccugaaggagaaggaagaaaaccuggugaacucccucgucaccgccggccauggccagguugauaauuucucacugggcgugcuaggcauggcacucuucuuagaggagaugcugcggacccgcguugggacgaagcacgcgauccuccugguggccguuuccuucgucacccuaaucaccggcaacaugagcuucaaggaccucggucggguggugguaauggugggcgccaccaugacggacgacauugguaugggcguuaccuaccuggcacugcucgccgcguucaagguccgccccaccuucgcagcaggccugcugcuccggaagcugaccuccaaggagcugaugaugacgacgaucgggauugugcucuuaagccaguccgcgaucccagaaaccgugcuggagcucaccgacgcccuggcacugggcaugaugguccucaagauuguccgcaacauggagaaguaccaacuggccguuacgaucauggccauacuguguguaccaaacgccgugauccuccagaacgccuggaaagucagcugcaccauccuggcggugguguccgucucgccucugcuuuugacuuccagccagcagaaaacagacuggaucccguuggcacucacgaucaagggucugaacccuaccgccaucuuccugaccacccucucccgcacgaacaaaaagcgguccuggccgcugaacgaggccauuauggcggugggcauggugagcauacuggccagcucccuccugaagaacgacauccccaugaccggccccuugguggccgggggccuccugacugugugcuacgugcugaccggucguagcgccgacuuggagcuggaaagagccacggacgucaagugggaggaccaggcggagaucuccggcagcagcccaauccuguccaucaccaucagcgaggacgggaguaugagcauaaagaaugaagaggaggagcagaccuuaacaauccugauccgcacgggccugcuggugaucuccggccuguucccgaucucaauaccaaucacugccgccgccugguaucugugggaggugaagaaacagcgggccgggguccucugggacgugcccagcccgccgcccaugggcaaggcggagcuggaagacggggccuaccgcaucaagcagaagggcauccuaggcuacagccagaucggcgccggcguguauaaggaaggcacuuuccacaccauguggcacgucacccgaggcgccgugcucaugcacaaggggaagcggaucgaacccucgugggccgacgugaagaaagaccuuaucagcuacggcgggggcuggaaacuggagggugaguggaaagagggagaggaaguccaggugcuugcccuggagcccgggaagaacccgcgggcugugcagacaaagcccggacucuucaagaccaacacuggcaccaucggggcuguaucauuggacuuuagucccgggacguccgggucccccaucauugauaagaagggaaaaguggugggccuguacgggaauggcgucguaacccgcucaggcgccuaugugagcgccaucgcgcagaccgagaaaagcaucgaggacaaucccgaaauugaggacgacaucuuccggaagcgccggcugaccaucauggaccugcaccccggagccggcaagacgaagagguaccucccggccaucgucagagaggccaucaagagagggcugcggacccugaucuuagcgccgacccgcguggucgccgccgaaauggaggaggcccugcggggccugccaauccgcuaccagacccccgccauacgggcggagcauacggggcgcgagaucgucgaccucaugugccaugcaaccuucaccaugcgccugcugagucccgugcgggugccaaacuacaaccucaucaucauggacgaagcccacuucacggaucccgccuccauagccgcccgcggcuauaucagcacgcgggucgagaugggcgaagccgccgggaucuuuaugaccgcuacgccgccaggcagcagggauccguucccccagagcaacgcccccaucauugacgaggagcgggagauccccgagcgguccuggaacaguggacacgagugggugaccgauuucaagggcaagacgguaugguucguccccagcauaaaggcggggaacgacauagccgcgugccugcggaagaacggcaaaaaggugauccaacugucccgcaagacuuucgauagcgaguaugugaagacgagaaccaaugacugggacuucgucgugacuaccgauaucuccgagaugggcgccaacuucaaggcggaacgcgugaucgacccacggcgcugcaugaagccagucauccuuacagauggggaggagcgugugauccuggccggccccaugccuguaacccacagcuccgccgcccagaggcgggggaggaucggccggaaccccaagaaugagaacgaucaguacaucuacaugggggagccccuggagaacgacgaggacugugcccacuggaaagaggccaagaugcuccuggacaacaucaacacgcccgagggcaucaucccgaguauguucgagcccgagagagagaaagucgaugcaauugacggcgaguaccgucugcgcggggaggcccgcaagacuuuuguugaccucaugcggcgcggggaucugcccguuugguuagcauacaaggucgccgcggaggguaucaacuacgccgacaggcgcuggugcuucgacggcaucaagaacaaucagauuuuagaggagaacguggagguagaaaucuggaccaaggaaggggagcggaagaaguugaagccgcgauggcuggacgcccggaucuacuccgacccccucgcccugaaagaguucaaagaguucgccgccggacgcaagagccugacccucaaucuaauaacggaaauggggcgccugcccacauucaugacccagaagacacgcgacgccuuagacaaccuggccguacugcauacagcugaggccggcgggcgggcuuacaaccaugcccucuccgagcugcccgagacccuggagacccuccugcuacucacucuccuggccacgguuaccgggggaaucuuucucuuccugaugagcgggcgcgggaucggcaaaaugacccuggggaugugcugcaucaucaccgcguccauccucuugugguacgcgcagauccagccgcacuggauagccgccagcauaauccuggaauuuuuccucaucgugcuacugauccccgagcccgagaagcagcguacgccacaggauaaccaguuaacguauguagugaucgccauauuaaccgugguggccgccaccauggccaaugagaugggcuuccuggagaaaaccaagaaggacuuagggcuggguagcaucgccacucagcaaccagagagcaacauccuggacaucgaccuccgccccgcauccgccuggacccuauaugcgguggccaccaccuucgucacgccaaugcugcggcacagcauagagaacagcuccgugaacgugucgcucacugccaucgcgaaccaggccacgguccugaugggccuggggaagggguggccccucaguaagauggacaucggagugccgcuacuggcaaucggcuguuauagccaggugaaccccauaacccugacggccgcccuucuguugcuggucgcccacuacgcgaucaucgggccuggccuccaagccaaggccacccgcgaggcacagaaacgugccgcggcuggcaucaugaaaaaccccaccguggacgggaucaccgugaucgaccucgacccgauucccuacgacccaaaguucgagaaacagcugggccaggucaugcugcucauccuaugcgugacccaggugcugaugaugcgaaccaccugggcccucugcgaggcccugacccuggcgacgggacccaucuccacccucugggagggaaaccccggacgguucuggaacaccaccaucgcggucagcauggccaacaucuuccgcggguccuaccucgccggggccgggcuccucuucagcaucaugaagaacacgacuaacacccggcgaggaaccgggaacaugggcgagacgcugggcgagaaguggaaguccaggcuaaaugcccucgguaaguccgaguuccagaucuacaagaaaagcggcauccaggagguggaccggacccuggcgaaggaggggaucaagcgcggcgagaccgaccaccacgccgugagcagaggguccgcuaagcugcgcugguucgucgagcggaacauggugaccccggagggcaagguggucgaccucggaugugggaggggaggguggucuuacuacugcggcgggcugaagaacguucgggagguaaaaggccugacgaagggagggcccggccacgaggagcccaucccgauguccaccuauggguggaaccucguccgccugcagagcgggguggacguguucuucauaccacccgagaagugcgacacccugcucugugacaucggggaguccagccccaacccgaccgucgaagccggccggacucugcggguccugaaccugguggagaacuggcugaacaauaacacccaguucugcaucaagguacugaaccccuacaugccauccgugaucgagaagauggaagcguuacaacggaaguacggcggggcgcucgugcgcaacccacugagccggaauagcacacacgagauguauugggucuccaacgccagcgggaauauagucuccagugugaacaugaucucucggaugcugaucaaccgguucaccaugcgccacaagaaggccaccuaugagcccgacgucgaccucgggagcggcacucggaacaucgggaucgaguccgagauccccaaccuagacaucaucggcaagcgcaucgagaagaucaagcaagagcacgagaccagcuggcacuacgaccaggaccaccccuacaagaccugggccuaucacgguaguuacgagacaaagcagacugggagcgcuuccuccauggugaacggcguggucaggcugcucaccaagccgugggacgugcugcccaccgugacccaaauggcaaugacagacaccaccccguucgggcaacagcgcgucuucaaggagaaggucgacacccgcacgcaagagccaaaggagggcacaaagaagcugaugaagauuacggccgaguggcucuggaaggaacugggcaagaagaagaccccgcggaugugcacgcgugaagaguucacccggaagguuagauccaacgccgcccugggugcgaucuucaccgaugagaacaaguggaagucagcccgggaagccguugaggacucccgcuucugggagcuaguggacaaggagcggaaccugcaccuggagggcaagugcgagaccugcgucuacaacaugaugggaaaacgcgagaaaaagcucggcgaguucgggaaggccaaggggagccgggccaucugguacauguggcugggcgcgcgcuuccuggaguucgaagcccuuggguuccugaaugaggaccacugguucucccgggagaacagccuguccggcguagaaggagagggccuccacaagcugggguacauccugcgcgacgugagcaagaaggagggcggugcuauguacgccgacgacacggcggggugggauacccggaucacgcucgaagaucugaagaacgaggagauggugaccaaccacauggaaggcgagcacaagaagcuggccgaggcgauauucaaacucacguaccagaacaagguggucagggugcagagacccacgccccgggggacaguuauggauauaaucagccggcgcgaccagcgggguuccggccagguggggaccuacggccugaauacauucacaaacauggaagcccagcugauccgucaaauggagggggagggcgucuucaagaacauccagcaccucaccgugaccgaggaagucgccgucaagaacuggcuggcgcggguggggcgugagcgccuguccagaauggccaucaguggcgacgacugcgugguaaagccucucgacgaccgcuucgcaaaugcccugacugcccugaacgacaugggcaagauccggaaggacauccagcagugggagccgagcaaggguuggaacgacuggacccaggugcccuuuugcucccaccacuuccacgagcucauuaugaaggacggccgcgugcuagucgugcccugccggaaucaggacgagcugaucgggcgcgcgcggaucagccagggugccggguggucccucagggagacagccugccugggcaagucguacgcccagaugugguccuuaauguacuuccacagacgcgaccuccggcuggccgcaaacgccauaugcagcgccgugccuucccacugggugccgaccagccguacgaccuggaguauucacgccaagcacgaguggaugaccacggaggacaugcugaccguguggaaccggguguggauccgcgagaaucccuggauggaggacaagacgcccgucgagagcugggaggagauacccuaccucgggaagcgggaggaccagugguguggcucccuuaucggccugaccagucgagccacuugggcgaagaacauccaagccgccaucaaccagguacggucccucaucgggaacgaggaguacgccgacuauaugccuagcaugaagcgcuuccggcgcgaggaggaggaggcgggcgugcugugguga

SEQ ID NO: 25307 - RNA, 9876 nt, Artificial Sequence
  derived and/or modified CDS sequence (opt11) from DENV-2__EU569721__SS-prME
agugcggggaugaucauaaugcugauccccaccgugauggccuuucaccuuacaacccgcaacggggagccccacaugaucgucgggauacaagaaaaggggaaguccuuauuguuuaagaccgaagauggaguuaacaugugcacccuaauggcgauggaccugggggagcugugcgaggacaccaucaccuauaagugcccccucuugcggcagaacgaaccggaggacaucgacuguugguguaacagcaccagcaccugggugacuuacgggacgugcaccaccaccggcgagcaccggcgagaaaagcgcagcguagcccuggugccccacguugggaugggccucgaaaccaggaccgagaccuggaugaguagcgagggggcguggaagcacgcccagcgcaucgagaccuggauacuucggcacccagguuucacgaucauggccgcuauucuggccuacaccaucgggacaacccacuuccagcgcguccugaucuucauccugcugacggccguggcgcccuccaugacaaugcgguguauaggcaucagcaaucgcgacuucguggagggcgucuccgguggcucuuggguggacaucguucucgagcacggguccugugucaccaccauggcgaaaaauaagcccacgcuggacuucgagcugaucaagaccgaggcaaaacagcccgccacucuccggaaguacugcauugaggccaagcugacuaacacgaccaccgagagcagauguccgacccagggcgaacccucccugaaggaggagcaagacaagcgguucgucugcaagcacagcaugguggaccgcggcugggggaacggaugcggacuguucggaaagggcgguauagucacuugcgcuauguucacaugcaagaagaacauggagggcaagaucgugcagcccgaaaacuuagaguacaccauuguugucacgccgcacagcggggaggagcacgcaguuggcaacgacaccgggaaacacggccaagagaucaaggugaccccgcagagcuccaucaccgaggcagaguugaccggguauggcaccgucacgauggaguguuccccgcggaccggccucgacuucaacgagauggugcugcugcagauggagaacaaggccuggcucgugcaccgccagugguuccucgaccugccccuccccugguuaccgggggccgacaagcaggaauccaauuggauccagaaggaaacccuggucacauucaaaaacccucacgcgaagaagcaggacguggucgugcucggcagccaggagggggcgaugcacaccgccuugaccggggccaccgagauccagaugagcuccgggaaccugcucuucaccggccaccugaagugccggcugcgcauggacaagcuccaacugaaaggcaugagcuacuccauguguacggggaaguuuaaggugguuaaagagaucgccgagacucagcacgguaccaucgugauccgggugcaguaugagggggacggcagccccugcaagauccccuucgagauuauggaccuggagaagcgcuacguccuaggccgucugaucaccgugaacccgauagucacggagaaggacucccccgucaauauagaggccgagccacccuucggggacagcuacaucaucaucggcguggagccgggacagcugaagcucaacugguuuaagaagggcaguagcauugggcagauguucgagaccacgaugcgcggcgcgaaacggauggccaucuugggcgacacugccugggacuuugggucacugggagggguguucacgagcaucggcaaggcacugcaccagguuuucggggccaucuacggcgcggccuuuuccggcgugucauggacaaugaagauccugaucggggugaucauuaccuggaucggcaugaacucccggagcaccucccugagcgucucgcugguucucguggggauuguuacguuguaccugggggugaugguccaggcggacagcgggugcgucguguccuggaaaaauaaagaguugaagugcgguagcggaaucuuuauuaccgacaacguacauacguggaccgagcaguacaaguuccagcccgagucacccaguaaacuggccucugcgauccagaaggcccaggaggagggcaucugcggcauccgcuccgucacgcggcuggaaaaucucauguggaagcagaucacccccgagcugaaucacauccuggccgaaaacgaggugaaacucaccauaaugaccggggacaucaagggcaucaugcaggccgggaaacgcagccugcggccgcagcccacggagcugaaguacuccuggaagaccuggggcaaagccaagaugcuaucuaccgagagcuacaaucagaccuuccugaucgacggcccggagacggcugagugcccgaacacgaaccgcgccuggaauagccuggagguggaggacuacggguucggcgucuucaccaccaacaucuggcucaaacugaaagagaagcaggaugccuuuugcgacaguaagcucaugucagccgccaucaaagacaaccgggcggugcacgcugacaugggguacuggaucgagucugcccugaacgacacguggaagauugagaaggcaagcuucaucgagguuaagaacugccacuggcccaaaucccauacccuguggucaaacggcguccuggagucugaaaugauuaucccaaagaaucucgccggaccgguuagccaacacaacuaccgcccgggguaccauacccagaucgcaggccccuggcacuuggggaaguuagagauggacuucgacuucugcgacggcacaaccgugaucgucacggaggacugcgggaacagaggacccucccuccgcaccaccaccgccucgggaaagcugaucacagaguggugcugucgcagcuguacccugccgccgcuccgcuaccgcggggaggacgggugcugguacgguauggagauuagaccccugaaggagaaggaggagaaccuggugaacucccucgugacugccggccacggucagguggacaacuucucucugggggugcugggcauggcccucuuccucgaggagauguugagaacccgcguugggacgaagcacgcgauccuccuggucgccguguccuuugugacccugauaaccggcaacaugagcuucaaagaccucgggcggguaguggugauggucggcgccacuauggccgacgauauagggaugggcgugacguaucuggcucuguuagcagcauucaaggugcgaccgaccuucgccgccggacugcugcuccggaagcugaccuccaaggagcugaugaugaccacgauagggauuguauuacucagccaguccacaauacccgagaccguccuggagcucaccgacgccuuggcgcuagguaugaugguacucaagauagucaggaauauggagaaguaccagcuggccgugaccaucauggccauccugugcgucccuaacgccgugauccuccagaaugcauggaaggucagcugcaccauccuggcggucguuucagucagcccccugcuccugaccuccagccagcagaagaccgacuggauuccccuggcgcucaccaucaaggggcugaaccccaccgccauuuuccugacgacccucucucgcaccaacaagaagcggagcuggccacugaacgaggcaaucauggcgguuggcaugguguccauacuggccagcucccuccugaagaacgacauucccaugaccggcccccugguggccgggggccuccugaccgugugcuacgugcugaccggucgcagcgcagaccucgagcuggagcgagccacggauguuaagugggaggaccaggcggagaucuccggcuccucgcccaucuuguccaucacuaucagcgaggacggguccaugagcaucaaaaacgaagaggaggaacaaacccucaccauccugauccgcacgggucuacuagucauauccggccuguucccgauaagcauccccaucaccgccgcggccugguaccugugggagguuaagaagcagcgagccggggugcugugggacguccccagcccccugccgaugggcaaggcggaacuagaggacggggccuacagaaucaagcagaagggcauccugggguauagccaaaucggggccgggguguacaaagaggggacuuuccacaccauguggcacgugacgcggggagccguccugaugcacaaggggaagcgcaucgagccuuccugggccgacgugaagaaagaccugaucucuuauggagggggcuggaagcuugagggcgaguggaaggaaggggaggagguacagguccuggcgcuggagcccggcaagaauccgcgggccgugcagacgaagcccggccucuucaagaccaacacaggcacuaucggggcagugucgcuggacuucucccccggcacguccggcagccccauuaucgauaagaaggggaaagucguggggcuguacgggaacggagugguaacccgcuccggcgccuacgugagcgccaucgcgcagaccgagaaguccaucgaggacaacccugagaucgaggacgacaucuuccguaaaaagcgucugaccaucauggaucuccacccaggugcaggaaagacgaagcgauaccugcccgcuaucgugcgcgaggccaucaagagggggcuucgcacccucauccuggcucccacccgagucguggcugccgaaauggaggaggcucugcgcgguuuaccgauccgguaccagacccccgccauccgcgccgagcacacagggcgggagaucguggaccugaugugccacgccaccuucacuaugcgccugcucagccccguucgcgugcccaacuauaacuugaucaucauggacgaagcacauuucaccgaccccgccuccaucgccgcgcggggcuacaucucaacucgcguggagaugggcgaggccgccggcauauucaugaccgccacgccgcccgguagccgggacccuuuuccucaguccaacgcucccaucauugacgaggagcgcgagauccccgagcggagcuggaacucugggcacgagugggugaccgacuucaagggcaagaccgugugguucguaccauccaucaaggcggggaacgacaucgccgccugccugcgcaagaacggcaaaaaggucauacagcucucacggaagaccuucgacuccgaauacgugaagacgcgcaccaaugacugggacuucguggucacgaccgauaucuccgagaugggcgccaacuucaaggcugaacgggugaucgauccccgccgcugcaugaagcccgugauucugacggauggggaggagcgcgucauccuagccggccccaugccgguuacucacagcuccgcagcccagcggcgagggcggaucggccggaacccaaagaacgagaacgaccaguacaucuauaugggcgagccacucgagaaugacgaggacugcgcccauuggaaagaggcgaagaugcugcuggacaacaucaacacgcccgagggaaucauccccagcauguuugaaccggagcgugagaaaguggacgccaucgacggcgaguaccgccuccgcggggaggcacggaagaccuucgucgaccugaugcgcagaggcgacuuacccguguggcuugccuacaagguugccgcggaagggaucaacuacgcagacagacgguggugcuuugacgggaucaagaacaaucaaauccuggaggagaauguagagguggagaucuggaccaaagagggggaacgcaaaaagcugaagccccgauggcucgacgcaaggaucuacuccgacccgcuggcgcuaaaggaguucaaggaguucgcagcaggccggaagucccucacccugaaucucaucacggagauggggcgccuccccaccuucaugacccagaagacccgggacgcccucgacaaucuggccguccuccacacggcggaggccggugggcgagcguacaaccacgcccugagcgagcugccugagacacuagaaacccugcugcuccuuacccugcucgccacggugaccgggggcauuuuccuguuccugaugagcgggcgggggauuggcaagaugacccucgggaugugcugcauaauaacugccuccauccuucugugguacgcgcaaauccagccgcacuggaucgcggcgagcaucauauuggaauucuuccugauugugcugcucaucccggaacccgaaaagcagcgcacuccccaggauaaucagcugacguacguuguuaucgccauccuuaccguggucgccgcgaccauggccaacgagaugggcuuucucgagaagaccaaaaaggaccuggggcugggcuccaucgccacccaacagcccgagagcaacauccucgauaucgaccugaggccggccuccgccuggacucuguacgcgguggcuaccacuuucgugacccccaugcuccgccacagcaucgagaauagcagugucaacgugagccuaacagccauagccaaccaggccaccgugcugaugggguuggguaagggcuggccccuguccaagauggacaucgggguccccuugcucgcgauaggcugcuacagccaagugaacccaaucacgcugacggccgcacuccuccugcugguggcccacuaugcaauaauugggcccggccuccaagccaaggccacccgggaagcccagaagcgcgccgcagcuggcaucaugaagaacccaacggucgacggaaucacugugaucgaucuggauccaauuccguacgaccccaaguucgagaaacaacugggacaagugaugcuccugauccugugcgucacacagguccuuaugaugaggacaaccugggcccugugcgaggcccugacccuagccacggggcccaucuccaccuuaugggagggcaaucccgggcgcuuuuggaacaccaccaucgcgguuagcauggccaauaucuuccguggcuccuacuuagccggagccgggcuccuguucagcaucaugaagaacacgaccaacacccgccggggcaccgggaacaugggcgagacgcugggcgagaaguggaagucccgacucaacgcccugggcaaauccgaauuccaaaucuacaagaaauccggcauccaggaggucgaccgcaccuuagcgaaggaagggauaaagcggggcgagaccgaccaccacgccguuagcaggggguccgcgaagcuccgcugguucguggagcgcaauaugguuaccccagagggcaaagugguggaccugggcugcggacggggcgggugguccuacuacugcggcgggcuaaaaaacguccgcgaggucaagggucucacuaagggcgggcccggccacgaggagcccauccccauguccaccuacggguggaaccuugugcggcugcagagcggcgucgacguguucuucaucccgcccgagaagugcgacacccuccugugcgacaucggagaauccucacccaaccccaccguggaggcggggcgcacacugcggguccucaaccugguggagaauugguugaacaacaacacccaguucugcauaaaggugcugaacccguauaugcccuccgucauagagaaaauggaggcgcuccagcgcaaguacggcggggcacuggugcguaacccucugagcagaaacagcacccacgagauguacugggugucuaacgccagcggcaacaucguuuccucagugaacaugauuucccggaugcuuauuaaccgcuuuacaaugcggcacaaaaaggccaccuacgagccggauguggaccuuggaucgggcacgcgcaauaucgggauagagagcgagacccccaaccuggacaucaucgguaaaagaaucgagaagaucaaacaggagcacgagaccagcuggcauuacgaucaggaucacccguacaagaccugggcauaccacggcuccuacgaaacgaagcagaccggaagcgcguccucuauggucaacgguguggugcgccuccugaccaagccuugggacguccugccgacagugacgcagauggccaugaccgacaccacccccuucgggcagcagaggguguucaaggagaaggucgacacgcgcacccaggagcccaaggagggcaccaagaaacucaugaaaaucaccgccgaguggcuguggaaggagcuaggcaagaaaaagacaccucgcaugugcacccgggaggaguucacgcgcaaggugcgguccaacgcugcccugggggcgaucuucacggacgagaauaaguggaaauccgcacgcgaagccguggaggacucccgguucugggaauuaguagacaaggagcgcaaccugcaccucgagggcaagugcgaaacgugcguguauaauaugauggggaagcgggagaagaaacugggggaguucggaaaagccaagggcagccgcgccaucugguacauguggcugggcgcgagguucuuagaguucgaggcgcugggguuccugaaugaggaccacugguucucccgagagaauucgcucuccggcgucgagggggagggccugcauaaauuaggguacauccuccgggacgugucuaagaaggagggcggcgcaauguacgccgacgacaccgccgggugggacacccgcaucacccuggaggacuuaaagaacgaggagauggugaccaaccacauggagggcgagcacaagaaguuagcagaggccaucuucaaacuuacuuaccaaaacaaggucgugcggguccaacgccccaccccccggggcaccgucauggacaucaucagccgccgugaucagcggggcagcggccagguggggacguacggccugaacaccuucaccaacauggaggcccagcucauccggcagauggagggggagggcguguucaaaaacauccagcaucugaccgucacugaggagguggccguucaaaacuggcuugcgcgugucgggcgggaacgccucagccgcauggcuaucuccggugacgacugcguuguaaagccccuggacgaccgguucgccaacgcgcugaccgcccucaacgacaugggcaagauccgcaaggacauccagcagugggagcccaguaagggguggaacgacuggacccaagucccguucugcucccaccacuuucacgaauugauuaugaaggacggccggguacuggugguccccugccguaaccaggaugagcucaucgggcgggcucgcaucagccagggugccggguggucacugcgggagacggccugccuuggcaagagcuaugcccagauguggucccucauguacuuccaccgccgggaccugcgccuggccgcgaacgcgauuugcucagcugugcccucccacugggucccuacgagccggaccaccugguccauccacgccaagcacgaauggaugaccaccgaggacaugcucacgguuuggaaccgcguguggauccgggagaacccauggauggaggacaaaaccccgguggagagcugggaggagauacccuaccugggcaagcgggaggaccaauggugcgguucccugaucggcuuaacaucccgggcuaccugggcgaagaacauccaggccgccaucaaccaaguccgaucccugaucgggaacgaggaguacacggauuacaugccuagcaugaagcgguuccgccgggaggaagaggaggccggcgugcugugguga

SEQ ID NO: 25308 - RNA, 9876 nt, Artificial Sequence
  derived and/or modified CDS sequence (opt11) from DENV-2__EU482451__SS-prME
agcgcaggcaugaucaucaugcugaucccuaccgugauggcuuuucaccucaccacucggaacggggaaccccacaugaucguaggcauacaggagaagggcaagagucugcuguucaagaccgaggacggcgucaacauguguacacucauggcgauggaccucggcgagcuaugcgaggacaccaucacguacaagugcccccuccugcggcaaaacgagcccgaggauaucgacuguuggugcaacagcaccagcacgugggugaccuacgggaccugcaccaccaccggugagcaucggagagagaagcgguccgucgcccucgugccccacguggggaugggccuugaaacccggaccgagacguggauguccucagagggcgccuggaaacacgcccagcgcauugagaccuggaucuugcggcacccugguuucaccaucauggccgcgaucuuagccuacaccaucggaaccacccacuuccagcggguccucauauucaucuugcucacggcaguagcacccuccaugaccaugcggugcauuggcauuagcaaucgugacuucguggagggcgucuccggggguagcuggguggacaucguucuagaacacggguccugcgugacuacaauggcgaagaacaagcccacucuggacuucgaauuaauaaagaccgaggccaagcagccagccacccuccgaaaguacugcauagaggccaagcuuaccaauacgaccacggagucccgaugcccaacccagggcgaaccgucccuaaaggaggagcaggacaagcgguuugucuguaagcacucaaugguggaucgcggcugggggaacggcugugggcuguucggcaagggcgggaucgucaccugcgccauguucacaugcaagaagaacauggaaggaaagauaguccagcccgagaaccuggaguacaccaucguaguuacgccccacucuggggaagagcacgcggugggcaacgacacgggaaagcacggaaaagagaucaaggugacuccgcagagcucgaucacgggggccgagcugacuggcuacggcacggucacgauggaguguagcccccggacugggcucgauuucaaugaaaugguucugcugcagauggagaacaaggccuggcucgugcaccgccagugguuccuggaccugccccucccauggcugccaggugcugauaagcaggaguccaacuggauacagaaggagacccuggucaccuucaagaacccccacgcaaagaagcaggacguggucgugcucgggagccaggagggcgcgaugcacacugcccugaccggggccacagagauccagaugagcuccggcaaccuccuguucaccggucaccugaagugucgguugcguauggacaagcuccagcugaaggggaugagcuacaguaugugcaccgggaaauuuaaagugguaaaagaaaucgccgagacacagcacggcacaaucgucauuagaguccaguacgagggcgacggcagccccugcaagauccccuucgagauuauggaucuggaaaaaagguacguccucgggcggcuaauuacugugaacccgaucgugacggaaaaggauuccccagucaacauugaggccgagccccccuucggcgauaguuauaucaucaucgguguugagccgggccagcuaaaguuaaacugguuuaagaaaggguccagcaucggccagauguucgaaaccacaaugcgcggagcgaaacgcauggcaauuuugggggacaccgcaugggacuucgggucccuaggcgggguguucacauccaucgggaaggcccugcaucaggucuucggagccaucuacggagcggccuucuccgggguuagcuggaccaugaagauccucaucggggugaucauuacuuggaucgguaugaauucccggagcaccucccugucaguaucccucguucucguaggaaucgucacucuguaucugggagucauggugcaggccgacagcggcugcgucgugucguggaagaacaaggagcuuaagugcggcagcggcaucuucgugacggacaacguccacaccuggacugaacaguauaaguuccagcccgagagccccaguaagcuggccagcgcgauucagaaggcccaggaggaaggcauaugcgggauucgcuccguaacccgacuggaaaaccucauguggaagcagaucacccccgagcugaaccacauccuggccgagaaugagguuaagcugaccaucaugaccggcgacauaaaggggaucaugcaggccggcaaacgcagccugcggccacagccgacggagcugaaguacuccuggaagaccuggggaaaggccaagaugcucaguaccgaguccuacaaccagacauuccugauugacgggccugagacugcggaguguccgaacaccaauagggccuggaacagccuggaggucgaggacuacggcuuugguguguuuaccacaaacaucuggcucaagcugaaggaaaagcaggacgccuucugcgacuccaagcugaugagcgcagcaaucaaggacaaucgggcggugcaugccgacaugggcuacuggauagaguccgccuuaaacgacacguggaagaucgagaaggccagcuucaucgagguaaagaacugccauuggcccaagagucacacccuguggaguaacggcgugcucgaguccgagaugauuaucccaaaaaaucucgccgggcccguaagccagcacaacuacagaccgggcuaccacacacagaucgccgggcccuggcaccugggcaagcuugagauggacuuugauuucugcgaugggaccaccgucaucgugacggaggacugcggcaaccggggccccagccuccgcaccaccaccgccagcgggaagcugaucacggaguggugcugccggaguugcacacugccaccucuccgcuaccggggagaagacgggugcugguacggcauggagauccgcccccuaaaggagaaggaggagaaccuggugaacucccuggucacugcaggccacggccagguggauaacuucucgcuggggguccugggcauggcacucuuucuggaagagauguugcggacgcgcgugggcacuaagcaugcgauccuccugguggccgugucguucgucacccuaaucacggguaacaugagcuucaaggaccucggccgggugguggucauggugggagcuaccauggccgacgacaucgguaugggcgugaccuaucuggcgcugcucgcggccuucaagguccgccccacguucgccgccgggcuucugcuccggaaacugaccuccaaggaacuaaugaugacaacgaucggaaucgugcuccugagccaauccacaauuccggagacgguucuggagcugaccgacgcgcuggcgcucgggaugaugguccucaaaaucgugagaaacauggagaaauaucagcuggcagucacgauaauggccauccugugcguaccgaacgccgugauauugcagaacgccuggaaggucucaugcaccauccuugcgguggugagcgucuccccccugcuccugaccucuucccagcagaagaccgacuggauccccuuagcccuaacgaucaagggucugaaccccacagcuaucuuucucacuaccuugucgcggacgaacaagaagcggagcuggccacugaacgaagccaucauggcggugggcaugguauccauccuggcaagcucccugcuaaaaaacgacauacccaugaccgggccccuagucgcaggcgggcucuugacugugugcuacgugcugaccggccgaagcgccgaccucgaguuagagcgcgccacggacgucaagugggaggaccaagcggagaucuccgggagcagccccauccuguccaucaccaucagcgaggacggauccaugucaauaaagaacgaggaggaagagcagacccuuaccauccugauccgaacuggccugcucguuaucuccgggcuguucccgaucagcauccccaucaccgccgccgccugguaccuaugggaagugaagaagcaacgggcuggcgugcucugggaugugcccuccccgccgcccauggggaaagccgagcuagaggacggcgccuaucgcauaaagcagaaaggcauccugggauauucccaaaucggggccgggguguacaaggaggggacuuuccacaccauguggcacgucacccgcggggcgguacucaugcacaagggcaagcgcauagaaccauccugggccgaugugaagaaggaccugaucagcuauggaggcggcuggaagcuggagggggaguggaaggagggcgaggagguccaggugcucgcgcuugagccugggaagaacccccgggccguucagacgaagccggggcuguucaagacauccacugggacgaucggcgccgucucucucgauuuuagcccgggcaccagcgggucacccaucaucgauaagaagggcaaagugguagggcuguauggcaacggggucgugacccgcagcggggccuacguguccgccaucgcgcaaaccgagaaguccaucgaagacaaccccgagaucgaggaugacauuuucagaaagcgccggcugaccauaauggaccugcaccccggggccgguaagaccaagcgcuaccucccggcuaucguuagagaggccaucaagcggggccugcggacccuuauccucgcgccgacacgcguuguggcagcggagauggaggaggcgcugcgggggcugcccauccgcuaccaaaccccugcaauccgggcugagcacacgggcagggagaucguugaucucaugugccacgccaccuucaccaugcgccugcuguccccugugcgggugccgaacuacaaccucaucaucauggacgaagcccauuucacggaucccgccucaaucgccgcacgcggcuacauaagcacacgggucgagaugggcgaggcugccggcaucuucaugaccgcuacaccgcccgggucccgcgacccauucccacagagcaacgcccccaucaucgacgaggagcgggagauccccgaacgcuccuggaacuccggacacgaaugggugacugacuucaagggaaaaacgguuugguuuguaccguccaucaaggcaggcaacgacaucgcagcuugccugcggaagaacgggaagaaggugauccaacugagccgcaaaaccuucgacagugaguacguuaagacuaagacgaacgacugggacuucgucgugacgacggacaucucagagaugggcgccaacuucaaggcggagcgcgugaucgacccacgccguugcaugaagcccgucauccucaccgacggcgaggagcgcguuauccuagccgggcccaugccagugacccacuccucugccgcgcagcggcguggacggaucggacgcaaccccaagaaugagaacgaccaguauaucuauaugggagaaccucuggagaacgacgaggacugcgcgcauuggaaggaagcgaagaugcuccuagacaacaucaacacgcccgagggcaucaucccguccauguuugagcccgagcgggagaaggucgaugccauagacggggaguaccgccugaggggcgaggcgcgaaagaccuuuguggaucucaugcgccgcggggaccuacccguguggcuggccuauaaggucgccgcggaaggaaucaacuacgcugaucgucgguggugcuuugacgggaucaaaaacaaccagauucucgaggagaacguggaggucgagauauggaccaaggagggcgagcgaaagaagcucaagccgcgguggcuggacgcgaggaucuacagcgacccccucgcccugaaggaguucaaggaguucgcugcuggacggaagucccugacccucaaccugaucacggagaugggucgccugccaaccuucaugacccagaagacccgggaugccuuggacaaccuugcagugcugcacacggccgaggcgggcgggcgcgccuacaaucacgcccucagcgagcuucccgagacguuagaaacccucuuacuacucacccugcuggcuacugugacaggcggaauauuccuguuuuuaauguccgggcggggcaucgggaagaugacccugggcaugugcugcaucauaaccgccucgauccuccugugguaugcgcagauucagccacacuggauagccgccuccaucauacucgaguucuucuuaaucguacugcugauccccgaacccgagaagcagcgcacaccacaggacaaccagcucacuuacguggugaucgccauccugaccgucguggccgcgaccauggccaacgagaugggguuucuggaaaagaccaagaaggaucucgggcuuggcagcaucgccacucagcagccagaauccaacauccuggauaucgaccucaggcccgcaagcgccuggacccuguacgccgucgcaaccacuuucgucacgcccaugcuucggcacagcaucgagaacucaagcguaaauguaagccucacagccaucgccaaccaggccacuguccugaugggccugggcaaggguuggccccucagcaagauggauaucggcgugccgcugcuggcgaucggguguuauucacaggucaaucccaucacccucacggccgcccugcuccuccuggucgcccacuacgcgaucaucggccccggccugcaagcaaaggccacacgugaagcgcagaagcgcgccgcagcugggauuaugaagaacccuaccgucgacggcauuaccguuaucgaccucgaucccauccccuacgacccuaaauucgagaagcagcuggggcaagucaugcugcucauccuaugcgugacccagguucugaugaugcggacaacuugggcucucugcgaggcccuaacgcuggcaacgggucccaucuccacgcucugggaggggaacccgggccgcuuuuggaacacgaccaucgcggucuccauggccaauauuuuucgcggcagcuaccuggccggggccggacuccuguucuccaucaugaagaacacgaccaacacucgcagggggacggggaauaucggcgagacgcugggggagaaguggaagagccgccugaacgcccuaggaaaguccgaguuucagaccuacaagaagucggguauccaggagguggaccgaacacuggcgaaggagggcaucaagcgcggggagaccgaccaucacgccguaucccgaggcagcgcaaagcugcggugguucgucgagcgcaacauggugacgccugaaggcaagguggucgaccuuggaugcggacgcggaggcugguccuacuacugcgguggacugaagaacgugcgcgaggucaagggucugaccaagggcggcccugggcacgaggagcccaucccgauguccaccuauggcuggaaccucguccggcugcaauccggcguggauguauucuucaucccgccggagaagugcgacacacugcucugcgacauuggcgagagcucccccaacccgacaguagaagccggccgcacccugcgagugcugaaccuaguggagaauuggcugaacaacaacacccaguucugcauaaagguccugaauccguacaugcccagcgugaucgagaagauggaggcgcuccaacgcaaguacggcggcgcccucgugaggaacccgcuguccaggaacucaacccacgaaauguacugggucaguaacgccuccgggaauauuguaagcucugugaauaugauuagccggaugcugaucaacagguucaccaugcgacacaagaaggccacguacgagccugaugucgaccucggcuccgggacccgcaacaucggcaacgagagcgagauccccaaucuggacaucaucggcaagcggaucgagaaaaucaaacaggagcacgagaccuccuggcacuacgaccaggaccacccguacaagaccugggcauaccacgggagcuacgagacgaaacaaaccggcuccgcgucgagcauggugaacggcgugguccgccuguugacuaagccgugggacgugcugccgaccgugacgcagauggcuaugaccgacaccacucccuucggccagcagcgggucuucaaggagaagguagauacgcgcacccaggagcccaaggagggcaccaagaagcucaugaagauaaccgcagaauggcucuggaaggagcuggggaagaagaagacgccccgcauguguacgcgggaggaguucacgcgcaaggugcgcagcaacgcugcccugggcgcgaucuucaccgaugagaacaaguggaaaucagccagagaggccgucgaggacagccgguucugggagcucguggacaaggagcggaaucuacaccuggaggggaagugcgagacuugugucuacaacaugaugggcaagcgggagaagaagcucggcgaguucgggaaggcgaaaggcucccgcgccauuugguacaugugguugggggcgcgguuccuggaguucgaggccuuaggguuccugaacgaggaccauugguuuagccgcgagaacucccuaagcgggguggagggcgaggggcuucauaagcuaggcuacauucuucgggacgucagcaagaaagagggcggcgccauguacgccgacgacaccgcuggcugggacacccgcaucacgcucgaggacuugaagaacgaggaaauggucaccaaccacauggagggggagcacaaaaaacuggccgaggccauuuucaagcuuaccuaccaaaacaagguaguucggguccaacgccccacaccacggggcaccgucauggacaucaucucccgccgggaccagcgggggagcggccaggugggcacauacgggcuuaacaccuuuaccaacauggaggcacagcugauccggcagauggagggcgagggagucuucaagaacauccagcaccucaccgugacggaggagguggcaguccagaacuggcuggcgagaguaggccgggagcgccugucccgcauggcaauaagcggagaugacugcguggucaagcccuuggacgaucgguuugcaaacgcccugacagccuuaaacgacauggggaagauucgcaaggacauucagcagugggagccguccaaaggauggaacgacuggacccaggugcccuucugcagccaccauuuccacgaguuaauaaugaaggacgggcgugugcuagugguccccugccgcaaccaggacgagcugaucgggcgggcacgcaucucccagggggccgguuggagucuacgggagaccgccugccuggggaaguccuacgcgcaaauguggagccugauguacuuccaccgucgggaccuccgccuggccgcgaaugccaucuguucagcugugccgagccacugggucccgaccagucggacgaccuggagcauccaugccaagcacgaguggaugaccacagaggacaugcugacgguuuggaacagaguguggauccgggagaaccccuggauggaggacaaaacccccgucgaguccugggaggaaauuccguaccucgggaagcgcgaggaucaauggugcggcucccugauuggucugacgagccgggcuaccugggcgaagaauauucaagucgccaucaaccaggugcgcagccucauuggcaaugaagaauacacggauuacaugccgagcaugaagcgguuccgccgggaagaggaggaggcggggguccugugguga

SEQ ID NO: 25309 - RNA, 9876 nt, Artificial Sequence
  derived and/or modified CDS sequence (opt11) from DENV-2__EU660413__SS-prME
agcgcgggcaugaucauuaugcugauccccaccgugauggcguuccaccugacaacccggaacggggagccccacaugaucgugggcauccaggagaagggcaagucgcugcuguuuaagacagaggacggcgugaacaugugcacccuuauggcgauggaccugggggaguugugugaggacaccauaaccuacaagugcccccuucugcggcagaacgagcccgaggauaucgauugcugguguaauaguaccaguaccugggugaccuacgggaccugcacgaccaccggcgagcacagacgggagaaacggagcguggcccugguaccucacguggggaugggccucgagacgcggaccgagacauggauguccagcgagggggcuuggaaacacgcccagcgcaucgagaccuggauuuuacggcauccgggcuucacgaucauggccgcgauccuggccuacaccaucgggaccacgcauuuccagcgcguacucauuuucauccugcugacggccguugccccuuccaugacaaugcggugcaucgggaucagcaaccgggacuucguggagggcgucuccgggggaagcuggguggauaucgugcucgagcacggcuccugcgucacgaccauggcgaagaacaagcccacgcuggacuucgagcugauuaagacugaagccaagcagcccgccacgcuccggaaguacuguaucgaggccaaauugaccaacacgaccaccgagucucgcugucccacccagggcgagcccucccugaaggaagagcaggacaagcgguucgugugcaagcacucuauggucgaccgcggcugggguaauggcugcggccucuucggcaagggcgggaucgucacgugugccauguucacgugcaaaaagaacauggagggcaaaaucguacagccugaaaaccuggaguauaccauaguggucacuccccacagcggggaggagcacgcggugggcaacgauacggggaagcacggcaaggagaucaaggugacaccccaaaguuccaucaccgaggccgaguugacaggguacggaaccgucacgauggaguguagccccagaaccggcuucgacuucaacgagauggugcuucuccagauggaaaacaaggcauggcugguacaucgccagugguuccuugacuugccucuccccuggcuccccggggccgacaagcaggaguccaacuggauccagaaggagacccugguaacguuuaagaacccccacgcaaagaagcaggacguggucauccugggcagccaggagggggcaaugcauacggcccucaccggagccaccgaaauccaaaugagcuccgggaaccugcuguucacaggccaccucaagugucggcugcgcauggacaaacugcagcucaagggcauguccuauagcaugugcacgggcaaauucaaggucgucaaggaaaucgccgagacccaacacggaaccauagucauccggguacaguacgagggggacggcagcccuugcaagauccccuucgagauaauggaccuggagaaacgcuacguucugggccggcucauaacggucaacccgaucgugacggagaaggacucccccguaaacaucgaggccgagccgccauuuggggacagcuacaucaucaucggcgucgagcccgggcagcucaagcugaacugguucaaaaaaggcuccagcauuggucaaauguucgagaccacuaugcgcggcgcgaagcgcauggccauccucggcgacaccgccugggacuucggaucccugggcgggguuuucacgucaaucggcaaggcccuacaccagguguucggagccaucuacggcgcugcauucuccggggucagcuggaccaugaagauucucaucggugugaucaucacguggaucggcaugaacucccgguccaccucccugucggugucccugguccugguugggauugugacgcucuaccugggggucauggugcaagcugacucagguugcgugguaucauggaagaacaaggagcugaagugcggcagcggcaucuucaucaccgacaacgugcacaccuggacggagcaauauaaguuccagcccgagagccccuccaaguuagccuccgcgauccagaaagcccaggaggaggggaucuguggcauacgcuccgugacgcggcuggagaacuugauguggaaacagaucaccccugagcucaaucacauccuggccgagaacgaggucaagcugacuaucaugacaggggauauacgcggcauuaugcaggcggggaagcggucacuccgcccucaacccacggaacugaaguauuccuggaagaccuggggcaaggccaaaaugcuaagcaccgaguccuacaaccaaacguuccuaaucgacggccccgagacggcggagugcccgaacaccaacagggccuggaacucccuggagguggaagauuacggguucggcgucuucaccaccaacaucuggcugaagcucaaggagaagcaggacgccuuuugcgacuccaagcugaugagcgccgcuaucaaggacaaccgcgcgguucacgccgacaugggguacuggaucgaauccgcucugaacgauacguggaagauugagaaggccagcuucaucgaggugaagaacugccacuggcccaagagccacacccucuggagcaacggcguccuggagucagagaugaucauccccaagaaccuggccggccccgucagccagcauaauuaccggccgggguaccacacccagaucgcuggccccuggcaccucgggaagcuggagauggacuucgacuucugcgacggaaccacggugauagugacggaggacugcgggaaccgcggccccucccuacggaccaccaccgcuuccggcaagcucauaacggaguggugcugccgcagcugcacccugcccccguuacgguaccgcggcgaggacggcugcugguaugggauggagauacggccccucaaggagaaggaggagaaccuggucaacucccugguuacugccggacacggccagguggacaauuucagccucgggguccuaggcauggcgcuguuccucgaggagaugcugcgcacccgggugggaacuaagcaugcgauccugcucguagcggucuccuucgugacccuaaucacaggcaacaugucuuuuaaggaccuggggcgcguggucgugauggugggcgcgacgauggcggacgacaucgggaugggcgucacguaucucgcccugcuggcggccuucaaggugcggcccaccuuugccgccggcuuguugcuacgcaagcucaccucuaaggagcugaugaugaccacgaucgggaucgugcugcucagccaauccaccauccccgagaccguacuggagcugaccgaugcccuggcucuuggcaugauggugcugaagaucgugcggaauauggagaaguaccaguuagcagucaccaucauggcuauccugugcgugccgaacgccgucauccugcagaacgcuuggaaggugagcugcaccauccucgcgguggucuccgucagcccccugcugcucaccuccagccagcagaagaccgacuggaucccccuggcacuuacgauuaaggggcucuccccuaccgccauuuuccugaccaccuuaagccggucuaacaagaagcggagcuggccgcucaacgaggcaaucauggcggugggcauggucuccauccuggccucaagucugcugaagaacgacauccccaugacuggcccccuaguggccgguggccugcucaccguuugcuauguccugacaggacgaucugccgaccuggagcucgagcgcgccaccgacgugaagugggaggaucaggcggagaucucaggcuccagcccgauccuuuccaucaccaucagcgaggauggguccaugagcaucaagaaugaggaggaggagcagacccugacuauccuuauccgaaccggccuccuagugaucuccggccucuucccgaucagcauccccaucacggccgccgcaugguaccugugggagguaaagaagcagcgcgccggggugcugugggacgugcccagcccgccucccaugggaaaggcagaacucgaggacggggccuaccggauaaaacagaagggcauccugggguauagccagaucggcgccggcguauacaaggaagguaccuuccacacuauguggcacgugacacgcggcgccguacugaugcacaaggguaagcguaucgagcccuccugggccgacgucaagaaggaccucaucucuuacggcggaggcuggaagcuggagggggaguggaaagagggggaggagguccaggugcuggcgcucgagcccggcaagaaccccagggccgugcaaaccaagccggguuuauucaagacgaacaccggcaccaucggggccgugucccuggacuucagcccaggcaccuccggcucuccgaucaucgacaagaagggaaagguagucggccucuacgggaacggcgugguuacucguuccggcgccuacgucagcgccaucgcgcagaccgagaaguccaucgaggauaaccccgagaucgaggacgacaucuucaggaaacggcgccugaccaucauggaccugcaccccggggccggaaagaccaagcgguaccuccccgccauagugagggaggccaucaagagggggcuccgcacguuaauacuggcuccaacccgcguggucgcagcugaaauggaggaagcccuacgcggccugcccauaagguaccagacccccgccauccgcgcggagcacaccgggcgugagaucguggaccuaaugugccacgccacguucacuaugcgguugcugucgcccguccgcguaccaaacuacaaucugaucaucauggaugaggcccacuucaccgaccccgcuagcaucgccgcgcgcggcuacaucuccacccgcguggagaugggagaggccgccgggaucuucaugacggccacgccgccuggcagccgugacccauucccccaguccaacgcacccauuauugacgaggagcgcgagauccccgaacggagcuggaacuccggccacgagugggugaccgacuuuaagggcaagaccgucugguucgugccaagcaucaaagcggggaacgacaucgcugccugccuccgcaagaacggcaagaaggugauccagcuuucgagaaagacguucgacuccgaguacgucaagacccgcaccaacgacugggacuucguggugacuacggacaucucggagaugggugccaacuucaaggcggagcgggucaucgacccucgccggugcaugaagcccgugauccugacugacggggaggaacgcguaauccucgccgggcccaugcccgucacccacagcuccgccgcccagcggcgugggcgcaucggccgcaaccccaagaacgagaacgaccaguacauuuacaugggagagccccuggagaacgacgaggacugugcccacuggaaggaggcgaagauguugcucgacaacaucaacacacccgaaggcaucauaccgagcauguuugagccugagcgggagaagguagacgcaauugacggggaguaccgccugcgcggggaggcccggaagacguucguggaccugaugaggcggggcgaccucccuguauggcuggccuacaaaguggcugcagagggaaucaacuacgcagaccgccgguggugcuucgauggcaucaagaacaaccagauccuggaagagaacguagagguugaaaucuggaccaaggagggcgagcgaaagaagcucaagccgcgcugguuggacgcccgcaucuacucggauccucuggcccucaaggaguucaaggaguucgccgcuggccggaagucccucaccuuaaaccucaucaccgagauggggcgcuugcccacguucaugacccagaagacccgcgacgcccuggacaacuuggccgugcugcacaccgccgaggccggcgggcgugcuuacaaccacgcgcuguccgagcuccccgagacgcuggagacccugcucuuacuaacgcuccuggccaccguuaccggcgggaucuuccuauuccucaugagcgggcggggaaucggcaagaugacccuggggaugugcugcaucaucacggccuccauucuguuaugguacgcgcagauccagccgcacuggaucgccgccagcaucauccuggaguuuuuucugaucguuuuguugaucccggagcccgaaaagcaaaggacgccccaggauaaccaguuaaccuacguagucaucgcgauccucaccguuguggccgcgaccauggccaacgagaugggcuuucuggaaaagaccaagaaggaccuggggcuaggcggcaucgccacccagcagcccgaguccaacauacuggacauagaccugcggcccgccagugcguggacucucuacgcagucgcaaccaccuucgugaccccaaugcugcgccacagcaucgagaacaguagcgugaacguguccuuaacggccaucgccaaccaggccaccguacucauggggcuuggcaagggguggccccugagcaagauggacaucggcgugccgcuacuggcgaucgggugcuacagucaggucaaccccauuacgcuuaccgccgcucuccuguuacugguggcccacuacgcgaucaucggccccggccugcaagccaaggccacacgggaggcccaaaagcgugccgcggcaggcaucaugaagaaccccacgguggacggcaucaccgucauagaccuggacccgauccccuacgaccccaaguuugagaagcagcucggucaggugaugcugcucauccucugcgugacccagguccugaugaugcggacaaccugggcucugugcgaggcgcucacccuggccacgggccccaucagcacgcugugggaggggaacccgggucgcuucuggaacaccaccauagcgguauccauggcaaacaucuuccgcggcagcuaccucgccggcgcuggcuuacucuucagcaucaugaagaacacgacgaacaccaggcgcgggaccggcaacaucggcgaaacucucggcgagaaguggaagucccggcugaacgcccugggcaagagugaguuccaaauuuacaagaaguccggaauccaggaaguggaccggacccucgcgaaggaggggaucaagcgaggggagacagaccaccacgccgucucacgcggcagcgccaagcugcggugguuuguggaacgcaacauggugacucccgagggcaaggugguggaccuaggguguggccgcggcgggugguccuacuacugcggcgggcucaagaacgugcgcgaggucaaggggcugaccaaggggggucccgggcacgaggaacccaucccuaugagcacguacggcuggaaccuggugaggcuccaauccgggguggacgucuucuucaucccgcccgagaaaugcgacacccuucugugcgacaucggagagagcucccccaauccgaccguggaggcaggccgcacccuacgggugcugaaccuggucgaaaacuggcucaauaacaacacgcaguucugcaucaaggugcugaacccguacaugcccuccgugauagagaagauggaggcccugcagcgaaaguacgggggcgcccuaguccggaaccccuuaucaaggaacucgacccaugagauguacuggguaagcaacgccuccgggaacaucguuagcuccgucaauaugaucagccggaugcugaucaaccgcuucaccaugcggcauaagaaggccaccuacgagcccgacguggaccugggcuccgggacccguaacaucggcaucgagucggagaaaccgaaucuggacaucaucggcaagcggaucgaaaagaucaagcaggagcacgagacguccuggcacuacgaccaagaucaccccuacaagaccugggcguaucacggaagcuacgagaccaagcagacgggauccgccagcuccaugguuaacggggucgugcgccugcugacgaagccgugggacgugcuccccaccgucacacagauggccaugaccgacacgacccccuucggccagcaaagaguguucaaagagaagguggauacacguacccaggagcccaaggaggggaccaagaagcucaugaagauuacagcggaauggcuauggaaggagcuagggaagaagaagaccccgcgcaugugcacccgggaagaguucacgcgaaagguccggagcaacgccgcccugggcgcgauauucaccgacgagaauaaauggaaguccgcccgagaggcgguggaggacagccgguucugggagcugguggacaaggaacgcaaccuccacuuggaggggaagugcgagaccugcgucuacaacaugaugggcaagcgggagaagaagcugggggaguucggcaaggccaaaggguccagggcgaucugguauauguggcugggcgcgcgguuccuggaguucgaggccuugggcuuccucaacgaggaccacugguucagccgcgagaacucccugagcggggucgaaggggaggggcugcacaagcucggguacauccugagggaugugagcaagaaggagggcggggccauguacgccgacgacaccgcgggaugggauacgcgcaucacccuggaggaccucaagaacgaagagauggugacaaaucacauggagggggagcacaagaagcuggcggaggcuaucuucaagcuaaccuaccagaacaaagugguccgugugcagcggcccacgccccgcggcaccguaauggacauaaucucccgccgggaucagcgcggauccggccaggucggcaccuacgggcucaacaccuuuacgaacauggaggcccaguuaauucggcagauggagggcgaggguguguucaagaacauccagcaccuuaccgugaccgaggaggucgccgugcacaacuggcucgcuagggugggccgcgagcggcugagccgcauggccaucagcggggacgauuguguggucaagccccuagacgaccguuucgccaaugcccuaaccgcgcugaacgacauggggaagauccgcaaggacauccagcagugggagccguccaagggcuggaaugacuggacucaggucccauucugcagucaccauuuccaugagcugaucaugaaggacgggcgggucuugguggugccaugccgcaaccaggaugagcugauaggccgggcgcgcaucucccagggggccggcuggagccugcgggagaccgccugccucggcaaguccuaugcccagauguggagccuuauguacuuccacaggcgggacuuacgccucgcugcuaaugccaucuguucggccgugcccucacacugggucccaaccucccggaccacguggucaauccacgccaagcacgaguggaugaccaccgaggacaugcugaccguguggaaucgagucuggauccgggagaaccccuggauggaggacaaaacccccguggaguccugggaggagauccccuaccuggggaagcgcgaagaccaguggugcgguucgcugaucgggcuaacgucucgggcaacgugggcgaaaaauauccaggcggccaucaaccaggugcgcagccugaucggcaaugaggaguacaccgacuacaugccgagcaugaagcgguucagacgcgaggaggaggaggccgggguucucugguga

SEQ ID NO: 25310 - RNA, 9876 nt, Artificial Sequence
  derived and/or modified CDS sequence (opt11) from DENV-2__EU660414__SS-prME
agcgccggcaugaucaucaugcugauccccaccguaauggcuuuccaucuuacuacgcguaauggggaaccucauaugauagugggcauucaggaaaagggcaagagccugcuguucaagaccgaagacggggugaacauguguacacucauggcuauggaccugggggagcugugugaggauaccauuacguacaaaugcccccuucugcggcaaaaugaacccgaggacauagacugcuggugcaacagcacgucaaccugggugaccuacgggaccugcacaacuaccggggaacaccgccgggagaagcgcagcgucgcauuggugccccacguugguaugggccucgagacccggaccgaaaccuggaugucgagugagggggccuggaagcacgcccaacgcaucgaaacuugggucuuacggcacccgggcuucacgaucauggcugcgauucuggccuacaccauugggaccacccauuuccagcggguguugaucuucauccuacugaccgcaguggcucccucaaugaccaugcgguguaucgggaucuccaaucgcgauuucgucgagggcguguccggagggagcuggguagacaucgugcucgagcauggcucaugcguaaccaccauggcgaagaacaaaccuacacuagacuucgaguuaaucaagaccgaagccaagcagcccgccacccuccggaaguacugcauugaagcaaaauuaacaaacacgaccacggagagucgcugccccacccaaggcgagccaucccugaaagaggagcaagacaagcguuucgugugcaagcacaguaugguggaccgggggugggguaacgggugcggcuuguucggcaaaggugggauugugaccugcgccauguuuacgugcaagaaaaauauggaggggaagauugugcaacccgagaaccuggaguauaccaucgucgucacgccucauucuggagaggagcacgccguggggaacgacacggggaaacacggccaagagaucaaggugacgccccaaagcucuauuaccgaagccgaguuaaccggguacgguaccguuacgauggagugcuccccucgaaccggccucgacuucaacgagauggugcuccugcagauggagaacaaggccuggcucguccaccgccagugguuccuggaucuaccacucccuuggcuaccaggagcggacaagcaagaaucuaacuggauccagaaggaaacccuggugaccuucaaaaacccgcacgcaaagaagcaagacgucguuguucucgggucccaagaaggggcgaugcacacagcccugacgggagcuaccgagauccagaugagcuccggcaaucucuuauucaccggccaccugaagugucgucuucgcauggacaagcuccagcugaaaggcaugucuuacagcaugugcacggggaaguucaaggucgugaaggaaauagccgagacccagcacggcacaaucgugauccgcguccaguaugagggggacgguagccccugcaaaauacccuucgaaaucauggaucucgaaaagcgcuacgugcucggccggcugaucaccguaaauccaauugucacggagaaagacuccccggugaacaucgaagccgagccgcccuucggggacagcuauaucaucaucgguguggagccggggcaacugaagcucaacugguucaagaaaggcucaaguaucggacagauguucgagaccacaaugcgcggugcuaaaaggauggccauccugggugacaccgcuugggacuucgggucucucgguggggucuucacgucuaucggcaaagcccuccaccagguguucggggccaucuacggcgccgccuucuccggcgugagcuggaccaugaagauccugauaggggucauuaucaccuggaucgggaugaacucacggucaaccucccuuagcguauccuugguucucgucgggaucguaacgcuguaccuuggcgucaugguccaagccgacagcgguugcguggucucauggaaaaauaaggagcuaaagugcggcucuggcauuuucaucaccgacaacguccacaccuggaccgagcaguacaaauuccagccugagucgcccuccaaacuugcuagcgcgauccagaaggcccaagaggaggggaucugcggcauccggagcguuacgagacuggaaaaccugauguggaagcagauuacucccgagcugaaucacauacuggcugagaacgaggugaagcuaacuaucaugaccggagacaucaagggcaucaugcaggcagggaagcgcagcuugcggccucagcccaccgaacuuaaguacuccuggaagacuuggggcaaggcgaagaugcucucaaccgaguccuacaaccagacuuuccugauugacggccccgaaacggccgagugcccgaacacuaaccgagcauggaacucucuggaagucgaggacuauggguucggcguguucacgaccaauaucuggcucaaacuuaaggagaaacaggacgcuuucugugacuccaagcugaugucagcggccaucaaggacaaucgagcggugcaugccgauaugggauauuggaucgaguccgcccucaacgacacguggaaaauagagaaagcuagcuuuaucgaggucaagaauugccauuggcccaagucccacacccuguggagcaauggugugcuugaguccgagaugauaaucccgaaaaacuuagccggccccgugagccagcacaauuacagaccgggguaucacacccaaaucgcggggccuuggcauuugggaaaacuugagauggauuucgacuuuugcgacggcacgaccgucaucgucacggaggacugcgggaaccggggcccaucccuacgcaccacaacagccagcggaaagcugaucacggaguggugcugccgcucuugcacacugcccccgcuccgcuauaggggagaagacgguugcugguacggaauggagauccgcccccuaaaagagaaagaggagaaucugguaaauucccugguaaccgccggccacgggcaagucgacaacuucagccugggggugcugggcauggcccucuuccuggaagagaugcugcgaacacgaguggggacaaagcacgcgauccuccucguggcuguguccuucgucacccugaucaccgggaauaugucauucaaggaccucggccggguugugguuauggugggcgccaccauggccgaugauauuggcaugggagugacguauuuagcucuacucgcggcuuucaaaguccgcccgacguuugcggcgggccuguuauuacggaaauugacaucuaaggagcugaugaugacuacgaucggcaucgugcuccugucgcaguccaccauucccgaaaccgugcuggaacucaccgaugcccuggcgcuuggcaugaugguacucaaaaucgugcgcaauauggagaaguaucaguuagccgucacgaucauggcaauucuuugcguuccgaacgccgugauccuccaaaaugccuggaaaguaagcugcacaauccuggcgguaguguccguaucgccucugcuccugacguccagccagcagaagaccgacuggaucccuuuagcccucacaauaaaggggcugaaccccaccgccaucuuccugaccacucugucgcgcacuaacaagaagcggaguuggccuuuaaaugaggcaauuauggcggugggcaugguguccauucuugcgagcucccugcucaaaaacgacaucccuaugaccggcccgcuggucgccgggggacuccugacugugugcuacgugcugacgggacgcagugccgaccucgagcuugagcgagcgacggaugucaagugggaggaccaagcggagaucuccggcagcucaccuauacuauccaucaccaucuccgaggauggcucaaugagcaucaaaaaugaggaggaggaacagacacugacuauacugauccgcacgggacugcuagugaucuccggauuauuucccauauccauccccaucaccgccgcugccugguaucugugggaggucaagaagcaacgugccgggguucugugggaugugccaucuccgccgccaaugggaaaggcugagcuggaggauggggcguaccgcaucaagcaaaaaggcauucugggguauagccaaaucggugcaggcguguacaaggagggcaccuuccauaccauguggcacgucacccggggagcaguucugaugcacaaggggaagcgcaucgaaccguccugggcugaugugaaaaaggaucugaucagcuacggcgggggcuggaagcuggaaggcgaauggaaggaaggggaggagguccaggugcucgcucuugagcccggaaagaacccccgggccgugcaaaccaagcccgggcuauucaagacaaacaccggcaccaucggggcgguaucccucgacuucagcccaggcacgaguggaagucccaucaucgacaagaaggggaaggugguaggacuguacgggaacggcgucgucacccgcagcggcgccuacgugucggccaucgcgcagaccgaaaaguccaucgaggacaaccccgagaucgaggacgacaucuucaggaagcgcaggcugaccaucauggaccugcacccaggggccgguaagacgaaaagguaucuacccgccaucguccgggaggcgaucaaacgcggccugcggacacugauacuggccccuaccagaguagucgccgccgagauggaggaggcucugcggggccugccaaucagauaccaaacgcccgccauacgggcggaacacacugguagagagauugucgaccucaugugucacgcaaccuucacaaugcgccuucuaagccccguacgggugccgaacuacaaccuaaucauaauggacgaggcccacuucaccgaucccgccuccauagccgcgagaggauacaucagcacgcgggucgagaugggcgaagcugccgguaucuucaugacggccacgccgcccggcaacagagacccguuuccacaaagcaacgcccccaucauagacgaagaacgagaaauacccgagcguuccuggaacuccggacacgaaugggugaccgauuucaaggguaagacggugugguucgucccgucgauuaaagcggguaacgacaucgccgcgugucugcgcaagaacggcaaaaaggugauccaacugagccggaagaccuuugacuccgaguacgugaagacgcggaucaacgacugggacuuuguggucaccacggacaucagcgagaugggcgccaacuucaaggcggagcguguuaucgacccucggcguugcaugaagcccgucauccucaccgacggggaggagcgggugauucuggccggacccaugccggugacacauuccagcgccgcucaacgucgggggcgcaucggccggaaccccaagaacgagaaugaccaguacaucuauaugggggagccccuggagaacgacgaggacugcgcgcacuggaaagaggcaaagaugcucuuggacaauauaaauacccccgaaggcaucaucccauccauguucgagcccgaacgggagaaggucgaugcgaucgacggggaguaucgguugcguggugaggcccgcaagacguuuguugaccucaugcgcagaggagacuugccgguguggcuagcauacaaggucgccgccgaggggaucaauuaugccgaccggcgcugguguuucgacggaauaaagaauaaccagauccucgaggagaacguugagguugaaaucuggaccaaggagggggagcggaagaagcuaaagccgcgcugguuggaugcgcggauuuacagcgacccccucgcacuuaaggaguuuaaggaguucgcagcaggccgcaagucgcuuacacucaaccugaucaccgagaugggccgucugccuacguucaugacccaaaagacccgcgacgcgcuggacaacuuggccguacugcacacagccgaggccggcgggcgcgccuacaaccacgcgcucucagagcuucccgaaacucuggaaacccuccugcugcucacuuuauuagcgaccgugaccggagggaucuuccucuucuuaauguccgggcgcgguaucgguaagaugacccuugggauguguugcaucaucaccgccaguauccuccugugguacgcgcaaauccaaccgcacuggaucgccgccucgaucauccuggaauuuuuccucaucguccuacugauucccgaaccggagaaacagcggaccccucaggacaaccagcuaacauacgugguuauugccauacugacggucguggcggcgaccauggccaacgagaugggcuuucuugagaagaccaagaaagaucugggccuagggagcauagccacccagcagccggagucgaacauccucgacaucgaccuccgccccgccagcgcguggacgcuguacgcgguggcgaccaccuucgugacacccaugcugcggcacuccaucgagaacucuagcguaaacguaucccucacggccaucgccaaccaggcuacuguccugaugggcuuagggaagggcuggccccucagcaagauggacaucggagugccucugcuggcgaucggcuguuacucccagguuaaccccaucacacucaccgccgcccugcuacuccuggucgcccacuacgccauaaucggacccgggcugcaggcgaaggccacgcgcgaagcgcaaaagcgagcagcagccggcauaaugaagaaucccaccguggacgggaucaccguuaucgaccucgauccgauccccuacgaccccaaguucgagaaacagcugggccaagugaugcuccucauacugugugugacgcaaguacucaugaugcgcacaaccugggcccugugcgaggcccugacgcuggccaccgggcccaucagcacgcucugggaaggcucccccgggcgauucuggaacacuaccaucgcgguuagcauggccaauauauucagaggaaguuaccuggccggggccggccugcucuuuagcaucaugaaaaacacgacgaacaccagacgcgggaccggaaauaugggggagacccugggugaaaaguggaagucccguuugaacgcccucgggaaguccgaguuccaaaucuacaagaaaucagguauccaggaaguggaucggacgcuggcgaaggagggaaucaagcgcggcgagacagaccaccacgccgugagccgggguagugcuaaguuaagaugguuugucgagcggaacauggugacccccgagggcaaggugguagaucucggcugcgggagaggagggugguccuacuacugcggagggcugaagaacgugcgggaagugaagggucugacgaagggaggaccagggcacgaggagcccaucccgauguccacguacggguggaaucuaguaagacugcaaagcggaguggauguguuuuucaucccacccgagaagugugacacacuguuaugcgauaucggagaguccagcccgaacccgaccgucgaggccgggcggacacuaagagugcugaaccucguggaaaacuggcucaauaacaauacgcaauucugcaucaaagucuuaaaccccuacaugcccuccgugaucgagaagauggaggcgcugcagcgaaaauacggaggggcgcuuguacgcaacccgcuaucucgcaacagcacacacgagauguacugggugagcaacgccucugggaacauugugaguagcgugaacaugaucucccguaugcugauaaaccgguuuaccaugaggcacaagaaagcgacguacgaaccagacguggaccucggaagcggcacacggaauaucgggaucgaauccgagacaccaaaccuggacaucaucggcaagagaauugaaaagauaaaacaggaacacgagacuagcuggcacuacgaccaggaccacccauacaagacuugggccuaccacggauccuacgagacaaagcagacgggcagcgcgucuuccauggugaacggcguaguccgccugcucaccaagccgugggacguacugcccaccgugacucaaauggcaaugacggauaccacgcccuucggucagcaaagagucuucaaagagaagguggauacccgcacgcaggaaccaaaggagggcacaaagaaacuaaugaagaucacugccgaguggcucuggaaggagcuggguaagaagaaaacuccacggaugugcacgcgcgaggaguucacucggaaagugcgaagcaacgccgcgcugggggcgaucuuuaccgacgagaacaaauggaagucagcccgggaggccgucgaggacagucgcuuuugggagcucguggacaaggaacggaaucugcaccuggagggcaagugcgagaccugcguuuacaauaugauggguaagcgcgagaagaagcucggcgaauuugggaaggcuaaaggcagcagagccaucugguacaugugguuaggcgcuagauuuuuagaauuugaggcccucggguuccugaaugaggaccacugguucucccgggagaacagccucuccggugucgagggggagggccuccacaaauuaggguacauacugcgcgacgugagcaagaaagaggguggagccauguacgccgaugauacggcggggugggacacucggaucacccucgaggacuugaagaaugaggagaugguuaccaaucacauggagggugagcauaaaaaguuagccgaggccaucuucaaacucaccuaccaaaauaaaguugugcgcguacaacggcccacaccccgggggaccguuauggacaucauaagucggcgcgaucagagaggcuccggccaaguggggaccuacggccugaacacguucaccaauauggaggcgcagcucauccgccagauggaaggcgagggcguauucaagaacauccagcaccucacagugaccgaggagguggcgguccagaacuggcuggcgcggguggggcgcgagcgccugagccguauggcuaucuccggggaugacuguguggucaaaccccuugacgaucgcuucgccaacgccuugacggcccugaacgacaugggcaagauccggaaggacauacagcagugggagccguccaagggguggaacgacuggacccaggugcccuucugcucccaccacuuccacgagcucaucaugaaagacggcagggugcugguagugcccugccgaaaccaggacgagcugaucgggcgcgcccggaucagccagggcgccggguggagucuacgcgagaccgcguguuuaggaaaaagcuacgcccaaauguggagucucauguacuuccacaggcgcgaucuuagacuggccgcaaaugccaucugcagcgccguuccgagucacugggucccgaccagccgcacuaccuggaguauccaugcgaagcaugaguggaugaccaccgaggacaugcugaccguuuggaaccggguguggauacgggagaaccccuggauggaggacaagacacccgucgagagcugggaggaaauccccuaccucggcaagcgcgaggaccaguggugcgggucguugaucggguugaccagccgcgcuacaugggcgaaaaacauacagguagcuauaaaccagguacggucccucauugguaacgaggaguacacugacuauaugcccucaaugaagcgcuuuaggcgggaagaggaggaggcaggcguacuuugguag

SEQ ID NO: 25311 - RNA, 9876 nt, Artificial Sequence
  derived and/or modified CDS sequence (opt11) from DENV-2__EU660415__SS-prME
agcgccgguaugauuaucaugcugaucccaaccgugauggccuuccaccucaccacccggaacggagagccucacaugauagucggcauccaggagaaggggaagucucugcuguucaagaccgaggacggcgugaacauguguaccuugauggcgauggaccugggugaacugugcgaggacacaauuaccuacaaaugcccacuccugcggcagaacgagcccgaagacaucgauugcuggugcaauaguaccuccaccugggugaccuacgggaccugcaccaccaccggcgagcaccgccgugagaagagaagcgucgcccuggugccccacguggguaugggcuuagagacccgcaccgagacauggaugagcagcgagggggcguggaaacacgcgcaacgcaucgaaaccuggauccugcggcaccccggauucacgaucauggcagcuauucuggccuauaccaucggcaccacucacuuucagcgcgucuugauauucauccuguugaccgccguggcacccaguaugaccaugcgaugcaucggcaucagcaaucgcgacuuuguagaaggagucuccggagggagcuggguggacaucgugcucgagcacgggucguguguaaccaccauggcgaaaaacaagcccacgcuggacuucgagcugauaaaaacagaggcaaagcagcccgcaacccuccggaaguauugcauagaggcaaaacugaccaacacgaccaccgaaucucgcugcccuacccagggcgagcccucccugaaggaggagcaggacaagagauucguguguaagcacagcaugguugaccgcggcugggggaacggcuguggccuguucggcaaaggcgggaucgucacgugugccauguucacgugcaagaagaauauggaggguaagaucgugcagcccgagaaccuggaguacacgaucguggucacaccccacuccggggaggagcacgcgguuggaaacgacacggggaagcacggcaaggaaauuaaggugaccccacagagcucaaucaccgaagccgaacugaccggguacgggaccgucaccauggagugcagcccccggaccggccucgacuuuaacgagauggugcugcugcaaauggaaaacaaggccuggcuagugcaccgccagugguuccuagaccugccccuccccuggcugccgggggccgacaagcaggaaagcaacuggauccaaaaggagacccuggucaccuuuaaaaacccccacgcuaagaagcaggauguggucgugcucggcucacaggagggggcgaugcacacggcccugaccggcgccaccgagauccagaugagcuccgggaaucuccuguucaccggccacuugaagugccgacugcgcauggacaagcuacagcugaagggcaugagcuacuccauguguacggggaaguuuaagguugucaaggagauugccgagacccagcauggcacgauugugauccgggugcaguacgaaggggacggcagccccuguaagauacccuucgaaaucauggaccuggagaagcgcuacguccucggucgacugaucaccgugaacccgauagugacggagaaagauucccccgucaacaucgaagccgagccgcccuucggugacagcuacaucaucaucggaguuggcccgggccagcugaaacucaacugguucaagaagggcucgagcauaggacaaauguucgagaccaccaugcgaggcgcgaagaggauggccauccugggggacaccgccugggacuucggcucccugggcgggguguucacgagcaucgggaaggcgcuccaucaggucuucggcgccaucuacggcgcagccuucuccggggugagcuggaccaugaaaauucugaucggggugauaaucacguggaucggaaugaacucccgcagcaccucacugagugucucccuugugcuagugggcaucgucacgcuguaucugggagugauggugcaggcggauagcggaugcgucgucuccuggaaaaauaaggagcucaagugcggcucugggauuuucaucacugacaacgugcacaccuggaccgagcaguacaaguuccagcccgagagcccgagcaagcuagccagcgcgauucagaaggcccaagaggagggcauaugcgguauccgauccguaacgcgacuggaaaaccucauguggaagcagaucacacccgagcugaaccacauacuggccgagaacgaggugaagcucacaaucaugaccggcgacaucaaggggauaaugcaagccggcaaacgcagccuccggccccaaccuacggagcugaaguacucuuggaagaccuggggcaaggcuaaaauguugagcaccgaauccuauaaccagaccuuccuuaucgacgggcccgaaacggccgagugcccgaacaccaacagagcguggaacucccucgagguagaggacuacggcuucggggucuucacgaccaacauauggcugaagcucaaggagaagcaagaugccuuuugugacuccaagcugaugagcgccgcaaucaaggacaaucgggcggugcacgccgacaugggcuauuggaucgagagugcccucaaugacacguggaagauugagaaggcaagcuucaucgaggugaagaacugccauuggcccaagucucacacacuguggucaaacgguguccuggagucagagaugaucauccccaagaaccucgccggaccggugucccagcacaacuaccgccucggcuaccacacccagauugcggggccguggcaccugggcaaguuggagauggacuucgacuucugcgaugggacgaccgucaucguuaccgaggacugcggcaaccggggccccucccugcgcaccaccaccgccagcgggaagcugaucacggaguggugcugucggagcugcacccugccgccgcugcgcuaccggggugaggacgggugcugguauggcauggagauccgcccguugaaggagaaggaggagaaccucgugaacucacuggugaccgcagggcacggccaggucgacaacuucagccugggcgugcucggcauggcccuguucuuagaggagaugcuucggacgagaguggggacgaaacacgcgauccugcuggucgccgugagcuucgugacccucaucaccgguaacauguccuucaaggaccugggccgggugguagugauggucggcgcaaccauggccgacgauaucgguauggguguaacuuaccuggcccugcuggcggccuucaaagugcgcccuaccuucgcugcagggcugcuccuucggaaacuuaccuccaaggaacucaugaugaccacgauuggcaucguccugcugagccaguccacuaucccagagaccgugcuagaguugaccgaugcccuggcgcucgggaugauggugcugaagaucguacgcaacauggagaaauaucagcuugccgugacgauuauggccauccugugcguccccaacgcgguuauccugcagaacgcguggaaggugagcugcaccauucuggcggucgugucugugagcccgcuccuacugaccuccagucagcaaaaaaccgauuggaucccgcucgcacuuacgaucaagggccugaaccccaccgccaucuuccucaccacccugucccgcacgaacaagaagcggagcuggccccugaacgaggccaucauggcggucggaaugguguccaucuuggccagcucccugcugaagaaugacaucccgaugaccgggccccucguugcgggcgggcugcugacugucugcuacgugcuuaccggccgcagcgccgaccuagagcuggaacgagccacggacgugaaaugggaggaccaagcggagaucuccgggagcagccccaucuuauccaucacaauuagcgaggacggcuccaugagcaucaagaacgaggaggaggagcagacccugacuauccugauccggacggggcuccuggucauaucugggcuguuccccaucagcauccccaucaccgcugccgccugguaccucugggaggugaaaaagcagcgggccggcguccucugggauguccccagcccuccgcccauggggaaggccgaacuggaggacggcgccuaccgcaucaaacagaaggggauccucggcuacagccagaucggcgccgggguguacaaggagggcaccuuccacaccauguggcacgugacccgcggggcgguccuaaugcacaagggcaagcgcaucgagcccuccugggccgacgugaagaaggaccugauuucauacgggggcggcuggaaacucgagggggaauggaaggagggcgaggaggugcagguccuggcgcuggagcccgggaagaaccccagagccgugcaaacgaagcccggacuauucaagaccaacaccgggaccaucggcgccgugucccuggacuucucgcccggcacuucagggagccccauaaucgacaagaagggcaaggucgugggucuguacggcaacggcguggucacacgcuccggcgccuacgucagcgccaucgcgcaaaccgagaagggaaucgaggacaacccggagaucgaggacgacaucuuccggaaacgccggcuuaccaucauggaccuacaccccggggccggcaagacuaaacgcuaccuacccgcaaucgugagagaggccaucaagagagggcugagaacccucauccuugcccccacccgcgucguggccgccgagauggaggaggcgcugcggggccucccgauucgauaccaaacccccgccauccgggcagagcacacgggccgcgaaaucguggacuuaaugugccaugccaccuucaccaugcgccugcuuucccccguccgcgugcccaacuacaaucuaaucaucauggacgaggcacacuucacugacccggccagcauagccgcgcgcggguacaucuccacgcggguggagaugggcgaggccgccgggaucuucaugacggccacgccucccgguagccgcgaccccuucccgcagagcaacgcucccaucauagacgaggagcgggagauccccgagcgcuccuggaacaguggccacgaguggguuaccgacuucaagggcaagacggugugguuugugcccuccaucaaggcgggcaacgacauagcugcgugcuugcggaaaaacgggaagaaggucauccagcucucccguaagaccuuugacuccgaguacgugaaaacucgcaccaacgacugggacuuugugguuacgacagauauaagcgagaugggagccaacuucaaggcugagcgagugaucgacccccggaggugcaugaagcccguuauccugacggacggggaggaacgggucauccuggcuggccccaugcccgugacccacuccagcgccgcccagcgccggggucgcaucggccguaacccuaagaacgagaacgaccaguacaucuacaugggcgaaccccucgagaaugacgaggacugcgcucacuggaaagaggcgaaaaugcugcuggacaacaucaacacgcccgaggggauuauucccuccauguuugagccggagcgcgaaaagguagacgccaucgacggcgaguaccggcuccgaggggaggcccgcaagaccuucgucgaccugaugcggcgcggagaccugcccguguggcucgcauacaagguggccgcugagggcaucaacuaugccgaccgccgcuggugcuucgacggcaucaagaacaaccagauccuggaagagaacgucgagguggagaucuggaccaaggagggcgagcggaagaagcugaagccgagguggcucgacgcccggaucuauagcgacccgcuggcucugaaggaguucaaggaguuugcagcgggucgcaagucccucacccugaaccugaucacggagaugggccggcuccccaccuucaugacccaaaagacccgcgacgcccuggauaaucuggccguccuccacacggcggaggccgggggccgggccuacaaucacgcccugagcgaguugcccgagacccucgagacccugcugcuccugacccugcucgcuacggugaccggcggcauuuuccuguuccucaugucaggacgagggaucggcaagaugacgcucggcaugugcugcaucaucaccgccagcaucuuguuaugguaugcgcagauccagccgcacuggaucgccgccuccaucauccucgaguucuuccugaucgugcugcucaucccggagcccgagaaacagcggacgccccaggacaaccagcugacguacgucgugauagccauccugaccguggucgcggcgaccauggccaacgagaugggcuuccucgagaagacgaagaaagacuucggacuggggagcauugccacgcagcagcccgaguccaacauccuggacauugaccuccggccggccagcgcuuggacccucuacgcgguggccaccacauucgugacgcccaugcugcggcacuccaucgagaacagcagcgucaacgugucccucaccgccaucgccaaccaggccaccgucuugaugggucuggggaaaggcuggccgcucagcaagauggacauagggguccccuugcuggcgaucggcugcuacucccaggugaacccgaucacuuugacggccgcacugcugcuccugguggcccauuacgcgaucaucggccccggacuacaggccaaggcgacccgcgaggcccagaagcgggccgcggccggcaucaugaagaaccccacuguagacgggaucaccguuaucgaccuagacccgauuccuuacgaucccaaguucgaaaagcagcugggccaagugaugcugcucauccugugcgucacccaagugcugaugaugcgcacaaccugggcccucugcgaggccuuaacccuggccacgggaccgaucagcacccucugggagggcaacccaggccgguucuggaacacgacgaucgcgguguccauggcuaacaucuuuagaggcaguuaccuggcaggcgccggccuccucuucuccaucaugaagaauacgaccaacacccggcgcggcaccggcaacaucggggagacgcugggcgagaaauggaaguccaggcugaacgcacuuggcaagagcgaauuccagauuuacaaaaagagcggcauccaggaggucgauagaacccuggcaaaggaggggaucaagcgcggagagaccgaucaucacgccgugucucggggcagcgccaagcugaggugguuuguggaacggaacauggucaccccggaggggaaggugguggaccucgguugcgggcgugguggauggaguuauuacugcgguggcuugaaaaacguccgggaggugaagggacugacgaagggcgggcccgggcacgaggaacccaucccuaugagcacuuacggauggaaccucgugaggcugcagagcggcgucgacguguuuuucaucccgccugagaagugcgacacccuccucugcgacaucggagagaguucccccaaccccacgguggaagccgguagaacacugcggguccucaauuugguggagaacuggcuaaacaacaacacccaauucugcaucaagguccugaacccauauaugcccuccgucauagagaagauggaggcacugcagcgcaaguacggcggggcccucgugcguaacccccugucacgcaacagcacacaugagauguacugggugagcaacgcguccgguaacaucgucagcuccgugaacaugaucagccgcauguuaaucaaccgauucaccaugcggcacaagaaggcgaccuaugagccggauguggaccuaggguccgggacgcggaacaucggcaucgagagcgagauaccgaaucuggacaucauagggaagcgcaucgagaagaucaagcaggagcacgagaccuccuggcacuacgaccaggaccaccccuacaagaccugggcguaccacggcagcuacgagaccaagcagacgggcuccgcuagcagcauggugaacggcguggugcggcugcucaccaagcccugggacguacugccgacagugacccagauggccaugacagacaccacccccuucggccagcaacgcguguucaaggagaaggucgacacccgaacgcaggagccuaaggagggcacaaagaagcugaugaagaucaccgccgaguggcucuggaaggaacugggcaagaagaagacgccacggauguguacucgcgaggaauucacccggaaggugcgcagcaacgcagcccucggggcgaucuucaccgacgaaaacaaguggaaguccgcccgggaggccguagaggauagcagauuuugggagcucgucgacaaagaacggaaccugcauuuggagggaaagugcgagaccuguguguacaacaugaugggcaagcgcgagaagaagcucggcgaguucggcaaggcaaagggcucccgggccauuugguauaugugguugggcgcgcgcuuccuggaguucgaggcccucggguuccugaacgaggaccauugguucucccgggagaacucccuaucuggagucgagggugagggccuccacaagcucgguuacauccugcgcgacgugucgaagaaggagggcggugccauguaugccgacgacacggcggggugggauacccggaucacccucgaggaccuuaagaacgaagaaaugguuaccaaccauauggagggcgagcacaagaagcuggcugaggccaucuucaaguuaacguaccagaacaaggucguucgcguucagcggccgacgccccgcggaaccgucauggacaucauaucccggcgcgaccagcggggaagcgggcagguggggacuuacggccugaacaccuucacaaacauggaggcccagcugauccgccagauggagggggagggcguguucaagaacauccagcaccucacaguaaccgaggagguggccguacagaacuggcuggcgcgggucggccgcgaacgacuuuccagaauggccaucuccggggacgacuguguggugaagccacucgacgacagauuugccaacgcccugacggcccugaacgacaugggaaagaucaggaaggacauccagcagugggaacccuccaagggguggaaugacuggacccaggucccguuuuguagccaccacuuccacgagcucaucaugaaagacggccgcgugcuugugguccccugucggaaccaggacgaacugaucgggagggcgcggaucucgcagggagccggcuggagucuccgagagaccgcaugccuggggaagaguuacgcccagauguggagccugauguacuuccaccggcgcgaccuccggcuggccgcgaacgugaucugcuccgccgugcccagccacuggguccccaccuccaggacgaccuggucgauccaugccaaacaugaguggaugaccaccgaggauaugcugaccguguggaaccgggucuggauucgcgagaauccguggauggaggacaagacucccguagaguccugggaggaaauccccuaccucggcaaacgagaggaccaguggugcgggagccugaucggccugacgucccgcgccaccugggcaaagaacauccaagcggccaucaaccaggugcggagccucaucgggaacgaggaguacaccgauuacaugcccuccaugaagcgcuuccggcgcgaggaggaggaagccggcgugcugugguaa

SEQ ID NO: 25312 - RNA, 9876 nt, Artificial Sequence
  derived and/or modified CDS sequence (opt11) from DENV-2__EU687249__SS-prME
agcgcagggaugauaaucauguuaauacccacagugauggccuuccaucucaccacgcgcaauggggagccucacaugaucgucgggauccaggagaaggggaaaucccugcuguucaagaccgaagacggagucaacaugugcacucucauggcgauggacuuaggagagcugugcgaggauaccaucaccuacaagugccccuuacugagacagaacgagccggaagacaucgauugcugguguaacagcaccuccaccugggucaccuacgggaccugcacaaccacgggcgagcacaggcgggagaagcgcagcguagcccucguaccccacguggggauggggcucgagacccggacggagacauggaugucgagcgagggugcuuggaagcacgcacagcgcaucgagaccuggauccuucggcacccgggcuucacgaucauggccgccaucuuggccuacacaaucgggaccacccacuuccagcgcguccucaucuucauccugcucacggccguggcucccuccaugaccaugcgguguauaggcaucagcaaccgcgacuucguggagggcgucucaggcggcagcuggguggacaucguccucgaacaugggucuugcgugaccaccauggcgaagaacaagccuacacuugacuucgaguuaaucaagacugaggccaaacagcccgcuacccuucggaaguacugcaucgaggcgaagcugaccaauaccaccaccgaaagccgcugcccuacucagggcgagcccucccugaaggaggagcaggauaagcguuucgugugcaagcacucgaugguugacaggggcugggguaacggcugcggucuguucggaaagggcgggaucgucacgugcgccauguucacgugcaaaaagaacauggagggcaaaaucguucagccagagaaccuggaguacaccauuguggugacgccccacuccggggaggagcacgcggucgggaaugacacggggaagcacggcaaagaaaucaagguaaccccgcaaagcuccaucaccgaggcagagcugacuggguacggcacagugacgauggagugcagcccucguaccggccucgacuucaaugagaugguacuuuugcaaauggagaacaaggccuggcucgugcaccgccagugguuccuggaccuaccccuccccuggcuaccgggggcugacaagcaggagaguaacuggauccaaaaggagacgcuggucaccuucaaaaacccccaugcuaagaagcaggacguggucgugcucgggagccaggaaggggcuaugcacacggcccugaccggcgccaccgagauacagaugagcaguggaaaccuucuguucaccgggcaccuuaaaugucggcugcgcauggacaagcuccagcugaagggcaugagcuacuccaugugcacagggaaguucaagguagucaaggaaaucgcugagacccagcacgggaccauugugaucagggugcaauacgagggggacgggagcccaugcaagauccccuucgagaucauggaucuggagaagcgcuacauacucggcaggcugaucaccgucaacccgaucgugacagagaaggacucucccgugaacaucgaagccgagccgccguucggagacagcuacaucauuaucggcgucgagccgggacaacuaaagcuuaacugguucaagaagggauccucuaucgggcagauguucgagaccaccaugcgcggcgcgaagcgcauggccauccuaggcgacacagccugggacuucgggucccuggguggcguguucacgagcaucgggaaggcccuccaccaggucuucggggccaucuacggcgcggcauucucgggugucagcuggaccaugaagauccugaucggcgugauaaucaccuggaucggcaugaauuccagaagcacuucccugucuguuucccugguccucguggggaucgugacgcuguacuugggcguuauggugcaggcggacucugggugugugguauccuggaagaacaaggaacucaagugcgggagcggcauauucaucaccgacaacgugcacacuuggaccgagcaauacaaauuccagcccgagagccccuccaagcuggcuagcgcgauccagaaagccagagaggaggggauaugcggcauucgguccguuacgcgccuggagaaccugauguggaagcagaucacccccgagcugaaucauauacuagccgagaacgaagucaagcugaccaucaugaccggggacaucaagggcauuaugcaggcagguaagcggagucugcgcccgcagccaacggaguugaaguacuccuggaagacguggggcaaagccaaaaugcucagcaccgaauccuacaaccagaccuuccugauugacgggcccgaaacggcggagugcccgaacacaaaccgggcuuggaacagcuuagaaguagaggacuauggguucggcguguucaccaccaauaucuggcuuaaacugaaggagaagcaggacgccuucugcgacuccaagcugaugagugccgccaucaaggacaaccgcgccguccacgccgacaugggguacuggaucgaguccgcccucaacgacacguggaagauagagaaggcauccuucaucgaagugaagaacugccacuggcccaagucccacacuuuguggagcaacggcgucuuggaauccgagaugaucauacccaagaaccucgccggccccguaagccaacauaacuacaggccgggguaucacacgcagauugcgggccccuggcaccuggggaaguuggagauggacuuugacuucugcgauggcaccaccgugaucgugaccgaggacugcgguaaccgcgggccgucccuccggaccaccacagccagcggcaagcugauuacggaguggugcugucgcagcugcacccugccgccgcuccgguaucgcggugaggaugggugcugguacgggauggagauccggccacugaaggagaaggaggagaaccuggucaauucccucgugacagcugggcacggccaaguggacaauuucagccugggcgugcugggcauggcccucuuccuggaggagaugcugcgcacccggguggggacaaagcacgcgauacucuuaguugcagucucauucaugacccuaauuaccggcaacaugagcuucaaagaccucgggaggguaguggucauggugggcgccaccauggcagacgacaucgggaugggcgugacguaccuggcccugcuggcggccuucaagguccggcccaccuucgcagccggcuugcugcuccguaagcugacguccaaggaacugaugaugaccacgaucggcaucgugcuucuuagccagucaaccauacccgagaccgugcuugaacucaccgacgcacuagcgcugggcaugaugguccucaagaucgugcgaaacauggaaaaguaccaguuagcugugacaaucauggccauccuuugcguuccgaacgccguaauccuccagaacgccuggaaggugagcugcacgauccucgcagugguguccgucagcccccuucuccucacuuccagccagcagaaaacggacuggaucccccuagcucucacgauuaaggggcugaacccuaccgccaucuucuugaccacccucucccggacuaacaagaagcgcaguuggccgcugaacgaagccaucauggcagugggcauggugucgauucucgcuagcucacuccugaagaacgacauccccaugaccggcccgcuggucgccgggggacuucugaccgugugcuauguccucacaggccggagcgccgaccucgagcuugagcgcgccacagacgucaagugggaggaccaggcggagauaagcggcaguagccccauccugaguaucaccaucagcgaggacgggaguaugagcaucaaaaacgaggaagaagagcagacccuaaccauucugauccggacgggcuuacucgugaucuccggccuguucccaaucagcauacccaucaccgcagcugcgugguaccugugggaggugaagaagcagcgcgccgggguccucugggacgugccaagcccuccgcccaugggcaaggcggagcuggaagauggggccuaccggaucaagcagaagggcauucugggguauagucagaucggugccggcguguacaaggaggggaccuuccacacgauguggcacgucacccgcggagcugugcucaugcacaaggggaagcggauugagcccuccugggccgacgugaaaaaggacuugaucagcuacggcgggggcuggaagcuggagggcgaguggaaggagggggaggagguacaagugcucgcccuggagccgggcaagaacccacgcgccguacagacgaagcccgggcucuucaagacaaacacgggcacgaucggagccgucucccucgauuucagccccggcaccuccggcagccccauaauagauaagaagggaaagguggugggccuguacgggaacggggucgugaccagguccggcgccuacgugagcgccauugcccaaacagagaaguccaucgaggauaaucccgagaucgaggacgacaucuuccgcaagcggcgccugacaaucauggaccugcacccaggggccggcaaaacuaagcgguaccuacccgccaucgucagagaggccaucaagcgggggcugcgcacccugauacuggccccgacgcgggucguggcugccgaaauggaggaggcccugcgcggucugcccauucgauaccagacccccgcuauccgcgcggagcacacagggcgcgagaucguggaccucaugugccacgcaaccuuuaccaugcgauugcugagccccgugcgcgugccgaacuacaaccucauaaucauggaugaggcccacuucaccgauccagccucgauugccgcucgcggcuacaucagcacgcgcgucgagaugggcgaggccgccgggauauucaugaccgcgacgccgcccggcagccgggaccccuucccccaguccaacgcgcccaucaucgacgaggagcgugaaauacccgagagaagcuggaacuccgggcacgagugggugaccgacuucaagggcaagacgguaugguucguaccguccaucaaggcggggaaugauaucgcggccugcuuacgcaaaaacggcaagaaggugauccagcucucccggaagaccuuugacagcgaguacgugaagacacgcacgaaugacugggacuucgucgugacgaccgacaucuccgagaugggcgccaacuucaaggcggagcgggugaucgacccccguaggugcaugaagccagucauccucacagacggggaggagcgcgugauccuggccggucccaugccggugacacauucguccgccgcgcagcgacgcgggcggaucgggcgcaauccuaaaaaugaaaacgaucaguacaucuacaugggggagccccuggagaacgacgaggauugcgcccacuggaaagaggcgaagaugcuccuggacaacaucaacacgcccgagggaauaaucccgagcauguucgagccugaacgggaaaaggucgacgccaucgacggcgaguaccgccugcgcggggaggcccggaagacuuuuguggaccucaugagacggggagaucugccaguuuggcuggcuuacaaggucgcugcggaggggaucaacuacgcggaccgccgguggugcuucgacggaaucaagaacaaucagauccucgaggagaacguggagguggaaaucuggacuaaggagggugaacgcaagaagcugaagccgcgguggcuggacgcccggaucuacuccgacccccucgcccugaaggaguucaaggaguucgccgccggccgaaagucccugacgcucaauuugaucacggagaugggccgccugcccaccuucaugacucagaagacccgggacgcucuagacaaccuugccguccuacacacugcagaggccggcgggcgcgccuacaaccacgcccucuccgaguuacccgagacgcuugagacccuccugcugcucacccugcuggccacggucaccgggggcaucuuucucuuccugaugucaggccgggggaucggcaagaugacacuggggaugugcuguaucauaaccgccuccauucuguuaugguacgcgcagauccaaccgcauuggaucgccgccucuaucaucuuagaguucuuccucaucgugcuccugauacccgagcccgaaaagcagcgcacgccccaggacaaccaauugacguacguggugaucgccauccugaccgugguggccgcgacgauggcgaacgagaugggcuuccuggagaagacuaagaaagaccucggguugggguccaucgccacgcagcagccggaaagcaacauccuggauauugaucuccggccugccuccgccuggacgcuguaugcgguugccacuaccuucgucacgccgaugcugcggcacucuauagagaacagcuccgugaacgugagccucaccgcgauagccaaccaggccaccgucuugauggggcuaggaaagggcuggccccuuuccaaaauggauaucggcguaccgcugcuggcgaucggcuguuauagccaggugaacccaaucacccuuacggcggccuugcugcuccuggucgcccacuacgcuaucaucggacccggccugcaagccaaggccacccgggaggcccagaagcgcgccgcggccggaaucaugaagaaucccaccguagaugggaucaccgugaucgaucucgaucccaucccauacgauccaaaguuugaaaagcaauugggccaggucaugcugcucauccugugcguuacacaggugcuaaugaugcggaccaccugggcucuuugcgaggcccugacccuggccacggggcccaucuccacccucugggaaggcaacccugggcgguuuuggaacaccaccaucgcggucuccauggccaacauuuuccggggcuccuacuuggcaggcgccgggcugcucuucagcaucaugaagaacacgaccaacacucgccgcggcaccgggaauaucggcgagacgcuuggcgaaaaguggaagucacggcugaacgcccucggcaagagcgaauuccagaucuacaagaaguccggcauccaggagguagaucgcacccuggcgaaggaggggaucaagcggggcgagacagaucaccacgcagugagccggggaagugccaagcuucggugguucgucgagaggaacauggugacccccgagggccgcgucgucgaucucgggugcgggcgcggagguuggucguacuauuguggcggauuaaaaaacguccgggaggugaagggccuaacgaagggcggacccggccacgaggagccaauaccgauguccacuuacggguggaaccucguccgucugcagagcggggucgacguauucuucaucccgcccgagaagugugacacucugcucugcgacauuggggagucuagccccaacccaacggucgaggcgggccggacacugcgcgugcucaacuuaguggagaacuggcugaauaauaauacccaguucugcauuaagguccucaaccccuacaugccauccgugaucgagaagauggaggcgcugcagcggaaguacgguggggcccucgugcgcaacccgcuuagccggaacagcacccacgagauguacugggucucuaacgccagcggcaacaucguguccagcguuaacaugaucucccggauguuaaucaauagguucaccaugcgccacaagaaggccacguacgagcccgacgucgaccucggaagcggcacgaggaacaucgguauugaguccgagguacccaaccuggauauaaucggcaaacgcaucgaaaagaucaagcaggagcaugagacgucuuggcacuacgaccaggaucaccccuacaagaccugggccuaucacggcuccuacgagaccaaacagaccgguucggcgucuucgauggugaacggcgucgugcgccugcucaccaaaccuugggacgugcuuccgacggucacccagauggccaugacggacacgacaccauucgggcagcagcggguguucaaagagaaaguagacacccgcacccaggagcccaaagagggcaccaagaagcugaugaagaucaccgccgaguggcucuggaaggagcugggcaagaagaagaccccgcggaugugcacgcgagaggaauuuacccggaagguccgcuccaaugccgcuuugggggcgauuuucaccgacgagaauaaguggaagucagcccgagaggccguggaggacucucgguucugggagcucgucgauaaagaacggaaccuacaucuggagggcaaaugugagaccugcgucuauaauaugauggguaagcgcgagaagaaacucggggaguucgggaaggccaaggguagcagagcuaucugguacauguggcugggcgcgcgcuuccuagaguucgaggcccucggguuccugaacgaggaccauugguucagucgggagaacucucugucaggcguggaaggggagggccuccacaagcuugguuacauccugcgcgacgucuccaagaaggaggggggggccauguacgccgacgauacggcggggugggacacccggauuacccuugaggaccuuaagaacgaagagauggugaccaaucacauggagggcgagcacaagaagcuggccgaggccaucuucaaacuuacguaucagaauaaggugguccgcgugcaacggcccacgccccgugggaccgugauggacaucauuagccggcgcgaccagcggggcagcgggcaggucggcaccuacggccugaacacguucaccaauauggaagcccaacugauccgccagauggagggggaaggcgucuucaagaacauacagcaccucaccgugaccgaggaggucgccgugcagaacuggcuggcgcggguugggcgcgaaaggcugucgagaauggccaucuccggcgacgacugcgucgugaagccccuggacgaccguuucgccaacgcgcugacggcacuaaacgacaugggcaagauccggaaggacauccagcagugggagccaagcaaagggugguccgauuggacccaggugccuuucugcagccaccacuuucacgaacuuaucaugaaggacggccgcguuuuagugguacccugccggaaccaggacgagcuuaucgggcgcgcgagaaucucacaaggcgccggguggagccuccgugagaccgccugccugggcaagucguacgcgcagauguggagccugauguacuuccaucggcgcgaccugcggcuggccgcgaacgccaucugcuccgcagugccaagccacuggguucccacgucccgcacaaccuggucgauccacgcgaaacacgaguggaugaccacugaggauaugcugaccguguggaaccgcgucuggauccgagaaaaccccuggauggaggauaagacgcccguggaaucaugggaggaaauucccuaucucggcaaacgggaggaccaguggugcggaagccugaucggccugaccucccgagccacgugggcgaagaacauccaggccgccauuaaccaagugcggucgcucaucgggaacgaggaguacacggacuacaugccgagcaugaaacguuucaggcgagaagaggaagaggccgguguccugugguga

SEQ ID NO: 25313 - RNA, 9876 nt, Artificial Sequence
  derived and/or modified CDS sequence (opt11) from DENV-2__EU660416__SS-prME
agcgccgggaugaucauaaugcugauccccaccgugauggccuuucaucucaccacccgcaacggggaaccgcacaugaucgucggaauacaggagaaaggcaaaagccugcuauuuaaaaccgaggacggcguaaacaugugcacccucauggccauggaccuuggggaacucugugaggacaccaucacauacaaauguccccuccugcgccaaaacgagccagaggauaucgacuguugguguaauucuaccuccacgugggugaccuaugggacauguaccaccaccggcgagcaccgccgcgagaagcgcagcguugcccuggugccccacgucggaaugggccucgagacccggaccgagaccuggauguccagcgagggggcguggaaacacgcgcaaaggaucgaaacuuggauccuucgacacccgggcuucaccaucauggccgcgauacuggccuacacgaucgggaccacccacuuccaacgcguucucauauuuaucuugcugacggccguggcccccucuaugaccaugcgaugcauagguaucucgaaccgcgacuucguggagggagucuccggcggcagcuggguggacaucgugcuugagcacggguccugcguaaccaccauggcgaagaacaagccgacguuagacuucgagcugaucaagaccgaggccaagcaaccagcuacccuccggaaguacugcaucgaggcuaagcucacuaacacgaccaccgagucaaggugccccacccagggggagcccucccugaaggaggaacaggacaagcguuuugucugcaagcacagcaugguggaccgcggaugggggaacggcugcggacuguucggcaaaggcggcauuguaacgugugcuauguuuacgugcaagaagaacauggagggcaaaauuguccaacccgaaaaucuggaauacaccaucgugguuacgccccauuccggggaggaacacgcggugggcaacgacacggggaaacacgggaaggagauuaaggucacaccccaaucguccaucaccgaggccgagcucaccggguacggcacugugacgauggagugcagcccuaggaccggccucgacuucaacgagauggugcuacugcagauggagaacaaggcauggcucgugcaccgccaaugguucuuagaccugccccuccccuggcuaccgggggccgacaagcaggaguccaacuggauccaaaaggagacucuagucaccuucaagaacccccacgcgaagaaacaagacguggucguauugggcagccaggagggggcgaugcacacggcacugaccggcgccacugagauacagaugagcuccgggaaucuccuguucacaggacaucugaaaugccggcugcgcauggacaagcuccaacucaaggguaugaguuacagcaugugcacggggaaauucaagguggucaaagaaaucgccgagacacagcauggcaccauugugaucagagugcaguacgagggggacggcagccccugcaagauccccuucgaaaucauggacuuagagcgccgauacguccucggccgauugaucaccgugaacccgaucgugacagagaaggauucucccgucaacaucgaggcggagccgcccuuuggagacagcuacaucaucaucggcguggagccugggcaacugaagcucaacugguucaagaaaggcuccagcaucgggcagauguucgagacuacgaugagaggcgcaaagaggauggccauccugggugacacggcuugggacuucgggucucugggcggcguguucacuucuauuggaaaggcccuccaccagguuuucggggccauuuacggcgcggcuuucucuggggucagcuggaccaugaagauccugauaggggugauaaucaccuggauuggcaugaacucgcgcucuacuucccugagcgucucccuggugcugguggguaucguaacacuguaccugggcgugauggugcaggcggauuccgggugcguuguguccuggaagaacaaggagcucaagugcgggucgggcauauucauaacggacaauguccacacuuggaccgagcaguacaaguuccagcccgagagccccuccaagcuggccucggcgauccaaaaggcccaggaggaggggauuugcggcauccgguccgucacgcgccuggagaauuuaauguggaaacagaucacuccagagcuaaaccacauccuggccgagaaugaggugaaguugaccauaaugaccggggacaucaagggcaucaugcaggccgggaagaggucccuacgcccgcagcccacggagcugaaguacucauggaagaccuggggcaaggcuaagaugcucagcaccgaguccuauaaccagacauuccugaucgacggaccggagacggcggagugcccgaacaccaaccgugccuggaauagccuggaggucgaagauuacggauucggcgucuucaccaccaacaucuggcucaagcugaaagagaagcaggacgccuuuugugacucuaagcugaugagcgccgcaauaaaggacaaccgcgcggugcaugccgacaugggauacuggaucgagagcgcucucaacgacacguggaaaaucgagaaggccaguuucaucgaggugaagaacugucacuggcccaagucccacaccuuguggucgaacggaguauuggaauccgagaugaucauccccaagaaccucgcuggccccgugucacagcacaacuaccggccgggguaccacacgcaaauagccggcccauggcaccucgggaaacuggaaauggacuucgacuuuugcgaugggacuaccgugaucgucacggaggauugcgggaaccgcggccccucccuacggaccaccaccgccagcggcaaacugauuacggaaugguguugcaggagcugcacacuaccgccguuacgguacaggggcgaagacggguguugguaugggauggagauucggccacugaaggagaaggaggagaaccucgugaacucacucgugaccgccggccaugggcaggucgacaauuucagccucggcguacugggcauggccuuguuccuggaggagaugcuccgcacucgaguagguaugaaacacgcaauccuccugguugccguguccuucgugaccuugauaaccggcaauaugagcuucaaagaccucgggaggguaguggugauggucggggccaccauggccgacgacaucgggaugggcgugaccuaccuagcccuccucgcggccuuuaaagugcgacccaccuucgccgccgggcuguuacuccgcaagcugaccaguaaggaacugaugaugaccacgauagggaucgugcuccugagccaauccacgauccccgagaccgugcuggagcuuacugacgcccuggcgcuggggaugauggugcucaagauugugcgcaacauggagaaguaccagcuggcggugaccauaaugacgauccugugcgucccgaaugcugucauacugcagaacgccuggaagguaucaugcaccauucuggccgugguguccgugagcccauuacuacucaccuccagccggcagaaaacggacuggaucccccuagcgcuaacgaucaagggccuaaaccccacggccaucuuccugaccacccucucccgcacaaacaagaagcgcagcuggccgcucaaugaggccauuauggccguggguaugguguccaucuuggcauccucccuccuuaagaacgacauacccaugacuggcccgcucguugccgggggccuccuaaccgucugcuacgugcugaccgggcgcuccgcagaccucgaguuagagcgggccacggacgugaagugggaagaccaggcagagaucuccgguaguucgcccauccuaucuauaaccauuucugaggacggguccaugagcaucaagaacgaagaagaggaacagaccuuaaccauucugauccggacgggccuauuggucaucagcggccuguucccgaucucuaucccuaucaccgcggccgccugguaccugugggaggugaagaaacagcgggccggagugcucugggauguccccaguccgccgccaaugggcaaggccgagcuggaggacggggcauaccgcaucaagcagaagggcauccucggauauagccaaaucggcgcuggagucuacaaggaggguacguuccacaccauguggcauguaacucggggagcaguacuuaugcacaaagggaagcggauugagcccuccugggccgacgugaaaaaggaccugaucucauacggcgggggauggaagcuggaaggcgaguggaaggaaggggaggaggugcagguccuggcccuggagccgggcaagaacccccgggccgugcagacgaagcccgggcuguucaagaccaacaccggcacuauaggggccgugucgcucgacuuuucacccggcacauccggcagccccaucauagacaagaaggguaaaguagucgggcuguaugggaauggcguggugaccagguccggcgcuuaugugagcgccaucgcucagacugagaagucgaucgaggauaaucccgagauugaagacgacaucuuccggaagcgccgacugacgaucauggaccugcaccccggagccggcaagacgaagcgcuauuuacccgcaauugugcgggaggcuaucaagcgcgggcuccggacccugauccucgccccaacacgcguuguggccgccgagauggaagaggcccuccggggccuccccauccgcuaccagacccccgccauacgcgccgaacauacuggcagggagauaguggaccucaugugucaugcgacauucacgaugcgccugcuuagccccguccgggugccgaacuacaacuuaauaaucauggacgaggcccacuuuacggauccagccuccaucgccgcccgcggcuauaucagcacgcggguugagaugggcgaagcggccgggauauuuaugaccgccacgccacccggcagccgcgaccccuuuccccagucaaaugccccuaucaucgacgaggaacgagagauccccgagcgcagcuggaacuccgggcacgagugggucacagacuucaaggggaagaccgugugguucgugccgucgaucaaggccggaaacgacaucgcggccugccucagaaagaacgguaaaaaggucauccaguugucccgcaagacguucgacucagaguaugugaaaacucgaaccaaugacugggacuucguggucacgacugacaucagcgagaugggcgcuaacuucaaggccgaacgcgucaucgauccucggcgcugcaugaagccggucauccucacugacggggaggagcgggucauccuggcuggcccuaugccggugacccacucuuccgccgcgcagcgucgggggcguauaggccggaaccccaagaacgagaacgaccaauacaucuauaugggggagccccuggagaaugacgaagauugugcccacuggaaggaggccaaaaugcuccuggacaauaucaacacgccagagggaaucaucccgagcauguucgaaccugagcgcgaaaaaguugacgcgaucgacggagaauaccggcugcgaggugaagccaggaagaccuucgucgaccucaugcggcgaggggaucugcccguguggcuggcuuacaagguggccgccgaagggaucaacuacgcggaccggcgcuggugcuucgacggcaucaagaacaaccaaauccucgaggagaacgucgagguggaaaucuggaccaaggagggagagcguaagaagcugaagccgcgcuggcuggacgcccggaucuacagcgauccucuugcccugaaggaguucaaggaguucgccgccggucgcaaaucacucacccucaaccugaucacagagaugggucggcugcccacauucaugacccaaaagacccgcgaugcccuggacaaccuggcgguccugcacacggcagaagccgguggcagagcguacaaccacgcccucuccgaacuccccgagacccuggagacacuccugcuccucacucuuuuagccacggugaccgggggcaucuuccucuuucugaugaguggccgggggaucggcaaaaugacccugggaaugugcuguaucaucacagcuucaauccuccugugguacgcccagauucagccccauuggaucgcggccagcaucauccuggaguuuuuccucauuguucugcugaucccggagccggagaagcagcgaacaccacaggacaaccaacucacguacguugugaucgccauccugaccguggucgccgccaccauggcgaacgagaugggcuuccuggagaagaccaagaaagaccucgggcugggcagcauagcuacgcagcaaccggagucgaacauccuggacauagaucucagaccugcuuccgccuggacucuguacgccguagcgacgaccuuugucacccccauguuacgucauagcaucgagaacucguccgucaacgugucccuuaccgccaucgccaaccaggcaacuguccugauggggcucgggaaaggcuggcccuugucgaagauggacauaggggucccgcugcuggcgauuggcuguuacucacaagugaaucccaucacucucacggcugcccugcugcuccugguggcgcauuacgccauuaucgggcccggacugcaggcgaaggcuacccgcgaagcccagaagcgggccgcagcggggauaaugaagaacccuaccgucgacgggaucacagugaucgaccuggacccgaucccauacgacccgaaauucgagaagcaauuaggccagguuaugcugcuaaucuugugcgucacucaaguguuaaugaugaggaccaccugggcacuaugcgaggccuugaccuuggccacgggaccgaucucgacacucugggagggcaauccgggacgguucuggaacaccaccauugccgugaguauggcgaacauauuccgcggcuccuaucucgccggcgcuggguuacuauucaguauaaugaagaauacgacuaacacgcggagaggcacugggaacaugggcgaaacccugggcgagaaguggaagucccgccugaacgcccuaggaaaguccgaguuccagauuuauaagaaauccggcauacaggaggucgaucggacccuggcuaaagagggcaucaagcggggugagaccgaccaucacgcgguuagccggggaucugccaaauuacggugguucguggagaggaacauggucacccccgagggcaaaguuguggaucucggaugcgggagaggcggcuggagcuacuauugcggugggcugaaaaacguccgggaggugaaaggcuuaacgaaaggcgggcccggccacgaggagcccaucccgauguccacuuacgguuggaaccucguacgccuacagucuggugucgacguguucuuuauuccacccgagaagugcgacacgcuccuuugcgauaucggggaguccagccccaauccgacuguggaggccggucggacgcugcggguccuaaaccugguugagaacuggcugaacaacaacacgcaguuuugcaucaaggugcugaaucccuacaugcccuccgucauugagaagauggaggcgcugcaacggaaguacggcggggcccucgugcgcaacccguugagcagaaauuccacccacgagauguacuggguguccaaugccagcggcaauaucguaaguaguguaaacaugaucagucgcaugcuaaucaaccgguucaccaugcgccauaagaaggccaccuacgagcccgacguagaccucggcuccggcacgcggaacauugggaucgaguccgagauccccaacuuggacaucaucgggaaacgaaucgagaaaauuaagcaggagcacgagaccagcuggcacuaugaccaggaccaucccuacaagacgugggccuaccacggauccuacgaaaccaaacaaacgggguccgccuccagcauggucaacggcguggugcgcuugcucaccaagccgugggacguccugcccaccgugacccagauggcgaugacggacaccacccccuucggacaacaacguguguucaaggagaaggucgauaccaggacgcaggagccuaaagagggcacgaagaagcugaugaagauuaccgccgaguggcuuuggaaagaacuaggcaagaagaaaaccccgcggaugugcacgcgggaggaguuuacuaggaaaguccgcuccaaugccgcccuaggcgccauuuucaccgacgaaaauaaguggaagagugccagagaggccguagaggacucccgcuuuugggagcucgucgacaaggagcgcaaccugcaucuugagggcaagugcgagacuugugucuacaacaugauggguaaacgcgaaaagaagcucggcgaguucgggaaggccaaagggagucgagccaucugguacauguggcugggggcgcgcuuccuggaguucgaggcguuaggauuccugaaugaggaccacugguucucccgugagaacagccuguccggagucgagggggagggccuccacaaguugggauacauccugcgcgacgugagcaagaaggagggcggcgccauguacgccgaugacaccgccgggugggauacccggaucaccuuagaggaccugaaaaacgaggagauggugaccaaucacauggagggcgaacauaagaaacuggcugaagccauauucaagcucacguaccaaaacaaggucguucgcgugcaacggcccacgccccgcgggacagucauggauaucaucagccggcgcgaccagcgggggucaggacaggugggaacauauggccugaacacguucaccaacauggaggcacagcugauucgucagauggagggcgagggcguguucaagaacauccaacaucucaccgucacggaagagguggccguacagaacuggcuggcccggguugggagggagagguugucucggauggcuaucuccggggacgacuguguugugaaaccccucgacgaucgcuucgccaaugcccucacggcgcugaaugacaugggaaaaaucaggaaggacauccagcagugggagccgucaaaaggguggaacgacuggacccaggucccauucugcucgcaccacuuccacgaacugaucaugaaggacggccgcgugcucguagucccuugccggaaccaagacgagcugaucgggcgcgcacggaucagccagggugcgggguggagucuccgagagaccgccugucuggguaagagcuacgcccagauguggucccugauguacuuccaccggcgcgaucuucggcucgccgccaaugcgauuuguagcgccgugcccucccacuggguccccaccagccgcacgaccuggucgauacaugccaagcacgaguggaugacuacagaggacaugcugacugucuggaacaagguguggauacgggagaacccuuggauggaggacaagaccccggucgagagcugggaggagauacccuaucuaggcaagcgugaagaccaguggugcgggucgcugaucggucugacuagccgggccacaugggccaaaaacauccaggcggccaucaaccagguccgcucacucaucgggaaugaggaguauaccgacuacaugccgaguaugaaacgguuccgacgcgaagaggaggaggcaggagugcugugguga

SEQ ID NO: 25314 - RNA, 9876 nt, Artificial Sequence
  derived and/or modified CDS sequence (opt11) from DENV-2__EU660417__SS-prME
ucggccgggaugaucaucaugcucauccccacugugauggccuuccaccucacgacaaggaacggggagccccauaugauaguagggauccaggagaagggcaagagccugcuguuuaagaccgaggacggcgugaacaugugcacgcucauggcgauggaucuuggggagcugugcgaggacacgaucaccuauaagugcccccuccuccggcagaaugaacccgaagacaucgacuguuggugcaacagcaccuccacguggguaacuuauggcaccugcaccacgaccggcgagcaccgccgggagaagcgcucggucgccuuagugccccacguugguaugggcuuagaaacccggacagaaaccuggaugucaagcgagggggccuggaagcacgcgcagcggaucgagaccuggauccuacggcauccgggcuuuacgaucauggccgccauacuggccuacaccaucgggacaacccacuuccaacgcguccucaucuucauccugcugacggccguggcgcccuccaugaccaugcgauguaucgguaucucaaaucgcgacuuuguagagggcgucucaggggguagcuggguggacaucgugcucgagcacggguccugcgucacaaccauggcgaaaaacaagcccacguuggauuucgagcugaucaagacggaggccaagcagcccgcaacccuccggaaguacugcaucgaggccaaguugacuaacacgaccacugagagccgcugccccacccagggugagcccagucugaaagaggagcaggacaagcgguuuguaugcaagcacagcaugguggaucgcggcugggggaacggcugcgguuuauucgggaagggugguauugucacgugcgccauguucacgugcaagaagaacauggaggggaaaaucguacagccugaaaaccuagaauacaccaucgugguuacgccacacuccggggaggagcacgcgguggguaacgacacggggaaacacggcaaggagaucaagguaaccccgcagagcuccaucaccgaggccgaacugaccggguacggcaccguaacgauggagugcagcccuaggaccggccucgauuucaacgagaugguucugcugcaaauggagaacaaggcauggcucguacaucgacagugguuccuggaccuuccccuccccuggcucccgggggccgacaaacaggaguccaauuggauucagaaagagacccuggucaccuucaagaauccccacgcgaagaaacaggacgugguaguucucggcagccaagagggggcgaugcacaccgcccugaccggcgccaccgagauccagaugagcuccgguaauuugcuguucacuggccaccugaagugccgcuugcgcauggacaagcugcagcugaaggguaugucguacuccaugugcacagggaaguucaagguggucaaagagaucgccgagacccagcacggcaccaucgugauacggguccaguacgagggggacggcagccccuguaagauccccuucgagaucauggaccucgagcgccgguacgucuugggccgccugaucaccgugaacccgauaguuacggagaaggauucccccguaaacaucgaggccgagccgcccuucggggacagcuacaucauaaucggcguggaaccggggcagcugaagcugaauugguuuaagaaggguuccagcauuggacagauguuugagaccaccaugcgaggcgccaagcguauggcaauccugggcgauaccgccugggacuucgggagucugggcggaguguucacgagcaucggcaaggccuugcaccaagucuucggggccaucuacggcgcggccuucuccggcgugagcuggaccaugaagauccugauagggguuaucaucaccuggaucgguaugaacucccgcagcaccucgcugucgguuucccuggugcucgucgggaucguuacgcuguaccuaggcgucaugguccaggccgacagcgggugugugguaagcuggaagaacaaggagcugaagugcggcagcggcaucuucauuaccgacaaugugcacaccuggaccgaacaauacaaguuccagccugagagcccguccaagcuggccagcgcgauccagaaggcccaggaagaggggaucugcggcaucagguccgucacgagacuggagaaucuuauguggaagcagaucacccccgaacugaaccacaucuuggccgagaacgaggugaagcucacgauaaugaccggggacauuaagggaaucaugcaagccggcaagcggagccugcgcccgcagcccacggagcugaaauacucuuggaagacguggggcaaagccaagauguugucaacugaaucguacaaccaaacguuccugaucgacggccccgagacggcggaguguccgaacaccaaccgcgcuuggaauagccuggagguggaagacuacggauuuggcgucuucacgacaaacaucuggcucaaacugaaggaaaagcaggacgccuucugcgacuccaagcugaugagcgccgcaaucaaggacaaucgagcggugcacgccgacaugggguauuggauugagucagcccucaacgacaccuggaagaucgagaaggccagcuucaucgaggugaagaacugccacuggcccaaaucccauacccuauggagcaacggaguccucgaaagugagaugaucauccccaagaaccucgccggcccagugagucagcacaacuaccguccuggguaccacacucagauagcuggacccuggcaccuggggaagcuugagauggacuucgacuuuugcgacggcaccaccgugaucguaacggaggacugcgguaaccgcggccccagccuccggacuacgaccgcuagcggcaagcugaucacggaguggugcugccgcagcugcacucugcccccgcuccgguaucguggggaggacggcugcugguacggcauggagauccgaccccucaaggagaaggaggagaaccuggugaacucgcucgugaccgccggucacgggcaggucgauaacuucagccugggcguucugggcauggcccucuuccuggaggagaugcugaggacgcgggugggaacgaagcacgcgaucuuacuggucgcugugagcuucgucacccugaucacugggaauaugucguucaaagaucucgggcgcgucguggugauggucggagccacaauggccgaugauaucgggaugggugugacguaccuggcccuucucgcugccuucaaagugcggcccacauuugccgccggccugcugcuccgcaagcugacguccaaggagcugaugaugaccacgaucggaaucgugcuccugagccaguccaccaucccagagaccguacuggagcuaaccgacgcgcuagcgcuggggaugaugguucuaaagaucguccgcaacauggagaaguaccagcuggccgucaccaucaugaccauacugugugucccuaacgcugugauccuccagaacgccuggaaggugagcugcacgauacuggccgucguguccgugucaccccuucuucucaccuccagccggcagaagacggacuggaucccccuagcgcucacaaucaaggggcugaaccccacagcuaucuuccuaaccacgcucucacggaccaacaagaagcguagcuggccguugaacgaggccaucauggcugucggcauggucucuauccuggcgagcucucuucugaagaacgacaucccgaugacugggccguuaguugccgggggacucuugaccgucugcuaugugcucacggggcgaagcgcagaccucgagcuggaacgggccacugacgugaagugggaggaccaggccgagaucuccggcagcagccccaucuugucgaucaccaucagcgaggacggaucuaugagcauaaagaacgaggaggaggagcagacgcugacgauccugauccgcaccggccuucucgucaucagcggccuguuccccauaagcaucccaaucaccgcggccgcaugguacuugugggaggugaagaaacagcgggcgggggugcucugggauguccccagcccgccgcccauggguaaggccgagcuggaggacggugcguaccgaaucaagcagaagggcauacugggguacucgcaaaucggggccggcguguacaaagaggggacauuccauacgauguggcacgugacgcguggcgccguacuaaugcacaaagggaaaagaaucgagcccaguugggccgacgugaagaaggaucuaaucaguuacggagggggcuggaaguuggagggcgaguggaaggagggugaggaggugcagguccucgcgcuggaacccggcaaaaacccccgggcgguccagaccaagcccgggcuguucaaaacgaacacgggcacgaucggcgcgguuuccuuagacuucagucccgggaccuccggcagccccaucaucgacaagaaaggaaaaguagugggccuguacgggaacggagucgucacgcgcucgggcgccuacguaucggccauugcccagaccgagaaguccauugaggacaaccccgaaaucgaagaugacaucuuccggaaacgcagacugacgaucauggaccugcacccaggggcugggaagaccaagcgcuaccucccggccauugugagggaggccaucaagcgagggcugcgcacccugauacucgccccgacccgcgucguggcggcugagauggaggaggcccugcggggccugccaauccgcuaccagacgccagccauccgcgccgaacauacagggcgggaaaucguggaccucaugugccaugcgacuuucaccaugcgccugcuuaguccaguccgggugccgaauuacaacuugaucaucauggacgaggcccauuucacggaucccgccuccaucgcagcgcgaggguacauaagcacacgaguggagaugggcgaggcagccgggaucuuuaugaccgcuacgccacccggcagucgcgacccguucccccagucaaaugcccccauaaucgacgaggagcgggaaaucccggagcggagcuggaacuccggccacgagugggucacggacuucaaaggcaagaccgugugguucgugccgagcauuaaggccgggaaugacaucgccgcuugcuugcggaaaaacggaaagaaggucauccagcugagccgcaaaaccuuugauagcgaguacgugaagacacggacuaacgauugggacuuugugguaacaaccgauaucuccgagaugggggccaauuuuaaggccgagcgcgugauugauccgcggcgcugcaugaaacccgucauccucaccgacggggaggagcgagucauucuggcgggccccaugcccgugacgcacagcagcgccgcccagcgucgggggcguaucggccggaaccccaagaacgaaaacgaccaauacauuuacaugggagagccacuggagaacgacgaggacugcgcccacuggaaagaggccaagaugcuccuggauaacaucaacacuccagagggcaucaucccgucaauguucgagcccgagcgcgagaaaguggacgcgaucgacggcgaauaccgccugcgcggggaggccaggaagaccuucgucgaccucaugcggcguggcgaccugccaguauggcuugcauacaaagucgccgcagaggggauaaauuacgcugaucgccguuggugcuuugacgguaucaagaauaaccagauccuagaagagaacguugagguggagaucuggaccaaggagggggagcggaagaagcuaaagccucgcugguuagaugcacggaucuacagcgacccccucgcgcugaaagaguucaaggaguucgccgcaggucguaagagccugacgcucaaccugaucaccgaaaugggccgguuaccaacguucaugacccagaagacgcgcgacgcgcucgacaaucuagccguccuacacaccgccgaggccgggggccgggcguacaaccacgccuuauccgagcugcccgagacccuggagacccuccugcugcucacucugcuggccaccgugacuggaggcaucuuucuguuccugaugagcggccgcgggauugggaagaugacccuggggaugugcugcauuauaaccgcuuccauccuccugugguacgcgcagauccagccucacuggaucgcggccagcaucauccuggaguuuuuccuaaucguacugcugaucccagagcccgagaagcagcggacgccccaggacaaccagcuaacuuacgucguuaucgccaucuuaaccgucgucgcugccacaauggcaaaugagaugggcuuccuggagaaaacuaagaaggaucuagggcuuggcaguaucgcgacccagcagccggagagcaacauccuggauaucgaccuccgccccgccuccgcguggacucuguacgccguggccacgacguucgugaccccaaugcugcggcacagcaucgagaauagcuccgucaauguaagcuuaacggccauagccaaccaggcaacggugcuuaugggccuggguaagggcuggccccucuccaaaauggauaucgggguaccacuguuagccaucggcugcuacagccaggugaaccccaucacgcugaccgcggcccugcugcuccugguggcccacuaugccaucaucgggccggggcugcaggcgaaggcuacucgcgaggcccagaagcgggccgccgcgggcaucaugaagaaucccacggucgacgggaucacggugaucgaccucgacccgauccccuaugaucccaaguucgagaagcagcugggucaggugaugcuacucauccucugcgucacccaagugcucaugaugcgcaccaccugggcccucugugaggcccugacucucgccaccgggcccaucuccacacuaugggagggcagcccggggcgguuuuggaacaccacuaucgcuguauccauggcaaacaucuuccgcgguucguaccuggccggcgccgggcuccucuuuuccauaaugaagaacaccacaaauacccgucggggcaccgggaacaugggcgagacccugggggagaaguggaaaucucggcugaacgcacucgggaaguccgaguuccagaucuacaagaaguccgguauccaggaggucgaccgcacccuggccaaggaggggaucaagcgcggcgagaccgaccaccacgcggucuccaggggcucagcaaagcugcgcugguuuguggaaaggaacauggucaccccggaaggcaaagugguggaccucggcugcgggcgcggcggauggagcuauuacugcggcgggcuuaagaacguccgcgaggugaagggccugacaaagggcggcccgggccaugaggagcccaucccgaugagcaccuacggauggaaccucgugagacugcaguccggggucgacguguucuucaucccaccggagaagugcgacacccugcucugcgacauuggugagagcagccccaaccccacgguggaggcaggccgaacccuucguguccugaacuugguggagaauuggcugaacaacaacacccaguuuugcaucaaagugcugaaccccuauaugcccucggucauagaaaagauggaggcccuacagcggaaguacggcggggcgcucgugcgcaacccucuuagccgaaauucgacccacgagauguacugggugagcaacgccuccggcaacaucgucuccuccgugaauaugaucagccgcaugcugaucaaccguuucacuaugaggcacaagaaggccacguacgagccagauguugaccucggaucugggacccggaacaucgggaucgaaagcgagauucccaaccuggacaucaucgguaaaagaaucgagaagaucaagcaagagcacgagacguccuggcacuacgaccaggaccaccccuacaaaacaugggccuaccacggcagcuacgaaacgaagcagaccgggagugccucauccauggucaacggcguggugcgccugcuuaccaagccgugggacguccugccuacggugacgcaaauggcgaugacggacacuacccccuucgggcaacagcggguguucaaggagaagguugacacgcgcacacaggagccaaaagaggggacaaagaagcugaugaagaucaccgccgaguggcuauggaaagagcugggcaagaagaaaacgccgcguauguguaccagagaggaguucacccggaagguccgcagcaacgccgcgcugggagccaucuucaccgacgaaaacaaauggaaauccgcgcgggaggcaguggaggacagccguuucugggagcucguggacaaggaaaggaaccugcaucuggaggguaagugcgagacaugcguguacaacaugauggggaaacgcgagaaaaaguugggcgaguucggcaaggccaaaggcucacgggcuauaugguauauguggcugggcgcccgcuucuuagaguucgaggcguugggguucuugaacgaagaccacugguucagccgggaaaacucccugagcggcgucgagggggaaggucuccacaaguuaggguacauccucagagacgugucuaaaaaagagggcggcgccauguaugccgacgauaccgccgggugggacacccgaaucacucucgaggacuuaaagaacgaggaaauggugacgaaccacauggaaggugagcacaagaagcuggcggaagcaaucuucaagcugaccuaccaaaauaagguggugcgcgugcagcggccgacgccccgggggaccgucauggacaucaucucccggcgcgaccagcggggcagcggccaggugggaacauacggccugaacaccuucacaaacauggaggcccagcugauucgccagauggagggugagggcguguucaaaaacauacagcaccucaccgucacggaggagguggccgugcagaacuggcuggcgcgcguggggcgggagcgccuuucccggauggcuaucuccggcgaugacugcguggugaagccgcucgacgaccgcuuugccaacgcccugaccgccuuaaacgacaugggcaagauccguaaggacauccagcagugggagccguccaaaggguggaacgauuggacccaggucccauuuugcucacaccacuuccacgaacucaucaugaaggaugggcgcgugcugguuguccccugccggaaccaggaugagcugaucggucgcgcccgaaucucccagggcgcgggguggucguugcgcgagaccgccugucugggcaaguccuacgcccagauguggagccugauguacuuccacaggcgugaccuccggcuggccgccaacgcaauuugcuccgccguccccagccacugggugccgacguccaggacaacuuggagcauccacgccaagcacgaguggaugaccaccgaggacaugcugacgguuuggaauaagguguggauccgcgagaaucccuggauggaagacaaaacccccguggaguccugggaggaaauccccuauuugggcaagcgcgaggaucaguggugcggcagccugaucggccugaccuccagagccaccugggccaagaacauacaggcggcgaucaaccagguccggagccucaucgggaaugaagaguacacggacuacaugccgaguaugaagagguuccgccgcgaggaggaggaagccggcguccugugguga

SEQ ID NO: 25315 - RNA, 9876 nt, Artificial Sequence
  derived and/or modified CDS sequence (opt11) from DENV-2__EU677137__SS-prME
ucggcgggcaugaucaucaugcugauucccaccgucauggccuuccaccuuacuacgcggaacggugagccccacaugauaguaggcauucaggagaaggggaaaucacugcuuuucaagaccgaagacggcgugaacaugugcacauuaauggcgauggaucugggcgaacucugcgaggacacgauuaccuauaaguguccgcuccugcggcaaaacgagccagaggacauagauugcugguguaacagcacaagcacgugggucaccuacgggacuugcaccaccacaggcgagcacaggcgggagaagcgcagcgucgcucuggucccucauguggguaugggccucgagacgcguaccgagaccuggaugagcuccgagggugccuggaagcacgcccagcgcaucgagacuuggauccugcggcacccgggauucacgaucauggcggcgaucuuagccuacaccaucgggaccacacacuuccagcguguccucaucuucauacuguuaacagccguggcucccagcaugaccaugcggugcaucggcaucagcaaccgcgacuucguggagggcgucagugggggcagcuggguggauaucguguuagagcauggguccugcgugacaaccauggcgaagaacaagccuacauuagacuucgagcuuaucaaaaccgaggcuaagcaacccgccacucuccguaaguacugcaucgaggccaaacugaccaacacgacaaccgagagccgcugccccacacagggcgagcccuccuugaaggaggaacaggacaaacguuucgucugcaagcacagcaugguggaccgcggcuggggaaaugguugcggccuguucggcaagggagggaucgucaccugcgccauguucacuugcaaaaagaacauggagggcaagaucgugcaaccggagaauuuagaauacaccauugucguaacgccacacuccggugaggagcacgccguuggcaacgacacggggaagcauggccaggagauuaaggugacaccgcaaagcucuaucacagaggccgaauuaacagguuacggcacgguuacgauggagugcagcccgagaaccggcuuggacuuuaacgagauggugcugcugcaaauggagaauaaagccuggcuuguccaucgccagugguucuuggaccugccccucccguggcugccuggggccgacaagcaggaguccaacuggauccaaaaggagacccuggugaccuucaagaacccucacgcaaagaagcaggacgugguaguccugggcagccaggaaggggcgaugcacacagcccuuacaggggccacggagauucagaugagcucgggaaaccuccuuuucacgggccaccugaagugucgguuacgcauggacaagcugcagcuaaaaggcaugucuuacuccaugugcacgggcaaguuuaaaguagucaaggagaucgcagaaacccaacacgggaccauuguuauccgaguacaguaugagggggacggcucucccugcaagauccccuucgagaucauggaccuggagaagagguacguccuuggccgccucauaaccguuaacccuauugugacggagaaagacucccccgucaacauugaggccgagccgccguucggcgacuccuacauaauuaucggcgucgagccagggcagcucaaguugaacugguuuaagaagggcucaagcauagggcagauguucgagaccaccaugaggggugcuaaaagaauggccauccugggcgacaccgcuugggacuucgggucccucggcggcguauucacgucuaucggcaaggccuugcaccaggucuucggggcuauauacggcgcagcuuucucgggcgucagcuggacuaugaagauccucaucggggugauaaucacauggauuggcaugaacucccggagcaccucccuuagcgucucgcugguacucguugguaucgucacguuauaccugggcgugauggugcaggcggauagcggaugcgucgucucguggaagaauaaggaacucaagugcgggagcggcaucuucauuaccgacaacguacacaccuggacagagcaguacaaguuucagcccgaaagccccuccaaacucgcaagcgcgauucagaaggcccaggaggaggggaucugcgggauccggucugucacgcggcucgagaaccucauguggaagcaaauuacucccgaguugaaccacauacuagcggaaaacgaggugaagcucaccaucaugaccggagacaucaaaggaaucaugcaggccgguaagcggagccugcggccgcaacccacugaguugaaguacucuuggaagacgugggggaaagcuaaaaugcucuccaccgaguccuacaaccagacauuucugaucgacggcccagagacggcugagugcccgaauacaaaccgcgcuuggaauucccuggagguggaagacuacggguuuggugucuucacaacaaauaucuggcucaagcuuaaggagaagcaggacgccuuuugcgauuccaagcuaaugucggccgccauaaaagauaaccgggcugugcacgccgacaugggguacuggaucgaguccgcacucaacgauacguggaagaucgaaaaagccagcuuuaucgagguuaagaacugccacuggccgaaaucccacacccuguggagcaacggcguccucgagucugaaaugaucauacccaagaaccucgccggacccguuagccagcacaauuacagaccgggguaccacacgcagaucgcgggccccuggcaccuggggaagcuggagauggacuucgauuuuugcgacggcacaacugugaccgucaccgaggacugcgguucccgggguccuucucuucguaccaccacugccagcggcaagcuuaucacugaaugguguugccggaguuguacgcugccaccccugcgcuaccgcggggaggauggcugcugguacggaauggagauccgcccccucaaggagaaagaagagaaucuggugaauucacucguaacggcuggccacggacaggucgacaacuucucccucggcgugcugggcauggcccuguuccuggaagagaugcugcgaacgcgcgugggaaccaagcacgcgauccugcugguggcuguuuccuucgugacccuuaucaccggcaauaugucuuucaaggaccuagggcgaguggucgugauggucggcgcgacgauggcugaugacaucgggaugggcgugaccuacuuagccuuacuggcagcuuucaaaguacgccccacuuuugcggccggacuccuucuucggaaacugaccagcaaggaguuaaugaugacgacuaucgggauaguccugcugucgcagagcacgauacccgagacaguucuggagcucaccgaugcgcuggcccugggcaugaugguguugaagaucguacgcaauauggaaaaguaccaacuggccguuacgauaauggcaauccugugcgucccaaacgccgugauccuccaaaacgccuggaaaguguccugcacgaucuuagcgguuguaagugugucuccucuguuacugaccucgucccaacagaaaacagacuggaucccccuggcgcucaccgucaagggacugaaccccaccgccaucuuccugaccacgcucagccgcacuaacaagaaacguuccuggccacugaacgaggccaucauggcagugggcaugguuagcauucuagcaagcucgcuacugaagaacgacauacccaugacagguccccuaguugccggaggccuccugacugugugcuacguguuaacggggcgcuccgccgaucuagaacuggagcgugccaccgacgucaagugggaggaucaggcugaaaucagcgguucgucgccuauccuguccaucaccaucuccgaggaugguaguauguccaucaagaacgaggaggaggagcagacccuaacgauccugauccgcacagggcuucuugugaucagcggccuguucccgaucuccaucccuaucacagccgccgccugguaccugugggaaguuaagaagcaacgcgccgggguccucugggacguucccuccccgccgcccaugggcaaggccgaauuagaggacggggccuaccgaaucaaacagaagggcauacugggauauucgcagaucggagcuggcguguauaaggagggcaccuuccauaccauguggcacgucacgcgaggcgccgugcucaugcacaaagggaagcgaauugagcccuccugggcggacgucaagaaagaccugauauccuacggcgggggcuggaagcuagagggagaguggaaagagggugaagaaguccagguacuagcgcuagaaccggguaagaacccucgggccguucagacuaagccagggcucuucaaaaccaacaccgguacgaucggggccgucagccucgacuuuucccccggcaccagcgggucccccauaaucgacaagaaagggaagguggugggauuauaugggaacggcgucgugacacgcagcggcgccuacguguccgcgaucgcgcagaccgaaaagucgaucgaggacaaccccgaaaucgaggacgauaucuuccggaagcgccggcuuacgauaauggaccugcaccccggcgccggcaagacuaagcguuaccugcccgcuaucgugcgggaggcgauuaagcgggggcuucggacccuaauccuggccccgacgagggugguagccgccgagauggaagaggcccugcgugggcugcccauccgcuaccagacccccgcuauacgggcggaacacacgggcagggaaaucgucgaccugaugugccacgcuaccuucaccaugcgccuacucucccccguucgggugcccaauuauaaccucaucaucauggacgaggcccacuucacggacccagcgucgaucgccgcgcgcggcuauaucagcaccagggucgaaaugggcgaggcugcagggaucuucaugacugcuacgccaccuggcagccgugacccauucccacaguccaacgccccgaucauugacgaagagcgggagaucccagagcguuccuggaacuccggacacgaguggguuacagauuucaagggcaagacugugugguucgucccgucgauuaaggcggggaacgacaucgccgcuugccugaggaagaacggcaaaaaggugauacaauuaucccgcaagacguuugacuccgaguauguuaagacgcggacgaacgauugggacuucguagugaccaccgacaucucugagaugggugccaacuuuaaggcggagagagugauugauccacggcgcuguaugaagcccgucauccuaaccgacggggaggagcgggugauacuggcaggucccaugccggugacucacuccagcgcugcucagcgccgggggcggauuggccggaauccaaagaacgagaacgaccaguacaucuacaugggugagccccuggagaacgaugaagacugcgcccacuggaaagaggcgaaaaugcuccuagauaacauuaacacaccagagggaaucauuccgagcauguuugagcccgaacgcgaaaaaguagaugcgaucgacggcgaguacaggcugcgcggagaggcucguaagacuuuuguagaccucaugcggcgaggcgaccugcccguguggcuggcguauaaggucgccgcugaggggauuaacuaugcggaucggcgcugguguuucgacgguaucaagaacaaccagauacucgaagagaacguggaggucgaaaucuggaccaaagagggagaacggaagaagcuaaagccgcgcugguuagacgcccggauuuauucagacccacucgcguugaaggaguucaaagaauucgcggcgggacgcaagagucucacguugaaucugauuaccgagaugggccggcuacccaccuucaugacacagaagacgcgcgacgcccuugacaaccuagcggugcugcauacugccgaggcagguggucgcgcguacaaccacgcgcucucggaacugcccgagacccuggaaacccuucugcugcucacgcuguuagccacggugaccgggggcaucuucuuauuucugaugaguggucgagguaucggcaagaugacccugggcauguguuguaucaucacagcgagcaucuugcucugguacgcucagauccagccgcauuggaucgccgcuuccaucauccuggaauuuuucuuaauagugcugcugauacccgagcccgaaaaacagcggacgccgcaagacaaccagcucacuuacgucgugaucgccauccuaacggucguugcagccacaauggcuaacgagauggguuuccuggaaaagacgaagaaggaccucggucugggcucgauugccacgcagcagccugaguccaauauucuggacaucgaccuccgccccgccucagccuggacccuauacgccguagccaccacguucgucacuccgaugcugaggcacagcaucgagaauuccagcgugaaugugagccucaccgccauagccaaccaagcuacggucuugauggguuuggggaagggguggcccuugagcaaaauggacaucgguguaccguugcuggcgaucggauguuacucgcaaguuaaccccaucacgcucaccgccgcccugcugcuccugguagcccacuaugcgaucaucgguccuggucugcaggccaaagcaaccagagaggcccagaagcgcgccgcggcugguaucaugaagaaccccaccguugacggaaucaccgugaucgaccuggacccgauucccuacgaucccaaguucgaaaagcagcugggccaggucaugcugcugauccugugcguuacccaggugcugaugaugcgcaccaccugggcccucugcgaagccuuaacgcuggcuaccggucccaucagcacccucugggaggggaacccggggcgguucuggaauacuacuaucgcggucuccauggcgaacauuuuccgcggcagcuaccuugccggagcaggacuccucuuuuccaucaugaaaaacaccaccaacacucggcgcgggacuggaaauaugggcgagacgcugggcgagaaguggaagucccgguuaaacgcccucggaaaauccgaguuccaaauauacaagaaaucgggaauccaggagguugaccgcacgcuggcuaaggaaggaaucaagaggggggagaccgaccaccaugccgucucacgggggagcgccaagcugcguugguuuguagaacggaauaugguaacgcccgagggcaaaguggucgaccuaggcugcgggcgcggcgggugguccuauuacugcggcggucuuaaaaacgugcgagaagugaagggccucaccaagggugggccaggccaugaggagcccauccccaugagcaccuacgguuggaaccugguccgccuucaauccggaguggauguguuuuucauaccgccugagaagugugacacccugcugugugauaucggggagagcuccccgaauccgacgguugaagcgggccggacccugcgcgugcucaaccuuguugaaaacuggcugaacaauaacacucaguucugcaucaagguccugaacccuuacaugcccagcgugauagaaaagauggaggcgaugcagcgaaaguacggcggugcgcugguucguaauccguugucucggaauucaacacacgaaauguacuggguaagcaaugccagcggaaacaucguuagcagcgucaacaugaucagccggauguuaaucaaccgguucaccaugcgccacaagaaggcaaccuacgagcccgacguugaccuagggucaggcacccgaaacaucgggaucgagucagagauaccgaaccuggacaucaucggcaagcgcaucgaaaagauaaagcaagagcaugagacguccuggcacuacgaccaagaccacccauacaaaaccugggccuaccacggcucguaugagacuaagcaaaccgguucagcgagcucaaugguuaacggcguggugcgacugcuaaccaagccgugggacgugcuccccaccgugacucagauggccaugacggacaccacccccuucggccaacagagagucuucaaagagaagguggauacgcgcacccaggaacccaaagagggcaccaagaaguuaaugaaaaucacugcagaguggcuuuggaaagagcuggguaagaagaagacaccaagaaugugcacgcgcgaagaguucaccagaaaggugcgcagcaacgcggcccuaggagcgaucuucaccgacgagaacaaauggaagagcgcccgagaggcuguugaggacagccgcuucugggaacuuguggacaaggagcggaacuugcaccuggagggcaagugugagacuugcgucuauaacaugauggggaagagggagaagaaguugggggaguuugguaaagccaagggcucccgcgccaucugguacauguggcucggcgcgcgcuuccuggaauuugaggcccugggauuccucaaugaagaccacugguucagccgagaaaacucgcugagcggcguggagggggagggcuugcacaaacucggguacauccuacgugaugugucaaagaaggaggggggcgccauguacgccgacgacaccgcggguugggauacucgcauuacccuggaggaccucaagaacgaggaaauggucacgaaucacauggagggggagcacaagaagcuugccgaagccaucuucaaacuuacuuaucagaacaaaguuguucggguccagcggcccacgcccagggguaccguaauggacaucauuucucgacgcgaccaacggggaagcggccagguagguacguauggccucaacacuuucaccaacauggaggcccaacucauccggcagauggaaggggagggagucuucaagaacauccaacacuugacagugacggaagaggucgccguccagaacuggcucgcgcggguggggcgcgagcgcuugucccggauggcaauaagcggggacgacugcguagugaagccgcuggacgacagauucgccaacgcuuuaaccgcccugaacgacaugggaaaaauaagaaaggacauccaacaaugggaaccguccaagggguggaacgauuggacucagguacccuucugcagucaucacuuccacgagcuaauuaugaaggacggucggguccucgucgugcccugccgaaaccaggacgaacugaucggccgugcgagaaucucccagggcgccggguggagcuuacgugagacagcuugccucggaaaguccuacgcccagauguggucgcuaauguacuuucaccggagggacuuacgucuagccgcgaacgcuauuugcuccgcggugccaucacacugggucccgaccucccggaccacauggagcauccacgccaagcacgaguggaugaccaccgaggacauguugacgguguggaaccguguguggaucagagagaauccuuggauggaggacaaaacccccguugaguccugggaagagaucccauaccucgguaagcgcgaggaccaguggugcgggagccucaucggucugaccucccgcgccaccugggcaaagaacauccaggcugcaaucaaccaggugcggagccugaucggcaacgaggaguauacggacuauaugcccagcaugaagcgcuucaggcgcgaagaagaggaggccggugugcucugguag

SEQ ID NO: 25316 - RNA, 9876 nt, Artificial Sequence
  derived and/or modified CDS sequence (opt11) from DENV-2__EU677138__SS-prME
agcgcggggaugaucauuaugcugauccccaccgugauggccuuccaccucaccacccgcaacggugagccgcacaugaucgucgguauccaggagaaggggaaauccuuacuguuuaagaccgaggauggcguaaacaugugcacucugauggcgauggaccugggggagcugugugaggacacgaucaccuauaagugcccccuguugcggcagaacgagcccgaggauaucgacugcuggugcaacagcaccuccaccuggguuaccuacgguacuugcaccaccaccggugaacaccgccgggagaagcgcagcguugccuuagugccccacguggggaugggccucgagacccggacggagaccuggaugucgagcgagggggcuuggaagcacgcccagcgcaucgagacguggauccugcgccauccaggcuucacaaucauggcagcgauacucgcauauaccaucgguaccacucacuuccagcgcguccucaucuuuauccugcugacagccguugcccccuccaugaccaugcggugcauuggcauaagcaaccgcgauuucguggaaggcgucuccggggggagcuggguugacaucgugcucgaacacggcuccugcgucacgaccauggcgaagaacaaaccuacgcuggacuucgagcugaucaagacggaagccaagcagcccgccacgcuccguaaguacugcauugaagccaagcugaccaacacgaccaccgagucgcgaugccccacucagggagagccgucccuuaaggaagagcaggacaaacgguucgucugcaagcauucaaugguggauaggggcuggggcaacggcugcggacuguucggcaagggcgguaucgucaccugcgccauguucacgugcaagaaaaacauggagggcaagaucgugcagcccgagaacuuggaguacaccaucgugguaaccccccacuccggagaggagcacgcugugggcaacgacacggggaaacacggccaggagauuaaagugaccccgcagucauccaucaccgaagccgagcugacgggguacggcacugucacgauggagugcagcccccggaccggccucgauuucaacgagauggugcugcugcagauggagaacaaggccuggcucguccaccgccagugguuccuggaucugccccuaccguggcugccgggggccgacaagcaggagagcaauuggauacagaaggagacccuggucaccuuuaagaacccccaugcgaagaagcaagauguggucgugcucggcagccaggagggggcgaugcacaccgcccugaccggcgcuaccgaaauucagaugucgagcgggaaucuccuguucaccggccaucucaaaugccgacugcggauggauaagcuccaacugaaaggaaugagcuacucaaugugcacggggaaguucaaaguggucaaggaaaucgccgagacccagcauggcaccaucgugaucagggugcaauacgaaggggacggcagcccuugcaagauccccuucgaaaucauggacuuggagaaacgcuacgucuuaggccggcugaucaccgugaacccgaucgugacagagaaggacuccccagucaacaucgaggccgagccgcccuucggggauagcuacaucaucaucggcguggagccgggacagcuuaaauuaaacugguucaagaaaggauccucgaucggucagauguucgagaccaccaugcgcggcgccaagcgaauggccauccugggcgauaccgcgugggacuucgggucauuaggaggggucuucacaagcauaggcaaggcccuucaucaggucuucggggccaucuacggcgcggcuuuuaguggcgugagcuggaccaugaaaauccugaucggggugauaaucaccuggaucggcaugaacucccggagcaccuccuugagcgucucccuggugcugguggggaucguaacucuguaucuuggagucaugguccaggcagauucggggugugucguguccuggaagaacaaggagcuuaagugcggcagcggcaucuucaucaccgauaacgugcauaccuggaccgagcaguacaaguuucagccagagucccccucgaagcucgccagcgcgauccagaaggcacaggaagaggggauaugcggcauccgcucagucacgcggcuagagaaccucauguggaagcagaucacccccgagcugaaccacauccuggccgagaaugaaguaaagcugaccaucaugaccggcgacaucaagggaaucaugcaggccgggaagcguagucugcggccgcagcccacggagcugaaguauuccuggaaaacguggggcaaagccaagauguuaagcaccgaguccuacaaccaaaccuuccugaucgacggccccgagacggcggagugcccgaacaccaaccgcgccuggaacucacuggagguggaggacuauggguucggugucuucaccaccaacauuuggcucaaacugaaggaaaagcaggacgcauucugcgauuccaaguuaaugagcgccgccaucaaggacaacagggcgguacacgccgacaugggguacuggaucgaguccgcccucaacgacacguggaagauagagaaggccagcuucaucgaggugaagaacugccacuggcccaaaucccacacccuguggagcaacggcguccuggaguccgagaugaucauccccaaaaaccucgcaggccccgugagccagcauaauuaccgcccuggguaccacacccagaucgccggcccguggcaucuugggaagcuggagauggacuuugacuucugcgacggaaccaccgucauagucacggaggacugcgggaaccguggcccgucccugcgcaccaccaccgccagcgguaagcugaucacugaguggugcugcaggagcugcaccuugcccccgcuccgcuaccguggagaggacggcugcugguacgggauggaaaucaggccccugaaggagaaggaagaaaaccugguaaacucccucgugaccgccggccacgggcagguugacaacuucagccugggagugcugggcauggcccucuuccuugaggaaaugcugcggacccgcguggggacaaagcacgcgaucuugcugguggccguguccuucgugacccugaucaccgguaacaugagcuucaaggaccuggggcgggugguggugauggucggcgcuaccauggccgacgauaucggcaugggcguaacguaccuggcccuguuagcggcauucaagguccgccccaccuuugccgccggccugcugcuccggaaguugaccuccaaggagcugaugaugaccacaaucgggaucguccuccugagccaguccaccauccccgagaccgugcuggaacucaccgacgcccuggcgcugggaaugauggugcucaagauaguccggaauauggagaaguaccagcuugccguuacgauuauggcgauccugugcgucccgaaugccgugaucuugcaaaacgccuggaaggugagcugcaccauauuagcggucguguccgugucaccgcugcuccugacguccagccagcagaaaacggacuggaucccccuggcccucacgaucaagggacugaacccaaccgccaucuucuuaaccacccucucccgcacaaauaaaaagcggagcuggccccugaaugaggccaucauggcggucggcauggugucaaucuuagccucgucccuccugaagaacgacauccccaugaccggcccccugguggccgggggccuccucaccgucugcuauguucugaccggacgcagugccgacuuggaacuggagcgcgccacggaugugaagugggaagaccaggcggagaucuccggcucuagccccaucuuauccaucaccaucagcgaggacggguccaugagcauaaagaacgaggaggaggagcagacccucaccauacugauccgcacaggccugcucgucaucucgggccuguucccgaucagcauccccaucaccgccgcugcgugguaccugugggaggugaagaagcagagagccgggguacugugggacguucccagcccgccgcccaugggacgcgcggagcuugaggacggcgccuaccggaucaagcagaagggcauucugggcuauucacagaucggcgccggcguguacaaagaggggaccuuccacacaauguggcaugugacacgcggcgccguccucaugcacaaggggaagcggauugagcccuccugggccgacguaaagaaagaccugaucagcuacggcggcggcuggaaguuggagggcgaguggaaggagggggaggaggugcagguacucgcgcucgagccaggcaagaacccccgcgccguacagacgaagcccgggcuguucaagaccaauaccggcaccaucggagcugugucccuggacuucaguccgggcacguccggcagcccuaucaucgacaagaaagggaaggucguaggccuguacgggaacggcguagucacccggucuggugccuacgugagcgccaucgcacagaccgagaaguccaucgaggacaacccagagaucgaggacgacaucuuccgcaaaagacgucugaccaucauggaucugcaccccggggccggcaagacgaagcgguaccuccccgccauagugcgcgaggcgaucaagcggggguugcgcacccugauccuugcgccgacccgggucguggccgccgagauggaggaggcccuccgcggcuugcccauccgguaccaaacccccgccauccgagcggagcacacggggcgcgagaucguggaccuuaugugccacgccacauucaccaugcgccugcugagccccguccgcgugccgaacuacaaccucaucaucauggacgaggcccacuucaccgaccccgcuuccaucgccgcgcggggcuacaucagcacgcgcguggaaaugggagaggccgccgggaucuucaugaccgccacgccccccgguagccgggacccguuuccccaguccaacgcccccaucaucgaugaagagagagagaucccggagcggucauggaacuccgggcacgagugggucaccgauuucaagggcaagacggugugguuugugccgucuaucaaggcggggaacgacaucgccgcuugucugcgcaagaacggcaagaaggucauccagcuuucccggaagaccuuugauagcgaguacgugaagacacguaccaacgacugggacuuuguggucacgaccgacaucuccgagaugggcgccaacuucaaggcggagcgggugauagauccccgccggugcaugaagccugugauccugaccgacggggaggagcgcguuauccuagcgggcccgaugccggugacccacagcuccgccgcccaacggagggggcggaucggccgcaaccccaagaacgagaaugaccaguacaucuacaugggggagccucuggagaaugacgaggacugugcccacuggaaggaggcgaagaugcuccuggacaacaucaacacgccggagggcaucaucccgagcauguucgagcccgagcgugagaagguggacgccaucgacggcgaguaucgccuacgcggggaggcgcgaaagacguucgucgaccucaugcgccggggcgaccugcccguguggcuggcauacaaaguggccgcggaggggauaaacuacgccgaccgccgguggugcuucgacgguaucaagaacaaccagauccucgaggagaacgucgagguggaaaucuggaccaaggaaggggagcgcaagaagcugaagccgcgguggcuggacgccagaauuuacuccgacccccucgcccugaaagaguuuaaggaguucgccgcgggacggaagucccugacccucaaccugaucacggagaugggccgccuccccaccuucaugacccagaaaacccgcgacgcccuggacaaucuagccguccuucacacggccgaggccggaggccgggccuacaaccacgccuuauccgagcugcccgagacccuggaaaccuuacugcugcucacccuguuggccacggugaccgggggaauauuccucuuccucaugagcggacgggggaucggcaagaugacccuggggaugugcugcaucaucacggccuccauccuccucugguacgcgcaaauccagccgcacuggaucgccgccagcaucauccuggaauucuucuuaaucguguuacugauccccgagcccgagaagcagcgcaccccucaggacaaccagcucacguacgucgugaucgcaauccugacuguggucgccgcgacuauggccaacgagauggguuuccuggagaaaacgaagaaagaccucgggcucggcuccaucgccacgcagcagccugagagcaauauacuugauaucgaucuccggcccgccuccgccuggacccuguacgcgguggccaccaccuucgugacgccgaugcugcgccauagcaucgaaaacagcuccgucaacgugagccucaccgccaucgcuaaccaggccacgguccugaugggccucgggaagggcuggccccucuccaagauggacaucggcguaccguuacuggcaaucggcugcuacucccaggugaacccaaucaccuuaacggccgccuugcugcuccugguggcccacuacgcgaucaucgggccaggccugcaggccaaggccacaagggaggcccagaagcgggccgcggccggcaucaugaagaacccuaccgucgacgguaucaccgugaucgaccucgacccgauuccuuacgaccccaaguucgaaaagcagcugggccaggugaugcugcuaauccugugcgucacccagguucuuaugaugcggaccacuugggcccucugcgaagcccugacucuagcgacggggcccauuuccacccucugggagggaaacccgggcagauucuggaacaccaccaucgcggugagcauggcgaacaucuuccggggcucguaccuggccggcgccgggcuccucuuuucuaucaugaagaauacgaccaacacucgccgcgggaccggcaauaugggagagacgcucggcgagaaguggaagucacggcugaaugcccucggcaaaagcgaguuccagaucuauaagaaguccggcauccaggaagucgaucgcacccucgccaaggaggggaucaagcggggcgagaccgaccaccaugcugugucccgcggguccgccaaacugaggugguuuguggaacgcaacauggucacccccgaaggcaaggugguggaccucgggugcgggcggggcggguggucguacuacugcggcgggcugaagaacgugcgcgaggugaagggccugacaaagggcgggcccggccaugaggaaccgaucccgauguccacguacggguggaaccucguacggcugcagagcggcguugacguguucuucaucccaccugagaaaugcgacacccugcucugcgacaucggugaauccagccccaacccaacgguugaggcgggucgaacgcugcggguauugaaccucguggagaacuggcugaacaacaacacucaauucugcaucaaggugcuuaaucccuauaugcccuccgucaucgaaaagauggaggcgcugcagcgcaaguacggcggagcccucgugcggaacccgcugagccgcaacagcacccacgagauguacugggugucgaacgccagcggcaacaucgucuccaguguuaacaugaucucccgaaugcugaucaaccgcuuuacaaugcggcacaagaaagccaccuacgagcccgacguggacuugggguccggcacccgcaacaucgggaucgaguccgagacccccaaccuggacaucauuggcaagcggaucgagaaaaucaagcaggagcacgagaccuccuggcacuacgaccaggaccacccauauaagaccugggccuaccacggcuccuaugagacgaagcagaccggguccgccuccagcauggucaacggcguggugcgccugcucaccaagccgugggacguccugcccaccgugacccagauggcaaugaccgacaccacgcccuucgggcagcagcgcgucuucaaggagaaggucgacacgagaacccaggagccaaaggagggcaccaagaagcucaugaaaaucaccgccgaguggcucuggaaggagcugggaaagaagaagacgccgcgcauguguacucgggaggaguucacccgcaaggugcgguccaacgccgcccugggggcgaucuucacggaugagaacaaguggaaguccgcucgcgaggccguggaggacucccgguuuugggaacuagucgacaaggaaagaaaccugcaccuggagggcaagugugagacgugcguguacaacaugauggggaaacgugaaaagaagcucggcgaauucgggaaggcgaagggcucgagagccaucugguacauguggcucggcgcaagauuccuagaauucgaggcccucggguuccugaacgaggaucacugguucucccgcgaaaacucacugucuggcgucgagggggagggacuccauaaauuaggguacauacugcgggaugugagcaagaaggagggcggcgccauguacgcagacgacaccgcggggugggacaccaggauaacccucgaggaccucaagaaugaagagaugguuacgaaccacauggagggcgaacacaagaaauuagccgaggccaucuucaagcucaccuaccagaacaagguagugcggguacagcgcccaacgccacgggggacugucauggacaucaucucacgccgggaucagcggggcuccggccagguggggacguacgggcugaacaccuucaccaauauggaggcccagcugauccggcagauggaaggggagggcguguuuaagaacauccagcaccucacggccacagaggagguugcugugcaaaacuggcuagcccgcgugggccgcgagcggcuuagccgcauggccaucucuggagacgacugcguagugaaaccccuggaugaccgcuucgccaacgcccugaccgcgcugaacgacauggguaagauccgcaaggacauccagcaaugggagccgagcaagggauggaacgacuggacccagguaccguucugcucccaccacuuccacgagcucaucaugaaggacggccggguccugguagugcccugucgcaaucaggacgagcugaucggucgggcccgcauuagccagggcgccggguggucccuccgugaaaccgccugccugggaaagaguuacgcccagaugugguccuuaauguacuuucaccgccgcgaccuccgccuggcggccaacgccaucugcagcgccguucccucccacugggugccgacgucucguaccaccugguccauacacgccaaacacgaguggaugaccaccgaggacaugcugacgguguggaaucgcgucuggauccgggagaaccccuggauggaggacaagacccccguggagagcugggaagagauucccuaccucgguaaacgcgaggaccagugguguggguccuugauaggacugaccagccgggcgaccugggccaagaacauucaggucgcgaucaaccaggucaggucccucauagggaacgaggaguauacggacuacaugccgucuaugaagcgguuuagacgcgaggaggaggaggccggugugcugugguga

SEQ ID NO: 25317 - RNA, 9876 nt, Artificial Sequence
  derived and/or modified CDS sequence (opt11) from DENV-2__EU677149__SS-prME
ucagccgggaugauuaucaugcugaucccgaccgugauggcuuuccaucucaccacgcgcaauggggagccucacaugauugucgggauucaagagaaaggcaagucccuguuauuuaaaacugaggauggcgugaacaugugcacccucauggcgauggaccucggagagcugugcgaagauaccaucacuuacaagugcccccuccugcggcaaaacgagccagaggauauagauugcuggugcaacuccacaaguaccugggugacauacggcacaugcacuaccacuggugagcaccgccgggaaaagaggucggucgcccuggucccccauguggggaugggccuugagacccgaaccgaaacuuggauguccucggagggggccuggaagcacgcgcaaagaaucgaaaccuggauccugagacacccgggcuucacgaucauggccgcgaucuuggccuacaccaucgggaccacccacuuucaaaggguacugauuuucauccugcugaccgccguggcacccuccaugaccaugcggugcaucgggaucuccaaccgcgauuuuguggagggcgucuccgggggcagcugggucgacaucguuuuggagcacggguccugcgucaccaccauggcaaagaacaagcccacgcuggauuuugaacugaucaagacagaggcgaagcagcccgcaacacuccggaaauacuguaucgaagcuaaacugaccaacacgaccaccgagagccgcugccccacucagggcgagcccuccuugaaggaggagcaagacaagagguucgugugcaagcacagcaugguugaucgaggcugggguaacgguugcggccucuucgguaagggcgggaucgucacgugugccauguucacuugcaagaagaacauggaaggcaagaucgugcagcccgaaaauuuagaguacacgauuguugucacaccccacuccggggaggagcacgcggugggcaacgacacugggaaacacgguaaagagauaaagguaaccccgcagagcucgauaaccgaggccgagcuaacaggcuacgggacugucacgauggaaugcaguccccggacgggcuuagacuucaacgagaugguccuccugcagauggagaacaaagccugguuaguacaccgccagugguuccuagaucugccccuccccuggcuacccggggccgacaagcaggaguccaacuggauccagaaggagacccuagucacguuuaagaacccccaugccaagaagcaggauguuguuguucucgggucucaggaaggggcuaugcauacggccuuaacuggggccacugagauccagaugucauccgggaaccuccuguucacuggccaccuaaaaugcagacugcgcauggacaagcuccaacugaagggcaugagcuacucaaugugcacggggaaauucaaaguggucaaggaaauugcugagacgcagcacggcacaaucguaaucagaguccaauacgagggugacggcagucccugcaagauucccuucgagauuauggacuuggagcgccgguauguccucggacguuugaucacggugaauccuauugugacggagaaagacucccccguaaacaucgaggcugagccgccauuuggagacagcuacaucaucaucggaguugagccggggcaguuaaagcucaauugguuuaaaaaggguagcagcaucgggcaaauguucgagacgacuaugaggggcgccaagcgaauggccauacuuggcgacacugccugggacuucgggagucugggugggguguuuacgaguaucggcaaggcccuccaccagguauucggggccauauacggcgcggccuucucgggagugaguuggacaaugaaaauccugaucggugugaucauuaccuggauugguaugaacucuagaagcaccagccugagcgucucccugguucucguggggauugucacgcuguaccuaggagugauggugcaggccgacagcggcugcgucguguccuggaagaacaaggaacucaagugcggcaguggaaucuucaucaccgacaacgugcacacguggaccgagcaguacaaguuccagccggagaguccauccaagcuagccagcgcaauccaaaaagcgcaagaggagggcauuugcggcauccgguccgugacgagguuggagaaccucauguggaagcaaaucacucccgagcugaaucacauccuggccgagaaugaggugaaguugaccaucaugaccggggacauaaagggaauuaugcaggccgggaagcggagccugcgcccgcagccuacagagcugaaguacuccuggaagacauggggcaaagcgaaaaugcucucgaccgagaguuacaaucagaccuuccuaaucgacggucccgagacggcggagugcccuaacaccaaccgugcguggaacagccuggagguggaggacuacggguucggagucuucacaaccaacaucuggcucaaacuaaaagagaagcaggacgccuucugugacagcaagcugaugagugcugcaaucaaggauaaccgcgcggugcacgccgacaugggguacuggaucgaauccgcuuugaacgacacauggaagaucgagaaggcgucuuucaucgaggucaaaaacugccauuggcccaaaucccacacccuguggagcaacgguguucuggaauccgaaaugaucauacccaagaaccucgcggggccagugagucaacacaacuacaggccggguuaccauacccagaucgcgggccccuggcacuuggggaaauuggagauggacuucgacuucugcgacggcaccaccgugauuguaacggaggacugcgggaauagggggccgucacuccggaccaccaccgcuagcggcaagcucaucacagaguggugcugccguagcuguacccugccaccccuccgguaccgcggugaggacggcugcugguacggcauggagauccggcccuugaaggagaaagaggaaaaucuggucaacucccucgucaccgcaggccacgggcaggucgauaacuucucccuuggcguacugggcauggcacucuuccuggaggagaugcugcgcacccgcgugggcacgaagcaugcgauccuccuggucgccguguccuuugugacccugauaacgggcaacaugagcuucaaggaccucgggcgcguggucgugauggucggcgccaccauggccgacgacaucgggaugggcgugacguaccuggccuuacucgcggccuuuaaggugcggcccaccuucgcggccggccuucuguuacgcaagcugaccucgaaggagcugaugaugacaacgauugggauugugcuccuaagucaguccaccaucccugaaacuguacucgagcucaccgaugcucuggcguugggaaugauggugcuaaaaaucguaaggaacauggaaaaguaccagcuggcggugaccaucaugacaauccugugcguaccgaacgccgugauccugcagaaugccuggaaggugagcuguacgauccuugccguagugucgguaagcccccugcuccugacuuccagccggcagaagaccgauuggaucccccuggcgcugacuaucaagggguugaaucccacagccauauucuugacaacacugucaaggacuaacaaaaagcguagcuggccguugaacgaagcaaucauggccguagguauggugucgauccuggcaagcucuuugcugaagaacgacauccccaugaccggcccacugguugcaggaggccuuuuaacuguguguuacgugcugacggggcgcagcgccgaccuagagcuggagcgggccacagacgugaaaugggaagaccaggcggagaucuccggcagcagccccauccucucgauuaccauaagcgaggaugggucaaugagcauaaagaacgaggaggaggaacagacacucacaauccugauccgcacgggccugcucgucauaaguggacuguucccuaucaguauacccauuaccgcagcugccugguaccugugggaggugaagaagcagcgugcaggggugcucugggaugugcccagcccgccgccuaugggcaaagccgagcuggaggacggggcguaccgcauuaagcagaagggcauccugggguacagccaaaucggcgcgggcguauacaaggaggggaccuuccauaccauguggcacguuacgcggggcgcaguacucaugcauaaaggcaagcgcaucgagcccagcugggccgaugugaagaaagaccuaauaagcuauggcgggggcuggaaacuggagggggaguggaaagagggagaagagguucagguccucgccuuggaacccgguaaaaauccacgugcgguacaaacaaaaccggggcuguucaagaccaacacgggcacgaucggggcugugucccucgauuucagcccaggcaccucuggcucgccaaucauagauaagaaagggaaggucgugggccuauacgggaauggcgugguuacccgguccggcgccuacgugagcgccaucgcccagaccgagaaguccaucgaggacaaucccgagaucgaggaugauauuuuucggaagcgucggcugacgaucauggaucugcaccccggggccggcaagacgaagcgcuaucucccugccauagugcgagaagccauuaagaggggguuacggaccuuaauccuggccccgacccgcgugguggcggccgagauggaggaggcccugcggggccuaccgauccgcuaccagacgccggccauacgcgccgagcacaccgggagggaaaucguggaccugaugugccaugcaaccuucacaaugcgccuacugagcccgguucgaguaccgaauuacaaccugauaaucauggaugaggcccacuucaccgaccccgccuccauagccgcucgcgguuacaucuccacucggguagagaugggcgaggcugccgggaucuucaugacugccacgccucccgguaguagagacccauucccccagucaaacgccccaaucaucgacgaggagcgggagauuccggagcgcucuuggaacuccggacaugagugggucacggauuuuaagggcaagaccgucugguucguuccaagcauaaaggccgggaacgacauugccgccugucuccgaaagaauggcaagaaagucauacagcugagccgaaagaccuucgauagcgaguauguuaaaacccggacgaacgacugggacuuuguaguuaccaccgacaucagcgagaugggcgccaauuuuaaagccgagcgcgugaucgacccucggcgaugcaugaagcccgucauauugaccgacggagaggaacgcgugauccuagccggucccaugccggugacgcacagcagcgccgcccaacggcgggggagaaucggccggaacccaaagaacgagaacgaccaauacauauauaugggugaaccucuggaaaacgacgaagacugugcccacuggaaagaagccaagaugcugcuggauaacauuaacacgcccgagggcaucauccccagcauguucgaaccagagagggagaaggucgacgcgauagacggcgaguacagauugcgcggggaggcccgaaagacuuucgucgaccucaugcgucguggagaccuuccugugugguuggcauacaaggucgcggcggaggggaucaauuaugcggacaggagauggugcuucgauggcaucaaaaacaaccagauccucgaggagaaugucgagguugagaucuggacuaaggagggggagcggaagaaauugaagccgcgcuggcuggacgcucggauuuauuccgacccucuagcgcugaaggaauuuaaggaguucgccgcuggccgcaagucucugacgcucaaccugaucaccgagaugggcagacugccuacguuuaugacacagaaaacgcgagacgcacucgauaauuuggcaguccuccacaccgccgaggccgggggccgugcguacaaccacgcccucuccgagcuuccagagacccuagagacccuacugcuucucacgcugcuggcgaccgugacagggggaaucuuucucuuccucaugagcggccgcgggaucggcaagaugacccuggggaugugcugcaucaucaccgccuccauccuccugugguacgcccagauccagccgcacuggaucgcagcgucuauuauccuugaguucuucuugauuguguuacuaauccccgagcccgagaagcagcggacgccccaagacaaccagcucaccuacguggugaucgcaauucuaaccgugguggcugccaccauggcgaacgagaugggauuucuggagaagacuaagaaggaccucggucuuggcuccaucgcaacccagcaaccggagagcaacauccuagacaucgaccuccgccccgcuuccgccuggacccuguacgcgguggcaaccacguucgugaccccaaugcugagacacagcaucgagaacagcucgguaaacgugagccucaccgccaucgccaaucaggccaccguucuaaugggccuggggaaaggcuggcccuuaaguaagauggauauuggugucccgcugcucgccauagguuguuauucccaagugaacccuaucacguugacagcugcacuucugcuccuggucgcccauuacgcuauuaucggacccggccuccaggcaaaggccacccgcgaggcccagaagcgggccgccgcggggaucaugaaaaaccccacaguugaugggauaacuguaaucgaccuagacccgauacccuacgaucccaaguucgagaagcagcuaggccaggugaugcugcucauacugugcgugacccagguacugaugaugcggacgaccugggcccucugcgaggccuuaacgcuggcgaccgggcccaucuccacccuuugggagggaaacccugggcgguucuggaacaccacuauugcuguuagcauggcgaacaucuuccgcgguucguaccuugccggcgcagggcuacucuucucgaucaugaagaacacuaccaacacacgcagaggcaccggaaacaugggcgagacguugggcgaaaaauggaagagucgcuugaacgcccucggcaagucagaguuccaaaucuacaagaaguccggcauccaagaggucgaucggacccuugccaaagaggggaucaagcguggagagacagaccaccacgccgugagccguggguccgccaaacuucgcugguucguagagcggaacauggucacgcccgagggcaaggugguggaccucggcugcggccgugggggauggucuuauuauugcggcgggcugaagaacgugagagaggugaagggacugaccaagggcgggccgggccacgaggagccgaucccgauguccaccuacggguggaacuuggugcgccugcaaagcgguguggaugucuucuucauaccgcccgagaagugcgacaccuuacugugugauauaggugaguccucucccaauccgacgguggaggcagggcguacccugcgcguucugaaucucguggagaacuggcugaacaacaacacccaauucugcaucaaggugcugaaucccuauaugccguccgucaucgagaagauggaggccuuacagcggaaguacggcggcgcuuuagugcgcaacccgcugagcagaaacagcacucacgagauguacugggucuccaacgccagcgggaacaucgucucuagcgugaacaugauuagccgcaugcuaauaaaccgcuuuaccaugcgccauaagaaggccaccuacgagccagacguggaccuuggcagcgggacccguaacaucgggaucgaauccgagaucccgaacuuagacauaauaggaaagcgcaucgagaagauaaagcaggagcacgagaccucuuggcacuacgaccaggaccaccccuacaagaccugggcuuaccacggcuccuaugagacuaaacaaacugggagcgcauccucuaugguaaacggcgucgugcgccuccucacgaagccgugggacguacucccuacgguaacgcaaauggcgaugaccgauacuacccccuucgggcaacagcgcguuuuuaaggagaaaguagacacucgaacacaagagcccaaggagggcaccaagaaauugaugaagauuacggccgaauggcuauggaaggaguuggggaagaaaaagacgccgcguauguguacccgcgaggaguucacucggaaggugcgcuccaacgccgcccuuggggcaauuuuuaccgaugagaacaaguggaaauccgcgcgggaggccguagaagauagccgauucugggaacucgucgacaaggaacggaaccugcaccuggagggcaagugugagacgugcguuuacaacaugauggggaagcgugagaagaagcugggcgaguucgggaaggccaagggcucgagagccaucugguacauguggcugggugccagauuucuggaguucgaagcgcucggguucuugaaugaggaccacugguucucccgggagaacagccuuuccggcgucgaaggcgagggacuccacaagcugggguacauccugagagacguauccaagaaggaaggaggggcuauguaugccgaugacaccgcugggugggacacccgcaucacccucgaggaccugaagaacgaggagaugguaacgaaccauauggagggggagcacaaaaagcuggcggaggccaucuuuaagcucaccuaccagaacaaaguugugcgcgugcagagacccacgccccgggggaccgucauggacaucaucagccggcgggaccagcggggguccggccaggucggcaccuacggccugaauaccuucaccaacauggaggcacagcugaucaggcagauggagggggagggcguauucaaaaacauacagcaucucaccgucacggaggagguggccgugcaaaacuggcucgccagggucggacgcgaacgcuugagccggauggcgaucucaggcgacgacugcguggugaaaccguuggaugaccgcuuugccaaugcacugacggcccuuaacgacaugggcaagauccggaaggacauccaacagugggaaccgucuaagggguggaaugauuggacacaaguaccuuucugcucccaccacuuccacgagcugauuaugaaagacggccgaguucucguugucccaugucgcaaccaagacgagcuaauuggacgcgcccggaucagccagggcgcaggguggagccuccgggaaacggcuugccuuggaaagagcuacgcccagauguggucucugauguacuuccaccggagagacuuacggcuggccgccaacgcgaucuguagcgccgugccgucccacuggguaccgacgagucguaccaccugguccauccacgcaaagcacgaguggaugacaaccgaagacauguuaacggucuggaacaagguguggauccgugagaaccccuggauggaagauaagacucccguggagagcugggaagagauccccuaccucggcaagcgcgaggaucaauggugcgggucccugaucggacugaccagcagagccacaugggcgaaaaacauccaggcggcgauuaaucagguccgcucccucaucgggaacgaggaguacacugacuacaugccuagcaugaagcgcuuccggcgcgaggaggaggaggccggggugcugugguga

SEQ ID NO: 25318 - RNA, 9876 nt, Artificial Sequence
  derived and/or modified CDS sequence (opt11) from DENV-2__FJ024452__SS-prME
agcgccggcaugaucaucaugcugauacccaccgugauggccuuccaccucacuacacgaaacggggagccccacaugaucgugggaauccaggagaaggguaagagcuugcuguuuaagaccgaggacggcgugaacauguguacccucauggcuauggaccucggggagcugugcgaagacacaauaaccuacaaaugcccucugcugaggcagaacgagcccgaggacaucgauugcuggugcaacuccacguccaccugggugaccuaugggaccugcaccacuaccggcggucacagacgggagaagcgcucggucgcucuggugccccacgugggcauggggcucgagacgcggacugagacuuggaugagcagcgagggcgccuggaagcacgcccagaggaucgagacguggauccuacggcacccgggguucacgaucauggccgcgauccuggcuuauacaauuggcaccacccacuuccagcgcguccucaucuucauccugcugacggccguggcccccuccaugacuaugagguguaucggcaucagcaaccgcgauuucguggagggaguuucuggaggcagcuggguggacauugugcucgaacacggcucaugcgucaccaccauggcaaagaauaagcccacguuagauuucgagcugaucaagaccgaggccaaacagcccgccacacuccguaaguacugcaucgaggcgaagcucaccaacacgaccacagagucaagaugcccuacccagggugagccuucgcugaaggaggagcaggacaagcguuucaucuguaagcacagcaugguggaccgggguuggggcaacgggugcggucucuucggcaagggcggcauagugacgugugccauguucacaugcaagaaaaacauggaggggaaaaucguccagcccgagaacuuggaauacaccaucguggugacgccucacuccggcgaggagcacgcggucgggaacgacacgggaaagcacgggaaggagaucaaggugaccccgcagagcuccaucaccgaagccgaguuaaccggcuacggcaccgugacgauggagugcucuccccguaccggacuagacuuuaacgagauggucuuguugcagauggaaaacaaggccuggcucgugcacagacagugguuucuggaccugccccuucccuggcugccaggagcggacaaacaggaguccaacuggauacagaaggaaacacuagugacuuucaaaaacccccacgcgaagaagcaggacgucgugguccucgggucacaagaaggggcgaugcacacagcgcugacaggggccaccgagauccagaugagcuccgguaaccugcuguuuacgggccaccugaagugccgccugagaauggacaaacuccaacuaaaggggaugagcuacucgaugugcacugggaaguucaagguugugaaggagaucgcggagacacagcacgggaccaucgucauucgggugcaguacgagggcgacggcucgcccuguaaaaucccguucgagauuauggaccuggagaagcgcuacgugcuggggcggcugauuaccgucaacccgaucgugacggagaaggacucaccagugaacaucgaggccgagccgccguuuggggacucauauaucaucaucggagucgaaccgggccagcugaaacucaacugguucaagaaggguucgagcaucgggcagauguucgagaccacgaugagaggcgcgaagcgcauggcaauccucggggacaccgcgugggacuucggcucccucggcgggguguucaccagcaucgggaaggcccuccaccagguguucggggccauauauggggccgccuuuuccggggucagcuggaccaugaagauccugaucggcgugauuaucaccuggaucgggaugaacucgcggagcaccucccugucagugucccucgucuuaguggggaucgugacgcuguaccuggggguuauggugcaagcugacucugguugcguggucuccuggaagaauaaggagcucaagugcgguagcgggauuuucauaaccgacaacguucacacguggaccgaacaguacaaguuccagcccgagucuccguccaagcuggccagcgcgauccagaaggcccaggaggagggaauaugcgggaucagguccgugacgcgccuggagaaccucauguggaagcaaauaaccccggaguugaaucauauccuggccgagaaugaggucaagcuuacgaucaugaccggcgacauaaaggggaucaugcaggcggggaaacgcagccugcguccgcagccuacggagcugaaguacuccuggaagacaugggggaaggccaagaugcucagcacggaguccuacaaucaaaccuuccugauagacggcccagaaacggcggagugcccgaauaccaaccgcgcguggaacucucuugagguagaagacuauggcuuugggguguucaccaccaacauauggcuaaagcugaaggagaaacaggacgccuucugcgauuccaaacugaugagcgccgccaucaaagacaaccgggccgugcacgccgacaugggguacuggaucgaguccgccuugaacgacacuuggaagaucgagaaggccagcuuuaucgaagugaagaauugucauuggcccaagagccacacguuauggucaaacggcgugcuugaguccgagaugaucaucccaaagaaccucgcaggacccguaagccagcauaacuaccgcccgggguaccacacccaaaucgcgggcccauggcaucugggcaagcuggagauggacuucgacuucugcgacggaaccacgguuaucgugacggaggacuguggaaaccggggaccaucccugcgaaccaccaccgcaagcgggaagcugaucacggaguggugcugcaggaguugcacccuucccccguuacgcuaccggggcgaagacgguugcugguacggcauggagauccgcccccugaaggagaaggaggagaacuuggucaacucucuagugacagccgggcacgggcagguggauaacuuuagccugggcguccuagggauggcccucuuucuggaggagaugcugcggacccgcgugggcacgaagcacgcgauccucuugguggccguauccuucguuacacugaucacggggaauaugucuuucaaggaccucggccggguggucgugauggugggugcaacgauggccgacgacaucggcaugggcgucacguaccuugccuugcucgcggccuucaaggugcggcccaccuucgcagccgggcugcugcuccggaaacugacauccaaggagcucaugaugaccacgaucggcaucgugcuccugagucagagcaccauccccgagaccguccuggaacucaccgaugcccuggcgcuggggaugauggugcucaagaucgugcgcaacauggagaaguaccagcuggccgucacgaucauggccauccugugcgugccuaacgccgucauauuacagaaugccuggaaggugagcugcaccauccuggcgguggucucuguuuccccccugcuccugacuuccagccagcagaaaaccgacuggauuccccuggccuugaccaucaagggccugaaccccacggccaucuuccugaccacccuguccagaacaaacaagaaacgaagcuggccgcugaacgaggccaucauggcaguagggauggucuccauccuugcaagcucgcuccugaaaaacgacaucccaaugaccgggccccugguggccggcggguugcugacuguguguuacguacuaaccggucgcagcgccgaccucgagcuggaacgggcgacggacguuaagugggaagaccaggcggagaucuccgggagcaguccuauacugagcaucacgaucagugaggacggcucaaugagcauaaagaacgaggaggaggagcagacccugaccauccugauucgcacgggucuauuggugauuucuggguuauucccgaucagcauccccaucaccgcugccgcgugguaccuaugggaggucaagaagcagcgggccggcgugcuaugggauguccccagcccgccgcccauggggaaagcggagcuggaagacggcgccuaccgcaucaagcaaaaggguaucuugggcuacagccagaucggcgccggggucuacaaggagggcaccuuucacacaauguggcacgugacucgaggggcggugcucaugcacaaggguaaaagaauagagcccuccugggccgacgucaaaaaggaccugaucagcuacgggggcggcuggaagcuggagggugaguggaaggagggcgaggagguacaggugcucgcccuugagccggggaagaacccccgcgccguccagacgaaaccaggcuuguuuaagacuaauaccgggaccaucggcgccgucucccuagacuucagcccgggcacguccgggagccccaucaucgacaaaaagggcaagguggucggucuauacggcaacggaguggugaccagauccggggccuacgugagcgccaucgcgcaaacgggcaaguccauagaggacaacccggagauugaggacgacaucuuccggaagcgccggcugaccaucauggaccugcaccccggugccggcaagacgaagcgcuaucuucccgccauugugcgugaggcaaucaagcgcgggcugcggacccugauacucgccccaacacgcguggucgcugccgagauggaggaggcccugaggggccugccuauccgcuaccagacccccgccauccgggcggagcacacaggccgagagauaguggaccucaugugccacgcgaccuucaccaugcgccugcugagccccgugcgggucccuaacuacaaccuuaucaucauggacgaggcccacuucaccgacccggccuccaucgccgcacgcgguuacaucucgacgagaguggagaugggcgaggcagccgggauuuucaugaccgccacgccacccgguagucgcgacccauucccgcaaucuaacgcccccaucauugacgaggagcgggagauucccgaacguagcuggaacuccggucacgagugggugaccgacuucaagggcaagaccgucugguucgugccgagcaucaaggcgggcaacgacaucgccgccugccuccggaaaaacgggaagaaggugauccagcuguccagaaaaacauuugacagcgaguaugucaagacccggaucaacgacugggauuucguggugaccacggacaucucugagaugggcgccaacuucaaagcggagagagucaucgaccccaggaggugcaugaagcccgucauccuuacagacggugaggagcggguuauccuggccggucccaugcccgucacccacucauccgcggcgcagcgacgagggcgcauagggaggaaccccaagaacgagaaugaccaguacaucuauaugggcgagccccuggaaaaugacgaagacugcgcccacuggaaggaagcgaagaugcuccuggacaacaucaacacccccgaggguaucaucccgagcauguucgagcccgaacgcgagaagguggacgcaaucgauggcgaguaccggcugcgcggggaagcacgcaaaacguuuguggaccucaugagacgcggcgaucugcccgucuggcuggcauacaagguagccgcggaagggauaaacuacgccgauagacgcugguguuucgacggcaucaagaacaaccagauucucgaagagaacguggaggucgagauuuggacuaaggagggcgagcggaagaagcucaagccccgcuggcuggacgcucggaucuauuccgacccccucgccuuaaaggaguucaaagaauucgcggccgggcgcaagagccucacacucaaccugaucaccgagaugggccgguuaccuacguucaugacccagaaaacccgagacgcccuugacaaccuggccguucuucacaccgccgaggccgggggacgggcauacaaccacgcccucuccgagcugcccgagacgcuggagacccucuugcugcucacgcugcuggccaccgucacgggcgggaucuucuuguuccuaaugagcggccgcgguaucggcaagaugacccugggaaugugcugcaucaucacggccuccauccucuugugguacgcgcaaauucagccacauuggaucgccgccuccaucauccuggaauucuuccucaucgugcugcugaucccggaacccgagaagcagcggacaccccaggacaaccagcuaacuuacgucgucaucgcgauucugacggugguagccgcgaccauggcgaacgagaugggcuuccuggagaagaccaagaaggauuugggccucggcucaaucgccacacagcaaccggagagcaacauccuggacaucgaccuccgcccggcguccgccuggacgcuuuacgcggucgccaccacuuucgugacuccgaugcugagacacagcaucgagaacagcuccgugaacguaagccuaacggccaucgccaaccaggccaccgugcugauggggcuggguaagggcuggccccucuccaagauggacaucggcgugccccugcuggcgaucggcugcuauagccagguaaaccccauaacucucacagccgcgcugcugcuccugguggcccauuaugccauuaucggucccggacuucaggccaaagcaacucgcgaggcccagaaacgggccgcggccggcauuaugaagaacccaacaguggaugggaucacgguaauugaucucgauccuauccccuaugacccgaaguuugagaagcagcugggccaggugaugcuacuaauccugugcgugacccagguacugaugaugcgcacuaccugggcccucugcgaagccuugacccuggccacugggcccaucuccacccucugggagggcaacccgggccgguucuggaacaccacgaucgcugugagcauggccaacauuuuccgcgggaguuaucuggccggcgcagggcuucuguucagcauaaugaagaacaccacaaacacccggcggggcaccggcaacaucggugagacccugggagagaaguggaagucccgccugaacgcucucgguaaaucagaguuccagauauauaaaaagagcggcauccaggagguagaucgcacgcucgcgaaggaggggauaaagcgcggagaaaccgaucaccacgccgucagucggggcuccgcuaaacugcgcugguuuguggagcggaacauggugaccccugaggggaagguuguggaccuuggcugcggacgcggcggguggucauauuauugcggcggccugaaaaacgugcgggaagugaaggggcugaccaagggcgggcccggucacgaggagcccaucccgauguccacguacggguggaaccucgugcgccugcagagcggcguugacgucuucuuuaucccccccgagaagugugauacccugcucugcgauaucggcgaguccucucccaacccgaccguggaggccgggcggacccuccgcgugcucaaucuugucgagaacuggcugaauaacaacacgcaguucuguauuaaagugcugaaccccuacaugccguccguuauugaaaagauggaagcccugcagcggaaauauggcggggcucuuguccgaaacccgcugucccggaacagcacccaugagauguacuggguguccaacgccagcgguaauaucguguccagugucaacaugaucucccggaugcugaucaaccgguucaccaugcgacacaagaaggcgaccuaugaacccgacguggaccuuggcaguggcacccggaauaucgguauagaguccgagauccccaaccuggacaucauaggcaagcgcauugaaaaaaucaagcaggagcacgagacuagcuggcacuacgaccaggaccaccccuacaagaccugggcguaccacggcaguuaugagacuaagcagaccgggagcgcauccucuauggugaacggcgucgugcggcugcucacgaagccuugggacgugcugccaaccgucacccagauggcaaugaccgacacgacacccuucggccaacagcgcguauucaaggagaagguagacacacgcacccaggagcccaaggaggggacaaagaaguugaugaagaucaccgcugaguggcuguggaaagagcuaggcaaaaagaaaacaccgcgcaugugcacccgcgaggaguuuacacggaagguccgcuccaaugccgcccucggggcuaucuucaccgaugagaacaaguggaaguccgcccgggaggccguggaggacucccgcuucugggaacucaucgauaaggagcgaaaccugcaccuggagggcaagugugagaccugcguuuauaauaugauggggaagagagagaagaagcucggcgaauucggcaaggcuaaggguagccgcgccauuugguacauguggcugggcgcgcgcuuucuagaguucgaagcccucggguuucugaacgaggaccacugguuuucccgggagaacagccuguccggcgucgaaggggaaggccuccacaagcugggcuacauccugcgcgacgugagcaagaaagaaggcggugccauguaugccgacgacaccgcggggugggacacgagaaucacgcuggaagaccuaaagaaugaggagauggucacgaaccacauggagggcgagcacaagaagcuggcugaggccaucuuuaagcucaccuaccagaacaaaguuguacgcguccaacggcccacuccccggggaacagugauggacaucauaagucggagagaucaaagggggagcgggcaaguagggacguacggucugaacaccuucacgaauauggaggcccagcugauccgccagauggagggugaaggugucuucaagaacauccagcaccucaccgugaccgaggagguggccguccaaaacuggcuggcgcgaguggggcgcgaacgccugagccggauggccaucuccggggacgacugcguggucaagccccucgacgaccgcuucgccaacgccuuaaccgcccugaacgacaugggcaaggugcgaaaagacauucagcagugggagccgucaaagggauggaacgacuggacccaggugccauucugcagccaucacuuccacgaguugaucaugaaggacggccgcguccugguggugcccugccggaaccaggaugagcugauagcgcgcgcccggaucagccaaggggccggcuggagccuccgggaaaccgccugccugggcaagagcuacgcccagauguggucacucauguacuuccacagaagagaccuccgccuggcggccaacgccaucugcagcgccgucccaucccauugggugccgaccagccgcaccaccugguccauccacgcgaagcacgaauggaugaccaccgaggauauguugaccgucuggaaccgggucuggauccgcgagaaccccuggauggaagacaagaccccaguggagaguugggaagagaucccguaccucgggaagcgggaggaccaaugguguggcagccugaucggguuaacgagccgcgccaccugggccaagaacauccaggcagccaucaaccaggugcguucccucaucggcaacgaagaguacacugacuacaugccgucgaugaagcgcuuccggcgcgaggaggaggaggcggggguuuuaugguaa

SEQ ID NO: 25319 - RNA, 9876 nt, Artificial Sequence
  derived and/or modified CDS sequence (opt11) from DENV-2__FJ205877__SS-prME
agcgcgggaaugauaauaaugcuaauucccaccguaauggcauuccaccucacgaccagaaauggagaaccccacaugaucguagggauucaagaaaaagggaaaucucuuuuauucaaaaccgaagacgggguaaauaugugcacccugauggcaauggaucucggggaacugugcgaagacacuaucacuuacaaauguccacuacucaggcaaaaugaacccgaagauauugacugcugguguaauagcacuuccacgugggugaccuacggaacgugcacgaccacaggcgagcaccgaagagagaagcguaguguagcacuugucccccacgucggcaugggauuggagacgagaacggaaacguggauguccagcgagggagccuggaaacaugcacagaggaucgaaaccuggauacuaagacacccaggcuuuacgaucauggcggcgauacuagcauacaccaucggaaccacccacuuucagaggguacugauauucauacuccugacagccguggcucccagcaugaccaugagaugcauaggcauaagcaaccgagauuuugucgaaggagugagcggaggaucauggguagauaucguccuggagcacgggucuugugucacgacaauggcgaaaaacaaaccgacacuugacuucgagcugaucaagacugaagcaaaacagcccgcaacguuacguaaauacuguauugaggcaaagcucaccaacacaacgacagagaguagauguccgacccaaggagaaccgucacucaaagaagaacaagacaagcgcuuuguaugcaagcacagcaugguagaccgcggguggggcaauggcugcggacucuuuggcaaaggugggaucgucacuugugccauguucacaugcaaaaagaacauggaggguaaaaucguccagcccgaaaacuuagaauacaccauagugguuacaccccauucaggcgaagaacacgccgucgggaacgauaccggcaagcauggcaaagagauaaaggugaccccacaauccuccaucacagaagcugaacucacgggauacgggacagucacaauggagugcagcccccgaaccggguuagacuucaacgaaaugguacuguuacaaauggaaaauaaagcauggcugguucaccgccaaugguucuuagaccuaccacucccauggcuaccuggagcugacaaacaagaaagcaacuggauacaaaaggaaacauuggucacauucaaaaacccacacgccaagaaacaagacguugucguuuuaggaagccaggaaggagcaaugcauaccgcacucacaggcgccacggaaauacagaugagcagcgggaaucuacuguucaccggucaccugaaaugccggcuacggauggacaagcugcagcucaagggaaugagcuauaguaugugcacggggaaauucaaggucguaaaagaaauagcagaaacacaacauggaaccauuguuaucagaguccaguaugagggagacggaagcccaugcaagauccccuucgaaaucauggaccuggaaaggagguacgugcuuggacggcucauaaccguuaacccuauaguuacggaaaaagauucccccgucaacaucgaagcagagccacccuucggagacagcuauaucaucaucggagucgagcccggccagcucaaauuaaacugguucaaaaaggggagcucuauaggacaaauguuugaaacaaccaugaggggcgcuaaaaggauggcgauccucggagauacagccugggauuucggauccuuaggaggaguguucaccucgaucgggaaggcacugcaucaaguguucggugcgauauacggcgccgccuucagcggggucagcuggaccaugaaaauucuaauaggagucauaaucacauggaucgggaugaacucacggucuacaucgcuguccguaucacucguccuaguuggcaucguaaccuuauacuugggcgucaugguacaggcugacucaggaugcgugguauccuggaagaacaaagaacuaaaaugcggcagcggcauauucaucaccgacaacguacacacuuggacagaacaguacaaauuccagccggaaucccccagcaagcuggcgagcgccauucaaaaggcgcaagaagagggcauaugcggcauccgaucgguaacccgacucgaaaaucucauguggaagcagauuacaccggaacucaaccauauuuuagccgaaaacgaagucaaacucacgauaaugacuggggauauaaaagggauuaugcaggcgggaaagaggucauuaaggccucagccaacggagcuaaaauacucauggaaaacauggggaaaggccaaaaugcucagcacggaaagcuacaaccagacauuucugaucgauggaccugagacugcagaaugcccgaacacuaauagagccuggaacuccuuggaaguagaggacuauggauucggcgucuucacuaccaauaucuggcuuaaacucaaggagaagcaagacgcuuucugugacucgaagcuaauguccgcggccaucaaggacaaccgagcggugcaugccgacaugggguauuggauugaaagcgcauugaacgacacauggaaaauagaaaaagcaucauucaucgaaguaaagaacugccacuggccaaagagccacacccuauggaguaacggcgugcuagaaagcgaaaugauaauacccaaaaaccuagccggccccgucucacaacacaacuauagaccgggcuaccacacacagauagcgggacccuggcauuuagggaagcuggaaauggacuucgacuucugcgacgggacgacgguaauagugacggaagacugcggcaacaggggaccaucccucaggacgaccacagccagcgggaagcuaauaaccgaauggugcugccggucgugcacauuaccgccccuacgcuaucguggugaggacggaugcugguaugguauggaaauuagaccccuaaaggaaaaagaggaaaaccucgucaacucguugguaacggcggggcaugggcagguagacaacuuuagccugggugucuuagggauggcacuguuucucgaggaaaugcucagaacacgggugggaacuaagcacgcaauucugcugguggcgguguccuucguaacccucauaaccgggaacaugucauuuaaagaccucgggagggucgucgucaugguaggggccaccauggccgacgacaucggcaugggagugacuuaccuggcucuccucgcggcguucaagguccgaccaacguucgcugcaggucuccuacuaagaaaacuaacgagcaaagaacugaugaugaccacaauaggcauaguacuacuuagccagaguacgaucccugagaccguucuagaauugaccgacgcccucgcguuaggaaugauggugcugaagauaguucgaaacauggagaaguaccagcucgcaguaaccaucaugacuauacuaugcgucccaaaugcaguuauauuacaaaacgccuggaagguaucgugcacaauccuugccguggucucggugagcccgcugcuacugacaucgucgcgccagaaaaccgacuggauaccgcuagcccuaacaaucaaaggacuaaacccgaccgccaucuuucucaccacuuuaucaaggacaaauaaaaagcguuccuggccccucaacgaagcgauuauggcagucggaaugguaagcaucuuagcuagcagccuccugaagaacgacaucccaaugaccgggcccuuggucgcgggagggcuccucacaguaugcuacguucucacgggcaggagcgcugaucucgaacucgagagagccacagauguaaaaugggaagaucaagcggaaauuucgggaaguucgcccauccugaguauaacuauaagugaagauggaucaaugucaauuaaaaacgaagaggaagaacaaacgcugaccauauugauaagaaccggacuccuaguaauuaguggccuauucccaauuucgaucccgauaacggccgcggcuugguaccuaugggaaguuaagaagcagagggcaggaguccuaugggacguccccagcccuccuccaauggggaaagcagaguuggaggacggagcauaucguaucaaacaaaaagguauccugggauacucacagaucggggcggggguauauaaggaaggcacguuucacacuauguggcacguuacucggggcgccguacuuaugcacaaaggcaaacgaaucgagccaagcugggcagacguuaaaaaggacuuaaucagcuacgguggcgguuggaaguuagagggagaguggaaggaaggagaggagguacaagugcucgcgcuugagccggggaaaaacccgcgcgcaguccagacgaaaccaggccuauuuaaaacaaauacgggcacaaucggcgcaguuuccuuagacuucagccccgggaccagcggguccccgauuaucgacaagaaagguaaggucguaggacucuacggcaauggagucguuacgcgaagcggcgccuacgucagcgccaucgcgcaaacagaaaaguccaucgaagacaacccugaaaucgaagacgacaucuuccgcaagcgcaggcucaccauaauggaccugcauccaggagccgggaagacaaagagguaccuaccagcgauuguacgugaagcgauaaaacgaggacugcgcacuuugauacuggcgcccacaagagucguggcggcggaaauggaggaagcacugaggggacuaccaauacgcuaccaaacaccagcuauacgagccgaacacaccggacgcgaaauaguagaccucaugugccacgccaccuucacgaugcggcuccuaucccccguucgcguuccaaauuauaaccuuaucauuauggaugaagcccacuuuacagauccggccagcauugcagcaaggggguacaucucuacccgaguggaaaugggcgaagcagccggcauuuucaugacggccacgccgccaggcagccgcgacccauucccccaaagcaaugcgccaaucaucgacgaggagcgggagauuccagagagaagcuggaacagcggucacgagugggucacggacuuuaaggggaagacgguaugguuuguaccaagcaucaaggccggcaaugacaucgcggcuugucuacggaaaaacggcaagaaagucauucaacugagcagaaaaaccuucgauagcgaguacguaaaaacaagaaccaacgacugggacuucgucguaaccacagacauaucugagaugggggcaaauuucaaggccgagaggguaaucgacccccgcagauguaugaagcccgucauccuaacggacggggaagaacggguaauauuagccggaccaaugccaguuacgcacaguucugcggcucaacguagaggucgcauaggucguaacccgaagaacgaaaaugaccaauauauauacaugggcgaaccauuagaaaacgacgaagacugcgcgcauuggaaggaagcaaagaugcuacuggacaacauaaacacgccggaagguaucauuccaagcauguuugagcccgaaagagagaaaguggacgcgaucgacggagaguauagacuccgaggcgaggcccguaaaacauucguagaccuuaugcgucggggugaccuccccgucuggcuugcauauaaaguagccgccgaaggcaucaacuaccccgacagacggugguguuuugacgguauaaagaauaaccaaauucuggaagaaaacguagagguagagauauggccaaaagaaggggaacgaaagaagcuaaagccacgauggcuagauccgagaauuuacucggagccuagggcgcugaaagaguucaaggaguuuccacccggccgcaaaagccucacccugaaccugaucacagaaaugggacgccuacccacguucaugacgcagaagacucgcgacgcccucgauaaccuagcagggcuucauaccgcugaagccggagggcgagcagacaaccacgccuuaucggaacucgcagaaacccucgaaacgcuacuacuucuaaccuuauuggccaccggaacaggcgggaucuuccuuuuccugaugucgggcagaggcauugggaagaugacgcuggguauguguugcauaaucacggccagcauacugcuuugggacgcacagauccagccacauuggauagcugcaucaaucauccuugaguucuuccucauuguccuccucaucccugaacccgaaaaacaaagaaccccacaagauaaucagcucacguacguagugaucgcgauacuuacaguagugggcgccaccaugcccaaugaaaugggcuucuuagagaaaaccaagaaggaccuaggccuaggaaguauagcaacccagcaacccgaaucuaacauccuagacaucgacuuaagaccagcuucagcauggacgcucuaugcaguggcaacuaccuucgugacucccauguugaggcauucaaucgaaaacucgagcguaaacguaucacugacagccauagcaaaccaagcgacaguccugaugggccuugguaaagguugggcgcuagcaaagauggauauaggggucccgcugcuaggaaucggaugcuacucccaaguaaacccaaucacacucaccggagcgcugcuacuacugggcggacacuacgcaauaaucggccccggccuacaggcgaaagcgacgcgagaagcucaaaagcgagccgcaccgggcauaaugaaaaaccccaccguggacggcaucaccgucauagaccuagacccaaucccauacgacccgaaauucgaaaagcaacucgggcaaguuaugcugcuaaucuuguguguaacccagguacugaugaugcggacuaccugggcccuaugugaagcucuuacguuagcgaccggaccuaucucaacacucugggaggggaacccaggacgauuuuggaacacaacaauagccguaucuauggcaaacauauuucggggcucguaccuggcaggcgcggggcuccucuuuucuauaaugaaaaauacaacaaacacucggcggggcacaggaaacaugggcgaaacucucggcgagaaauggaaaucaaggcuuaaugcguuaggcaagagcgaguuccagauauacaagaagaguggaauacaagaaguagacaggacacuggcgaaagaaggaauaaaacgaggggaaacggaccaccaugcagucagccgggguagcgcaaaacuccgaugguucgucgaacgcaacauggucacaccagaaggcaaaguaguggauuuagguugcgccaggggcggauggaguuacuauugcggcggccugaaaaacgugcgcgagguaaaaggccucacuaaaggagggcccggccacgaagaacccauacccaugaguacauacgguuggaaccugguacgccuacaauccgggguggauguauucuucaucccgccagagaagugugacacccuguuaugugacauaggggagucauccccaaacccgaccguugaggcaggucgaacccucagaguauuaaacuuagucgagaauuggcucaacaacaauacccaauucugcauaaagguccuaaaccccuacaugccuagcgucauagagaaaauggaagcacuccagagaaaguacggcggcgcacugguccguaacccacuaagcaggaacagcacacaugagauguauugggucagcaacgcauccgggaacauagucucaagcguaaauaugaucucacgaaugcucauaaauagguucacgaugcgccacaaaaaggccacguaugaacccgacguugaccuaggauccgggacacgcaacaucggcauagagucagaaauaccaaauuuagauauaaucgggaagcggauagagaagauuaagcaagaacacgagacaagcuggcacuacgaccaggaccacccguauaaaaccugggccuaccacggcucguacgaaacuaaacaaacagggucggcaagcagcaugguaaaugguguaguacgacuacucacaaaacccugggacgugcucccaacgguaacacaaauggcaaugacugacacaacuccguucggacaacaacgggucuuuaaggaaaaaguagacacgagaacccaagacccgaaggaagggaccaaaaagcucaugaagauaacggcugaauggcucuggaaagaacuaggcaagaagaaaaccccacgaaugugcacacgcgaagaguuuacgcggaagguacgaagcaacgcugcgcugggcgcaauauucacagacgaaaauaaauggaaaagugcgagagaagcggucgaggacucaagauuuugggagcuaguagacaaagagcggaaccuccaucucgaagggaaaugcgaaacaugcguuuacaacaugaugggcaaacgcgagaaaaagcugggugaguucggaaaagcuaaagcaagccgcgcgauaugguacauguggcuaggagcccguuucuuagaguucgaagccuugggcuuucuaaacgaggaccacugguucagccgagagaacucccuuucagguguugagggcgaaggccugcauaaauuaggcuauauacuacgagauguuuccaaaaaggaaggaggcgccauguacgcagacgacacugccgggugggacacucgcauaacacuagaagaccuuaagaaugaagaaauggucacgaaccauauggagggggaacauaagaaacucgcugaggcaauuuucaaacucacguaucagaauaaggucguccgcguacaaagaccaaccccacggggaacggucauggacauaauuucccggcgugaccaaagaggcucggggcaggucgcaacguacggccuaaacacguucacaaauauggaagcccagcuaauccggcagauggaaggcgaaggaguauuuaaaaauauccagcaucugacagugacagaggagguagccguacagaacuggcucgcaagaguagggagagaacgucuaccacgcauggcaaucagcggugacgacugcguagugaagccacuugacgcccgcuucgcuaacgcccuaacagcgcuaaacgccaugggcaaaauacgaaaggacauccaacaaugggagccgucaaagggguggaacgauuggacacaaguacccuucugcucccaucacuuucacgagcugaucaugaaagacggaagaguccucgucguaccgugucgaaaucaagacgaacugauaggccgugccagaaucagucaaggugcugguuggagcuugagagagacggccugcuugggcaagucauaugcucaaauguggucacuaauguacuuucaccgacgagaccuacggcuagcggcaaacgccauauguagcgcuguaccaagccacugggugccaacuagccgaaccacauggagcauacacgcaaaacaugaauggaugacgacugaagauaugcuaacggucuggaacaaggucuggaucagagagaacccauggauggaagauaagaccccaguggaaucaugggaagagaucccauaccugggcaaaagggaagaccaauggugcgggagccucaucggacugacaagcagagcgaccugggccaaaaauauucaggcagcuauuaaccaaguccggagccugauaggcaacgaagaguacacggacuauaugcccucaaugaaaagauuccgacgcgaagaggaggaggcgggaguccugugguag

SEQ ID NO: 25320 - RNA, 9876 nt, Artificial Sequence
  derived and/or modified CDS sequence (opt11) from DENV-2__FJ024454__SS-prME
uccgcggggaugaucaucauguugauccccacagugauggccuuccaccuuacgacccggaacggggagccgcacaugaucgucggcauccaggagaaaggaaagucccugcucuuuaagaccgaggauggugugaauauguguacccucauggcgauggaccugggugaacugugcgaggacacuaucaccuacaagugcccccucuugcggcagaaugagccagaagacaucgauugcuggugcaacagcaccagcaccugggugaccuacgggaccugcaccacuaccggcgagcaccgccgggaaaaacgcagcguugcccuggucccccacguggggaugggauuggagacacgcacugagaccuggauguccucagagggggccuggaagcacgcccaacgcauagagaccuggaucuugcggcacccgggauucaccaucauggcggcgauccuggcuuacaccaucggcaccacccacuuucaacgcgugcucaucuucauccugcugacggccguggcccccuccaugacaaugcggugcaucggcauuagcaaccgcgacuucguggagggcgugagcgggggcagcugggucgacaucguccucgagcacggguccugcgucaccacgauggcgaagaauaagcccacgcuugacuuugagcugaucaagaccgaggcuaagcagcccgccacucucagaaaguauugcaucgaggccaagcugacaaacacgaccacggagagccgcugcccaacccagggcgagcccucacugaaggaggagcaggacaagcgguucguguguaagcacaguaugguggaccgcggcugggggaauggcuguggccucuucggcaagggcgggaucgucacgugugccauguucacgugcaagaagaauauggagggcaagaucgugcagcccgagaaccuggaguacacgaucguggucacgccccauuccggggaggagcacgcgguuggcaacgacacagggaagcacggccaggagaucaaggugaccccgcagagcuccaucaccgaggccgagcugaccggguacggccccgucacgauggagugcagcccccggacgggacucgacuucaaugaaauggugcugcugcaaauggagaacaaggccuggcucgugcaccgccagugguuccuagaccugccacucccguggcugcccggggcggacaaacaagaguccaacuggauacagaaggaaacccuggucaccuucaagaacccgcaugccaaaaagcaggacguggucguccucggcucacaggagggagcaaugcauacagcccuuacgggcgccaccgagauucaaaugagcuccgggaaccuccuguucacaggccaccugaagugccggcugcgcauggacaagcugcagcugaagggaauguccuacuccauguguaccgggaaguucaaggucgucaaggagaucgccgagacccagcauggaaccaucgugauccgggugcaguacgagggggauggcagccccugcaagaucccauucgagauuauggaccucgagaagcgauacguccucggccggcugaucaccgugaaccccaucgugacggaaaaagauucccccgucaacaucgaggccgagccgccguucggcgacucguacauaaucaucggugucgagcccggccagcugaaacucaacugguucaagaagggcucuucgaucgggcagauguuugagacgaccaugcgcggcgcgaagcguauggccauccugggcgacaccgcgugggacuucggcagccugggggggguguuuaccucaaucggcaaggcccuccaccaagucuuuggggccaucuacggcgcagccuucuccggggugagcuggacgaugaagaucuuaaucggggucauuaucaccuggaucggcaugaacucccgcaguaccucccugagcgucucccuggugcugguggggauugucacccuguaccuaggcgugauggugcaagccgacagcgggugcgucguguccuggaagaacaaggaacucaaaugcggcagcgggaucuuuaucacggacaacguacacaccuggaccgagcaguauaaguuucagcccgagagccccuccaaacuggccagcgcgauccagaaggcccaggaggaagggauauguggcauccgcuccgucacccgacuggaaaaccucauguggaagcagauuacuccggagcugaaccacauccuggcggagaaugaggugaagcucaccaucaugaccggggacauaaagggcaucaugcaggcugggaagcgcagccugcggccccagcccacugagcuuaaguauuccuggaagaccuggggcaaggccaaaaugcuuagcacugagucuuacaaccaaaccuuucugaucgacggcccagagaccgcggagugcccuaacacgaacagagccuggaacagccuggagguggaggauuauggguuugguguauucaccacaaacaucuggcucaagcugaaagagaagcaggacgccuucugcgacuccaagcugaugagcgccgcgaucaaagacaaccgggcggugcacgccgacaugggcuauuggaucgaauccgccuuaaacgauaccuggaagaucgagaaggccagcuucauagaggugaaaaauugccacuggcccaagucccacacgcuguggagcaacggcguccuggaguccgagaugaucauccccaagaaccuggccggcccagugagccagcacaacuaccgacccggguaccacacccagaucgcgggccccuggcaucuggggaagcuugagauggacuucgacuucugcgacggcaccacggugaucgugacugaagauugcgggaaucggggcccgucccuccgcacgaccaccgccagcggcaaacucaucacggaguggugcugccggagcugcacacugccgccccuccgcuaccgcggggaggacggcugcugguacgggauggaaauccgcccgcugaaggagaaggaggagaaccugguuaacagucucgugacugccggccacgggcaggucgacaauuucagccucggcgugcuugggauggcccucuuccuggaggaaaugcugcggacccguguggggacuaagcacgcuauucuccuggucgccguguccuucgugacacugauuaccggaaacaugagcuucaaggaccucgggcgggucguggugaugguaggcgccaccauggccgaugauaucgggaugggcgugacguaccuggcccuguuagcggccuucaaggugcgccccacguucgcagccggccugcuauuacggaaguuaaccuccaaggagcugaugaugacaaccaucgggaucguccucuuaagccaguccacgaucccggagaccgugcuggaguuaaccgacgcgcucgcgcucggcaugauggugcucaagauaguccgcaacauggagaaguaccaguuagcagucaccaucauggccauccugugcgugcccaacgccgugauccuacagaacgcguggaaggucagcugcacgaucuuagcugucguguccgugagcccccugcuacugacuuccagccagcagaagacugacuggaucccgcuggcccucaccaucaaagggcugaaccccacggccaucuuccucaccacccucucccgcacgaacaaaaagcggagcuggccccugaacgaggcgaucauggcgguuggcauggugaguauccuggccucaucccuccugaagaacgacauccccaugacgggcccccugguggccggaggccucuuaacggucugcuacguccugaccggccgcagcgccgaucuugagcuggaacgggcuacggacgugaaaugggaggaucaggccgagaucuccggcagcagcccgauccuguccauuacgaucagcgaggacggguccaugagcaucaagaaugaggaagaggagcagacucucaccaucuuaauacgcaccggccugcucgucaucuccggccuguuccccaucagcauccccaucacggccgccgcuugguaucugugggagguaaagaaacagcgggccggagugcuaugggaugucccuuccccuccgcccaugggcaaagcggaguuggaagacggggccuaccgcauaaaacagaagggcauccugggguacagccagaucggcgccggcguguacaaggaggggaccuuccacaccauguggcacgugacccggggcgcgguccuuaugcacaaaggaaagcguaucgagccguccugggccgaugucaagaaagaucucaucagcuacgggggaggcuggaaguuggagggcgaguggaaggagggggaggaggugcagguccucgcgcuagagcccggcaagaacccccgggcagugcagaccaagcccggcuuguucaagacgaacaccggcaccaucggugccgugucccucgacuucagcccgggaaccuccggcagucccaucaucgacaagaagggcaaggucgugggccuguaugggaacgguguggucacucgcucgggcgcuuaugugucggccaucgcgcaaaccgagaaguccaucgagaacaaccccgaaaucgaggacgacaucuuccggaagcgccggcugacgaucauggaccugcaccccggggccgguaagaccaagcgcuaccucccugccaucgugcgagaggccaucaagcgcgggcugcggacgcuuauccucgcgcccacccgcgucguggcagccgagauggaggaggcccucagaggccugcccaucagauaccagacccccgccauccgggcggagcauaccgggcgcgagauugucgaccucaugugucacgccacauucacgaugcgccugcugagcccgguccggguucccaacuacaacuuaauuaucauggacgaagcccacuucaccgaccccgcaucuaucgccgcgcgcggcuacaucagcacccggguggagaugggagaggccgccgggaucuucaugacagccacaccgcccggcagccgcgaccccuucccccaguccaacgcucccaucaucgaugaggagcgugagaucccagagcggagcuggaacuccgggcacgagugggucacggauuucaaggggaagaccguaugguuugugcccagcaucaaggcggggaacgacaucgccgcaugucugcggaagaauggcaagaaggucauccagcugucccgcaagaccuucgacucagaguacgucaagacccggaccaacgacugggacuucguggucaccacggacaucuccgagaugggcgccaacuucaaggcggaacgcgugauagacccucggcgaugcaugaagcccgugaucuugacggacggggaggagcgggucauucuggcugguccgaugcccgugacgcacagcuccgccgcccagcgccgugggcgcaucggccguaaccccaagaacgagaacgaucaguacaucuauaugggggaaccccuggagaacgacgaagacugcgcccacuggaaggaggccaagaugcuccuggacaacauuaacacaccggaagggaucaucccuagcauguucgagcccgaacgcgagaagguggaugccaucgacggugaguacaggcugcgcggggaagcccgcaaaaccuucguggaccucaugcggcgcggcgaucugccaguauggcuggccuacaaaguagccgcugaggggaucaacuacgccgaccggcgauggugcuuugacggcaucaagaacaaccaaauccucgaggagaacgucgaggucgagaucuggcccaaggaaggggagcggaagaagcugaagccgcguuggcuggacgcgcguaucuacucagacccucucgcgcugaaggaguucaaggaauucgccgcgggccgcaagagccugacccucaaccugaucaccgagaugggccgauuaccuaccuucaugacacagaagacccgcgaugcccucgacaaccuggccguacugcauacggcugaggccggcggucgggccuacaaccacgccuuaucugagcugccggagacccuggagacucuacugcugcucacucugcuggccacggugaccgggggcauuuuccucuuccugaugagcggccgcgggaucgggaagaugacgcuggguauguguugcaucaucaccgccuccauccuccugugguacgcgcagauucagccgcauuggaucgccgccagcaucauucuggaguuuuuccuuauugugcugcugauaccagagccggagaagcaacggacgccccaggacaaccaacucaccuacgucguaauagccauucugaccguggucgccgcgacgauggccaacgagaugggcuuccuggagaaaacaaagaaagaccucgggcugggcuccaucgccacccagcagccugagagcaacauccuagacaucgaccucaggcccgccuccgcguggacccuguacgcgguugccacaaccuucgugaccccgaugcuccggcauagcaucgagaacagcuccgucaacguuagccucaccgccaucgccaaccaggcuacggugcugaugggccuggggaaaggcuggccccucucaaagauggacaucggggucccccugcuggcgaucggcuguuacagucaaguuaaccccaucacccucacugccgcccugcuucuccugguggcccauuacgcgaucauaggcccgggccugcaggcaaaggccacccgagaggcccagaagcgggcugcggccggcaucaugaaaaacccgacagucgacggaaucaccgucauagacuuagaccccauccccuacgacccaaaauuugagaagcagcugggccaggugaugcugcucaucuuaugcgucacccaggugcugaugaugcgcaccacgugggcccucugcgaggcccugacccuggccaccgggcccaucucaacccucugggagggaaaccccggucgguucuggaauacgacaaucgcggugagcauggccaacaucuuccgcggcucguaccuggccggcgccgggcuccucuucagcaucaugaagaacaccacaaacacgcggcgcggcacggggaacaugggcgagacccugggcgagaaguggaagucccgcuugaaugcgcucggcaagagcgaguuccagaucuacaagaagucugggauccaggaggucgaccggacccuagcgaaggaggggaucaagcgcggcgagacggaccaccacgccgugagccggggguccgccaagcuccgcugguucguggagaggaacauggucacccccgagggcaagguaguggaccucggcugcgggcgcgguggguggagcuauuacugcggcgggcugaagaaugugcgggagguaaagggccugaccaagggcgggccgggccaugaggagccaauccccauguccaccuacggguggaaccucguacgccugcagagcggcgucgacgucuucuucaucccgcccgaaaagugcgacacgcugcucugugauauuggggaguccucacccaaucccaccguggaggccggccggacccugcgcguacucaaccucguggagaacuggcugaauaacaauacgcaguucugcaucaagguacugaacccguacaugcccagugucaucgagaagauggaggcacugcaacggaaguacggcggggcccucgugcgcaacccccugagccggaauucaacgcacgaaauguauuggguguccaacgccagcggcaacauagugucgagcgucaacaugaucucccgaaugcugaucaaccgguucaccaugcggcacaagaaggcaaccuacgaacccgacguggaucucggcucuggcacccggaacauagggauagagagcgagacgccgaaccuggacaucaucggcaagcguauagagaagaucaagcaggagcacgagacgagcuggcacuacgaucaggaccacccguacaagaccugggccuaccacggcuccuaugaaaccaagcagaccgggucagcguccagcauggucacgggcguggugagacugcucacuaagcccugggacguccugcccacugugacacagauggccaugacggacacaacgcccuucgggcagcagcgcguguucaaagagaaggucgacacccgcacucaggaccccaaagaggccaccaagaagcugaugaagaucaccgcagaguggcucuggaaggaacugggcaagaagaagacgcccagaaugugcacgcgugaggaguucacccggaaggugcgcuccaacgccgcgcucggggccaucuucaccgacgagaauaaguggaaauccgcccgggaggccgucgaagacucgagauucugggaguuaguugacaaggagcggaaccugcaccuggaggggaagugcgagaccuguguguacaacaugauggguaagagggagaagaagcucggggaauucggcaaggcuaaggggagccgggccaucugguacauguggcuaggcgcccgcuuccucgaguucgaagcccucggauuccugaacgaggaccacugguucucccgggaaaacucgcugagcggggucgagggcgaggggcuccacaagcugggauacauauugcgagacguaucuaagaaggaagguggggccauguacgcggaugacacggccggcugggauacucggauaacccucgaggauuugaaaaacgaggagauggucacuaaccacauggagggggagcauaagaagcucgcagaggccauuuucaaauuaacauaccagaacaaagucguacgugugcagcggccaaccccgcgcggcacugucauggacauaaucagccggcgcgaccaacgggguagcggucagguggggaccuacggccucaacacguuuaccaacauggaggcccagcugauacgccagauggagggggaagggguguucaagaacauucagcaccucccgguaacagaagagguggcggugcagaacuggcuggcgcgggucggccgcgaacgucugucgcggaugccgaucuccggggacgacugcguggugaagccccucgacgcacgcuucccgaccgcccugaccccccugaaugacaugggaaagauccggaaggacauccaccagugggaccccagcaaaggcuggaacgacuggacccagguccccuucuguucccaucacuuccacgagcucaucaugaaggacggacgcgugcuaguggucccgugcaggaaccaggacgacuugaucgcccgcgcgcguaucagccaaggcccuggguggucccuccgcgagacggcuugucuuggaaagagcuacgcccaaauguggucccugauguauuuccaccggcgcgaccuccgguuagccgccaacgcgaucugcagugccgugccuucccacugggugcccaccagccgcacgacaugguccauacacgccaagcacgaauggaugacuaccgaggauaugcugaccgucuggaaucggguguggauccgcgagaacccguggauggaggacaagacgcccguggagagcugggaagaaaucccuuaccucgggaagcgggaggaccaguggugcggcucccuaauuggccugaccagccgcgcgaccugggccaagaacauccagguugcgaucaaccaggugcggucccucaucgggaacgaagaguacaccgauuacaugccgagcaugaagcgcuuccggagggaggaggaggaggccggcguacugugguga

SEQ ID NO: 25321 - RNA, 9876 nt, Artificial Sequence
  derived and/or modified CDS sequence (opt11) from DENV-2__FJ205878__SS-prME
agcgcagguaugaucaucaugcuuauucccaccguaaccgccuuccaccucaccacacgcaauggcgaaccccacaugaucguaggcauacaggagaagggcaaaagccugcuguucaagaccgaggacggagugaacaugugcacgcuuauggcgauggacuugggggagcugugcgaggauaccauaaccuacaaaugcccccuccugaggcagaacgagccggaagacauagauugcugguguaacagcaccaguaccugggucaccuacggcaccugcaccaccacaggcgagcaccgucgggagaagaggagcgucgcccuggugccccacguggggaugggucuugagacccggaccgagaccuggauguccagcgaaggggcauggaaacacgcccagcgcaucgagacauggauacugcggcaccccggcuucaccaucauggccgcaauccuagccuacaccaucgguaccacgcacuuucagcgcguccucauauucauacugcugaccgccguggcccccuccaugaccaugcggugcaucggcaucagcaaccgugacuucguugagggcguaucggggggcagcuggguagacaucgugcucgagcacggcuccugcgucaccacgauggcgaagaacaagcccacccuggacuucgagcugaucaaaaccgaggccaaacaacccgcuacccuccgcaaguacugcaucgaggccaagcugacaaacaccaccacugagucucgcugccccacgcagggcgagccgucccugaaggaggagcaagauaagcgguucgucugcaagcacagcaugguggaccgcggaugggggaauggcuguggccuguucggcaagggcgguauagugacuugcgccauguucacgugcaagaagaauauggagggcaagauagugcagcccgaaaaccuugaguacaccaucguggucacgccccacucgggugaggagcacgcggugggcaacgacaccgggaagcauggccaagagaucaaagugaccccgcagaguuccauaaccgaggcagaguugaccggguacggaaccguaaccauggagugcagcccccggaccggccucgacuucaacgagauggugcugcugcagauggagaacaaggcguggcucgugcaccgccagugguuccuggacuugccccugcccugguuaccgggagccgacaagcaggaguccaacuggauccaaaaagagaccuuggucacguucaagaacccccacgccaaaaagcaggacguagucgugcucggcagccaggaaggggcgaugcacaccgcccugaccggcgcuaccgagauccagaugagcuccggaaaucuccuguuuacgggacaccugaagugccggcuacgcauggauaagcuccagcucaaaggcaugagcuacagcaugugcaccgggaaguucaagguggucaaagagaucgccgagacacagcacggcaccaucgugauccggguccaguaugagggggacgguagccccugcaagauccccuucgaaaucauggaccuggagaagcgcuacguccucggccggcugaucacugugaacccgaucgugaccgagaaggacucccccgucaacauugaggccgaaccgcccuucggggacaguuauauuaucaucggcguggagccagggcagcugaagcucaacugguucaagaagggcuccagcaucgggcagauguuugagaccaccaugcggggcgcgaagcgcauggcgauccuuggcgauacggcuugggacuucgggagucugggugggguuuucaccagcaucggcaaggccuugcaccaggucuucggcgccaucuacggcgcggcuuuuuccggcgugucguggaccaugaagaucuugaucggggugaucaucaccuggaucggcaugaacucuagaucuacgucccugagcgucucccuggugcucguggggaucgucaccuuguaccucggcgugauggugcaggccgacagcgggugcgugguauccuggaagaauaaggagcucaagugcggcucggggaucuucauuaccgacaacgugcacaccuggacugagcaguauaaguuccagccugagagccccuccaagcuggccagcgcgauccaaaaggcccaagaggaggggaucugcggcauucgcuccgucacccgacuggagaaucucauguggaagcagaucaccccugagcugaaccacauccuggccgagaacgaggugaagcucacuaucaugacuggagacaucaagggcaucaugcaggccgggaagagaagccugcgcccgcagcccaccgagcugaaguauuccuggaagacaugggggaaggcgaagaugcugagcacggaguccuacaaccagacauuccugauagacggccccgagaccgcggagugcccgaauaccaaccgggccuggaauagccuugagguggaggacuacggguucgguguguucaccacuaacauauggcucaagcugaaggagaagcaggacgccuucugcgacuccaaacuuaugagcgcagccaucaaggacaacagagccgugcacgccgauaugggguacuggaucgaguccgcccucaaugauaccuggaaaaucgagaaggcgagcuucaucgaagugaagaacugccacuggccaaaaucccacacauuauggagcaacggcgugcucgaguccgaaaugaucaucccuaagaaccucgccggccccgugucgcagcacaauuaccgcccuggguaccacacucagaucgcgggccccuggcaccuggggaagcuugaaauggacuucgacuucugugaugguaccacggucaucgucaccgaggacugugggaaccgcggccccucccugcgcaccacgacggccaguggcaagcugaucaccgaguggugcugccgaucuuguacauuaccgccuuuacgauaucgcggggaggacggcugcugguacgggauggagauucgaccccugaaagagaaggaggaaaaccuggugaacagccucgugaccgccggccacgggcaagucgacaacuucagccugggcgugcugggcauggcgcucuuccuggaggagaugcugcggacgcggguggggacuaagcacgcgauccuucugguagccguguccuucgugacccugauuaccgggaacaugucguucaaggaccuugggcgggucgugguaauggucggugccacgaugaccgacgacaucgggaugggcgugaccuaccuggcccugcucgcagcauucaagguucgcccaaccuucgccgccggccuguugcuucgcaagcugacguccaaggaguuaaugaugaccacgaucgggaucgugcuccugagccaguccacgauccccgagacgguuuuggagcucaccgacgcccuggcccuggguaugauggugcucaagauugugcggaacauggagaaguaccagcuggcggugaccaucauggccaucuuaugcguaccgaacgccgugauucuccagaacgcauggaaggugagcuguaccauccuggccgucgugucugugagcccacugcuccugacguccagccagcaaaagaccgacuggaucccccuggcgcucaccaucaagggacugaauccgaccgcuaucuucuuaacgaccuuguccaggaccaacaagaagcggucguggccgcugaaugaggcuaucauggcugucggcaugguguccauccuggccagcucccuccugaagaacgacauccccaugaccggcccccugguagccggcggccuccugacggugugcuacgugcugaccgggagaagcgccgaccucgagcuggagcgggcgaccgacgugaagugggaggaccaggccgagaucagcggcagcagccccauccugucuaucacgaucagcgaggacggguccaugagcaucaaaaacgaggaagaggagcaaacgcugaccauccugauccgcacuggccugcucgucauauccggccuguucccgaucagcauccccaucacggcagccgccugguaccugugggagguaaagaagcaacgggccggcguacucugggacguccccuccccgccgccgaugggcaaagccgagcuggaagauggggcguaccgcaucaagcagaagggcauccugggauauagccagaucggcgccgguguguaucgggaagggaccuuccauaccauguggcaugugacucgcggcgccguccucaugcacaaagguaagcggaucgagcccuccugggccgacguaaagaaggaccucaucagcuauggcgggggcuggaagcuagaaggggaguggaaggagggcgaggaggugcagguccucgcccuggagcccggcaagaacccccgcgcggugcagaccaagccaggucuguucaagacuaauacuggcaccaucggggccgugucccucgacuucagcccuggcaccuccggcagccccaucaucgacaagaaggggaaggucgugggcuuguacggcaacggcguggucaccaggagcggcgccuacgugagcgccaucgcccagacggagaaguccaucgaggacaacccagagaucgaggacgacaucuuccguaagcggcgacugacgauaauggaucuucaccccggcgcagguaagacaaagagauaccuucccgccaucgugcgcgaggccaucaagcgggggcugaggacccugauccucgccccgacuaggguaguggcugccgaaauggaggaagcccugcggggccuccccauccgguaccagaccccagcuauccgcgccgagcacaccgggcgagagaucguggacuuaaugugucacgcgacauucacuaugagacuguuaagccccguucgcgugccgaacuacaaccucaucaucauggaugaggcccacuucaccgaccccgccucaauugccgcgcggggguauaucagcacccgcguggagaugggcgaggcggccgggaucuucaugaccgcgacgccgccuggcucucgcgacccauucccccaauccaacgcccccauaauagacgaggagcgcgagauccccgagaggucguggaacuccgggcacgaauggguaaccgacuucaaaggcaagaccgugugguuuguuccgagcaucaaggcugggaacgacaucgccgccugccuacgaaagaacggcaagaaggucauccagcugucccguaagaccuucgacagcgaauacguuaagacacgcacuaacgacugggacuucguggucaccaccgacaucuccgaaaugggugccaacuucaaggccgaacggguaaucgaccccagacgguguaugaagcccgugauucucacggauggggaggagcgcgugauccuggcgggccccaugccggugacccacagcuccgcagcccagcggcgggggcgaauaggcagaaaccccaagaacgagaaugaccaguacaucuacaugggggagccucuggagaacgacgaggacugcgcgcacuggaaggaggccaagaugcuccuugacaauaucaacacccccgagggcauaaucccgagcauguucgagcccgagcgggagaaaguggacgcgaucgacggcgaauaccgccugcgcggggaggcccggaagaccuucgucgacuuaaugcgccggggugaccugcccguguggcuggccuacaagguggcggccgaggggauaaacuacgcugaucgccgguggugcuucgacggcauaaagaacaaccagauccucgaggagaauguagaaguggagaucuggacgaaggagggcgaacgcaaaaaacugaagccgcggugguuagacgcccgcaucuacuccgacccccucgcccugaaggaguucaaggaguucgccgccggccggaagucccugacccuaaaccuaauuaccgagaugggccgccugcccaccuucaugacgcagaagacccgggacgcccucgacaaccuggccguccugcacaccgccgaggccgggggccgugcguacaaucacgcccucuccgaacugccugagacgcuggagaccuuguuacugcucaccuugcuggccaccguaacaggggguaucuuccucuuccucaugagcggucgggggaucgguaagaugacccuggggaugugcugcaucaucaccgcguccauccuacugugguacgcccagauccaaccgcacuggaucgcggccagcauaauccuggaauucuuccucauaguguugcuaaucccugaacccgagaagcagcgcacgccccaggacaaccagcuaacauauguggugaucgccauccugaccguggucgccgccacgauggcgaacgagaugggcuuccuggagaagaccaaaaaggaccugggacuuggcuccaucgccacccagcagccggagagcaacauccuggacaucgaucucagaccugccuccgccuggacccuguacgccguggcgacgaccuucguaaccccgaugcugcgccauucaauagagaacaguagcgugaacgugagccucaccgccauugccaaccaggccacagugcucaugggcuuggggaagggcuggccccucuccaagauggacaucggcgucccgcugcuggcgaucggcugcuacagccaggugaaccccaucacccucaccgcggcauuacugcuccugguggcucacuacgcgaucaucgggcccggccugcaggcgaaggccacccgggaggcccagaaacgcgccgccgcgggcauuaugaaaaaccccaccguggaugggaucaccgugaucgaccucgacccgauuccuuacgaccccaaguucgagaagcagcugggccaggugaugcuguugauccugugcgucacccaaguucugaugaugagaaccacgugggcgcucugcgaggcccugacucuggccacggggccuaucuccacacucugggagggcaacccggggcgcuucuggaacacgacgaucgcugucaguauggcgaacaucuuccggggcuccuaccuugccggcgccgggcuccucuucagcauuaugaagaacaccaccaauacucgccggggcaccgggaauaugggcgagacccugggcgagaaguggaagucccggcugaacgcccucggcaagagcgaguuccagauauacaaaaaguccggcauccaggagguugaccgcacccuugccaaagaggggaucaagcggggggagacggaccaccacgcggugagccgcggguccgccaagcugcggugguucguggagcgcaacauggucacaccagaaggcaaggugguggaccuuggcugcgggcggggcggauggagcuacuacugcggcgggcugaagaacgugcgggaggugaaggggcugaccaagggcgggccgggccaugaggagcccauaccgauguccaccuacggguggaaccucgugcggcuacagucgggcgucgacguuuucuucauaccaccggagaagugugacacucuguuaugcgacaucggggaaucgagccccaacccgacgguugaggccgggcgaacccugcgaguccugaaccucguugagaacuggcugaacaacaacacccaguucugcaucaagguacugaaccccuauaugccauccgucaucgagaagauggaggcccugcagcgaaaguacgguggggcucucgugcgcaacccgcugagccgcaacagcacccacgagauguacuggguauccaacgccagcggcaacaucgucuccagcguuaacaugaucagccggaugcugauuaaucgcuucacgaugaggcacaagaaagccaccuacgagccagacguugaccucgggagcggcacacguaauauugggaccgaguccgagauaccuaaccuggacaucaucggcaagcggauugaaaagaucaagcaggagcacgagacuagcuggcacuacgaccaggaucaccccuacaagaccugggccuaccacggcuccuacgagaccaagcagaccgggagcgccuccagcauggucaauggcguggugcgccugcucaccaaacccugggacguccugcccauggugacccagauggcaaugaccgacaccacgcccuucgggcagcagcggguguucaaggagaaaguugacacccggacccaggagcccaaagagggcacuaagaaguugaugaagaucacggcugaguggcucuggaaggaacugggcaagaagaagaccccgcgcaugugcacgcgggaggaauuuacccgcaaggugcgguccaacgccgcccugggugccaucuucacggacgagaauaaguggaaguccgcucgcgaagccguugaggacucccgguucugggagcucgucgacaaggagagaaaccugcaccuggagggcaagugugagaccuguguguauaacaugauggggaagcgggagaaaaagcucggugaguucgggaaagccaagggcucgcgagcaauuugguauaugugguugggcgcgagguuccuggaguuugaagcgcucggguuccugaacgaggaccacugguucucccgcgagaacagccugaguggcgucgagggggaagggcuccacaagcugggguacauccuucgggacgugagcaagaaagagggcggcgccauguaugccgacgacaccgcagggugggacacccggaucacacuggaggaucucaagaacgaggagauggucaccaaccacauggagggagagcacaaaaaacuagcggaggccaucuucaagcucaccuaccagaacaaaguugugcggguacaacgccccaccccccgggggacggucauggacaucaucucccgccgggaccagagaggcuccggucaaguggggaccuacggucugaacaccuuuaccaacauggaggcccagcugauccggcagauggagggcgaggguguguuuaagaacauccagcaccucacugucacugaggaggucgccgucaagaacuggcuggcccgcgucgggcgugagcgccugucucgcauggcaaucuccggcgacgauugcgucguaaagccccucgaugaccgguucgccaacgcucugacggcccugaacgacaugggcaagauacgcaaggauauccagcagugggagccaagcaagggguggaacgacuggacccagguccccuucugcucccaccacuuucacgagcucaucaugaaggacggccgggugcuggugguacccugcaggaaccaggacgagcugaucgggcgugcccgcaucagccagggcgcgggguggucccuccgggagacggcuugccuggggaagagcuacgcccaaauguggucccugauguacuuucacaggcgggaccuccgcuuagccgccaacgcuaucuguucugccgugcccucccacugggugccgaccagccggaccacauggucuauccacgccaagcaugaguggaugacaacggaggacaugcugacagucuggaauaggguguggaucagagagaaccccuggauggaggacaaaaccccgguggaaagcugggaggaaauccccuaccucggcaagcgcgaggaccaguggugcgggucccugaucggucugacuagccgggccacuugggcgaagaauauccaggcggcaaucaaccagguccgcuccuuaaucgggaacgaggaguauacggacuacaugccgagcaugaagcgguuccgcagagaggaggaggaggccggcgugcugugguga

SEQ ID NO: 25322 - RNA, 9876 nt, Artificial Sequence
  derived and/or modified CDS sequence (opt11) from DENV-2__FJ205879__SS-prME
ucggcggggaugaucauuaugcugauccccacuguuauggccuuccaucucaccacccggaacggggagccccacaugaucgucggcauccaggagaagggcaaguccuugcuguucaagaccgaggauggcgugaacauguguacccuuauggcgauggacuugggggagcugugcgaggacaccaucacguacaaguguccccuccuccgccagaacgagcccgaggacaucgacugcuggugcaacagcaccagcaccugggugaccuaugggacgugcacuacgaccggggagcaucgccgggagaagcgcucuguugcccugguaccgcacguggguaugggguuagagacccgaaccgaaacguggaugucguccgagggcgccuggaagcacgcccaacgcaucgaaaccuggauccugcgucacccgggcuucaccauuauggccgcgauacucgccuacacgaucgguaccacucacuuccaaagggucuuaaucuucauccugcugacggccguggcccccuccaugaccaugcggugcauuggcaucagcaaccgagacuuuguagagggagucuccgggggcagcuggguggacaucguccucgagcacggguccugugucaccaccauggcuaagaacaagcccacucuggacuucgaacuuaucaagaccgaggccaagcagcccgcuacgcuccggaaguauugcaucgaggcgaagcugaccaauacgaccacggagagccgcugccccacccaaggagaacccucucugaaggaggaacaggacaagcgguucaucugcaaacacucgaugguggaucguggcugggggaaugguuguggccuauucgguaagggcggcaucgugacgugcgccauguuuacgugcaagaagaacauggagggaaagaucguccagccggagaacuuagaauacaccaucgugguuacgccccauucaggagaggaacacgcagucggcaacgacacggggaagcauggcaaggaaauaaaggugaccccgcagaguuccaucaccgaggcagaacuuacuggguacggcaccgugaccauggagugcagccccagaacaggccuugacuucaacgaaaugguccuucuacagauggagaacaaggccuggcuugugcaccgacagugguuccuggaccugcccuuaccuuggcugccaggugcagacaaacaggaguccaacuggauacagaaggagacccugguaacauuuaagaauccacacgccaagaaacaagacgucguuguccucgggucgcaggagggggcgaugcacacugcacuaacuggcgccacagagauccagaugucaagcggaaaucuccuguuuacaggccaccugaagugccggcugcgcauggacaaguuacagcugaaggguaugagcuacuccaugugcaccggaaaguucaagguggugaaggaaaucgcggaaacccaacacggcacaauugucauucgggugcaauacgagggggacgguagccccugcaagauacccuucgagauaauggaccuggagaaacgguacgugcuuggccgucugaucaccgucaacccgaucgucaccgagaaagacucccccgugaacaucgaagccgagccucccuucggggacaguuacauuaucaucggagucgagccggggcagcugaagcucaacugguucaagaagggcagcagcaucgggcagauguuugagacgaccaugagaggggcuaagcgcauggccauccugggcgacacagcuugggacuucgggucccuagguggggucuuuaccagcaucgggaaggcccuccaccagguguuuggggcaaucuacggcgccgccuuuuccggcgucagcuggaccaugaagauccugaucggggugaucaucaccuggaucggcaugaacucccgaagcacaucccugagcguguccuugguccuugucgggaucgugacgcuguaccugggggugaugguacaggccgacagcgggugcguagucuccuggaagaacaaggaguuaaaaugcggcagugguaucuucaucaccgacaacguacauacguggaccgagcaguacaaguuccagcccgagucacccuccaagcuggccagcgcuauccaaaaggcccaggaagaggggaucugugggauccgcuccgugacucggcuggagaaccucauguggaagcaaauuacgcccgagcuuaaucacauccuggccgagaacgaggucaaguugaccaucaugaccggggacauuaaagguaucaugcaggcggggaaacgcagccuacggccucagcccacggaacucaaguacuccuggaagacuugggguaaagccaagaugcucagcaccgaaagcuacaaccagaccuuucuuaucgacgggccugaaacggcggaaugcccgaacacaaaccgcgcauggaacagccuugagguggaggacuacggguucggggucuucaccaccaauaucuggcucaaacugaaggagaagcaggacgccuucugcgacuccaaacugaugucugccgccauaaaagacaacagagcgguccacgccgacaugggguauuggauugaaucugcuuugaacgauacguggaagauugaaaaggccucauucauagaggugaagaacugccacuggcccaagucccacacccuguggagcaacgguguccuugaguccgaaaugaucauccccaaaaaucucgccggccccgugagccagcacaacuaccgccccggguaccacacgcagaucgcgggcccguggcacuuggggaagcuggagauggauuucgacuucugcgacggcacuacggucguugucacugaggauugcgggaauaggggccccagucuccgcacuacaaccgccuccggcaagcugaucacggaguggugcugccggagcugcacccugcccccucugagauaccgcggggaggacggaugcugguacgggauggaaauccguccccuuaaggagaaggaggagaaccugguuaacucccucgugacugccggccacggacagguggacaacuucagccucggcgugcugggcauggcccucuuccuggaggaaauguuacggacccgcgugggcacaaaacacgcgauccuccugguagccguguccuucgugaccuuaaucacuggcaacaugucguucaaagaccucggucgggucgugguuauggugggcgcaaccauggccgacgacauaggcaugggaguuaccuaccuugcccugcucgcagccuucaagguccgccccacuuucgccgccggucuacuacuccggaaacugaccuccaaggagcugaugaugaccacgauagggaucgugcuccugucccaauccacaaucccagaaacgguucuagaacucaccgacgcccuggcgcugggcaugauggugcucaagaucguucgcaacauggagaaguaccaacuagcgguaacgaucauggccauccugugcguucccaacgccgugauccuccagaacgccuggaaaguaaguuguaccauucuggcggucguguccguaagcccucugcuccugaccuccagccagcaaaagacggacuggaucccccuggcucucaccauuaaagggcuaaacccgaccgccaucuuccugaccacccuuucgcgcacgaacaaaaagcggagcuggccgcugaaugaggccauuauggcggucgguauggugucuauccuggccucgucccuccugaagaacgacaucccgaugaccggcccccugguggccgggggccuucugaccgugugcuaugugcugacagggcgcagcgccgaccucgagcuggagcgugcuacggacgugaagugggaggaccaggcagagaucuccggcagcagcccuauacuguccaucaccaucucggaggacggguccaugucuauuaagaacgaggaggaggaacagacccucaccauccugauccgcacggggcugcucgucaucuccgggcuguucccgaucucaauccccaucaccgccgccgccugguaucugugggaggugaagaagcagcgggcugggguguuaugggacgucccgagcccgccgcccaugggcaaggcggagcuggaggacggggccuaccgcaucaaacagaagggcauccuggguuacagccagaucggcgccgguguguauaaggaggggaccuuccacaccauguggcacguuacccgaggggcggugcucaugcacaaggggaaacgcaucgagcccuccugggccgacgugaagaaggaucugaucagcuacggcgggggcuggaaguuagagggugaguggaaggagggggaggaggugcagguccucgcgcuggagcccggcaagaaucccagggcgguccagaccaagcccgggcuguucaaaaccaauacgggcaccaucggggccgugucccucgacuucagccccggcacgucgggcagcccaaucaucgacaagaaggggaaggucgugggcuuauacgggaacggaguggucacccgcucuggcgccuacgugagcgcaaucgcgcagaccgagaagaguaucgaagacaaccccgagauugaggacgauaucuuccggaaacgcagacugaccauaauggaccuacacccgggcgcggggaagacgaagcgcuaccucccugccaucgugagagaggccaucaagcgggggcugaggacccugauucucgcgccuacgcgcgugguggccgccgagauggaagaggcccugcggggccuaccuauccgcuaccagacgcccgccaucagggcggagcacaccggacgcgagaucguggaccucaugugccacgccacauucaccaugcgccugcugagccccguacgggugccgaacuacaauuugaucaucauggacgaggcccacuucacagacccggcauccaucgcugcgcgcggcuauaucagcacgcggguugagaugggcgaggccgccgggaucuuuaugaccgcuacgccgcccggcagccgcgauccauucccucagaguaacgcccccauuauugacgaggaacgggagauccccgagcgcucguggaacagugggcacgagugggucaccgacuucaaggguaagacggugugguucgugccgagcauuaaggcuggaaacgacauugccgcaugucuucggaaaaacggcaagaaggucauucagcugucccgcaagacguuugauuccgaguacgugaaaacgcggacgaacgacugggauuucguuguuacgaccgacaucuccgagaugggcgccaacuucaaagcggagaggguaaucgacccccggcggugcaugaagcccgugauccucaccgacggugaggagcgugucauacuggccggucccaugccggucacccacaguucagccgcccaacgccgggggcgcaucggccguaacccgaagaaugagaaugaccaguacauauacaugggcgagccccuggagaacgaugaggacugcgcccacuggaaggaagcgaaaaugcuccuggacaacaucaacacacccgagggaauuaucccgagcauguucgagcccgagcgcgagaagguugacgccauagacggcgaguaccgguuacgcggggaggcacgcaagaccuucguugaccucaugaggagaggcgaucugcccgucuggcuggccuacaagguggccgcggaggggauaaacuacgccgaccggcgcuggugcuucgacggcaucaagaauaaccagauucucgaggagaacgucgagguggagaucuggaccaaagagggggagcggaaaaagcugaagccgagauggcuggacgcgcggaucuacuccgauccccucgcccucaaggaguucaaggaguuugccgcgggccgcaagagccugacccucaaccugaucacggagaugggccgucugcccacguucaugacccagaagaccagggacgcacuagacaaccuggcagugcugcacaccgccgaggcugguggacgggccuauaaucacgcccucuccgaguuaccggaaacgcuggagacccuccugcuccucacccugcuggccacggugacugggggcauauuccucuuccucaugagcggucgcgggaucggcaaaaugacacuggggaugugcugcaucaccaccgccuccauacuccugugguacgcgcagauccagccccacuggauugccgccagcaucaucuuagaguucuuccucaucgucuuacuuaucccugagcccgagaagcagcguacgccucaagacaaccaguuaaccuacguugugaucgccauccugaccguggucgccgcuaccauggccaaugagaugggcuucuuagaaaagacgaagaaggaucucgggcugggcaguaucgccacccagcaaccggagagcaacauccuggacaucgaccucaggcccgcuuccgccuggaccuuauacgcgguggcgaccacguuugugacccccaugcugagacauagcaucgagaacagcuccgucaacguuagccucacggcaaucgccaaccaggccaccgugcugaugggacuggggaagggcuggccccucuccaagauggacaucggggucccgcuccuggcgaucggcugcuacagccaggucaaccccauaacgcucacggccgcgcugcuguugcugguagcccacuaugcaaucauugggcccggacugcaggccaaggcaacccgcgaagcccagaagcgagcggcagccggcauuaugaaaaaucccaccgucgacgggaucacgguuaucgacuuagacccgaucccuuacgacccaaaguuugagaagcagcuggggcaggucauguuacuaauucugugcgucacccagguacugaugaugcgcacaaccugggcuuugugcgaggcccugacgcuagccaccgggcccauauccacccucugggagggcaacccggggcgguucuggaacaccacaauagcugugagcauggcaaacauauuccgcgguuccuaccuggccggcgcggggcuucucuucagcaucaugaagaacaccaccaacccgcggcgcggcacugggaacaugggggagacguuaggcgaaaaguggaaaucgcgucuuaacgcccucgggaaaucugaguuucagauuuacaagcggagcggcauccaagagguggacaggacacuggcgaaagaaggaaucaagagaggcgaaacugaccaucacgcagugagccgcggguccgccaaacuucgcugguuugucgagcgcaacauggucacccccgaaggaaagguggucgaccucggaugcgggcgggguggguggagcuacuacugcggcggucugaagaacguaagagaggugaagggccugacgaagggcgggcccgggcaugaggagccuauccccauguccaccuacggguggaauuuggugcggcuacaaagcggcgucgauguguucuucauuccgcccgagaagugcgacacacugcucugcgacauaggugaguccagcccgaaccccaccguugaggccggucgcacgcugcgggugcugaaccucguggagaacuggcucaacaacaacacccaauucugcaucaagguacugaaccccuauaugccguccgucaucgaaaagauggaggcgcugcaacgcaaauacggcggcgcacucgugcguaauccccugagccgcaacagcacacaugagauguacuggguguccaacgccuccggcaacauagucuccagcgugaauaugaucucacggaugcugaucaauagauucaccaugcggcacaaaaaggccaccuacgagcccgacgucgaccuagggagcggcacgaggaacaucgggaucgaaagugagauacccaaucuggacaucauuggcaagcggaucgaaaagauaaagcaggagcacgagaccagcuggcacuacgaccaggaccaccccuacaagaccugggcuuaucacggcucauacgagaccaagcagacggggucggcgaguagcauggucaacggugucgugcgccuguugacuaagcccugggauguccugccaaccgugacccagauggccaugacggacacaaccccuuuuggacaacagcggguguuuaaggagaaaguugacacccggacgcaggagccgaaggaagguaccaagaagcugaugaagaucaccgcggaauggcucuggaaggagcuggguaagaagaagaccccucggaugugcacacgggaagaguucacgcgcaaagugcggaguaaugccgcucucggggcgauuuucacagaugagaacaaguggaaaagcgcccgagaggccguggaggacucucgguucugggagcucgucgacaaagagaggaaccugcaccuugaaggcaagugcgagaccugcguguacaacaugauggggaagcgcgaaaagaagcugggcgaguucgggaaggccaagggaagucgcgcaaucugguacauguggcugggagcgcgguuucuggaguucgaggcccucggguucuugaacgaggaccauugguucucccgcgagaacagcuuaagcggcguugagggggagggccuccacaaacuuggguacauucuucgagacgugagcaagaaggagggaggugccauguacgcugaugacaccgcggggugggauacacguaucacccucgaggaucugaagaacgaggagauggugaccaaccacauggagggcgagcacaagaaacuggccgaagccauuuucaagcucaccuaccagaauaaggucgugcggguacagcgcccuacaccccgggggacagucauggacaucaucagccgccgggaccaacgcggaucuggccagguugggaccuacggccuaaauacauuuacaaacauggaagcccagcugauccggcaaauggagggggaggggguguucaaaaacauccagcaccucacggucaccgaggagguggcuguacagaacuggcuggcgcgcgucgggcgcgagcggcugagccgcauggccaucuccggcgacgacugcgugguaaagccgcucgacgaccgguucgccaacgcccugacggcccugaacgacauggguaagauccgcaaggacauccagcaaugggagcccagcaaaggguggaacgacuggacccagguccccuucugcagccaccacuuccacgagcucaucaugaaggacggccgggugcugguggucccgugcaggaaccaggaugagcugaucgggcgggcgcgcaucagccagggcgccggguggucccuccgggaaaccgccugccugggaaagagcuacgcccagauguggucccugauguacuuccaucgcagggaccucagacuggccgccaacgccaucugcagugccgugccuucccauuggguucccaccucacggacaacgugguccauccaugccaagcacgaguggaugacgaccgaggacauguuaaccgucuggaaccgaguguggauucgggagaaccccuggauggaggauaagacgcccgucgagagcugggaagagauccccuaccucgguaaacgcgaggaccaguggugcgggucccuaaucgggcugacaagccgugccacuugggcgaagaacauccaggccgccaucaaccagguucggucccucaucgggaacgaggaguacaccgacuacaugccgucgaugaagagguuucgccgcgaggaggaggaggccggcgugcugugguga

SEQ ID NO: 25323 - RNA, 9876 nt, Artificial Sequence
  derived and/or modified CDS sequence (opt11) from DENV-2__FJ390385__SS-prME
agcgccgggaugauaaucaugcugauccccaccgugauggccuuccaccucaccacccggaauggggaaccccacaugauuguggggauccaagagaaggggaagaguuugcuguucaagaccgaggauggcguuaacaugugcacccucauggcgauggaccugggggaguuaugcgaagacacuaucaccuacaagugcccccuguuacggcagaacgagcccgaggacaucgacuguuggugcaauagcaccucuaccugggugaccuacgggaccuguaccaccacuggcgagcaccggcgcgagaagcggagcgucgcacuggugccucacgugggcaugggccucgagacccggaccgagaccuggaugagcagcgaaggggccuggaaacacgcccagcgcaucgagaccuggauccugcggcauccgggguucacaauuauggcagcgauccuagccuacacgaucgggacuacccacuuucagagaguccugaucuucauacuauuaaccgcgguggccccguccaugacuaugcggugcaucggcaucagcaacagggacuuugucgagggcgucucuggcggcagcuggguggacaucgugcucgagcaugggaguugugucaccaccauggcgaagaacaaacccacacuggacuucgagcugaucaagaccgaggcaaaacagcccgccacccucagaaaguacugcauugaggccaagcugaccaauacgaccaccgagucacgcugcccaacccagggggagccaucucugaaggaggaacaggacaagcgauucgucugcaagcacagcaugguagauaggggcugggggaacgguugcggucuguuuggcaaaggcggcauugucaccugcgcaauguucacguguaagaagaacauggagggcaagaucgugcaacccgaaaaucuggaguacacgaucguggucacgccccacagcggggaggagcaugcggucggcaacgacacggguaagcacgggaaggagaucaaggugaccccgcagagcuccauuaccgaggccgagcugaccggguacggaacagucacgauggagugcagcccccggacuggucuagacuucaaugagaugguguugcugcagauggagaacaaggccuggcuagugcaccgccagugguuccuggaccugccgcuucccuggcugccaggggcagacaagcaggagaguaacuggauacaaaaagagacacuugugaccuucaagaacccccacgccaagaagcaggacguagucguucuaggcagccaggagggggccaugcauacggcccucaccggcgcaaccgagauccagaugagcuccggaaaccugcuguucacuggacaccugaagugucggcuccgcauggauaagcuccagcugaagggcaugagcuacaguaugugcaccggaaaguucaaaguagucaaggagauugcagagacccagcacggcacaaucgugaucagagugcaguacgagggagacggcagccccugcaagaucccauucgagaucauggaucuggagaagcgauacguacucggccgguuaaucaccgugaauccuaucgcuacggagaaagacuccccugugaacaucgaggcugagccgcccuucggggacagcuacaucaucaucggcgucgagccaggucaacugaaacucaauugguucaaaaagggcuccucaaucgggcagauguucgagaccacuaugcgcggugccaagcguauggccauccucggcgauaccgccugggacuucgggagucugggcgggguauuuacgagcauaggaaaggcccuccaccagguguucggugcgaucuacggagccgccuucuccgguguaagcuggaccaugaaaaucuugauuggggugaucaucaccuggauugggaugaacuccagaucaacgucccugagcgugucccuggugcuuguggguaucgugacgcuguaccugggcguuauggugcaggccgacagcgggugcguuguguccuggaagaacaaggagcucaaaugcggcucugguauuuucaucacggacaacgugcacacuuggacugagcaauacaaguuccagcccgagucccccucgaagcucgcuagugccauccagaaggcgcaggaagaggggauuugcgguauucgcuccguaacgcgccuggagaacuuaauguggaagcagaucacacccgaacugaaccauauccuggccgagaacgaggucaagcucacgaucaugaccggcgacaucaagggcaucaugcaggcggggaagagaagccugaggccucagccaaccgaguuaaaguacucguggaagaccuggggcaaggcgaagaugcuuucuaccgaguccuauaaccagaccuuccugauugacggccccgagacggccgaaugccccaacaccaaccgcgccuggaacagccuggagguggaggacuauggguucggcguguuuaccaccaacaucuggcucaagcugaaggagaagcaggaugccuucugcgacagcaagcugaugagcgccgcgaucaaggacaaccgggcgguccacgccgacaugggguacuggaucgaguccgcccucaacgacacguggaagaucgagaaggccucuuucauugaggugaaaaacugucacuggcccaagucccacacccuguggagcaauggcgugcuugagagcgagaugaucauccccaaaaaccucgcgggccccgucagccagcauaacuaucgcccgggguaccacacccagaucgccggacccuggcaccucgggaagcuugagauggacuucgacuucugugauggaaccaccgugaucgugacagaggacugcgggaaucggggccccucccuccgcaccaccaccgccagcggcaaacugaucacggaauggugcugccggagcugcacccugcccccgcugcgguaccgcggggaggacggcugcugguaugggauggagaucaggccccugaaggaaaaggaggagaaccuaguaaacucccucgugaccgccggucauggccaagucgacaacuucagccugggcguccuugguauggcccucuuccuugaggagaugcuucggacccguguggggaccaaacacgccauccuccugguggcagugagcuucgugacccugauaaccggcaacaugagcuuuaaggauuuggggcggguuguugucauggugggagccaccauggccgaugacaucgguaugggcgucacguaccuggcgcuguuagccgccuucaaggucaggccgaccuucgccgccggccugcugcucaggaaguuaaccuccaaggagcucaugaugaccacgaucggcaucguauugcugucccagucgaccauuccugagaccgucuuggagcucaccgacgcgcuugcccugggcaugaugguccuuaagaucguucgcaacauggagaaauaccaacuggcgguaaccauaauggccauccugugcgugccgaacgcggucauccuucagaacgcauggaaggucggaugcaccauccuggcagugguuagcgugucgccccugcuccucaccagcagccaacagaagacagacuggauccccuuggcccucacuaucaagggcuuaaaccccaccgcaaucuuccugaccacccugagccgcacgaacaaaaagcgguccuggccgcugaacgaggcgaucauggccguggggauggugagcauccuugccucaagcuugcugaagaacgacauccccaugaccgggccacugguugccggcgggcuccugaccgugugcuacguccuaaccgggcgcuccgccgaucucgagcuggagcgggcgacagacgucaagugggaggaccaggccgaaaucagcggguccucuccuauacuguccauuaccaucuccgaagacggcagcauguccaucaagaacgaggaggaagagcagacccucaccauccugauccgcacgggccugcuagugaucagcgggcuguucccgaucuccaucccgaucaccgccgccgcaugguaccugugggaagucaagaagcagcgagcgggcgugcucugggacguacccucgcccccgccuauggggaaggccgaacuagaagacggcgcuuacagaaucaagcagaagggaauccuaggcuacucucagaucggcgccggggucuauaaggagggcaccuuccacaccauguggcacgugacucgcggggcggugcucaugcacaagggcaaacgaaucgaacccagcugggcggacguuaagaaggaccucauauccuaugggggcggcuggaaacuggagggggaguggaaggagggcgaagagguucaggugcucgcccuggagcccgggaagaauccacgggccguccagaccaagcccggucuguucaagacaaacaccgggaccaucggggccgugagcuuggauuucucaccaggcacgucuggguccccuaucaucgauaagaagggcaagguggucggucuguauggcaacgggguugugacacgcagcggugcauacguauccgccaucgcccagaccgaaaagucuaucgaggauaaccccgagaucgaggacgacaucuuccggaagagacggcuaacuaucauggaucugcaccccggcgccggcaagacgaagcgcuacuuaccagccaucgugcgggaagcgaucaagcgcgggcugcggacccugauccucgccccgacccgcgugguugccgccgagauggaggaggcccugcgagggcugcccaucagauaccagacgcccgcgauaagguccgagcacacgggccgcgaaaucguggaccucaugugccacgccaccuucaccaugcgccuacugagccccgugcgggucccgaacuacaacuuaaucaucauggacgaggcacacuucacggaccccgcguccaucgccgcucguggcuacaucucgacgcggguggagaugggggaggccgccggcaucuucaugaccgccacgccgccagggucccgcgaccccuucccccaguccaacgccccgaucaucgaugaagagcgggagauccccgaacgcagcuggaacuccggccacgagugggugaccgacuucaaggggaagacggucugguucgugccuagcaucaaggcgggcaacgacaucgccgccugccugcggaagaacggaaagaaggugauccagcucucccgcaagaccuucgacagcgaguacgucaagacccggaccaacgacugggacuucguggugacgaccgauaucucugagaugggggccaacuucaaggcggagcgcgucaucgacccccggcggugcaugaagcccgugauccucacugauggcgaggagcgggugauccucgccgggcccaugccggucacucacagcuccgccgcccagaggcggggccguaucgggcggaacccgaagaacgagaaugaccaguacauauauaugggcgagccacuggagaacgacgaggacugcgcucacuggaaggaggcgaagaugcuccucgacaacauuaacacgcccgagggcaucaucccaucuauguucgagcccgagcgcgagaagguggacgccaucgacggggaauaccggcugcgcggcgaggcucgcaagaccuucguggacuuaaugcgucgcggggaccugcccguauggcuggccuacaagguggccgcggaggguaucaacuacgccgacagacgcuggugcuucgacgggaucaagaacaaccagauccucgaggagaacguggaagucgaaaucuggaccaaggagggcgaaagaaagaagcugaagccgcguugguuagacgcccggaucuacucagauccccucgcccugaaggaguucaaggaguucgccgcaggacgcaaaucccucacacuuaaccucaucacggagauggggaggcugccuaccuucaugacccagaagacccgcgacgcccucgauaaccuggccgugcugcacacggcagaggcuggggggcgcgcauacaaccacgccuugagcgaacuuccugagacccuggagacccuucuguuauugacccugcuggccacugucacgggcggcaucuuccucuucuuaaugagcgggcgcggcaucgggaagaugacgcuaggcaugugcugcaucaucaccgcguccauccuguugugguacgcgcaaauccaaccgcauuggaucgcagccuccauaauacuggaguucuuccuaauagugcugcugauccccgagccggagaagcagcggacgccgcaggacaaucaacucacauacguuguuaucgcuauccugacggugguggcggcaaccauggcaaacgagaugggguuuuuggagaagacgaaaaaggaccucggccugggcucaaucgccacgcaacaaccggagagcaacauccuggacaucgaccuccgccccgcauccgccuggacccuguaugcggucgccaccaccuucguuacgcccaugcugcggcacagcaucgagaacagcuccgugaacgucucgcucaccgccaucgccaaucaggccaccgugcugaugggguugggcaagggguggccccucuccaaaauggauaucggcgugccgcuguuagcgauugggugcuauagccagguuaaccccaucacccuuacggccgcccugcugcuucugguggcccacuacgcgaucaucggccccggccuccaggcuaaagccacccgagaggcccagaagcgggcggcggccgggaucaugaagaaccccaccguggacggcauaaccgucaucgaccucgauccgauacccuacgaccccaaauuugagaagcaacugggacagguuaugcugcuaauccucugcgugacgcaaguccuaaugaugcgcacaaccugggcucugugugaggcgcucacccuugccacuggccccaucaguaccuugugggagggcaacccuggccguuucuggaauaccaccaucgcgguaagcauggccaacauuuuucgcggguccuaccuggcaggggcuggccuccucuucucgauuaugaagaacacgaccaacaccagacgcgggaccggcaacaugggcgagacguuaggggagaaauggaagucccgccugaacgccuugggcaaaagcgaguuccagaucuacaagcggucugggauccaggaaguggaccgcacccuggcgaaggaggggaucaaacgcggcgaaacggaccaccacgccgucagcagaggcagcgcgaagcugcgcugguucguggagcgcaacaugguaaccccugagggcaaagucguggaccucgggugcggccgcggcggauggagcuauuacugcggcggccuaaagaaugugcgcgaagucaagggccuuacgaagggugggcccgggcaugaagagcccauccccauguccaccuauggcuggaacuuggugcgguugcagagcggggucgacgucuucuucaucccgccugagaagugcgacacccugcucugugacaucggugaguccagucccaacccgacgguggaagcuggccgcacgcugcgugugcugaaccucgucgagaacuggcuuaacaacaacacccaguucuguaucaaggugcugaaccccuauaugcccuccgugaucgagaaaauggaggcguuacagcgcaaauacgggggggcgcucguccggaacccgcugagcaggaacagcacccacgagauguacugggucuccaaugcuagcgggaacaucguuuccagcgucaacaugauaucccggauguugaucaaccgcuucaccaugcggcauaagaaggccaccuacgagcccgauguggaccucggguccgggacgcgcaacauuggcaccgaguccgagaucccgaaccuggacauuaucgggaagcggauagagaaaaucaaacaggaacaugagaccagcuggcacuaugaccaggaccauccguacaagaccugggcguaccacggguccuacgagacgaagcagaccggcagcgcgagcagcauggugaacggggucgugcgccugcucaccaagccgugggacguucugccuaccgucacgcagauggcaaugaccgauaccaccccuuucggacagcagcgcguauucaaagagaaaguggacacgcggacacaggaaccgaaggaggggacaaagaagcugaugaaaaucaccgcggaguggcuguggaaggaguuagggaaaaagaagaccccgcguaugugcacccgggaggaguucacccgcaagguccgguccaacgccgcccucggcgcgauuuucaccgacgagaacaaguggaaauccgcccgcgaagccguggaagauucccgguuuugggagcucguggauaaggagcgaaaccugcaccuggaggggaagugugagaccugcguauacaacaugauggguaaaagggagaaaaagcucggugaguucggcaaagcgaagggcagccgcgccaucugguacauguggcuaggggcgagguuccuggaguuugaggcccucggcuuucugaacgaggaccacugguucucccgagaaaauucccuguccgggguggaaggcgagggguugcacaagcugggcuauauccugcgggacguuagcaaaaaagagggaggcgcuauguacgcggaugacaccgccggcugggacacgcgcaucacccucgaggacuugaagaacgaggagauggugacgaaucacaugaagggggaacacaagaagcucgccgaagcgaucuuuaaacucaccuaccagaacaaggugguacgcgugcagcgccccacgccccguggcaccguaauggacaucaucagccggcgagaccagcgcggguccggccaggucggcaccuacgggcugaacacauucacaaauauggaggcccaacugauccggcagauggagggcgagggaguguucaagaauauucagcaccuaaccgugacggaagaggucgccguccagaauuggcuggcgagaguggggcgcgaacggcuaagccgcauggccaucuccggcgacgacugcgucgugaagcccuuggacgaccgguucgccaaugcccugacggcccugaacgacauggggaaaauccggaaggauauccagcagugggagccgagcaagggcuggaaugacuggacccagguucccuucuguucccaccacuuccacgagcucaucaugaaggacgggcggguauuaguagugccuugccgcaaccaagaugagcuuaucggccgggcuaggaucucucaaggggccggguggucccucagggaaaccgccugccuuggcaagagcuacgcccaaauguggucccugauguacuuccaucgccgggaucuccgccuggccgcaaacgccauaugcagcgcggucccgagccacugggugccgacuagucggaccaccugguccauccacgccaagcacgaguggaugaccacggaagacaugcuuacggucuggaaccgcguauggauaagagagaacccguggauggaagauaagacgccuguggagucaugggaggaaauccccuaccucgggaagcgcgaggaccaguggugugguucgcuaaucgggcugacaagcagggcgaccugggcgaagaacauacaggcggccaucaaucagguucgcaguuuaaucggaaaugaggaauauacggacuacaugccauccaugaagcgguucaggcgcgaggaagaagaggcugggguccugugguga

SEQ ID NO: 25324 - RNA, 9876 nt, Artificial Sequence
  derived and/or modified CDS sequence (opt11) from DENV-2__FJ024458__SS-prME
agcgcugguaugauuauuauguuaauccccaccguuauggccuuccaccucacaacccgaaauggggagccgcacaugaucgucgguauccaggagaagggaaagucccugcuguucaagaccgaggacggcgugaauaugugcacgcucauggcgauggaucugggcgagcugugcgaggacacuaucaccuauaagugcccccuccugcgucagaaugagcccgaggauauagauugcuggugcaacagcaccuccaccugggugacuuaugggaccugcaccaccacuggggagcaucgccgggagaagcggagcgucgcccuuguaccccacguggggaugggcuuagagacgcggaccgagaccuggauguccagcgaaggggccuggaaacaugcccagcgcaucgaaacguggauuuuacggcacccaggcuucacgauaauggccgcuauccuggccuacaccauugguaccacccacuuccagcgcguccucauauucauccuacugacggccguagccccuuccaugaccaugcgaugcaucgguaucucaaaccgagacuucguagagggcguuucaggagggucguggguggacaucgugcucgagcacgguaguugcgugaccacaauggcgaagaacaagcccacgcuggauuucgagcuaaucaagaccgaggcaaagcagcccgcgacccuccggaaguacugcaucgaggccaagcugacuaacacgaccaccgagucgcgcugccccacccagggcgaaccguccuuaaaggaagagcaggacaagcgguucguaugcaagcauucaaugguggaccgcggcugggggaauggcugcggccuguucggcaagggugggaucguuacgugcgcgauguucacguguaaaaaaaacauggagggcaagauagugcagcccgagaauuuagaguacaccaucgugguaacgccccauuccggggaggagcacgcaguagggaacgacacagggaaacacggcaaggagaucaaggugaccccgcagagcagcaucaccgaagcagaguuaaccggguacggcacugucacuauggaaugcagcccccggaccggccucgacuucaaugaaauggugcugcugcagauggagaacaaagccuggcuagugcaccgccagugguuucuggacuugccccuacccuggcugccgggggccgauaagcaggaguccaacuggauccagaaggagacccuggugacguucaagaacccccacgccaagaagcaagacguggucguacucgggagccaggagggggcgaugcacacagcccugacgggcgccacggagauccaaaugagcuccgggaaccuccucuuuacaggccaccucaagugccggcugcgcauggacaaguuacagcuuaagggcaugagcuacuccauguguaccgggaaguucaaggucguaaaagagaucgccgagacccagcauggcaccaucguuauccgggugcaguacgagggggacggcucccccugcaagauccccuuugagaucauggaccuggagaagcgcuacguccucgggcggcuaauuaccgugaacccgaucgucacugagaaggauaguccagucaacauugaggccgagccgcccuucggggacuccuacaucaucaucggcguggagccggggcagcugaagcuuaauugguucaagaagggcuccagcaucgggcagauguuugagaccaccaugcggggcgcgaagcgcauggccauacugggcgacaccgccugggauuucgggagccugggcgggguguucacgagcaucggcaaggcccuccaccaggucuucggggccaucuacggagcggccuuuuccggcgugagcuggacaaugaagauccugaucggggugaucauuaccuggaucggcaugaauagccggagcaccucccuuagcgugucccuggugcuaguggggaucgucacgcuuuaccugggcgucauggugcaggcagacagcgguugcgucguguccuggaagaacaaggaguuaaagugcggcucuggcaucuucaucaccgauaacgugcacaccuggacagagcaauacaaguuccagcccgagagccccuccaagcuggccagcgcuauccaaaaggcccaggaagaggguaucugcggcauccgcuccgucacucggcuagagaaccucauguggaagcagaucacacccgaguuaaaccacauacuggcggagaacgaggugaagcucacuaucaugacuggggacauuaaaggcaucaugcaggccggacgccggagccugcgcccgcagcccaccgagcugaaguauuccuggaagaccuggggaaaagccaagaugcucagcacugaguccuacaaccagaccuucuuaaucgacggccccgagacggcggaauguccgaacaccaaccgagccuggaacagccuggagguagaggauuacggguuuggcgucuuuacuaccaacauauggcucaagcugaaggagaagcaggaugccuucugcgacucuaaguugaugagcgccgccaucaaggacaaucgcgcgguccaugccgacauggacuacuggaucgaauccgcccugaacgacacguggaagaucgagaaagccuccuucaucgagguaaagaacugccacugggcuaagucccacacucuguggagcaacgguguccucgaguccgagaugauaauccccaagaacuuagccggccccgugucucaacacaacuaccgacugggcuaccauacccagaucgccgggccguggcaccugggcaagcuugagauggacuucgacuucugcgacgggaccaccguaaucgugacggaggauugcggcaaccgcggaccgucccugcggaccacuacugccagcggcaagcugaucacggaguggugcugccgcucuugcacccugccgcccuugcgguaucgcggcgaggacgggugcugguacggcauggagauccgccccuuaaaggagaaggaagagaaccuagucaacucccucgucaccgcagggcacggccagguagacaacuucagccugggggugcuaggcauggcgcuguuccuggaggaaauguuacguaccagagucggaacaaagcacgccauucugcugguagcaguguccuucguaacccucaucaccgggaacaugagcuucaaggaccuaggccgcguaguggugaugguuggggccaccauggccgacgauaucgguaugggggugacguaccucgcucuuuuggccgccuucaaggugcggccgaccuucgccgccggccugcuccuacguaagcugacgucaaaggagcuuaugaugaccacgauagggauaguccugcugagccagaguacgauccccgagaccgugcucgaguuaacugacgcucuggcccucgggaugaugguguugaagaucguccgcaauauggaaaaauaccagcuggccgugacgaucauggccauucucugcguaccaaacgccgugauccuucagaacgcguggaaaguuaguugcacuauccuggcugugguaucggugagcccccuccugcugaccuccagccagcagaagacggacuggaucccgcucgcacugacgaucaaaggccucaaccccaccgccaucuuccuuaccacccuguccaggacgaacaagaagcguagcuggccauuaaacgaggccauuauggccgucgggaugguguccauccuugccucuucccugcugaagaacgacauccccaugaccggcccgcucgucgccggcgggcuucugaccguaugcuacgugcuaaccggccguagcgccgaccuggagcuggaacgcgcgacggaugugaagugggaagaccaagcggagaucucgggcuccaguccuauccuaucaauuacuaucucagaagacggcaguaugagcaucaagaacgaagaggaagagcagacccugacaauccugauccggacggggcuccuggucauauccggccuguuccccauaucaauccccaucaccgccgccgccugguaccucugggaagugaaaaaacaacgcgcgggcgugcugugggacguaccgagcccgccgccuauggggaaggccgaacuggaggauggcgccuaccgaauuaagcagaaggggauccuuggcuacagccaaaucggggccggcgucuacaaggaaggcaccuuccacaccauguggcacgugacccgcggggcuguucuuaugcacaaaggcaagcggaucgaaccguccugggcggacguuaagaaggaccuaaucagcuacgggggcgguuggaaacucgagggcgaguggaaggagggcgaagaagugcagguucuggcccucgagccugggaagaacccccgcgccguccaaacgaaaccgggccucuucaagaccaacaccgggacaaucggcgccgugucccuggacuuuagcccugggacguccgguagccccaucauagacaagaagggcaaaguaguggggcuguacggcaaugguguggucacccgguccggcgccuaugugagcgcgaucgcccagaccgagaaguccaucgaggacaaccccgagaucgaggacgacaucuuucgcaagcggcgcuuaacaaucauggacuuacauccgggcgcggguaaaacuaaacgguaucuaccagccaucgugcgggaggcgaucaagcguggucugcguacccuuauccuggcccccacccgcgugguggcugccgagauggaggaggcacugaggggacugcccauccgguaccagaccccagcuauccgcgccgagcacacuggccgcgagaucguggaccugaugugccacgccaccuucaccaugcggcuacugagccccguccgcguaccaaacuacaaccugaucaucauggaugaggcgcacuucaccgacccggccuccaucgcggcgcgcggauauaucagcacgcgagucgagaugggcgaggccgccgguaucuucaugaccgccaccccccccggcagucgggaccccuucccacagucgaacgcuccgauaaucgaugaggagcgcgagaucccugagcggagcuggaauuccggccaugaaugggucacugauuucaaggggaagacagugugguuugugcccagcaucaaggccggcaaugacauugcggccugccugcgcaagaacgggaagaaggucauccagcuauccagaaaaaccuucgacagcgaguaugugaagacccgaacuaacgacugggacuucguuguaaccacugacaucuccgagaugggggccaacuucaaggccgaacgggugaucgacccccgacggugcaugaagccagugauccugaccgacggcgaggagcgcgucauccucgccgggcccaugcccguuacccacagcuccgcggcccagaggcguggcagaaucgggcgcaacccaaagaacgagaacgaccaguacaucuacaugggcgaaccccucgagaacgaugaggauugugcacauuggaaggaggccaagaugcugcuagacaauauuaacacucccgaagguaucauccccagcauguucgagccagagagggagaagguggacgccauugacggcgaauaccgccuccgcggagaggccagaaagacguuugucgauuugaugcgccgcggggaccugccgguguggcucgccuacaagguagcugccgagggcaucaauuacgccgaucgccgauggugcuuugacggcaucaagaacaaccaaauucuggaggaaaauguugagguggagaucuggacgaaggagggcgagcgcaagaagcugaagccccggugguuagacgcccgcaucuacagugacccauuggcccugaaagaguuuaaggaguucgcggccgggcgcaagagccucacccugaauuuaaucacggagaugggucggcuuccgacguucaugacccaaaagacccgggacgcgcucgacaaccuugccguccuccauacggcggaggccggcggccgcgccuauaaucacgcccuguccgaguuaccagaaacgcucgagacccugcugcuccugaccuuauuagccacggugaccggcggcaucuuccuguuccugaugagcggccgggguauagggaagaugaccuuaggaauguguugcaucaucaccgcguccauccugcugugguacgcccagauccagccucacuggauagccgccagcaucaucuuagaguucuuucuaaucguccugcucauccccgagccggagaagcagcgcacaccccaagacaaccagcugacguacgucgugaucgcuaucuugacugugguggcggccaccauggcuaacgagaugggcuuccuugagaagaccaagaaggacuucggccuggggucaaucgcuacacagcagccagagucgaacauccuggauaucgaucuccggccagccuccgcuuggacccuguacgcuguugcuacuacauucguuacgccgaugcugcgccacagcaucgagaacagcuccgucaacgugagccucaccgccaucgccaaucaggcgaccgugcugaugggccucggcaagggguggccccucuccaagauggacaucgggguaccccugcuggccauugggugcuauagccaggugaaccccaucacccucaccgccgcgcuccugcuacugguggcgcacuaugcgauaauuggcccgggucugcaggccaaggccacgcgagaagcccagaaacgcgcggccgccggcaucaugaaaaacccaaccgucgacggcauuacggugaucgaccucgacccaaucccuuacgacccgaaauucgagaaacagcugggccaggugauguuacucauccugugcgucacucaagugcugaugaugcggacgacuugggcacucugcgaggcccugacacuggccacgggacccaucuccacccucugggagggaaauccuggccgcuucuggaacaccaccaucgccgugagcauggccaacaucuuccggggcucauacuuagcgggcgccggguuacucuucagcaucaugaagaacacaacaaacaccaggcgugggaccggcaacauuggggagacgcugggugagaaauggaaguccagacugaacgcgcucggcaagagcgaguuccaaauauacaagaaauccgggauccaggagguggaccgcacccuggccaaggagggcaucaagagaggggagaccgaccaucacgccgucagccgcggcagcgccaagcuccggugguucguggagcgcaacauggucacccccgaggggaaggugguggaccuuggcugcggccgcgggggguggagcuacuacugcggcggccugaagaauguccgcgaggugaaggggcugaccaaaggcggcccgggacacgaggagccgauccccauguccaccuacggguggaaucuugugcggcugcagagcggagucgacguguucuucauaccaccugagaagugcgacacuuugcucugcgacaucggcgaguccucgcccaaccccaccgucgaggcgggucgcacgcuacggguccugaauuugguggagaacuggcugaauaacaacacccaguucugcaucaaggugcugaaccccuacaugcccuccgucaucgagaagauggaggcccugcaacgcaaguacggaggcgcccucguccggaacccgcuaucccgcaacagcacccacgagauguacugggugucaaacgccagcgggaacaucgucuccuccgugaacaugaucucccggaugcugaucaaccgcuucacuaugcggcacaagaaggcgaccuacgagccggacguggaccucggcagugggacgaggaacauuggcaucgaguccgaaauucccaaucuggauaucaucgggaagcggauagagaagaucaagcaggaacacgagaccagcuggcauuacgaccaggaccaccccuacaagaccugggcguaccacgguuccuacgagacuaagcagacgggcagcgcgaguuccauggucaacggagucgugagacugcucacgaagcccugggacguccugccaaccgugacccagauggccaugacggacaccaccccguucggacagcagcgcgucuucaaggagaaagucgacacccgcacgcaggagcccaaagaagggaccaaaaaacugaugaagauuacugccgaguggcucuggaaggagcugggcaagaagaagacaccccgaaugugcacgagggaggaguucacccgcaaagugcgguccaaugccgcccugggggccauuuucaccgacgagaacaaguggaaguccgcccgcgaagcaguggaagacucgcgguucugggagcucguagauaaagaacgcaaccuacaccuggaggggaagugcgagaccugcguguacaacaugaugggcaaacgggagaagaaacuuggugaguuuggcaaggccaaagguucccgcgcgaucugguacauguggcuuggcgcccgauuucuggaguucgaggcacucggcuuccuaaaugaagaccacugguuuucgcgcgagaauucgcuguccgggguugaaggcgaggggcuccacaagcuuggcuacauacugcgggacguaucaaagaaggaaggaggggcaauguacgcggacgacacggcggguugggacacccgcaucacccuagaggaccucaagaacgaggagauggugaccaaccacauggaaggggagcacaaaaagcuggcggaggccauauuuaagcuuacguaucagaacaaggucgugcgggugcagaggcccaccccgagaggcaccgucauggacaucaucagccgccgggaccagcguggguccggccaagucgggaccuaugguuuaaacacguucaccaacauggaggcccagcugauccgacagauggagggcgaggggguguuuaagaacauccagcaucucaccgucacagaggagguagcagugcaaaacuggcuggcccgcgucggccgcgagcgucugagccgcauggccauaagcggggacgacugcguggugaagccccucgaugaccgguucgccaacgcgcugacggcacugaacgauaugggcaagauucgcaaggacauccagcaaugggaaccgagcaagggcuggaacgacuggacgcaaguuccauucugcucccaccacuuccacgaacucaucaugaaggacggccggguccugguggucccuugcaggaaccaggacgagcugauaggccgggcgcgcauuagccagggggcaggcugguccuuacgggagaccgcgugcuuagguaaguccuacgcccagauguggucccugauguacuuccaccggcgggaccuccgucuugcggccaaugccaucugcagcgccgugccuucacauugggugcccacaagccggacgaccuggucaauccaugccaaacacgaauggaugaccacagaggacauguuaaccgucuggaaucggguguggauccgggagaauccuuggauggaggacaagacuccgguggagucgugggaggaaauccccuaccuaggcaaacgcgaggaccaguggugcgggucccugauagggcugaccucgcgggcgaccugggccaaaaauauccaggccgccaucaaccaggucagguccuuaaucggcaaugaggaauacaccgacuacaugcccagcaugaagcgguuccgccgcgaggaggaggaggcggggguguuaugguaa

SEQ ID NO: 25325 - RNA, 9876 nt, Artificial Sequence
  derived and/or modified CDS sequence (opt11) from DENV-2__FJ205880__SS-prME
ucagcgggcaugaucaucaugcugauacccacggugauggccuuucaccucaccacucgaaacggggagccccacaugaucgucggcauacaagagaaaggcaaaagucugcuguucaagacugaggacggcgugaacauguguacgcucauggcgauggacuuaggggaacugugugaggacaccaucaccuacaagugcccccuccugcggcagaacgagcccgaggauaucgacugcuggugcaacagcacgagcaccugggugaccuaugguaccugcaccaccacaggcgaacaccgaagggagaagcgcagcgucgcccuggucccccauguggguaugggccucgagacgcggaccgagaccuggaugagcagcgagggggccuggaagcacgcgcagcgcaucgagacauggauccugagacacccgggcuuuacgaucauggccgcgauccuggccuacacaaucgggacgacccacuuccagcgcguccucaucuucauccugcugacggccguggcgcccagcaugaccaugcguuguaucggcaucagcaaccgcgacuucguggaagggguguccgggggcucuuggguggacaucgugcucgagcacgggucaugcgucacgaccauggcgaagaacaaaccaacgcuggacuucgaauuaaucaagaccgaggccaagcagcccgccacccuccggaaguacugcaucgaggccaaacucacuaacacuaccaccgagucccgcugccccacccaaggcgagcccucccugaaggaggagcaagacaagagauuugugugcaaacauagcaugguggaucgcggcugggguaacggcugcggccuguucggcaagggcgggauagucacgugugccauguuuacgugcaagaagaacauggagggaaaaauagugcagcccgagaaucuggaguacaccaucguggucacgccccacuccggggaggaacacgccgucggcaacgacacggggaagcacggccaggagaucaaggugaccccucagagcucgauuaccgaggccgagcuuaccggguacgguaccgucacgauggagugcucgccccggaccggccucgauuucaacgagauggugcuguugcagauggagaacaaggcuuggcucguucacaggcagugguuccuagacuuacccuuacccuggcugccgggggccgauaaacaggagucaaacuggauccagaaggagacccugguaaccuucaagaacccccaugccaagaagcaggauguggucgugcucgggucccaggagggagcgaugcacacggcguugaccggcgccaccgagauccagaugucguccgggaaccuucuuuuuaccggccaccugaagugccggcugcgcauggacaaauugcagcugaagggcaugagcuacucaaugugcacggggaaguucaaaguggucaaggaaaucgccgagacccagcauggcaccaucgugauccgaguccaauacgagggggacggcagcccaugcaagauacccuuugaaaucauggaccucgagaagcgcuacguccucggccggcuuaucaccgugaacccgaucgugacggagaaggacucccccgucaacaucgaggccgagccgccuuucggggacagcuacaucaucaucggcguggagccggggcagcugaagcucaacugguucaagaagggauccagcauagggcagauguuugagaccacgaugcgaggagcgaagcgcauggccaucuuaggcgacaccgccugggacuucgggucacugggcgggguguucacgagcaucggcaaggcccuccaccaagucuucggggccaucuacggagcggccuucaguggugugagcuggaccaugaagaucuugaucggggugaucaucaccuggaucggcaugaacucccggagcaccucucugagcgucucccugguccuagucgggauuguaacacuguaucugggugugauggugcaggccgauucagggugcgucguguccuggaagaacaaagagcucaagugcggcagcggcaucuucaucacggacaacgugcauaccuggaccgagcaguauaaguuccagcccgagagccccucuaagcucgccucggcuauccagaaggcccaggaggaggggaucugcggcauaagauccgucacgcgguuggagaacuuaauguggaagcagaucacuccugaguugaaccacauccuggccgagaaugaggugaagcucaccaucaugaccggggacaucaaagguaucaugcaggccggaaagaggagccugcggccucagcccacggaacugaaguacuccuggaagaccugggggaaggcgaagaugcucagcaccgagucguacaaucaaaccuuccugaucgacggacccgaaacggcggagugcccgaacacgaaccgcgccuggaacagccuggagguggaggacuacggguucggggucuucaccaccaacaucuggcucaagcugaaggagaagcaggacgccuccugcgauagcaaacugauguccgccgccaucaaggacaaccgggcggugcacgcagacaugggguauuggaucgagagcgcgcucaacgacacguggaagauagagaaggccuccuucaucgaggugaagaacugucacuggcccaaaagccauacacuuugguccaacggcguccucgagucggagaugaucauccccaagaacuuggccggcccagugagucagcacaacuaccgcccgggguaccacacacagaucgccggccccuggcaucuugggaagcuggagauggacuucgacuucugugacgggaccaccgugaucguaacggaggacugcgguaaucggggccccagcuugcgcaccacuaccgccagcggcaagcugaucaccgaguggugcugucggucguguacccugccaccgcuccgcuaccgcggggaggauggaugcugguacggcauggagauccgcccccugaaggagaaggaggagaaccugguuaauagccucguuaccgccggucacgggcaggucgacaauuuuucuuuaggcgugcugggcauggcacucuuccuugaagagaugcugaagacccggguggggacgaagcacgcgauccucuuaguggcagugagcuucgugacccugaucaccggcaacaugucuuucaaggaccucgggcgcgucgucgugauggucggcgccacgauggcggacgauaucgggaugggagugacguacuuagcccuccuggcggcguucaaggugaggccgaccuucgccgccggccugcugcuccgcaagcuaaccagcaaggaacugaugaugaccacgaucgggaucguucuccugucccagagcaccauccccgagaccgugcuggagcucacagacgcccuggcgcuggguaugauggugcucaagaucguccggaauauggagaaguaucaacuggcuguuacgaucauggccauucugugcgucccgaacgcgguaauccuacagaacgccuggaaggugaguugcacgaucuuggcggucgugucagugagcccccugcuccugacuucgucccagcagaagacggacuggauaccccucgccuuaacaaucaagggguuaaaccccacagccaucuuccugaccacucucagccgcacaaacaagaaacgcucauggccgcuaaacgaggcgaucauggcggucggcauggugagcauccuggccuccagccuacugaagaacgacauccccaugacaggcccccuuguggccgggggccuccuaacagucugcuacgucuuaaccgggcgcuccgccgaccucgagcucgagagagccacggacgugaagugggaggaucaagcggagaucagcggaucuucccccauucugagcauaaccaucuccgaggacgggagcauguccauuaagaaugaggaggaggagcagacccucacaauccugauccggacgggccugcucgucauaagcggccuguucccgaucaguauccccaucaccgccgccgccugguaccugugggaggucaagaagcagcgggccggggugcucugggauguccccuccccaccacccaugggaaaggcugagcuggaggacggggccuaccgcauaaagcaaaagggcauucucggguacucccaaaucggcgccgguguguauaaggaagggacauuccacaccauguggcacgugaccagaggggcaguccucaugcacaaagggaagcggauagagcccagcugggccgacgugaagaaggacuugaucuccuacggagggggauggaaguuagagggcgaguggaaagagggggaggaggugcagguccucgcgcuggaaccaggcaagaacccccgcgccgugcagacgaagcccggacucuucaagacaaacacuggaaccaucggggccgugagccucgacuucuccccuggcacgagcggcagucccaucaucgacaagaaggggaagguagugggccuguacgggaacggcguggucacccggucgggggccuacguguccgccaucgcgcaaaccgagaaguccaucgaggacaaccccgagauugaggacgacaucuuccgcaagaggcgccugaccaucauggaucugcaccccggcgccgggaagacgaagcgguaccuacccgcgaucgugagggaggcgaucaagcggggguugcguacccugauccucgcgccgacccgggucgucgcugcagagauggaggaggcucuacgcggccugcccaucagguaucagacccccgcgauccgcgcggagcauacggggcgugagaucguggaccuaaugugccacgcaaccuucaccaugcgucugcugucccccgugcgagugccgaacuacaaccucauuaucauggacgaggcccacuucacagaccccgccagcauagccgcacggggcuacaucagcacgcgaguggagaugggggaggccgcggggaucuuuaugaccgccacgccgcccggcucacgggacccguuuccccaguccaacgcccccauuaucgacgaggagcgcgaaauccccgaaagguccuggaauagcggucacgaaugggucaccgacuucaagggcaaaacugugugguucgugccguccaucaaagcgggcaacgacaucgccgcaugucugcggaagaacggcaagaaggucauccagcugagccggaagacuuucgacucagaguacgugaagacucgcaccaacgauugggacuucguggucacgaccgacaucagcgagaugggugccaacuucaaggcggagcgagugaucgauccacgucgguguaugaagccggugauccucaccgacggggaggaacgggucauccuggccggacccaugccggugacccacuccuccgccgcccagcggcgagggcggauaggucgcaacccaaagaacgagaacgaccaguacaucuacaugggggagccccuugagaacgacgaggauugcgcccacuggaaagaggcgaagaugcuccucgacaacaucaacacgcccgagggcaucauuccguccauguucgagcccgagcgugaaaagguggacgcaaucgacggcgaauaccgccugcgcggggaggcacgcaagaccuucgucgaccucaugcgccggggagaucuucccguguggcuggcauacaagguggccgcggaggggauaaauuaugccgaucgccgguggugcuucgacggcaucaagaacaaccagauccucgaagagaacgucgagguggagauuuggaccaaggagggagagcgcaagaagcugaagccgcgguggcuggaugcccggauuuacagcgauccucucgcccugaaggaguuuaaggaguuugccgcaggccggaagucgcugacccugaaccuaauuacggagaugggccgccugccgacauuuaugacucagaaaacccgggaugcacucgauaacuuagccguacugcacaccgccgaggccggcgggcgcgcauacaaccaugcccucucagaacugccagagacccuagagacccuccugcugcucacccugcuggccacggucaccgggggcaucuuccucuuccugaugucuggacggggaaucggcaagaugacccuggggauguguuguaucauaaccgccagcauccuccugugguacgcacagauucagccgcacuggaucgcagccuccaucauccuggaguucuuccucaucgugcuucuaauccccgaacccgagaaacaacgcacgccccaggacaaucagcucacguacgucgugaucgcgauccugaccguggucgcggcgaccauggccaacgaaaugggcuuccuggaaaagaccaagaaagaccuugggcuggguagcaucgccacccagcagcccgaguccaacauccuggacaucgaccugcggcccgccagcgccuggaccuuguacgcgguggccaccaccuucgugacgcccaugcugcgccacagcauugagaacagcagcguuaaugugucccucaccgccaucgcaaaccaggccaccgugcugaugggccuggguaaagguuggccccucagcaagauggacaucggcgucccacugcuggcgauugguuguuauucccaggugaaccccaucacccucacggccgcacugcuacuccugguggcgcauuaugcgaucaucgggcccggccugcaggccaaggccacccgggaggcccagaagcgcgccgcggccggcaucaugaagaaccccaccgucgacgggaucaccgugaucgaccuggaccccauacccuacgaccccaaguucgagaagcagcugggucagguuaugcugcugauucugugcgugacccaagugcucaugaugcggacgacgugggcccucugcgaggcccugaccuuggccacggggcccaucucuacccucugggagggcaauccggggagguucuggaacaccaccaucgcgguguccauggccaacaucuuccggggcagcuaccucgcuggcgcagggcuccucuucuccaucaugaagaacacgaccaacacgcggcggggcaccgggaacaugggcgagacacugggggagaaguggaaaagccgccugaacgcccucgggaagucagaguuucagaucuacaaaaagagcggaauccaggaggucgaccgcacucuagcgaaggaagggaucaagcggggcgagaccgaccaccaugccgugucccgcgggucggccaagcugagaugguuuguggagcgcaacauggucaccccugagggcaaggugguggaccuuggcugcgggcggggcgggugguccuacuauugcggcggguuaaagaacguccgcgaagugaagggccugacgaagggcgggcccgggcacgaggagcccauaccgaugagcaccuauggcuggaaccuagugcggcugcagucuggcguugacguuuucuucaucccgcccgagaagugcgacacauuguuaugcgauaucggggaaucguccccgaacccgaccguggaggccggcagaacgcugcggguccugaaucucguggagaacuggcugaacaauaacacgcaguucugcaucaaggugcugaaccccuacaugcccagcguaaucgagaagauggaggcgcuacagcgcaaguacggcggggcccuagugcggaacccgcugagccgcaacuccacccacgagauguacugggugagcaacgccaguggaaauauugucucauccgugaacaugaucagccggaugcugaucaaccgcuucaccaugagacacaagaaggccaccuacgagcccgacguggaucucggaagcggaacccgcaacaucgggaucgagagcgagauccccaaccuugacauaaucgggaagcguaucgagaaaaucaagcaggaacacgagacauccuggcacuacgaccaggaccaccccuacaaaaccugggccuaccauggcagcuaugagaccaagcaaacgggguccgcgucauccauggucaaugguguaguacgccugcucaccaagcccugggacguuuuacccaccgucacccaaauggccaugacggacacuaccccauuuggacagcagcggguguucaaggaaaaggucgacacccgcacgcaggagccaaaggagggcaccaaaaagcugaugaagauuaccgccgaguggcuauggaaggaacugggcaaaaagaagaccccgcgaaugugcacacgggaggaguucacccggaagguccggaguaacgccgccuuaggggcgaucuuuaccgacgagaacaaguggaaguccgcccgugaggccgucgaggacagccgguucugggaacucgucgacaaggagagaaaccugcacuuagagggcaagugcgagaccugcguguauaacaugauggggaagcgggagaagaagcucggggaguuugggaaggcgaagggcuccagagcuaucugguacauguggcugggcgcgcgguuucuggaguuugaggcgcucggguuccugaacgaggaccacugguucagccgagaaaacucccugagcggcguggagggggagggccuacacaagcugggguauauacuacgggacguaagcaagaaggagggcggggccauguaugcugaugacacggcggggugggacacccgcaucacccucgaggaccucaagaaugaggagauggugaccaaccauauggagggugaacauaagaaacuagcugaggcuaucuuuaaguugacguaccagaacaaagucgugcgagugcagcgccccacgccccgggggaccgucauggacaucaucucccgucgggaccagcgcgguagcggccagguugggacauauggccugaacacguucaccaacauggaggcacagcugaucagacagauggagggggagggcguguucaagaauauccagcaccucacugugacggaggagguggccgugcagaauuggcuggcgagagucgggcgugagcgccugagccgcauggcaaucagcggcgacgauugcguggugaaaccccucgacgacagauucgcaaacgcccugacggcccugaacgauaugggcaagaucaggaaggacauccagcaaugggaaccguccaagggguggaacgacuggacccaaguccccuucugcagccaccacuuccaugagcucaucaugaaggacggacgggugcugguugucccaugccgcaaccaggacgaguuaaucgggcgugcgcgcaucagucagggcgccggguggagccuccgggagaccgccugccugggcaaguccuacgcccagauguggagcuugauguacuuccaccggcgggaucuccgccuggccgccaacgcaaucuguuccgccguacccucucauugggugccgacgucccguacuaccuggagcauccacgccaagcaugaguggaugaccaccgaggacauguugaccgucuggaacagaguuuggauccgggaaaaucccuggauggaggacaagacgcccguagaguccugggaggagaucccguaucucggcaagcgcgaggaccaguggugcgggagccugaucggccugaccucccgggcgaccugggcgaagaacauucaagccgccaucaaucaaguccguagccucaucgggaacgaggaguacaccgacuacaugccgagcaugaagcgguuucgccgggaggaggaggaggccggcgugcugugguga

SEQ ID NO: 25326 - RNA, 9876 nt, Artificial Sequence
  derived and/or modified CDS sequence (opt11) from DENV-2__FJ390387__SS-prME
agcgccgguaugaucaucaugcugauccccaccguuauggccuuccaccucaccacccgcaacggggagccccacaugaucgucgggauccaggagaagggcaagagccugcucuucaagaccgaggacggcguaaacaugugcacccucauggcgauggacuuaggggagcugugcgaagacaccaucacauauaaaugcccccuccuucggcagaacgagcccgaggauauagacugcuggugcaacuccaccuccaccuggguaaccuacgggacauguacgaccaccggggagcaucggcgggagaagcgcagcguagcccuggugccccacguuggaaugggauuggagacgcggaccgagaccuggauguccucagagggggcuuggaagcaugcccagcgaauugaaaccuggauacugcggcacccgggcuucacgaucauggccgcgauccuggccuacaccaucgggaccacccacuuccagcgcguccucaucuucauucuacugacggccguggcacccucaaugaccaugagauguaucggcauuagcaaccgcgacuucguggagggugucucugggggcagcuggguggacaucguccucgagcacggguccugcgucaccaccauggcgaaaaacaaacccacgcuggauuucgagcucaucaagaccgaggcgaagcagcccgccacacugcggaaauacugcauagaggcaaagcugaccaacacgaccaccgagagcaggugccccacccagggcgagcccucccugaaagaggagcaagacaagcgguucgugugcaaacacagcaugguggaccgcggcugggggaacgggugcggccuguucggcaagggcggaaucgucacgugcgcuauguucacaugcaagaagaacauggaagggaaaauagugcaaccggagaaccuggaguacaccauugugguaacaccccacuccggggaggagcacgcggugggcaaugacacggguaagcauggccaagagaucaaggugaccccgcagagcuccaucaccgaggccgagcuaaccggguacggcaccgugacaauggagugcagcccccggaccggcuuagacuuuaacgagauggugcugcugcagauggaaaacaaggccuggcucgugcaucgccagugguuccuggaccugccccuaccuuggcugccgggggccgacaagcaggaguccaacuggauccagaaggagacccuggucaccuucaagaacccccaugccaaaaagcaggacguggucguguuagggucccaggagggggcgaugcacacggcccugacgggcgccaccgagauccagaugagcuccgggaaccuuuuguucaccggccaccugaagugccggcugaggauggacaagcuccagcugaaggguaugagcuacuccaugugcacggggaaauucaagguggucaaagagauagccgagacccagcacggcaccaucguuauccgcguccaguacgagggggacggcagccccuguaaaguccccuucgagaucauggacuuagagaagcgcuacgugcucggucgucugauaaccgugaacccuaucgucacggagaaggauucccccguaaacaucgaggccgaaccgccuuucggggacucguacaucaucaucggugucgagccggggcaacugaagcucaacugguucaagaaggguuccagcaucgggcagauguucgagaccaccaugcgcggagcaaagcgcauggccauccugggcgacacagccugggacuucgggucccugggcggggucuucacgagcaucggaaaagcccuccaccagguguucggggcaaucuacggcgcggcuuucuccggcgugagcuggaccaugaagauccugaucgggguuaucauaaccuggaucggaaugaacucccggucuacgucccugagcgugucccuggugcucgucgggaucguaacgcuguaccugggcgugaugguacaggccgauucggggugcgugguguccuggaagaacaaagagcucaaaugcggcagcggcaucuucaucaccgauaacguccauaccuggaccgagcaguacaaguuucagccugagucacccuccaagcuggccagcgcgauucagaaggcacaggaagaggggaucugcggcauccgcagcgugaccaggcuggagaaccucauguggaagcagaucacacccgagcugaaccauauccuggcugagaaugaagugaagcucaccauuaugaccggggacaucaagggaaucaugcaagccgggaagcgcagccugcggccgcaacccacugagcugaaguacucauggaagaccuggggcaaggcuaagaugcucagcaccgaguccuacaaccagaccuuccugauagacggccccgagacggcggaaugccccaacaccaaccgggccuggaacucgcuggaggucgaggacuacggguucggcguguucaccaccaacaucuggcucaagcugaaagagaagcaggacgccuucugcgacucaaaguuaaugucugccgccaucaaggacaaccgggcggugcacgccgacaugggguacuggauugaguccgcccugaacgacaccuggaagaucgagaaggccagcuucaucgaaguaaagaauugucacuggcccaagucccacacccuguggagcaacgggguacuggaguccgagaugaucauacccaagaaccucgccggccccgugagccagcacaacuaccguccuggguaccacacccagaucgcugggcccuggcaccuggggaagcuugagauggacuucgacuucugcgacggcacaaccgucaucgugacggaggacugcgggaaccggggccccucacuccgcaccacgaccgccagcggcaagcugauaacggaauggugcugcagaagcugcacccugccgccucuacguuacagaggggaagacgggugcugguacgggauggagauacgccccuuaaaggagaaggaggaaaaccuggucaauucccucgucacugccggccacggccagguugauaacuucagccugggcgugcugggcauggcccucuuccuggaggaaaugcugcggacccgcguggggacgaagcacgcgauccugcugguugccguguccuucgucacccuaaucaccggcaauaugagcuucaaggaccucggacgcgucguggucauggugggcgccaccaugacggacgacaucgggaugggcguaaccuaccuggcccugcucgccgcguucaagguccgccccaccuucgccgccggucugcugcuacgaaagcuaacauccaaggagcuaaugaugaccaccaucgggaucguccugcugagccagucuaccauucccgagaccgugcuggagcucacggacgcccuggcucugggcaugaugguccucaagaucguacgcaacauggagaaguaccaacuggcggucaccaucauggccauccugugcgugccgaaugccgugauccuccagaacgccuggaaggucaguugcacgauccuggcgguugugagcgugagcccacugcuacugaccuccagccagcagaagacggacuggaucccccucgcgcucacgaucaagggguugaaccccaccgcaauauuucugaccacccucucccgcaccaacaagaaacggagcuggccgcuaaaugaggccaucauggccgugggaaugguguccaucuuagcgagcucacuccugaagaacgacauccccaugaccgguccccuggucgccgggggguuacugaccgugugcuacguccugaccgggcgcagcgccgaccucgaacucgagcgggccaccgaugucaagugggaggaucaagccgagaucuccggcagcagccccauccugucgauuacaauuagugaggacgggucuaugagcaucaagaacgaggaggaggagcaaacccugacgauccugauccgcacaggacugcuugugauauccggccuauuccccaucagcauacccauaaccgcggccgcuugguaccugugggaaguaaagaagcagcgggccgggguccucugggacgugcccagcccgccgccgaugggcaaggccgagcucgaggacggggcguaucgcaucaagcagaagggcauccugggguacagucaaauaggcgccggaguguacaaggaggguaccuuccacaccauguggcacgucacucggggcgccgugcuuaugcacaaggggaaacgcauagagccuuccugggccgacgugaagaaggaccuaaucucguacggcgggggcuggaaacuggagggcgaauggaaggagggggaagagguccagguguuagcucuggagcccggcaagaacccccgugcagugcagaccaagcccggauuguucaagaccaacaccgggacgauaggcgcggucucccucgacuuuagccccgggaccuccggcucucccauuaucgauaagaaggggaagguggucggccuauacgggaacggcgucgugacccgcuccggcgccuaugugagcgccauagcccagacagaaaaguccaucgaggauaacccagagaucgaggacgacauauucaggaaacgccgccuuacgaucauggaccuacaccccggagcgggcaaaaccaagcgcuaucucccagccaucgugcgggaggccaucaaacgggggcugcggacccugauccucgccccgacccgcgugguggcggccgagauggaggaggccuuacggggguuacccauccguuaccagacccccgccauccgggccgaacacaccggucgcgagaucgucgaccucaugugccacgcgaccuuuaccaugcgccugcuaagccccgugcgggucccaaauuacaaccucaucaucauggaugaggcacacuucacggaccccgccuccauagccgcccgaggguacaucuccacucgcgucgagaugggcgaagcggccggaaucuucaugaccgcgacgccgccaggcucgcgcgacccguucccccaauccaaugcacccaucaucgacgaggagcgggagauccccgagcgcagcuggaacuccgggcacgagugggugacggacuucaaggguaagaccgucugguucgucccgagcaucaaggccgggaacgacaucgcggccugccugcggaagaacgguaaaaagguuauccagcugucacggaaaaccuucgacagcgaguacgugaagacccggacgaacgacugggacuucgucguuaccaccgacaucuccgagaugggcgccaacuuuaaggcagagcgcgugaucgaccccaggcgcugcaugaagccugucauacucacugacggggaggagcgggucauccuagcgggccccaugcccgugacgcauagcuccgcagcacagcgccggggacgcaucggcaggaaccccaagaacgagaacgaccaguauaucuacaugggagagccccuggagaacgacgaggauugcgcccauuggaaggaagcgaagaugcuccuggauaacaucaacacccccgagggcaucaucccgagcauguucgagcccgaacgggagaaggucgacgcgaucgacggcgaguacaggcuccgcggggaagcccgaaagaccuuuguggaccucaugcggcgcggcgaucugcccguaugguuggccuauaaggucgccgcggagggaauuaacuacgcggacagacgcuggugcuucgacggcauaaagaacaaccagauccucgaggagaacguggaggucgagaucuggaccaaggagggggagagaaagaaguugaaaccgcgcuggcuugacgcgcggaucuacuccgauccucucgcccugaaagaguucaaggaguucgccgccggcagaaagagccugacgcucaaccugaucacagagaugggcaggcugcccaccuucaugacucaaaagacgcgcgacgcgcucgacaaccuggccgugcuucacaccgcggaggccgguggccgagcguacaaucaugcgcucuccgagcuaccagaaacccuggagaccuuacuucuccucacgcuacuggccacagugaccggcggcaucuuccucuuccugaugagcggccgcggcaucggcaagaugacccuggggaugugcugcauaaucaccgcauccauccuccugugguacgcccagauccagccgcacuggauugcggccuccauaauccuggaguucuuccucaucguccugcugaucccagaacccgagaagcaaaggacgccccaagacaaccaguugaccuauguggugauagccauccugaccgucguugccgcgacgauggcgaacgaaaugggcuuccuggagaagacgaagaaagacuuggggcugggcuccaucgccacccaacagccggagaguaacauacuagacaucgaccugcgccccgccuccgcuuggaccuuauacgccguggccaccacguucguaacacccaugcuucggcacagcaucgagaacagcuccguaaacgugucucucacagccaucgccaaccaggccaccguccugaugggccuggggaagggguggccucucuccaagauggauaucggggugccccugcuagccauuggcugcuacucucaggugaacccgaucacucucacagcggcacugcuucugcugguggcccacuacgcaaucauugggcccggccugcaggcgaaggccacgcgcgaggcccagaagcgagccgcagcgggcaucaugaaaaaccccaccgucgacgggaucacgguuaucgaccucgacccgauccccuacgacccgaaguucgagaaacagcugggccaggucaugcuguuaauucugugcgugacccaggugcugaugaugcgcacgaccugggcccucugugaggcccugacgcuggccacggggcccauuucgaccuugugggagggcaacccggggcgguucuggaacaccacgaucgcugucaguauggcgaacauauuccgcggcuccuaccuggcaggcgcugggcugcucuucagcaucaugaaaaacaccaccaacacccggcgcggcacggggaauaugggcgagacccugggcgagaaguggaagucccgccugaacgcccucgggaaguccgaauuccagauauacaagaaguccggcauccaggaaguggaccgaacccucgccaaggagggcaucaagcgcggcgagaccgaccaccacgcggugagccguggcagcgccaagcuccgcugguucgucgagcggaacauggugacccccgaggguaaaguggucgaccucggcugcgggcggggcggguggucuuacuacugcggcgggcugaagaaugugcgggaggugaaaggucugaccaagggcgggcccggccacgaggaacccaucccgauguccaccuacggguggaaccucguccgccuacagagcggcguggacguguucuucaucccgcccgagaagugcgacacccugcucugcgacauuggggaguccagucccaacccgacugucgaggccggccggacccugcgcgugcugaaccucguugagaacuggcuaaacaacaacacccaguucugcaucaagguccugaaucccuacaugcccuccgugaucgagaagauggaggcccuccagcggaaguacggcggggcgcucgugagaaacccgcugagccggaacagcacccacgagauguauugggucuccaacgcaagcggaaacaucguguccagcguaaauaugauauccaggaugcugaucaaccgguucacgaugcgccauaaaaaagccacguaugagcccgacgucgaccucgggagcggcacucggaacauugggaucgaguccgagauccccaaccuagacaucaucggcaagcgcaucgagaagaucaagcaggaacacgagaccagcuggcacuacgaccaggaccaucccuauaagaccugggccuaccacggcuccuacgagaccaagcaaaccgggucggccuccucuauggucaauggcguaguacggcuucuuaccaaaccgugggacgugcugcccaccgugacgcagauggcgaugacagacaccacccccuucggccagcagcgcguauucaaggagaagguggacacgcgcacucaggagcccaaggagggcaccaagaagcugaugaaaaucacagccgaguggcucuggaaggagcuggggaagaagaagacaccgaggaugugcacccgcgaggaguucacccggaaggugcgcuccaacgccgcgcugggggcaaucuucacggacgagaacaaguggaaguccgcgcgggaagcgguagaggauucccgcuucugggaguugguggacaaggaacguaaccugcaccuggagggcaagugugagacgugugucuacaauaugauggggaagagggagaaaaagcucggcgaauucgggaaggccaagggcagccgggcuauuugguacauguggcugggggcccgcuuccuggaguucgaggcgcucggguuccugaacgaagaccacugguucucccgggagaacagccugucgggcguggagggggagggccuccacaagcucgguuauauucugcgcgacguaagcaagaaggaggguggggccauguacgcggacgacaccgccgguugggacacucggauaacccucgaggaccugaagaacgaggagauggucacaaaccacauggaaggcgagcacaagaagcuggcggaggccaucuucaaguuaaccuaccagaacaagguggugcgcguccaacggcccacgccucgggggaccgugauggacaucauaagccggcgcgaccagcggggcuccggccaggucgggaccuacggccugaacaccuucacgaacauggaggcacagcugauccgccagauggagggggagggcgucuucaaaaacauccagcaccucaccguaacggaggagguggcggucaagaacuggcuggcacgggugggacgagagcgccuaagccggauggcgaucuccggcgaugacugcguggugaagccccucgacgaucgcuucgcuaacgcccugaccgcccugaacgauaugggcaaaauccggaaggacauccagcagugggagccgagcaaagguuggaacgacuggacccaggugcccuuuugcucccaccacuuccaugaguuaaucaugaaggacggccgcgugcuggucgugccuugccggaaccaggacgagcuggucgggcgugcacggauaagccagggggcgggguggucccucagagaaaccgccugccuuggcaagaguuacgcccagauguggucccugauguacuuccaucggcgcgaccucagacuggccgcaaacgcuaucugcucugccguccccucccacuggguaccgacuagccgcacgaccugguccauccacgccaagcacgaguggaugacaaccgaggacaugcugacggucuggaacagaguauggauccgcgagaacccauggauggaggacaaaacacccguggaaucaugggaggagaucccauaccucggcaagcgggaggaucaguggugcgggucucugaucggccucacuagccgcgccaccugggcaaagaacauccaggcggccauaaaccaggugcggagucugaucggcaacgaggaguauacggacuauaugccgagcaugaaacgcuuccggcgcgaagaggaggaagccggcguccugugguga

SEQ ID NO: 25327 - RNA, 9876 nt, Artificial Sequence
  derived and/or modified CDS sequence (opt11) from DENV-2__FJ024461__SS-prME
agcgccgguaugauuaucaugcugauacccaccgugauggcuuuucaccucacuacccggaacggggagccccacaugauuguaggcauccaggagaaggggaagucgcugcuguucaagacagaggacggggugaacaugugcacccucauggcgauggauuugggggagcuaugcgaagauacaaucaccuacaaguguccacuccugcgucagaaugagcccgaggacaucgacugcugguguaacagcaccuccaccugggugaccuacggaaccugcacuaccaccggcgagcaccgccgugaaaagcggucagucgccuuggugccccacgugggcaugggccucgagacccggaccgagaccuggauguccagcgagggagccuggaagcacgcccagaggauagagacuuggauccugcggcacccaggguucacgaucauggcggcuauucuggccuacaccaucgggacaacccauuuccagcgcguucucaucuucauccugcugacggcgguggcccccuccaugaccaugcggugcaucggaaucagcaaccgcgacuucguagagggcguauccgggggcagcuggguugacaucguacuugagcacgggagcugcgucaccaccauggccaagaauaaacccacguuggacuucgaacugaucaaaacggaggccaagcagcccgccacccugcgcaaguacugcaucgaagccaagcugacuaauacuacgaccgagagcagaugccccacacagggugaacccuccuugaaggaggaacaggauaaaagguucguaugcaagcacuccaugguggaccgagggugggggaacggcugcggccuguuuggcaagggugggaucgucacgugugccauguucacgugcaagaagaacauggagggcaaaaucgugcaaccagaaaaccucgaguacaccauagugguaacgccgcacuccggugaggaacacgcggugggcaacgacacggggaagcacggcaaggagaucaaaguuaccccgcagagcuccaucaccgaggcagagcucaccggcuaugggacaguuacgauggaauguagcccccggaccggccucgacuucaacgagaugguguuacuucagauggagaacaaggccuggcucgugcaccgacagugguuccuggaccugccucucccguggcuuccuggcgccgacaagcaagaguccaacuggauacaaaaggagacauugguuaccuucaagaacccccacgcuaagaaacaagacguggucguucucggaagccaagagggggcgaugcacacugcccugacaggcgccaccgagauucagaugagcuccgggaaccugcucuucacagggcaccuaaagugccgguugagaauggacaaacuccagcucaagggcaugucauacuccauguguacggguaaguucaagguggucaaggaaaucgcugagacgcagcauggaacaaucgugauccgcgugcaguacgagggggacggcagccccuguaagaucccauucgagauuauggaccuggaaaaacgcuacguccugggaagacucaucaccgugaauccuaucgugacugagaaggacucccccgucaauaucgaagccgagccgccguucggggacucauacauuaucauuggcguggagccggggcaacugaagcucaacugguucaagaagggcuccagcauagggcaaauguucgagacgaccaugcgcggcgcgaagcgcauggcaauucuuggagacaccgccugggacuucgggucucugggcggaguguucacguccauagggaaggcccuacaccaggucuuuggggcuauuuacggugcagcuuuuuccggaguaagcuggaccaugaagauccugauaggggugauuaucacguggaucggcaugaacucccggaguaccucuuugagcgucucccuggugcucguggggaucgucacacuguaccugggcgugaugguucaggccgauucggggugugucguguccuggaagaauaaggagcucaagugcggaagcggcaucuucauuaccgauaacgugcacacuuggaccgagcaguacaaguuccagcccgaaagcccguccaagcuggccagcgcaauccagaaggcccaagaagaggguauaugcggcauccgauccgucacacggcucgagaaucucauguggaagcaaaucaccccggagcugaaccacauccuagccgagaacgaggugaagcucacaaucaugaccggcgacauaaagggcaucaugcaggccgguaagcgcagccugcggccgcagcccacggaacugaaguacaguuggaagaccuggggcaaagccaagaugcucaguaccgaauccuacaaccagaccuuccugaucgacggucccgagacugcggagugcccgaauacgaaccgcgccuggaauucacuggaggucgaggacuauggguucggcgucuucaccaccaauaucugguuaaaacuaaaggagaagcaagaugccuuuugcgacaguaagcugauguccgccgccaucaaggacaaccgggcggugcacgcggacaugggguauuggaucgagucggcccucaacgacaccuggaagaucgagaaggcgucguucaucgaggugaagaauugccauuggccaaaaucccauacacuguggagcaauggagugcuggaguccgagaugaucauacccaagaaccuagcgggcccuguaagccagcacaacuacaggcuggguuaucacacccagaucgcggguccguggcauuuagguaagcucgaaauggacuuugacuucugcgaugguaccaccgugaucgucacggaggacugcgggaaccggggacccucccugcggacgacuaccgccagugguaagcugauuaccgaguggugcugccgcagcugcacccucccgccccugagguaccgcggggaggaugggugcugguacggcauggaaauccguccgcugaaggagaaggaggagaaccuggugaacaguuuagugacagcuggccacgggcagguggacaauuucagccugggugugcuggggauggcucuguuccuggaagagaugcucaggacccgcgucgggacgaagcaugcgauccugcugguugccguguccuucgugacccucaucaccggcaacaugagcuucaaggaccuagggcgcgucguggugauggucggugccacgauggccgaugauauagggaugggcgugacguaccuggcccuccuggcggccuucaaggugagaccuaccuucgcggcgggucugcuuuuacggaagcucaccuccaaagagcucaugaugacgacgaucgggauugucuuacugagccaaaguacgauccccgagaccguguuagagcugaccgaugcccuggcccucggcaugauggugcugaagaucguccgcaacauggagaaguaccagcuggccgucacaaucauggccauacuuugcguccccaacgcggucauccugcagaacgccuggaaggugagcugcacaauccucgcggucgugaguguaagcccgcuccugcugacuagcagccaacaaaagaccgacuggaucccucucgcguuaaccaucaagggguuaaaccccacagcuauuuuccucaccacccuuucccgcacuaacaagaaacggagcuggccacugaacgaggccauuauggccguagggaugguguccauccucgccagcucccugcugaagaacgacaucccaaugaccggcccccucguggccgggggccugcugaccguauguuacguuuuaaccgggcgcagcgccgaucuggagcuagaacgggccacggaugucaagugggaggaccaggccgaaaucagcggcucuagcccgauccucuccaucaccaucagcgaggacggauccaugagcaucaaaaacgaggaggaggaacagacacugacgauccugauucggacggggcuccuggucaucucaggucuguuccccaucagcaucccgaucaccgccgcagccugguaccucugggagguuaaaaagcagcgggccggcgugcugugggacgugcccucgccgccacccaugggcaaggcggagcuugaggacggagcguaccgcaucaaacagaagggcauucucggguacagccagauaggagccgggguguauaaggaggggaccuuccauaccauguggcacgucacucggggugccguccugaugcacaaggggaagcguaucgaaccguccugggccgaugucaaaaaggacuuaaucagcuacggcgggggguggaagcuagaaggcgaguggaaagagggggaggaaguccagguccuggcguuagagccuggcaaaaauccucgggcggugcaaacuaaacccggacucuucaagaccaacaccgggaccaucggggccgugucccuggacuucucuccaggcacgagugguagccccaucauagacaagaaggggaaggucgugggccuguacgggaacggcgugguuacccgcuccggcgccuacgugagcgcaaucgcgcagaccgagaaggggaucgaagacaacccggaaaucgaggacgacauauucagaaagcgcaggcugaccauuauggaccuccauccuggagccgggaagacgaagcgcuaccugccugccauagugcgcgaggcuauaaagcgcggucugcguacccugauuuuggcgccgacacgcgucguugccgccgagauggaggaggcacugcgagggcucccaauccgcuaccagaccccugccauacgggcggaacacacgggccgggagaucguggaucugaugugccaugccaccuucaccaugcgccuguuguccccugucagagugcccaacuacaaccugauaaucauggacgaagcccacuucaccgauccggcuagcaucgcggcacgcggcuauauaagcacuagaguggagaugggggaggccgcuggcaucuucaugacggcaacgccgccagggagcagagacccguucccgcaaucgaacgcccccaucauagacgaggaacgcgagauaccugagcgcuccuggaacagcggucaugaguggguuaccgacuuuaagggaaagacggugugguuugugcccuccaucaaggcuggaaacgacaucgcggccugccugcggaagaacggcaaaaaggucauccaacucucgcguaagaccuucgacagcgaauacgugaagacucggaccaacgauugggacuucguagugacaaccgauaucuccgagaugggggcuaacuucaaggcggagagagugauagacccgcggcgcugcaugaagcccgugauccugaccgacggugaggagcgagucauccuggccgggcccaugccugugacccauuccagugccgcccagcgccgugggcguauuggacggaauccgaagaacgagaacgaccaguacaucuacaugggcgagccccucgagaacgacgaagacugugcccacuggaaggaggcgaaaaugcugcuggacaacaucaacacgccagaaggcaucauaccauccauguucgagccggagcgggagaagguggacgccaucgauggggaguaccggcucaggggcgaggcucguaagaccuucguagaccugaugaggaggggcgaccuaccagucuggcucgccuacaagguggccgccgaaggcauaaacuacgccgauaggagguggugcuuugacgggaucaagaauaaccagauccuggaggagaacgucgagguggagaucuggacaaaagagggcgaacgaaagaaguuaaaaccaagauggcuagacgcuaggaucuauagcgacccgcuggcccugaaagaguucaaggaguucgccgcggggagaaaaucccucacccugaaucugaucacugagauggggcgcuuacccaccuuuaugacgcagaagacccgcgacgcgcuggacaaccuagccguccuacacacugcggaggcgggugggcgggcuuacaaccacgcguugagugaauuaccugagacccucgagacccuguuacuccuuacccugcuugcgacggugacgggcggcaucuuccuauuucugauguccgggcgcggaauagguaagaugacccucggcaugugcugcaucaucacagccagcauccugcucugguaugcgcagauccagccccacuggauagccgccucaaucauucucgaguucuuccugaucgugcuccucaucccggagcccgaaaaacagaggacgccucaggacaaccaguuaacuuacgucgugaucgcuauccugacuguaguggccgcgaccauggccaaugagaugggguuccucgagaagaccaaaaaggacuucggccuggggagcaucgccacgcagcagccggagucuaacauucuggacaucgaucuccgcccggccagugccuggacccuguacgcugucgccaccacuuucgugacucccaugcugcggcauaguauugagaacagcuccgucaaugucucucucaccgccauagcuaaucaagcuacagugcucauggggcugggcaagggguggccccucagcaagauggacaucggagucccccugcuagcuaucggguguuacucccaggucaacccuaucacccugacggccgcccugcugcucuugguggcccauuacgcgauaauuggccccggccugcaggccaaggccacccgcgaagcccaaaagcgggcugcggccgggaucaugaagaaccccacugucgacgguaucaccgucauugaucuugaccccaucccguacgaucccaaguucgagaagcaacugggccaagugaugcugcucauccugugugucacccaaguccugaugaugaggaccaccugggcccucugcgaggccuugacuuuagccacgggccccauaaguacgcucugggaagggaaccccggucgguucuggaacaccacuaucgcugugaguauggcuaauaucuucaggggcucauacuuagcgggggccggccuccucuuuuccaucaugaagaacacgacgaacacgcggcgcggcaccggaaacauaggcgagacacugggugagaaguggaagucccgccugaacgcucucggcaagagcgaguuccagauauacaagaaguccggcauccaggaggucgaccguaccuuggcgaaggaggggauuaagagaggugagaccgaccaccacgccgugagccggggcagcgcuaagcugcguugguucguggagcggaauauggucaccccagaggggaagguuguggaucuugggugcggcagagggggcugguccuacuacugcgggggccugaagaacgucagggaggugaagggccugacgaaggguggacccgggcacgaggagcccaucccgaugaguacauacggcuggaacuuggugcgcuugcaauccggggucgacguguucuucauaccgccggagaaaugugacacccuacucugcgacauaggcgagucaucccccaaccccacuguggaggccggccggacgcugcgcguccugaaccucguggagaacuggcugaacaacaacacccaguucugcaucaaagugcucaacccguacaugcccagcgucaucgagaagauggaagcgcugcagcggaaguacgggggcgcccuagugcgcaacccccugagucgaaacagcacccaugagauguacugggucagcaacgcaucggggaacaucgugucgucggugaacaugaucagucgcaugcugaucaaccgauucaccaugcgccacaagaaggccaccuacgagccagacguagaccucgggucggggacucggaacauaggcaucgagagcgaaauucccaaccuggauaucaucggcaagcgcaucgaaaagaucaagcaagagcacgaaaccuccuggcacuacgaccaggaccaccccuauaagaccugggccuaccacgguagcuacgagaccaagcagaccggcuccgcaucuuccaugguuaacggugugguacggcuccucaccaagcccugggacguccugccgaccguaacgcagauggccaugacggacacuaccccguucggccagcagaggguguuuaaggagaaagucgacacccgcacgcaggagcccaaggagggaacgaagaaguugaugaagaucaccgccgaguggcucuggaaggagcuggggaagaagaagacuccccgaaugugcacgcgcgaagaguucacuagaaaagugcguagcaacgcagcccugggcgcgaucuucaccgacgagaacaaguggaaguccgcccgggaggccgucgaggacucucgcuucugggagcucguagacaaggagcggaaccugcacuuggaggggaaaugugagaccugcguguauaacaugauggggaagcgcgagaagaaacucggagaguucggcaaggccaaaggcucccgagccaucugguacaugugguuaggggcacgcuuucuagaguuugaggcuuugggcuuccugaacgaggaucauugguucagccgggaaaacucccuuuccggggucgaaggugagggccugcacaagcuggguuacauccugcgagacgugagcaaaaaggaggguggagccauguacgcagacgacacagcuggaugggacacccggaucacguuggaggaccuaaagaacgaggagauggugaccaaucauauggagggggagcacaagaagcucgcugaagcaaucuuuaagcucacguaccagaacaaagucgugcgagugcagcggccgacuccaaggggcaccgucauggacaucauaucacggcgcgaccagcgggggagcggccaagugggcaccuaugguuugaacaccuucaccaauauggaggcccagcucauccggcagauggaaggggagggagucuuuaagaacauccaacaccugaccgucacagaggaaguggccguccaaaacuggcuggcgcgggucggccgcgagcgccugucccggauggcuaucucaggcgacgacugcguggugaaaccccucgacgaccgcuucgccaacgcccugacugcgcuuaacgauaugggcaagaucaggaaggauauucagcagugggaaccaagcaagggcuggaaugacuggacccagguccccuucugcucccaccauuuucacgagcugaucaugaaggacgggcgcgugcuggugguccccugccggaaccaggaugaauugaucggucgcgcgagaauaucccagggggccggauggagccucagggaaaccgccugccuggggaaguccuacgcgcaaauguggagccugauguacuuccaccggcgugaccuacggcuggccgcgaacgccaucugcuccgcagugccaucacacugggugcccaccagucgcacgaccuggagcauccaugccaagcacgaguggaugaccaccgaggacaugcuuaccguauggaaucgaguguggauacgcgagaacccguggauggaggacaaaacgcccguagagucuugggaggagauucccuauuuagggaagcgagaggaccaguggugcgggagucugaucgggcuaaccucccgcgcuacgugggcgaagaauauacaggcugccaucaaucaggugcggucgcucauaggcaacgaggaauauacugacuacaugcccuccaugaagcgguuuagaagggaggaggaggaggcagggguccuaugguag

SEQ ID NO: 25328 - RNA, 9876 nt, Artificial Sequence
  derived and/or modified CDS sequence (opt11) from DENV-2__FJ373299__SS-prME
ucagcgggcaugaucaucauguuaauccccaccgugauggccuuccaccuuaccacccggaauggggaaccccacaugaucguaggcauccaggagaaaggaaaaagccugcuguucaagaccgaggacggcgugaauaugugcacccuuauggcgauggaucugggagagcugugcgaggacaccaucaccuacaagugcccccuccugcggcagaacgagccagaggacaucgauugcuggugcaacuccaccuccaccugggugaccuacgggaccugcaccaccaccggggagcaucgccgggaaaagcggagcguggcccuggucccccauguugggaugggccuagaaacccggaccgagaccuggaugaguagcgagggugccuggaagcacgcgcagcggaucgagaccuggauacugcggcacccgggguucacgauuauggcugcgauccuggcguacacaauaggaaccacccacuuccagcgcguccugauauucauccugcuaacggccguggcccccuccaugaccaugcggugcaucgggaucagcaaccgggacuuuguugagggcguauccgggggcagcuggguggacauugugcuggagcacggguccugcgucaccacgauggcgaagaacaagccaacguuggacuucgagcugaucaaaaccgaggccaagcagccugccaccuuacggaaguacugcaucgaggccaagcugaccaacaccaccaccgagagccgcugccccacgcagggcgagcccucccugaaggaagaacaggacaagcgauucgugugcaaacacagcaugguggacagggggugggguaacggcugcggauuauucggcaagggcgggaucgucacgugcgccauguucacguguaagaagaauauggaggguaagaucgugcagcccgagaaccuggaguacacaauugucgugacaccccauuccggggaggagcacgcagugggcaacgacaccgggaagcauggccaggagauuaaagucacuccgcagucgucgauaaccgaagccgaacucaccggauacggcacagucacgauggagugcagcccacggaccggccucgacuucaacgagauggugcugcugcagauggagaacaaggccuggcucgugcaucgacagugguuccuggaucugccacuccccuggcugccgggugccgacaaacaggaauccaauuggauccagaaggagacccuggucaccuucaagaacccccacgccaaaaagcaggauguggucgugcucgggucacaggaaggggccaugcacacggcccugaccggcgccaccgagauccaaaugucgucggggaaucuccuauucaccggccaccugaagugccggcugcgcauggacaagcuccagcugaaagguaugagcuauuccauguguacggggaaauucaagguggucaaagagaucgcugagacccaacacggcaccaucgugauccguguccaguacgagggggacggcagccccuguaagauacccuucgaaaucauggaccuugagaagcgcuauguccuaggcaggcucaucaccgugaauccgauagugacggaaaaggacucgccugucaacaucgaggccgagccgcccuuuggggacuccuacaucauaaucggaguggagccggggcagcugaagcucaacugguucaagaagggcuccagcaucgggcagauguuugaaaccacaaugcgcggcgcgaagcgcauggccauccugggugacaccgccugggacuucgggucccuuggcgggguauucacgagcauaggcaaagcccuccaccagguauucggugccaucuacggcgcggccuucagcggcgugucauggaccaugaagauccucaucgggguaauaaucacguggaucggcaugaacucacggucuaccucucuguccgucucccuggugcucguagggaucgucacgcuguaucugggcguaaugguacaggcagacagcggcugugucgugucuuggaagaacaaagagcucaagugcgguagcggcaucuucauaacugacaacguacacaccuggaccgagcaguacaaguuccagccggagagcccuuccaaguuggcgucggcuauccaaaaggcccaggaggagggaauaugcgggauccgcuccgucacgcggcuggagaaucucauguggaagcagauaacgccugagcuuaaccacauccuggcagaaaacgaggugaagcucacuaucaugaccggggacaucaagggcaucaugcaggcagguaagcgaagccugcggccgcagcccacagaguuaaaauacuccuggaagaccuggggcaaggccaagaugcucaguaccgaguccuacaaccagacauuccugauugacggccccgagacggcagaaugcccgaacaccaacagggccuggaacagccuggagguggaggauuacggguucggcgucuuuacaacaaauaucuggcugaagcugaaggagaagcaggacgcguucugugacucccgcuugaugagcgccgccaucaaggauaaccgggcggugcacgcugauauggguuacuggaucgagagcgcccucaacgacacguggaagauugagaaggccagcuucaucgaggucaaaaacugccauuggcccaagucccacacccuauggucuaacggcguccuggaguccgagaugaucauccccaaaaaccucgccgggcccgugagccagcacaacuaccggccuggguaccauacucagaucgcgggucccuggcaccuggguaagcuggaaauggacuuugauuucugugacgguaccaccgugaucgucacggaagauugugggaaccgcggccccucacuccguaccaccaccgccagcggaaaguuaaucacagaauggugcugccgaaguugcacccugccaccgcuccgguacagaggagaggacggcuguugguaugggauggagauccguccccugaaggagaaggaggagaacuugguaaacucccucgugaccgccggccacggccaaguugacaauuucagccuaggcguccugggcauggccuuguuccuggaggagauguuacgaacccggguagggacgaagcacgcgauacuccugguagccguguccuucgucacccugaucacuggcaacaugagcuucaaggaccucgggcgcguuguggugaugguaggcgccaccauggccgacgacaucgggaugggcguaaccuacuuagcccugcucgcggccuuuaaggugcgucccaccuucgcugcggguuuacugcuccgaaagcugacuuccaaggagcugaugaugaccacgauugggaucguccucuugagccaguccaccaucccugagacuguccuggaauuaaccgacgcacuggcucugggcaugauggugcucaaaaucguuaggaacauggagaaguaucagcuggccgugacgauuauggcaauccugugugucccgaacgcugugauccuccaaaacgcuuggaagguuagcugcacuauccuggcggucgugagugugucaccccugcugcugacguccagccaacaaaagaccgacuggaucccccuggcucucacgaucaaagggcugaacccuaccgccauauuccugaccacccuuucccggacgaauaaaaagcgcucuuggccucugaacgaggccaucauggcgguuggcaugguguccauccuggccucgucucuccugaagaacgacauccccaugaccggcccccuuguagcagggggucuacugaccgucugcuacgugcucaccgggcguagcgccgaccuugagcuggagcgcgcuacugacgugaagugggaggaccaagcggagauuaguggcucaagccccauucugucaaucaccauaagcgaggacggguccaugagcaucaagaacgaggaggaggagcagacccucaccauucugauccgaacgggccuucuugucaucuccggccuguucccgaucagcauccccauuacugccgcggccugguacuuaugggaggugaaaaagcagcgcgccgguguguuaugggauguccccagcccuccgcccaugggcaaggcggagcucgaggacggggccuaccggaucaagcaaaagggcauccugggguacagccagaucggcgccgggguauacaaggaggggaccuuccauacaauguggcacgugacccgcggcgccgugcucaugcacaaggguaagagaaucgagcccuccugggcggacgugaagaaagaccugaucagcuacggcgggggcuggaagcuggagggagaguggaaggagggcgaagaggugcagguacucgcgcuggagccgggcaagaacccccgcgccgugcagaccaaacccggccuguucaagaccaacaccgggaccaucggagccguuuccuuagacuuuagccccgggacgucuggcagccccaucaucgacaagaaaggaaaggucgucggccuguacgggaacggcguggucacccgguccggcgccuacgugucugccaucgcgcaaaccgagaaguccaucgaagauaacccagaaaucgaggaugacaucuuucgcaagcggcgccugacgaucauggaccugcacccuggcgccgggaagacgaagcgguaucucccugccaucgugcgagaggccaucaagcggggauugcgcacccugauccucgcaccgacccgggucguggccgccgagauggaggaagcccugcgcgggcugccuauccgguaccagaccccggccauccgcgcggagcacacgggucgcgagaucguggaucucaugugucacgccaccuucacgaugcggcugcugucucccgugcgcgugccgaauuacaaccucaucaucauggacgaggcucacuucaccgaccccgccuccaucgcggcuagaggcuacaucagcacucgcguggagaugggggaagccgccggaaucuucaugacggccacgccgcccgggagccgggacccguucccccaguccaacgccccgaucauugacgaggagcgcgaaaucccggagcggagcuggaacuccgggcacgagugggucacugacuucaagggcaagaccgugugguucgugccgagcauuaaggccggaaacgacaucgcugcgugccugcgcaagaacggcaagaaggugauccagcugucccgcaagaccuucgacagcgaguacgugaagacccgcaccaacgacugggacuucguggucacgaccgauaucuccgaaaugggcgccaacuucaaggcggagcgggugaucgacccccgccggugcaugaagccggugauccuaaccgacggggaggagcgcgucauccuugccggacccaugccggugacccacagcuccgcugcacaacggcgcgggcggaucggccgcaaucccaagaacgaaaacgaccaguacaucuacaugggggagccccuagagaaugacgaggacugcgcccauuggaaggaagcaaaaaugcuccuggacaacauuaacacgcccgagggcaucaucccgagcauguucgagccugagcgggagaagguggacgccaucgacggcgaguaccgccugcgcggggaggccagaaagaccuucgucgaccucaugcgccgcggcgaucugcccguguggcuggccuacaagguggccgcaggcgggaucaacuacgccgaucgccguuggugcuucgacgguaucaaaaauaaccagauccucgaagagaacgucgagguggagaucuggaccaaggagggggagcgcaagaaacuuaaaccgcgguggcuggacgccaggaucuacucagacccucucgcccuuaaggaguucaaggaguucgccgcgggccggaaaucgcugacccucaaccugauuacggagauggggcgccuucccaccuucaugacccagaagacccgggaugcccucgauaaccuggccguccuccacacagccgaggcgggcgggcgcgccuacaaccacgcccucucugaguuacccgagacccuggagacccucuugcuguuaacccugcuggccacggucacgggcggaaucuuccucuuccugaugagcggccggggcaucgggaaaaugacccugggaaugugcuguaucaucaccgcguccauccuccugugguacgcacagauccagccgcacuggauugccgcuucuaucauccucgaguucuuccucaucguucugcugauacccgagccagaaaagcagcgcacuccccaggacaaccagcucacguacgucgugaucgccauccuaacaguugucgccgcgaccauggccaacgagaugggguuccuggagaaaaccaagaaggacuuaggacugggcucuauugccacgcagcagccggaaucaaauauccuggacaucgaccuccggcccgcaagcgccuggacccuguaugcgguggccaccaccuucgucacgcccaugcugaggcauucgaucgagaacagcucggucaaugugagccucaccgccauagcaaaccaagccaccguguugauggggcugggcaagggauggccacuuaguaagauggauaucggggucccgcugcuggccauagggugcuacagccaagugaacccuaucacccucacggccgcacugcuguugcugguagcccacuacgcgauaauaggcccgggcuugcaggcgaaggccacccgggaggcccaaaagcgugccgcugccggaaucaugaaaaaccccaccgucgacggcaucaccgugaucgaccucgauccgauccccuaugaccccaaauucgaaaagcagcugggccaagucaugcugcucauacugugcgucacccagguguuaaugaugcggaccacuugggcccucugcgaagcucugacgcuggcaacgggccccaucuccacccucugggaagguaacccgggacgcuuuuggaacaccaccaucgcgguaagcauggcuaauaucuucaggggcuccuaccuggcgggcgcaggccuccucuucagcauuaugaaaaacacgacaaacacccgccgcggaaccggcaacaugggcgagacgcugggcgagaaguggaagucccggcugaacgcgcucggaaagagcgaguuucagaucuacaaaaaguccgggauccaggaggucgacagaacucuggccaaggaaggcauuaaaagaggggaaacugaccaccacgccgucagccgaggaagugccaagcuacggugguucguggagcgcaacauggucacccccgagggcaagguuguggaccucgggugcggccgcggcggauggagcuacuacugcggcgggcugaaaaacguccgcgaggugaaggggcugacaaagggugggccagggcacgaggaacccaucccaauguccacuuacggcuggaaccucgugagacugcagagugggguagacgucuucuucaucccgcccgagaagugcgacacccugcucugcgacaucggugaguccaguccaaauccgacgguggaggcaggccgcacgcuacgaguccugaaccuagucgagaacuggcuuaacaacaacacccaguucugcaucaagguucugaauccguacaugccuuccgucaucgagaagauggaggcucugcagcgcaaauaugggggcgcccucgugcggaacccgcugagccgaaauagcacccacgagauguauugggucuccaacgccaguggaaacaucguuagcagcgugaacaugaucucccggaugcugauuaauagguucacgaugagacacaagaaggccaccuacgagcccgacguagacuugggcuccgggacgcgcaacaucggaaucgaguccgagacccccaaccuggacaucaucggcaagcggauugaaaagaucaaacaagagcacgagacuagcuggcacuaugaccaggaucaucccuacaagaccugggcuuaccacgguuccuacgagacgaagcagaccggaagcgcuuccagcauggucaacggugucgugcgccuccucaccaagccgugggauguucuucccaccgugacgcagauggccaugacugacaccacccccuuugggcaacagcggguuuucaaggagaagguagacacucguacccaggagcccaaggaaggcaccaaaaagcugaugaagaucacggccgaguggcucuggaaggagcuagggaagaagaaaacgccgcgcaugugcaccagggaggaguuuacccgcaaagugaggucuaacgccgcccugggcgcgaucuucaccgacgagaacaaguggaaguccgcccgcgaggccguggaagacucccgguucugggaguuggucgacaaggagcgaaaccugcaccuggaaggcaagugcgagacguguguauacaacaugaugggcaagcgggagaagaaacucggagaguucgguaaagcaaagggcucgcgagccauaugguacauguggcugggggcgcgguuccuggaguucgaggcccuuggcuucuugaaugaagaccacugguucagccgcgaaaacagccuaucuggggucgagggcgagggacuccacaagcuaggcuacauccugcgggacgugagcaagaaagagggcggggcgauguaugccgacgacaccgccggcugggacacccgcaucacccucgaggaccugaaaaacgaagaaaugguaacaaaccacauggagggggagcauaagaagcuggccgaggccaucuucaagcucaccuaccagaacaaagucgugcgggugcaacgucccacgcccaggggcaccgucauggauauuaucagucgacgggaccagcggggguccggacaggugggcacguacgggcugaacaccuuuaccaacauggaggcccaguugauccggcagauggagggugagggcguguucaagaacauccagcaccuuaccgucacugaagagguugcuguacagaacuggcuggcgcgcgucggccgcgagcggcugagccgcauggccaucuccggagaugacugcguggugaaaccccuggaugaucgguucgccaaugcccugaccgcccucaacgauauggggaagauccgcaaggacauccagcagugggagccgagcaagggguggaacgacuggacccagguccccuucugcucccaucacuuccacgagcucaucaugaaagacggccgggugcucgugguccccugccggaaucaagaugaacugauaggccgggcgcgcauaucccagggggcaggcuggagucuccgggagacggccugccugggcaaaagcuacgcccagauguggucccugauguauuuccaucgcagggacuuaagacuagccgcaaacgccaucugcucggccgugcccucccacugggugccgacgucucggacuacaugguccauccacgccaagcacgaauggaugacgaccgaggauauguuaacggucuggaaccgcguguggauccgggagaaccccuggauggaggacaagaccccuguagagagcugggaggagauccccuaccucgggaagcgcgaggaccaguggugugggucccugaucggguuaaccucacgggcgaccugggccaaaaacauccaaguagccaucaaccagguacgaucccucaucggcaacgaagaguacacggacuacaugccaagcaugaagcgcuuuagacgcgaggaggaggaggccgggguacugugguga

SEQ ID NO: 25329 - RNA, 9876 nt, Artificial Sequence
  derived and/or modified CDS sequence (opt11) from DENV-2__FJ410193__SS-prME
agcgccgggaugaucaucaugcugaucccaacugugauggcauuccaccucaccacacggaacggggagccccacaugaucgugggcauucaggagaaggggaagagucugcuauuuaagaccgaagacggcgugaauaugugcacccucauggcgauggaccugggagagcugugcgaagacacaaucaccuacaaaugcccccuccugcgccagaacgagcccgaggacaucgauugcuggugcaacagcacuagcaccuggguaaccuacgggaccugcaccaccaccggagagcaccgccgggagaagcgcagcgucgcacuggugccccacguggggaugggccucgagacgaggaccgagaccuggaugucaagcgagggggccuggaagcacgcccagcgcaucgagaccuggauccugagacacccuggcuucacgaucauggccgcgauccuggccuacaccaucgggaccacucacuuccaacgcguccucaucuuuauccugcugacugccgucgcacccuccaugaccaugcgcuguaucggcaucucuaaccgcgacuucguggaaggcgucucugggggcagcuggguggacauugugcucgagcacggguccugcgucaccaccauggcgaagaacaagcccacgcuggacuucgagcugaucaagaccgaggccaagcagcccgccacccuccggaaguauugcaucgaggccaagcucaccaacacgaccaccgaaagccgcugccccacccaaggcgagccgucccugaaggaggagcaggauaagcgguucauuugcaagcauagcaugguggaccgcggcugggggaacggcugcggucuuuucggcaaaggcgggaucgugacgugcgccauguucacgugcaagaagaacauggagggcaagaucguacagcccgagaaccuggaguacaccaucguggugacgccccacuccggggaggagcacgcggucggcaacgacacggggaagcacggcaaggaaauaaaggugacuccgcagagcuccaucaccgaagccgagcugaccggguacggcaccgugacgauggagugcagcccccggaccggcuuggacuucaacgagaugguacugcugcagauggagaacaaggccuggcuugugcacaggcagugguuccuggaccugccccuccccuggcugccgggagccgacaagcaggaguccaacuggauucagaaggagaccuuaguuacuuucaagaauccccacgccaagaagcaggacgucgugguccucggcagccaggagggggcgaugcauacagcccugacgggcgcaaccgagauccagauguccucugggaaccuccuguucaccggacaccugaagugccggcugcgcauggacaaguugcaacuuaagggcaugagcuacuccaugugcacggggaaguucaagguggugaaggagauugccgagacccaacacggcacaaucguaauccgggugcaguacgagggggauggcagcccuuguaagauacccuuugagaucauggaucuggaaaaacgcuacguacucggcagacugaucaccgucaauccgaucgugacggagaaggacucccccgugaacaucgaggcagagccgcccuucggggacagcuacaucaucaucggugucgagccggggcagcuaaagcucaacugguucaagaaggggagcuccaucgggcagauguucgagacuaccaugcggggcgcaaagcgcauggccauccugggcgauaccgcuugggacuucgggucacugggcgggguguucacgagcaucggcaaggcccugcaccagguguucggggccaucuacggcgcggccuucuccggggucagcuggaccaugaagauccugaucggugugaucaucaccuggaucgggaugaacucccggagcaccucccugagcgugucccuaguccucgugggcaucgugacgcuguaucugggcgucauggugcaggccgacagcgggugcgugguauccuggaagaacaaggagcucaagugcggcagcggcaucuuuaucacggacaacgugcacaccuggaccgagcaguacaaguuccagcccgaaagccccuccaagcuggccagcgcgauccagaaagcccaagaggagggaauaugcggcauacgcuccgugacgcggcuggagaaucucauguggaagcagaucacccccgagcugaaccacauccuggccgagaacgaggucaagcucaccaucaugaccggggacauaaagggaaucaugcaggccgggaagaggagccugcggccgcagcccacggagcugaaguacuccuggaaaaccuggggcaaggccaagauguuaagcaccgaguccuacaaccagaccuuccugaucgacggccccgagacggcagagugcccaaacaccaaccgcgccuggaacucccuggagguggaagacuacggguucggcguguucaccaccaacaucuggcuuaagcugaaggagaaacaggacgccuuuugugauucaaaacugaugagcgccgcaaucaaggacaaccgggcgguccacgccgacaugggguacuggaucgaguccgcccucaacgacacuuggaagaucgagaaggccagcuucaucgaagugaagaauugucacuggcccaagucccacacucuguggagcaauggcgugcuggaguccgagaugaucaucccgaagaaccuugccggccccgucagccagcacaacuaccgaccgggauaccacacccagaucgcggggcccuggcaccuggggaagcuggagauggacuuugacuuuugcgacggcaccaccguaaucgugacggaagacugcgggaaccggggccccucccuccgaaccaccaccgccagcggcaaacugaucacggaguggugcugucggagcugcacccugccuccgcuccgcuaccgcggggaggacggcugcugguacgguauggagauccgcccccugaaggagaaggaggagaaccucgucaacucucucgugacugccggccacggccagguggacaacuucagccuggguguccugggcauggcccucuuccuggaggagaugcugcggacccgcguggggacaaagcaugcgauacuccuuguggccgucagcuuugugacccuaaucaccggcaacaugagcuucaaggaccucgggcggguaguagugauggugggcgccaccauggccgaugacaucgggaugggcgucacguaccuggcccugcuagccgcauucaagguucgcccgaccuucgccgccggccugcugcuccggaagcugaccuccaaggagcugaugaugaccacgauagggaucgugcuccugagccaguccaccauccccgaaaccguccuggagcuuacagacgcccuggcgcugggcaugauggugcucaagaucgugcgcaacauggagaaauaccaacuggcugucacgaucauggccauccugugcgugccgaacgccguaauccuccagaacgccuggaaggugagcuguaccaucuuggcugugguauccgugagcccccugcuccugaccuccagccagcagaaaaccgacuggauaccccuggcccucacgaucaagggccuuaaccccacagccaucuuucugaccaccuugucccgcacgaacaagaagcggagcuggccccugaacgaggccaucauggcggugggaauggucuccauccuggccagcucccuacugaaaaacgauauccccaugaccggcccccucgucgccgggggccuucugaccgugugcuauguccugaccgggaggagcgccgaucucgagcuagagcgggccacggaugugaaaugggaggaccaggcggagaucuccggcuccagccccauccuguccaucacgauaagcgaggacggguccaugagcaucaagaacgaggaggaagagcagacgcucaccauccuuauccgcacgggccuucucguuaucuccgggcuguuuccgaucagcaucccgaucacugccgccgccugguaccugugggaagucaagaagcagcgggccggggugcucugggacgugcccagcccgccgcccauggggaaggcggagcuggaggacggcgccuaucgcaucaagcaaaagggcauucuuggguacagccagaucggcgccggcgucuacaaggaggggaccuuccacaccauguggcacgugacccggggcgccgugcucaugcacaaggggaagcgcaucgagcccuccugggccgacgucaagaaagaccugaucagcuacggggggggcuggaagcuggagggagaguggaaggagggggaggagguucaggugcucgcgcuggagcccggcaagaacccccgggccguccagacgaagccagggcuguucaagaccaacaccggcaccaucggcgccgugucccucgauuucagccccgggacguccggcagccccaucaucgacaagaaggggaagguuguaggccuguauggaaauggaguggugacacgcagcggggccuacgucagcgccaucgcacaaacugagaaguccaucgaggacaacccugagauagaggacgacauuuuccggaagcgccggcugacgaucauggaccugcaucccggggcaggcaagacgaaacgcuaccucccggccaucgugcgggaggccaucaagcgcgggcugcggacccucauucucgccccgacccgcguggucgccgccgagauggaggaggcccugcggggccugccuauccgcuaccagacgcccgccauccgcgcagaacacacggggcgcgagaucguggacuugaugugccacgccaccuucaccaugcgccugcuguccccagugcgggucccgaauuacaaccucaucaucauggacgaggcccacuucaccgaccccgccuccaucgcagcgcgcggcuacaucagcacgcggguugaaaugggcgaggcggcggggaucuuuaugaccgcgacgccgcccggcagccgcgacccuuucccccaauccaacgcccccaucaucgacgaagagcgggagauccccgaacgcucuuggaacuccggucacgagugggugaccgacuucaagggcaagacggucugguuugugccgagcaucaaggccgggaacgacaucgccgcaugccugcggaagaacggcaagaaagugauccagcuguccaggaagaccuucgacagcgaguacgugaagacccgcaccaacgauugggacuucguugugacgaccgacaucagugagaugggcgccaacuucaaggcggagcgcguuaucgacccccggcgcugcaugaagcccgugauccucaccgacggggaggagcgggugauccuggccggccccaugccgguaacccauagcuccgccgcccagcgccggggccgcaucggucgcaaccccaagaacgagaacgaccaguacaucuacaugggggagccccuggagaaugacgaggacugcgcgcacuggaaggaggcgaagaugcuacuggacaacaucaacacgcccgaaggcaucauaccgagcauguucgagcccgagcgcgagaagguggacgccaucgacggcgaguaccggcuacgcggggaggcccgaaagaccuucguugaccucaugcggcggggggaccugccggucuggcuggccuacaagguggccgcggaggggaucaacuacgccgaccggcgcuggugcuucgacggcaucaagaauaaccaaauccucgaggagaacguggaggucgagaucuggaccaaggagggugagcggaagaaacuaaagccgcgcuggcuggacgcccggaucuacuccgacccucuagcccugaaggaguucaaggaguucgccgccggccgcaagagccugacacucaaccugaucacggagaugggaagacugcccaccuucaugacccagaagacccgugacgcgcucgacaaccuggcugugcugcacacggccgaggccggcgggcgcgccuacaaccacgcccucuccgagcugcccgagacccuggaaacccuccugcugcucacccugcuggccacggucaccggugguaucuuccucuuccugaugagcggccgugggaucgguaagaugacccugggcaugugcugcauaaccacugcuucgaucuugcugugguacgcgcagauacagccgcacuggauagccgccagcaucauccuggaguucuuccucaucgugcugcugauccccgagcccgagaagcagcggacgccccaggacaaccagcucaccuacguggucaucgcgauccugaccgugguggccgcgaccauggcuaacgagaugggcuuccuggaaaagacgaagaaggaccucgggcugggguccaucgccacccaacagccggagagcaacaucuuagauauagaccuccgccccgccuccgccuggacccuguacgcaguagccaccacauucgugacccccaugcugcggcacagcaucgagaacucgucggugaacgucucgcucaccgccaucgccaaccaagccaccgugcugaugggccuagggaagggcuggccccucuccaagauggacaucggggugccgcugcucgcgaucggcugcuacagccaggucaacccgaucacacucaccgccgcccugcuacuccugguggcccauuacgcgaucaucgggcccggacugcaggccaaggcgacccgagaggcccagaagcgggccgcggccggcaucaugaagaaccccacuguggacggaaucaccgucaucgaccuagacccgauccccuacgaccccaaguucgagaagcagcugggccaggugaugcugcucaucuuaugcgugacccaagucuugaugaugcgcaccaccugggccuuaugcgaggcucucacgcuggccaccgggcccauuuccacccucugggagggcaacccagggcgguuuuggaauaccacgaucgcggugucaauggcaaacauuuuucgcggcuccuaccuggccggcgccgggcuccucuucagcaucaugaagaacaccaccaacaccagaaggggcacaggcaacaugggugagacccugggcgagaaguggaagucccgccuaaacgcucucgggaaguccgaguuucagauuuacaaacgguccggcauacaggagguggaccgcacccuagcgaaggaggggaucaagcggggcgaaaccgaccaccacgccgugagccgcggguccgccaagcugaggugguucguggagcgcaauauggugacccccgaaggcaaggugguggaccucggcugcgggcggggcgguuggagcuacuacugcggagggcuuaagaaugugcgcgaggucaagggccugaccaagggcgggcccgggcacgaggaacccaucccgauguccaccuacggguggaaucucgugcggcugcagagcggcguggacgucuucuucaucccgcccgagaagugcgacacccugcucugcgacaucggggaguccagccccaacccgacgguugaggcuggccggacccugaggguguugaaucuggucgagaacuggcugaacaacaacacccaguucuguaucaaagugcugaacccuuacaugcccagcgugaucgagaagauggaggcgcugcagcgcaaguacggcggggcgcucguccggaacccgcugagccgcaacucuacccaugagauguacuggguguccaacgccagcggcaacaucgugucaucugucaacaugaucucccggaugcugaucaaccguuucaccaugcggcacaagaaggcgacguacgagcccgacguugaccucgggagcggcacucgcaauaucgggaucgaguccgagauccccaaccuggacaucaucgguaaacggaucgagaagaucaagcaagagcacgaaaccagcuggcauuacgaccaagaccaccccuacaagaccugggccuaccacggcuccuacgagacgaagcagacggggagcgcguccagcauggucaacggcgucgugcgccugcucaccaagccaugggacgugcugccgacagugacucagauggccaugaccgauaccacacccuucgggcaacagcgcguguucaaggagaagguggacacgcggacccaggagccuaaggagggcacuaaaaagcugaugaaaaucaccgccgaguggcucuggaaggagcugggcaagaagaagaccccucgcaugugcacccgggaggaauucacccgcaagguccggaguaacgccgcccugggcgcuaucuucaccgacgagaacaaguggaagagcgcccgggaggccguggaggacagccgguucugggagcucguggacaaggagcgcaaccuccaccuagaggguaagugcgagacgugcgucuauaacaugauggggaagcgggagaagaagcucggagaauucgggaaggcaaagggcagcagagccaucugguacauguggcuuggcgcgcgguuccuugaguucgaagcccucgguuuccuuaacgaggaccauugguucagucgcgagaacagccugagcggcguggagggggagggacuccacaagcugggguacauuuugcgggauguuagcaagaaggagggcggcgccauguacgccgacgacaccgcgggaugggacacccgcaucacccucgaggaccuuaagaacgaggaaaugguuacuaaccacauggagggcgagcacaagaagcuggcagaggcgauuuucaagcucaccuaccagaacaaggugguccgggugcagcgcccggcgccccgggguaccgugauggacaucaucagccgccgugaccagcgcggcucagggcaggucggcaccuacggccugaacacguucaccaacauggaggcccagcugauucggcaaauggagggggagggcguguucaagaacauccaacaccugacggugaccgaggaggucgcggugcagaacuggcuggcccgcgugggucgcgagcggcugagccgcauggccauaaguggggacgacugcgucgugaagccccucgacgaucgguucgcuaacgcccuuacggcacugaaugacaugggcaagauccgcaaggacauccagcagugggagccguccaagggguggaacgacuggacccaggugcccuucugcucccaccacuuccaugagcucaucaugaaggauggcagaguccugguggugccgugccguaaccaggacgagcugaucgggcgggcccguaucagccagggggccggguggucccuccgggagaccgccuguuuaggcaagagcuaugcccagauguggucccugauguacuuccaccgccgggaccuccgccuugcugccaacgccaucugcagcgccguccccucccacugggugccgaccagcagaacgaccugguccauacacgccaagcacgaguggaugaccaccgaggacaugcugaccguguggaaccgcgucuggauucgggagaauccguggauggaagacaaaacgcccgucgagucaugggaggagauacccuaccucggcaagcgcgaggaccaguggugcgggucccugaucggccugaccagccgggcgaccugggccaaaaacauccaggcagccaucaaccaggugcgcucccuaaucgggaacgaggaguacacagacuacaugccgagcaugaaacgguuccgccgcgaggaggaggaggcgggcguccuuugguga

SEQ ID NO: 25330 - RNA, 9876 nt, Artificial Sequence
  derived and/or modified CDS sequence (opt11) from DENV-2__FJ410195__SS-prME
ucagcugggaugaucaucaugcugauucccacugucauggccuuccaccucaccaccaggaauggggagccccacaugaucgucgggauccaggagaagggcaagucucugcuguuuaagaccgaggacggcgugaacaugugcacccucauggcgauggaccugggggagcugugcgaagacaccaucaccuauaagugcccgcuccugcggcagaacgagcccgaagacaucgacugcuggugcaacucuacguccaccuggguuacguacgguaccugcacuaccaccggcgagcaccgccgggagaagcgcagcguggcccuggugccccacguggguaugggccucgagacgcggaccgagacauggauguccagcgagggggccuggaagcaugcccagcgcaucgagaccuggaucuuaaggcaucccggguucacgaucauggccgcgauucuggccuacaccaucgggacuacccacuuccagagaguccucaucuucauucuguuaaccgccguggcccccagcaugacgaugcggugcaucggcaucagcaaccgcgacuucguggagggugucuccgguggcagcuggguggauaucguucucgagcacggguccugcguaaccaccauggcgaagaauaagccaacacuggacuuugagcucaucaagacggaagccaagcaacccgccacccuccggaaguacugcaucgaggcgaagcuuaccaacacaaccacugagucgcgcugucccacccagggcgagccuagucuaaaagaggagcaggacaagagauucgucugcaagcauagcaugguggaucgcggcugggggaacggcuguggccuguucggcaaaggcgggauagucacgugcgccauguucacguguaagaagaacauggagggaaagaucgugcagccagagaaccuggaauacacaaucguugugacuccccacuccggggaggagcacgcggugggcaacgacacgggaaagcacggcaaggaaauaaaggugaccccgcagagcucaauuaccgaggccgagcugacaggguacggcaccgucacgauggaaugcagcccucggaccggccucgacuucaacgagauggugcuucugcagauggagaacaaggccuggcucgugcaccgccagugguuccuggaccugccccuccccuggcugccgggggccgacaagcaggaguccaacuggauccagaaggagaccuuggugaccuucaagaacccccacgccaagaagcaagacguggucgugcucggcagccaggagggggcgaugcacacggcccucacuggcgccacagagauccagaugagcagcgggaaucuccucuucaccggccaccugaagugcaggcugcgcauggacaagcuccagcugaagggcaugagcuauagcaugugcacggggaaauucaagguagucaaagagaucgccgagacccagcacggcacuaucgucauucgugugcaguacgagggggauggcagucccugcaagaucccuuuugagaucauggaccuggagaagcgcuacgugcucggacgauugauaaccgugaauccgaucgugacagagaaggacucccccgucaacaucgaggccgagccgcccuucggagacagcuacaucaucaucggcguggagccgggucagcugaagcucaacugguucaagaaggguuccagcaucggucagauguucgagacuaccaugcgcggcgccaagcgcauggccauccuaggcgacaccgccugggauuucggguccuugggcgggguguucacgagcaucggaaaggcccuccaccaggucuucggggccaucuacggcgcggccuucuccggcgugagcuggaccaugaagauucugaucggggugaucaucaccuggaucggcaugaacucccggagcaccucccuaucgguaucccuugugcucguggggaucgucacgcuguaccugggcgugauggugcaggccgacagcgggugugucguguccuggaagaacaaggagcucaagugcggcucggggauauucaucaccgacaacguacacaccuggaccgagcaguacaaguuucagccugagucacccuccaagcuggccagcgcgauccagaaggcccaggaggaggggauaugcggcauccgcuccgugacgcggcuggagaaccucauguggaagcagaucacccccgagcugaaccacauccucgccgaaaacgaggucaaguuaacgaucaugaccggcgacaucaagggcaucaugcaggccgguaagcgcagccugcggccgcagcccacagagcugaaguacucuuggaagaccuggggcaaagccaagaugcucagcaccgaguccuacaaccaaaccuuccugaucgacggccccgagacggcggaaugcccgaacaccaaccgcgccuggaacagccuggaaguggaggacuacggguucggcgucuuuaccacuaacaucuggcucaaacugaaagagaagcaggacgccuucugcgacuccaagcugaugagcgccgcgaucaaggauaaucgcgcggugcacgcagacaugggguauuggaucgaguccgcccucaacgacacguggaagaucgagaaggccagcuucaucgaggucaagaauugccauuggcccaagucccacacguuauggagcaacggcguccuggagucggagaugauuauacccaagaaccucgcaggccccgugucgcagcacaacuaccguccaggguaccacacccagaucgcgggcccuuggcaccuggggaagcuggagauggacuucgauuucugcgacggcaccacagugaucgucacggaggacugcgggaaccggggcccgucccuccgcacuaccaccgccagcggcaaacuaaucacugaguggugcugccggagcugcacccugcccccgcucagguacaggggggaggacggcuguugguacgggauggagauccgcccccugaaggagaaggaggagaaucuggucaacucccucgugacagccggccacgggcaggucgauaacuucagccugggcguguugggcauggcccucuuccuggaggagaugcugcggacucgcguggggacgaaacacgcgauacuccugguugccguuuccuucgugaccuugaucaccggcaacaugagcuucaaggaccuagggcggguuguggugaucguaggcgccacuauggccgacgacaucgggaugggcgugacguaccuggcgcugcucgcggcuuucaaggugcguccuaccuucgccgccggcuuacugcuccggaagcuuacguccaaggaacugaugaugaccacgaucggcaucguccuacuaagucagucuaccauccccgagaccguucuggagcucaccgacgcccucgcgcugggcaugauggugcuuaagaucguccgaaacauggagaaguaccagcuggccgugacgaucaugaccauccuguguguccccaacgccguaauccuccagaaugccuggaaggucagcugcaccauccuggccgucguuuccgugaguccccugcuccugacuucaagccgccaaaagacggacuggaucccccuggcgcucacgaucaaggggcugaaccccaccgccauauuccugacuacuuuaucucggacuaacaagaagcgcucguggccgcugaacgaggccaucauggccguaggaaugguguccauccucgcgagcucccuccugaaaaacgacaucccuaugacuggcccccugguggccgggggccuccugaccgucugcuacgugcuuaccgggcggagcgccgaccucgagcuagagcgcgccaccgacgugaagugggaggaucaggccgagaucuccggcagcagccccauccuguccaucaccauaagcgaagacggcuccaugucaaucaaaaacgaggaggaggagcagacccucacgauccugauccguacuggccugcucgucaucuccggccuccugccaauaagcauaccgaucacggcagcggcaugguaucugugggagguuaagaagcagcgcgccggggugcugugggacguccccagccccccgcccauggggaaggccgagcucgaggacggggcguaccguaucaagcagaaggggauccucggauauagccaaaucggcgcuggcguguacaaggaggggacguuccacaccauguggcacguaacacgcggcgccguucugaugcacaaggggaagcgcaucgagccguccugggcagacgugaaaaaggaccugaucagcuacggcggggguuggaagcucgagggggaguggaaggaaggugaggaggugcaaguccuggcccuggagcccggcaagaauccgcgcgcagugcaaaccaagcccggcuuauucaagaccaauaccggcacgaucggagccguuucgcuggacuucagccccggcaccuccggaagccccaucaucgacaagaaagggaaggucgugggccuguaugggaauggcgugguuacccgguccggagccuacgugagcgccaucgcccagaccgaaaagucaauagaggauaaccccgagaucgaggaugacauauuccggaagcgacgccugacaaucauggaccuccaccccggggcgggcaagaccaaacgguaucugccggccaucguacgcgaggccaucaagcgggggcugaggacacucauacuggccccgacgcgggucguggcggcagagauggaggaggcccugcgcggcuugcccauccgguaccagacgcccgccauacgcgcggaacauaccggacgcgaaaucguggacuuaaugugccacgcgacauucacaaugcggcugcucagccccguccgcgugccgaauuacaaccugaucauaauggacgaggcgcacuuuacggauccugccucaaucgccgcccggggcuacaucagcacccgcguggagaugggagaggcggcaggaaucuucaugacggccacgccacccgggagccgggauccauucccccaguccaacgcccccaucaucgaugaggagcgcgagauccccgagcggagcuggaacucggggcacgagugggucacggauuucaaggguaagaccgucugguucguaccgagcauuaaggcggggaacgacauagcggccugccugcgcaaaaacggcaagaagguuauccaacucucccguaagaccuucgacagcgaguacgugaaaacccgcacuaaugauugggacuucgucgucaccaccgacaucuccgaaaugggcgccaacuucaaagccgagcggguaaucgacccacgccggugcaugaagccugugauucugaccgacggggaggagcgcguuauccuggccggccccaugccggugacgcacagcuccgccgcccagcgccgcgggcggaucggccgcaacccgaagaaugagaacgaccaguauaucuauaugggggagccccucgagaacgacgaggacugcgcccacuggaaggaggcaaagaugcugcuggacaauaucaacacccccgaggguaucauaccuagcauguuugagcccgaaagagaaaaggucgacgcaaucgacggcgaguaccgccuccgcggggaggcaaggaagacuuucgucgaccugaugcgccggggcgacuuaccugugugguuagccuauaaggucgccgccgagggcaucaacuacgcagaccgccgguggugcuucgacggcaucaagaacaaccagauccuggaagagaaugucgagguggagaucuggaccaaggagggggagcggaagaagcugaagccgcgguggcucgacgcccgcaucuacucggacccccuggcccugaaggaguucaaggaguucgccgcgggucgcaagucccucacgcugaaucugaucaccgagaugggucgccuccccaccuucaugacccagaagacgcgggacgcgcuggacaaucuggccguacuccacaccgccgaggccggggggcgcgcguacaaccacgcacuguccgagcugcccgaaaccuuagagacccuguugcuccugacgcugcucgccaccgugaccggggguaucuuucuguuccugaugagcggccgggguaucggcaaaaugacccucgggaugugcugcaucaucaccgccuccauucugcucugguacgcccagauccagccgcacuggaucgccgcaagcaucauucuugaguucuuccuaaucgugcugcucaucccggagcccgagaagcagcgcacgccacaggacaaccagcugaccuacgucgugaucgccauccuuaccguggucgccgcuaccauggcgaacgagaugggcuuccucgagaaaacgaagaaggaccuggggcuaggcuccaucgccacccagcagccugagagcaacauacuagacaucgaccugcggcccgccuccgccuggacccuauacgccguggcgaccacguuugugacgcccaugcuccgccacaguauugaaaauagcucagucaacgugagccugacugcaauugccaaccaagccaccguguugaugggcuuggggaagggcuggccccuaucaaagauggacaucggggucccacugcucgccaucggcugcuacagccaggugaaccccaucacgcuaaccgcggcccugcuacuccuuguggcccacuacgccaucaucggccccggccuccaggcgaaggccacccgggaggcacagaagcgcgcggccgcgggcauaaugaagaaccccaccgucgacgggaucacggugaucgauuuggacccaauccccuacgacccgaaguucgagaagcagcugggacaggugaugcuccugauccugugcgugacccagguucucaugaugagaaccaccugggcgcuaugugaagcccucacgcuggcuaccgggcccauuuccacccuaugggagggcaacccggggcgcuucuggaacaccacgaucgcagugagcauggcgaacaucuuccggggcucuuaucuggcuggcgcgggccuucuguucagcaucaugaagaacacaaccaacacacgccgcggcacggggaacaugggagagacacugggugagaaguggaagucccgacucaacgcccuggggaagaacgaguuccagauuuacaagaaguccggaauccaggaagucgaucggacccuggccaaagaggggauuaagcggggcgagaccgaccaucaugcggugucccgcgggagcgccaagcuucgcugguucguggagcgcaacauggugacgcccgaaggaaaggugguagaucugggcugugggcggggcggguggucauauuacugcggcgggcugaagaauguccgcgaggugaagggcuuaaccaagggcgggcccggccacgaggaacccaucccgaugagcaccuacggguggaaccugguccgccugcaguccggugucgacguguucuucauuccgcccgagaagugcgacacucuccuuugcgacaucggcgaaagcucccccaauccgacgguggaggccggccgcacccugcggguccucaaccugguggagaauuggcucaacaauaauacccaguucugcaucaaagugcugaaucccuacaugcccagcgucaucgagaaaauggaggccuuacaacgcaaguauggcggggcucuggugcggaacccacuguccaggaacagcacccacgagauguacugggugucgaacgccuccgguaacaucguaagcuccgugaauaugaucagccggaugcucauuaaucgguucaccaugcggcacaagaaggccacguacgagcccgacguggaccuugggucuggcacccgcaacaucgggaucgagagcgagauccccaaccuggauaucaucgguaagcggauagaaaagaucaagcaggagcacgagaccuccuggcacuacgaccaggaucaccccuauaaaaccugggcuuaucacggcagcuacgagacgaagcagaccggcagugccucuaguaugguaaacggggugguacgcuuacuuaccaagccgugggacgucuugccuaccguuacgcaaauggcgaugaccgauaccacccccuucgggcagcagcggguguucaaagaaaaggucgacacgcggacgcaagagccgaaggagggcaccaaaaagcucaugaaaaucaccgccgaguggcuauggaaggaguugggcaagaagaaaacgccgcgaaugugcacccgggaggaguucacucggaaggugcgcucuaaugccgcccucggggccaucuucacggacgagaacaaauggaaguccgcccgcgaagccguggaggauagccgcuucugggaacuggucgacaaggagcggaaucuccaucucgaaggcaagugcgagacgugcguuuacaacaugauggggaaacgggagaagaagcuuggggaguucgggaaggccaagggcucccgugccaucugguauauguggcugggcgcccgguuccucgaguucgaagcgcugggguuccugaaugaagaccacugguuuucgcgggagaacagccucagcggcgucgagggggagggccugcacaaguugggguacauccuacgggacguauccaaaaaagagggcggcgccauguaugcggacgacaccgccgggugggacacccgcaucaccuuggaagaccugaagaacgaagagauggugacgaaccacauggagggcgaacacaaaaagcucgcggaggccaucuucaagcugaccuaccagaauaaggucguccgggugcagcgcccaacgccccgagggacugugauggacaucauuagccgccgggaccagcgcggcagcggccagguggggacguacggccugaauaccuucaccaauauggaggcacagcucauacggcaaauggaaggggaggggguguucaaaaacauccagcaucugaccgucacggaggagguggccgugcagaacuggcuggcccgcgucgggcgcgaacggcucucccgcauggcgauaagcggcgacgacugcgugguaaagccccuagacgaccgguucgcgaacgcucugacagcgcucaaugacaugggcaagauucgcaaggacauccaacaaugggagcccuccaagggguggaacgacuggacccaggucccauuuugcucgcaccacuuccacgagcugaucaugaaggacgggcgggugcugguugugccuugccgcaaccaggacgaguugaucgggcgagcccgaaucucgcagggcgcuggguggagcuugcgagaaacugccugccugggcaaguccuacgcccagauguggagccugauguacuuucaccgccgugaccugcgccuggccgccaacgcgauaugcuccgcgguaccuucucauugggugccaacgucccgaaccaccuggagcauccacgccaagcacgaguggaugaccaccgaggacaugcucacggucuggaaccguguguggaucagggagaaccccuggauggaggauaagacccccguggagucuugggaagagauccccuaucugggaaaacgcgaggaucaauggugcggcagccuuauuggccucacuucccgugccacgugggcgaagaauauacaggcagccaucaaccagguccgaagccugauagggaacgaggaguacacugacuacaugccguccaugaagcgguuuagacgcgaggaggaagaggccggcguucugugguga

SEQ ID NO: 25331 - RNA, 9876 nt, Artificial Sequence
  derived and/or modified CDS sequence (opt11) from DENV-2__FJ432726__SS-prME
agugcgggcaugauaaucaugcugauccccaccguaauggccuuccaccucaccacacgcaacggggaaccccacaugaucguggggauccaggagaagggcaagucgcugcuguucaagaccgaagacggcgugaacaugugcacucucauggccauggaccugggggaacugugcgaggacaccaucaccuauaagugcccgcuccugaggcagaacgagcccgaggacauugacuguuggugcaacagcaccuccaccugggugacguacggaaccugcaccaccacgggcgagcaccggcgggagaagagaucugucgcccugguaccccacguggggaugggccucgaaacucgaacagaaaccuggauguccagcgagggggccuggaagcaugcccagcgcaucgagaccuggauccugcggcauccaggcuucaccaucauggcagcaauccuggccuacaccaucgggaccacccacuuccagcgcguccucaucuucauccugcugacggcaguggcccccucuaugaccaugcgcugcaucggaaucaguaaccgcgauuucguagagggcgucuccggagggagcugggucgacaucgugcucgagcauggaaguugcgucaccaccauggcuaagaacaagccgacgcuggacuucgagcugaucaagaccgaagccaagcagcccgccacccuccggaaguacugcaucgaggccaaacugaccaauacgaccaccgagagccgcugcccuacccagggcgagccuucccugaaggaggagcaggacaagcgguucgucugcaagcauagcaugguugaccgcggcuggggcaacgggugcggccuguucggcaaaggagggauagucacgugcgccauguucacgugcaaaaagaacauggagggcaagaucguucagcccgaaaacuuagaguacaccauagugguaacgccccacuccggggaagagcacgcggugggcaacgacacugggaagcacgggauggagaucaaggucaccccgcagagcuccaucaccgaggccgagcugaccggguacgguaccgucacgauggaaugcucuccccggaccggcuuggacuucaacgaaauggugcugcugcaaauggagaauaaggccuggcucguccaccgccagugguuucucgaccugccccucccauggcugccgggggcggacaagcaggaauccaauuggauccagaaggagacccuggucaccuucaagaauccccacgcgaagaagcaggacgugguggugcucggcagccaggagggggcgaugcacacggcccugacaggagccaccgagauccagaugagcuccgggaacuugcuguucaccggacaucugaaaugccggcuucguauggauaagcuccagcugaagggcaugaguuacuccaugugcacggggaaauucaagguggucaaggaaaucgccgagacccagcacgggaccaucgugauacgcgugcaguacgagggggauggcagccccugcaagauucccuucgagaucauggaccuggagaaaagauacguccucggccggcugaucaccgugaacccgaucgugacggagaaggacucccccgucaacauagaagcagagccgcccuuuggggacagcuacaucaucaucggugucgagccggggcagcugaagcucaacugguucaagaagggcuccuccaucgggcagauguucgagaccaccaugcgaggcgccaagcgcauggcuauauugggggacaccgccugggacuuugggagucugggaggggucuucacgagcaucggcaaagcguuacaccaggucuucggggccaucuacggcgcggccuucuccggcgugagcuggaccaugaagauccugaucggggugaucaucacuuggaucggcaugaauucacggagcacuagucugagcgucucccugguacucguggggaucgucacgcuuuaccugggagugauggugcaggccgacucugggugcgucguauccuggaagaacaaggagcuuaagugcgguuccggcaucuucaucacugauaacgugcacaccuggaccgaacaauacaaguuccagccagagagcccauccaagcuagccagcgcgauccagaaagcccaggaggaggggaucugcggcauccguuccgucacgcggcuggagaaccuaauguggaaacagaucacccccgagcugaaccauauccuggccgagaacgaagugaaacucaccaucaugaccggggacaucaggggcaucaugcaggccggcaagcggucacugcgcccgcaacccacggaauugaaguacuccuggaagaccuggggcaaggccaagaugcugagcaccgagagcuacaaccagaccuuccugaucgacggccccgaaacggcggagugcccgaacaccaaccgcgcguggaacagccuggaggucgaagacuacggguucggagucuucaccaccaacaucuggcucaagcugaaggagaagcaggacgccuucugcgacucaaagcugaugagcgccgccauuaaagauaaucgcgcggugcacgcugacaugggauacuggaucgaguccgcgcucaaugacacguggaagaucgagaaggcaucauucaucgaggugaaaaauugucacuggcccaagucucacacccugugguccaaugggguucuggaaucggagaugaucauccccaagaaccucgccggccccgcgagccagcacaacuacaggccuggguaccacacccagaucgccggccccuggcaccuggguaagcuggagauggacuucgacuucugcgacggcaccaccgugaucguuacggaagauugcgggaaccguggucccucccuccggaccacuaccgccagcggcaagcugaucacggaguggugcugccgaagcugcacccugcccccgcuccgauaucgcggugaggacggcugcugguacgguauggagauccggccccuaaaggagaaggaagagaaccuggucaacucccucguuaccgccggccacggccaaguagacaacuuuagcuugggcguucucggcauggcccucuuucuggaggagaugcuacgcacaagggugggcaccaagcacgccauccuccugguggccgucucguucgugacccugaucaccggcaacaugaguuucaaagaccucgggcgcguggucgugauggugggugcaaccauggccgacgacaucggcaugggcgugaccuaucuggcgcugcuagcagccuucaagguucggcccacguucgcagccggccugcuguuacguaagcugacaucaaaggaguuaaugaugaccacgaucgggaucguauugcuaagccaguccaccaucccagagaccgugcuggagcugaccgacgcgcucgcucugggcaugauggugcuaaagauaguacgcaauauggagaaguaccagcucgccgucacgaucauggccauuuugugugugccgaacgccgucauccuccaaaacgccuggaaagugagcugcacuauauuggcgguggucucugugagcccgcuucuacugacgagcagccagcagaagacugacuggaucccccuggcacucacgaucaaggggcugaaucccaccgccaucuuccugaccacccuaucccggacgaacaagaagcgcagcuggccguugaacgaggcuaucauggccguaggcauggucuccauccucgcgaguucccuccugaaaaacgacauacccaugaccgguccccugguggccgggggccuccugaccgugugcuacguccugaccgggcggucagcugaccucgaacuugagagggcgacggacgugaagugggaggaccaggccgagaucuccggcagcucucccauccuguccaucaccauuagcgaggacgguucgaugagcaucaagaacgaggaggaggagcaaacccucaccauccuaaucaggacgggucugcucguaaucucgggacuguucccgaucagcaucccaaucaccgccgccgccugguaccugugggaggucaagaagcagcgagcgggggugcucugggacgugcccagcccgccgcccauggggaaggccgaacuggaggacggggccuaccggaucaagcagaagggcauccugggcuacagccagaucggcgccggugucuacaaggaggggaccuuccacaccauguggcacgugacccgcggcgccgugcucaugcacaaaggaaaacggaucgaaccauccugggcggacgucaaaaaggaucugaucagcuauggcggcggauggaagcuggagggggaguggaaagagggggaggagguccagguguuagcccuggagccuggcaagaauccccgcgccguccagacuaagcccggacuguucaagaccaacaccggcacgauaggugcgguaucccucgacuucagcccgggcacguccggcucacccaucaucgacaagaagggaaaggugguaggccuguacgguaacgguguggugacccguuccggcgcguacgucagcgcgauagcccaaaccgagaaguccaucgaggacaaccccgagaucgaggaugacaucuuccgcaagcgccgccugaccaucauggaccugcaccccggugccgggaagacgaaacgguaccuccccgcgaucgugcgcgaggcgaucaagcgggggcugcgcacgcugauccucgccccgacccggguggucgccgccgagauggaggaggcccugcgcggccugcccauacguuaucagacccccgcgaucagggccgagcacacggggcgcgagaucguggaccucaugugucacgccaccuucaccaugcgguuacugagcccugugcgcgucccgaauuacaacuuaaucaucauggacgaagcccauuucaccgacccagccaguaucgcugcacggggcuacaucagcacgaggguugagaugggagaggccgccgggaucuuuaugaccgcgacuccacccgguagccgggauccguucccucaguccaacgcgcccaucaucgacgaggagcgcgagauccccgagcggagcuggaacaguggacacgagugggugaccgauuucaagggcaagacgguuugguucgugccuagcaucaaggccgguaacgauauagccgcaugcuuacgcaagaacggcaagaaggugauucagcugucccggaagaccuucgacuccgaguacgucaagacccgcaccaaugacugggacuucguggugacgaccgacauuuccgagaugggcgcgaacuuuaaggccgagcgggucaucgacccccgccgaugcaugaagccuguaauccucaccgacggggaggagcgcgugauccuggccggccccaugccggucacccacagcuccgcggcacagcggcgcgggcgcaucggccgcaacccuaagaacgaaaacgaccaguacaucuacaugggggagccccuggagaacgacgaggacugugcgcacuggaaggaggcgaagaugcuccuggacaacaucaacacgcccgagggcaucauuccgaguauguucgagcccgagcgggagaagguggacgcgaucgauggugaguaccgccuccgcggggaggcccggaagaccuucguggaccucaugcgcaggggcgaccuaccagucuggcuggcguacaaggucgcggccgaggggaucaacuacgccgacaggcgguggugcuuugacggcaucaagaauaaucagauccucgaggagaacguggaggucgagauuuggaccaaagagggggagcgcaagaaguugaagccccgauggcuggacgcccgaauuuacuccgacccccuugcccugaaagaguuuaaggaauucgcggccggccggaagucccugacccuaaaccugauaacggaaaugggccggcugcccacguuuaugacccagaagacccgggacgcccucgacaaucuggccguccugcacacugcggaggccgggggccgcgccuacaaccacgcacucuccgagcugcccgagacccuggagacccuccugcugcucacgcugcuggccacgguuaccggggguaucuuccuauuccugauguccggccgggggaucggcaagaugacccuggggaugugcugcaucaucaccgcguccauccuccuaugguacgcccagauucaaccgcacuggaucgccgccagcaucauucuggaguucuuucucaucgugcuccugauccccgagcccgaaaagcagcgaaccccccaggacaaucagcucacguacgugguaauugccauucugaccguuguagcggccaccauggccaaugagauggguuuccucgagaaaaccaagaaggacuugggccugggguccaucgccacgcagcagccugagagcaacauacuggacaucgaucuccgaccggccuccgcguggacccuguacgccgucgccaccacauucgugacgcccaugcugcgccacagcaucgagaacagcuccguuaacguaagccucaccgcuauugccaaccaggcgacaguucugaugggccuggggaagggcuggccccucuccaagauggacaucgggguaccgcugcuggccaucgggugcuacagccaggucaaccccaucacccuaacggccgcccuacuucuccugguggcgcacuacgccaucaucgggcccggucugcaagccaaggccacuagggaggcccagaagagagcggccgccggcaucaugaagaaucccaccgucgacgggaucacagucaucgaccucgacccgauccccuacgaccccaaguucgagaagcagcuaggccaggucaugcugcucauccugugugugacgcagguccugaugaugcggaccaccugggcccucugcgaggcccugacccuggcgaccggucccauauccacccucugggagggcaauccggggcgcuucuggaacaccaccaucgccgugaguauggcgaacaucuuucgggggucguacuuggcuggcgccggccuccucuucagcaucaugaagaauacgaccaauacacgucgcggcaccgggaacaucggcgagacgcugggagagaaguggaaaucacggcucaacgcgcucggcaagagcgaauuucagaucuacaagaaguccggcauccaggagguggaccgcacccuggccaaggagggaaucaagcggggcgagaccgaccaccacgccgucagccgcgguucagccaagcugcggugguucguggaacgcaacauggugacccccgaaggaaaggucguggaccucggcugcggucggggcggguggagcuacuacugcgggggucugaaaaaugugcgcgagguuaagggccuaacgaagggcgggccgggucacgaggagcccauaccgauguccaccuacgguuggaaccucguuaggcugcaaaguggcguggacgucuucuucaucccgcccgagaaaugcgacacccugcucugcgauauaggggaaucgagccccaacccgacuguggaggcgggccgcacgcugcgaguguuaaaccucgucgagaacuggcuaaauaacaacacacaguucugcauaaagguacugaaccccuacaugcccucugugaucgagaagauggaggcgcugcagcgcaaguacggcggggcacucguccggaacccguugucaagaaauagcacccacgagauguacuggguguccaacgccagcggcaacaucguuuccagcguaaacaugaucaguagaaugcugaucaacagguuuaccaugaggcacaagaaagcaaccuacgagcccgauguggaccucgggucuggcacgcgcaauaucgggauugaguccgaaauccccaaccuggacaucaucggcaagcggaucgagaagaucaagcaggagcacgagacuagcuggcacuacgaccaagaucaucccuacaagaccugggcauaccacggcuccuacgagacuaagcagacagggagcgccuccagcauggugaacggcgucguaagguuacucacaaaaccgugggacgugcugcccaccgucacccaaauggccaugacggacaccacccccuucggccaacagcguguguuuaaggagaaaguggacacgcguacgcaggagcccaaggagggcaccaagaagcugaugaagauaaccgccgagugguuauggaaggagcugggcaaaaagaagaccccgcgcaugugcacgcgggaagaguucacccgcaagguccgguccaacgccgccuugggggccaucuucaccgacgagaauaaguggaagucugcccgcgaagccguggaggacucccgguucugggaacucguggauaaggagcgcaaccugcaccuggagggaaagugcgagaccugcgucuacaacaugauggggaagcgggagaaaaagcucggcgaauucgggaaagccaaaggcagcagggcgaucugguauauguggcugggcgcacgguuccuugaguuugaggcucucggguucuuaaacgaggaucacugguucucccgagagaauagccuaucgggaguggagggggaaggccuccauaagcugggguacauccugcgggacgucagcaagaaggagggcggagcgauguaugcggacgacacggccgggugggacacccgaaucacucucgaggaccugaagaacgaggaaauggugaccaaccacauggagggugagcauaaaaaacuggcagaggccaucuucaagcucacguaucagaacaagguuguccgggugcaaagaccuaccccccgugggaccguuauggacaucaucagcaggcgggaccagcgcggcuccgggcaggucggcaccuacggccugaacacguucaccaacauggaggcacagcugauaagacagauggagggggaggguguguucaagaacauccagcaccucacggugaccgaggaggucgcgguucauaacuggcuugcucgugugggucgcgagcggcugagccgcauggcuaucuccggcgacgacugcgucgugaagccccucgaugaccgcuucgccaacgcccugaccgcgcugaaugacaugggcaagauccgcaaggacauccagcagugggagcccagcaagggguggaacgauuggacccaagugcccuucugcucccaucacuuccacgagcucaucaugaaggacggccggauauuagucgugcccugccgcaaccaggacgagcugaucggacgggcucgcaucagccagggcgccggguggucccucagggagaccgccugccuaggaaagagcuacgcccagauguggucccugauguauuuccaccgacgggaccuccgccuggcggccaacgccaucugcuccgcugugcccucccacuggguuccgaccucacggacgaccugguccauccacgccaagcacgaguggaugacaacggaggacaugcugaccguguggaacaggguguggauccgggaaaacccauggauggaggacaagacgccugucgagagcugggaagagauucccuaucucggcaagcgcgaggaccaguggugcgggucccugauuggccucacuagccgcgcgaccugggcuaaaaacauacaggccgcuaucaaccaggugcggucccucaucggaaaugaggaguacaccgacuacaugccguccaugaagcgguuccgccgagaggaagaagaggcgggggugcugugguag

SEQ ID NO: 25332 - RNA, 9876 nt, Artificial Sequence
  derived and/or modified CDS sequence (opt11) from DENV-2__JF730049__SS-prME
agcgcggggaugauuaucaugcugauccccaccguuauggccuuccaccucaccacccgcaacggggagccccauaugaucgucgguauccaggaaaagggcaagagccugcuuuucaagaccgaggacggcgugaacaugugcacccucauggcgauggaccugggggagcugugcgaggacaccauaacuuacaaguguccccuccugcggcagaacgagccugaggacaucgacugcuggugcaacagcaccagcaccuggguaacuuaugguaccugcaccaccaccggcgagcaccgccgagaaaagcgcagcgucgcgcuggugccgcacgucgggaugggucucgagacucggaccgagaccuggaugucaagcgagggggcguggaagcacgcacagcgcaucgaaacauggauccugcggcacccgggcuucacgaucauggcugcgauucuggcguacaccaucgggaccacccacuuccaacgugugcucauauucaucuuauuaacggccguggcccccaguaugaccaugcggugcaucgggauaagcaaucgugacuucguggaagguguaucugggggcagcuggguggacaucgugcucgagcacgggaguugugucaccaccauggcgaaaaacaagcccacucuggacuuugagcugaucaagacagaggccaagcagcccgccacccuccggaaguacugcauugaggccaagcuaaccaauacuaccacggagagucgcugcccaacccagggcgaacccucacugaaggaagagcaagacaagcgguucguuugcaagcacagcaugguggacagagguuggggcaacggcugcggccuguucggcaagggcgggaucgucacgugcgccauguucacuugcaagaagaauauggagggcaagaucguacagccggagaaccucgaguacaccaucguggucacgccccauuccggggaggagcauguggugggcaacgacacggggaagcacggccaggagaucaaagucaccccgcagagcuccaucacugaggcggaacugaccggguacggaacggugacgauggagugcagcccccggaccggguuagacuucaacgagauggugcuguugcaaauggaaaacaaggccuggcucguccaccgccagugguucuuagacuuaccccuccccuggcugccgggggccgacaaacaggagaguaacuggauccagaaggagacccuggugaccuucaaaaacccccacgccaaaaagcaggacgucguggugcucggcagccaagagggggccaugcacacggcucugaccggcgccaccgagauccagaugaguuccggaaacuuacucuucacuggccaccugaaaugccgccugcgcauggacaagcuccagcugaaaggcaugagcuacuccaugugcacggguaaguucaaggucgugaaggagaucgccgagacccagcacggcaccaucguuauucguguccaguaugagggggaugguagccccugcaagaucccguucgagaucauggaccuggagaagcgcuacguccucgggcggcugaucaccgugaacccgaucgucacggagaaggacucccccgugaacaucgaggccgagccacccuucggggacagcuacaucauaaucggcguugagccggggcaacugaagcucaacugguucaagaagggcuccaguaucgggcagauguucgaaacuaccaugcgcggcgcaaagcgaauggcgauccugggcgacaccgcaugggacuucgggucccugggcggggucuucacaagcaucggaaaggcccuccaccagguguucggagcaaucuacggcgcugcguucuccggcguuagcuggaccaugaagauccuuauuggggucaucauaaccuggauaggcaugaacucccggagcacuagccugagcgugucccuggugcuggucgggaucgugacgcuguaucucggcgugaugguccaggcagacagcgggugcgugguguccuggaagaacaaggagcucaagugcggcagcggcauuuucaucacugacaacguucacaccuggacagagcaguacaaguuccaaccggagagcccauccaagcucgccucggccauacagaaggcgcaggaagagggaaucugcggcauccgcuccgugacgcggcuggagaaccucauguggaagcagaucacccccgagcugaaccacauccucaccgagaacgaagucaagcucacgaucaugacgggggacauaaagggcaucaugcaggcgggaaagcgcagccugcggccgcagcccaccgagcugaaguacuccuggaaaaccuggggcaaggccaagauguuuagcaccgaguccuacaaccagacguuccucaucgacggccccgaaaccgccgagugcccgaauaccaaccgggccuggaacagccuggaggucgaagacuacggguuuggcguguucaccacgaacaucuggcugaagcucaaagagaagcaagacgcguucugugacuccaagcugaugagcgccgccaucaaggacaaccgggccgugcacgccgauauggguuacuggauagagucggcgcuuaacgacaccuggaagaucgagaaggccagcuucauugaggucaagaacugucacuggcccaagucccauacacuuugguccaacggagugcuggagagcgagaugaucauccccaagaaccuggcuggccccgugagccagcauaacuaccgcccgggguaccacacccagauugcuggcccauggcaccuggggaaacuugagauggacuucgacuucugcgacggcaccacgguuaucgugaccgaggacugcggcaaccggggccccuccuugcgcacgaccacagcgagcggcaagcucaucaccgagugguguugccggucgugcacccugcccccgcugcgcuaccgcggggaggacggcugcugguauggcauggagauccgucccuuaaaggagaaggaggagaaccuggucaacucgcuggucaccgccggccacggccagguggacaacuucagccucggcgugcugggcauggcccuguuccuugaggaaaugcuuaaaacgcggguugggacaaagcacgcaauacugcucguggcagucuccuucgucacccugaucaccggcaacaugagcuucaaggaccuggggcgcgugguggucauggugggcgcaacgauggccgacgacaucgggaugggcguuaccuaccucgccuugcuggccgccuuuaaaguccggcccacauucgcggccggacuccugcugcgcaagcucaccuccaaggagcugaugaugacgacaauugggaucgugcugcucagccaguccaccaucccagaaaccgugcuggaacuuacugaugcccucgcccugggcaugaugguccugcggaucgugaggaacauggagaaauaccagcucgccguaaccaucauggcuauccuaugcgugccgaacgccgucauccugcagaaugcauggaaggucaguuguaccauccucgccguagucuccguuaguccgcugcugcucaccuccagccagcagaagacagacuggaucccccuggcccugaccaucaagggacuuaauccaaccgcgaucuuccugaccacgcuaucucgcaccaacaagaagcggagcuggccgcucaacgaggccauuauggcggugggcaugguguccauccuggccagcucccugcucaaaaacgauauccccaugaccggcccucugguagccggugggcugcuuaccgugugcuaugugcugacggggcgaagcgccgaccuggagcuugagagggcaacagacgucaagugggaagaccaagccgagaucucugggaguagcccgauccuguccaucacaauaagugaggacggauccaugagcauaaagaacgaagaggaggagcaaacccugacgauccuaauccgcaccggccugcuggugaucagcggccucuucccgauuagcauccccaucacagccgcggccugguaccugugggaagugaagaagcagcgugccgguguccucugggacgugcccucaccgccgcccaugggcaaggcggaacucgaggauggggcguaccguaucaaacagaagggaauccugggguacagccaaaucggugcgggcguuuacaaggaggggaccuuccacacuauguggcacgucacgcggggcgcagugcugaugcauaaggggaagcgcaucgagcccuccugggccgacgugaagaaggaccucaucagcuacggcgggggguggaaacuggaaggggaguggaaggagggggaggagguccaggugcuugcacuggagccaggaaagaacccccgggccguacaaaccaagccugggcuguucaagacuagcaccggcacgaucggggcugugagccuggauuucucccccggcaccuccggguccccgauuaucgacaaaaaggggaagguggugggccucuacgggaacggcgucgugacccgcagcggcgccuacguguccgcaaucgcccaaaccgagaaguccaucgaggacaacccugagaucgaggacgacaucuuucgcaagcgccggcugacaauuauggaccugcaccccggggcuggcaagacuaagcgcuaucugccggcgaucguccgggaggccaucaagcgcggacuccggacccucaucuuggcccccacccgcgugguugccgcugagauggaggaggcccugagaggccugcccauccgcuaucagacgccagccauucgggccgagcacaccggccgcgagaucgucgaccugaugugccacgccacauucaccaugcgccuccuguccccggugcgggucccgaacuacaaccugauaaucauggacgaagcgcacuucacggaccccgccagcauagcggcgcgcggcuacauaagcacccgggucgagaugggcgaagccgcggggauuuucaugaccgcaacgccucccggcucccgcgacccguucccccagagcaacgcgccaaucaucgacgaggaacgggagauccccgaacgcuccuggaacagcggucacgaauggguuacggacuucaagggaaagaccguaugguucguaccguccaucaaagcuggcaaugauaucgccgcgugccuacggaagaacgggaagaagguuauccaacugagccgcaagaccuucgacuccgaguacgugaagacgcggacaaacgacugggacuucguugugaccacggacaucagcgagaugggcgcgaacuuuaaggccgagagagugaucgacccccggcgcugcaugaagccggugauccugacggacggggaagagcgagugauccucgcuggucccaugccaguuacccauuccucggccgcacagcgccgggggcgcaucggcaggaacccaaaaaacgagaacgaccaguacaucuacaugggggagccccuggagaaugaugaggauugcgcccacuggaaggaagcuaagaugcuccuugacaauaucaacacccccgagggcaucaucccgucaauguucgagcccgagcgcgagaaggucgaugccauugacggagaguaccggcugcgcggggaggcgcgcaagaccuucguggauuugaugagacgcggggaccuccccguguggcuggccuacaaagucgccgcagagggaaucaacuaugccgaccggcgcuggugcuucgacggcaucaagaauaaccagauccuggaggagaacguugaggucgagaucuggaccaaagagggggagcggaagaagcucaagccgcgcuggcuggacgcgcggaucuacagcgauccccuggcccucaaagaguucaaggaguucgccgccggucgcaagucccugacccugaauuuaauuaccgagaugggccggcuucccaccuucaugacccagaagacgcgagacgcccucgacaaccucgcgguuuuacauaccgcugaggccgggggccgggccuacaaccaugcgcucagcgaacucccagaaacccuggagacccugcuccuccugacccuccuggcaaccgucaccgguggcaucuuccuguuccuuauguccggccgcggaauuggcaagaugacccuggggaugugcugcauaaucaccgcaagcauccugcucugguacgcacagauccagccgcacuggaucgccgcuuccaucauccuggaguucuuucugaucguccuccugaucccugagccugagaagcagcggacgccccaggacaaccagcugacauacguggugaucgccaucuugaccgucguggccgccaccauggccaacgagaugggcuuccuggaaaagacgaagaaggaccuggggcucggcagcaucgcgacccaacagccggaguccaacauccuggacauugaccugcggcccgccagcgccuggacacucuacgccguggccacuacguucgucacgcccaugcuacggcacagcaucgagaacuccagugugaacgugucgcucaccgcgaucgccaaccaagccaccguccucaugggcuuagggaagggcuggccucugagcaagauggacauuggggugccguuacuggccaucggcuguuacucccaggugaaccccaucacgcugaccgccgcguuacugcugcuuguagcccacuacgccaucaucgggcccggccugcaagccaaggcgacccgcgaggcccaaaagcgggccgccgccggcaucaugaagaaccccacuguggacgggaucacagugauagaccuugacccgauucccuacgaccccaaguucgagaagcaacucggccagguuauguuacugauccucugcguuacgcagguucugaugaugcgcaccaccugggcgcugugcgaggcccucacgcuggccaccgggcccauuucaacccugugggagggcaauccgggccgguucuggaacacaacgauagccgucuccauggccaacaucuucagaggcagcuaccucgcgggcgcuggucuucuguucucuauuaugaaaaacaccaccaacaccagacgcggaacggggaacaugggcgagacccucggcgagaaauggaagucccgccugaacgcacucgggaaguccgaguuccagauauauaagaaauccggcauacaagagguggaccggacccucgccaaggaggggaucaaacgcggagagaccgaccaucacgccgugucccgggggagcgcgaagcugcgcugguuuguagagcgcaacauggugacgcccgagggcaagguggucgaccuggguugcgggcgcggcggguggaguuacuacugcggcgggcucaagaacgugcgggagguaaagggcuuaaccaagggcgggccuggccaugaggagcccauaccgaugagcaccuacggauggaaccuuguucgucuccaguccgguguggacguguucuuuaucccgccugagaaaugcgauacacugcugugcgacaucggggaguccucccccaacccgacggucgaggccggccgaacccuccgagugcugaacuuaguggagaacuggcucaauaauaauacccaguucugcaucaaggugcugaaccccuacaugcccagcgugauagagaaaauggaggcccugcagcggaaauacggcggggcccuuguccgcaauccguugagccggaacuccacccacgagauguacugggucagcaacgcuuccggcaacaucgugucguccgugaacaugaucucacggaugcugaucaaccgguucaccaugcgccacaaaaaagccaccuacgagccagacgucgaucugggcucaggcacccggaauaucgggaucgagagugagauccccaaucucgacaucaucgggaagcgcaucgagaagauaaagcaggagcacgagaccucguggcacuaugaccaggaccaucccuacaagaccugggcuuaccacgguaguuacgagacgaagcagacuggguccgccagcuccauggugaacggagugguccggcuguuaaccaaaccgugggacgugcucccuaccguuacucagauggcaaugaccgacaccacccccuucgggcagcagcgcgucuucaaggagaagguggacacgcgcacgcaggaaccgaaggagggcaccaaaaagcugaugaagauaaccgcggaauggcuguggaaagaacucggcaagaagaagacgccgcggaugugcacacgcgaagaguucacccgaaagguccgcagcaacgccgcccugggggcuaucuucaccgacgagaacaaguggaagucagccagggaggcugucgaggacagccgcuucugggagcugguggacaaggagcggaaccuccacuuggaggggaagugcgagacgugcgucuauaacaugaugggaaagcgcgagaagaaauuaggcgaguucgggaaggccaaaggcucucgggccaucugguacauguggcucggcgcccgcuuccucgaguucgaggcccuuggguuccuaaacgaggaucauugguuuagccgggagaacucccugucaggcguggagggcgagggccugcacaagcucgguuauauucugcgcgacgugagcaagaaggaggguggugcgauguacgccgaugauaccgcugggugggacaccagaaucacccuggaggaccucaagaacgaagagauggucacgaaccauauggagggcgagcacaaaaagcuggccgaggcgaucuucaagcuaaccuaccagaacaaagugguacgcguccagcgucccacaccacggggcacggugauggacaucaucucccggagggaucagcggggcagcggccagguggggacuuacggccucaacaccuucaccaacauggaggcccagcuaauccgccagauggagggggagggcgucuucaagaacauccagcaccugaccgugacggaggaggucgccguccagaacuggcucgcccggguggggcgcgagaggcugucccggauggccaucagcggcgacgacugcguggucaaaccacuggaugaccguuucgcgaacgcacucaccgcccugaaugauaugggcaagauccggaaggauauccagcagugggagccguccaagggguggaacgacuggacgcaggugcccuucuguagccaccauuuucacgagcugaucaugaaggacggacgcgugcucgucgugcccugcaggaaccaggacgagcugaucgggcgcgcccggaucucccagggcgccgguuggucccugcgggaaaccgcgugucucggcaaguccuaugcccaaauguggucacugauguacuuccaccggcgcgacuugcggcucgccgccaacgccauaugcuccgcggugcccagccacugggugccgacuucgagaaccaccuggagcauccacgccaagcacgaguggaugaccaccgaggacaugcugacgguguggaaccggguguggauccgcgagaaccccuggauggaggauaagacccccgucgaguccugggaagaaauucccuacuuagggaagcgagaggaccaguggugcgggagcuugaucggccugaccucccgcgccaccugggcaaagaauauacaggcugcgaucaaccaaguccgaagccucauagggaucgaggaguacacugacuacaugccgaguaugaaacgcuuccggcgcgaggaggaggaggccggcgugcuaugguga

SEQ ID NO: 25333 - RNA, 9876 nt, Artificial Sequence
  derived and/or modified CDS sequence (opt11) from DENV-2__FJ562098__SS-prME
agcgcggggaugauuaucauguuaaucccaaccgucauggcguuccaccuaacuacccgcaauggggagccccacaugaucgucgggauccaggagaagggcaaaagucuguuauucaagacugaggacggcgugaacaugugcacccucauggcgauggaccugggggaacugugcgaagauacgaucacauacaagugcccacuccugcggcagaacgagcccgaagacaucgacugcugguguaacagcaccuccacaugggugaccuacgggaccugcacgaccaccggcgagcaucgccgggagaaacgcagcgucgcucuggugccccauguggggaugggccuagagacgcggaccgagaccuggauguccagcgagggggcauggaaacaugcacaacgcaucgagacauggauccuccggcacccgggcuucacaaucauggcugcgauccuggcauauacgaucgguaccacccacuuccagcggguccuaaucuucauucugcugacggccguggcccccuccaugaccaugcggugcaucggcaucucuaaccgggacuucguggagggcgucagcgggggcagcugggucgacaucgugcucgaacacggguccugcgucaccaccauggcuaagaauaagcccacgcuggacuuugaacugaucaagaccgaggcaaagcagcccgccacgcuccggaaguacugcauagaggccaagcucaccaacacgaccaccgagagucgcugccccacccagggggagcccucccugaaggaggagcaggacaagagauucgucugcaagcacagcaugguggaccguggcugggggaacggcugcggccuguucggaaagggcgggaucgucacgugcgccauguucacgugcaaaaagaacauggagggcaagaucgugcagcccgaaaaccuggaauauaccaucguagucacgccccacagcggggaagaacacgcagugggcaaugacacggggaagcacggaaaagagaucaaggugaccccgcagucauccaucaccgaggccgagcugacuggauacgggaccgucacgauggaaugcagcccccggaccggucucgacuuuaaugagaugguguuguuacagauggaaaacaaagcauggcucgugcaccgccagugguuucuggaccugccccuccccuggcugccuggggccgacaagcaggagagcaacuggauccagaaggagacucuggucaccuucaagaacccccacgccaagaagcaggacgugguuguguuaggcagccaggagggugcgaugcacacggcccugaccggcgccacggagauccagaugucguccggaaaccuccuguucaccggccaccugaagugccggcugcgcauggacaagcuccagcugaaggguaugagcuacaguaugugcaccgggaaguucaagguggucaaggagaucgcugaaacccagcacgguacaaucgugauccgggugcaguacgagggggauggcucgcccugcaaaaucccuuucgaaaucauggaccuggaaaagcgcuacguccucggucgguugaucacggucaacccgaucgcaacagagaaggacagccccgugaacaucgaggcggagcccccuuucggggacagcuacauuauaauuggcgucgagcccgggcagcugaagcucaacugguucaagaagggaucuucaaucgggcaaauguucgagaccaccaugcgcggcgccaagcguauggccauccugggcgacaccgccugggacuucggcucgcugggcgggguguucacuagcaucggcaaggcccuccaccaaguguucggggcgaucuacggcgccgcauuuucuggagucuccuggaccaugaagauccuuauaggggugauuaucaccuggauaggcaugaacucccguucgaccucccucagcgugucacugguccucguggggauagugacgcuguacuuaggagucauggugcaggccgacagcgggugcguaguuagcuggaagaacaaagagcucaagugcggcucagguaucuuuaucaccgauaacguccacacuuggacagagcaguacaaguuccagcccgagagccccuccaaguuagcgagcgccauucaaaaggcccaggaggaggguauaugcggcauccgauccgugacgcggcuggagaaccucauguggaagcagaucacccccgagcugaaccacaucuuggccgagaacgagguaaagcucaccaucaugaccggggacauaaagggcaucaugcaagccgggaagcgcucgcuucggccgcagcccaucgagcuaaaguacucuuggaagacguggggaaaggcgaagaugcucucuaccgagucccauaaccagaccuuucugaucgacggucccgagaccgcugagugccccaacacgaaucgcgcuuggaacagcuuagaagucgaagacuacggcuucgguguauucacuaccaacaucuggcuacggcugaaagaaaagcaggacgccuucugugacuccaagcugaugucugccgcgaucaaggacaaccgugccguacacgccgacaugggguacuggaucgaguccgcucucaacgauacuuggaagaucgaaaaggccagcuuuaucgaggucaaaaacugccacuggccaaagucccacacgcuguggagcaacggcgugcuggaguccgagauggucauccccaagaaccucgcgggccccguuagccaacauaacuaccgcccgggguaccauacccaaaucgccggccccuggcaccucgguaagcuggagauggauuucgacuucugcgacggcaccaccgugaucguaaccgaggacugcgggaaccgcggccccuccuuacggacgaccaccgcaucgggcaaacugaucaccgaguggugcugccgaagcugcacgcugcccccacuccgguacagaggggaggacggcuguugguacgggauggagauccggccucuuaaggaaaaggaggagaaccugguuaacucccucgugaccgccggccacggucaggucgacaacuucagccugggcguccugggcauggcccucuucuuggaggagauguugaggaccagagugggaacaaagcaugcuauccuccuggucgccgugagcuuugugacgcugaucaccggcaacaugucuuuuaaggaccucgggcgcgucguggugauggucggcgcaacgauggcagacgacaucggaaugggcgugacguaucucgcguuguuagccgccuuuaaagugcggcccacguucgccgcgggccugcugcuccgcaagcucaccuccaaggagcugaugaugaccaccaucgggauuguauugcugagccaaaguacgauccccgagacugugcuggagcuaaccgaugcgcuggcccugggcaugaugguucucaagaucguccguaacauggagaaauaccagcuggccgugaccaucauggcgauccugugcgucccgaacgcugugauccuccaaaacgcguggaagguaucgugcacgauccuggcgguuguguccgugagcccccugcuacuuaccuccucgcaacagaagaccgacuggauaccccuggcccucaccaucaagggguugaauccaacagccaucuuucugaccacccucucucggacgaacaagaagcgcagcuggccgcugaaugaggcuaucauggccgugggcaugguauccauccuggccagcucgcugcugaagaacgauaucccuaugacgggucccuugguggccggagguuuacugacagucugcuacgugcugaccggucggagcgccgaccuugagcuggagcgugcgaccgacgugaagugggaggaccaggccgaaaucuccggcagcuccccgauccuguccauuacgaucagcgaggauggguccaugagcaucaagaacgaggaggaggagcagaccuugacgauccucauccggaccggccugcucgucaucucuggccuuuucccgaucagcaucccuaucacggcagcggccugguaccugugggagguuaagaaacagagggccgguguguugugggacguuccaagcccgccgccaaugggcaaagccgaacuggaggacggggccuaccggaucaagcagaagggaauccugggguauagccaaaucggggccggcguguacaaggaggggaccuuccacaccauguggcacgugacccggggcgcgguucucaugcacaaggggaagcggaucgagcccuccugggcggacguuaagaaagacuugaucagcuacggcggggguuggaagcuagaaggggaguggaaggaaggggaggagguccaaguccucgcccuggagccaggcaagaaucccagggccguucagaccaagcccgggcuguucaagacgaauaccggcaccaucggagcugucaguuuggacuucagccccggcacauccggcagucccaucauugacaagaaggggaaggugguaggccuguacgggaacggcguggucacacgcuccggcgccuacgugucagcgauugcccagaccgaaaaguccaucgaggacaaccccgaaaucgaggacgauaucuuccgaaagcggcgccugaccaucauggaccuccaccccggggccggcaagaccaagagauaccuccccgccauuguacgcgaggcgaucaagagaggguugcgaacgcugauucucgccccgacacggguuguagccgcggagauggaggaggcccugcgcggccuacccauccgguaccagaccccagcgauccgugccgaacacaccgggcgcgagaucgucgaccucaugugccacgccacguucaccaugcggcugcugucgcccguucgcgugccuaauuauaaccucauuaucauggacgaagcccacuucaccgaccccgccuccaucgccgcccguggguacaucagcacccgcguggaaaugggagaggccgccgggauuuucaugacggcgacaccgcccggaagccgggacccguucccccagucgaacgcgccgaucaucgaugaagagagagagaucccugagcggagcuggaacuccgggcaugaauggguaaccgacuuuaagggaaagaccgugugguucgucccuagcaucaaggccgggaacgacaucgccgccugccugcgcaagaacggcaagaaggucauccaacugucucggaagacguucgacagcgaguacgugaaaacccggaccaacgacugggacuucguggugacuacggacaucuccgaaaugggcgcgaauuucaaggccgaaagggugaucgacccucgcagaugcaugaagcccgucauccucaccgauggggaggagcgcguuauccuggccggccccaugccgguuacccacuccagcgccgcccagcggcgcggacggaucggccgcaaccccaaaaaugaaaaugaccaguacaucuacaugggggagccccuugagaacgacgaggacugcgcgcacuggaaagaggcuaagaugcuccuggacaacaucaauacgcccgaaggcauuaucccgagcauguucgagccggaacgugagaagguggacgccaucgacggugaguaccgacugcgcggggaggcccggaagacguucgucgaucucaugcgccggggcgaucugccuguguggcuggccuacaaaguggcagcugaggggaucaacuacgccgaccgccgguggugcuucgaugguaucaagaacaaccagauccucgaggagaacgucgagguggaaauauggaccaaggagggggagcgcaagaagcugaagccacgguggcucgaugcucgcauauacuccgauccccuagcccuuaaggaguucaaggaguucgcggcuggccggaagucauuaacccucaacuuaauaacagagaugggucgcuugcccacguucaugacccagaagacccgggacgcccuggacaaucuggccguccugcacaccgcggaagccgguggccgcgccuauaaccacgcgcucagugagcugcccgagacgcucgagacccucuuguuacucacucugcuggccacggugacgggcgguaucuuccucuuccugaugucggggagggggauaggcaaaaugacccuggggauguguugcauuaucaccgcguccauccuccugugguacgcccagauccagccccacuggauugccgccagcaucauccuggaguucuuccucaucgugcugcugauccccgagccugagaagcaacgcacgccccaggacaaccagcucaccuacgucguaauugccauccugacgguaguugcugccaccauggccaacgagaugggauuccuggagaagaccaagaaggaccucgggcugggcuccaucgcaacccagcagccggagagcaacauccuggacaucgaccuccggcccgcaagcgcauggacucuguacgcgguggccaccaccuucgugaccccuaugcugcgccacagcaucgagaacagcuccguaaacgugagccucaccgcuaucgcuaaccaggcaaccguccugaugggccuagggaagggcuggccccucuccaagauggauauaggcguaccccugcuggcuaucggcuguuacucccaggugaacccuaucacucucacugccgccuuacugcuccuaguggcgcacuacgccaucauugggcccggccugcaggccaaggccacgcgggaagcccaaaagcgcgccgccgccggcauaaugaagaaccccaccgucgacgggauaaccgugaucgaccuggacccgauccccuaugaccccaaguucgagaagcagcugggccaggugaugcuguugaucuugugcgucacccaagugcugaugaugcggacgaccugggcccucugcgaagcccugacccuggccaccgggccgauuuccacgcugugggaaggcaauccgggacgcuuuuggaauaccaccaucgcugugucuauggccaacaucuuccggggcuccuaucuagcuggagccggccuccucuucagcaucaugaagaacaccacgaacacccgccgcggcacggggaacaugggggagacccugggcgagaaguggaagucccggcucaacgcucucggaaagagcgaguuccaaaucuacaagaaauccggcauccaggaaguugauaggacacuugccaaggaggggaucaagagaggggagacugaccaccacgccgugagccgcggcuccgccaaacuacggugguucguagagcgcaacauggucacaccggagggcaaggugguggaccucggcugcggccgggguggguggucguacuacugcggagggcuuaagaacguccgagaggugaagggccugaccaagggagggcccgggcacgaagaaccgaucccgaugucaacguaugguuggaaccucgugagauugcagaguggcgucgacguguucuucauaccucccgagaagugcgacacgcuucuaugcgacaucggggagucuagccccaaccccacuguggaggcgggacggacucugcggguacugaaucucguggagaacuggcugaauaacaacacccaguucugcaucaaggugcuuaacccguacaugcccagcguuauagagaagauggaggcccuucaacguaaauacgguggggcccucgugaggaauccacugucucgaaauagcacccacgagauguacuggguguccaacgccagcggaaacaucgucuccagcgugaacaugaucucccggaugcugaucaaucgcuucaccaugcggcacaagaaggccaccuacgaacccgacguagaccucggaagcggcacucgaaauaucggaaucgagucggagauccccaaccuggacaucaucgguaagcggaucgagaagaucaagcaggagcacgagacuucuuggcacuacgaccaggaccaucccuacaaaaccugggccuaccacgguucuuacgagacgaaacagaccgggagugccaguucuauggucaauggcguuguccguuugcucacgaagccgugggacguccugccaaccgugacgcagauggccaugaccgacaccaccccguucgggcagcagagaguuuucaaagagaaaguggacacccggacgcaggagcccaaggagggcacgaagaaacugaugaagaucacggccgagugguuauggaaggaacugggaaagaagaagacuccccgcauguguacccgagaggaguucacgcguaagguucgguccaacgccgcgcugggggccaucuucaccgacgagaacaaguggaaguccgcccgugaggccguggaagacucgcgguucugggagcuuguugacaaggagcgcaaccuucaccuggagggcaagugcgagaccuguguguacaacaugauggggaagcgugagaagaagcucggcgaguucgguaaagccaaggguagccgcgcaauaugguauauguggcuaggcgccagauuccuggaauuugaggcccucggguuucugaacgaggaccacugguucucccgcgagaauagccuguccggagucgagggggagggccuccacaagcugggguacauccuacgggacguguccaaaaaggagggcggcgccauguacgcggacgacacugccgggugggacacgcgcaucacccuagaggaccugaaaaacgaggagauggucaccaaccacauggagggcgagcauaagaagcuggcugaggcgaucuuuaagcucacguaucagaacaaggucgugcgggugcagcgaccaacgccccgggggacagucauggacauuaucagccgccgugaccagcguggcuccggccaggugggcacguacggucucaacaccuucacgaacauggaggcccaacugauccggcagauggagggagagggcgucuucaagaacauccagcaccucacugugaccgaggagguggcagugcagaacuggcuggcccgcgucgggcgcgagcgacuaagccgaauggccauauccggcgacgacugcgugguuaaaccacucgacgacagguucgcuaacgcacugaccgcacuuaacgacaugggcaagauccgcaaggauauccaacagugggaaccgagcaagggguggaacgauuggacacaaguuccuuucugcucacaccacuuccaugagcucaucaugaaggacggccgggugcugguggucccaugccgcaaccaggacgaguugaucgggcgggcccgcaucagccaaggugccggguggucccuccgugaaaccgccugcuugggcaagagcuacgcgcagauguggucacugauguacuuucaucgccgggaccuccgccuagcggccaacgccaucugcagcgcugugcccucccacugggugccgaccagccggaccacguggucuauacaugccaagcacgaguggaugaccaccgaggauaugcuuaccguuuggaaccgaguauggauaagagagaaccccuggauggaggacaagacucccguggagagcugggaagagauaccauaccucggcaagcgcgaggaccaauggugcgggucacugauuggacuaacaagccgggcgaccugggccaagaacauacaggccgcaaucaaccagguucgcucccucaucgggaaugaggaguacaccgacuauaugccaagcaugaagcgguuccgccgagaggaggaggaggcgggcgugcugugguga

SEQ ID NO: 25334 - RNA, 9876 nt, Artificial Sequence
  derived and/or modified CDS sequence (opt11) from DENV-2__FJ859028__SS-prME
ucugcggggaugaucaucaugcugauccccaccgugauggccuuccaccucacgacccgcaauggggagccccacaugaucgucgggauccaggagaaggguaagucccuucuguucaagaccgaggacggcgugaacaugugcacgcucauggcgauggaucucggggaguuaugcgaggacacgaucaccuacaagugcccccuccugcggcaaaacgagcccgaggacaucgacugcuggugcaacucaacuucaaccugggugaccuacgggaccuguaccacuaccggcgaacaccgacgggagaagcgcagcguugcccuggugccgcacguggggauggggcucgagaccagaacggagaccuggaugucgagcgagggggccuggaagcacgcucagagaauugagaccuggauccugcggcacccgggcuucaccauaauggccgcgauccucgccuauaccaucgggaccacccacuuucaacgcguccucauauucauacugcuuacugccguugcccccagcaugacgaugcggugcaucggcaucagcaaccgcgacuucguggagggcgucuccgggggcagcuggguggacaucguccuugagcacgggagcuguguuaccaccauggcgaagaacaagcccacacuugacuucgagcugauaaagaccgaggcuaagcagcccgccacucugcggaaguauugcaucgaggcaaagcuuaccaacaccacuaccgagagccgcugccccacccagggcgagcccucccugaaggaggagcaggauaagcgguucgugugcaagcacagcaugguggaccgcggcugggggaacggcugcggccuguucggcaagggcgggaucgucacgugugcuauguucacuugcaagaaaaacauggagggcaagaucguucagcccgaaaaccuggaauacaccaucgugguuacgccccacuccggggaagaacacgcggugggcaacgacacagggaagcacgggcaggaaaucaaggugaccccucagagcagcaucaccgaggccgagcugaccggguacggcaccgucacuauggagugcagcccccggaccggcuuggacuucaacgagauggugcugcuccaaauggagaacaaagccuggcuugugcaccgccagugguuccuggaccugccccuacccuggcugccgggggccgacaagcaggaguccaacuggauccagaaggagacccuggucaccuuuaagaacccccacgcuaagaagcaggacguugucguucucggcagucaagagggggcgaugcacacggcccugaccggcgccaccgaaauccaaaugagcucagggaaccuauuguucaccggccaccugaagugccggcugcgcauggacaagcuacagcucaagggcaugagcuacucaaugugcacgggcaaguucaaaguggucaaggagauugccgagacgcaacacggaaccaucgugauccgggugcaguacgagggggacggcagccccugcaagauccccuucgagaucauggaccuggagaagcguuacguccucgggcggcugaucaccgugaacccgauaguuacggaaaaggacucccccgucaacauugaggcggagccgcccuucggugacucuuacaucaucaucggcguggagccggggcagcugaagcucaacugguuuaagaaaggcuccagcaucgggcagauguucgagacaaccaugcgcggcgcaaagaggauggccauccugggagacacggcuugggauuucgggucccugggcgggguguucaccucaauaggcaaggcacuucaccaagucuuuggggccaucuacggcgccgccuucuccgggguaagcuggacgaugaagauccugaucggggugaucaucacauggaucggaaugaacagccggucaacuucccugagcgucuccuuagugcucguggggauugucacacuguaccugggcguuaugguucaggccgacagcgggugcgucgugaguuggaagaacaaggagcucaagugcggcagcggcaucuucaucacugauaacgugcacaccuggacagagcaguacaaguuccaaccugagagcccuuccaaguuagcuagcgcgauccagaaagcccaggaagagggcauuugcggcauccgcuccgugacgcggcuggagaaccucauguggaagcagaucacucccgaauuaaaucauauccuggccgaaaacgaggugaagcucaccaucaugaccggagacaucaagggcaucaugcaggccgggaagcgcagccugcggccgcaacccacggagcuaaaguacuccuggaaaaccuggggcaaggccaaaaugcucucgaccgaguccuacaaccagaccuuccugauagacggucccgaaacggcagaaugcccgaacacgaacagggccuggaauagucuggagguggaggacuacggguucggcgucuucaccaccaacaucuggcucaaauugaaggagaagcaggacgccuucugcgauuccaaauuaaugagcgccgccaucaagaacaaccgugcggugcacgccgauaugggguauuggauagaguccgcccuaaacgacacguggaaaaucgagaaggccagcuucaucgaggugaagaacugccacuggcccaagucccacacccuguggucuaauggaguccucgaauccgagaugaucauccccaaaaaccucgccggccccgugagccagcacaacuaccgcccgggguaccacacccagauagcgggcccuuggcaccuggggaagcuggagauggacuucgauuucugcgacgguaccaccgugguggugacggaggacugcgggaaccggggcccuucccugcgcacuaccacggcguccggcaagcugaucacggaguggugcugccggucgugcacccugcccccgcuccgcuaccgcggggaggacgguugcugguacggcauggagauccguccccugaaagagaaggaggaaaaccugguaaacucccucgucaccgccggccacggccaaguggacaacuucagccugggcgugcuuggcauggcgcucuuccuggaggagaugcugcggacccgcguagggacgaagcacgccauccuacugguugccguguccuucgucacgcugauaacaggcaacaugagcuucaaggaccuagggcggguagugguaauggugggcgccacgauggccgaugacaucgggaugggagugacguauuuagcccuccucgcggccuucaaaguccguccaaccuucgccgccggccugcugcuccggaagcugaccagcaaggagcugaugaugaccacgaucgggaucguguuacugagccagucgaccauccccgagaccgugcuggagcucacggacgcccuggcgcugggcaugaugguuuugaagaucgugcgcaacauggagaaauaccaguuggccgucacuaucauggcuauucugugcguacccaacgccgugaucuuacaaaacgcuuggaaggucagcugcacaauccuggcggucguguccgucucgccccuacuccugaccuccagccaacagaagaccgacuggaucccccuggcacucacgaucaaggggcugaaccccacggccaucuuccugaccacccucucccgcacgaacaagaagcgguccuggccgcugaacgaagccaucauggcgguuggcauggucuccauacuggccagcucccuccuaaagaacgacauccccaugaccgggccccuggucgcagggggccuccugacaguauguuacguauugaccgggaggagcgccgaucucgagcuggagcgggccaccgacgucaagugggaggaccaggcugagaucuccggcuccucgcccaucuuauccauuaccauauccgaggacggguccaugagcauaaaaaacgaggaggaggagcagacccucaccauucugauacgcacaggccuguuagugauuuccggccuguucccgaucagcauccccaucaccgcugccgcaugguaccugugggaggucaagaagcaacgggccgggguccucugggacguccccagcccaccaccaaugggcaaagccgaauuggaggacggugccuaucgcaucaaacagaaaggcaucuuaggguacagccagaucggcgccgggguguacaaggagggcaccuuccauaccauguggcaugucacucggggugccguacucaugcauaaggggaagcggaucgagccguccugggccgaugugaagaaggaucugaucagcuacggcggaggcuggaagcuugagggcgaguggaaggagggggaagaggugcaggugcuugcacuagagcccggcaagaacccccgggccgugcagacgaagcccgggcuguuuaagaccaacaccggcacaaucggggccgugucccucgacuuuucgccugggacguccgguagccccaucauugacaagaaggggaagguggugggcuuauacggcaacggcgucgugacccgcuccggcgcuuacgugagcgcgaucgcccagacugagaagagcauagaagauaaccccgagaucgaggacgacaucuuccgcaagcggcggcugaccaucauggaccugcaccccggggccggcaagacgaagcgauaccuccccgcgaucguccgggaggcuaucaagcgcggccugcggacauuaaucuuagcgccgacccgcgugguggccgccgagauggaagaggcccugaggggucuacccauccgguaccagacccccgccauucgggcggagcacacggggcgcgagaucgucgaccucaugugccacgccaccuucaccaugcgccugcugagccccgugcgggugccgaacuacaaccucauuauuauggacgaagcccacuucaccgaccccgccuccauagcugcgcgcggcuacaucuccacgcgugucgagaugggugaggccgccgggaucuucaugaccgccacgccgcccggcucacgugacccuuucccccaauccaacgcacccaucaucgacgaggagcgcgagauccccgaacguaguuggaacuccgggcacgagugggugaccgacuucaagggcaagacggugugguucgucccgagcaucaaggcagggaacgacauugccgcuugucugcggaagaacggcaagaaggugauccagcugucccgcaagacguucgacagcgaguaugugaagacccggacuaacgacugggacuucguagugacgaccgacaucucagagaugggcgccaacuucaaggcggagcgcgugaucgacccccggagaugcaugaagccagucauccucaccgacggggaggagcggguuauccuggccggccccaugccggugacccacagcuccgccgcucagcggcgcgggagaaucggccguaaccccaaaaaugagaacgaccaguacaucuauaugggggagcccuuggagaacgaugaggauugcgcccacuggaaggaggcgaagaugcugcuggauaacauuaacacgccggagggcauaaucccgagcauguucgagcccgagcgcgagaaggucgacgccauugacggcgaguaucggcugcgcggcgaggcacgcaagaccuucguggaucucaugcggaggggcgaccugcccguguggcuggcauacaaagucgccgcggaggggaucaacuacgcggaccggcgcuggugcuuugacggcaucaagaacaaucagauccucgaggagaacguggaggucgagaucuggacgaaggagggggagcggaagaagcugaaaccgcgcuggcuggaugcccgaaucuacuccgacccccucgcccugaaggaguucaaggaguucgcagcgggcagaaagagccugacacucaacuuaaucacggagaugggccggcugccuaccuucaugacucagaagacccgcgacgcccucgauaauuuggccguucugcacacggccgaggccggcggacgugccuacaaucacgcacucuccgaacugcccgagacucuugagacccuucuacugcuuacccugcuggccacggugaccgguggcauuuuccucuuccugaugucgggcagggggaucggcaagaugacccuggggaugugcugcaucaucaccgcuuccauccuacugugguacgcucagauccagccgcacuggauagccgccagcauaauucuggaguuuuuucucaucguccugcugauccccgaacccgagaagcagcggacgccccaggacaaccaacucacguacguggugaucgccauccucaccguaguggcggcgaccauggccaaugagaugggcuuccuggagaagaccaagaaggaccucgggcugggguccaucgcgacgcaacagccggagagcaacauccuugacaucgaccuccgccccgccuccgccuggaccuuguacgcgguagccaccacauuuguaacccccaugcugcgccauagcaucgagaacagcuccgugaacgugagccucaccgccaucgcgaaccaggccaccguucugaugggccugggaaagggauggccccucuccaaaauggauaucggcgugccccugcuggcgaucggcugcuacagccaggugaacccuaucaccuuaacggcagcccugcugcuccuggucgcccacuacgccaucaucgguccuggccugcaggcuaaggccacccgcgaagcccagaagcgggccgcggcaggcaucaugaagaaccccaccguggacgggaucaccgugaucgaccucgauccgauccccuacgaucccaaguucgaaaagcagcuaggccaggucaugcugcucauccucugcguaacccaggugcugaugaugcgcacuaccugggcccugugcgaagcucugacccuggcgacgggaccuauauccacccucugggagggcaacccaggacgguucuggaacaccaccaucgcggucagcauggccaacaucuuccgcggcuccuaccucgcaggggccgggcuccuguuuagcauuaugaaaaauaccaccaacacccggcgcggaaccgggaacaugggcgaaacgcugggcgagaaguggaagucacgccugaacgcccuggggaaguccgaguuccagauuuacaagaaguccggcauacaggagguugacagaacccuggcgaaggaggggaucaagagaggcgagaccgaccaccaugccgugagccguggguccgcuaagcugagaugguuugucgagcggaacauggugacccccgagggcaaagucgucgaccugggaugcgggcgcggcggguggagcuacuacugcggugggcuaaagaacgugcgggagguuaaaggccugacgaagggagggcccggccacgaggagccuaucccgaugucuaccuacggauggaacuuaguccgucugcagagcggcguggauguguucuucaucccgcccgagaagugcgacacccugcucugcgacaucggggaguccagcccuaacccgaccgucgaggccggccggacgcuacgcgugcugaaccugguggagaacuggcugaacaacaacacccaauucugcaucaaggugcucaaccccuauaugcccuccgugaucgaaaaaauggaggcgcuacaacggaaguacggcggggcacucgugcgcaacccgcugucucgcaacagcacccacgagauguacugggugagcaacgccagcggcaauaucguguccagcguuaacaugaucucccgcaugcugaucaacagauuuaccaugagacacaagaaggccaccuacgagccugacguggaccuugguagcggcacgcggaacaucggaaucgaguccgaaauacccaaccuggauaucauagggaagcgcaucgagaagauuaagcaggagcacgagacaagcuggcacuacgaccaggaccaucccuacaagacuugggccuaccacggcuccuacgagaccaagcagacgggaagcgcguccagcauggugaacggugugguccggcugcucacuaagccgugggacgugcugcccaccgugacccaaauggccaugacagacaccacccccuucggucagcagagagucuucaaggagaagguggacacccggacgcaggagcccaaggagggcaccaagaagcugaugaagaucaccgcggagugguuguggaaggagcugggcaagaaaaagaccccgcggaugugcacgcgcgaggaguucaccaggaaggugcgcuccaacgcggcccugggggcgaucuucaccgacgagaacaaguggaaguccgcacgggaggccguagaggauucccgcuucugggaguugguggacaaggagcggaaccugcaccuggagggcaagugugagacuugcgucuacaacaugauggggaagcgcgagaagaaacucggggaguucggaaaggccaaggguagccgggccaucugguauauguggcugggcgcccguuuucuggaguucgaggcccucggcuuccucaacgaggaccacugguucucccgggagaacucgcuguccgguguggagggugagggacuccacaagcugggguacaucuugcgcgauguaagcaagaaggagggcggcgccauguacgccgacgacacggcgggaugggacacccggaucacccucgaggaccugaagaaugaggagauggucaccaaucacauggagggcgagcacaagaaacuggccgaggccaucuucaagcucacguaccagaacaaaguggugcgugugcagaggcccacaccccgugggacggugauggacaucaucagccgccgcgaccagcggggcuccggucagguggggaccuauggccugaacacguuuaccaauauggaagcccagcugauccgccagauggagggugaaggcgucuucaaaaauauccagcacuugaccgugaccgaggagguggccguccagaacuggcuggcgcggguggggcgcgagcgccuuagccgaauggcaaucuccggcgacgacugcguggucaagccccucgacgaccgcuuugcgaacgcccugacggcauugaacgacaugggcaaaauccggaaggacauucagcaaugggagccgagcaagggguggaacgacuggacccaggugccuuucugcucccaucacuuccacgagcucaucaugaaggacgguagggugcuggucgugcccugccggaaccaggacgaacugaucggacgcgcacguauaucacagggugccggguggucccuccgcgagaccgccugccucggcaagagcuacgcccagauguggucccugauguacuuccaccggcgcgaccuccggcuggcagcgaacgccaucugcagcgcugugcccucccacugggucccgaccagcaggacgaccuggagcauccacgcgaagcacgaguggaugacuacagaggacaugcugaccguguggaaccggguguggauccgcgagaaccccuggauggaggacaagacgcccguggagucaugggaagagauccccuaccucggaaagcgggaggaccaguggugcgggucccugaucggcuuaaccagccgcgccacgugggcgaagaauauccaaguggccauaaaccaggugcggucccucaucggcaacgaggaguacaccgacuacaugccgucgaugaagcgguuucggcgcgaggaggaggaggcaggaguccugugguga

SEQ ID NO: 25335 - RNA, 9876 nt, Artificial Sequence
  derived and/or modified CDS sequence (opt11) from DENV-2__FJ410200__SS-prME
ucggcaggcaugauaaucaugcugaucccgaccgugauggcauuccaucuaaccacccgaaacggggaaccgcauaugauugucggcauccaggaaaagggcaagagccuacuguuuaaaaccgaagauggcgugaauaugugcacguuaauggcuauggaccugggggaacuaugcgaggacaccauaaccuacaaaugcccccuccuacgucagaacgagcccgaagacaucgacugcuggugcaacagcaccucgacguggguaacuuaugggaccugcacuacgaccggagagcaccgcagagagaagcgcagugucgcgcuggucccacauguggggaugggccucgaaacccguaccgagaccuggaugucguccgagggggcauggaaacacgcccagagaaucgaaacauggauccugcgucacccugguuucacgauuauggcugcgaucuuagccuauaccauaggaaccacccacuuccagagagugcucauauucauccuacuuacugccguggcccccuccaugacaaugcggugcaucggaauuagcaaccgcgauuuugucgagggcguguccgggggaagcuggguugacaucgugcuggagcacgguuccugcgucaccaccauggccaaaaauaagcccacgcuggacuucgagcugaucaagacugaagccaagcagcccgccacucuccggaaauauugcaucgaggcaaaauuaacaaauacuaccaccgagucacgaugccccacccaaggugagccgucgcugaaagaggaacaggacaagcgguuuguguguaaacacagcaugguggaccgcgggugggguaacggcugcgggcuguucggcaagggcggcauuguaacuugugccauguucacgugcaagaagaauauggagggaaaaaucgugcagcccgagaacuuagaguacacgaucguggucaccccacacaguggggaggagcacgcaguggggaacgacacggggaagcacggccaggagauuaagguuacaccacagagcuccauaaccgaggccgagcugacaggguaugggacgguaaccauggagugcagcccacggaccggccucgacuuuaaugaaauggugcuucugcagauggagaacaaggcguggcuagugcaccgccaaugguuccucgaccucccccuucccuggcugccuggugcagauaagcaagagaguaacuggauccaaaaggagacauuaguaacguuuaaaaacccacacgcgaagaagcaagacgugguagugcuaggcagccaggagggcgcgaugcauacggccuugaccggcgcaaccgaaauccagauguccuccgggaaucuccucuucacaggccaucugaagugcagacugcgaauggacaaacugcagcugaaaggcaugagcuacuccauguguacagggaaguucaagguggucaaggagaucgccgaaacccagcacgggacgaucgucauccgggugcaguacgaaggugauggcagccccuguaaaauaccguucgagauaauggaccuggagaagcgcuacguccuuggaagguuaaucaccgucaacccgaucgugacggagaaagauucgccggugaacauagaggccgaaccgcccuucggugacucauacaucauuaucggcguagaaccggggcaacuuaaacucaacugguucaagaagggcucgucgaucggccagauguuugaaacaaccaugaggggcgccaagcgaauggccauccugggcgacaccgccugggacuuugggucacugggugggguauucacaaguaucgguaaggcccuccaccaggucuucggcgccauuuacggcgcggcguucaguggcguauccuggaccaugaagauacugaucggcgucauaaucaccuggauuggcaugaacucccggaguaccagucugagcguuucccuugugcucguggggaucgucacgcuguaucuagguguuauggugcaggccgauagcgggugcguaguuucauggaagaauaaggaacucaagugcggcucggguauuuucaucaccgauaacgugcauacuuggaccgaacaguauaaguuccagccggaaagccccuccaagcuagcuucggcgauccagaaagcacaggaagaagggaucugugggauacgcagcgucacgcggcucgaaaaccucauguggaagcagaucacccccgagcuaaaccauauccuggcugaaaaugaggugaagcuaacaaucaugaccggggacaucaaggguaucaugcaggccgggaagagaucuuuacgaccgcagcccacugaacugaaguacagcuggaagacgugggguaaagccaaaaugcucagcaccgaguccuacaaccagaccuuccugaucgauggacccgagacagccgagugcccgaacacgaaccgagccuggaacucccuggaaguagaggacuacggguucggcgucuuuaccaccaacaucuggcuuaaguugaaggaaaagcaagacgccuucugcgauuccaaacuuaugagcgcugcaauaaaagauaaucgcgccgugcacgcagacauggguuacuggaucgaguccgcccuaaacgacacguggaagauagagaaggcuuccuuuaucgaggugaagaacugccauuggcccaagagccacaccuuguggagcaacgguguccuggagucggagaugaucauacccaagaaccuggccggccccguuagucagcacaacuaccgcccgggauaccacacccagaucgcuggcccguggcaccuggggaagcuagagauggacuuuaacuucugugacggcaccacggugaucgucacggaagauugcgguaacagaggcccgucccuccgcaccacgacggcaagcggaaaacuuaucacggaguggugcugucguagcugcacccuacccccgcuacgauacagaggggaagacggcugcugguacggaauggagauccguccucugaaagagaaggaggagaaucuagugaacuccuuggucaccgcgggccacgggcaggucgauaauuucagccugggggugcucggcauggcccucuuccuggaagagaugcuucgaaccagagugggcacaaagcacgcgauccuccugguggcaguguccuucgugacgcugauaacaggcaauaugagcuucaaggaccucggccgggucguggugauggucggcgccaccaugacggaugacauagggaugggcguuacguauuuggcauugcucgccgcguuuaaagugcgcccaaccuucgcagccggucugcugcuccgcaaacuuaccucaaaggagcuuaugaugaccacgauagguauuguccuccuuagccaguccacgauccccgaaacuguacuggagcucacggacgcacuagcccugggcaugauggugcucaagaucguacguaauauggagaaguaucagcuggcggugaccauaauggccaucuuaugcguaccgaacgcagugauccuccagaaugccuggaagguaucauguacgauucuggcugucguguccgugucgcccuuguugcugaccuccucucagcagaaaacggacuggaucccccuggcgcucacuauuaaaggguuaaacccuaccgcgauauuccuuaccacccucucucggaccaauaagaaaaggagcuggccucugaacgaagcaaucauggcugucggcaugguguccauucuggccuccucccuccugaaaaacgauauccccaugaccgggccguugguggccgggggacuauuaacgguaugcuacguacugacugggcgcagcgcggaccucgagcuggagcgggccaccgaugugaaaugggaggaccaggcggaaauuaguggcucgagcccaauccuguccaucaccaucagcgaggaugguuccaugagcaucaagaaugaagaagaagaacagacgcucacgauccuaauucgcacuggccugcuagucaucagcggucuguucccgauuagcauucccaucaccgcggcggcaugguaucuaugggaaguuaagaagcagcgggcgggaguauuaugggacgugccgagcccgccgcccaugggcaaggccgaacuagaggacggggcguaccgcaucaagcagaaaggcauacuugguuacagccagauaggagccggcguguauaaggaagguacuuuucacaccauguggcacgucacgcggggagcggugcucaugcacaaggggaaacgcaucgagcccucuugggcggacgucaagaaagaccugaucagcuacgguggaggguggaagcuggagggagaauggaaagagggggaagagguacaggugcucgcgcuggagccaggcaagaauccccgggcaguucagacaaagcccggacuguucaaaaccaacaccgguacuaucggggccgugucucucgacuucaguccuggcaccucggguagcccuauuauagacaagaaaggcaagguggugggucuguacggcaacgguguggucacacgcucaggcgccuaugugagcgccauagcccagacugaaaagucuauugagaacaaucccgagaucgaagacgauauauuuagaaagcgccggcugacgauuauggaccugcacccgggggcuggaaagaccaagcgguaccugccugccaucguacgggaagccaucaaacgcgggcugcggacgcugauccucgccccgacccgcguaguugcagccgaaauggaggaggcgcugagggggcugcccauccgcuaccagacccccgccaucagagccgagcacacuggcagggagaucguggauuugaugugucaugcaaccuuuacuaugaggcuguuaagcccgguucgggugccuaacuauaaucucaucaucauggacgaggcccacuucacggacccugcaucuauagcagcccgcggcuauaucagcacucggguggagaugggcgaagcugcugguaucuucaugaccgcgacgccuccaggcagccgcgaccccuucccccagaguaacgccccgauaaucgacgaagaacgggaaaucccggaacguagcuggaacucggggcacgaaugggucacagacuuuaagggcaagacagucugguucgugccguccaucaaggcggggaacgacauagcggcaugccugaggaaaaacggcaagaaggucauucaacucucccgcaagacauuugacagcgaauacgucaagacccggaccaaugacugggacuucguggucacuaccgacaucagugagaugggcgccaauuucaaagccgagcgcgugauagauccgcggcguugcaugaagccgguuauccucaccgacggggaggagaggguaauccuagcggggccuaugcccguuacgcacuccuccgcggcucaacgccgugggcgcaucgggcgaaacccuaagaaugaaaacgaccaguacauauacaugggggagccgcuggaaaaugacgaggacugcgcgcacuggaaagaggcaaagaugcuucuggacaacauuaacacacccgaagggaucaucccgucaauguucgaacccgagagagagaagguggacgcaaucgacggcgaguaccggcugcgcggggaggcgcgcaaaaccuucguagaucugaugcggcguggugaccugcccgugugguuagccuacaaaguggccgcugaggggaucaacuacgcggaccgaagguggugcuucgacggcaucaagaacaaccagauacuagaagagaauauggaagucgagauuuggaccaaggagggggagagaaagaaacuaaagccgagauggcuugacgcccggauuuacuccgaccccuuagcccuaaaggaauuuaaagaguucgcggccggacgcaagagcuugacgcugaaccugauaaccgaaauggggcggcugcccaccuucaugacucagaagacgcgcgaugcacucgauaaccuagcggucuugcacacagccgaagccgggggccgggcguacaaccacgcucucuccgaacuaccugaaacacuggagacgcuccugcugcucacgcugcuggccacugucaccggcggcaucuuccucuuucugaugucuggacgggggaucgguaaaaugacuuuagggaugugcugcaucauaaccgcuuccauucuccugugguacgcacagauucagccgcacuggaucgcggccagcauaauucuggaguucuuucuuaucguauuacuuauuccagagcccgagaagcagcggacgccacaggacaaccaguugacauauguggucauugcuauccuuacugugguggccgcgacgauggcgaacgagaugggcuuccuggagaaaaccaaaaaggaccucggguugggcaguaucgccacccgccagccugagagcaacauacuggacauugaccucaggcccgccucggccuggacgcuauacgccgucgcgacgacguucgugacccccaugcuucgccacagcaucgagaacagcaguguuaacguaagccucaccgcuauugccaaucaagcgaccguucucaugggacuggggaagggguggccuuuaucgaagauggacaucggggucccgcugcuagccaucggcugcuacagucaggucaaccccaucacgcuuaccgcugcucugcugcuccugguugcccacuaugccaucaucgggccggggcugcaggcgaaggcgacuagggaagcccagaagcgugccgcagcgggcaucaugaagaacccgaccguugaugggauuacggucauugaucucgacccgaucccguacgauccuaaauucgagaagcagcugggacaggugaugcugcucguguugugcgucacccaagucuugaugaugcggacgaccugggcccucugcgaggcgcuuacguuggcaacugggccuaucuccacccucugggagggcaacccggguagauucuggaauaccacgaucgcaguaagcauggcuaauaucuucagaggcucuuaccuugccggcgccgggcuucucuucaguaucaugaagaacacgaccaauacgcgccgcggaacggggaacaugggcgagacccugggcgagaaguggaagucccggcugaaugcccucggcaaaucggaguuccaaaucuacaagaagucaggcauccaggaggucgaccgcacacuggccaaggaaggaauaaagcgaggagagaccgaccaucaugcggugagccgcgguuccgccaagcugcguugguucguggagaggaauauggucacgccugaaggcaaaguggucgaccucgggugcgggcggggcgguuggucuuacuauuguggagggcucaaaaauguccgugaagugaaaggccuaacgaaaggcgggcccgggcacgaagaacccauucccauguccacuuacggguggaacuuaguaaggcugcagucaggcgucgacguguucuuuauuccgcccgagaagugcgauacacugcugugcgacaucggggagaguucacccaauccgacgguagaggccggccgcacucugcgggugcuaaaccuaguggagaauuggcuaaacaacaacacccaguucugcaucaaaguucugaacccguacaugcccuccgucauugagaagauggaagcgcugcaacgcaaguacggaggggcgcuagugcguaacccucugucgcgcaauucuacccacgagauguacugggugaguaacgcgucgggcaauaucguauccagcgugaacaugaucucccggaugcugaucaaucgcuuuacaaugcgucacaagaaagccaccuaugagcccgacguggaccuugggucagguacccguaauaucggaaucgaaucugaaaucccgaaccuggacaucauagguaaacggauagagaaaaucaaacaagaacacgaaacuagcuggcacuacgaccaggaucacccauauaagaccugggccuaccacggguccuaugagacgaagcagaccgggagcgcuucuucgaugguuaacggcgugguccgguuacuuaccaaaccgugggacguucugcccaccguaacgcagauggcgaugaccgauacuacccccuucgggcagcagcgcgucuuuaaggaaaagguugacacaaggacgcaggagccgaaggaggggacuaagaagcucaugaaaaucaccgcggagugguuauggaaggagcugggcaagaaaaagacaccccgccgguguaccagagaagaguucacgcggaaggugcgguccaacgccgcccuuggagccauuuucaccgacgagaacaaguggaagucagcgcgggaggccguggaggacagucgguucugggaauugguugacaaggaacgaaaccugcaccuggagggcaaaugcgagacaugcguguauaacaugaugggaaagcgcgagaagaaacuaggcgaguucgggaaagccaaaggcucacgggcaaucugguacauguggcuaggcgcacgauuccuggaguucgaagcguuaggguuccucaacgaggaccacugguuuagccgggagaacagccuauccggcguagaaggggagggccuccacaagcucgguuacauccugcgcgaugugucgaagaaagagggcggagccauguacgccgaugauaccgcuggcugggacacgcggaucacccuagaagaccuaaagaacgaggagauggugacgaaccauauggagggcgaacauaagaaguuggcggaggcuaucuuuaaacucacauaccagaacaaggucgugcgcgugcagcggcccacgccccgggggacggucauggacaucaucucacggcgcgaccagcggggcaguggccagguggggacauaugggcuaaacacguucaccaacauggaggcgcaacuaauuagacagauggagggcgaagguguauucaagaacauccagcaccucacggucacagaggaggucgcagugaagaauuggcuggccagggugggacgggaacgccuaagccgaauggcgaucagcggcgacgacugcguggugaagccguuggaugaucgcuucgccaacgcacugacagcccugaacgauaugggcaaaaucagaaaggacauccaacagugggagccaucgaaaggguggaacgauuggacucaggucccauuuugcagccaccacuuccacgagcugaucaugaaagauggccguguguugguuguccccugccggaaucaggaugaauugaucggccgugcccggaucagccaaggcgcugguuggucccuccgcgagacagcaugccugggcaagagcuacgcucagauguggaguuuaauguacuuccacaggcgcgaccuccgauuggcggcgaacgccauuuguagcgccgugcccucgcacuggguaccgaccagcaggaccaccugguccauccaugccaagcacgaguggaugaccacggaggauaugcugacggucuggaaccgggucuggauuagagagaaucccuggauggaggacaagacccccguggagagcugggaggagauccccuaccucggcaagcgggaggaccagugguguggguccuugaucggucugaccagucgcgccaccugggccaagaacauacaggcggcaaucaaccagguacggagccuaaucggcaaugaggaguacacggacuacaugcccagcaugaaacgcuuccgacgggaagaggaggaggcaggcgugcucugguga

SEQ ID NO: 25336 - RNA, 9876 nt, Artificial Sequence
  derived and/or modified CDS sequence (opt11) from DENV-2__FJ410202__SS-prME
agcgccgggaugaucaucaugcuuauacccaccgugauggccuuucaccucaccacccggaacggggagccccauaugauagucggcauacaagagaaggggaaaagccuguuauucaagacggaggacggcgugaacaugugcacuuugauggcuauggaccugggcgagcucugcgaggacacgaucaccuacaaaugcccguuacuccggcagaaugagcccgaggacaucgacugcuggugcaacagcacgagcaccugggugaccuacgggaccuguaccaccaccggcgagcaccgcagggaaaagcgcagcgucgcucucguaccccacguggggaugggccuagagaccaggacagaaaccuggaugucguccgagggggccuggaaacacgcccagcgaaucgagaccuggauccuuaggcacccgggcuucacgauaauggccgcgauacuggccuacaccaucgggacaacucacuuucaacggguccuaaucuucauccugcugacggcaguagcccccucaaugacgaugcggugcauuggcauaagcaaccgcgacuucguggagggcguaucuggggguagcuggguggacaucgugcucgagcacggcuccugcgucacuaccauggcgaagaacaagccaacccuggacuucgagcuaaucaagacggaggccaaacagcccgcuacccuccggaaguacugcaucgaggccaagcugaccaacacgaccaccgagagccgcugccccacacagggcgaacccucacugaaagaggagcaggauaagcgguucguguguaagcauagcaugguagaccgcggcugggggaacggaugcggccuguucggcaaaggcgggauugucacgugcgccauguucaccugcaagaaaaacauggagggcaagaucguccagccggagaaccucgaguacacuaucguggucacgccccacuccggggaggaacacgcggugggcaacgacacggggaagcauggcaaggagauuaaagugacgccucagucuuccauaaccgaagccgagcugaccggguauggcaccgucacgauggagugcaguccccggacgggcuuagacuucaacgagauggugcugcugcagauggagaacaaggccuggcucgugcaccgccagugguuccuggaccugccccuccccuggcugccgggggcggacaagcaggaguccaacuggauccagaaggagacccuggucacuuucaagaacccccacgccaagaaacaggacguagucgugcucggcagccaggaaggcgcgaugcacacggcgcuuaccggcgccaccgagauccaaaugagcuccgggaacuugcuguucaccggccaucugaagugccggcugcgcauggauaagcuccaguuaaaggggaugaguuacucuaugugcacggggaaguuuaagguggucaaggaaaucgccgagacccagcacggcaccaucgugauccggguccaguacgagggggacggcagccccugcaagauccccuucgagauaauggaccuagagaagcgcuauguccucggccggcugauaacagugaauccuaucgugaccgagaaggacucacccgucaacauugaagcggagccgcccuucggggacaguuacaucaucaucggcguggagccggggcaacugaagcucaauugguucaagaagggcuccagcaucgggcaaauguucgagacgaccaugagaggcgcgaagagaauggcuauccuaggugauaccgcgugggacuucgggucccucggcgggguguucacgagcgucggcaaggcccuccaucagguguuuggagccaucuacggcgcggccuucuccggggugagcuggaccaugaagauccuuaucggcgucaucaucaccuggaucggcaugaacucccggagcacuucccugagcgugucccugguucucgucgggaucgugacccuguaccucggcgucaugguccaggccgacagcgggugcgugguguccuggaaaaacaaggagcucaagugcggcagcggcaucuuuauuaccgacaacguccacaccuggaccgagcaguacaaguuccagccggagagccccuccaagcuagcuagcgcgauccagaaggcccaggaggagggcaucugcggcauccgcucagugacacgccuggaaaaccugauguggaagcaaaucaccccagagcuaaaccacauccuggccgagaacgaggugaaguugaccaucaugacaggcgacauaaaggguaucaugcaggcugggaagcgcucccuacgcccgcagcccacggagcugaaguacuccuggaagaccuggggcaaagccaagaugcucagcaccgagucuuacaaucagaccuuccugauugacggccccgagacggcggagugcccgaacaccaaccgcgccuggaacagccuggaggucgaggacuauggcuucggcguguucaccacuaacaucuggcucaaguugaaggagaagcaggacgccuucugcgauucuaagcugaugagcgcugccaucaaggacaaccgggcggugcacgccgacaugggguacuggaucgaguccgcccucaacgacacuuggaagaucgagaaggccagcuucaucgaggucaagaacugccacuggcccaagucccacacacuguggagcaacggcgugcuggaguccgagaugauuauccccaagaaccuggccggccccgugagccagcacaacuaucgcccgggguaccacacccagaucgcgggccccuggcaccucgggaaacuggagauggacuucgacuuuugcgauggcaccacugugauagugacggaggacugugggaaccgggggcccucccuccgcaccaccaccgcuagcggcaagcuaauaacggaauggugcugccggucuugcacccuacccccacuccguuaucgcggcgaggacggaugcugguacgggauggagauacgcccccucaaggagaaagaggagaacuuagugaacuccuuagucacagccggccacgggcagguggacaauuucucccugggcguucugggaauggcccuuuuccuggaggagaugcugcggacccgagucgggaccaaacaugcgauccuccugguggcugucuccuucgucacccugaucacuggcaacaugagcuucaaagaucucgggcgggugguugucauggugggcgccaccauggccgacgacaucggcaugggcgugacguaccuggcccuucuggccgccuucaaggugcgcccaaccuucgccgccggacugcugcuccggaaguuaaccuccaaggagcugaugaugaccacgaucgggauugugcucuugagccaguccaccauacccgagacuguguuagaacucaccgacgcccuggcgcuggguaugaugguucucaagaucgugcgcaacauggagaaguaucagcuagccgucaccaucauggccauccugugcgugccgaacgccgugauccuacagaacgccuggaaggucagcugcaccauccuggcggugguguccgucagccccuuauugcugacguccucccagcagaagacagacuggauaccccuggcccucacgauuaaggggcuaaauccgaccgccaucuuccugaccacccucucccgcacaaacaagaagcggagcuggccuuugaacgaggccaucauggccguagggaugguguccauccuggccagcucccucuugaagaacgacaucccgaugaccggcccgcuagucgcggggggccugcugaccguguguuacguccugacggggcgcagcgccgaucucgagcuggagcgggccacggaugucaagugggaggaccaggccgagaucuccggcagcagccccauccuguccauaaccaucagcgaggacggauccaugagcaucaaaaaugaggaggaggagcagacccucacaauccuaauccgcacgggucuguuagugauuuccggccuguucccuauuagcauucccaucaccgccgccgcuugguaucugugggaggugaaaaaacagcgggccggcguacucugggacgugccaucuccgccacccaugggcaaggcggaauuggaagacggggccuaccgcaucaagcaaaagggcauccugggguacagccagaucggcgccggcguguacaaggaggggaccuuccacaccauguggcacgucaccagaggcgcagugcucaugcacaaggguaagcgcaucgagcccuccugggccgacgugaagaaggaccugaucagcuacggcggaggcuggaagcuggagggcgaguggaaggagggagaggagguccaggugcuugcacuggagcccggaaagaacccccgggccgugcagacgaagcccgggcuguucaagaccaacacuggcacaaucggugcugucucgcucgacuucagucccggcacguccggcagcccuaucaucgacaagaaggggaaggugguggggcuguacgggaacggcguugugacccgcuccggcgcuuacgugagcgccaucgcgcagaccgagaaguccaucgaggacaaccccgagaucgaggacgacaucuuccggaagcgccggcucaccaucauggacuuacaccccggggccggaaagacgaagcgcuaccucccggccauaguccgggaggcgaucaagcgcgggcugcggacccuuauccucgcgccgacgcgcgugguggccgccgaaauggaggaggcucugcguggucugccgauccgcuaccagacccccgccauccgggccgagcacacgggacgcgaaauagucgaccucaugugccaugccaccuuuacaaugcgacugcugagcccugugcgcguuccgaacuacaaccugaucaucauggacgaggcacacuuuaccgaucccgccuccauagccgcgaggggcuacaucucuacacggguagagaugggcgaggccgccgggaucuucaugaccgccacgccgcccggcucccgcgacccguuuccccagagcaacgcgcccaucaucgacgaggagagagagauccccgagcgcagcuggaacagcgggcacgaguggguuaccgacuucaagggcaagacggugugguuugucccgagcaucaaggcggggaacgauaucgccgccugccuacggaagaauggcaagaaggugauccagcugagucgcaagaccuucgacagcgaauacgugaaaacccguaccaaugacugggacuucguggucacgaccgacaucagugagaugggcgccaacuucaaggcggagcgugucaucgacccccggcgcugcaugaagcccgucauccucaccgacggggaggagagagugauccuggccggccccaugccggugacccacagcuccgccgcccagcgacgggggcgcaucggaagaaaccccaagaaugagaacgaccaauauaucuacaugggugaaccucuggagaacgacgaggauugcgcccacuggaaggaggcgaagaugcuccuggacaacaucaacacgcccgagggcaucauaccgagcauguuugagcccgagcgcgagaaggucgacgcuaucgacggcgaguaccggcuacgcggggaagcccgcaagaccuucguagaccucaugcgacgcggggaucugccugucuggcuggccuacaaggucgccgcggaggguauaaacuaugccgauagacgcuggugcuucgacggcaucaagaauaaccagauccucgaggagaacgucgagguagagguguggacaaaggagggggagcggaagaagcugaagccgcgcuggcuggacgcccguaucuacuccgacccccucgcccugaaggaguucaaggaguucgccgcugggcgcaaaagccugacccucaaccugaucaccgagauggguaggcuucccacuuucaugacccaaaagacccgcgacgcacuggacaaccuggccgugcugcauacggccgaagucgggggccgggcguacaaccacgcacucuccgagcugccagagacccuggagacuuugcugcuguuaacccugcuggccacggugaccggugggaucuuccucuuccugaugaguggccgcgggauugguaaaaugacccuugggaugugcugcaucauaacugccuccauccuccugugguacgcccagauccagccacacuggaucgcggcgagcaucauccuggaguucuuccuaaucgugcuguugauccccgagccagagaaacagcggacgccccaggauaaccagcucacauacgucgugauugccauccuuaccguggucgccgcgacgauggcgaacgagaugggcuuccuggagaagaccaagaaggaccuugggcuaggcuccaucgccacgcagcagccggagucgaacauccuggacaucgaccuccgaccagccuccgccuggaccuuauacgccguggcgaccaccuuugugacgccaaugcugagacacagcauagagaacagcuccgucaauguuagccuaaccgccaucgccaaccaggccaccgugcugaugggccuggggaagggauggccacucuccaaaauggauaucggggucccccugcuggccaucggcuguuacagccaggugaaccccaucacucucacggcggcucugcuguuacugguggcacacuacgccaucaucgggcccgggcugcaggcgaaggccacccgcgaggcccagaagcgggccgccgcgggaaucaugaaaaaccccaccgucgacgggaucaccgugauugaccucgacccgauccccuacgaucccaaguucgagaagcagcugggacaggugaugcuacucauccucugcgucacccaggugcugaugaugcgaaccaccugggcgcucugcgaggcucuuacccuggccacggggccgaucucuacucucugggagggcaacccugggcgguucuggaacaccaccaucgccgugucaauggcgaauaucuuccgagguucauauuuagccggcgccgggcuccucuucagcaucaugaagaauacgaccaacacacggcggggcaccgggaacaugggggagacgcugggcgagaaguggaagucacgccugaaugcccucggcaagagugaguuccaaauuuacaagcgguccggcauccaggaagucgaccgcacccucgccaaggaggguaucaagcgaggagagaccgaucaccacgcggugagccgcggguccgccaaacugcguugguucguggaacgcaacauggucacccccgagggcaaggugguggaucucggcugcggacgggggggguggagcuauuacugcggcgggcuaaagaacguccgcgaggugaaggggcugacgaagggcgggcccggucacgaagaacccauuccgaugucuacauacggguggaaccugguucgguugcagagcggcgucgacguauucuucaucccucccgagaagugcgacacccuucucugugacaucggggaguccagucccaacccgaccgucgaggccggccgcacauugcggguccugaaucucguggagaacuggcugaacaacaacacccaauuuugcauaaagguucugaaccccuacaugcccucugugauugagaagauggaggcccugcagcgcaaguauggcggggcgcucguucggaacccgcugagcaggaauagcacccacgagauguacuggguuucuaacgccagcggcaacaucgucuccagugugaacaugaucucucggaugcugaucaaccgcuucacgaugcgacacaaaaaggccaccuacgagcccgacguggaccucgggagcgggacgcgcaacaucgggaucgaguccgagauaccaaaccuggacaucaucggcaagcggaucgaaaagauaaagcaggagcacgagaccagcuggcacuacgaccaggaccaucccuauaagaccugggccuaccacggcucauacgagacaaagcagacgggcagcgccuccagcaugguaaacggcguggugcgcuugcucacaaagcccugggauguucugccaaccgugacccagauggccaugacggacaccaccccguucgggcagcagcgcguguucaaggaaaaggucgacacccggacgcaggagccuaaggaaggcaccaagaagcugaugaagaucaccgccgaguggcucuggaaggagcucggcaagaagaagaccccgaggauguguacgcgggaggaguucacccgcaaggugcgauccaaugcggcccugggggccaucuucaccgaugagaacaaguggaaguccgcacgcgaggccgucgaagacagccgguucugggagcucguggacaaggagcggaaccugcaccuggagggcaagugcgagaccugcguguacaacaugauggggaagcgggagaagaagcucggcgaguuugggaaggcaaagggcagccgagccaucugguauauguggcugggcgcccgguuucuggaguucgaggcgcucggguuccugaacgaggaccacugguucucccgugagaacagccuguccggugucgagggggagggccuccacaagcugggguauauccuacgggacgugagcaagaaggaaggcggugccauguacgccgacgacacugccgggugggacacccgcaucacacucgaggaccugaagaacgaggagauggugacuaaucacauggagggcgagcacaagaagcuggcugaggcgaucuucaagcucacguaucagaacaaggucgugagagugcaacgccccacgccccgggggacggucauggacaucaucagccgccgggaccagcgcggcucaggacagguggggacauacggccugaacacauucacuaauauggaagcccagcugauccggcagauggagggggaggggguguucaagaacauccagcaccucaccgucaccgaggagguggccgugcagaacuggcuggcgcgcgucgggcgagaacggcugagccggauggcuaucucaggcgacgacugcgucgugaagccgcuagacgaccgguucgccaaugcccucaccgcccugaacgacaugggcaagauucgcaaagacauucagcaaugggagccgagcaagggguggaacgacuggacccaggucccauuuugcucucaccauuuccacgagcucaucaugaaggacggccgggugcugguugugcccugccgcaaccaggacgagcuuaucgggcgggcgcgcaucagccagggagcgggauggucccuccgggagaccgccugccuggggaagagcuacgcccagauguggucccugauguacuuccaccgccgagaucuccgccuggcugccaacgcgauuugcagcgccgugcccucccacugggucccgaccagccggacgaccugguccauacacgccaagcacgaguggaugaccaccgaagauaugcugaccgucuggaaccgcguguggauccgagagaacccguggauggaggacaaaacacccguggagagcugggaggagauccccuaccucggcaagcgcgaggaucaguggugugggucguugaucggccugacgagccgagcuaccugggccaagaauauccaggcggcgaucaaccagguccgcucccucaucgggaacgaggaguauauagacuacaugcccagcaugaaacgguuccgccgcgaggaggaagaagcuggcgugcugugguga

SEQ ID NO: 25337 - RNA, 9876 nt, Artificial Sequence
  derived and/or modified CDS sequence (opt11) from DENV-2__FJ410208__SS-prME
agcgccgggaugaucaucaugcugauccccaccgugauggccuuccacuuaaccacccggaacggagaaccccacaugaucgucggcauccaggaaaaggggaaguccuuacuguucaaaacugaagacggaguuaacaugugcacucucauggcaauggauuuaggugagcugugugaagacaccauaaccuacaagugcccccuccugcggcagaacgagccggaagacaucgacugcuggugcaacagcaccuccacuugggugaccuacgguaccugcaccaccaccggggaacaccggcgagaaaagcgcagcgucgcacuggugccccacguggggaugggccuagagacccggaccgagaccuggauguccucagaaggggcuuggaagcacgcccagagaaucgagaccuggauccuacggcacccgggcuucacgaucauggccgcgaucuuggccuacacaauugggaccacccacuuucaacgcguccucaucuucauccugcugacggccguugccccguccaugaccaugcggugcaucggaauaagcaaccgcgacuucguggagggcgucuccgggggcagcuggguggacaucguccucgagcacggguccugcgucacaacgauggcgaagaacaagcccacgcuggacuucgagcugaucaagaccgaggccaaacagccggcuaccuugcggaaauacugcaucgaggcgaaacugaccaacacgaccaccgaaagccgcugccccacucaaggcgaacccucacugaaggaagaacaagacaagcgguucguguguaagcacagcaugguagaccgcggcugggguaacgggugcggucuguucggcaagggggggaucgucacgugcgccauguucacgugcaagaagaacauggagggcaagaucguccaacccgagaaccuggaguacacgaucguggucacaccccauucuggcgaggagcacgcugugggcaaugauacgggaaagcacggccaggagaucaagguaacaccacagagcuccauuaccgaggcagagcugacuggguacggcaccgucaccauggaaugcagcccacgcacaggccucgauuuuaacgagauggugcugcugcaaauggagaacaaggccuggcuugugcaucgccagugguuucuggaucugccccuccccuggcugccgggggccgacaagcaggaguccaacuggauccagaaggagacccuugucaccuucaaaaauccccacgccaagaagcaagauguggucgugcucgggagccaggagggggcgaugcacacggcccuaaccggagcuaccgagauucaaaugagcuccgguaaucuccuguucaccggccaccugaagugcaggcuacgcauggacaagcuccaacugaagggaaugagcuauagcaugugcacggggaaguucaagguagucaaggagaucgccgaaacccagcacggcaccaucgucaucagaguacaguacgagggggacgggagccccuguaagaucccuuucgagaucauggaccuggaaaaacgcuauguccucggccggcugauuacagugaauccgaucgugacggagaaggauucccccgucaacaucgaagcggaaccgcccuucggcgacagcuacaucaucaucggcguggaacccgggcagcugaagcugaacugguucaagaagggaucaagcaucgggcagauguucgagaccacgaugcgcggcgcgaagcgcauggcaauucugggcgacaccgccugggacuucggcucccugggcgggguguucacgagcaucggcaaagcccuccaccaagucuucggggccauauacggcgcggccuuuuccggcgugagcuggaccaugaagauccugaucggggugaucaucaccuggaucggcaugaacucccgaucaaccucccugucggucucccuggugcucguggggaucguuacgcuguaccugggcguuauggugcaggccgacucagggugcgugguguccuggaaaaauaaggagcucaaaugcggcagcggcaucuucaucaccgacaacgugcacaccuggaccgagcaguacaaguuucaaccagagucaccuuccaagcuggccagugcaauccagaaagcacaagaggagggcaucugcggcauucgcuccgucacgcggcuagagaaccugauguggaaacagauuacccccgagcugaaccacauccuggcggagaacgaggugaagcucaccaucaugaccggugacaucaagggcaucaugcaggccggaaagcgcagccugcggccgcaacccacggagcugaaguacuccuggaaaaccuggggcaaggccaagaugcucagcacggaguccuacaaccagaccuuucugaucgacggccccgagacggccgagugcccgaacacgaaccgcgccuggaacagccuggagguggaggauuacggauucgguguauucacuacaaacauuuggcucaagcuaaaggagaagcaggaugcuuucugcgacuccaagcugaugucugcagcgaucaaggacaaccgggcgguucacgccgacaugggguacuggaucgagagugcccucaacgacacguggaaaauagagaaggccagcuucaucgaggugaagaacugccacuggccaaagucccacacccuguggagcaacggcguccuggagagugaaaugaucauccccaaaaaucucgcuggcccugugagccaacacaacuaccgcccgggguaccacacccaaaucgcgggccccuggcaccuggguaaguuggagauggacuucaacuucugugacggcaccaccgugauugucacggaggacugugguaaccggggccccucccuccgcaccaccacugccagcggaaagcugauuacggaguggugcugucggagcugcacccugcccccgcuccgcuaccgcggggaggacggcuguugguacgguauggaaauucgcccgcugaaggagaaggaggagaaccugguuaacucccuugugaccgcaggccacgggcaagucgauaauuucucgcugggcgugcuggguauggcacucuuccuggaggagaugcuucggacccgcgugggcacgaagcacgcgauccugcuggucgccguauccuucgugacucugaucaccggcaacaugucauucaaggauuuaggacgggucguggugauggucggcgccaccaugaccgacgacaucgggaugggcgugaccuaucuggcccugcucgcagcguucaaggugcgccccacguucgcugccggccugcugcuacguaagcugaccuccaaggaacugaugaugacgaccaucgggaucguccuacugagccaguccaccauaccugagaccgugcuggaacucacggacgcccuggcccuggguaugauggugcucaagaucguucgcaacauggagaaguaucagcuggcggugaccaucauggcaauccugugcguccccaacgccgugaucuuacagaacgcguggaagguuucaugcaccauccuggccgucguguccgugagcccccugcucuugaccucuagccaacagaagacggacuggauuccacuggcguugaccaucaaggggcugaaccccaccgccaucuuucugaccacgcucucccgcacaaacaagaagcggagcuggccgcugaacgaagccaucauggccgugggcauggugucgauccuggcgagcuccuugcugaaaaacgacauccccaugacggggccccuuguggccgggggccuccugacagugugcuacgugcuaacggggagaagcgccgaccucgagcuggagagagcuaccgacguaaaaugggaagaccaggccgagaucuccggcaguagccccauccucuccaucaccaucagcgaggacggguccaugaguaucaagaacgaggaagaggagcagacccucacgauccugauccgcacugggcugcucgucaucuccggacuguucccgaucagcaucccgaucacugcggccgccugguaccugugggaggugaagaagcagcgggccggagugcucugggacgucccaagcccaccgccaaugggcaaggccgaacuggaagacggggcuuaccgcaucaaacaaaaggguauccuggguuacagccagauuggagcuggcguuuauaaggaaggaaccuuccacaccauguggcacgugacacggggugcaguccucaugcacaaagguaagcgcauagaacccuccugggcugacguuaagaaggacuugaucuccuacggcgggggcuggaagcuggaaggggaguggaaggagggggaggaggugcagguccucgccuuagagccggggaagaaucccagggcggugcaaaccaagccaggccucuucaagaccaauaccgggacgaucggggcggugucacucgauuucagcccaggcaccuccggcagccccaucaucgauaagaaggggaaggucguggggcucuacgggaacggaguggucacccgauccggcgcuuacguuagcgccaucgcccagaccgagaagucaaucgaggacaaccccgaaaucgaggacgacaucuuucggaagcgccgacugacgaucauggaccugcauccgggggcggguaagaccaaaagguacuugcccgcgaucgugcgggaggccaucaagcgcggucugcggacgcuaauccucgcgccgacccgugucguggcggcagagauggaggaggcccugcggggcuugcccauccgcuaccagacgcccgccauccgggccgagcauaccggcagagaaaucguggaccucaugugccaugcaaccuucacaaugagacugcugagccccgugcgggugccgaacuacaaccucaucaucauggacgaggcccacuucacggaccccgccaguaucgccgcucgcgguuauaucagcacccggguggagaugggcgaggcggcugguaucuucaugacagccacaccgcccggcagccgcgacccguucccccaguccaacgcccccaucaucgacgaggagcgggagaucccugagcggagcuggaacuccgggcacgagugggucacggacuucaagggcaagaccgugugguucguaccaagcauuaaggccgggaacgacauagcggccugccugcggaagaacggcaagaaggucauccagcugucccgaaaaaccuucgacagcgaguacguuaagacccggacuaacgacugggauuucguggucaccaccgacaucucagagaugggcgccaacuucaaggcugagcgcgugaucgacccccggcgcugcaugaagcccgugauccucaccgauggggaagaacggguuauccuggcgggccccaugccugugacgcauagcuccgccgcccagcgccgggggcgcauaggccggaaccccaaaaacgagaacgaccaguacaucuacaugggagagccgcuggaaaacgacgaagacugcgcccacuggaaggaggcaaagaugcuccuggacaacaucaauacccccgaaggcaucaucccgagcauguucgaacccgaacgugagaagguggacgcuaucgacggugaauaccggcugaggggggaggcccgcaagacuuucgucgaucucaugcggcgcggcgaucugcccguauggcuggcguacaagguggccgccgaggggaucaauuacgcggaccggcgcuggugcuucgacggcaucaagaauaaccagauccucgaggaaaacauggaggucgagaucuggaccaaggagggggagcggaagaagcugaagccgcguuggcucgacgcucggaucuacagcgacccccucgccuuaaaggaguucaaagaguucgccgccggccgcaagucccugacguuaaaccugaucaccgagaugggccggcugcccaccuucaugacccagaagacgcgcgacgcgcucgacaaccucgccgugcugcacaccgccgaggccggaggucgagcauacaaccaugcccucagcgagcugcccgagacguuagagacccuccugcugcucacgcugcuggccaccgucaccggggggaucuuccucuuccugaugagcggcagggggaucgguaagaugacacuggggauguguuguaucaucaccgccuccaucuugcugugguacgcccagauccagccgcacuggaucgcggccagcaucauccuggaguucuuccugaucgugcugcugauccccgagcccgagaagcagcggacgccccaggauaaccagcucacauacguggucauagcaauacugaccgugguggccgccaccauggcgaacgagaugggcuuccuggagaagacgaagaaggacuuggggcuuggcuccaucgccacccgccaaccggagagcaacauccuugacaucgauuuacggcccgccuccgccuggacccuguacgcugucgcgaccacauucgugacccccaugcugcgccauagcauagagaacagcuccguaaacguaagccucacagccaucgccaaucaggcuaccgugcugaugggccuggguaagggcuggccacucagcaagauggacaucggggugccgcucuuagccauuggcuguuacagccaggucaaccccaucacgcuaaccgcggcccugcugcuacugguggcccauuacgccaucaucgggcccgggcugcaggcgaaggcgacccgcgaagcgcagaagcgugcugccgcgggcauuaugaagaaucccaccguggacgggaucacggucaucgaccucgacccgauccccuacgaucccaaauucgagaagcagcugggccaggugaugcugcucguacugugcgucacacaagugcugaugaugcggaccaccugggcccucugcgaggcccuaacgcuggccaccgggcccauaucuacucucugggagggaaacccggggcgcuucuggaacaccacgaucgccgucagcauggcaaacaucuuccggggauccuaucuggccggcgccggauugcucuucaguaucaugaagaacacgaccaauacgcgccgcggaacggggaacaugauagagacauuaggugagaaguggaagucccggcugaacgcccucggcaaaucagaguuccagaucuacaaaaagucagggauacaggaggucgacagaacccuggccaaggaggguauaaaacgcggggagaccgaucaccacgcggugagccgcggcuccgccaagcugcggugguucguggagcgcaacauggucacucccgaggggaaggucguggaccucggcugcggccgaggcggguggagcuacuacugcgguggcuugaaaaacguccgcgaggugaaggggcugaccaagggcggacccgggcacgaggagcccaucccgauguccaccuacggauggaaccucguccgguugcagagcggggucgacguguucuucaucccgcccgagaaaugcgacacccugcucugcgacaucggagagagcucacccaacccaaccguggaggcagggcgcacgcugcggguccugaaccucguagagaacugguuaaauaacaacacccaguucugcaucaaggugcugaaccccuauaugccuucggucaucgagaagauggaggcacugcagcgcaaguacggcggugcgcucgugcggaacccgcuaucccgcaacagcacgcacgagauguacugggugaguaacgccagcggcaacaucgucuccagcgugaacaugaucagucggaugcugaucaaccgcuuuaccaugcggcacaagaaggccacguacgagcccgacguggaccucggcuccggaacccgcaacauuggcaucgagucggagauucccaaccuggauaucaucggcaagcggaucgagaagaucaaacaggagcacgagaccagcuggcacuacgaccaggaucaucccuauaagacaugggccuaucacggcuccuacgagacuaagcagaccgggagcgccucgagcaugguuaaugguguggugcgccuccucacaaagccgugggacguccugcccacggugacgcaaauggcgaugaccgacaccacccccuucggccagcagcgcguguucaaggagaaggucgacacgcggacccaggagcccaaggaagggaccaagaagcugaugaaaauaaccgccgaguggcucuggaaggaacugggcaagaagaagacgccgcgcaugugcacucgugaggaguucacccgcaaggugagguccaacgccgcccugggagcaaucuuuaccgaugagaauaaguggaaguccgcgcgugaggcuguggaggacucccgguucugggagcucgucgacaaagagcgcaauuuacaccuugaggggaagugcgaaacgugcguguacaacaugauggggaagcgggagaagaagcucggcgaguuuggcaaggccaaagggagccgggccaucugguacauguggcugggagcacguuuccuggaguucgaggcgcucggguuccugaacgaggaucacugguucucccgcgagaacagccugaguggggucgagggagaggggcuccacaagcuaggcuacauccugcgugacgugagcaaaaaggagggcggggccauguacgccgacgacaccgcaggcugggacacccguaucacccucgaggaccugaagaacgaggaaaugguaacgaaucauauggagggggaacacaagaagcuggcggaggccauauucaagcuuacguaccagaacaaggucgugcgugugcagcgccccacgccccgcggcaccgucauggacaucauaagccggcgggaccagcgcgggaguggccagguggggacguacggccugaacaccuucaccaacauggaggcccagcugauacggcagauggaaggggagggaguguucaaaaacauccagcaccucaccguuacugaagagguggccgugaagaacuggcuggcacgcgucggccgagagagacuuagccgcauggcgaucuccggggacgacugcguggugaagccccucgaugacagauucgccaacgcucuuaccgcccugaaugacaugggcaagaucaggaaagacauccagcaaugggagccgagcaagggguggaaugauuggacccagguuccguucugcagccaccauuuccacgagcuuaucaugaaggacgggcgggugcuggugguucccugccgcaaccaagacgagcugaucggccgggcccguaucagccagggggcgggcuggucccuccgggagacggcgugcuugggcaaaagcuacgcccagaugugguccuuaauguauuuccaucgccgggaccuccggcuggccgccaacgcgaucugcagcgccguucccagccacugggucccgacgagccggaccaccuggucgauucacgccaagcacgaguggaugaccaccgaggacaugcugacggucuggaaccgcguguggauccgugaaaaccccuggauggaggacaagacccccguggagagcugggaagagauccccuaccucggcaagcgcgaagaccaauggugcggcucacugaucgggcugacgagccgggccacuugggccaagaacauucaggcggcgaucaaccagguucgcucucucauuggcaacgaggaauacacggacuacaugccguccaugaagcgcuuccgcagggaggaggaggaggccgggguucuaugguag

SEQ ID NO: 25338 - RNA, 9876 nt, Artificial Sequence
  derived and/or modified CDS sequence (opt11) from DENV-2__FJ461305__SS-prME
ucagcggggaugaucauaaugcugauccccaccgugauggccuuccaucucaccacccggaacggggaaccccacaugaucgugggcauccaggagaaggguaagucccuucuguucaagacggaggacggcgugaauauguguacccucauggccauggaccugggggagcugugcgaggauaccauaaccuacaagugcccccuccugcggcagaacgagcccgaagacaucgacugcuggugcaacagcaccuccaccugggugaccuacgggaccugcaccaccaccggcgagcaccgccgugaaaagcgcagcguagcccugguaccccauguggguaugggccucgagacccggaccgagaccuggauguccucugagggggcuuggaagcacgcccagcgcauagagacguggauccugcggcacccgggcuucaccaucauggccgcgauccuggccuacaccaucgggaccacccacuuccagcgcgugcucaucuucaucuugcugaccgccguggcccccuccaugacuaugcggugcauuggcaucuccaaccgugauuucguggagggcguguccgggggcucauggguggacauagugcuugagcauggguccuguguuacaaccauggcuaaaaacaaacccacgcuggacuuugagcugaucaagaccgaggccaaacagcccgccacccuccggaaguacugcaucgaggccaaacugaccaacacgaccaccgagagccgcugcccaacccagggcgagcccucucugaaagaagaacaagacaagcgauucguguguaagcacagcaugguugaucguggcuggggcaacggcugcggccuguucggcaagggugggaucguuacgugcgccauguucacgugcaaaaagaacauggaggggaagauugugcagcccgaaaaccuggaguacaccaucguggugacgccccacuccggggaggaacaugcggugggcaacgacacggggaagcacggccaggagaucaaagugaccccgcagucguccaucaccgaggccgagcugaccggguacggcaccgucacgauggagugcagcccccggaccggccucgacuucaacgagauggugcugcugcagauggagaacaaggcuugguuaguucaccgccagugguucuuagaccuaccccugcccuggcugccgggggccgacaagcaggaguccaacuggauccagaaggagacgcuugucaccuucaagaacccccacgccaagaagcaggacguggucgugcuaggcagccaggagggggcgaugcacacggcucugaccggcgcgaccgagauccagaugaguuccgggaaccuacucuucacaggccaccugaagugucggcugcgcauggacaagcuccaauugaagggcaugagcuacuccaugugcaccgggaaguucaaggucgucaaggagaucgccgaaacccagcacggaacuaucgugauccgugugcaguacgagggcgacggcucucccugcaagaucccguucgagaucauggacuuggagaaaagguaugucuugggccggcugauuaccguaaacccgauugugacggagaaggacucccccgugaauaucgaggcagagccacccuucggggacucuuacaucaucaucggcguggagccggggcagcugaagcuaaacugguucaagaagggcuccagcaucggucaaauguuugagaccaccaugcgcggcgcgaagcguauggccaucuuaggugacaccgccugggacuuugggagccugggcggggucuucacgagcaucggcaaggcccuccaccaggucuuuggggccaucuacggcgcggccuucuccggcgugaguuggaccaugaagauccugauuggugugaucaucacuuggauuggcaugaacucccggagcacguccuugagcgucuccuugguccucguggggaucgucacgcuauaucuggguguuauggugcaggccgacucggguugcgucgucucguggaagaacaaggaacucaagugcggcagcggaaucuucaucaccgacaacguccauaccuggacagagcaauauaaguuccaacccgaaagcccaaguaagcuagcuagcgcuauccagaaggcccaggaggaggggaucugcggcauccgcuccgucacucgguuggagaacuuaauguggaaacagaucacacccgagcugaaucauauccuggccgaaaacgaggugaaacuuaccaucaugaccggggacaucaaggguaucaugcaggccgggaagcgcagccugcggccgcagccgacggagcugaaguacuccuggaagaccuggggcaaggccaagaugcucuccaccgaguccuacaaccagaccuuucugaucgacggucccgagacggcagagugcccgaacacaaaucgcgccuggaacagccuggagguggaagacuacggguucggaguuuucaccacgaacaucuggcucaagcugaaggagaaacaggacgccuucugcgacuccaagcugaugagcgcugccaucaaagacaaucgggcggugcacgccgacaugggguacuggaucgagagcgcccucaacgauacguggaagaucgaaaaggccagcuucaucgagguuaagaacugccauuggccaaagucccacacccuguggagcaacggaguccuggaguccgagaugauaauccccaagaaccucgccggcccagugucgcagcacaacuaccgcccgggguaccacacacagaucgccggccccuggcaccuggggaaacuggagauggacuuugacuucugugacggcaccaccguaauuguuacggaggacugcgggaaccgaggccccucucugcgcacaaccaccgccagcggcaagcugauaacggaguggugcugccggagcugcacccugcccccacuccgcuaccgcggagaggacggcuguugguaugggauggagauccgcccccugaaggaaaaggaggagaaccuggugaacucccucgugaccgccggccacggucagaucgacaacuucagccugggcgugcugggcauggcccucuuccuggaagagaugcugaagacccgcgucgggacgaaacacgcgauccucuugguugcggucuccuucgugacccugaucaccggcaacaugagcuuuaaggaccucgggcgcguggucgugauggugggcgccacgauggcagacgacauugggaugggggucaccuaccuggcccugcuugcggccuucaaagugcggcccacuuucgccgccggcuuauugcuccguaagcugaccuccaaggagcugaugaugaccacgauugggaucguguuacugagccaguccaccaucccagaaaccguccuggagcucaccgacgcccuggcccugggcaugaugguguugaagauaguucggaacauggagaaguaccagcuggccgugacuaucauggcgauccugugcgugccgaacgcagucaucuugcagaacgccuggaaggugagcugcaccauccuggcgguggucuccgugagcccucugcuucucaccuccucgcagcagaagaccgacuggaucccccuggcccucacgaucaaagggcugaaccccaccgcaaucuuccugaccacccucucccgcacgaacaagaagcgcagcuggccgcugaacgaggcuauuauggcgguugggauggucuccauccuggccucaucccuccucaagaacgacaucccaaugaccggaccccugguugccggaggccuccugaccgucuguuacguccugaccggucggagcgccgaccucgagcuugagagagccacggaugugaagugggaggaccaggcggagauuuccggcagcagccccauacuguccauuacuaucagugaggacgggagcaugagcauaaagaacgaggaggaggaacagaccuuaaccauacugauccggacgggccuacucgugaucuccggccuuuucccgauuaguauucccaucaccgccgccgcuugguaucugugggaggucaaaaagcagcgcgccggggugcucugggacgugcccuccccgccgcccaugggcaaggcggaacuugaggacggagccuacagaaucaagcagaaaggcauucucggcuacagccagauuggagccggcgucuacaaggaggggaccuuccacaccauguggcacgugacccgcggcgccgugcucaugcauaaggguaagcggaucgagcccuccugggccgacgucaagaaggaccugauuagcuacggcggaggcuggaagcucgagggugaguggaaggagggugaggagguccaggugcuggcguuagagcccgguaagaacccccgcgccguccagacgaagccggggcuguuuaagaccaacacgggcacuaucggggccgugucccucgacuucucccccggaacgucaggcagccccaucaucgacaagaaggggaagguggucggccuguacggcaacggcgugguaacccgguccggcgccuacguaagcgcaaucgcgcagaccgagaaguccauugaggacaauccagagaucgaggacgauaucuuccguaagcggcgccugaccauuauggaccuccaucccggagccggcaagacgaagcgguaucuccccgcaaucgugcgcgaagcgaucaagcgggggcugcgaacccugauacucgcgccgacccggguggucgccgccgagauggaagaggcccugcgcgguuuaccgauccgguaccaaacaccagcuaucagagcggagcacacggggcgggagaucguggacuugaugugccaugccaccuucacaaugcgccugcugagcccugugcgcgucccgaacuacaacuuaauaaucauggacgaggcccacuuuaccgaccccgccuccaucgccgcgcggggcuauaucagcacccgcguggagaugggcgaggccgcagggaucuuuaugaccgcuacgccgcccggcagccgggaccccuucccccaguccaacgcccccaucaucgacgaggagcgcgagauccccgaaagaagcuggaacuccgggcacgagugggugaccgauuucaagggaaagacggucugguucgugccgagcaucaaggcggggaacgacaucgccgcuugccugcguaagaauggcaagaagguaauccagcugagucgcaagaccuuugacagcgaguacgucaagacacgcaccaacgauugggacuucgugguaacgaccgacauauccgagaugggcgccaacuucaaggcggagcggguaaucgacccccgccggugcaugaagcccgugauccucaccgacggagaggagcgcgugauccuggccggccccaugccggucacccacagcucugccgcccagaggcgcggaaggaucggacgcaacccuaagaacgagaacgaccaguacaucuacaugggggagccacuggagaacgacgaggacugcgcucauuggaaggaggcgaagaugcuccuggauaacaucaacacacccgaggguaucaucccguccauguucgaaccugagagggagaagguggacgccaucgacggcgaauaccgucuacgcggggaggccagaaaaacauucguggaccucaugcgccgaggcgaccuccccguuuggcuagccuacaaaguggccgcggaggguaucaacuacgcagaucgccgguggugcuucgacggcaucaagaacaaccagauccucgaagagaauguggagguggagaucuggaccaaagagggcgagcgcaagaagcugaaaccacgguggcucgacgcgcgcaucuacucugacccccuugcgcugaaggaguucaaggaguucgccgcgggccggaagucccugacgcucaaccugaucacggagaugggcagacugccaaccuucaugacccagaagacucgggacgcccucgacaaucuugcagugcugcacacggcagaggccggagggcgcgccuacaaccacgcccucuccgagcugcccgagacacucgagacacuccugcuccucacccugcuggccacggucaccggaggaaucuuccucuuccuuaugagcggucgggggaucggcaagaugaccuuggggaugugcugcaucaucaccgccucuauucucuuaugguacgcacagauccaaccgcacuggauugcugcaagcaucaucuuagaguucuuccucaucgugcuacugauccccgagccagagaagcaaagaacgccccaggacaaccagcuaacguacguggucaucgccauccugaccguuguggccgcgaccauggccaaugaaaugggcuuccuggagaagaccaagaaggacuuggggcugggcuccaucgccacccagcagccggaguccaacauccuggacaucgaccugcggcccgccuccgccuggacccuguacgcggucgccaccaccuuuguuacgcccaugcuccgccacagcauagagaacucguccgugaaugucagccucacagcaaucgccaaucaggccacggugcugaugggccuggggaagggcuggccccucuccaagauggacaucggggugccgcuccuggcgaucggguguuacucgcaggucaaucccaucacccucacggccgccuuacugcuccuaguagcucauuacgcgauaaucgggcccggucugcaggccaaggccacccgugaggcccaaaaacgugcggcggccggcaucaugaaaaaccccaccguggacgggaucaccgucaucgaccucgacccaauccccuacgacccgaaguucgagaagcagcugggacaggugaugcugcucauccugugcgugacacaggugcugaugaugcggacgaccugggcccucugcgaagcacugacccuugcaacagggcccauaucaacccucugggagggcaacccugggcgcuucuggaauaccacgaucgcggugagcauggccaacaucuuccggggaucuuaccuggccggcgccgggcuccucuucuccaucaugaagaauacgacaaacacgcgccggggcaccggaaauaugggcgagacgcugggcgagaaguggaaaucccgacugaaugcccucggcaaguccgaguuucagauauacaagaagucuggcauacaagagguggaccguacccuagcuaaggaggguaucaaacggggagagaccgaccaucacgccgucucccgcggguccgccaaacuccgcugguucguggagcgcaacauggugaccccggagggcaaggucgucgaucucggcugcgggcggggcggcuggagcuacuacugcggcgggcugaagaacgugcgcgaggugaagggccugacgaaagggggcccugggcacgaggagcccaucccgaugucgaccuacggcuggaaccucgugcggcugcagagcggcguagacgucuuuuucauaccgccugagaagugcgacacccugcucugcgacaucggggaguccagcccuaacccgaccguggaggccggccgcacucugcgggugcuuaaucucgucgagaacuggcugaacaacaacacucaguucugcauuaagguuuuaaaccccuauaugcccuccguuaucgaaaagauggaggcacugcagcgcaaguacggcggggcccucgucaggaacccgcugagccgcaacucgacccacgagauguacuggguuuccaacgccagcggcaauauuguaucaagugucaacaugaucucccggaugcugauuaaccgcuuuacuaugcggcacaagcgcgcaacuuacgagccagacguagaccucgggagcgggacgcguaauaucgggauugaaagcgagauccccaacuuagacaucaucggcaagcguaucgagaagaucaagcaggagcacgagaccagcuggcacuacgaccaggaccacccguauaaaacaugggccuaccacggcucauacgagacaaagcagacggggagcgcauccagcauggugaacggcgucgugcggcugcucaccaagccgugggacgugcugcccacaguuacacagauggcuaugacggacacuacccccuucgggcagcaacggguguucaaggagaagguggauacucgcacgcaggagcccaaggagggcaccaagaagcugaugaaaaucacggccgaguggcucuggaaggagcugggcaagaagaagaccccgcguaugugcacgcgcgaggaguuuacccggaaggucagauccaacgccgcccugggggcuauauucaccgacgagaacaaguggaaaagcgcccgggaggcuguagaggacucccgcuucugggagcuaguggacaaggagcggaaccugcaccuggaggguaagugcgagaccugcgucuacaacaugaugggaaagcgcgagaagaagcucggcgaguucgggaaggcgaagggcagccgggccauuugguacauguggcugggcgcccgcuuccuggaguucgaggccuugggguuccugaacgaggaccacugguucucccgugagaacagcuuguccggaguggagggggagggccuccacaaguugggguacauccugcgcgacgucagcaagaaggagggcggcgccauguacgccgacgauacggcggggugggacaccaggaucacccucgaggaccugaagaacgaggagauggugaccaaccauauggaaggcgagcacaagaagcuggccgaggcuaucuucaaacucacguaccagaacaaggugguccgcguccaacggcccacaccccgggggaccguaauggacaucaucucgcgucgagaccagcgggguuccggucagguugguacuuacggccugaacacguucaccaauauggaggcccagcugauccggcagauggagggggaagguguguucaagaacauccagcaccucaccgugaccgaggagguagccgugcagaacuggcuggcgcggguggggcgcgagcgccugagccggauggcgaucuccggagaugacugcgucgugaagccccucgacgaccgcuucgccaacgcacugacggcccucaacgacaugggcaaaauccggaaggacauccagcagugggagccgagcaagggguggaacgauuggacccaggugcccuucugcucccaccacuuccaugaguuaaucaugaaggacggccgcguccugguugugcccugccggaaccaggacgagcugaucgggcgcgcgcguaucucgcagggugccggguggucccuccgcgagaccgccugucuaggaaaguccuaugcccagaugugguccuuaauguauuuccaccggcgcgaccuccggcuagcggcgaacgccaucugcagcgccgucccuucccacuggguuccgacuucacgcacgaccugguccauccacgcuaagcaugaguggaugaccaccgaggauaugcugaccgucuggaaccgcgucuggauccgcgagaaccccuggauggaggauaagacacccguugagagcugggaagagauccccuaccucggcaagcgggaggaccagugguguggguccuuaaucggccugaccucgagagccaccugggccaagaacauccaggccgccaucaaccaagugcggaguuugaucgggaacgaggaguacaccgacuacaugcccagcaugaagcgcuuccggcgcgaggaggaggaggccgggguccugugguaa

SEQ ID NO: 25339 - RNA, 9876 nt, Artificial Sequence
  derived and/or modified CDS sequence (opt11) from DENV-2__FJ410215__SS-prME
agcgccggcaugaucaucaugcugaucccgacugugauggccuuccaccucaccacccgcaacggugaaccccacaugaucgucggcauccaggagaagggcaagagccugcuguucaagacugaagacggcgugaacaugugcaccuuaauggcgauggaccucggggagcugugcgaggacaccaucacauacaaguguccccuucugaggcagaacgagccugaggacaucgacugcuggugcaacagcacaagcaccugggucaccuaugggacaugcaccaccaccggugagcaccgccgggagaaacgcagugucgcccuggugccgcauguugguaugggccucgagacccggacagagaccuggauguccagcgagggggcuuggaagcacgcccagagaauugagacguggauacugcggcacccgggcuucacgaucauggccgcgauucuugccuacaccaucgggaccacccacuuccagcgcgugcuaaucuucaucuuacugacggccguggcccccuccaugaccaugcggugcauuggcauuagcaaccgcgacuucguggagggcgucuccgggggcagcuggguggacaucgugcuggagcacggguccugcgucacgaccauggcgaagaacaaacccacgcuggauuucgagcugaucaagaccgaggccaagcagcccgcgacgcugcggaaguacugcauagaggccaagcugaccaacacaaccaccgaaagccgcugcccgacccagggcgagccgucacugaaggaggagcaggacaagcguuucgugugcaagcacagcaugguugaccgcggcugggggaacggcugcggccuguucgguaagggugggaucguaaccugcgcuauguucacgugcaagaagaauauggaggggaagaucguucagcccgagaaccuggaguacaccaucguggucacgccacacucaggggaggagcacgcggugggcaacgauacgggaaagcacggcaaggagauaaaggugaccccgcagagcuccaucaccgaggccgaacucaccggguacggcacagugaccauggaaugcagcccucggaccggccuugacuuuaaugagauggugcugcugcagauggagaacaaggccuggcucgugcaccgccagugguuccuggaccuaccacuccccugguuaccgggggccgauaagcaggaauccaauuggauccaaaaggagacccuggucacguucaagaacccccaugccaaaaagcaggacguagucgugcucggcagccaggagggggcuaugcacacugcucuuaccggcgccaccgagauccaaaugagcucgggcaaccuccucuucacuggccaccugaagugccgacugcgcauggacaagcuccaacugaagggcaugagcuacuccaugugcacggggaaguucaagguggucaaggagaucgccgagacccagcacggcaccaucgugauucgcguacaguacgagggggacgguucgcccugcaagauucccuucgagauuauggaccuggagaagcgcuacguccucggccggcugaucaccgugaacccgaucgugacggagaaggauucgcccgucaauauugaggccgagccacccuucggagacagcuacaucaucaucggcguggagccggggcagcugaagcucaacugguucaagaagggcuccagcaucgggcagauguucgagaccaccaugcgcggcgcgaagcgcauggcuauccugggggacacugccugggacuuuggcucccugggcgggguguuuacgagcaucggcaaggcccuccaucaagucuucggagcuaucuacggcgcggccuucuccggcgugagcuggacaaugaagauccugauaggggugaucauuaccuggaucggcaugaacucccggagcacaucacugagcguuucgcugguccucguugguaucguaacgcuguaucugggcgugauggugcaggccgacagcgggugcgugguguccuggaagaacaaggaacucaaguguggcagcggcaucuucaucaccgacaacgugcacaccuggaccgagcaguauaaauuccagcccgaaagcccuaguaagcuggcuagcgcaauccagaaggcccaagaggaagggaucugcggcauccgauccgucacgcggcuggaaaaccucauguggaagcaaaucacucccgaguuaaaccacauacuggccgagaacgaggugaagcucaccauaaugacaggggacaucaagggcauaaugcaggccgggaagcgcagccugaggccgcagccaacugaacugaaguauuccuggaagaccuggggcaaggccaagaugcugagcaccgagagcuacaaccagaccuuccuaaucgacggccccgaaacggccgagugcccgaauacaaaucgcgccuggaacagccuggagguggaggacuacggguucggcguauucaccacaaacaucuggcucaaacugaaggaaaagcaggacgccuucugcgacaguaaguuaaugagcgccgccaucaaggacaaccgagcgguccacgcugacaugggguacuggauagaguccgcauuaaacgacacguggaagauagagaaggccucguucaucgaggugaagaacugccacuggccaaagucccauacccuguggagcaacggcgugcuggaguccgaaaugaucauccccaagaaccucgccggccccgugagucagcacaacuaccguccaggguaccacacccagaucgcgggcccuuggcaccuggggaagcuggagauggacuuugacuucugcgacggcaccaccgugaucgucacggaggacugcgguaaucggggcccaagccugcggaccaccacugccagcggcaagcuaaucacggaauggugcugccggagcuguacccuacccccuuuacgcuaucgcggggaagacgguugcugguacgggauggagauccgcccacugaaggagaaggaggagaaccuggugaacucccucgugacugccggucauggccagguugauaacuucucgcuggguguccugggcauggcccucuuccuggaggagauguugcguacccgcguggggacgaaacaugccauccuccuggucgccgucuccuucguaacccugaucaccggcaacaugagcuucaaggaccucgggcgggucguggucaugguaggggccgccauggccgacgacaucgggaugggcgugaccuaucuggcguuacucgcggcauuuaaggugcgccccacguucgccgccggccuccugcuaaggaaacuuaccucgaaggagcugaugaugaccaccaucgggauuguccuccugagccagucgacgauccccgagacuguauuagaauuaaccgaugcgcuugcacugggcaugauggugcucaagauaguccgcaauauggagaaguaccagcuggcgguuacgaucauggccauccuuugugucccgaaugccgugauccuacagaacgcguggaaggugagcugcacgaucuuggcugucgucagcgugagcccauugcuccuuaccagcagccagcagaagaccgacuggauucccuuggcgcucaccaucaagggacugaaccccacggccaucuuccugaccacccucucccgcacaaacaagaagcggucguggccgcugaacgaagcgaucauggccguaggcauggugucgauccuggccuccucccuacugaagaacgacauccccaugacgggcccacugguggcagggggccuccugaccgucugcuacgugcugaccgggcguagcgccgaccucgaacuugagcgggcaaccgacgugaagugggaggaccaggccgagauauccggcagcucucccauucuaucuauuacaauaagcgaggacggauccaugagcaucaagaacgaggaggaggagcagacccucaccauccugauccgcacgggccugcucguaauuuccggccuguucccgauuagcauccccaucacggcagccgccugguaccugugggaggugaagaagcagcgggcggggguacucugggacguccccagcccgccgcccaugggcaaggccgagcuggaggacggggccuacagaauaaaacaaaagggcauccugggguacagccagaucggcgccggcguguacaaggaggguaccuuccauaccauguggcacgugaccaggggcgccgugcucaugcacaagggaaaacgcaucgagcccagcugggcugacgucaagaaggaccugauuagcuacggcggggguuggaagcucgagggcgaauggaaagagggggaggaggugcagguccucgccuuagagcccggcaagaacccccgggccgugcagaccaagccggggcuguucaagacgaacacgggcacuaucggggccgugucccuugacuucaguccaggcaccuccgggagccccaucaucgacaagaaggggaaggucgugggccuguacgggaacggcguggugacgcgcuccggcgcguacgugagcgcgaucgcgcagaccgagaaguccaucgaggacaaucccgagaucgaggacgacauuuuuagaaagcgccgccugaccaucauggaccugcaccccggggccggcaagaccaaacgcuacuugccggccaucgugcgugaggcgaucaagagaggccugaggacgcugaucuuagcgccgacccgcgucguggccgccgaaauggaggaggcccuacgagggcugcccauccgcuaccagacccccgcgaucagagccgaacacaccgggcgcgagaucguggacuugaugugucacgcgacguuuacuaugagacuacugagccccguacggguucccaacuacaaccugaucauuauggacgaggcccauuucaccgaccccgccaguaucgcggcccgcggcuacaucucuacccggguggagaugggcgaggcagccgggaucuuuaugacggcuacgccgccuggcucccgcgauccguuuccccagucuaacgccccaauuaucgacgaggagcgggagaucccggagcgcagcuggaacuccgggcacgaaugggucaccgauuucaagggcaagaccguuugguucgugccgagcauuaaagcggggaacgacauugccgccugccugcggaagaacggcaagaaagucauacagcugucccgcaagacguucgacucagaguacgugaagacccggacuaacgacugggacuucguugucacgacggacaucagugagaugggugcgaacuucaaggcagagcgcgugaucgacccccggcgcugcaugaagcccgugauccucaccgacggggaagaacggguaauccucgccgggcccaugccggugacccacagcuccgcugcacagcgccggggacggaucggccggaaccccaagaacgaaaacgaccaguacaucuauaugggggagccacucgagaacgacgaggacugugcgcacuggaaggaggccaagaugcuccuagacaacaucaacacgcccgagggcaucaucccgucaauguucgagccugagcgcgagaagguggacgccaucgacggcgaguaccgccugcgcggggaggcccgcaagacguucgucgaccucaugcgucgcggcgacuuacccguguggcuagccuacaagguggcggccgaggggaucaauuaugccgaucggcgcuggugcuucgacggcauuaagaacaaccagauccuagaggagaacguggaggucgagaucuggaccaaagagggggagcggaagaaacugaagccucgcuggcuggaugcccggaucuacagugacccccucgcccugaaggaguucaaggaguucgcggccgguagaaaaagccugacccuuaaucugaucacagaaaugggccggcugcccacguucaugacccaaaagacccgagacgcccucgacaaccuugccguccugcacaccgcggaggccggagggcgggccuacaaccacgcccucuccgagcuccccgaaacuuuagagacccucuuacugcucacccugcuggccaccgugacaggcgggaucuuccucuuccugaugagcgggcgcgggaucggcaagaugacacugggaaugugcugcaucauaaccgcguccauccucuugugguaugcgcagauucagccacacuggaucgcugccagcauaauccuggaguuuuuccucauugugcuguugauccccgagcccgagaagcagcggacgccucaggacaaccagcuuaccuacgucgugauagccauccugaccguggucgccgcgacgauggccaacgagaugggcuuccuggagaagaccaaaaaggacuucggacucggguccauagcgacucagcagccggagucaaacauccuggacauugaccugcgacccgccucagcguggacgcuuuacgcaguggccacaacauucgugacgcccaugcuucggcacagcaucgagaacagcucugucaacgugagccugacggccaucgccaaccaggcgaccgugcucaugggacuggggaaaggauggccccuguccaagauggauaucggcgucccccuccuggcgaucgggugcuacagccaggugaaccccaucacccugaccgccgcccuccugcuucugguggcucacuacgccaucaucgggcccggccugcaggccaaagccacgcgggaggcgcagaagcgggcugccgccggcauuaugaagaaccccaccgucgacggaaucacagugauagaccuagacccgaucccauacgaccccaaguuugaaaaacagcucggccaggugaugcugcugauccucugcguuacccagguucugaugaugcgcacuacuugggcccugugcgaggcccucacacuggcgaccgggccgauauccacgcugugggagggcaauccggggcgguucuggaauaccacuaucgccgugagcauggccaacaucuuccggggcuccuaccucgccggggcgggucugcuguucagcaucaugaagaacaccacuaacaccagacggggcaccgggaauaucggcgagacccucggagagaaguggaaguccaggcugaacgcgcuggggaaguccgaguuccagacguacaaaaaguccggcauccaggaggucgauagaacccucgcgaaggaagggaucaaacgcggcgagacagaccaucacgccgugagucgcggaucagccaaguuacgcugguucguggagcggaacauggucacccccgagggcaagguggucgaccugggcugugggaggggcggguggucauacuacugcggagggcucaagaacguccgggaagugaagggcuugacgaagggagggcccgggcacgaggagcccaucccgauguccaccuacggguggaaccuggugcgccuccagagcggcgucgacguauucuucaucccgcccgagaagugcgacacccugcugugcgacaucggggaguccagccccaaucccaccguggaggcgggccggacgcuccgcguacugaaccugguggaaaauuggcugaacaacaacacucaauucugcauuaaggugcugaacccuuacaugcccuccgugaucgagaagauggaagcgcugcaacgcaaguacggaggggcccuggugcggaacccgcucucacggaauagcacccacgagauguacuggguauccaacgccagcggcaacauagucuccagcgugaacaugaucuccagaaugcugaucaaccgguucaccaugaggcacaaaaaggcgaccuacgagcccgauguggaccuggggagcggcacgcggaacaucgggaucgaguccgagauucccaaccucgacaucauaggcaagcggaucgagaagauaaaacaggagcacgagaccagcuggcacuacgaccaagaccauccuuacaagaccugggcguaccacggcagcuaugagaccaagcagaccgguagcgccuccagcaugguaaacggcguggugcggcugcugaccaagccgugggacguccuccccaccgugacccagauggcuaugacggacaccacccccuucggucagcagcgcguguucaaagagaagguugacacccgaacacaggagccaaaggagggcacaaagaaguuaaugaagaucaccgccgaguggcuguggaaggagcucggcaaaaagaagacaccgcggaugugcacgcgcgaagaguucacccggaaggugagauccaacgccgcgcugggggccauuuucaccgacgagaacaaguggaaaucggcacgggaggccguugaagauucucgcuucugggagcuggucgauaaggagcggaacuugcaccuggagggcaaaugcgagaccuguguauacaacaugauggggaagcgcgagaagaagcugggagaguucggaaaggccaaggggagccgggccaucugguacauguggcucggcgcccgcuuccuggaguucgaggcccucggauuccucaaugaggaccacugguucucgcgggagaacagccugucugguguagagggggagggccugcacaagcucggguacauccugcgcgaugugagcaaaaaggagggcggcgccauguacgcagaugacacggccgguugggauacccggaucacccuggaagaccuaaagaacgaggagauggugaccaaccacauggagggugagcauaaaaagcuggcagaggccaucuucaaguugacguaccagaacaaggucgugcgcgugcagagacccacgccccgggggaccgucauggacaucaucagccggcgcgaccagcgggguaguggccagguagggaccuacggccugaacaccuucacgaacauggaggcucagcuuauccgccagauggagggggagggcguguucaagaacauccagcaccugacggucaccgaggagguggcugugcagaauuggcucgcccgggucgggcgcgagcgccugucccggauggccaucucuggcgaugacugcguggugaaaccccuggacgaccgcuucgccaacgccuugacggcgcuaaacgacaugggcaagauccggaaggacauccagcagugggagccguccaagggguggaacgacuggacccagguccccuucuguucccaucacuuucaugagcuaaucaugaaggacggcagagugcuggucgucccgugccggaaccaggacgagcugaucgggcgagcccggaucucucagggcgccggguggucccuccgcgaaaccgccugccucggcaagagcuaugcccagauguggagucugauguacuuccaucggcgcgaucugagauuagcggccaaugccaucugcagcgccgugccaagccacugggugccgaccucgcguacgacuugguccauccacgccaaacacgaguggaugaccaccgaggauaugcugaccgucuggaaccggguguggauacgcgagaaccccuggauggaggacaagacgccuguggagagcugggaggaaauccccuaccugggcaagcgggaggaccaguggugcggaucccucaucggccuaaccagccgcgcgaccugggccaagaacauccaggcagccaucaaccaagucaggucccugaucgggaacgaggaauacaccgacuacaugccgagcaugaagcgcuuccgucgcgaggaggaagaggcgggcgugcucugguga

SEQ ID NO: 25340 - RNA, 9876 nt, Artificial Sequence
  derived and/or modified CDS sequence (opt11) from DENV-2__FJ461309__SS-prME
ucggcggggaugaucaucauguugauccccaccguuauggcauuccaccucaccaccagaaauggcgaaccacacaugaucgucggcauccaagaaaaggguaagucgcuucuguuuaagacagaggacggcgugaauaugugcacacucauggccauggaccucggcgaacugugcgaagacacuauaaccuauaagugcccacucuugcggcaaaaugagccggaggauaucgacugcugguguaauucgaccucgaccugggugacauacggcaccuguaccaccaccggggagcacagacgggagaagaggagcgucgcccuugugccccacguggggaugggccuugagacgcguaccgagacauggauguccagugagggggccuggaagcaugcccagcgcaucgagaccuggauuuuacgccauccgggcuucacuaucauggccgcaauacuggccuacaccaucgggacgacgcauuuccagcgcguucucaucuucauucugcuuacggccgucgcccccuccaugaccaugcggugcaucgggaucagcaaccgcgauuucguugagggcgucagcgggggcucuuggguggacauugucuuggagcauggguccugcgucaccaccauggcgaagaacaagccgacacuugacuuugaacugaucaagaccgaggccaaacagccggccacccugcggaaguauuguaucgaggccaagcucaccaauacgacuacugagagccgaugccccacccagggcgaacccucacugaaggaggagcaggauaagcgguucgugugcaagcauucuaugguggaccgcggcugggguaacggaugcggacuguucggaaaaggcgguauuguaacgugcgccauguucacguguaagaagaacauggagggcaagauagugcagcccgagaauuuagaguacaccaucguugucacgccacacagcggcgaagaacacgcagugggaaacgacaccgggaagcacggccaggaaaucaaggugaccccgcaaagcucgauuaccgaggcagagcuaaccggguacggcaccgucacgauggaaugcagcccacggaccggccuggauuucaacgagauggucuuacuacagauggagaauaaggccuggcuugugcaccgucagugguuucuggaccucccccuuccguggcuuccgggggccgacaaacaggagucgaacuggauccaaaaagaaacccucgucacguucaagaauccucaugcuaagaagcaagacguggucguacuaggcucucaggagggggccaugcacacggccuuaaccggcgccacagagauccagaugagcucagggaaccuccuauucacuggccaccugaagugucggcugcgcauggacaaauuacaacugaaaggcaugagcuauaguaugugcaccggaaaauucaagguggucaaggagauagcugagacccagcacgguaccaucgugauccgggugcaguacgagggggacggcagcccauguaagauucccuucgagaucauggaccuggagaagcguuacguccucggcaggcugauaaccgugaaccccaucgucacggagaaggauucgccagucaacaucgaagccgagccgcccuuuggggacucauacaucauaaucgggguugagccuggacaauuaaagcucaacugguucaagaagggcuccagcaucggacagauguucgagacgacaaugcggggcgcgaaacggauggccaucuuaggcgacaccgcgugggacuucgggucccugggcgggguuuuuacgagcaucggcaaggcuuugcaucaggucuucggcgccaucuacggcgccgccuucuccggcgugagcuggaccaugaaaauacugauugggguaaucaucaccuggaucgguaugaacucgcggagcacaucacugagcgucucuuuagugcucguagguaucgucacgcuguaccugggugucaugguacaggcagacagcgguugcgucgucucauggaagaacaaggagcucaagugcggcagcggcaucuucauaacagauaaugugcauaccuggaccgagcaguacaaguuccaacccgagagucccuccaaguuggccuccgcaauccagaaggcccaggaggaggggaucuguggcaucagaucggugacccggcuggagaaccucauguggaagcagaucacccccgaguuaaaccauauccuggccgagaacgaggugaagcucaccaucaugaccggcgacauuaagggcauaaugcaagccgggaagcggucgcugcguccgcagcccacggagcugaaauacucguggaaaaccuggggcaaggccaagauguuaucuaccgagucuuacaaccagaccuuccucauugacggcccagaaacggcggagugcccgaacaccaaccgcgcauggaacagcuuggaaguggaggacuacggauucggcgucuucacgaccaacaucuggcucaagcugaaggagaaacaggacgccuucugcgauuccaagcugaugagcgccgccauuaaggacaaccgggcgguccacgccgacaugggguacuggauagaauccgcccuuaacgauacguggaagaucgagaaggccagcuucaucgaggucaagaacugucacuggcccaaaucccacacccuguggagcaacggcgugcuggaguccgagaugaucaucccaaagaauuuagcuggucccgugucgcagcacaauuacagaccgggcuaccauacccagaucgcaggcccuuggcaccuggggaagcuggagauggacuucgauuucugcgacggcaccaccgucauagugacggaggacugcggcaaccggggccccucccuccgcaccaccaccgccagcgguaagcugaucacggaguggugcugccggagcugcaccuuaccgccguugcgcuaccgcggugaggacggcugcugguacggaauggagauucgaccccugaaggagaaggaagagaaccuggugaacucccucgugaccgccgggcacgggcagguagacaacuucagccugggagugcugggaauggcucucuuucucgaggagaugcugaagacacgcgucgguacuaagcacgcgauacuccuggucgccguguccuucgugacucugaucacaggaaacaugucauuuaaggaccugggaagagucguugucauggucggcgccaccauggccgacgacaucggaaugggcguuacguaccuggcccugcucgcggcguucaaggugcggccaaccuucgcggccggguuacugcuccgcaaacugacauccaaggagcuaaugaugacaacgaucgggauaguccuacucucccaaucgacgauucccgagacugugcuggagcucaccgaugcccuggcgcugggcaugauggugcucaagauagugaggaacauggagaaguaccagcuggccgucacgaucauggccauccuuugcgucccgaacgccgugauccuccaaaaugccuggaagguuucaugcacgauccucgcggucguauccgugagcccccugcuccugaccucaucacagcagaagaccgauuggaucccccuggcccucacgaucaaaggguugaaccccacggccauuuuucucacuacccuaucccgcacgaacaagaagcgcaguuggccgcugaacgaggcuauuauggcggucggaaugguguccauccuggccagcucccuccugaagaacgacaucccgaugacggggccccugguggccggugggcuccugaccgucugcuacgugcugacugggcggagcgcggaccucgaacuggagcgcgcuacggacgugaagugggaagaccaagccgagauauccggcagcaguccaauccuguccaucaccaucagcgaggacgguuccaugagcaucaagaacgaggaagaggaacagacccucacgauccugauccggacaggccuucuugucaucucggggcuguuuccgaucagcauaccuaucacugcggccgccugguaccugugggaggugaagaagcagcgcgccggagugcugugggacguccccaguccgccgccuaugggcaaagcggagcuagaggacggggcuuacagaaucaagcagaaaggaauacuuggcuacagccagaucggagccggcguguacaaggaggguaccuuucacacgauguggcacguaacacgaggcgccguccucaugcacaaggggaagcguaucgagccuuccugggccgacgucaagaaagaucugaucucguacggugggggcuggaagcuggagggcgaguggaaagaaggggaagaggugcaaguccuagcguuagagcccgguaagaacccccgcgccgugcagacgaagcccggacuguucaagaccaacaccggcaccaucggggcugugucccucgauuucaguccuggcacuuccggcucaccaauuaucgauaagaaggggaaggucgugggccuguaugggaacggagugguuacacgguccggcgccuaugugagcgccaucgcgcaaaccgagaagucuaucgaggacaaucccgaaaucgaagacgacauuuucagaaagcggcgccuaaccauaauggaccuacacccaggggccggcaagacgaaacgcuaccuuccggcaauuguacgggaggccauaaagagagggcugcgcacgcugauccucgcuccgacccggguuguggccgcggagauggaggaagcccugcggggccugcccaucagauaccagacgcccgccauuagggcggaacacacgggacgggagauaguggaccucaugugucacgccacuuucaccaugcgccuucugucacccguccgcgugccgaacuacaaccuuaucaucauggacgaggcucacuuuaccgaccccgccuccaucgccgcgcggggcuacaucagcacccgcgucgagaugggcgaggccgcagggaucuucaugaccgcaacgccgcccggaagccgggacccguucccgcagagcaaugcacccauaauagacgaggagcgagaaauccccgagcgguccuggaacuccggccaugaguggguuaccgacuucaagggcaagacgguuugguucgugccgucaaucaaggcgggcaaugacaucgccgccugcuuacgcaagaacggcaagaagguuauucaguuaucccggaagacguucgacagcgaguacgugaagacacgcaccaacgacugggauuuuguggucacaacggacaucuccgagaugggcgccaacuucaaggcggagcggguuaucgacccgaggcggugcaugaagccggucauccugaccgacggggaggagcgcguuauccuggccggcccaaugccggugacgcacagcuccgccgcccagcggcgggggcggaucgggagaaaccccaagaacgaaaacgaucaguacaucuauaugggggagccccuagagaacgacgaagacugcgcccauuggaaggaagcgaagaugcuccuggacaacauuaacacgcccgagggcaucauuccgagcauguucgaacccgaacgggagaaaguggacgccauugauggagaguaucgccugcgcggggaggcccgcaagacauucgucgaccuaaugcgccgcggcgaccuacccgugugguuagccuacaaaguagccgccgagggcaucaacuacgccgaucgccgguggugcuucgaugggaucaagaacaaccagauccucgaggaaaaugucgagguggagaucuggacgaaagagggugaacgcaaaaagcugaagccgcgguggcuggacgcccgcaucuacuccgacccccucgcccugaaggaguucaaggaguucgccgcgggccggaagucccucacccucaaccugaucacggaaaugggccgccuuccuaccuuuaugacccaaaagacccgggacgcccuugacaaucuggcgguuuugcacaccgcagaagccggagggagagccuacaaccacgcccucuccgagcugcccgagacuuuggagacccuccugcuauugacccugcuugcgacggugaccgggggcaucuuccucuuccugaugaguggccgagggaucggcaagaugaccuuagggaugugcugcaucauaacugccuccauucuccugugguacgcgcagauccagccacacuggauagccgcgagcaucauccuggaguucuuccucaucgugcuccugaucccggagccagagaagcaacgcacaccccaagauaaccagcucacauacgucguuaucgccauccugaccguggucgcugcaaccauggccaaugaaaugggcuucuuagagaagaccaagaaggaccucgggcugggcuccaucgccacgcagcagcccgaaagcaacauccucgacauugaccuccggcccgccuccgcauggacccuguacgcgguggccacaaccuuugugacacccauguugcgccacucaaucgagaacagcucugucaacgugagccucacugccauugccaaucaagccaccgugcugaugggacucgggaaaggguggccgcucuccaagauggacauaggggucccacuucuggcuauaggcugcuauagccaagugaaccccaucacccucaccgcggccuugcugcuccugguugcgcacuacgcaauuaucgggccgggccugcaagccaaggccaccagggaggcccagaagcgcgcugcagccggcaucaugaagaaccccacuguggaugggaucacugugaucgacuuggauccgaucccuuaugaucccaaguucgagaagcagcugggacaggugaugcugcucauccuaugcguaacccaggugcucaugaugaggaccaccugggcccucugcgaggcgcugacacuggccacggggcccaucucuacccucugggagggcaacccggggcgcuuuuggaacaccaccauugcaguaagcauggcuaacauuuucagggguuccuaccuggccggcgccgggcuacucuucagcauuaugaaaaacacgaccaacacccgccgggguaccgggaauaugggggaaacguuaggcgagaaguggaagucccgcuugaacgcucucggcaaaagcgaauuucagaucuacaagaaguccggcauccaggaaguagaccgcacccuggcgaaggaagggaucaagcgcggggaaacagaucaccacgccgugagccggggguccgcuaagcugcgaugguucguagaacgcaacauggugacccccgagggcaaggucguggaccucgggugcgggcggggaggcuggucuuauuacuguggcggacugaaaaacguccgagaggugaagggccugacgaagggcggaccugggcacgaggagccuaucccgauguccaccuacggauggaaccucguucggcuccagucgggcgucgauguauucuucaucccgcccgagaagugcgacacccugcucugcgacaucggagagucuagccccaacccgacgguggaagcggggcggacgcugcggguccugaaucuaguggagaauuggcugaacaauaacacgcaguucugcaucaaaguguuaaacccuuacaugcccuccgucaucgagaagauggaggcgcugcagcgcaaguauggcggggcccucgugcggaauccucuuagccggaacaguacccacgagauguauugggugucgaacgccagcggcaacaucgucuccagcgugaauaugauuucccggaugcuuaucaaccgcuucaccaugcgacacaagaaggccaccuacgagcccgauguggaucucgggagcggcacgcgcaacauugguaucgagucugagauaccgaaccuggacaucaucgggaagcguauagagaaaaucaagcaggagcacgagacuuccuggcacuacgaccaggaccacccauacaaaaccugggcguaccacggcuccuacgagaccaagcagacggggucugccucuagcauggucaacgggguuguacgcuuacucaccaaaccaugggauguacugcccaccguaacgcagauggccaugacugacacaacccccuucgggcaacagcggguuuucaaagaaaaggucgacacccgcacgcaggaacccaaagagggcacuaagaagcugaugaagauaacggccgaauggcucuggaaagagcugggcaagaagaagacgccaaggaugugcacccgggaggaguucaccagaaaggugcggagcaacgccgcccucggggcuaucuucacugacgaaaacaaguggaaauccgcccgcgaggcugucgaggauggccgguuuugggaacucgucgacaaggagcgcaauuugcacuuggaggggaagugcgaaacaugcguguacaacaugaugggcaagcgggagaaaaagcucggcgaguucggcaaggccaaaggcucacgcgccauuugguauaugugguugggugcgcgguuccuugaguucgaagcccucggcuuucugaacgaggaccacugguucagccgcgagaacucgcuaagcggcguagagggcgaggggcuccacaagcuggguuacauucugcgggacguguccaaaaaggaagggggugccauguacgcugacgacacggccggaugggacacccggaucacucucgaggaccugaagaacgaggagauggugacgaaccacauggagggggagcacaagaagcucgccgaagccaucuucaagcucacguaccaaaauaaggucgugcgggugcagcgcccuacgccccggggcacggucauggacaucaucucgagacgggaccaacgcgggucuggccaggugggcaccuauggccugaacaccuucaccaauauggaggcccaguuaauucgucagauggagggcgaggggguguuuaagaauauccagcaccucaccgucacugaggagguggcagugcagaacugguuggcgagaguuggccgggagcgucugucccgcauggccaucagcggcgacgacugugugguuaagccccucgacgaccgguucgcgaaugcccugacggcccugaacgauauggggaagauacgcaaggacauccaacagugggagccguccaaagguuggaacgacuggacccagguccccuuuugcucucaccacuuccacgaacuuauaaugaaagaugggcgggugcuggugguccccugccgcaaccaggacgagcugaucggcagagcgcgaauuucccagggugccggcuggagccuccgggagaccgccugccuggguaaguccuacgcccaaauguggagccugauguauuuccaucggcgggaccuccgccuggcggcgaaugcaauuugcuccgcaguuccaagccacugggugcccaccucccggaccaccuggagcauccacgccaaacacgaguggaugaccacugaggacaugcucacggucuggaaucgcgucuggauccgggagaacccauggauggaggacaagacgccgguggaguccugggaggaaauccccuaccucgggaagcgcgaggaccaaugguguggaucccugaucggacugaccucccgggccaccugggcaaagaacauccaggccgccaucaaccaaguccgcagccucaucggcaacgaggaguauaccgacuacaugccguccaugaagagauuccgccgugaagaggaggaagccggggugcugugguga

SEQ ID NO: 25341 - RNA, 9876 nt, Artificial Sequence
  derived and/or modified CDS sequence (opt11) from DENV-2__FJ461311__SS-prME
agcgcagggaugaucauaaugcugauccccaccgugauggccuuccauuugaccacccgcaacggggaaccccacaugaucgucgggauccaggagaagggcaagucacugcuguucaagaccgaagacggcgugaacaugugcacgcugauggcgauggaccugggcgagcugugcgaggacaccauuaccuacaagugcccccuccugcggcagaacgagcccgaggacaucgacugcuggugcaacagcaccuccacuuggguaaccuacgggaccuguaccaccaccggcgagcaccgccgggagaagagaagcgucgcccuggucccccacguggggaugggcuuagagacccggaccgagaccuggauguccagcgagggagccuggaagcacgcccagcgcaucgaaaccuggauccugcggcacccggguuucacgaucauggcagcaauccuggccuacaccaucgggaccacccacuuccagcgcguccucaucuucauccuucugacagccguagcucccuccaugaccaugcggugcaucggcaucaguaaccgcgacuucguggagggcgucuccgggggcagcuggguggauaucgugcuugagcacggguccugcgucaccaccauggcgaagaacaaacccacgcucgacuucgagcugaucaagaccgaggccaagcagccagccacucuccggaaguacugcaucgaggccaagcugaccaacacgaccaccgagagccggugccccacccagggcgagcccucacugaaggaggagcaggacaaacgguucguuugcaagcacucgaugguggaccgcggauggggcaacggcugcggccucuucggcaagggcgguaucgucacgugcgccauguucacuugcaagaagaacauggagggcaagaucgugcagcccgagaaccuggaguacaccaucguggucacgccacacuccggggaggagcacgcgguggggaacgacacggggaaacacggccaggagaucaaggugaccccgcagagcuccaucaccgaggccgagcugacaggcuacggcaccgucacaauggagugcagcccccgaacaggcuuggacuucaacgagauggucuuauuacagauggagaauaaagccuggcucgugcaccgccagugguuccuggaccugccucuccccuggcugccgggggcagacaagcaagaguccaacuggauccagaaagagacucuggucaccuucaagaauccccacgccaagaagcaggacgucgucgugcucgguucccaagagggggcgaugcacacggcccugaccggcgccacagagauccaaaugagcuccggcaaccuccuguucaccggccaccugaagugccgccugcgcauggauaaacuccagcugaagggcaugagcuacuccaugugcacggggaaguucaagguggucaaggagaucgccgagacccagcacggcacaaucgucauccgggugcaguaugagggcgacggcucuccguguaagauccccuucgagaucauggaccucgagaagcgcuauguccucggccggcugaucaccgugaacccuaucgugacggagaaggacucccccgucaacaucgaggccgagccgcccuuuggggacucauacaucaucaucggcguagagcccgggcaacugaagcucaacugguucaagaagggcuccagcaucgggcagauguuugagaccacaaugcgcggcgccaagcgcauggcuauccugggcgauaccgccugggacuuuggguccuugggcgggguguucaccagcaucggcaaggcccuucaccaggucuucggggccaucuacggggcggccuuuagcggcgugagcuggacaaugaagauccugaucggagugaucaucaccuggaucggaaugaacucccggagcaccucccugagcgucucccuggugcucguugggaucgucacgcuguaccugggcgucauggugcaggcugacagcgggugcgucguguccuggaagaacaaggagcuuaaaugcggcagcggcaucuucaucaccgacaacgugcacaccuggaccgagcaguacaaguuccagcccgagucccccuccaagcuggccagcgcgauccagaaggcccaggaggaagggaucugcggcauccgcuccgucacgcgccuggagaaccucauguggaagcagaucacccccgagcugaaccacauccuggccgagaacgaggugaagcucaccaucaugaccggggacaucaaaggaaucaugcaggcugggaaacgcagccugcggccgcagcccacggagcugaaguacuccuggaagaccuggggcaaggccaagaugcucagcaccgaguccuacaaccaaaccuuccugaucgacggcccagagacggcggaguguccgaacacaaaccgcgcuuggaauucgcuggagguggaggauuacggguucggcguguucaccacuaacauuuggcucaagcugaaggagaagcaggacgccuucugcgacucuaagcucaugagcgccgccaucaaggacaaccgcgcggugcacgcggacaugggguauuggaucgaauccgcgcugaaugacacguggaaaaucgagaaggcgagcuucaucgaggugaagaauugccacuggcccaagucccacacccuguggagcaacgguguccuggaguccgagaugauuauacccaagaaccucgcuggccccgugagccagcacaacuaccgcccgggcuaccacacccagaucgcgggccccuggcaccuggguaagcuggaaauggacuucaacuucugcgacggcaccaccgugaucgucacggaggauugcgggaaccggggccccucccuccgcacuaccaccgccagcggcaagcucaucacggaguggugcugccggagcugcacccugcccccgcuccgcuaucgcggggaggacggcugcugguacgggauggagauccggccccugaaggagaaggaagaaaaccuggugaacucccucgugaccgccggccacggccaggucgauaacuucagccuggguguacucggcauggcccuguuccuggaggagaugcugcgaacccgcgugggaacgaagcacgcgauccuccuggucgccgucuccuucgucacccugaucaccggcaacaugagcuucaaggaccucggucggguuguggugaugguaggcgccaccaugacggacgauauugggaugggggugaccuaccuggcguuacucgccgcguucaaggugaggccgaccuucgcugccggccuucugcuccggaagcugaccuccaaggagcugaugaugacgacuauugguaucguucuccugagccagucuaccauccccgagaccgugcuggaacucacugacgcacuggcccugggcaugaugguucucaagauaguccgcaacauggagaaguaccagcuggccgugaccaucauggccauccugugcgucccgaacgccgugauccugcagaacgccuggaaggugagcugcaccauccuggccgucguguccgugagcccccugcuccugaccuccagccagcagaagacggacuggauccccuuagcgcucacaaucaaggggcugaaccccaccgccaucuuccugaccacgcucucccgcaccaacaagaagcggagcuggccgcugaacgaggccaucauggccgucggcaugguguccauccuggcgagcagcuuacugaagaaugacauccccaugaccggccccuugguggccggcggccuccugaccgucugcuacgugcugacggggcgcagcgccgaccucgaguuagagcgggccaccgaugugaagugggaagaucaggcggagaucuccggcaguagccccauccugucaaucacuaucagcgaggaugggagcauguccaucaagaacgaggaagaagagcagacucuuacgauccuuauccgcaccggccugcucguuaucuccggccuguucccgaucagcauccccaucaccgcugcagccugguaccugugggaggugaagaagcagcgggcaggggugcucugggacguccccuccccgccgcccaugggcaaggccgagcuggaggacggggcguaccgcaucaagcagaagggaaucuugggauacagccaaauaggcgccggcguguacaaagaggggacuuuccacaccauguggcacgugacgcggggagccgugcucaugcacaaggggaagcgcaucgagcccaguugggccgaugugaagaaggaccugaucagcuacggcggaggcuggaagcuggagggcgaguggaaagagggugaggaggugcagguucucgcccuggagcccggcaagaauccccgggcgguccagaccaagccagggcuguucaagaccaacaccgggacgaucggugcugucucccucgacuucagccccggaaccuccggcagccccaucaucgacaagaaggggaagguaguuggccuguacgggaaugggguggucacccgguccggcgcauacguuucugccaucgcacagaccgagaaguccaucgaggacaaucccgagaucgaggaugauaucuuccggaagagacggcugacgauuauggaccugcauccgggggcaggcaaaaccaagagauaucuccccgccauagugcgggaagccaucaagcgcgggcugagaacccugauccucgccccuaccaggguuguggcggccgaaauggaagaagcccugcggggccugcccauaagguaccagacgcccgcuauccgggcugagcacacugggcgcgagaucgucgaccucaugugccacgcgaccuucaccaugcgccugcuuagccccguccgggugccgaacuacaaccuaaucaucauggacgaggcccacuucacggaccccgccuccaucgccgcccgcggauacaucagcaccaggguggagaugggggaggcggccgggaucuucaugaccgccacgccgcccgguagccgcgacccguucccccagucgaacgccccuaucaucgacgaggagagggagauccccgaacgcuccuggaacuccgggcacgagugggucacggacuucaaggggaagacgguaugguucgugccgucgaucaaggccgggaacgauaucgcggccugucugcggaaaaacggaaagaaggucauccaguuaucccgcaagacguuugauucagaguacgugaaaacccggacgaacgacugggacuucguggucaccaccgauaucuccgagaugggcgcaaacuucaaggccgagcgcgugaucgacccgcggcgcugcaugaagcccgugauccucacggacggugaggagcgggucauacuggcgggccccaugccggugacucacagcucagccgcccagcgccgggggcguaucggccggaacccaaagaaugagaaugaccaguacaucuacaugggugagccccuggagaacgacgaggauugcgcccauuggaaggaggccaagaugcuccuggacaacauaaacacacccgaggguauuauaccgagcauguuugagcccgagcgcgagaaaguagacgcgaucgacggcgaguaccgguugaggggggaggcccgcaagaccuucguagaccucaugcggcgcggcgaccugcccguguggcuggccuacaagguggcagccgaagggaucaacuacgcagaccggcgcuggugcuucgacggcaucaagaacaaccagauccucgaggagaacauggaggucgagaucuggaccaaggagggugagcggaagaagcugaagccccgcuggcuggacgcgcgcaucuacucggauccccucgcucugaaggaguucaaggaguucgccgccggccgcaagucauuaacgcucaaccugaucaccgagaugggccgccuccccaccuuuaugacccagaagacgcgcgacgcgcucgacaaccuggccgugcugcacaccgccgaggccgggggacgggcguacaaccaugcccucuccgaauuaccggagacccuggagacccuccugcugcuaacgcugcuggcaaccgucaccgggggcauauuccuauuccuuaugagcggccgcgggaucggcaagaugacccuggggauguguugcauuauaaccgccuccauacuccugugguaugcucagauacagccgcacuggauugcggccagcaucauccuggaguucuuccucaucgugcugcugauccccgagcccgagaagcagcguacgccccaagacaaccagcuaaccuacguugucaucgccauuuuaaccgugguugccgccaccauggcgaacgagaugggcuuccuggaaaagacgaagaaggauuuagggcugggcuccaucgccacccgccagccggagagcaacauccuggacauagaccucaggcccgccucggccuggaccuuauacgccguagcgaccacguucgugaccccgaugcugcgccacagcaucgagaacagcuccgugaacgucagccucaccgccauugccaaccaggccaccguguuaaugggucuggggaagggcuggccacucuccaagauggacaucggggugccgcuguuggccaucggcugcuacagccaggucaaccccaucacgcucaccgcugcccugcuucuccugguggcccacuacgccaucaucggacccggucugcaggcuaaggccacgcgggaggcccagaagcgcgccgccgcgggcaucaugaagaaccccaccguggacgggaucacagucaucgaccuggacccgauucccuaugauccaaaguucgaaaagcagcugggccaggucaugcugcucgugcugugcgucacccagguucugaugaugcggaccaccugggcacucugcgaggcccucacgcucgccacugggcccaucuccacccucugggagggcaacccggggcgcuucuggaacaccacuaucgccgucucgauggcgaacaucuuccggggcuccuaccuagccggcgccgggcuccucuucucaaucaugaaaaacaccacuaacacccgccgcggcacggggaacaugggggagacccugggcgagaaguggaagucacaguugaacgcccuggggaagucugaguuccagaucuacaagaaguccggcauccaggaggucgaccggaccuuagccaaggaggggaucaagcgcggcgagaccgaccaccacgcggugagccggggguccgccaaguuacgcugguuuguggaacggaacauggugacgcccgagggcaaagugguggaccucggaugcgggcgcggcggguggagcuacuacugcggugggcugaaaaacguccgggaggugaagggccugacgaagggggggccuggccacgaagagcccaucccgauguccaccuacggguggaaccuggugcgucuucagaguggcgucgacguguucuucaucccgcccgagaagugugauacacugcucugcgacaucggggaauccagccccaacccgacgguggaggcgggccggacccugcgaguccugaaccucguggaaaacuggcugaacaacaacacccaguucugcaucaaggugcugaaccccuacaugccaucggucaucgagaaaauggaggcacugcagcggaaguacgguggggcccucgugcgcaauccucugagccggaacucuacccacgagauguacuggguguccaacgccuccggcaacaucgucuccagcgugaacaugaucuccagaaugcugaucaaccgguucaccaugaggcacaagaaggccacguacgagcccgacguggaccucgggagcggcacacggaacaucgguaucgaguccgagauccccaaccucgauaucaucggcaagcgcaucgagaaaaucaaacaggagcacgagaccucguggcacuacgaccaagaccacccuuacaagaccugggccuaccacggcuccuacgagacgaagcagaccgggagcgccuccucgaugguaaacggcguggugcggcugcugaccaaaccuugggacguccugcccacggugacgcagauggccaugaccgacaccacccccuucgggcagcagcgcguguucaaggagaaaguugacacucgcacacaggagcccaaggagggcacuaagaagcugaugaaaauaaccgccgaguggcucuggaaggagcugggcaaaaagaagacgccgcggaugugcacgcgcgaggaguucacucgaaagguacgcuccaacgccgcccugggugccaucuucaccgacgagaauaaguggaaauccgcgcgggaggccguggaggacucccgcuucugggaguuagucgacaaggagcggaaccugcaccuggagggaaagugcgagacaugcguguauaacaugauggggaagagggagaagaagcucggugaguucgggaaggccaagggcagccgggccaucugguacauguggcugggcgcccgcuuccucgaauucgaggcgcucggguuccugaacgaggaccacugguucucccgggagaacagccuguccggcguggagggggagggccuccacaagcugggguacauacuucgcgacgugagcaagaaggaaggcggcgccauguacgcggacgacaccgccgggugggacacccggauaacccucgaggaccugaagaacgaggagauggugacgaaccacauggagggagagcacaagaagcuggcggaggcgaucuucaagcucaccuaccagaacaaggucgugcgcgugcagcggccaacuccccgggggacggucauggacaucaucucucgccgcgaccagcggggcuccggccagguggguacauacggccugaacaccuucaccaacauggaggcccagcugauccggcagauggagggggagggcguguuuaagaauauccagcaccucaccgucacggaggagguggcggugaagaacuggcuggcccgggucgggcgcgagcgccugucgcggauggcgaucuccggagacgauugcguggugaagccccucgacgaccgcuucgccaacgcccugaccgcccugaacgacaugggcaaaauuagaaaggauauccagcagugggagccuagcaagggguggaacgacuggacccaggucccuuuuuguucccaccauuuccacgagcucaucaugaaagacggccgcgugcuggucguccccugccggaaccaagacgagcuaaucggacgcgcccggaucucacagggugcgggguggucccuccgcgagaccgcaugccuggguaaaagcuacgcccagauguggucccugauguacuuccaccggcgcgaccugcggcucgccgccaacgcgaucugcagcgccguuccaagucacugggugccgacgagccguaccaccugguccauccacgccaagcacgaguggaugaccaccgaggacaugcugacgguguggaaccggguguggauccgcgagaacccguggauggaggacaagacccccguggaaucaugggaggaaauacccuaccucggcaagcgggaggaccaguggugcgguucccugaucggucugaccagccgcgcgaccugggcgaaaaacauccaggccgccaucaaccagguacgguccuugaucgggaacgaggaguacacggacuacaugccgagcaugaagcgcuuccggcgcgaagaggaggaggcuggcgugcugugguga

SEQ ID NO: 25342 - RNA, 9876 nt, Artificial Sequence
  derived and/or modified CDS sequence (opt11) from DENV-2__FJ410217__SS-prME
agcgcagggaugaucaucaugcugauccccacagugauggcuuuccacuugacuacgcgcaacggugagccacacaugaucguaggaauccaggagaaggggaagagccugcuguuuaaaaccgaggacggugucaacaugugcacccucauggcaauggaccugggcgaacuaugugaggauaccaucaccuacaaauguccccuccugaggcagaaugaacccgaggacaucgacugcugguguaauagcacuaguaccugggugacguacgguacgugcacuaccaccggggagcaccgcagggagaagcgcagcguggcccugguuccccacguagggaugggccuagaaacccggaccgagaccuggaugucaucggagggggcguggaaacaugcacagcgcaucgagaccuggauccuuaggcauccgggcuucaccauuauggccgcuauccuggcuuacaccaucgggacuacacacuuccagcguguccucaucuucauucugcugacggccguugcccccuccaugacaaugcggugcaucggcaucaguaaccgcgauuuuguagagggcguguccgggggcagcuggguagauauaguauuagagcaugggucuugcgucaccaccauggcgaagaacaagcccacgcuggacuucgagcugauaaagaccgaggcgaaacagccagcaacccuccggaaguacugcauagaggccaaacuaaccaacacgaccaccgagagccgcugccccacccaaggugagcccucguuaaaggaagagcaggauaagagauucgugugcaagcauagcaugguggaucgcggcugggggaacggcuguggccuguuuggcaagggugggaucgucacgugugcuauguucacgugcaagaaaaacauggagggcaagaucguacaacccgagaaccuggaguacaccaucguuguuaccccccacuccggggaagaacacgcgguggggaacgauaccgggaagcacggaaaggagauaaaagugaccccgcagagcucuaucaccgaagccgagcugacuggguacggaacugugacgauggagugcagcccucggacaggccuagauuuuaacgagauggugcugcugcagauggagaauaaggcguggcucgugcaccgccagugguuccuggaccugccgcuccccuggcugcccggcgccgacaaacaggaguccaacuggauccagaaggagacccuggucaccuucaaaaauccccacgcgaagaagcaagacguggucgugcucggcucgcaggagggggcaaugcacacggcccugaccggugccaccgagauccagaugucgagcggaaaccugcucuucacagggcaccuuaagugccggcugcgaauggacaagcuccagcuuaagggaaugucauacagcaugugcacggggaaguucaaaguagugaaagaaaucgcagaaacacagcacggcaccauuguuauccgugugcaguacgagggagacgguagccccugcaagauucccuucgaaaucauggaccuggaaaagagauauguccucgggcggcucaucaccgugaauccgaucgugacggagaaggacucccccguaaacaucgaagccgagccccccuucggggacagcuauaucauuaucggcguggagccggggcagcugaagcuaaacugguucaagaagggauccuccaucgggcaaauguucgaaaccaccaugcgcggcgccaagaggauggccauucugggcgacaccgccugggacuuuggaucccugggugguguguuuacgucaaucggaaaagcccuccaccaggucuucggugcaaucuacggggcggccuuuuccggcgugucguggaccaugaagauccuuauuggggugaucaucaccuggauaggcaugaacagcagaucgaccucccugagugugucccuagugcucguggggaucgucacccuguaccugggcgucauggugcaagccgacuccggcugcaucguguccuggaagaauaaagagcuaaagugcgguucgggcaucuucguuaccgacaacguucacaccuggaccgagcaguacaaguuccagccagaaagcccuucgaagcuggcaagcgccauccagaaggcccaggaggaggggaucugcggcauacgcuccgugacgcggcuugaaaaccuuauguggaagcagaucacccccgagcuuaaccacaucuuagccgaaaacgaggugaaguuaaccaucaugaccggggacauuaagggaaucaugcaggcuggaaagcgcagccugcggccgcagcccacggaacucaaguacuccuggaagaccuggggcaaggcgaaaaugcuaucaaccgagucccauaaccaaacauuucugauugacggccccgagacggcggaaugcccgaacaccaaucgcgccuggaacagcuuagagguggaagacuauggauucggcgucuuuaccaccaauauauggcuccggcugaaggagaagcaggacgccuuuugcgauuccaagcuuaugagcgccgccaucaaggacaaccgcgcgguacacgccgauaugggguacuggaucgaauccgcccucaacgacacguggaagaucgagaaggccucguucaucgaggugaagaacugccacuggcccaagucccacacccuuuggucuaaugggguccucgaguccgagaugaucauccccaagaaucucgccggccccgugucgcagcauaacuacagaccgggguaucauacgcagauugcgggccccuggcaccuggggaaacuggaaauggacuucgauuucugcgacggcaccaccgugauugucacggaggacugugguaaucgcggucccucccucaggaccaccacugccagcgggaaacugauaacggaguggugcugccgcagcugcacccuucccccacuucgguaccgcggggaggacggcugcugguaugggauggagauccggccccugaaggagaaggaggaaaacuuggugaacucacucgugacagccggccacgggcaggucgauaacuucagccugggcguguuaggcauggcccucuuccuggaggagaugcuucguacacggguggggacgaagcacgcgauucuccugguugcgguauccuucgucacacugaucaccggcaacaugagcuuuaaggaucucgggagggucgucgugauggucggugccacgauggccgacgauaucggcaugggugugacguaccuggcccugcuggcggcuuucaaggugcggcccaccuucgccgcaggguugcugcuccguaaacugaccaguaaggagcugaugaugaccaccaucgggauagugcuauuaagccaguccacaauacccgagaccgugcuggaacucacggacgcacuggcguugggcaugauggugcucaaaaucguccgcaacauggagaaguaccagcuggcugugaccaucauggccauccuuugcgucccuaacgccgugauacuccagaacgccuggaaagugagcugcaccauccuggcggucguguccgugagccccuugcuccugaccuccagccagcaaaagaccgacuggaucccccuggcccuaaccaucaaaggccugaacccuaccgccaucuuucugacaacccucuccaggacgaauaaaaagcgcaguuggccgcugaacgaggccauaauggcggucggcauggugaguauuuuagcgagcucccuucucaaaaacgacauccccaugaccggcccccugguagcugggggucuccugaccgugugcuacgugcuaaccgggcggucggccgaccuggaguuagaacgcgccacugacgugaagugggaggaccaggcggagaucuccggcagcagccccauccuuuccaucaccauuagcgaagacgggaguaugagcauaaagaacgaggaggaggagcagacucucaccaucuuaauccgaacaggccugcucguaauuuccggcuuauucccgauuucuauacccaucacugccgcggccugguaccugugggaggugaagaagcagcgcgccgggguccugugggacguccccagcccuccgcccaugggaaaagcggaacuggaggacggggccuaccggaucaagcagaaggguaucuucggauacagccagaucggagcaggggucuacaaggaggggaccuuccacaccauguggcacgugacccgcggagccguccuaaugcacaaggggaagcggaucgaaccauccugggcugaugugaagaaggaccucaucucuuacggcggaggauggaaacuggagggcgaguggaaagagggggaagaggugcaaguccucgcgcucgagcccggcaagaacccacgcgccgugcagacuaaacccgggcuguucaagacaaacaccggcaccauuggggccguaucccuggacuucagcccuggcacguccggcucaccuaucauugauaagaagggaaaagucgugggccucuacgggaauggcguggucacccgguccggcgccuacgucagcgcgaucgcgcaaaccgagaaguccaucgaggacaauccagaaaucgaggacgacaucuuccgcaaacggcgacugaccaucauggaccugcaccccggggccggaaaaacgaaaagguaccuacccgcgauagugcgcgaggccaucaagcggggacuccgcacucugauccuggcgccgacccgcgucguggcagccgaaauggaggaggcucucaggggcuugcccauccgguaccagacuccugcaaucagagcggaacacacuggaagggaaauuguggauuuaaugugccaugcuaccuucaccaugcggcuccugagcccgguccgagugcccaauuacaaccugauuaucauggaugaggcccacuucaccgaucccgccaguaucgccgcgcgggguuacaucagcacgcggguggagaugggcgaagcagccgggaucuuuaugacggccacgccccccggcagcagggacccuuuuccccaguccaacgcccccaucaucgacgaagagcgagagauaccugagcgcaguuggaacuccggacacgagugggucaccgacuucaagggcaaaacggucugguucgugccgagcaucaaggcggggaaugauaucgcagcaugccucagaaaaaacggcaagaaggucauccaacuaucacgaaagaccuucgacagcgaguaugugaaaaccagaaccaaugacugggacuucguugucacgaccgacauuucugagaugggggccaauuucaaggcagagcgggugaucgacccacgccggugcaugaagcccgugauccuggccgacggugaggagcgcguuauccucgcaggccccaugccagugacccauucgucagccgcccagcggcgcgggcggaucggccgcaaccccaagaacgagaacgaucaguacaucuacaugggggagccccuggaaaacgacgaggacugcgcgcacuggaaggaggccaagaugcuucuugacaacaucaacacccccgagggcauuaucccgagcauguuugaacccgagcgggaaaagguugacgccaucgauggcgaauaccgccugcgcggggaggcccguaaaacauucgucgaccuuaugcgcaggggagacuugcccgugugguuagccuacaagguggcggccgaggggaucaacuaugccgaccgccgguggugcuuugacgggaucaagaacaaucaaauccuggaggagaacgucgagguugaaauuuggaccaaggaaggcgagcgcaagaagcuuaaaccucgguggcuggacgcccgcaucuacagugacccacuggcucucaaagaguucaaagaguuugcggccggccguaagucccugacccuuaaccuuaucacggaaaugggcaggcucccaacguucaugacccagaagacccgggacgcccuggacaacuuagccguccugcacaccgcggaagcagggggccgcgcuuacaaccacgcacugagcgagcuccccgagacgcuggagaccuuacuacuccugacgcuacuggcgaccgucaccggcgguauuuuucuuuuccucaugagcgggcggggcaucggaaagaugacuuuagggauguguugcauuaucaccgcauccauccugcucugguaugcccagauccagccgcauuggauagccgcgaguaucauccuggaguucuuccuuaucgugcuccugauacccgagcccgagaagcagcgcacgccccaggacaaccaacugaccuacguugugaucgccauccucacggucgucgcggccaccauggcaaacgagaugggcuuccuagagaagacuaagaaggaccuugggcucggcuccaucgccacacagcagcccgaaagcaacauccuggacauagaccugcggcccgccuccgcuuggacgcuguacgccguggccacaaccuucguaacccccaugcuccgccacaguaucgagaacagcuccgucaacgucagucucaccgccaucgccaaucaagcuaccgugcucaugggccuggggaagggcuggccccugagcaaaauggacauuggggucccgcuccuggcgaucggcuguuacagccaaguuaacccaaucacccugaccgcugcccuccugcuucugguggcgcauuacgccaucaucgggccgggacugcaggcuaaggcaacucgugaggcucagaagagagcagccgccggcaucaugaagaacccgaccgucgacggaaucaccgugauugacuuagacccgauucccuaugaccccaaguucgaaaaacagcucggccaggugaugcuucuuauccuaugcgucacucaggugcuaaugaugagaacgaccugggcucugugcgaggcccucacccuagccaccgggcccaucuccacucugugggagggcaaccccgggcgcuucuggaacaccaccaucgccguaagcauggcuaacaucuucaggggcuccuaccucgccggcgcggggcugcuguucucgaucaugaaaaacaccaccaaugcccgccgcgggaccgguaacaugggggagacacuaggcgaaaaguggaagucccggcugaacgcccuagggaaaagcgaguuucagaucuacaagaagucggguauccaggaggucgacaggacccuggccaaggaggggaucaaacggggcgagaccgaccaucacgccgugagccgcgguuccgcgaagcugcggugguucguugagcgcaacauggucaccccagagggcaagguuguggaccuugggugcggacggggcggauggucuuacuauuguggcgggcugaaaaauguccgcgaggugaagggacuuaccaaaggcgggcccggccacgaagagcccaucccgaugucgaccuaugguuggaaccuggugcggcuccagagcggugucgacguauucuucaucccgccugagaagugcgacacgcugcucugcgacaucggggaguccucgcccaacccgacuguggaggccgggaggacucuccggguucugaaucugguagagaacugguuaaacaauaacacccaauucugcaucaaggugcugaauccuuacaugccuucugucauugagaaaauggaggcccugcaacgcaaguacggaggggcccuggugcggaacccgcucuccagaaacagcacgcacgagauguacuggguguccaaugcaagcggcaacaucgucuccagugugaacaugaucucccggaugcugaucaaccgcuucaccaugcggcacaagaaggcgaccuacgagcccgauguggaccuuggaagcggcacgcgcaacaucgggaucgaguccgaaauccccaaccucgacaucaucggcaaacggaucgagaaaaucaagcaggagcacgagaccucguggcauuaugaucaagaucaccccuacaagacgugggcguaucacggcuccuacgagaccaaacagaccgggagcgccuccucgauggugaauggggugguucgccugcucaccaagccgugggacguguuacccacuguuacacagauggccaugacugacaccacucccuucggucagcaacgcguuuucaaggaaaagguugacacccgcacccaggaacccaaggagggcaccaagaagcugaugaaaaucacggccgaguggcuguggaaggaguugggcaagaagaaaacgccgcgcaugugcacccgggaggaguucacccgcaaaguucggaguaacgcggcccuuggggccaucuucacggacgagaacaaguggaaguccgcccgcgaggccguggaggacucccgguucugggagcuaguagacaaggagcgaaaccuccaucuggagggaaagugcgagacaugcguauauaacaugauggggaagcgggagaagaagcugggcgaguucgguaaagcgaaaggaagucgcgccaucugguauaugugguuaggcgcacgguuccuggaauucgaggccuuaggguuucucaacgaggaccacugguucucccgcgagaacucacuguccggcguagagggggaaggccugcacaagcucggguacauccugcgcgacguaucgaagaaggaaggcggcgcgauguacgcugacgacaccgcagggugggacacacgcauaacgcuggaggaucuaaaaaacgaagaaauggugacgaaucacauggagggcgagcacaaaaagcucgccgaggcuaucuucaaacugaccuaucagaacaaggucgugcgaguacagcguccgacgccacgggggaccgucauggacauuaucagccgccgggaucagcguggcuccggccaaguggggaccuacggauuaaacacauucaccaacauggaggcgcaacugauacggcagauggagggagagggcguguuuaagaauauccaacaccugacggugacagaagagguggccgugcagaacuggcucgcccgcgucgggcgugagcgguugagucgcauggccaucuccggcgacgacugcguuguaaagccccucgacgaccgguucgccaacgcgcucacugcccuuaacgauauggguaagauacgcaaggacauccagcaaugggagccgagcaagggauggaacgacuggacccaggucccuuucugcucucaccacuuccaugagcugaucaugaaggacggccggguguuagugguccccugccgcaaucaggacgagcucauugggcgggcccgcaucucacagggcgcugguuggucgcugcgugaaacagccuguuugggcaagagcuaugcgcagauguggagccugauguacuuccaccgccgggaccuucgccuugccgccaaugccaucugcagcgccgugcccucccauuggguaccuaccagccguaccacaugguccauacacgcuaagcacgaauggaugacgaccgaagacaugcugacagucuggaaccgagucuggaucagggagaaccccuggauggaggacaagacccccguggagagcugggaggagaucccauauuuaggaaagcgcgaagaccaguggugcgggucccucaucgggcugaccucgcgggccaccugggccaagaauauacaagcagcaaucaaccagguccgcucccugauugggaaugaggaauacacagacuacaugccgagcaugaagcgguuucggcgugaggaggaggaggcuggcgugcucugguga

SEQ ID NO: 25343 - RNA, 9876 nt, Artificial Sequence
  derived and/or modified CDS sequence (opt11) from DENV-2__FJ410219__SS-prME
ucagccgggaugaucaucaugcugauccccaccguaauggccuuccaucucaccacccggaacggggagccgcacaugaucgucggcauucaggagaagggcaagagcuuacuguucaagaccgaggacggggugaacaugugcacguugauggcgauggaccugggggagcugugcgaggacaccaucaccuacaaauguccccuccugcggcagaacgagcccgaggacaucgacuguuggugcaacagcaccagcaccugggugaccuacggcacguguaccaccacuggcgagcacagacgggagaagagaagcgucgcccuugugccacacguggggaugggcuuggagacgcgcaccgagaccuggaugagcagcgaaggggcuuggaagcacgcccagcgcauugagaccuggauacugcggcaccccggcuucacgaucauggcggccauucuggccuacaccauuggcaccacccacuuccagcggguuuugaucuucauccugcucaccgccguggcccccuccaugaccaugcgguguaucggcaucucaaaucgcgacuucguggaggguguuuccggcggauccuggguggacaucguucucgagcacgguuccugcguuaccaccauggccaagaacaagcccacgcuggauuucgaacugaucaagaccgaggcuaagcagcccgccacucuccggaaauacugcaucgaagccaaacugaccaacacgaccaccgagucacgcugucccacccaaggcgagcccucacugaaggaggagcaggacaagcgguuugucugcaagcacagcaugguggaccggggcugggggaacggcugcgggcucuucggcaagggcgguaucgucacgugcgccauguuuacgugcaagaagaacauggaaggcaaaaucgugcagcccgagaaccuggaguacaccaucguagucacgccccauuccggcgaggagcacgcgguaggcaacgacacggggaaacauggccaggagaucaaggugaccccgcagagcucaaucacagaggccgaacugaccggauacgggacugucacgauggagugcagcccucgaaccggccucgacuucaacgagaugguccugcugcagauggagaacaaagccugguugguccaccgccaaugguuccuggaccugccccuccccuggcugccgggggccgacaagcaggaguccaacuggauccagaaggagacccuggucaccuucaagaacccccacgcaaagaaacaggacguugucgugcucggcagccaggaaggggcuaugcacacggcccugaccggcgcaaccgagauccugaugagcuccgggaaccuccuuuucacuggccaccugaagugccgucuccgcauggacaagcuucaacugaaaggcaugagcuacuccaugugcacgggcaaguucaagguggucaaggagaucgcagagacccagcacgggacaaucgugauccgggugcaguacgagggggacggcucgcccuguaagauacccuucgaaaucauggauuuagagaagcgcuacguccugggccgucugaucaccgugaauccgaucguaaccgagaaggacucccccgucaacauugaagccgagccgcccuucggggacagcuacauaauuaucggcgucgagccgggucagcuaaagcuaaacugguucaagaagggcuccucgaucgggcagauguucgagaccaccaugcgcggcgcgaagaggauggcgauccugggcgacaccgcaugggauuucgggucccuuggcggcgucuucacgucuaucggcaaggcccugcaccaggucuucggagccauuuauggcgcggccuucuccggcgucucguggaccaugaagauacugaucggcgugaucaucaccuggaucgguaugaacucccgaaguaccucccugagcgucagccucgugcugguggggaucgucacgcuguaccugggcguaaugguacaggcggacagcgggugcguaguguccuggaaaaacaaggaguuaaagugcgggagcggcaucuucaucaccgauaacguacacaccuggaccgagcaauacaaguuccagcccgagagccccaguaagcuggccucugcgauccagaaggcccaggaggaggguaucugcgguauaagguccgucacgcggcucgagaaccugauguggaaacagaucacccccgaacugaaccacauccucgcagagaacgaggugaagcugaccaucaugaccggggacauaaagggcaucaugcaggcugggaagcgauuucugcggccgcagcccaccgagcucaaguacagcuggaaaaccuggggcaaggcgaagaugcuguccaccgagucauauaaccagaccuuccuaaucgacggccccgagacggcggaaugcccgaauaccaaccgcgccuggaacucccucgagguggaggacuacggauucggcgucuucaccaccaacaucuggcugaagcugaaggagaaacaagacgccuucugugauagcaagcucauguccgcagccaucaaggacaaccgggcugugcacgcagacaugggguauuggaucgagagcgcucugaacgacacguggaagauugagaaggccuccuucaucgaggugaagaacugccauuggccgaagagccacacccugugguccaaugggguccucgagagcgagaugauaauccccaagaaccuggccgggcccgugucccagcacaacuacaggccaggguaccacacccagaucgccggcccuuggcaccuggggaagcucgagauggacuucgauuucugcgacggcaccaccguaaucgucacggaggacugcggaaaccggggccccagccugcgcacuaccaccgccuccggcaaacugauaacggaguggugcugcaggagcugcacacugccgccgcugcgcuaucgaggggaggacgguuguugguacgggauggagauccggcccuuaaaggaaaaggaagagaacuuggugaacagccuagugaccgcaggucacggacaggucgacaacuucucccuaggcguguugggcauggcccuguucuuagaggagaugcuccggacccgcguggggaugaagcaugcgaucuugcuggucgcggugucauucgugacgcucaucaccgguaacauguccuucaaagaccugggucgggucguuguaauggucggcgccaccaugaccgacgacaucgguaugggcgucacguaccuggcccuccuggcggcguucaaggugcgccccaccuucgcagccggccugcuuuuacggaaguugaccuccaaggaacucaugaugaucaccauugggauuguccugcugucccagagcacaauccccgagaccguccucgaauuaacggacgcccuagccuugggcaugaugguccugaagaucguacgcaauauggagaaauaccagcuggcggugaccaucauggccauucucugcguccccaacgcggugauccugcagaacgcauggaaggucuccugcacgauccuagccgucgugagcgucagcccgcuccugcugaccagcucccaacagaagacugacuggaucccccucgcgcugaccaucaagggacugaaccccacggccauuuucuuaaccacacugagccgcacuaacaagaagagguccuggccgcugaacgaggccaucauggccgucggcauggucagcauacuggcguccagccugcugaaaaacgauauccccaugacgggcccgcucgucgccgggggccugcucacugugugcuacgugcucacugggcgcuccgccgaucuggagcuggagcgugugaccgacgucaaaugggaggaccaggccgagaucagcggcuccagccccauucucagcauaacgaucuccgaggaugggagcauguccaucaagaacgaggaggaggagcagacccugacgauucugauacgcaccggucuccuggugaucagcggccuguucccgaucuccauccccaucacggcagcggccugguaccucugggaggugaagaagcaacgggccgggguccugugggacgugcccucuccgccgcccaugggcaaggccgaacuggaggacggggccuaccgcaucaagcagaagggcauacucggguacucccagauuggggcgggcguguacaaggaggggaccuuccacacuauguggcauguaacacgaggggccgugcugaugcacaaggggaagcgcaucgaaccauccugggccgacgugaagaaggaccugauuuccuauggcgggggcuggaagcucgagggagaguggaaggagggggaggaggugcaggugcuggccuuagagcccggcaagaacccccgggccgugcaaaccaaacccggucuguucaaaacgaacaccggcaccaucggggcggucagccuggacuucucccccgguaccucgggcuccccgaucaucgacaagaaggggaaggucgugggccuguacgggaacgguguagugacacgcagcggcgccuaugucuccgccaucgcgcagacagagaagucgaucgaggacaacccggagaucgaggaugacauuuuucggaagcgccggcugaccauuauggaccuacaccccggggccgguaagaccaagcgcuacuuaccagccaucguccgggaggccaucaaacggggcuuacggacgcugauccuggccccgacccgcguggucgccgcggagauggaggaggcccugcguggccuccccauccgcuaccagacccccgccauacgggccgagcacaccgggcgcgagaucgucgaccugaugugccacgccacguucacaaugagacugcucagccccgugcgggugccgaacuacaaucugauaaucauggacgaggcgcauuucaccgaccccgcaagcaucgccgcccguggcuacaucuccacccgggucgagaugggagaggccgcggggaucuucaugacggcaacgccgcccggcagccgcgacccguuuccccagagcaacgcccccaucaucgacgaggagcgggagauccccgagcgcuccuggaacucaggccaugagugggugaccgacuucaaagguaagacugucugguucguuccguccauaaaggccgggaacgacaucgcagcuugccugcggaaaaacggcaagaaggugauacagcucagccgcaagacguuugacucagaauacgugaagacccggaccaacgacugggacuucgucgugaccacggacauuagcgagaugggcgccaacuuuaaggccgagcgcgucauagacccccggcgcuguaugaaacccguuauccugaccgacggggaggagcgggugaucuuagccggcccaaugccggugacccacagcagcgcggcgcagcgcagagggcgcaucggccggaaccccaagaacgagaacgaccaguacaucuauaugggggagccccucgagaacgacgaggauugcgcccacuggaaggaggccaagaugcugcuggacaacaucaacacccccgaaggcaucauaccguccauguucgaacccgaacgcgagaaagucgacgcgaucgacggcgaguaccggcuccgcggggaagcgagaaaaacguucguggaccugaugagacgcggcgaccugcccguguggcucgccuauaagguggccgccgaggggaucaacuacgccgacagacgcuggugcuuugacggcauuaagaacaaccagauccuggaggagaacguggaaguggagauauggacaaaggagggggagaggaagaagcuuaagccgcgauggcucgacgcgcggaucuacagcgacccgcuggcccugaaggaauucaaggaguucgcugccgggcgcaagucccucacccugaaccugaucaccgagaugggccgacuccccacauucaugacacagaagacccgcgacgcccuggacaaccucgcaguucuccacaccgccgaagccgggggccgggccuacaaccacgcccugagugaacugcccgaaacgcucgaaacacuucuacuccucacccugcuugcgaccgugaccggcgguaucuuccuguuccugauguccgggcgcgggaucgggaagaugacccucggcaugugcugcaucaucacagccucuauccugcuaugguacgcacagauccagccgcacuggaucgccgcgucgauaauccucgaguucuuucugauaguccuguuaauuccugagcccgagaagcagcggacgccccaggacaaucagcuaaccuacguggugaucgccauccuaacggucgucgcagccacaauggccaacgagauggguuuccucgagaagacuaagaaggaucuggggcuaggcucuaucgcgacccagcagccggaguccaacauccucgauaucgaucugcggcccgccagcgccuggacgcuguacgccguggccacuacauucgucacccccaugcuccggcacaguaucgagaacagcucgguaaacguuucgcugacggcgaucgccaaccaagccaccguccugaugggccucgggaagggcuggccacuaagcaagauggauaucgggguuccacuucucgccaucggaugcuacucccagguaaacccgaucacccugaccgccgcgcuguugcugcuugucgcccacuaugccaucaucgggccaggccuccaggccaaggcgacgcgcgaggcccagaagcgugccgccgccggcaucaugaaaaaccccacuguagacgggauaaccgugaucgaccuggacccgauacccuacgaccccaaguucgagaagcagcugggccaagucaugcuccugauccugugcgugacccagguucuuaugaugcgcaccaccugggcgcugugcgaggcccugacccucgccaccgggcccaucaguacgcugugggagggcaaccccgggcgguucuggaacacaaccauagccgucucaauggccaacauauuucgcggcagcuaucuggcaggcgccgggcugcucuucuccauaaugaagaacacgacaaacacacguagaggcaccgguaacaugggcgagacccugggcgagaaguggaagucccgccucaacgcgcuggggaagagugaguuccagaucuacaagaaauccgguauucaggagguggaccggacgcuggccaaggaagguaucaagcguggcgagacugaccaccacgccguaagucgggggagcgcgaaacuccgcugguucgucgagcggaauauggugacccccgagggcaagguggucgaucucggcugcgggcgcggugggugguccuacuacugcggggggcugaagaacguccgagaggugaagggccuuacgaagggcgggccaggacacgaggaaccaaucccuaugagcaccuacggguggaaccuuguccgccugcagaguggcguggauguguucuucaucccgcccgagaagugugacacccuccugugugacaucggggagagcuccccgaacccgaccgucgaggccggccggacccugcgcguccucaaccuaguggagaacuggcugaacaacaacacgcaguucuguaucaagguccugaaccccuauaugcccucugucaucgagaagauggaggcccuccagcggaaguacgguggggcccuggugaggaacccgcugucccggaacuccacccacgagauguacugggucagcaacgcgagcggcaacaucgugagcuccgugaacaugauuagcagaaugcucaucaaccgguucacgaugcgccacaaaaaggccaccuacgagcccgaugucgaccugggguccggcacccgcaauauaggaaucgagagcgaaauccccaaccuggacaucaucggcaagagaaucgagaaaaucaagcaagagcacgagacguccuggcacuacgaccaagaccaucccuacaagacgugggcguaccacggcagcuacgagaccaaacagaccggauccgccagcuccauggugaacggagugguccggcuacuuacgaagccgugggacgugcugcccaccgugacccagauggccaugaccgacacgaccccauucgggcagcagagagucuucaaagaaaagguggauacccgcacccaagaacccaaggaggggacuaagaagcucaugaagaucaccgcggaguggcuguggaaggaacucgggaagaagaagaccccgagaaugugcacacgcgaagaguucacgcggaaggugcgcagcaaugccgcccucggcgccaucuucacggaugagaacaaguggaaguccgcccgggaagcagucgaggacagccguuuuugggagcuggucgacaaggagaggaaccuccacuuagagggcaagugcgagacgugcguguauaacaugauggggaagcgcgagaaaaagcugggcgaguucgggaaggccaagggcucccgagccauuugguacaugugguugggcgcccguuuccucgaguucgaggcccugggguuccugaacgaggaccauugguucucacgggagaacuccuuaagcggcguggagggggaaggucugcacaaacugggguacauccuacgcgacguguccaagaaggagggcggcgcgauguacgccgacgacaccgccgguugggacacccggaucaccuuggaggaccugaagaacgaggagauggugaccaaccacauggaaggcgagcacaagaagcuugccgaggcuauuuucaagcugaccuaucaaaacaagguugugcgcguccagcggcccacgccccgcgggaccgugauggacauaauaagccggcgcgaccaaagagguagcggccagguggggaccuacggccugaauaccuucacgaacauggaggcccagcuaauccgccagauggagggggagggcgucuucaaaaacauccagcaccugaccgucaccgaggaagucgcagucaaaaauuggcuggccagagugggcagagagcgccucuccagaauggccauaagcggagaugacuguguggucaagccacuggacgaccgguucgcgaacgcccugacugcccucaacgacaugggcaagauccggaaggacauccaacagugggagcccaguaagggguggaacgacuggacccaagugcccuuuugcagccaccacuuccacgagcugaucaugaaggacggccgcgugcuggucguucccugccgcaaccaggacgagcucaucgggcgcgcccgcauuucccagggcgccggguggagccugcgcgagaccgcuugccugggcaaauccuacgcccagauguggucucucauguacuuccaucggcgcgaccuucgccucgccgccaacgccaucugcuccgcgguacccucgcacugggucccgaccuccagaaccacguggagcauacacgccaagcacgaguggaugaccaccgaggacaugcucacuguguggaaucgaguguggauccgcgagaaccccuggauggaggauaagacccccgucgaguccugggaggagauccccuaucuggggaagcgggaggaccaguggugugggagcuuaaucggucucaccucccgcgcuacaugggccaagaacauccaggccgcgaucaaccagguccgaaguuugauaggaaacgaagaguacacugacuacaugccguccaugaagcgcuuccggagagaggaagaggaggccggcgugcugugguga

SEQ ID NO: 25344 - RNA, 9876 nt, Artificial Sequence
  derived and/or modified CDS sequence (opt11) from DENV-2__FJ461314__SS-prME
agugcagggaugauaaucaugcugauccccacugugauggccuuccaccucaccacccggaacggggagccccauaugaucguaggaauccaggagaaggggaaaucccugcuguuuaagaccgaagacggcgugaacaugugcacccugauggcgauggacuugggggagcugugcgaggauaccauuaccuauaagugcccccuccugcggcagaacgagcccgaggacauugacuguuggugcaauagcacuuccacuuggguaacuuaugggacuugcaccaccaccggcgagcaccgccgggagaagcgcagcgucgcgcuugugccucacgugggaaugggccucgagacccgaaccgagaccuggaugaguucugagggcgccuggaagcacgcacagcgcaucgaaacguggauccugcggcaccccggcuucacaaucauggccgcgauccuggccuauaccaucggaacaacgcauuuccagcgcguccucauauucauccugcugacggccguggcucccuccaugacaaugcgcugcaucgggaucaguaaccgcgacuucguggaaggugucuccgggggaagcuggguggacaucgugcucgagcacggauccugugucacgaccauggcgaagaacaaacccacgcuggacuucgagcugaucaagaccgaggcaaagcagcccgccacccuccgaaaguacuguauagaggccaagcuaacuaacacgaccaccgaaagccgcuguccgacacagggggaacccucacuaaaggaggagcaagauaagcgguucguguguaagcauagcaugguagaccgcggcugggggaacggcugcggccuguucggaaaggggggaauagucacaugcgccauguucaccugcaagaagaacauggaaggcaagaucgugcagcccgagaaccuggaguauaccaucguggugacgccccacuccggggaggagcacgcgguggggaaugacaccggcaagcacggccaggagaucaagguuaccccgcagagcuccaucaccgaggccgaguugaccggauacggaaccgucacgauggaaugcucuccccguacgggccuugacuucaacgaaaugguccugcugcaaauggaaaacaaagccuggcucgugcaucgacagugguuccuagaccugccccuacccuggcuaccgggggcagacaagcaagaauccaacuggauccagaaagagacccuggucacauucaaaaauccgcacgccaagaagcaggacguggucgugcucggcagucaggagggggccaugcacacggcccugaccggagccaccgagauccagaugagcagugggaaccucuuauucaccggccaccugaaaugccgccugcgcauggacaagcuccaacugaaggggaugagcuacucaaugugcaccgggaaguucaaaguuguuaaagagaucgccgagacucagcacggcacaaucgugaucagagugcaguaugaaggggacgguucgcccuguaagauccccuucgagaucauggaccuagagaagcgcuaugugcuuggccggcuaaucaccgugaauccgaucguaacagagaaggauucccccgucaacaucgaggccgagccccccuucggggauagcuacaucauaaucggcguggagccggggcagcucaaguuaaacugguucaagaagggcuccagcauagggcagauguucgagaccaccaugaggggcgccaagaggauggcgaucuugggcgacacggcgugggauuucgggucccugggcgggguauucacaagcauaggcaaggcccuccaccagguguucggggccauauacggcgcggcuuucuccggagugagcuggacccugaagauccuuauuggugugaucaucacauggaucgguaugaacucacgcagcaccucucucagugucagcuuagugcucgugggcaucgucacccuguaucucggcguaaugguccaggcugauagcgggugugucguuuccuggaagaauaaggagcugaaguguggcagcggcaucuucauuaccgacaacgugcacacuuggaccgagcaauacaaguuucagccggagagccccucaaaacuggccuccgcaauccagaaggcccaggaagaagggauuugcggcauccggucggucacccggcucgaaaaccugauguggaagcagaucacucccgagcugaaucacauauuggcugagaacgaagugaagcugacaaucaugacuggggacaucaaaggcaucaugcaggccgguaagcgcagccugcggccgcagccgacagagcugaaguacuccuggaagaccugggguaaggcgaagaugcugagcaccgaauccuacaaccagaccuuccugauagacggccccgagacagcagagugcccgaacacuaaucgagccuggaauagccuggagguggaagacuacggguucggcguauucaccaccaacaucuggcugaagcugaaggagaagcaggacgccuucugcgacuccaagcuaaugagcgcagccaucaaagacaaccgggcuguacacgccgacaugggguacuggaucgaguccgcccugaacgauacuuggaagauagagaaggcgaguuuuaucgaagugaagaauugccacuggcccaagucccacacccuguggagcaauggcguuuuagaguccgagaugaucauucccaagaaccuggccgggcccgugagccagcauaauuaccgcccgggguaccacacccaaaucgcaggacccuggcaccuggguaaguuagagauggacuucgacuuuugcgacggcaccacagugaucguaacggaggauugugggaacagaggcccuagccugcguaccacuaccgccucuggcaagcuaauuacggaguggugcugccggagcuguacccuaccgccccuucgcuaccgcggggaagacggcugcugguacgggauggagauucgcccgcugaaggaaaaggaggagaaccucgugaacucacugguaaccgccggacacgggcagguagacaacuuuucauugggcgugcucggcauggcucuguuccuggaagagaugcuccgaacccgcguggggaccaagcacgcuauccugcuggucgccguguccuucgugacccucaucaccgggaacaugucguucaaggaucuggggcggguagucgugaugguaggcgccaccauggcggacgacaucgggaugggcgugacguacuuggcccuucuggcugccuucaaaguucgcccgaccuucgccgcgggucugcuccugaggaagcugaccagcaaggaacuuaugaugacuacgaucggcaucguccugcugagccagucuaccauccccgagaccguacucgagcugacugacgcacuggcacuuggcaugaugguguuaaagauugugagaaacauggagaaguaccagcuggcggugacgaucauggccauccuuugcguacccaacgccgugauuuuacagaacgccuggaaaguaagcuguacuauucuggcaguagucuccguaagcccgcugcugcugaccuccucacagcagaagaccgacuggauuccgcucgcgcugacuaucaaggggcugaauccaaccgcuauuuuccuuaccaccuuaucacgcacgaacaagaaacgaucuuggccguuaaacgaggccaucauggcggucggcaugguuuccauccucgcauccucucugcugaagaacgacaucccuaugaccggacccuuaguggccgggggccugcugaccgucugcuacguucuuaccgggcgaagcgcagaccucgagcuugagcgggccaccgacgugaagugggaagaccaggcggagaucuccggaucgagcccuauccuauccaucacuauuagcgaagacggaagcaugagcaucaagaacgaggaagaggagcagacccugacaauucugaucagaaccggcuugcugguaaucuccggccuguuuccgaucagcaucccaaucaccgccgccgcgugguaccugugggaggugaagaagcaacgggccggcgugcugugggacguccccagcccgccgcccaugggcaaggcggagcuggaagauggagccuaccguaucaagcaaaaggggauacuuggguacucucagauaggcgcuggcguguacaaggaggggacuuuccauacaauguggcacgugaccagaggcgccgucuugaugcacaaaggcaaacgcaucgaacccuccugggccgacgugaagaaggaccuaaucagcuacggcggggguuggaagcucgaaggcgaguggaaggagggagaggaggugcagguccuggcguuggagccugggaagaauccucgggccguacagacgaagcccggucucuucaagaccaauaccgggaccaucggggccguaucauuggacuucagccccgguaccuccggcagccccauaauugacaagaaagggaagguugucggcuuguaugggaauggcguggucacucgguccggagccuacgugucagccaucgcacaaaccgagaaaagcauagaggacaaccccgagauugaggacgauaucuuccggaaacgucgauugaccauuauggaucuccaucccggagcuggaaaaacgaaacgguaucugcccgcaaucgugcgggaagcgaucaagagagggcugcgaacccuuaucuuggcgccgacccgcgugguagcggcggagauggaggaggcccugcggggacugcccauccgcuaccagacgccugccauucgggcggaacacacggggagagagauaguggaccuuaugugucacgccaccuucaccaugcgcuuacucagccccguccgcgugccgaacuauaaccugaucaucauggacgaggcccacuuuaccgacccagccuccaucgccgcgcgcggcuacaucagcacgagagucgagaugggcgaggccgccgggaucuucaugacugccacgccccccgggagccgagaccccuuuccccaguccaaugccccuauaaucgacgaggagcgggagauccccgagcggucauggaauagugggcaugagugggugacggacuucaaaggaaaaaccgugugguucgugccgucaaucaaagcggggaaugacauugccgcuugucuuagaaagaacgguaagaaggucauccagcucuccaggaagacuuucgauagcgaguacguuaagacccguaccaacgacugggauuuugugguuacaaccgacaucuccgagaugggggccaacuucaaggcggagcgcgugaucgaccccagaaggugcaugaagcccgugauacucaccgacggggaggaacgggugauccuggccggccccaugccagugacccacagcagcgccgcccagcgcagggggcgcaucggccguaacccgaagaacgagaacgaccaguacauauauaugggggagcccuuagagaacgacgaggacugcgcgcacuggaaagaagcgaagaugcugcuggacaacauuaacacgcccgagggcaucaucccgaguauguucgagccagagagagagaaaguggaugcaauagacggcgaguacagacuacggggggaggcccgcaagaccuucgucgaucugaugcggcgcggcgaucugcccguuuggcuggccuacaagguggccgcggagggcauaaacuaugccgauagacguuggugcuucgacggaaucaagaacaaccagauccucgaggagaacgucgagguggaaaucuggaccaaggagggggagaggaagaagcugaagccgcgauggcucgacgcccggauuuacuccgacccccuggcucugaaggaguucaaggaauuugccgcgggccgaaaaagcuuaacucugaaccugauuacggagaugggccggcuuccuaccuucaugacccagaaaacgcgcgacgcacuggauaaccuggcaguccuccacacggccgaggcgggugggcgggccuacaaccacgcccuguccgaguuacccgagacgcucgaaacucugcugcucuuaacguuacuugcgacggugaccggaggcaucuuccuguuccugaugagcggccgcggcaucgggaagaugacccucgguaugugcugcaucaucacugcguccauccuccugugguacgcgcaaauacagccgcacuggauagccgccucaaucauccucgaguucuuccugaucguacugcucauccccgagccagagaaacagcggacgccccaggacaaccagcugacguacgucgugaucgccauccuuaccgucgucgcagcgaccauggcaaacgagaugggcuuccucgaaaagacgaaaaaggaccuggggcucggauccaucgcgacacaacagccugagagcaauauccucgacauagaccugcgccccgccuccgccuggacgcuguacgcaguggccaccaccuucgugacgcccaugcuccggcauagcaucgagaacagcuccgugaacgugucgcuuaccgccauugcuaaccaggccaccgugcugaugggccucgggaaggguuggccguuguccaagauggauaucgguguuccgcugcuagcgaucgguugcuacagccaggugaaccccaucacccugacugcugcccuacuccuacugguugcccacuacgcgaucauugggccuggccugcaagccaaggccacgcgcgaggcccagaagagggccgcagcagggaucaugaagaaccccacgguagaugggauuacggugaucgaccuggauccgauccccuacgacccgaaguuugagaagcaguuaggccaggugaugcugcugauucugugcgucacacaggugcucaugaugcggaccaccugggcccugugcgaggcccugacucucgccacuggccccaucagcacccugugggagggcaacccggggcgguucuggaacaccaccaucgcggucagcauggcuaacaucuuccgaggcagcuaccuggccggcgccgggcuccuuuucucaauuaugaagaacacgaccaacacgcggcgcggcaccgggaacaugggagaaacgcugggggagaaguggaagucccgucugaauaccuuaggcaagagcgaauuccagaucuauaagaagucagggauacaagaggucgaccggacccuggcuaaagagggcaucaagaggggggagacggaccaccacgccgugucuagagggucggccaaacuccgcugguucguggagcggaacaugguaacgccagagggcaaggucguggaccuggguugugggcgugguggguggagcuacuacugcggcgggcugaagaauguccgggaggugaaaggccucaccaagggaggucccggccacgaggagcccaucccgauguccaccuacggguggaaccugguuagacuccaguccggcguugacguguucuucauuccgccagagaagugcgacacccuccugugugacaucggggaguccagccccaaucccacgguggaagcaggccggacccugaggguccucaaucugguggaaaacuggcuuaacaacaacacccaauucugcaucaaggugcugaaccccuacaugcccuccgucaucgagaagauggaggcccuccagcggaaguacgguggggcgcuggugcguaacccgcugucucggaacagcacccacgagauguacuggguauccaacgccagcggcaacauugucuccagcgugaauaugaucuccaggaugcuaaucaaccgguucaccaugcgacacaagaaagccacauacgaaccugauguggaccuugggagcggcacccggaacaucgguauagaguccgagauacccaaccuggacaucaucgguaagcgcaucgagaagauaaagcaagagcacgagaccagcuggcacuacgaucaggaccaucccuacaagacuugggcuuaccacggcuccuacgagaccaaacaaaccgguagcgcuucaucgauggucaacggcgugguccggcuccugacuaagccgugggacguccugccaaccgugacucagauggcgaugaccgacaccacuccguuugggcaacagcguguauucaaggagaaggucgacacgaggacccaggagccaaaggaaggcaccaagaagcuaaugaagaucacagcggaguggcuguggaaggagcucgggaaaaagaagacgccgagaauguguacucgcgaagaauucacgcggaaagugcgcuccaaugccgcgcugggugccauauucacugacgagaacaaauggaagucugcgcgggaggccguggaggacucccgcuuuugggaacuggucgacaaggaacgaaacuuacauuuagagggcaagugcgagacguguguguacaacaugaugggcaagcgcgagaagaagcugggcgaguucgggaaggccaagggcaguagagccaucugguacauguggcugggcgcgagguuucucgaauucgaggcccuuggguucuugaaugaggaucacugguucucccgggaaaacagccuguccggugucgagggggaaggccugcacaaguugggguauauccuccgcgacgugucuaagaaagagggcggggcaauguacgcagacgacaccgccgggugggacacccgaaucacccuggaagaucugaaaaacgaggagauggucacgaaccacauggagggcgagcauaaaaagcucgcggaggccauauucaagcugacauaccagaacaaggucguacgggugcaacggcccacgccccgcgggaccguaauggacaucaucagccggcgcgaccagcgcggcuccggccaggucgggaccuacggucugaacaccuucaccaacauggaagcccaacucauacgucagauggagggggaggguguguuuaagaacauccagcaccugacuguaacggaggagguagcugugcagaacugguuggcccgggucggucgugagcgcuugagccggauggcgauaagcggcgacgacugcgucgugaagccccuggacgaccgcuucgccaacgcacuaaccgccuugaaugacauggguaaaauucggaaggacauccaacagugggagccgagcaaaggguggaacgacuggacccaggucccauucugcucccaccacuuccacgagcugauaaugaaggacggacguguucuuguaguuccuugccggaaucaggacgagcuaauuggccgcgcucguaucucccaaggcgcggguuggucccugagggagaccgccugccugggcaaaagcuaugcccagauguggucacuuauguacuuccacaggagggacuugcggcuggccgcuaacgcgauuuguucggcugugcccucccauugggugccuacgucgcgcaccaccuggucuauccacgcgaagcacgaauggaugaccaccgaggacaugcuuacggucuggaaccggguguggauacgcgagaaucccuggauggaggacaagacacccguugagagcugggaggagaucccuuaccucggcaagagagaggaccaaugguguggcuccuuaaucggccucaccucacgcgcuaccugggccaagaacauccaagcagccaucaaccagguccggucccugaucgggaacgaagaguacacagacuacaugccgaguaugaagcgcuuccggcgugaggaggaggaagccggcguacugugguga

SEQ ID NO: 25345 - RNA, 9876 nt, Artificial Sequence
  derived and/or modified CDS sequence (opt11) from DENV-2__FJ410221__SS-prME
uccgcggguaugaucaucaugcuuauccccaccguuauggccuuccaccucaccacgaggaacggggagccccacaugaucguggggauucaggaaaagggcaagucccugcuguucaagaccgaggacggcgugaacaugugcacccugauggcgauggaccugggcgagcugugcgaagacaccauaacuuacaagugcccccucuuacggcagaacgagcccgaggacaucgauugcuggugcaacagcaccagcaccugggugaccuacgggaccuguacgaccacaggggagcaccgccgggagaagcgcagcgucgcgcuggugccccacguggggaugggcuuagaaacgcggacagagacauggaugagcagcgagggggcuuggaagcaugcccagcgaaucgagacuuggauccugcggcacccgggauucacgaucauggccgccauccuggcguacaccaucgggacgacccacuuccagcgcguccugauauucauccugcugaccgccguggccccauccaugaccaugcggugcauuggcaucagcaaccgcgacuucguggagggcgucuccggggguagcuggguggacauagugcucgagcacggguccugcguuaccaccauggcgaagaacaagccaacgcuggacuucgaguugauaaagaccgaggccaagcagcccgcaacccuccggaaguacugcaucgaggccaagcugacgaacacuaccaccgagagccgcugcccuacacagggcgagcccucccugaaggaggagcaggacaagcgguucguguguaagcacagcaugguggaccgcggcugggguaacggcugcggccuguucggcaaggguggaaucguaaccugcgcgauguuuaccugcaagaagaacauggaggggaagaucguccagcccgagaacuuagaguacaccaucguggucacgccccacuccggugaggagcaugcgguaggcaaugauacuggcaagcacggcaaggaaaucaaggugaccccgcagucauccaucaccgaggcugagcugacaggguacggcaccgucacgauggagugcagcccacggaccggccucgacuucaacgaaaugguuuugcugcagauggaaaauaaggcauggcucgugcaccggcagugguucuuagaccugccccuccccuggcucccgggggccgacaagcaagaauccaacuggauccagaaggagacccucgucacuuucaagaauccccacgccaagaagcaggacguggucgugcuaggcucacaggagggagcaaugcacacggcccugaccggcgccaccgagauccaaaugagcuccgggaaccuucuauucaccggccaccugaaaugccggcugcgaauggauaaacuccagcugaagggcaugagcuacuccaugugcacgggcaaauucaaggucguaaaggagaucgccgagacccagcacggcacgaucgugauccgggugcaguacgaaggugacggcagcccaugcaagauccccuucgagaucauggaucuagagaagagauacgucuugggacggcugaucaccgugaacccgaucgugacggagaaggacucccccgucaacaucgaggccgagccgcccuucggggacagcuacauuauuaucggcguggaaccaggacagcuaaagcucaacugguucaagaagggcuccagcaucggacagauguucgagaccaccaugcgcggcgcgaagaggauggccauccucggcgacaccgccugggauuucgggucccuagggggaguguucacgagcauaggcaaggccuugcaucaagucuucggggcaaucuacggcgccgccuucuccggagugagcuggacaaugaagauccuuauuggggugaucaucaccuggaucggcaugaacucccggucgaccucccugagcgucucccugguccucguggggaucgucacgcuguaccugggcgucauggugcaggccgacagcgggugcgucguguccuggaaaaacaaagagcucaagugcggcaguggcaucuucaucaccgacaacgugcacaccuggaccgaacaguauaaguuucaacccgagagucccuccaagcuagccagcgcgauucagaaggcccaggaggaggggaucugcggcauccgcuccgugacgcgguuagagaaccucauguggaagcagaucacccccgagcugaaccacauccuugcggagaacgaggugaagcucaccaucaugaccggggacaucaaggguauuaugcaggccgggaagcgcagccugcgcccucagcccacggagcuaaaauacuccuggaagaccuggggcaaagccaagauguuaagcaccgaguccuacaaccagaccuucuugauagacggacccgaaaccgcggagugcccgaauacgaacagggccuggaacagccuggagguggaggacuauggguucggcgucuucaccaccaacaucuggcucaagcugaaggagaagcaggacgccuucugcgacuccaagcuaaugagcgccgccauaaaggacaaccgggcgguacacgcggacaugggguauuggaucgaguccgcacucaacgauacguggaagauagagaaagccagcuucaucgaggugaagaacugucacuggcccaagagucacacccuguggagcaacggcguccuggagagugagaugauuauccccaagaaucucgccggccccguuucccaacacaacuaccgaccgggguaccauacccagaucgcaggccccuggcaccucgggaagcuagagauggacuucgacuucugcgacggcaccaccguuaucgucacggaggacugcgggaaccgcgggcccucccuccgcacaacaaccgccagcggcaagcucaucacggaguggugcugccguagcugcacccucccgccgcuccgcuacagaggggaggacgguugcugguacggcauggagaucagaccccuuaaggagaaggaagaaaaccuagugaacucccucgugaccgccggccacgggcagguagacaacuucucacugggcgugcugggcauggcccucuucuuggaagagaugcuacgcacccgcguggggacgaagcaugcgauccuccuggucgcgguguccuucgugacccugaucaccggcaacaugagcuucaaggaccuagggcgggucguggugauggucggcgccaucauggcugacgacaucgguaucggagugaccuaccuggcccugcuggcggcauucaaggugcgacccacguucgccgccggcuuauuacucaggaagcugaccuccaaggagcugaugaugaccaccaucggcaucguccugcugagccaauccacgauccccgagaccgucuuggaguuaaccgacgcccuugcgcugggcaugaugguucucaaaaucguccgcaacauggagaaguaucaguuggcagugaccaucauggccaucuuaugcgugccuaacgcggugauucuccagaacgcguggaaggugagcugcacgauucuagcggucgugucgguaagcccccugcucuugaccucgagccagcaaaagaccgacuggauccccuuagcgcucaccaucaaggggcugaaccccacagccaucuuccugaccacccucucgcgcaccaacaagaagcggucuuggccgcugaaugaagccaucauggccgugggcaugguuuccaucuuagccagcuccuugcugaagaacgauauccccaugacggguccccugguggccggcgguuugcugaccgucugcuacguucugaccgggcgcagugccgaccuggagcuggaacgggccaccgacguaaagugggaggaccaggcggagaucuccggcagcagccccauccuauccauaacgauuucagaggacggguccaugagcaucaagaaugaggaggaggagcagacccucaccauucugauccgcaccggacugcucgucaucuccggccuguucccgaucagcaucccgaucacggccgcagccugguaccugugggagguuaagaagcagcgggccggagugcucugggacguaccuaguccgccgcccauggguaaggcugagcuggaggacggggccuaccgcaucaaacagaaaggcauccugggguacagccagauuggcgccggcguuuauaaggagggcacauuucacaccauguggcacguaacccggggcgccgugcucaugcacaagggaaaacgcaucgagcccucuugggccgacgugaagaaggaccugauuucauacggcgggggcuggaagcuggagggcgaguggaaggagggggaggaggugcagguccucgcgcuugagcccggcaagaacccccgggcaguccagaccaagcccgggcuguuuaagacgaacaccggcaccaucggggccgugucccucgauuucagccccgggaccaguggcagcccaaucaucgacaagaaagggaaggucgugggacuguacgggaauggcguggucacgcgcuccggcgccuacgugagcgccaucgcgcaguccgagaaguccaucgaggacaaucccgagaucgaggacgacaucuuccggaagcggcgucugaccaucauggaccugcaucccggggccgggaaaaccaagcgcuaccuccccgccaucguacgggaggcaauuaagcgcgggcugaggacacugauccucgcaccgacgcgcguaguggcagccgagauggaggaggcuuugcggggccugcccauccgcuaccagacccccgcaauccggguugagcacacagggagggagauaguagaucucaugugccacgcgacauucacgaugcgccuucugucccccgugcgggugcccaacuacaauuugaucaucauggacgaggcccacuuuaccgacccggccagcaucgcugcccgcggcuacaucagcacccgggucgagaugggagaggcggcugggaucuucaugacugccacgccgcccggcucgcgcgacccuuucccccagagcaacgcucccauuauugacgaagaacgggagauccccgagagauccuggaacagcggucacgagugggugaccgacuucaagggcaagaccgugugguucgucccgaguaucaaggccgguaacgacaucgcggcgugccugaggaaaaacggcaaaaagguuauccagcugagccgcaagaccuucgacuccgaguacgugaagacacggaccaacgauugggauuucgucguaaccaccgacaucagcgagaugggcgcaaacuuuaaggccgagcgcgugaucgacccccguagauguaugaagcccgucauucucacagacggggaggaacgggucauccuggcgggcccgaugccggugacccauuccuccgccgcccaacgccgggggcguaucggccggaaucccaagaacgaaaacgaccaauacaucuacaugggggaaccccuggaaaacgacgaggacugcgcccacuggaaggaggcgaagaugcuccuggacaacauaaacacucccgaaggcauuauuccguccauguucgagcccgaacgcgagaaggucgacgcgaucgacggcgaauaccggcugcgcggggaggcccgcaaaacuuucguggaccugaugcggcgcggcgaccugccagucuggcuggccuauaagguagccgcggaggggaucaacuacgcggaccggcguuggugcuucgacggcaucaagaacaaucagauccuagaggagaacguggaagucgaaaucuggacgaaggagggggaacgcaaaaagcugaagccgcgcuggcuggacgcccggaucuacagcgacccccucgcccuuaaggaguucaaggaguucgccgccggccgcaagucccugacucugaaccugaucaccgagaugggacggcuccccaccuucaugacgcagaaaacccgcgaugcauuggacaacuuggccgugcuccauacugccgaggccgggggccgggcguacaaccacgcccucagcgagcucccugagaccuuagagacgcuccugcugcucacccuccuggccaccgucaccgggggcauauuccuauuccugaugucaggccgcgggauaggcaagaugacguuagggauguguugcaucaucaccgccagcauucuccugugguacgcgcagauccagccgcauuggaucgcagccuccaucauccuggaguucuuuuuaauaguccuguuaauccccgagcccgagaaacagcggacgccccaggauaaccagcucaccuacguggugauagcgauucugacggucguggccgccacgauggcuaacgagaugggcuuccuggagaaaaccaagaaggaccuuggccugggaagcauagcuacccagcaaccggaguccaacauccuggauaucgaccuccgucccgcaagcgccuggacccuuuacgcgguggcgacuaccuucgugacgcccaugcugcggcacagcaucgagaacuccagcgugaacgugucguuaaccgccaucgcuaaucaagccacuguccugaugggcuuggggaagggcuggccccucagcaagauggauaucggggugccgcuguuagccaucggcugcuacucccaggugaaccccaucacccucaccgcggcccugcugcuucugguugcccacuacgcuaucaucggccccggccugcaggcgaaggccacccgggaggcccaaaagcgggccgccgccggcauaaugaagaacccaacggucgaugggaucaccguaauugaccucgacccgauccccuacgaccccaaguucgagaaacagcuaggccaggugaugcugcucauacugugcgugacccaggugcugaugaugcgcaccacgugggcccucugcgaggcacugacauuggccaccggacccaucagcacccucugggaaggcaacccugggcgguucuggaacacgaccaucgccgucaguauggcgaacaucuuccgaggcagcuaucuggccggcgccgggcuccuguuuuccaucaugaagaacaccaccaacacgaggcguggcaccgggaacaucggcgaaacccugggggaaaaguggaagucccgccuaaacgcccuagguaaguccgaguuucagauuuacaagaaguccgguauacaggagguggaccggacccuggcaaaggaggggaucaagcgcggcgagacggaccaccacgcuguuucucggggguccgccaaguugcgaugguucgucgagagaaacaugguaacccccgagggaaagguagucgaccucggcugcgggcgcggagggugguccuacuacugcggcgggcugaagaacguccgagaggucaagggcuugacaaagggagggcccggccacgaggagcccaucccaaugagcacauacggguggaaucucgugcgucugcaguccggcguagacguguucuucaucccuccagagaagugcgacacgcugcucugcgacaucggggagagcucccccaaccccacagucgaggccggccggacccugcgcguacucaauuuagucgaaaacuggcugaacaacaacacgcaguucugcauuaagguccugaaccccuacaugcccagcgugaucgagaaaauggaggcccugcagcggaaguacggaggggcgcucgugcgcaacccgcugagccgaaacucuacgcacgagauguacugggucagcaaugccuccggcaacaucgugagcagcguuaacaugaucagccgcaugcugaucaacagguucaccaugcgccacaagaaggccaccuacgagcccgacguggaucucggcuccggaacucggaacguggggaucgagagcgagauccccaaccuggacaucaucggcaagcgcaucgagaagaucaagcaggaacacgaaaccuccuggcacuaugaccaggaccaucccuacaagaccugggccuaccacgguagcuacgagaccaagcagaccgggagcgcuaguuccauggugaauggggucgucagacugcucaccaagccgugggacgugcugcccacggucacccagauggcgaugaccgacaccacgccauuugggcaacagcguguuuucaaggagaagguggacacccgcacccaggaacccaaggaagguaccaagaagcugaugaagaucacggccgagugguuauggaaggagcugggcaagaagaagaccccgcggaugugcacccgcgaggaguucacccggaagguccgaagcaaugcagcccugggggccaucuucacggacgagaauaaguggaaguccgcgcgggaggcaguggaggauagccgcuucugggaauuagucgacaaagagcggaaccuccaccuggaaggcaagugugagaccugcguguauaauaugauggggaagcgcgagaagaagcucggcgaguucggaaaggccaagggcucccgggcuauuugguacauguggcugggcgcucgcuuucuggaguucgaggcgcucggguuccugaacgaggaccacugguucagcagggagaacucucugagcggcguggagggggagggccuccacaagcugggguacauauugagggacgucaguaaaaaggagggcggcgccauguaugcugacgacaccgccggcugggacacacggaucacgcucgaggaccucaagaacgaggagaugguuacuaaucacauggagggcgagcacaagaagcuggcggaggcuaucuucaaacuuacuuaccagaacaaggugguuagagugcagcggcccacgccccgggggaccgucauggacaucaucucccggcgcgaccaacgggggucugggcaggucggcaccuacggcuugaauaccuuuacaaacauggaggcccaguugauccgacagauggagggggagggcguguucaagaauauccagcaccucacggugaccgaagaggucgccguucaaaauuggcuggccagggugggucgcgagagacucucccgaauggcgaucagcggggacgacugcguuguaaagccccucgacgaccgcuucgcgaacgcccucacagcccugaacgacaugggcaagauccguaaggacauucagcagugggaacccuccaagggauggaacgacuggacccaggugcccuucugcagccaccacuuccacgagcucaucaugaaggacggacgcguguugguaguucccugccggaaccaagacgagcugaucgggcgcgcccgcauuagucagggcgcgggguggucgcuccgggagacggccugcuuaggaaaguccuacgcccagauguggagucucauguacuuccaccggcgcgaccuccggcuggcggccaacgcgauuugcuccgccguccccucccacugggugcccaccucgcgcaccacuuggucgauucacgccaaacacgaguggaugacgaccgaggauaugcugaccguguggaauagagucuggauccgcgagaaucccuggauggaggauaaaacccccguggaguccugggaggagauccccuacuuaggcaaacgggaggaccaguggugcgggagccugaucggacugaccagucgcgcuacgugggccaagaacauccaggcggccaucaaccaggugcggagccucauuggcaacgaagaauacaccgacuacaugcccagcaugaagcgcuuuagacgcgaggaggaggaggccggaguccugugguga

SEQ ID NO: 25346 - RNA, 9876 nt, Artificial Sequence
  derived and/or modified CDS sequence (opt11) from DENV-2__FJ547064__SS-prME
agcgcagguaugauaaucaugcuaauccccaccguuauggccuuccaucucaccacccggaacggggaaccccacaugguugucgggauacaggagaagggaaagucucugcuguucaaaacugaggacggggucaauaugugcacccuaauggcgauggaccugggagagcucugcgaggacaccaucaccuacaagugcccccuccugcgucagaacgagcccgaggacaucgacugcuggugcaacagcaccuccaccugggugaccuacgggacgugcaccaccaccggggagcaucgaagagaaaagcgcagcguggcccuggugccacacgucgggaugggccucgaaacaagaacagagaccuggaugucuagcgagggggcuuggaaacacgcccaacgcauagagacauggauccugcggcacccaggcuucaccaucauggcugcgauucuggcauacacuaucggcacaacccacuuccagcguguguugauuuucauccuccucacggccgucgcccccuccaugaccaugcgcugcaucggcaucagcaaucgcgauuucgucgagggcgucuccgggggcucauggguggacaucgugcuggagcacggguccugcgugaccacgauggcgaagaacaaacccacucuggauuucgaacugaucaagaccgaagccaagcagccugccacacuccggaaauacugcaucgaggccaagcuaaccaacacaaccaccgagucucggugccccacccagggcgagcccucccugaaggaggaacaggacaagcgguucguuugcaagcacagcaugguggaccggggcuggggcaacggcugcggauuauucggcaagggagggaucguuacgugugccauguucacgugcaaaaagaacauggaaggaaaaaucgugcagcccgagaaccuggaguacacaaucgucgugacaccccacuccggggaggaacacgcggucggcaaugacacggggaagcacggccaggagauuaaggucaccccucagaguucgaucacugaagccgagcugacaggguacggaaccgucacaauggagugcagcccccggaccggccucgacuucaaugaaauggugcugcugcagauggagaacaaggccugguugguccacagacagugguuccuggaccuuccccuuccguggcugccaggcgccgacaagcaggaguccaacuggauccagaaagagaccuuagugaccuucaaaaauccccacgcgaaaaagcaggacguggugguucucggcagccaagagggggcaaugcacacggcccugaccggcgccaccgagauacagaugagcuccgggaaccuccuguucaccggucaccuuaaaugccgucuacgcauggacaagcuccagcugaagggcaugagcuacaguaugugcacggggaaguuuaagguggucaaggagauagccgaaacccaacacgguacaaucguaauccggguccaauacgagggcgauggcagcccuuguaagaucccguucgagaucauggaccuggagaagagguacguucucggccggcuuaucaccgugaacccaaucgucacugagaaagacucccccgugaacaucgaggcugagccgcccuuuggggacagcuacauuaucaucggcguugagccagggcagcucaaacucaacugguucaagaagggaucuagcaucggccagauguuugagaccaccaugcgaggcgcaaagcgcauggcgauccugggggacacagccugggauuucgggagccugggugggguguucacgagcaucggcaaggcccuacaccagguguucggggcgaucuacggagcggccuucuccggcguguccuggaccaugaagauccugauuggggucauuauaaccuggaucgggaugaacuccaggaguacgucccuguccguuucccuggucuuagucgggauuguaacguuauaccuggggguuaugguacaggccgacucuggaugcgugguguccuggaagaacaaggagcucaaaugcggcagcggcaucuuuaucaccgauaacguccacacguggaccgagcaauacaaauuccagcccgagagccccuccaagcuggccucggcgauacagaaagcucaggaggaagggaucugcggcauccguuccgugacccggcuggaaaaccucauguggaagcagaucacccccgaguugaaccacauacuggccgagaacgaagugaaacuuaccaucaugaccggugacauuaagggcaucaugcaggccgggaagcgcagccucagaccgcagcccacggaacugaaguacuccuggaagaccuggggaaaggccaagaugcucagcacagaguccuacaaccagaccuucuugaucgacggccccgagacggcugaguguccgaauaccaaucgcgcguggaauagccuggaggucgaggacuacggguucgguguguucacgaccaacaucuggcucaagcucaaggagaagcaggaugcauucugugauuccaagcugaugagugcugcgaucaaggacaaccgggcggugcacgcagacaugggguacuggaucgaauccgcccucaacgacacguggaagaucgagaaggccagcuucaucgaggucaagaacugccacuggccuaagucucauacccuauggagcaacggcguuuuggagucggagaugaucauuccuaagaacuuagcaggccccgugagccaacacaauuaccggccgggguaccacacacaaauagcuggaccauggcaccuggggaagcuagagauggauuucgacuucugcgacggaaccaccgucaucgugaccgaggauugcggaaaucggggccccuccuugcgcacaaccaccgccucugggaagcugauuacggaaugguguugccggagcugcaccuuacccccgcuccgcuaccgcggugaggacggcugcugguacgggauggaaauccgcccguugaaggagaaagaagagaaccuggugaacucccuugucacggcagggcauggacagguggacaacuucuccuugggugugcucggcauggcccucuuccuggaggagaugcugcgaacccgcgucggaacgaagcacgcgauccuccugguggcgguuucauuugucacccugaucaccggcaacaugagcuuuaaggaccuagggcgggugguagucauggugggcgcgaccaugacggacgacaucgggaugggugugaccuaccuggcccugcucgcggcguuuaagguccgccccaccuucgccgccggacugcugcuccggaaacugacuuccaaagagcuuaugaugacgaccauugggauagugcuccugagccagucaacgauccccgagacagugcucgagcuuacagacgcccuggcgcugggcaugaugguccuaaagauugugcggaacauggagaaguaucagcuggcggucacgauaauggccauccucugcgugccuaacgccgugauacuccaaaacgccuggaaagucagcuguaccauccuagccguuguguccguuagcccgcuacuccuuacauccagccagcaaaagacggacuggaucccccuggcucucaccaucaagggccugaaccccacugcaaucuuuuuaacuacguuaucccgcaccaacaagaagcggaguuggccgcugaaugaggccaucauggcugugggcaugguguccauccuggcuagcucccuccugaagaacgauauccccaugaccggccccuuggucgcgggcggccuccugaccguguguuauguguugacugggcgaagugccgaccucgaacuggagcgggcaaccgauguaaagugggaggaucaggccgagaucuccgggucuagcccgauccugagcaucaccaucucggaggauggguccaugagcaucaagaaugaagaggaggagcagacccuaacgauccugauccggacgggccuguuggugauaaguggccuuuuuccgaucagcauccccaucacagcggccgccugguaccugugggaggugaagaagcagcgagccgggguccucugggaugugcccagcccgccucccaugggcaaggccgagcuugaggacggugcguaucguaucaagcagaagggcauacuaggcuacucgcaaauuggcgccggcguauaccgggagggaaccuuucacacgauguggcaugucacgcgaggcgccguacucaugcacaaggggaagcggaucgagccgaguugggccgacgugaagaaggaccugauaucguacggcgggggcuggaagcuggagggcgaguggaaggaaggggaggagguccaggugcuagcccuggagcccggcaagaauccccgcgcggugcagaccaagcccggacuauuuaagaccaacacaggaacgauuggggcggucucccucgacuuuagccccggcaccucaggaagcccaaucaucgacaagaaggggaagguggugggacuguaugggaacggcgucgugacccgguccggcgcuuacgugagcgccaucgcccagaccgagaaauccaucgaggauaaccccgagauagaggacgauaucuuccgcaagcgccgccuaacaaucauggaucuacaucccggggcgggcaaaaccaagcguuaccuccccgccauaguacgcgaggccauaaagcgagggcugcgcacucuaaucuuggcaccgacccgcgugguugcggccgagauggaggaggcucugcgaggccugcccauccguuaccagacgccagccauacgagccgagcacaccggucgcgagaucguagaucugaugugucacgccaccuuuaccaugcgccugcucagccccgugcgugugccgaacuacaaucucaucauaauggacgaggcacacuucacggaccccgccuccaucgcugcccggggcuacauuaguacccgugucgagaugggggaggcggccgguaucuucaugacggcuacgccacccgguagccgggacccuuucccccagucuaacgcccccaucaucgaugaggagcgagagauuccggagcgguccuggaacuccggucacgaguggguuaccgacuucaagggcaaaacaguaugguucgucccgagcaucaaggccgggaacgauaucguugcgugccuccgcaagaacggcaagaaggugauccagcugucccguaaaaccuucgacagcgaguacguuaagacccgcacgaacgacugggauuucgugguaaccaccgacaucagcgaaaugggggccaacuucaaggccgagcggguuaucgacccucgccggugcaugaagcccguuauccuuacagacggugaggagcgcgugauccuggccggucccaugccggucacgcauucauccgcggcgcagcggcgagggcggaucggcagaaacccgaaaaaugaaaacgaccaguauaucuacaugggggagccgcuggagaacgaugaggauugcgcccacuggaaggaagcgaagaugcuccuggauaacaucaacacgcccgaaggcaucauccccagcauguucgaacccgagagagagaagguagaugccauugauggcgaguaccgucugcgcggggaggcgaggaagacguucguggaccucaugcgucggggcgauuugcccgucuggcuggccuacaaaguggccgccgaagggaucaauuaugcggaccgcagaugguguuucgauggcauuaagaauaaccagauacucgaggaaaaugucgaaguugagaucuggaccaaggagggggaacgcaaaaagcugaagccucgguggcuggacgcgcgaaucuacucugacccgcuagcccugaaagaguucaaggaguuugcggcgggucgaaaaucauuaacgcucaaccugaucaccgagaugggccgccugccgaccuuuaugacccagaagaccagagacgcccucgauaauuuggcuguccugcacaccgccgaggcgggaggacgcgccuacaaccacgcgcuguccgagcugcccgaaaccuuggagacccucuuacugcucacgcugcuggccacagucaccgggggcaucuuccuauuccugaugagcggccgggggauuggcaagaugacccuggggaugugcugcauuauaacggccuccauccugcugugguaugcccagauucagccccacuggaucgccgcaaguaucauccuugaguucuuucugaucgugcugcuuauccccgaacccgagaagcagcgcacuccccaggacaaccagcucaccuaugugguuaucgccaucuugacugugguggccgccaccauggcaaaugaaaugggcuuccuggagaaaacgaaaaaggaccucggguugggcucgauugcaacccagcaaccggagagcaacaucuuagacaucgaccuccggcccgcuucagccuggacccuguaugccgucgccaccacauucgugacccccauguuacgucacagcaucgagaacagcucggugaacgugagccucaccgcgaucgccaaccaagccaccguacugaugggccugggcaagggcuggcccuuaaguaagauggacaucggggugccgcugcuggcaauaggcuguuacagccaggucaaucccaucacucucaccgcggcgcugcuguuauugguggcccacuacgccaucaucgggcccggccugcaggccaaggcgacgcgggaggcgcagaagcgcgcagcagccgggaucaugaagaaccccaccguggacgggaucacuguuaucgacuuggauccaauccccuacgaucccaaguuugagaagcagcuggggcagguuaugcugcuaauucugugcgugacccaaguccucaugaugcggacaaccugggcucucugugaggcgcugacccucgcgaccgggcccaucuccacguuaugggagggcaacccgggacgcuucuggaacacaacgaucgccgucucaauggccaacaucuuccguggaaguuacuuggcuggagccgggcuccucuucucaaucaugaagaacaccacaaacacacgccgcggcacgggaaauaugggcgagacccugggcgagaaguggaagucaaggcugaacgcacucggcaagagcgaguuccagaucuauaagaagagugguauacaggagguggaccgaacucuagccaaggaggggauuaagcggggcgaaacugaccaccacgccgucucucgcggguccgcgaagcugagaugguuuguggagcgcaacaugguaacccccgagggcaaggucguugaccuugguugcggccggggcggguggagcuacuacugcggcggcuugaagaacguccgcgaggucaagggucuuaccaagggcgggccgggccacgaggagccgaucccgauguccacuuacggguggaaucucgugcgucugcagagcggaguggacguauucuuuaucccuccugagaagugugauacccugcucugcgauaucggugaguccagccccaacccaacgguagaagccggcaggacccugcgcguccuuaaucucgucgagaacuggcugaacaacaacauccaguucugcauaaaagugcugaauccuuacaugccauccgucaucgaaaagauggaggcccuacagcgcaaguaugguggugcccugguccggaacccguugagccgcaauagcacccacgagauguauuggguuuccaacgcgucaggcaacaucguguccagcgucaacaugaucucucggaugcucaucaaccgguuuacaaugcggcauaagaaagcuacuuacgagcccgacguagaucucgggagcggcacgcgcaacaucgggacggagucagaaauccccaaccuagacauaaucggcaaacggaucgagaaaauuaagcaggagcacgagacuagcuggcacuacgaucaggaccaccccuacaagaccugggccuaccauggcuccuaugaaacgaagcagaccggguccgccuccucaauggugaacggagucgugcgcuugcucaccaagcccugggacguguugccuauggucacccagauggccaugacggacaccacccccuucgggcaacagcgcguguuuaaggagaaaguggacacccggacgcaggagcccaaggaaggcaccaagaagcugaugaaaaucaccgcggaguggcucuggaaggagcuuggcaaaaagaagaccccucgcaugugcacgcgggaggaguuuacccgcaagguucggaguaacgcugcacugggcgccaucuucacagaugaaaacaaguggaaguccgcgcgcgaagcaguugaggacucccgcuucugggaguuagucgacaaggagcgcaaccuacaccuggaaggcaagugcgagaccugcguuuacaauaugauggggaagcgcgagaagaaacuuggcgaguuugggaaagccaagggcucgcgcgccauaugguauauguggcugggcgcacgguuccuggaguucgaagcucugggguuccucaacgaggaccacugguucucaagggaaaauucgcucucgggcguggagggugaaggccuccacaagcugggguacauccugcgugaugucagcaagaaggaaggcggggcgauguacgcggacgacacggcggggugggacacccgcaucacacucgaggaccucaaaaacgaggagaugguaaccaaccacauggagggggagcacaagaagcuggcugaagcgaucuuuaagcucacguaccagaacaaaguuguucgggugcaacgccccacgccccggggaaccgugauggacaucaucagccgccgggaccagcgaggcuccggacaagucggcacuuacggccucaacacguucacgaacauggaggcccagcugauucggcagauggagggggagggugucuucaagaacauccagcacuugaccgucaccgaggaggucgccgugaaaaacugguuggcccggguggggcgcgaacgacucagccgcauggccaucucgggcgacgacugcgucgugaagccccucgacgaccgauucgccaaugcucugacggccuugaacgauaugggcaaaauccggaaagacauacaacagugggagccgagcaaaggguggaaugacuggacccaggugcccuucugcucccaccauuuccacgagcucauaaugaaggacggccggguguugguaguaccaugccgcaaccaggacgaacugaucggacgggcccgcaucagccagggcgcgggguggucccuucgggaaaccgccugccugggcaagagcuacgcucaaauguggucccugauguacuuccaccgccgggauuuacgccuggcggccaaugcuaucugcagcgcgguccccucccacugggugccgacuagcagaacgacauggucuauccacgcgaagcacgaguggaugacuaccgaagauaugcugaccguguggaaucgcgucuggauccgggaaaaucccuggauggaggacaagacucccguggagagcugggaagagauucccuaccucggaaaacgagaggaucaguggugcggguccuugauuggacugacaucgcgggccaccugggccaagaauauucaagcagcgaucaaccaggugcgcucccucauagggaaugaggaauacaccgacuacaugccguccaugaagcguuuccgccgcgaagaggaggaggcuggcguccugugguga

SEQ ID NO: 25347 - RNA, 9876 nt, Artificial Sequence
  derived and/or modified CDS sequence (opt11) from DENV-2__FJ410223__SS-prME
uccgcuggcaugaucaucaugcugauccccacaguuauggccuuucaccuuaccacccggaauggcgagccgcacaugaucgucggcauccaggagaaggggaagucccugcuguucaagaccgaggacggcgucaacaugugcacacugauggcgauggaccugggggaguugugcgaagacacuauuacuuacaagugcccccuccuucgacagaaugagccagaagacaucgacuguugguguaacagcaccuccacgugggugaccuacgggaccugcaccaccacaggugagcaccgccgggagaagagaagcguugcccugguaccccacguggggaugggccucgagacgcggacugagacuuggaugucgagcgagggggccuggaaacaugcacaacgcaucgagacuuggauuuugcggcacccgggcuucacgauuauggccgcgaucuuagccuacacgaucgggacgacucacuuucagcgcguccucauauucauacugcugacggccgucgcucccuccaugaccaugcggugcaucggcaucucgaaccgcgacuucguggaaggcgucagcgggggcaguuggguggacaucgugcucgaacauggcagcugcgucacaacaauggcuaagaacaagccuacucuggacuucgagcucaucaagaccgaggccaagcagcccgccacccuccggaaguacugcaucgaggccaaacuuacuaacacuacgaccgagagccggugucccacccagggcgagcccucacugaaggaggaacaggacaagagauucgugugcaagcacuccaugguggaccgcggaugggggaauggcuguggucucuucggcaagggugggauaguaaccugcgccauguucacauguaagaaaaacauggagggcaagaucgugcaacccgagaaccuggaguacacgaucguggucacgccccacuccggggaggaacacgccgugggaaacgacacagggaagcacggacaggagaucaaggugaccccgcagucauccaucacggaggcugagcugacgggguaugggacagucacgauggaguguucgccccgaaccggccucgacuucaacgagaugguccuacuucagauggaaaacaaggccuggcucgugcaccggcagugguuccuggaccugccccuccccuggcugcccggggccgacaagcaggagucuaacuggauccagaaagagacccuggucacauucaagaauccccacgccaagaagcaggacguggucgugcucggcucccaggagggugcgaugcacacggcgcugacuggagccaccgagauacagaugagcuccgguaauuuacuguucacaggccacuugaagugccggcugcgcauggauaaguuacaacugaagggcaugucguacaguaugugcacgggcaaguucaaggucgucaaggagaucgcagagacccagcauggcacgaucgugauccgcguccaauacgaaggggauggcagccccugcaaaauaccauucgagaucauggacuuggagaagcgcuacguccucggaagacucaucaccgugaacccgaucgugacugagaaagauucccccgucaacaucgaggcagagccgcccuuuggggacagcuacauaaucaucggcguggagccggggcagcucaagcugaauugguucaaaaagggcuccagcaucggccagauguucgagacgaccaugcgcggcgcgaagcgcauggccauccugggcgacaccgccugggacuuugggucccuuggggguguguucacguccaucggcaaagcccuccaccagguauucggggccaucuacggggcggcguucagcggcguuagcuggacuaugaagauccugaucggggugaucaucacuuggaucggcaugaacuccaggaguaccucccugagcgucagccuagugcucguggggauagucacguuguaccugggugugauggugcaggccgacucugggugugucgugucuuggaaaaacaaggaacucaaaugcggcagcggcaucuucaucaccgacaacgugcauaccuggacagagcaguacaaguuccagcccgagagcccuuccaaacuugccucagcgauucagaaggcccaggaggaagguaucugcgggauccgcuccguaacgcgcuuagagaacuugauguggaagcagaucacccccgagcugaaccacaucuuagccgagaacgaggugaagcucaccaucaugaccggggacaucaagggcaucaugcaagccgguaagcgcagccugcggccgcagccaacggagcugaaguacucauggcggaccuggggcaaagcgaagaugcucagcacagaguccuacaaccagacauuccugaucgacggacccgaaacggcggaguguccgaacaccaaccgggcguggaauagccuugagguggaggacuacggguucggcgucuucaccaccaacauauggcucaaacuaaaggagaagcaggacgccuucugcgacuccaaacugaugagcgcugcgaucaaggauaaccgcgcggugcacgcagacaugggguacuggauagagucagcccucaaugacacguggaaaaucgagaaagccagcuucauagaggugaagaacugucauuggccaaagucacauaccuuauggucaaacggcguccuggagucagaaaugaucaucccaaagaaccuugcuggccccgugagccagcacaacuaucggccagguuaccacacccagauugcgggccccuggcaccuggggaagcuggagauggacuucgacuucugcgacggaacaacggugaucguuacggaggacugcgggaaccgcggucccuccuuacggaccacgaccgccagcggaaaauuaaucacggaauggugcugcaggagcugcacguugcccccgcuccguuaccgcggggaagacggcuguugguacggaauggagauccggccccugaaggagaaagaggagaaccuggucaacagccucgugaccgccggccacgggcaggucgacaacuucagccugggcgugcugggcauggccuuguuccuggaggagaugcugcgaacccggguggggacgaagcacgcgauccuccuggucgccguguccuucgugacccugaucacaggcaacaugagcuucaaggaccuagggcgcgucguaguaauggucggcgcaacuauggccgaugauauaggcaugggagugacauaccuggcccuauuggcggccuucaaagugcggcccaccuucgcugccggucugcugcuccgaaaacugacauccaaggagcugaugaugaccacuaucggaaucgugcuccugagccagucaaccauccccgagaccguucuggaguugacugacgcccuggcgcugggcaugauggugcucaagaucguccgcaacauggagaaguaccaacuggcagugacuauaauggccauccugugcguuccgaacgcugugauacuacagaacgcuuggaaagugagcuguaccauccuggcggucguauccgucagccccuuacucuugaccuccucacagcagaagaccgacuggauuccucuggcccucacaauaaaggggcugaaccccacggcuaucuuccugaccacacucuccagaacgaauaagaagcguucguggccgcugaaugaagccaucauggcggugggcaugguguccauccuggccagcuccuuacugaagaacgacauccccaugaccggcccccugguggcagggggccuccuaaccgucugcuaugugcucaccggacggagcgccgaucucgagcuggaacgcgcgacugacgugaagugggaggaccaggccgagaucuccggcuccagccccauccuguccaucaccaucagcgaggauggaaguaugagcaucaagaaugaggaggaggagcaaacgcucacaauccugauccgcacuggccuucuagucauauccggccuguuccccauaagcaucccuaucacagcagcagccugguaccugugggaggucaagaagcagagagcgggggugcuuugggacgucccgagcccgccgcccaugggcaaggcggagcuggaggacggggccuaccggauuaagcaaaagggcaucuuaggauacagccagaucggcgcuggcguguacaaagaggggacguuucacacuauguggcacgugacccgcggcgccguccucaugcacaaggggaagcggaucgagcccucaugggcggacguuaagaaggacuugaucagcuacggcgggggcuggaagcuagaaggcgaguggaaagagggggaggaggugcaaguccucgcgcuggagcccggcaaaaauccacgcgccguucagacgaaaccaggucuguuuaagacgaacacgggcacgaucggggccgugucccucgauuucagccccgggaccuccggcagucccauuauagacaaaaaggggaaggucgugggucuguacggaaacgguguagucacccgguccggcgccuacgugagcgccaucgcgcagaccgagaaguccaucgaggauaaucccgagauagaggaugacaucuuccgcaagaagcggcugaccaucauggaccugcaucccggagcagguaagacaaagcgcuaccucccugccaucgugcgggaggccauaaagcgagggcuccggaccuugauucucgcgccuacucgugucguggcagccgaaauggaggaggcccugagaggccugcccauccgcuaccagacccccgccaucagggcggagcacacggggcgcgagauaguggaucucaugugucacgcuaccuuuacaaugcgacugcugagccccguucgggugccaaauuacaacuugaucaucauggacgaggcccacuucaccgaccccgccucaaucgccgcgagaggcuacauaaguacgcggguugaaaugggcgaagccgcggggaucuuuaugaccgcuacuccgcccggcagccgagaccccuucccccaguccaacgcccccauaaucgacgaggagcgggagauacccgagcgcaguuggaacuccgggcacgaguggguuaccgacuuuaagggcaagacugugugguucgugccgagcaucaaggcugggaacgacauagccgccugcuugaggaaaaacggcaagaaggucauccagcugucccggaagacauuugacagcgaauacguaaagacgcggaccaacgacugggacuucguggucacgaccgacaucuccgagaugggcgccaauuucaaggccgagcgcgugaucgauccccggcgcugcaugaagccggugauccuuaccgacggggaagaacgggucauccuggccggcccgaugccggugacccacagcucugcugcccagcgccgcgggcgcaucggccggaaccccaagaacgaaaacgaucaguauaucuauaugggcgagccgcuggagaacgacgaagauugugcucacuggaaggaggccaagaugcucuuagacaacaucaacacgccggagggcaucauaccgagcauguucgagcccgaacgcgagaagguugacgccaucgacggugaguaccgguugcgaggggaggcccgcaagaccuucgucgaccucaugcggcgcggcgaccugcccgugugguuagcguacaaggucgccgcggaggggauuaauuacgccgaccggcgcuggugcuucgacggcaucaagaacaaccagauuuuggaggaaaacguggagguggaaaucuggacgaaggaaggugagcggaagaagcugaagccgcgcuggcuugacgcccggaucuacuccgacccccucgcgcugaaggaguucaaggaguucgcugcuggcagaaagagccugacgcuuaaccuaauuacggagaugggucgucugccgaccuucaugacgcagaaaacccgcgacgcccucgauaaccuggcgguccugcacaccgcugaggccggcgggcgggccuacaaccacgcacucuccgagcugccugagacccucgagacacuccugcugcucgcacugcuggccaccgugaccggaggcaucuucuuguucuuaaugagcggccgugggaucggcaagaugacgcuggggaugugcugcauaaucaccgcguccauccuccugugguacgcccagauucagccgcacuggaucgccgcaagcauaaucuuagaauuuuuccucauaguacugcugauuccugagccugagaagcagcgcacgccucaggacaaccaguugaccuacgucgugaucgcgaucuugacuguaguugcggccaccauggccaacgagaugggguuccuggagaaaaccaagaaggaccuugggcugggcuccaucgccacccagcagccagagagcaacauccucgacauugaucuccgccccgccuccgcguggacgcuguacgccguggccaccacguucgucacccccaugcugcgccacagcaucgagaacagcuccgugaacgugagccucacggccaucgccaaccaggcuaccguguuaaugggccucgggaagggcuggccccucuccaagauggacaucggggucccgcuacuagccauagguugcuacagccaggugaaccccaucacccucacugccgcccugcugcuccugguagcucacuacgccauaauagggccuggccugcaggcaaaagccacgcgcgaggcccagaagcgggcggccgccggcaucaugaagaaccccaccgucgauggcaucaccgugaucgaucuugacccgauccccuacgacccuaaauucgagaagcaacugggccaggugaugcuucuaauuuugugcgucacccaggugcuaaugaugcgcacaaccugggcauuaugcgaggcccugacauuagcgaccgggcccaucuccacguuaugggaggguaaucccgggcguuuuuggaacaccaccaucgcugucagcauggccaacaucuuucgaggaucuuaucuggccggcgccgggcuccucuucagcaucaugaagaacaccacgaauacccggcgcggcacagggaacaugggugagacccugggcgagaaguggaaauccaggcuuaacgcgcucgggaaguccgaguuccagauauacaagaagucgggcauccaggagguugaccggacgcuggccaaagaagggaucaagcgcggugagaccgaccaucacgccgugagccgggggucagcgaagcugcgcugguucguggagcggaacauggucacaccugagggcaagguggucgaccucggcugcgggagaggaggguggagcuacuacuguggcggauugaagaacguccgggaggugaagggccugacgaagggagggcccggacacgaggaaccuauuccgauguccaccuacggauggaaccucgugcgccugcagagcggcgucgacguuuucuucauaccaccagagaagugcgacacacugcucugcgacaucggggagagcuccccuaauccgaccgucgaggcuggcagaaccuugcgcguccugaaccucguggagaacuggcuaaacaacaacacacaauucugcauaaagguccuuaacccuuacaugcccucagucaucgaaaagauggaggcccuacagcggaaguacggcggggcccucgugcgaaacccguuauccgggaaucugaaaaacgagauguauuggguaagcaaugccuccgggaacaucgucagcuccgucaacaugaucucccggaugcucauaaaccgguucaccaugcggcacaagaaggccacauacgaacccgacguagaccucggcucugggacccgcaauaucggcaucgagagugaaacucccaaccuggacaucauaggcaagcguaucgaaaagaucaagcaggaacacgagacauccuggcacuacgaccaagaccaccccuacaagaccugggcuuaccacgggagcuacgagacgaagcaaaccggcuccgccagcucuauggucaacgggguggugcgacugcugacaaagccgugggacguccuuccuaccgugacccagauggcgaugacugacacgacccccuucggccagcagcggguuuucaaggagaagguagacacccgcacgcaggagcccaaggagggcacgaagaagcucaugaagauaaccgccgaguggcuguggaaggagcuuggaaagaagaaaacaccgcgcaugugcacccgggaggaguucacccgcaaaguucggagcaaugccgcuuuaggcgccauuuucacugacgagaacaaguggaaguccgcccgugaagccgucgaggacagccgguucugggaacugguagauaaggagcgcaaccugcaccuggaaggcaagugcgagaccugcguauacaacaugaugggcaagcgggagaagaagcugggagaguucgggaaggccaagggaucucgcgcgaucugguacauguggcugggggcccgguuccucgaguucgaggcccugggcuuccugaacgaagaccacugguuuucccgugagaacucacucagcggagucgagggcgagggacugcacaagcugggcuacauucuccgggacguguccaagaaggaaggcggggccauguacgcugacgacaccgccggcugggauacgcgaaucacccuggaggaccugaagaacgaggagauggugacgaaccacauggagggggagcauaaaaagcucgccgaggccauauucaaacuuacauaccagaacaagguagugcggguucagcgccccacgccccggggcaccgucauggauaucaucagccgcagggaucagaggggcagcggccagguuggcacuuacgggcugaacacuuucacgaacauggaggcccagcucauucgacaaauggagggcgagggaguguucaagaacauccaacaucugaccgucaccgaggagguggcgguacagaacuggcuggcacgcgucggcagagagcguuuguccaggauggccaucuccggcgacgacugcguggugaagccccuggacgaccguuuugccaacgcgcugaccgcgcucaaugacauggggaagauccgcaaagacauccagcagugggagcccuccaaggguuggaacgacuggacgcagguucccuucugcagucaccacuuccaugagcugaucaugaaggaugggcgagugcugguggucccaugccgcaaccaggacgagcucaucggccgggcucgaaucucccagggggccggauggagccuccgggagaccgcgugccugggaaagucguacgcccagauguggagccuaauguacuuccaccgcagggaccugcgguugguggcgaacgccaucugcuccgccgugcccagccacuggguccccaccucgcggacuacguggucgauccacgccaaacacgaguggaugacuaccgaggacaugcucaccguguggaaccgcguguggauccgggagaaccccuggauggaggacaagacccccgucgaguccugggaggagauccccuacuuagggaagagagaggaccaguggugcggcagccugaucgggcucacgucgcgggcgaccugggcgaagaacauccaggcggccaucaaccaggugcgcagccuuaucggcaacgaggaauacacugacuauaugccguccaugaaacgguuucgcagagaagaggaagaagccggggugcugugguga

SEQ ID NO: 25348 - RNA, 9876 nt, Artificial Sequence
  derived and/or modified CDS sequence (opt11) from DENV-2__FJ410224__SS-prME
ucugcggggaugaucauaaugcuaauccccaccgugauggccuuccaccuaaccacucgcaacggagagccccacaugaucguuggcauucaagagaaggggaagucccugcuguuuaagaccgaggacggcgugaacauguguacccugauggcgauggaucugggggagcuaugcgaagacaccgugaccuacaagugcccccugcuacggcagaacgagcccgaggacaucgauugcugguguaacucgaccuccaccuggguaaccuacgggaccugcacuacgacgggggagcaccgccgggagaaacgcagcgucgcucuugugccccacgucggaaugggccucgagacccggaccgagaccuggaugucgucagagggggccuggaaacaugcccagcgcaucgagaccuggauccugcggcacccgggcuucacgaucauggcggcgauccuggccuacaccauuggaaccacccacuuccagcgugugcucaucuuuaucuuacucacggccguggcccccucuaugacaaugcggugcaucggcaucagcaaccgcgauuucgucgaaggcgugagcggagggagcuggguggacauuguucucgagcacggguccugugugacaacuauggcgaagaacaagcccacgcuggacuucgagcuuaucaaaaccgaggccaagcagcccgccacccuccggaaguacugcaucgaggcuaagcugaccaauacgaccaccgaaagccgcugccccacccaaggagagcccucccugaaagaggagcaggacaagcgguucgucugcaagcacucuaugguggaucgcggcugggggaacgggugcggccuguucggcaagggcgggaucgugacuugcgccauguucacguguaagaagaacauggaaggcaagauugugcagcccgaaaaccuggaauacaccaucguuguuacuccccacuccggggaagaacaugccguggggaaugacacggggaagcacggcaaagaaaucaaagucaccccucagagcucgauuaccgaagccgagcugaccgguuacggcaccgugacgauggaguguagccccaggaccggccucgauuucaacgaaaugguccugcugcagauggagaacaaggcuugguuaguccaccgccagugguuccuggaccugccacuucccugguuaccgggggcggauaagcaggaguccaacuggauccaaaaggagacccuggugaccuucaagaauccacacgccaagaagcaggacguggucguacucgggagccaggagggggcgaugcacacugcucugaccggcgccacugagauccagaugagcucggggaaccuccuguucaccggucacuugaagugccggcugcgcauggauaagcuccaacuaaagggcaugagcuacuccaugugcacggggaaguucaaggucgucaaggagaucgccgaaacccagcacggcacgauagugaucaggguccaguacgagggcgacggcagccccugcaagauucccuucgagaucauggaccuggagaagcgcuacgugcucggcaggcucaucaccgugaacccgaucgucacggagaaagacucccccgugaacauagaggccgagccgcccuucggugacagcuacaucaucauuggcgucgagccggggcaacuuaaguugaauugguucaaaaaggguuccagcaucggucagauguuugaaaccaccaugagaggugcgaaacgcauggccauccugggcgacaccgccugggacuuugggucccugggaggggucuucacgagcaucggaaaggcccuccaccagguguucggagccaucuacggcgcggccuuuuccgguguuagcuggaccaugaagaucuugaucggcgucauuaucaccuggauugguaugaacagucgaucuaccucccugaguguaucccuugugcucgucgggacugugacccuauaccugggcgugaugguccaggccgacagcgggugcguggugucuuggaaguccaaggagcuuaagugcggcuccgggaucuuuauuaccgacaacguccacaccuggacggaacaguauaaguuucaaccagagucuccgagcaagcuagccuccgccauccagaaggcccaggaggaggggaucugcggcauccgcuccgugaccagacuggaaaaccucauguggaagcagaucaccccagaacugaaccacauccuugcggagaacgagguuaagcucacaauaaugacgggagacaucaagggcaucaugcaggcaggcaagcgcucccugcgaccgcagcccaccgagcugaaguacagcuggaagaccuggggcaaggccaagaugcucuccaccgagagcuacaaucagacguuccugaucgacggccccgagaccgcggagugcccaaacaccaaccgcgccuggaacucccuggaaguugaagacuacggcuucggcguguucaccacgaacaucuggcucaaauugaaggagaagcaggaugccuucugcgacagcaagcugaugagugccgccauuaaggacaaccgagcggugcacgccgacaugggcuacuggaucgagagcgcccucaacgauacuuggaagaucgaaaaggccucguucauagaggucaagaacugccauuggccaaagagccauacgcucugguccaacggcgugcuggagagcgagaugaucaucccuaagaaucuugccggcccgguuucacagcacaacuaccgcccgggguaccauacccaaaucgcaggucccuggcaucuggggaagcuggagauggauuuugacuucugugacggcaccacgguaauugucacugaggacugcgggaaccgggguccgagccucagaacgacaacagcuagcggcaaguugaucacagaguggugcugccggagcugcacccugccgccccuccgcuaccgcggggaggacgggugcugguaugggauggaaauacgaccccugaaagaaaaagaggagaaccuggugaacagccuggucacggccggccacggccagguggacaauuucucccuuggggugcugggcauggcccucuuccuggaggagaugcugcguacacgugucgggaccaagcacgcuauccuccuaguggccgucagcuucguuacccugaucaccgguaacauguccuucaaggacuugggucggguggugguaauggugggcgccacgauggccgacgacaucgggaugggcgugaccuaccuggcacugcucgcggcauucaagguccgcccaaccuucgccgccggccugcugcuccggaagcugaccagcaaggaacuaaugaugacgacaaucgggaucgugcuccuuucccagagcaccauccccgaaaccgugcuggaacuaacagacgcccuggcuuugggcaugaugguccucaagaucgugcgcaacauggaaaaguaccaguuagccgucaccaucauggccaucuugugcgugccgaaugccgugauccuccagaacgccuggaaggucuccugcaccauccuggcggucguguccgucagcccccugcugcugacaucgucccagcagaagacggauuggauccccuuggcgcuuaccaucaaggggcuaaaucccaccgcaaucuuccugaccacgcucagccgcaccaacaagaagcgguccuggccgcugaacgaagccaucauggcggugggcaugguuuccauccucgccuccagccuccugaagaaugacaucccgaugaccggcccccuggucgcagggggccuccugaccgugugcuacgugcugacggggagguccgccgauuuggaacuggaacgggccaccgaugugaaaugggaagaccaggcggagauaucaggcagcucccccauccuauccauuacuaucuccgaggacgggucuaugucgaucaaaaacgaggaggaagaacagacccucaccauacugauucgcaccggccuauuaguaaucagcggucuguucccgaucucuauucccaucaccgccgccgcaugguaccugugggaggugaagaagcagagggccgggguccucugggacguccccagcccaccacccaugggcaaggcggaacuugaggacggagccuacaggauaaagcagaaggggauccugggauacucccagaucggggccgggguguacaaagaggggaccuuccacaccauguggcaugucacgcggggcgccgugcuuaugcacaaggguaagcgcaucgaacccagcugggccgaugucaagaaggaccugauauccuacgggggaggcuggaagcucgagggugaguggaaggagggugaggaaguccaggugcucgcguuagagccagguaagaacccccgggccgugcaaaccaagcccgggcuguuuaagaccaacaccggcacaaucggggcagucucacuggacuucucccccggcaccaguggcagccccaucaucgacaagaaagggaaggugguaggccuguacgggaacggcgucgugacacggagcggugccuacguuagugccaucgcgcaaaccgagaaguccaucgaagauaaccccgagauagaagacgacaucuuccguaagcgccggcugacgauuauggaucugcaccccggggccgggaagaccaagcgcuaccucccggcaaucguccgggaggccaucaagcgaggauugcggacccuaauacuagccccgacccgcguuguggccgccgagauggaggaggcccugcggggucuaccgauucgcuaccaaacccccgccauccgggcagagcacaccgggcgcgagauuguugaccuuaugugccacgccacguucaccaugcgccugcuaagcccagugcgggucccuaacuacaaccucaucaucauggacgaggcccacuucacggaucccgcuuccauugcugcgcgcggcuacaucuccacgcgggucgagaugggcgaggccgccgggauuuucaugaccgccacgccgccgggcucccgcgaccccuucccccagagcaacgcccccaucauagacgaggagcgagaaauucccgagagauccuggaacagcgggcacgaaugggugacggacuucaagggcaagacagugugguucgucccguccauaaaggcggguaacgacaucgccgccugccugcggaagaacggcaagaagguuauccagcuaagccgcaagaccuucgauuccgaguacgucaagacccggacgaacgacugggacuuugucgucaccaccgacaucagcgagaugggugccaacuuuaaagcggaacgcgugaucgacccccggagaugcaugaagcccgucauacuaaccgacggggaagaacggguaauccuggccggccccaugccggugacgcacucaucagcggcccagcgccggggccgcaucgggcggaaccccaagaacgaaaacgaccaguacaucuacaugggagagccgcuggagaacgacgaagacugcgcccacuggaaggaggccaagaugcuccuggauaacaucaacacaccagagggcaucaucccguccauguucgagcccgagcgugagaaggucgacgcgaucgacggugaguaccggcugcgcggggaagcgcgcaagacauucguggaccuuaugcggcgcggagaccugccgguguggcuggccuacaaggucgccgcggaagguaucaacuaugccgaccggcgcuggugcuuugacggcauuaagaacaaccaaauucucgaggagaacguagagguugagaucuggaccaaagagggggaaaggaagaaacuuaagccgcguuggcuggaugcccgcaucuacagcgauccccucgcccugaaggaguucaaggaguuugccgcuggccgcaagucccugacacucaacuugaucacagagaugggccggcugcccaccuucaugacucagaagacacgcgacgccuuagacaaccuggccgugcugcacaccgcugaggccggcgggcgagccuacaaccacgcccucagcgagcugccugagacacuggaaacacuccugcuucucacacugcuggcgacgguuacagggggcaucuuccucuuccugauguccggccgcgggaucggcaaaaugacccuggguaugugcugcaucauuacggccucaauccuauugugguacgcgcagauccagccgcacuggaucgccgccucgaucauacuugaguucuuccucaucguccuccugauccccgagccggagaagcagcggacgccccaggacaaucagcucaccuacguggugaucgccaucuugaccguaguggccgcgacaauggccaacgagauggguuuccuggagaagacgaagaaagaccucgggcuuggcagcaucgccacacagcagccggaguccaacauucuggacaucgaccuccguccggccagcgcguggacccuguacgcggucgcgacgacguucguuaccccuaugcugagacacagcaucgagaacuccucugugaacgucagucucacggccaucgccaaccaggccacggugcugaugggccuggggaagggguggccacucagcaagauggacaucgggguaccccuguuagcgaucgggugcuacucccaggugaaccccaucacgcucaccgccgcccugcugcuccuggucgcccacuacgcaaucaucgggcccggucugcaggccaaggcaacccgcgaggcccagaagagagccgcggcaggcaucaugaagaacccaaccguggaugggauuacgguuaucgaccucgacccgauucccuacgaccccaaguucgaaaagcagcucggccaggucaugcuacucauucucugcgugacccaggugcugaugaugcgcaccacgugggcccuuugcgaggccuugacgcucgccaccgggcccaucucgacccucugggagggaaauccggggcgguucuggaacaccacgauugcagucucaauggccaauauauuccgggggaguuaccucgccggcgcagggcuccucuucuccaucaugaagaacaccacaaacacccgccggggcaccgguaacaucggagagaccuugggcgaaaaguggaagucccgccugaacgcacucgggaaguccgaguuccagaccuacaagaagucaggcauccaggagguggaccggacccuggcgaaggaagggaucaagcgaggcgaaacggaccaccacgccgugucccgggggagcgccaagcugcgcugguucgucgagcggaacauggucacucccgagggcaagguggucgaucucggcugcgggcgcggcgggugguccuacuacuguggcgggcugaagaacgugcgcgaggugaaaggccugaccaagggcgggccaggccacgaggagcccaucccgaugucgaccuacggguggaaccucguacgccugcagucgggaguggauguguucuucaucccgccagagaagugcgacacgcugcucugcgacaucggggagagcucccccaacccgacggucgaggcaggccggacccugcgcguacuuaaccucguggaaaacuggcugaacaacaacacccaguucugcaucaaaguacugaauccuuacaugcccagcgugauagagaagauggaggcgcugcagcggaaauauggcggggcccucguccgcaacccccuuuccagaaauuccacucacgagauguauugggucagcaacgccucgggcaauaucgugagcagcgugaacaugaucagcaggaugcugaucaaccgguucaccaugcgucauaaaaaggccaccuacgagccggacgucgacuuaggauccggaacgcgcaacauuggaauugaaagugagauccccaaccuggacaucauuggcaagcguauugagaaaaucaagcaggaacaugagaccuccuggcacuacgaccaggaccacccguacaagacgugggcuuaucacggcagcuaugaaaccaagcaaaccgguuccgccagcuccauggucaacggcgugguccggcugcuuacaaagccgugggacgugcuccccacggugacccagauggcuaugaccgauaccacgcccuucgggcagcagcgcguuuucaaggagaagguggacacccgaacccaggagcccaaggagggcacaaagaaauuaaugaagaucacggccgaguggcucuggaaagaacugggcaagaagaagacaccccguaugugcacccgcgaggaguucacccguaaagugcgcagcaacgccgcccugggggcaauauuuacggaugaaaacaaguggaaguccgcccgggaggccgucgaggacagccgcuucugggagcucguggacaaggagcggaaccugcacuuggaaggcaagugcgagaccugcgucuacaacaugauggggaagcgcgagaagaagcucggugaguucgggaaggcaaaggguagccgggcuauaugguacauguggcugggcgcgcguuuccuggaguucgaggcccucggguucuugaacgaggaccacugguucagccgggagaacagccugagcggcguggagggggaaggccuccacaaacuaggguacauccucagagacgugagcaagaaagagggcggggcgauguacgccgacgacaccgcggggugggacacgcggaucacgcuugaagaccugaagaacgaggagaugguaaccaaccacauggagggggagcacaagaagcuggccgaggccauauucaagcucacguaucagaacaagguggugcgcguacaacggcccacuccccgggggacggugauggauaucauuucccgaagagaccagcgcggaucgggccagguggguaccuacggccugaacacuuucaccaacauggaggcccagcugauccgccagauggagggggagggcgucuuuaagaacauacagcaccuaaccguaaccgaggagguggccguccaaaacuggcuggcgcggguggggcgagaacgccugagccggauggccauuagcggcgaugacuguguggucaagccgcucgacgaucgcuuugccaacgccuuaacagcccugaacgacaugggcaagauccggaaggacauccaacagugggaaccgucgaaggguuggaacgacuggacccaggugccuuuuugcagccaccacuuccacgagcucauaaugaaggacggccgugugcugguugugcccugccguaaccaagacgagcugauugggcgcgcgcgaauaucccagggcgccggguggagccuccgcgagacggccugccugggcaaguccuacgcccagauguggagcuugauguacuuccaccggcgcgaucuccgucuugccgcgaacgccaucugcucggccgugccaucccacugggucccgaccucccgcacaaccuggagcauucacgccaagcacgaguggaugacaacggaggacaugcugaccguguggaaccggguguggaucagggagaaccccuggauggaggacaagacccccgucgaauccugggaggagauccccuaccucggcaagcgagaggaccaguggugcgggagccugaucggacugacuucccgugccacgugggccaagaacauccaggccgccaucaaccaggugcggagccucaucgggaaugaagaguacaccgauuacaugccgagcaugaagagauuccggcgcgaggaggaggaggccggggugcugugguag

SEQ ID NO: 25349 - RNA, 9876 nt, Artificial Sequence
  derived and/or modified CDS sequence (opt11) from DENV-2__FJ461321__SS-prME
agcgccgggaugaucaucaugcugaucccgaccgugauggccuuccaccuaaccacacggaacggggaaccccacaugaucgucgggauccaggaaaagggcaagagccugcuguucaagaccgaagacggggugaauaugugcacccucauggcgauggaccugggggagcucugcgaggacaccauaaccuauaagugcccccuccugcggcaaaacgagcccgaggacaucgacugcuggugcaacucaaccuccaccugggugaccuacgggacaugcaccacgaccggggagcaccgccgagagaagaggagcguagcccucgugccccacguaggcaugggccucgagacccgaaccgagaccuggaugucgagcgagggggccuggaagcacgcacagcgcaucgagaccuggauccugcggcacccgggcuucacgaucauggccgcgauccuggccuacacuaucgggaccacccacuuccagcgcguccuaauauucauccugcugacugcgguggcucccuccaugaccaugcggugcauaggcaucagcaaccgcgacuucguggagggcgucuccgggggcagcuggguggacaucguacuugagcacgggucuugcgucaccaccauggcaaagaacaagcccacgcuggacuuugagcugaucaagaccgaggccaagcagcccgccacccuccgcaaguacugcaucgaagcgaaacuuacaaacacgaccaccgagagccgcugccccacccagggcgagcccagccugaaggaggagcaggacaagcgguucgugugcaagcacagcaugguggacaggggcugggggaacgggugcggccuguucgggaagggcgggaucgucacgugcgccauguucacgugcaagaagaacauggagggcaagaucgugcagcccgagaaccuggaguauaccauaguggucacgccccacuccggcgaggagcacagcgugggcaacgacacggggaagcacggcauggagaucaaggugaccccucagucgucgauuaccgaggccgagcuaacaggguacggcacggucacgauggagugcucuccccggaccggccucgacuucaaugaaauggugcugcugcaaauggagaacaaggcguggcucgugcaccgccagugguucuuagaccuacccuugccguggcugccgggggccgacaagcaggagucuaauuggauccagaaggagaccuuggucacauuuaagaacccccacgccaagaagcaggacgugguaguacuuggcucgcaggagggcgcuaugcauacagcauugaccggcgccaccgagauccagaugucaagcgggaaccuccuguucaccggucaccugaagugccggcugcgaauggacaagcuccagcuuaagggcauguccuacagcaugugcacggggaaguucaagguggucaaggagaucgccgagacccagcacggcaccauugugauccgggugcaguacgagggggaugguucccccugcaagauccccuucgagaucauggaccuggagaaacgcuaugucuuaggucggcugauuaccgugaauccgaucgugaccgagaaggacucgcccgucaacaucgaggccgagccucccuucggggauuccuacaucaucaucggcguggagcccgggcagcugaaacuuaacugguucaagaagggcagcagcauagggcagauguucgagaccaccaugcgcggcgccaagagaauggcuaucuugggcgauacggccugggacuucgggagcuugggcgggguuuucacauccaucggcaaggcccuccaccagguuuuuggggccaucuacggcgccgcguuuagcgguguguccuggaccaugaaaauccugaucgggguuaucaucaccuggaucggcaugaacagccgguccaccagcuuaucagucagccucgugcucguugggauagucacacuguaucugggcgugaugguacaggccgacuccggcugcgucgugagcuggaagaacaaggaguuaaagugcggcucgggcaucuucaucaccgacaacgugcacaccuggaccgaacaguacaaguuccagcccgaaucccccagcaagcuggccuccgccauccagaaggcgcaggaggaggggauaugcggcauccguagcguaacacggcuggagaaccucauguggaagcaaaucacccccgagcugaaccacauccuggccgaaaacgaggugaaguugaccaucaugaccggggacauccgcggcaucaugcaggccgguaagcggucccugcgcccgcagcccacggaguuaaaguacagcuggaagaccugggggaaggccaagaugcucucaaccgagagcuacaaccagaccuuccugauugacgggcccgagacggcggagugcccgaacacgaaccgggcguggaacucccuggagguggaggacuacggguucggcguguucaccaccaauaucuggcucaagcugaaggaaaagcaggacgccuucugcgacagcaaguuaauguccgcagccaucaaggacaaccgcgccgugcacgcggacauggguuacuggaucgagagcgcccucaacgacacguggaaaaucgaaaaggccuccuucaucgaggucaagaacugccacuggccaaagagucacacccugugguccaacggcguccuggagagcgagaugaucauccccaagaaccucgccggucccgugucccaacacaacuaccggccgggguaucacacccaaaucgccggaccauggcaccucgggaagcuggagauggacuucgauuucugcgacggcacaaccgugaucgucacggaggacugcgggaaccgcggccccagccuccggaccaccaccgcgagcggcaagcuaaucacugaguggugcugccgcuccugcacccugcccccgcuccgguaccgcggggaggauggcugcugguacgggauggagauccggccccugaaggagaaggaggagaacuuaguuaacagccucgugaccgccggccacgggcaagucgacaacuucucccugggcgugcugggcauggcccucuuccuggaggagaugcugcgcacgcggguggggacgaagcacgccauccuccuggucgcagugagcuucgugacucugaucaccggcaacaugaguuucaaggacuuggggcgcgucguggugaugguaggcgccaccauggccgacgacaucgggaugggcgugacguaccuugcccugcucgccgcguucaaagugcggcccaccuucgccgcaggucuguuguuacgcaagcugaccagcaaggagcuaaugaugaccacgaucgggauaguccuccugucccagagcaccauccccgagaccgugcuggagcucaccgacgcccuggcccugggcaugaugguuuuaaagaucguccgcaacauggagaaguaccagcuggcagugacuauuauggccauccugugcgucccaaacgcagugauccuccagaacgccuggaagguguccugcaccauccuagccgucgugagcgugaguccccuguuacugacuagcucccagcagaagaccgacuggaucccccuggcgcuuacgaucaaaggguugaaccccaccgccaucuuucugaccacgcucucgcggacgaacaagaagaggucauggccgcugaacgaggccaucauggccgucggcauggugagcauccuggcguccucgcuccugaagaacgacauccccaugacaggaccccugguggccgggggccuccugaccgucugcuacgugcugaccgggagaagcgccgaccucgagcuggagcgcgccacgaacgugaagugggaagaccaggcagagaucagcggaucuucccccaucuugagcaucaccaucuccgaggacgggagcauguccaucaaaaacgaggaggaggagcagacccugaccauccugauccgcacgggccugcuggucaucagcggccuguucccaaucuccauccccaucaccgcugccgccugguacuuaugggaggugaagaagcagcgcgccggggugcucugggacguucccucaccgccgcccaugggcaaagccgaacuggaggacggggcguaucggaucaaacagaagggcauccugggguacucccagaucggcgccggcguguauaaggaggggaccuuccacaccauguggcacgugacccgcggcgccguccucaugcacaaggggaagcgaaucgagcccagcugggccgacgugaagaaggaccugauuucauacggaggaggguggaagcuggagggcgaauggaaggagggggaggaggugcagguccucgcccucgagcccggcaagaauccccgcgcggugcagacgaagcccggccuguucaagaccaacaccggcaccaucggggccgugucacucgacuucucccccggcacgagcggcucacccaucaucgacaagaaggggaagguugugggccuguacgggaacggcguagucacucggucgggggccuacgucucggccaucgcccagaccgagaaaucaaucgaggacaaccccgagaucgaggacgacaucuuccgcaagcggcgccugaccauuauggaccugcacccuggagcgggcaagacgaagcgguaccuccccgccaucgugcgcgaggccaucaaacggggccugcgcacacugauccucgccccgacccgggucguggcggccgagauggaggaggccuugcguggcuugccgauacgguaccagacacccgccauccgcgccgagcacacggggcgcgagaucguggaccuuaugugccacgcgaccuucaccaugcggcugcugucccccguccgcgugccgaacuacaaccucaucaucauggacgaggcccacuuuaccgaccccgccagcaucgccgcccggggcuacaucagcacgcgcgucgaaaugggcgaggcggccgggauauucaugacagccacgccacccggcucucgcgauccguucccacagagcaacgcacccaucaucgacgaggagcgcgagauccccgagcgguccuggaacagcgggcaugagugggucacagacuucaagggcaagacggugugguuugugccgucaaucaaggccgggaacgauaucgcagccugucuucgcaagaacggcaagaaggucauccagcucagccggaagaccuucgacuccgaguacgugaagacccguaccaacgacugggacuucguggugacgaccgacaucagcgagaugggcgccaauuucaaggccgagcgggugaucgacccccgccgaugcaugaaacccgugauccucaccgacggcgaggagcgcgucauccuggcgggccccaugccagugacccacuccagcgccgcccagcggcgcgggcggaucggccgcaaccccaagaaugagaacgaccaguacaucuacaugggggagccccucgaguccgacgaggauugcgcccacuggaaggaggccaagaugcuccuggauaacauaaacacgcccgaggguaucauccccagcauguucgagcccgaacgggagaagguggacgcgaucgacggugaguaccggcugcgcggggaggcccggaaaaccuucgucgaucucaugcgccggggcgaccugcccguguggcuggccuacaagguggcggcagaggggaucaacuacgcggaccgccguuggugcuucgacggcauuaagaacaaccagauccuugaggagaacgucgagguggagaucuggaccaaggaaggggagcgcaaaaagcugaaaccgcgguggcuggaugcccgcaucuacagcgacccccucgcccugaaggaguucaaggaguucgccgccggcagaaaaagccugacccucaacuugaucacugagaugggccgccugccuacauucaugacccaaaagacucgggacgcgcucgacaaccuggccgucuugcacacggccgaggccgguggccgagccuacaaccacgccuuauccgagcuccccgaaacccuggagacucucuugcugcucacccugcuggccacggugaccgguggcaucuuccucuuccugaugagcggccggggcauuggcaagaugacccuggggaugugcugcauaaucacagccuccauccuccugugguaugcccagauccagccacacuggaucgcggccucaaucauccuggaguucuuccuuaucgugcugcugauccccgagcccgagaagcagcgcacgccccaagauaaccagcucacguacguggugaucgccauccugaccguggucgccgccaccauggcgaacgagaugggcuuccuggaaaagacgaaaaaggacuuagggcugggcuccaucgccacacaacagccggaaagcaacauccuggauauagaccuccggcccgccagcgccuggacccuguacgccguggcgaccaccuuugugacgcccaugcugcgccacucuauugagaacagcucagucaacgugagccucaccgcgaucgccaaccaggccaccgugcugaugggccuggggaagggcuggccccucuccaagauggacaucggggucccgcugcuggccaucggcugcuacucucaggugaaccccaucacccuuacggcggccuuauuacuccucguggcccacuacgccaucaucgggcccggccugcaagcgaaggccacccgggaggcccagaaacgcgccgccgcgggcaucaugaagaauccgaccguagacgggaucaccgugaucgacuuagacccgauacccuacgaccccaaguucgagaagcagcugggacaggugauguugcucauccugugcgucacccagguucugaugaugaggaccacgugggcccucugcgaggcccugacccuggccacggggcccaucuccacccuuugggagggcaacccggggcgcuucuggaacaccaccaucgccguuagcauggcgaacauauucagaggguccuaccuggccggagcaggucuccucuucagcaucaugaagaacacgaccaauacccgccgcggcaccgggaacaucggcgagacgcugggugaaaaguggaagucccggcugaacgcccucggcaagagcgaguuccagaucuacaagaaguccggcauccaggaggucgaccgcacccuggccaaggaggggaucaagcggggcgagaccgaccaccacgcugugagccgcgggucugcuaagcugcggugguuuguggaacgcaauauggucacaccggagggcaaggugguggaccugggcugcgggcgugguggauggagcuacuacuguggcgggcugaagaacguccgcgaggugaagggccucacgaagggcgggcccggacacgaggagcccaucccaauguccaccuacggguggaaccuggugcgguuacagagcggcgucgacguguuuuucaucccgcccgagaagugugacacccugcucugugacaucggggaguccagccccaacccgaccguggaggccggccgcacgcugcgggugcugaaccucguggagaauuggcugaauaauaacacgcaguucugcauaaaggugcucaaccccuacaugcccuccgucauagagaagauggaggcccugcagcggaaguacggcggggcgcuugugcggaacccgcugucccgcaacagcacccaugagauguacuggguguccaacgccagcggcaacauugucuccagugugaacaugauuucgcggaugcugaucaaccgcuucaccaugcggcacaagaaggcgaccuacgagcccgacguggaccuggggucugguacccgcaacaucgggaucgaauccgaaauuccgaaccucgacaucauaggcaagcggaucgagaagauuaagcaggagcacgaaacuagcuggcacuaugaccaagaccaccccuauaagaccugggccuaucacggcuccuacgaaaccaaacagacggggucagccagcagcauggucaaugguguggugcgccugcucaccaagccgugggaugucuuacccaccgugacccagauggcgaugacggacaccacccccuucggucagcagcgcguguucaaggagaaggucgacacccgaacgcaagagcccaaggagggcaccaagaagcugaugaagaucaccgccgaguggcucuggaaggaguugggcaagaagaagaccccgagaaugugcacgcgggaggaguucacccgcaagguucgguccaaugccgcucugggggccauuuucaccgacgagaacaaguggaaaagcgcccgugaggccguugaggacucccguuuuugggagcuagucgacaaggagcgcaaccugcaccuggagggcaagugugagaccugcguguauaacaugauggggaagcgggaaaagaagcucggcgaguucgggaaggccaaaggaagccgcgccaucugguacauguggcugggcgcccgguucuuagaguucgaagcgcucggguuccugaacgaggaccacugguucucccgcgagaauagccugagcggcgucgagggggagggccuccacaagcugggguacauccugcgagacguguccaagaaggagggcggcgccauguacgccgacgauacggccgggugggacacuagaaucacccucgaggaccucaagaaugaggagauggugaccaaccacauggaaggcgagcacaagaagcuggcggaggccaucuucaagcuaacguaccagaacaagguggugcgggugcagaggccgacgccgcgggggaccguaauggauaucauuagccgccgggaccagcgcggcagcggccagguuggcaccuacggccugaacacguucaccaacauggaggcccagcugauccggcagauggagggggagggcguguucaagaacauccagcaccucaccgucacagaggaaguggccguacacaacuggcuggcccgcgucggccgcgagcggcugagccgcauggcgaucuccggugacgacugcguggucaaaccccucgacgaccgguucgcuaacgcccugaccgcgcugaacgacaugggcaagauccgcaaggacauucagcagugggagccgagcaagggguggaacgacuggacucaggucccuuucugcucccaccauuuccacgagcucaucaugaaggacggucgcauucugguggugcccugccgcaaccaagacgagcugaucggucgagcccgcaucucccagggggcgggguggucccuccgggagaccgccugccugggcaagagcuacgcccagauguggucccugauguacuuccaccgccgggaccuccgccuugcagccaacgcaaucugcagcgccguccccagucacugggugcccaccagccgcacgaccugguccauccacgccaagcaugaguggaugaccacagaggacaugcugaccguguggaauagagucuggauccgggaaaaccccuggauggaggauaagacgcccguggagucaugggaagagaucccguaccucggcaagcgcgaggaccaauggugcggaucgcugaucggccugacgagccgggccaccugggccaaaaacauccaggcggccauuaaccaggugcguagccugaucgggaacgaggaauacaccgacuacaugccgucgaugaagcgguuccgccgcgaggaggaggaagcaggcguccugugguga

SEQ ID NO: 25350 - RNA, 9876 nt, Artificial Sequence
  derived and/or modified CDS sequence (opt11) from DENV-2__FJ410228__SS-prME
agcgcggggaugauaaucaugcugaucccaaccgugauggccuuccaccucaccacccgcaauggggagccccacaugaucguagggauccaggagaaggguaagucccugcuguucaagaccgaggacggcguaaacaugugcacccucauggcgauggaccugggggagcugugcgaggacacgaucaccuacaagugcccccuccuccggcagaaugaacccgaggacaucgacuguuggugcaacagcaccuccaccuggguaaccuacgggaccugcaccaccaccggcgaacaccgucgggaaaagcgcucggucgcgcuggugccccacgucgggaugggcuuggagacucggacggagaccuggaugaguagcgagggggcguggaagcacgcucagcgcaucgaaaccuggauucugaggcacccuggguucacgaucauggcggcuaucuuggccuacacaaucgguacaacccacuuccagcgcguuuuaaucuucauauuacugacggccguggcgcccuccaugacuaugcggugcaucgguaucagcaaccgagacuucguggaaggcgucuccggcgggucguggguggacaucgugcucgagcauggguccugcgucaccacaauggcgaagaacaagcccacgcuagacuucgagcugaucaagaccgaggccaagcagcccgccacacuccggaaguauugcaucgaggccaagcugaccaacacgaccacggaguccaggugucccacccagggggagcccucccugaaggaggagcaggacaagcgguucgugugcaagcacagcaugguggaccgcggcugggggaacggcugcggccuguucggaaaaggagggaucgucacaugcgccauguuuaccugcaagaagaacauggagggcaagaucgugcagcccgagaaccuugaauacacgaucguggucacgccccacuccggagaggagcaugcggugggaaacgacacggggaagcacgggauggagaucaaggugacaccgcagagcuccaucacggaggccgaacugaccgguuacggcaccgucacgauggagugcagcccgcggaccggacucgacuucaacgagauggugcugcugcagauggaaaacaaggccuggcucgugcaccgccagugguuccuggaccugccccuccccuggcugccgggagccgauaagcaggaguccaauuggauccagaaggagacucuggugaccuuuaagaacccgcaugcaaagaagcaggacgugguggugcucggcagccaggaaggggcgaugcacacggcccugaccggcgccacagagauccagaugagcuccggaaaccuccuguucacgggccaccugaagugccggcugcgcauggacaagcuccagcucaagggcaugagcuacuccaugugcacugguaaguucaaggugguaaaggagauagccgagacccagcacggcaccauuguaauccgggugcaguacgagggggacggcagccccugcaagauccccuucgagaucauggacuuggagaagcgcuauguacugggccggcugauuaccgugaacccgaucgugacggagaaggacucucccgugaacaucgaagccgagccgccauucggggacagcuacaucaucauaggcguggagcccgggcaacugaaguuaaacugguucaagaagggcuccagcauagggcagauguuugaaaccaccaugcguggcgcgaagcgcauggcaauccuaggagacacggccugggacuucggaucccuuggcgggguguucacgucgaucggcaaggcccuccaccaaguguucggggccaucuauggcgcagccuucucuggcgugagcuggaccaugaagauccugauuggggugauaauuaccuggaucggcaugaacucccgguccaccuccuuaucuguuucccuggugcucguggggauugucacgcuguaccugggcgugauggugcaggccgauagcgggugugucguuuccuggaagaauaaagagcucaagugcggcagcggcaucuucaucaccgauaacgugcacaccuggaccgagcaguacaaauuccagccggagagccccuccaaguuagccagcgcgauccagaaagcgcaggaagaggggaucugcggcauccgcuccgucacacgucuugagaaccucauguggaagcagaucacccccgagcugaaccacauccuggcugagaacgaggucaagcucaccaucaugacaggagacauccgcgguaucaugcaagccgggaaacggagccugcgaccgcaacccacggaacugaaguacucuuggaagaccuggggcaaggccaagaugcucagcaccgaguccuacaaccagaccuucuuaaucgaugguccggagacggccgagugcccuaacaccaaccgggccuggaacagccuggagguagaagacuacggauucggcgucuucacgaccaacaucuggcucaagcugaaggaaaagcaggacgcguucugcgacuccaagcuaaugucagccgccaucaaggacaaccgcgcggugcacgccgacaugggguacuggauugaguccgcccucaacgacacguggaagaucgagaaggccagcuucaucgagguaaagaauugccacuggcccaagucccacacucuguggaguaacggcguccuggagagugagaugauaaucccaaagaacuuggccggccccguaagccagcauaauuaccggccgggguaucacacccagaucgcgggccccuggcaccuggggaagcuggagauggacuucgacuucugcgacgggaccaccgugaucgucacggaggacugcgggaaccgcggccccucccuccgaaccacaaccgccucaggcaagcugaucacggaguggugcugccgcagcugcacgcuaccaccgcuccgguaccgcggcgaggacggaugcugguacgggauggaaauccggccccugaaagaaaaagaggagaaccuggugaacucucuagugaccgccggccacgggcaggucgacaacuucagccugggcgugcugggcauggccuuauuccuggaggagauguugcgcacacggguggggacgaagcacgcgauccuccuggucgcaguguccuucgugacccugaucaccggcaacaugagcuucaaggaccucggccgcgucgugguuauggucggcgccaccauggcugacgacaucgggaugggcgugacuuaccuggcccugcucgcggccuucaagguucggcccaccuucgccgcaggccugcuucuucgcaagcugaccuccaaggagcugaugaugaccacgaucgggaucguccucuuaagccaguccacuauccccgagaccgugcuggagcucaccgacgcgcuggcgcugggcaugauggugcuaaagaucgucagaaacauggaaaaauaccagcuggcgguaacuauaauggccaucuugugcgucccgaacgccgugauacuucagaacgccuggaaaguuagcuguaccaucuuggcagucgugucggugucuccgcugcuccucaccuccagccaacaaaagaccgacuggaucccucucgcccuaaccaucaagggauugaaucccaccgccaucuuucuuaccacgcuuucccggacgaacaagaagcgcucuuggccgcugaacgaggccaucauggccgucggcauggucuccauccuggccucgucccuccugaaaaacgacaucccaaugaccggaccccugguagcagggggccuccuaaccgucugcuacgugcuuaccggccggucagccgaccucgagcuggagcgggccacggacguaaaaugggaggaccaggcggagaucuccggcagcagccccauccuaagcaucaccauaagcgaggacggguccaugucgaucaagaacgaggaggaggagcaaacccucacgauccucaucagaacgggccugcucguaaucuccggccuguucccgaucagcauacccaucaccgccgccgccugguaccugugggaagugaaaaagcagcgggccgggguacuuugggauguccccagcccuccgcccaugggcaaggcggagcucgaggacggagcauaccgaauaaagcagaaaggcauccucggguacagccagaucggcgcggguguguacaaagagggaaccuuccacacaauguggcacgugacacgcggcgcuguccugaugcauaaggguaaacggaucgagcccuccugggccgacgugaagaaggaccugauuagcuauggugggggcuggaagcuggagggcgaguggaaggaaggugaggaggugcaaguacucgcgcuggaacccggcaagaacccccgcgccgugcagacgaagcccggacuguucaagaccaauaccggcaccaucggggccguaucacuagacuucagcccuggaacguccggcagucccauuaucgacaagaaggggaaggucgugggcuuauacgggaacggcguggucacgcggagcggcgccuacguuagcgcuaucgcgcagaccgagaaguccaucgaggacaaccccgagaucgaggacgacaucuuccgcaaacggcgccugaccaucauggaccugcaccccggugcuggcaaaacgaagcgguaccuccccgccaucguacgcgaggccaucaagcggggccugcggacccugauccucgcgccgacgcgggucguugccgccgagauggaggaggcccugcgcggccuccccauccgguaccagacccccgccauccgggcggagcacacugggcgcgagaucguggacuuaaugugucacgccaccuucaccaugcggcugcuaagccccgucagagugccgaauuacaaccucaucaucauggacgaggcccacuuuaccgaucccgccuccaucgccgcgcggggcuacaucagcacgagggucgaaaugggugaggccgccgggauauucaugaccgccacaccgccgggaagccgagacccguuuccccagaguaacgcccccaucaucgacgaagagagagagauccccgagcgaagcuggaacuccggacacgagugggucaccgacuucaacggcaagacugugugguucguaccgagcaucaaggcugggaaugacaucgcggccugccugcgcaagaacggcaagaaggucauccagcugucccggaagaccuucgacagcgaguacguuaagacccgcaccaacgacugggauuucgugguuacgacagacaucucugagaugggugccaacuucaaagcugagcgggugaucgacccccgucgguguaugaagcccguuauccucaccgacggagaggagcgcgucauucuggcgggccccaugccggucacgcacagcuccgcugcccaacggcgcgggcggaucggucggaacccaaagaacgagaacgaccaauacauauacaugggggagccccuggagaacgacgaggacugcgcccacuggaaggaagcgaagaugcucuuagacaauauaaacacacccgagggcaucauuccgucaauguuugagcccgagcgggagaagguugacgccauagacggcgaguaccgccugagaggggaggcccggaagacauucgucgaccuuaugagaagaggcgaccugcccgucuggcuugccuacaagguggccgcggagggaaucaauuaugcagaccgccgcuggugcuucgacgggaucaaaaacaaccaaauucucgaagagaaugucgagguggagaucuggaccaaggaaggggagcgcaagaagcugaagccacgauggcuggaugcccgaauauacuccgacccccucgcccugaaggaguucaaagaguucgcggcggggcggaagucccugacacucaacuugaucacggagaugggccgucugcccacguucaugacccaaaagacccgggacgcccucgacaaccuggccguacugcacacggccgaggcuggcgggcgcgccuacaaccaugcccucucagaacugccugaaacccuggagacccuccugcugcucacccugcuggccacgguuaccgggggcaucuuccucuuucugauguccggacgggggaucgguaagaugacucuugggaugugcugcauuaucacggccuccauccuguugugguacgcgcagauccagccgcacuggaucgcugcguccaucauccuggaguucuuccucaucgugcugcucauucccgagccggaaaagcaacgcacgccucaggacaaccagcucacguacgucgugaucgccauccugacaguugucgccgccaccauggccaacgagaugggcuuccuggaaaagacuaagaaggaccucggucugggcagcaucgccacacagcagcccgagaguaacauacuggacauagaccuccggcccgcgucagcguggaccuuauacgcgguggccaccacuuucgugacaccaaugcugcgacacagcaucgagaacucguccgucaacgucucccucacggccaucgccaaccaggccaccguguuaaugggccuugggaagggcuggccccuauccaagauggacaucggggucccgcuucucgcuaucggcugcuacagccaagugaaccccauuacccucacggccgcccugcugcuccugguggcccacuaugcgaucaucggccccggccugcaggccaaggccacgcgggaggcccagaagcgagccgcggccggcauuaugaagaaccccacggucgacgggaucacugugaucgaucucgacccgauccccuacgaccccaaguucgagaagcaacugggccagguaaugcugcucauacuuugugucacccaggugcugaugaugcgaaccaccugggcccucugcgaggcucugacucuagccacagggcccaucuccacccuaugggagggcaaccccgggagguucuggaauaccaccauugcggugagcauggccaacaucuuccggggcuccuaccuggcaggcgccgggcuccucuucucuaucaugaagaauacgaccaacacccgcagaggcaccggcaauauaggcgagacgcuuggcgagaaguggaagucccggcugaacgcccucggcaagagcgaguuccaaaucuacaagaaguccggcauccaggaagucgaccggacucuggcuaaggaggggauaaagcgaggcgagaccgaccaccaugccgugagccgcgggucagccaagcuccguugguucgucgagcgaaacaugguuacccccgagggcaaggugguugaucucggcugcgggcggggcggguggagcuacuacugcggcgggcugaagaacguccgcgaagugaagggccuuacgaagggcgggccaggccaugaggagcccauccccauguccacauacgguuggaaccucgugcggcuucagagcggcguagauguguucuucaucccacccgagaagugcgacacccuguuaugugacaucggugaguccagccccaacccgaccguagaggccggacgcacguugcggguccugaaccucguggagaacuggcugaauaacaauacccaguucugcaucaaagugcuaaacccguacaugcccuccgucaucgagaaaauggaggcccuccagcgcaaguacggcggggcccucguucggaacccgcugagucgcaauagcacccacgagauguacuggguguccaacgcuucaggcaacaucgucuccagcgugaacaugauuucucggaugcuuauaaaccgcuuuacaaugcggcacaagaaagccacguacgaaccugacguggaccucggcagcggcacgcggaacaucgggaucgaauccgaaauccccaaccuggacaucaucggcaagcggauagagaaaaucaagcaggagcacgagaccagcuggcauuacgaccaagaccaccccuacaagaccugggccuaccauggguccuacgaaacgaagcagacggggagcgcguccagcauggugaacggcguugugcgccugcucacaaagccgugggacguccugcccaccguuacccagauggcgaugacggacaccacccccuucggucaacagcgcguguucaaggagaaggucgacacccggacucaagaacccaaggagggcaccaagaagcugaugaaaaucacagccgaguggcucuggaaggagcugggcaagaagaagaccccgcgcaugugcacucgggaagaguucacccgcaagguucggagcaacgccgcccugggagcaaucuucaccgacgagaacaaguggaaauccgcuagggaggccguugaggacucccgguucugggaguuagucgacaaagagcgaaaucugcaccuggaaggcaagugcgagaccugcguguacaacaugauggggaagcgggagaaaaagcucggcgaguuugggaaagccaaaggcagccgcgcaauaugguacauguggcugggcgcgcgcuuccuggaguucgaggcccugggguuucucaaugaggaucacugguucucaagggaaaacagccuguccggcgucgagggagagggccuccacaagcugggguacauccugcgggacgugagcaagaaagaaggcggcgcuauguaugccgacgacacggcggggugggacacccgaauaacccuugaggaccuuaaaaacgaggaaauggugaccaaccauauggagggcgagcacaagaaacuggcugaggccaucuucaaguugacguaccagaacaagguugugcgggugcagcgcccuacgccgcggggcaccgucauggacaucaucagccgccgggaucagcgcggcuccggccaggugggcaccuacggccugaacacguucaccaauauggaggcccagcugauccggcagauggaaggggaaggcguguucaagaauauccagcacuuaaccgugacugaggagguggccgugcacaacuggcucgcgcgggucggacgcgagcggcugagccgcauggccaucucuggagacgacugcguggugaagccccucgacgaccgguucgcgaacgcccugacggcccugaacgacauggggaagauccgcaaggacauccagcaaugggaaccaagcaagggguggaaugacuggacccagguccccuucugcucccaccacuuccacgagcugauaaugaaggaugggcggauccugguugugccgugccgcaaccaggacgagcugaucgggcgggcgcgcaucucacagggagccgguuggucccuccgggagaccgccugccugggcaagagcuaugcccagauguggucucugauguacuuucaccgccgggaccuccgccuggccgcgaacgcaaucugcagcgccguccccucccacugggugcccaccucacggacgaccuggucaauccacgcaaagcaugaguggaugaccaccgaggauaugcugaccguguggaaccgcgucuggauccgggagaaccccuggauggaggacaagacgcccguggaaagcugggaggagauccccuaccucggcaagcgcgaggaccaguggugcgggucccugauagggcugacuagccgagccaccugggcgaagaacauccaagccgccaucaaccaagugcgcagucucaucggcaacgaagaguauacggacuacaugccguccaugaagcgguuucgccgggaggaggaagaggccggcgugcugugguag

SEQ ID NO: 25351 - RNA, 9876 nt, Artificial Sequence
  derived and/or modified CDS sequence (opt11) from DENV-2__FJ410233__SS-prME
ucagcugggaugaucaucauguugaucccaaccgugauggcuuuccauuuaacgacucguaauggggagccgcacaugaucgucggaauccaggagaagggcaagucacugcuguuuaagaccgaagauggcgucaacaugugcacccucauggcgauggacuugggggagcugugcgaggacaccaucaccuacaagugcccccugcugcggcaaaacgagccagaggacaucgacugcuggugcaacagcaccuccaccugggugaccuacgggacgugcaccacaaccggcgagcaccgccgggagaaacgcagcgucgcuuuaguaccccacguagggaugggccucgagaccagaaccgagaccuggauguccagcgagggagccuggaaacacgcccaaaggaucgagaccuggauccugcggcacccuggcuucacgaucauggcugcgauucuggcguauacaaucggcacaacccauuuccagcgcguccucaucuuuauccuuuugacggccguugcccccuccaugaccaugcggugcauuggcaucagcaaccgugacuucguggagggggugucagggggcagcugggucgacaucgugcucgagcacggaaguugcgugaccaccauggcgaagaacaagcccacgcuggacuucgagcugaucaagacugaggccaagcaaccugccaccuuacggaaguacuguaucgaggccaagcugacuaacacgaccacggagagccgcugcccuacacagggcgagccaucgcugaaggaggagcaggauaagcgguucguaugcaagcacaguaugguggaccgcggcuggggaaacggaugcggccuuuuuggcaagggcgguauuguaacaugcgcgauguucacuugcaaaaagaacauggagggcaagaucgugcagccggaaaaucuggaguacaccaucgucguuacgccccauuccggugaggagcacgcggugggcaacgacacggggaagcacggccaggaaaucaaggucacaccgcagagcucaaucaccgaggccgagcugacuggguacggcaccguaacgauggaguguagcccgcgaacggguuuagauuucaacgagauggugcugcugcaaauggaaaacaaggcguggcuggugcaccgccagugguuccuggaccugcccuuaccuugguugccaggcgccgacaagcaggaauccaacuggauucagaaagagacccuggucacuuuuaagaauccccacgccaagaagcaagacguggucguacucggcagccaggagggggcgaugcauaccgcccugacgggcgccaccgagauccagaugagcuccgggaacuugcuguucacuggacaccugaagugccggcugcggauggacaagcugcagcugaaaggcaugucauacuccaugugcacggggaaguucaagguggucaaggagauagcagagacccagcacggcaccaucgugaucagagugcaguaugagggcgacggcagccccugcaaaauacccuucgagaucauggaccuggagaagcguuacguccucggccggcuaaucaccgugaacccgaucguuacagagaaagauucucccgucaacaucgaggccgaaccgcccuuuggugauucguacaucaucaucggcguggaaccuggccagcuuaaacucaacugguuuaaaaaagggucuagcaucgggcaaauguuugaaaccaccaugcgcggcgcuaagagaauggccauccugggagauaccgccugggacuucggguccuuaggcgggguuuucacgucaaucggcaaggcccuucaccaagucuuuggggccaucuacggcgccgccuucuccggcgugagcuggaccaugaagaucuuaaucggggugaucauaaccuggaucggcaugaauucacggagcacaucucugucagucucccucguccucgucgggaucgucacgcuguaccucggcgugaugguacaggccgacagcgggugcgucguguccuggaagaacaaggaacucaagugcgggagcggcauauucaucaccgacaacgugcacacauggacggagcaauacaaauuccaacccgagucucccuccaaacuggcaucugcgauccagaaggcccaggaggaggggaucugcgggauucgguccgucacgcgucuggagaauuuaauguggaagcagaucacccccgaacucaaccauauccuggcagagaacgaagugaagcucaccaucaugaccggggauaucaagggcaucaugcaggccgggaagagaagccugcgcccucagcccaccgaacugaaguacuccuggaagaccuggggcaaggccaagaugcucagcaccgaaucauauaaccagaccuuccugaucgacggccccgagacggcggagugcccgaacaccaaccgcgccuggaacucucuggagguggaggacuacggcuucggggucuucaccacuaauaucuggcugaagcuuaaggaaaagcaggacgccuucugcgauuccaagcugaugucggccgccauuaaggauaaccgggccgugcacgcugacaugggguauuggaucgagagcgcccucaacgacacguggaagaucgagaaggcaagcuucauagaggugaagaacugccacuggccgaagucucacacccuuuggagcaacgggguccuggaguccgaaaugaucauccccaagaaccucgccggccccgugagccaacauaacuacaggccgggguaucacacgcagaucgcgggccccuggcaccuggggaagcuugagauggacuucaacuucugcgacggcacaaccgugauagucacugaagacugcgggaaccggggacccucccuccgcacaaccaccgccagcggcaagcugaucaccgaguggugcugccgaagcugcacccugcccccgcuacgcuaccgcggggaggacggaugcugguacgggauggagauccgcccccuuaaggagaaagaggagaaccuggugaacucccucgugaccgccggccaugggcagguagacaacuucucgcugggcgugcugggcauggcccucuuucuggaagagaugcugaggacccgcguggggacgaagcacgcgauccuccuggucgccguguccuucgugacccucaucaccggaaacaugaguuuuaaggaucucggccgagucguggugaugguuggagccaccaugacggacgauauagggaugggaguuaccuaccuggcccugcucgccgcguuuaagguaaggcccaccuucgccgccggccuucugcuccggaaacugacuuccaaggaacugaugaugacgaccaucgggaucguguugcucagccagucgaccauccccgagacgguacuggagcugacggacgcccuggcucuggggaugaugguguugaagaucguccgcaauauggagaaauaccaguuggcagugaccaucauggcuauacucugcgucccgaacgccgugauccuccagaacgccuggaaggucagcuguaccauccuggcugucgugagugucucgccccugcuccugacuuccagucagcagaagacggacuggauuccucuggcgcucacgauaaagggacucaacccaaccgccauuuuucugaccacgcucucccgcaccaacaagaagcgaagcuggccgcucaacgaggccaucauggccgucggcaugguguccauccuggcuuccucccucuugaagaacgacaucccaaugaccgggccccuaguggccggcggccuccugaccgucuguuacguccugacgggucgcagcgcagaccucgagcucgagcgggccacggacguuaagugggaagaucaggcggagaucuccggcagcagccccauccugucuaucaccaucagcgaggacgggagcaugagcaucaaaaaugaggaggaagagcagacacucaccauccugauccggaccggacugcucgucaucuccggccuguucccgaucagcaucccuaucaccgcggcugccugguaccugugggaggugaagaagcagcgugccgggguccucugggauguccccaguccgccgccgaugggcaaggccgagcuagaagacggagcauaccgcauuaagcagaaggggaucuuaggguauagccagauuggcgccggcguuuacaaggaggggaccuuccacaccauguggcacguuacgcggggcgcgguccucaugcacaaagggaaacgcaucgagccuuccugggccgacgucaaaaaagaccugaucagcuauggagguggcuggaaacuggagggcgaauggaaagagggggaggaagugcagguccuagcgcuugagcccgggaagaacccucgggccgugcagaccaagcccggacuguucaagaccaauaccggcacgaucggggccgucucccucgacuucagccccggcaccuccggcagccccaucauugauaagaaggggaaggucgugggccuuuacgggaacgguguggucacccgcuccggagcuuacgucagcgccaucgcccagacagaaaagaguaucgaggauaaccccgagauugaggacgauaucuuccggaagcgacggcugacgaucauggacuuacaccccggagcuggcaagaccaagcgcuaccucccugcuaucgugcgggaagccaucaagcgcgggcugcggacccugaucuuggccccgacccgcgucguggcggcagagauggaagaggcccugcggggccugcccauccgcuaccagacgcccgccauccgggccgagcacaccgggcgcgagaucguagaucucaugugccaugcgaccuuuaccaugcgccugcuguccccaguccgggugccaaacuacaaccucaucaucauggacgaggcccacuucacggaucccgccuccauagccgcgcggggcuauaucagcacuagaguggagaugggcgaggcggcagggaucuucaugaccgccacgccacccggaagccgcgacccguucccccaguccaacgcccccaucaucgacgaggaacgggagaucccggaacguagcuggaacucuggucacgaguggguuacggacuucaagggcaagacugugugguuugugccgucaaucaaggcggggaacgacauugcggccugcuuacggaagaauggcaagaagguuauccaguugagucgcaagaccuucgacagcgaguauguuaagacccggacgaaugauugggacuucguggucaccaccgauaucucagaaaugggcgccaauuucaaggcugagcgcguaaucgacccgcggcgcugcaugaagcccgugauccucacugacggggaagagcgggucauucuggcuggccccaugccggugacgcacagcuccgcugcccagcgccggggacgcaucgggcggaaccccaagaacgagaacgaccaauacauauauaugggggagccacuggaaaacgacgaggacugcgcccauuggaaggaggccaagaugcugcuggacaacaucaacacgccagaggggaucauuccgagcauguucgagccugagcgcgagaagguagacgcgaucgacggggaguaccggcucagaggggaggcccgcaagaccuucgucgaccucaugcgacgcggcgacuuaccugugugguuggcauacaaaguggccgccgaggggaucaacuacgcagaccggcgcuggugcuucgacggcaucaagaauaaccaaauccucgaggagaacauggaggucgagaucuggaccaaggagggggaacguaagaaguugaaaccgcgcuggcuggacgcccggauauacuccgacccccucgcccugaaggaguuuaaggaguucgcugcgggccgcaaaagccugacgcucaacuugaucaccgagaugggccggcugcccacauucaugacccagaagacccgcgacgcgcucgacaacuuagcgguguuacacaccgccgaagccggcggcagggcguacaaccacgcgcucuccgaacugcccgagacccuggaaacccucuuacugcugacgcuccuggccaccgucacuggaggcauuuucuuguuucugaugucuggccgcgguaucgggaagaugacccugggaaugugcugcaucaucaccgccuccauacuccugugguacgcucagauacagccgcauuggaucgcggcaagcauaauccuggaauucuuccucaucgugcuguuaauccccgaaccagagaagcagcggacgccccaggacaaccagcucaccuacgugguuaucgccauccugaccgugguugccgcaaccauggcgaacgagauggguuuccuggagaaaacgaagaaggaccucgggcucggcucgaucgccacccgccagccggagucaaacauccuggacauagaccuccggccagccagcgccuggacccuguacgccgucgcgaccacauucgucacccccaugcugcgccauuccaucgaaaacucguccgugaacgucucccucaccgcgaucgcgaaccaggccaccgugcugaugggccugggaaaaggcuggccccucuccaagauggacaucggggugccccugcucgcgauaggcugcuacagccaggucaauccuaucacgcucacugcggcucuacuccuccugguggcccauuacgcaaucauaggacccggccugcaggcuaaggccacgcgggaggcccagaaacgcgcagccgcgggcaucaugaagaaccccaccguggacgggaucacggucaucgaucucgaccccauccccuaugaccccaaguucgagaaacaacugggacaagugaugcuguugguguugugcgugacccaggugcugaugaugcggaccacaugggcgcucugcgaggcccuuacgcuggccaccggacccaucuccacucuuugggagggcaacccaggucguuucuggaauacgaccaucgccguaagcauggcgaacauuuuccguggcagcuacuuggccggugccgggcugcucuuuagcaucaugaagaacaccaccaacacccgucgagguacugggaacaugggcgagacacugggcgagaaguggaagucgcggcugaacgcccucgggaaauccgaauuccagauauacaagaagagcggcauccaggaagucgaccgcacgcuggccaaggagggaauaaagcggggcgagaccgaccaucacgcggugagcagagggagugcgaagcugcggugguucguggagcgcaacauggucacgcccgagggcaaagugguggaccucggcugcgggcggggcggguggaguuacuacugcggcgggcugaagaauguccgcgaagugaagggccugaccaagggcggccccggccacgaggagcccaucccgaugucuaccuacggauggaacuuggucaggcugcagucaggggucgauguguucuucaucccgccggagaagugugacacccugcucugcgauauuggggagagcucgcccaacccgacgguggaggccggccgcacacugcggguccugaaucucgucgagaacuggcugaacaauaacacacaguuuuguaucaaggugcugaaucccuacaugccgagcgucauugagaagauggaggcacugcaaagaaaguauggcggggcgcucgugcggaacccgcuaagccggaauucaacacaugagauguacuggguguccaaugcuagcggcaacauugucuccucagugaacaugaucuccagaaugcugauuaaccgcuucaccaugcggcacaaaaaagccacguacgagcccgacguugaccucgggagcggcaccagaaacaucggaaucgaguccgagaucccgaauuuggacaucaucggaaagcggaucgagaagaucaaacaagaacacgaaacaagcuggcauuacgaccaggaccaccccuacaagaccugggccuaccacggcucauacgagacgaagcagacugggagugccucaagcauggucaauggaguggugcgccugcucaccaagccgugggauguccugccuaccgugacgcagauggcgaugaccgacaccaccccuuucgggcagcaacgaguguucaaggagaagguggacacgcggacccaggagcccaaggagggcaccaagaagcugaugaagaucaccgccgaguggcucuggaaagagcugggcaagaagaagacgccgagaaugugcacccgggaggaguucacccgcaaggugcgguccaacgccgcacugggggccauuuuuaccgacgagaacaaguggaaguccgcgcgagaggccguugaagacucccgguucugggagcucgucgacaaggaacgcaaucugcaccuggaggggaaaugcgagacaugcguguacaauaugauggguaagcgggagaagaagcuuggcgaguucgggaaggcuaagggcagccgcgccaucugguacauguggcugggcgcccgguuccuggaauuugaggcucucggauuccugaacgaggaucacugguucucccgcgagaacagccuguccggcguagaaggggagggccuccacaaacugggguacauacugcgggacgugagcaagaaggagggcggcgccauguacgcugacgacaccgcugguugggacacccgcauaacgcucgaggaucugaagaacgaggagauggugacgaaccacauggagggagagcacaagaaguuagcggaggccauuuucaaguuaaccuaccagaacaagguugugcgggugcagcgccccacaccgagggggaccgucauggacauuaucagccgccgggaccagcgcggcucgggccaaguggggacguacggacugaacacuuucaccaacauggaggcgcagcugauccggcagauggagggggagggcguauuuaaaaacauccagcacuugaccgucacggaggagguugcgguaaaaaacuggcuggcccgcgucgggcgagagcgucugucucgcauggcgaucuccggcgacgacugcgucguuaagccccucgacgacagguucgccaaugcccugaccgcccugaacgauaugggcaagauccgcaaggacauccagcaaugggagccgucgaagggguggaacgacuggacacaggucccauucugcucucaccauuuccacgagcucaucaugaaggacggaagggugcugguugugccaugcagaaaccaggacgagcucaucggccgugcucgcauaagucagggcgcaggguggucccucagagagacggccugccugggcaaguccuacgcgcagauguggucccugauguacuuccacagacgagaccuaaggcuggccgcaaacgcuaucugcucggccgugccuucacacugggugccgacgagcagaaccacuuggucuauccaugccaagcaugaauggaugacaaccgaggauaugcugacagucuggaaccgcguguggauccgggaaaaccccuggauggaggacaagacccccguggaaucuugggaagagauccccuauuugggcaagcgcgaggaccaguggugcggaucgcugaucggccugaccucgcgggccacuugggccaagaacauucaggcggcaaucaaccaaguacgcagucucaucgggaacgaggaguacaccgauuacaugccaagcaugaaacgguuccgccgcgaggaggaggaggccggggugcugugguag

SEQ ID NO: 25352 - RNA, 9876 nt, Artificial Sequence
  derived and/or modified CDS sequence (opt11) from DENV-2__FJ410237__SS-prME
agcgccgggaugauuaucaugcucauucccaccguaauggccuuucacuugaccacucgcaacggggaaccacacaugaucguuggcauccaagaaaaaggcaagucccugcuuuucaagaccgaagacggcguaaauauguguacacucauggcuauggaucuuggugaacugugcgaggacacgaucaccuacaaaugcccucucuugcggcagaacgagcccgaggacauagacuguuggugcaacagcacguccaccuggguaaccuaugggacuugcaccaccaccggugagcaucggcgggaaaagcgcagcguugcgcucgugccccacguugggaugggguuggagacccggacugagaccuggauguccucugagggugccuggaaacacgcccagcgcaucgaaaccuggauauugcggcacccuggcuucacuaucauggccgcaaucuuagcguacaccauagggaccacccacuuccagagaguccucauauucauccugcuaacggcgguggccccguccaugaccaugcgauguauaggcaucagcaaccgcgacuucguggagggcgucuccgggggcucauggguggacaucguacucgagcacggguccugcgucacaaccauggcgaaaaacaaaccgacgcucgacuucgagcugaucaagaccgaggccaaacaacccgccacccuccggaaguacugcauugaggcgaagcugaccaauacuaccacagagaguagguguccuacccagggcgagcccucccuuaaggaggagcaagacaagcgcuucgugugcaagcauagcaugguggaucggggcugggggaacggcugcggcuuguucggcaagggcgggauugucacgugugccauguuuaccugcaagaaaaacauggagggaaagaucguacaacccgaaaaccuggaguauaccaucguggugacgccccauuccggagaggagcacgcgguggguaaugacacggggaagcaugggcaagagaucaaggugaccccgcaguccuccauaaccgaggcagaguugacaggguacgggaccgucacgauggagugcucaccucggacaggccuggacuucaacgagauggugcuguugcaaauggagaacaaggcuuggcuugugcacagacagugguuucuggaccugccccugcccuggcucccgggggccgacaagcaggagucaaacuggauccagaaggaaacccucguuaccuucaagaacccucacgcaaagaagcaggacguggucguccucgggagccaggagggggcgaugcauacggcccucacgggcgcgaccgagauccagaugucuagugggaaccucuuauucacaggccaucucaagugccggcuacgaauggauaagcuccagcuuaagggcaugagcuacuccauguguacggggaaauucaaaguaguuaaagaaaucgcugagacccaacacggcaccauuguuauccgggugcaguaugagggggacggaagcccgugcaaaaucccauucgagauaauggaccuagagaagcgcuacguacucggcaggcugauaaccgugaacccgaucgugacggaaaaggacuccccggucaacaucgaagccgagccucccuuuggugacagcuacaucaucaucggcgucgaaccaggccagcugaagcucaacugguucaagaaggguagcagcaucgggcagauguucgagacgacuaugagaggcgcgaagcggauggccauccugggcgacaccgccugggacuuugggucccuuggugggguguucacgagcaucggcaaagccuuacaccagguuuucggggccaucuacggcgcugccuucuccggcguuagcuggacaaugaaaaucuuaauagggguuaucaucacguggaucggcaugaacucgcggagcaccucccugagcguuaguuuaguguuaguggguaucgucacucuguaccugggcgugauggugcaggccgacagcggaugcgucgugucuuggaagaacaaggaguuaaagugcggaagcggcaucuuuaucaccgacaacguacacacguggaccgaacaguacaaauuccaacccgagagccccucuaagcuggccucggccauacagaaggcccaggaggaagggaucugcggcauacgcuccguaacgcggcuggagaaccucauguggaagcaaaucacacccgagcugaaccacaucuuggccgagaacgaggugaaacuuaccauaaugaccggggacaucaagggcauuaugcaagccgggaagagaagccugcggccgcagcccacagagcuaaaauacuccuggaagaccugggggaaggccaagaugcuaagcaccgaaagcuacaaccaaaccuuccuaauagacggccccgagacugcggagugcccgaacacaaaccgcgccuggaacagccuggagguggaggacuacggauuuggggucuucacuacgaacauauggcucaaguugaaggagaagcaggacgccuucugcgacuccaagcucaugagcgcggccauaaaggauaacagggcaguccacgcagacaugggcuacuggaucgaguccgcgcugaacgacaccuggaagauugagaaggccagcuucaucgaggugaaaaacugucacuggcccaaaucccacacgcuuugguccaacggcgugcuagagucggagaugaucauccccaagaaucucgcuggccccgugagccagcacaauuaccgcccggguuaccacacccagaucgcggguccauggcaccugggcaagcuggagauggauuucgacuucugcgacggcaccacgguuauagucacugaggacugcgggaaccguggcccaucccuccgcaccaccaccgccucuggcaaguuaauuacggaguggugcugccggucguguacgcugccaccgcucagauauaggggcgaggacggcugcugguacgggauggagaucaggccacucaaggaaaaggaggagaaccuugugaacucccucgugaccgcgggccacgggcagguugacaacuucagccugggcgucuuagguauggcgcuuuuccuggaggaaaugcugcggacucguguuggcaccaagcacgcgauccuccuggucgcuguuuccuucguuacccugaucaccggaaacaugucuuucaaggaccuggggcgggucgucgucauggucggugccaccaugacagaugacauagggaugggcgugaccuaccuggcccugcucgccgcuuuuaaggucagaccuaccuuugcugccggccugcugcuccggaagcugaccuccaaggagcugaugaugacaaccaucggaaucgugcuccuaagccaguccacgaucccagagaccguccuggagcucacggacgcccucgcacucggcaugauggugcuaaaaauaguccgcaacauggagaaguaccagcuggcggugaccauaauggcaauacugugugucccgaacgcagugauucuccagaacgccuggaagguuagcugcaccauacuggcgguuguguccgugagcccgcugcuccugaccuccucgcagcagaagacggacuggaucccccuggcccuuaccaucaaaggacucaacccuacggcgauauuuuugaccacgcucucacguacgaacaaaaagcggucuuggccccucaacgaagcgaucauggccgucggcauggugaguauccucgcgucgagucuccucaagaacgauauccccaugacgggcccccugguggccgggggcuugcucacagucugcuauguccugacggggcgaagcgccgaccucgagcuggagcgugccacugacgugaaaugggaagaccaggcggaaaucuccggcagcagcccgauuuugagcaucaccauaagugaggacggauccaugucaaucaagaaugaagaggaggagcagaccuuaacgauccugauacgcaccggucugcucgucaucuccggacuguucccgaucagcauuccgauaaccgcggccgcaugguaccucugggaaguaaagaagcagcgcgcgggaguuuugugggaugucccaagcccaccgccuaugggaaaggccgagcuggaggacggagccuaccgcauuaaacagaaggggauucugggguacagccagaucggcgccggcguguacaaggaggggaccuuucacacgauguggcacgucacgcggggcgccguccucaugcacaagggcaagagaauugagcccuccugggcagacguaaagaaagaccuuaucaguuauggcgggggcuggaaguuggagggcgaguggaaggaaggcgaagagguacaggucuuggcguuagagccgggcaaaaacccccgggcgguucaaaccaagccgggguuguucaagacuaacacagggacgaucggggccguaucgcucgacuucagccccggcaccuccggcagccccaucaucgacaagaaaggcaaggucgugggcuuguacgggaauggcguggucacccgcuccggcgccuacgucuccgcuaucgcucagaccgagaaguccaucgaggauaaccccgaaaucgaggacgacaucuuccggaaaagacggcugaccauuauggacuuacaccccggggcgggaaagacuaaacgcuaccuccccgccaucguacgggaggcuaucaagagagggcugcggacccugauacucgccccaacgcgcgucguggccgcggagauggaagaggcccugcggggccugcccauucgcuaccagacacccgccauucgcgccgagcacaccgguagggaaaucguggaucucaugugccaugcuaccuucaccaugcgccugcuaagccccguccgggugccaaacuacaaccugaucaucauggaugaggcgcacuuuaccgauccagccucaaucgcagcccgcggauacauaucuacccggguggaaaugggugaggcggcagggauuuuuaugacagcgacgcccccagggagcagggacccguucccccaguccaacgcaccaaucaucgaugaggaacgggagauccccgagcggaguuggaacuccgggcacgaguggguaacggacuuuaaaggaaaaacggugugguucgugccauccauaaaggccggaaacgauaucgcggcuugccugcgcaagaacggcaagaaagucauccagcugucgcgcaagaccuucgacagcgaauacgucaaaacccggacuaacgacugggacuucguggugaccacugauaucucagagaugggugccaacuucaaggccgagcgcgugauugaucccaggcgcugcaugaagccagugauacucaccgacggcgaggagcgagucauccucgcgggccccaugccggugacgcacagcuccgccgcccagcgccggggucgcaucggccguaaucccaagaaugaaaacgaucaguauauauacaugggggaacccuuagagaacgacgaggacugcgcacauuggaaggaggccaagaugcuccuggacaauauaaacacccccgagggaaucaucccuagcauguucgagcccgagcgcgagaagguggacgcuaucgacggggaguaccggcugcgcggcgaggcccgcaagacguuuguugaucuuaugcggcgcggcgaucuuccggucuggcuggccuacaagguggccgcggaggggauaaacuacgcggaccgucgcuggugcuuugacggcaucaagaacaaucagaucuuggaggagaaugucgaggucgagaucuggaccaaggaaggcgagcguaagaaacugaaaccacguuggcuggacgcacgaauauauuccgacccucuugcccuuaaggaguucaaggaguucgccgcgggccgcaagagcuugacguuaaaccugauaaccgagauggggcggcugccaacguucaugacucagaagacgcgcgacgcgcuugacaaccuggccguccuccacacggccgaagccggagggcgggcguacaaccacgcgcuguccgagcuacccgagaccuuggagaccuuacugcugcucacccugcuggcuacuguuaccggcggcaucuuucucuuccucaugagcggcagggggaucggcaagaugacccuggggaugugcugcauuauaaccgcuagcauccuccugugguaugcccaaauccagccgcacuggaucgcggccucaauaaucuuggaguucuucuuaaucguguugcugauacccgagccugagaagcagcggacaccccaggacaaccagcucaccuacgucgugaucgccaucuuaaccguggucgccgccaccauggcgaacgaaaugggcuucuuggagaaaaccaagaaggaccucggccuggguucaauagccacccagcagccggaaagcaacauccuggacaucgaucucagaccagccagugccuggacguuauacgccguugcgaccacuuucgucacgcccauguugcggcacucgaucgaaaacagcuccguuaacgugagucucacggccauugccaaccaagcuacgguucugaugggccuggggaaaggcuggccgcucagcaaaauggacaucggggugccacugcuugccaucgguugcuacagccaagugaaucccauuacgcugacggcggcccugcugcuccugguggcccacuacgccauuaucggacccggacuucaggccaaggccacgagagaagcucaaaagcgagccgccgccggcauuaugaagaaccccaccgucgauggaauuacggucaucgaucucgacccgauccccuacgacccaaaauucgagaagcagcucggucaggucaugcuccugauccuguguguaacccaagugcugaugaugcgaaccaccugggcgcucugcgaggcccugacucuggcgaccgggcccauaucgacccuaugggagggcaacccagggcgauucuggaacaccacgaucgcggugagcauggcuaacaucuuccgcgggucauaucuggccggggccggucucuuauucucgaucaugaaaaacacgaccaauacacgucgcgguacagggaacaugggugagaccuuaggcgagaaguggaagucccgguuaaacgccuuagggaagucugaguuccagaucuacaagaaaagugguauccaggaggucgaccguacucucgccaaagagggcaucaagcgcggcgagaccgaccaccacgcggugucccggggguccgccaagcucagaugguucguugagcggaacauggucacgccggagggcaaagugguggaucugggcugcggacgcggcgguuggagcuacuacugcggugggcugaagaacguccgggaggucaagggccucaccaagggcggaccaggccacgaagaaccgauccccauguccacauacggguggaaccucgugcgccuacagucaggcgucgacguuuucuucauaccgcccgagaaaugcgauacccuucucugugacauuggggagucgagcccaaacccgacgguagaggcaggucggacccugcgcguccugaacuugguggagaauuggcucaauaacaacacgcaguucuguaucaaaguucugaaccccuacaugccuucagucauugagaagauggaggcacuacaacggaaguacggcggggcgcucgugcgaaacccucuaucuagaaauucaacucacgagauguauuggguguccaacgcuagcggcaacaucguauccagcguaaacaugauuucccgcaugcugaucaaccgauuuacaaugcgacauaagaaggccaccuaugagccagauguggaccuugggagcggcacccggaacauugggaucgaguccgaaauuccgaaccuggacaucaucgguaaacggaucgagaagauaaagcaggagcacgaaacgucuuggcacuacgaccaggaccacccuuauaagaccugggcuuaucacggguccuacgagacuaagcagacggggagcgccuccagcauggucaauggggucgugcggcugcuaaccaagcccugggacgugcugccaaccgugacucaaauggcgaugaccgacacuacaccauucgggcaacagcgcguguucaaggagaagguagauacgcgcacacaggagcccaaggaagggacaaagaaacuuaugaagauuaccgcugaguggcucuggaaggaauuagguaagaagaagacgccgcggaugugcaccagggaggaauuuacacggaagguccgcuccaacgcagcccuaggggcaaucuucacugaugagaacaaguggaaguccgcaagggaggcuguggaggacuccagguucugggagcuugucgacaaggagcggaaccugcacuuggaggggaagugugagacauguguguacaauaugauggggaaacgcgagaagaaacugggcgaguucggaaaggcuaaaggcucgcgggccaucugguacauguggcugggcgcccgcuuccuugaguucgaggcgcucggguuccugaacgaggaccauugguuuucgcgggagaacagccuguccggcgucgaaggugagggcuugcacaagcugggcuacauccugcgugacgugucaaagaaagagggcggcgcuauguacgccgacgacaccgcggggugggauacccggaucacccucgaggaccugaaaaaugaggagauggugacgaaucacauggagggggagcacaaaaagcuagcggaggcuaucuuuaagcugaccuaucagaacaaagucgugcgcgugcagaggccaacgccuagggggaccgucauggacaucauaucgcggcgcgaccagcgggggagcggccagguggggacguauggccugaacacguucaccaacauggaagcccagcugauucgacaaauggagggggaagguguguucaagaacauucaacaccucaccgucacggaggaaguagccgugaagaacuggcuggccagagucgguagagaacggcuaagccgaauggcgaucucaggcgacgauugcguaguaaagccucucgacgaccgcuucgccaaugcccuaacugcccugaacgacaugggcaagauccgaaaggauauccagcagugggagccgagcaaagguuggauagacuggacacagguacccuucuguucccaccacuuccaugaauugauuaugaaggauggucgcgucuuagugguccccugccgcaaucaggaugagcugaucgggcgcgcccggauuucgcaaggcgccggguggucccuccgcgagacagccugccugggcaagucguaugcccaaauguggucacugauguacuuccacaggcgugaccuccggcuggccgcuaaugcgaucuguucagccguuccgucccacugggugccgacuagccgcacgaccugguccauccaugccaagcaugaguggaugaccaccgaggacauguugacgguuuggaaccggguuuggauccgcgagaaccccuggauggaggacaagacccccguugaaagcugggaggagauucccuaucuuggcaagagagaagaucaauggugcgguucccugaucggccugaccagccgcgcgacaugggcgaaaaacauucaggcggccaucaaccagguacggucccucaucgggaacgaagaguaugcugacuacaugccgucaaugaaacgcuuccggcgcgaggaggaagaggcgggugugcugugguga

SEQ ID NO: 25353 - RNA, 9876 nt, Artificial Sequence
  derived and/or modified CDS sequence (opt11) from DENV-2__FJ410241__SS-prME
agcgcgggcaugaucaucaugcugauucccaccgugauggccuuccaucucacgacccgcaacggggaaccccacaugauaguugggauccaggaaaaggggaaaagccuguuguucaagacggaagacggugugaacaugugcacccucauggccauggaucucggggaauugugcgaagacaccauaaccuacaagugcccucuccugaggcagaacgagccugaggacaucgacugcuggugcaacagcaccucaaccuggguuaccuacgggaccuguaccacgaccggcgagcaccgcagagagaagcgcagcgucgcccucgucccucacgugggaaugggccuggaaacccggacugagacguggauguccucggaaggggcauggaagcaugcccaacgcaucgagaccuggauacugagacacccgggcuucaccauuauggccgcaauucuggcuuacaccaucgguacaacccauuuccaacgcgugcugaucuucauccugcugaccgccguggcaccgaguaugaccaugcggugcaucggcaucagcaaccgcgacuucguggagggcguaagcggaggcagcuggguugacauagugcuggagcacggcuccugcguaacuacgauggccaagaacaagcccacucuagauuucgagcucaucaagaccgaggccaagcagcccgccaccuugcggaaguauugcaucgaggccaagcugaccaacacgacaaccgagagccgcuguccgacacagggcgaaccaucccugaaggaggagcaggacaagcgguucguguguaaacauagcaugguggacagaggcuggggcaauggcuguggcuuauucggcaagggagggaucgucacgugcgcaauguucacgugcaagaagaacauggaaggcaagauugugcaaccggagaacuuagaguacaccaucguuguaacaccccacuccggcgaggagcacgcaguggggaacgauacggggaagcacggccaggaaaucaaagucacuccccagucguccauaaccgaggccgaguugacaggguaugggacggucaccauggaaugcucaccccggacaggccucgacuucaacgagauggugcuacugcagauggagaauaaggcauggcucguccaccgucaaugguuccuugaccucccccugccuuggcucccgggcgcagauaagcaggagucaaacuggauccaaaaggaaaccuuggucacuuuuaagaacccgcacgcuaaaaagcaggacguggucguacucgggagccaggagggggcgaugcauacagcacugaccggugccaccgaaauucagaugagcuccgggaaccucuuguucaccggccaccugaagugccggcucagaauggacaaauugcagcugaagggcaugucauacuccauguguacugggaaguucaaaguggucaaggagaucgccgagacucagcacggcaccaucguaaucaggguccaauaugagggggacggcagccccugcaagaucccauuugagauaauggaccuggagaagcgcuacguucucgggcggcugaucaccgucaauccgauugugacagagaaggacucccccgucaacaucgaggccgagccgcccuucggugacucguacaucaucaucggcguggagccggggcagcuuaagcucaacugguuuaagaaaggcuccuccauugggcaaauguucgagacuacuaugcgaggagcaaagcgcauggccauucugggcgacaccgccugggacuucggaucgcugggcggaguuuucacgagcaucgggaaagccuuacaccagguauuuggcgccaucuacggggcugccuucuccggcgugucguggacaaugaaaauacuuauuggugucauaaucacguggauaggaaugaacaguaggagcaccucccucagcguaucccucgugcucguggggaucgucacgcuguacuuaggcgucaugguucaggcggacucgggaugcgugguaucauggaaaaacaaggagcuuaaguguggcagcggcauuuucaucaccgacaacguccacaccuggaccgagcaguacaaguuccagcccgaaucucccuccaagcuggccagcgcgauucagaaggcucaggaagaaggcaucugcgguauucgguccgucacgcguuuagaaaaucucauguggaaacagaucacacccgagcugaaucacauccuggccgagaacgaaguuaagcucaccaucaugaccggggacauaaagggcaucaugcaagccgggaagcgcucucugcggccgcaaccgacggaacugaaguauaguuggaaaacguggggaaaggccaagaugcucagcacagaguccuacaaccagacuuuccugauagacggccccgaaacggcagagugcccgaacacgaacagggccuggaacagccuggagguggaggacuacggguucggcguuuuuaccacgaacaucuggcucaagcuaaaggagaagcaggaugccuucugcgacuccaagcugauguccgcagccaucaaagacaacagggcugugcaugccgauaugggguacuggauugaguccgcucucaaugacacauggaagaucgaaaaagccagcuuuauugagguuaagaacugucacuggcccaaaucccacacccuguggucaaacgguguacuggaguccgagaugaucaucccaaagaaucucgcuggccccgugucgcagcacaacuaccgaccgggguaccauacgcagauugccggccccuggcaccuggggaaacuagaaauggacuucgauuucugcgacggcaccaccguuaucgugacagaggacugcgggaaccgaggccccucgcucaggaccacaacagcgagcggcaagcugaucacggaaugguguugccgguccugcacccugcccccgcuucgcuaccgcggagaggacgguugcugguacgggauggaaauccgcccucugaaggagaaggaggagaaccuggugaacucccucgugaccgccggccacgggcagguagacaacuucucccugggcgugcuaggcauggcucucuuucuggaggaaaugcuaaagacccggguggggacgaaacacgccauccugcuugucgccguguccuucguuacccugaucacaggaaacaugaguuucaaggaccuagggagagucguggugauggucggcgcuaccauggccgacgacaucgggaugggcguuacguacuuagcccugcucgcugccuucaagguccggcccaccuuugccgccgggcugcuccuccgaaagcuaaccucuaaggagcugaugaugaccacgaucgggaucgugcuucucucgcaguccaccauaccugagaccguguuggaguuaacagacgcccuggcgcugggcaugaugguucuucggaucguccgcaauauggaaaaauaccaguuagccgugacaauaauggccauucucugcgucccgaacgccgugauccuacagaacgccuggaaggugagcuguacgauucuggcgguugugagugucagcccccugcuccugaccuccagccaacaaaagacagacuggaucccccuugcccucacgaucaagggucugaaccccacugccauauuucuuacuacacucucccgcacgaacaaaaagcggagcuggccgcucaacgaggcgaucauggcagucggcauggugucuauucuggccagcucccuccugaagaacgacauccccaugacgggcccuuugguggcugggggacuccugacugucugcuacgugcugacagggcguuccgccgaccucgaguuggaacgggcaacggacgucaagugggaggaccaagcggagaucucgggcagcucuccgaucuugagcaucaccauaagcgaggacggcuccaugagcaucaagaaugaggaagaggagcagacguugaccauacucauccguacgggauuacucgucaucuccggccuguuuccgaucagcauccccauuaccgcagcggcgugguaccugugggaggugaaaaagcagcgggcgggggugcucugggacguccccagcccgccgccaaugggaaaggcggaacuggaggauggggccuaccgaaucaagcagaaaggcauccugggguacagccagaucggcgccgguguguauaaggaggggaccuuccacacuauguggcacgugacccggggcgccgugcucaugcauaagggcaagcgcaucgagcccucaugggccgacgugaaaaaggaccugaucagcuacggagggggcuggaagcuggaaggcgaguggaaggagggggaagagguacagguguuagcucuggaacccggcaagaacccccgggcggugcaaacgaagcccgggcuguucaagaccaacacuggaaccaucggggccgugucucuugacuucagccccgguacguccgggagccccaucaucgauaagaaagggaaggucgugggccuguacgggaauggcguggucacccgaucuggcgcuuacgugucagccaucgcacagaccgaaaagucaaucgaggacaaucccgagauugaagaugacaucuuccggaaacggcggcugaccaucauggaccuucacccaggggcuggcaagaccaaacguuaccucccggccauugugcgggaagccaucaagcgcggguuacggacucugauccucgcgccgacccgcgugguugcugccgagauggaggaggcccuccggggccugcccauacgcuaccagacccccgccauccgggcggagcacaccgggagggagaucguagaccuuaugugccacgcuacauucaccaugcgcuugcucucacccguucgggugccgaacuauaaccucauuaucauggaugaggcccacuuuaccgauccagcuuccaucgcugcacgcggguauaucagcacccggguggagaugggcgaggcugccgggauuuucaugaccgccacgccacccggcucucgggauccauucccccaguccaacgcgccgaucauagaugaggaaagagagauuccagagcgcagcuggaacucuggucacgagugggucaccgacuucaaggggaagacugugugguucgugcccagcauaaaggcggguaaugacauagccgcguguuugcgaaagaacggcaagaaggugauccaauugucaagaaaaaccuucgacagcgaguacgugaagacccggaccaaugauugggacuucguuguaacuaccgacauuucggagaugggcgccaacuuuaaggcggagagagugaucgacccgcgaagaugcaugaagcccgugauacucacggacggggaggagagggucauucuggcaggcccgaugccggugacccauucauccgccgcccagcgccggggucgcaucggcagaaaccccaaaaacgaaaaugaccaguauaucuacaugggggagccguuagaaaacgaugaggauugcgcacauuggaaagaggcgaagaugcuucuggauaacauuaacacgcccgagggcauaaucccguccauguucgagccggaacgcgagaagguagacgcaauagauggcgaauaucggcuuagaggggaagcacgaaaaaccuucgucgaccucaugagacgcggcgaccugccugucuggcuagcguacaaggucgccgcggaagggaucaacuacgccgaccggcgcugguguuucgacggcaucaagaacaaccagauccucgaggagaacgucgagguggagauauggaccaaagagggggagagaaagaagcugaagccccguuggcuugacgcaagaaucuacagugacccccuggcccugaaagaguucaaggaguucgcugcagggcgcaagagccugacgcuaaaccugaucacugagaugggccgguugccaaccuuuaugacccagaagacccgcgacgcccuggauaacuuggcuguccuucacacggccgaagccggcggucgagcauacaaccacgcccuaucggagcugcccgaaacgcuugagacccuccuacuguuaacacugcuagccacggugacuggggguaucuuccucuuucuaaugagcggccgcgggaucggcaagaugacucuggggaugugcuguaucaucaccgccuccauccuccucugguacgcgcagauacaaccgcacuggaucgccgcgagcaucauccuggaguucuucuugaucgugcugcugauucccgagccggagaagcagcgaacgccccaggacaaucagcuuacuuaugucgugaucgccauucuuacgguggucgccgcuaccauggccaaugagaugggcuuccuggagaaaaccaagaaagaccucgggcugggcuccaucgccacccagcagcuggagagcaauauuuuagacaucgaccugcggccggcgucggccuggacacuguacgcaguggcaacaaccuuugugacgccuaugcuccggcacagcauagaaaauucgagcgucaacgucagccuuaccgccauagccaaccaggcgaccguauuaaugggccucggaaaggguuggccacuguccaagauggauauaggagucccuuuacucgcgaucggcuguuacagucagguaaacccgauaacucugacggcugcccugcuccugcugguggcccacuacgcgaucaucggaccaggacuccaggccaaggccacucgcgaggcgcaaaagcgggccgcggccggcaucaugaagaaucccaccgucgacggaaucacggugaucgaucuggacccaauuccguaugaucccaaauucgaaaagcagcugggccaggucaugcuccuuauccuuugcgucacccagguacucaugaugcguacuaccugggcgcugugugaggcgcugacccucgccacggggccgaucuccacgcugugggaaggaaaccccgggcguuucuggaacaccaccauugcggugucgauggccaacaucuuccgcggcuccuaccuggccggcgccggacuccuguucagcaucaugaagaauacgaccaacacccgccgaggcaccgggaacaugggcgagacccuaggcgagaaauggaagucccgccucaacgcacuggggaaguccgaguuccaaauauacaagaaguccggcauccaggaggucgaccggacacucgcgaaagaggggaucaagcggggcgagacggaccaccacgccguaucgcgcggguccgcuaagcuccgaugguucgucgagaggaauauggucaccccggagggaaaagugguggaucuggguugcggucgcggcgguuggagcuacuacugcgguggguugaagaacguccgugagguaaagggacugacgaaaggcggucccggccacgaggaacccauccccauguccacauacggcuggaaccugguccgccuucagucgggugucgauguguucuucaucccgcccgagaagugcgacacgcuccuuugcgacauaggagagaguagccccaaccccaccguugaggcuggccguacucugagaguccucaaccugguggaaaacuggcugaacaauaacacccaguucuguauuaaggugcugaaccccuacaugcccuccgucaucgagaagauggaagcgcuccagcggaaguacggcggggcccuagugagaaacccgcugucucggaacagcacccacgagauguacuggguguccaacgcgagcggaaacaucgucucgucuguuaacaugaucucccgaaugcucaucaaccguuuuaccaugcgccacaaaaaggcgaccuaugagcccgauguagaccuggggagcggcacgaggaacaucgggauugaguccgagaucccaaaccuggacaucauugggaaacgcaucgagaagaucaagcaggaacacgagacauccuggcacuaugaucaggaccacccguacaagaccugggccuaccacgguuccuaugagaccaagcagacggggagcgcaaguagcauggugaacggcguggugcgacucuugaccaagcccugggacgucuugccgacggugacacagauggccaugacagacaccacgcccuucggucagcagcguguguucaaagaaaaagucgacacccgcacgcaggaaccgaaggagggaacgaagaagcugaugaaaaucaccgcagaguggcuguggaaggagcucggaaagaagaaaacgccccggauguguacccgcgaggaguucacccgcaaaguacgcagcaacgccgcucuaggggccaucuuuaccgacgagaacaaauggaaguccgccagagaggccguugaggacucuagguuuugggagcuggucgacaaggagcggaaccugcaccuugaagggaaaugugagaccugcguguacaauaugauggguaagcgcgagaagaagcuaggcgaguucgggaaggccaaggguagccgcgcuaucugguacauguggcugggcgcccgcuuucucgaguucgaggcccuagguuuccugaaugaagaccauugguuuucacgggagaacagucuauccggcgucgaaggggaaggccuucacaaauugggcuacauccuacgcgaugugagcaagaaggagggaggcgccauguaugcggaugacacugcggggugggacacucgaaucacccuggaggauuugaagaacgaagagauggugacuaaccacauggaaggugagcacaagaagcucgccgaggcuaucuucaaguugacuuaccaaaauaaggucgugcgcgugcagcgaccgacaccccgcgguaccgucauggauaucauuagccgccgcgaccaacgcgguuccggccagguggggaccuacggccugaacacuuucaccaacauggaggcccaguugauccgccagauggagggggagggcguguucaagaacauucaacaccugacggucaccgaggagguggcagugcagaacuggcuggcgcgggucggacgcgagcgcuuaagcagaauggccaucagcggggacgacugcgucgugaagccccuugacgaccguuucgccaacgcucuuacagcccucaacgacaugggcaagauuaggaaggauauccagcagugggagcccagcaagggguggaacgacuggacucagguacccuucuguucccaccacuuccacgaacugaucaugaaggauggccgcguucuggucguuccaugucggaaucaggaugaacucaucggucgagcccggauuagccaaggggccggauggucccugcgcgagacugccugccucggcaagucuuacgcccagauguggucccucauguacuuccacaggcgcgaucugaggcuggccgcgaacgcgaucuguucugccgugccaucgcacuggguccccacgagucgcacgaccugguccauacaugccaagcaugaauggaugacaaccgaggauauguuaacugucuggaaucggguuuggauccgugaaaacccguggauggaggacaagacgcccguagagagcugggaagaaauccccuacuuagggaaaagagaggaccaguggugcggcucccugaucgggcucaccagcagggccaccugggcgaaaaacauucaggccgccaucaaccagguuagguccuugauagguaacgaggaauacacugauuauaugcccagcaugaagcgcuuucggagggaggaagaggaagccggugugcugugguga

SEQ ID NO: 25354 - RNA, 9876 nt, Artificial Sequence
  derived and/or modified CDS sequence (opt11) from DENV-2__FJ410259__SS-prME
uccgccgggaugaucaucaugcucaucccuacggugauggccuuccaucuuaccacgcggaauggggagccccacaugaucguggggauucaggagaagggcaagagccugcuguuuaaaacagaggacggugugaauaugugcacccucauggcaauggaccugggggaguugugcgaggauacgauaaccuauaagugcccucuacuccgccaaaaugagcccgaagacaucgacugcuggugcaacucaaccucuacaugggugacguacggcacgugcaccaccaccggcgagcaccgccgggagaagcgcagcgucgcacucguuccacacgucggcaugggccucgaaacacggacugagaccuggauguccagcgagggggcuuggaagcacgcccagcgcauagagaccuggauacugcgucacccggguuucacgaucauggcagcgauccuggccuacaccauagggaccacccauuuccaacgcguccuuaucuucauacuacugacggccguugcucccuccaugaccaugcgguguaucggcaucucgaaccgcgacuucguggagggcguguccggggguagcuggguggacauugugcucgaacacgguagcugcgucaccaccauggcgaaaaacaaacccaccuuagacuucgagcugauaaagaccgaggcaaagcagccugcgacccuucggaaguacugcaucgaggccaaacugaccaauacgacuacagagucccgcugcccgacccaaggggaacccucucucaaagaggagcaggauaagcgguucgugugcaagcacucuaugguggaucguggcugggggaacggcugcggacuauucggcaagggggggaucgugacaugugccauguucacaugcaagaagaacauggaaggcaagaucgugcagccagaaaaccuggaguacaccaucguggucacgccucacucuggggaggagcacgccgugggaaacgauacgggaaagcauggaauggaaaucaaggugaccccacagucauccaccaccgaggccgagcugacaggauacggcacagucaccauggagugcagcccccggaccgggcucgauuucaacgagaugguguuacugcagauggagaauaaggccuggcucgugcaccgacagugguuccuagaccugccucucccguggcugccgggggcagacaaacaggaguccaacuggauccaaaaagagacgcuggucacguucaagaacccccacgccaagaagcaggacguagucguguugggcagucaggaaggggcgaugcacaccgccuugaccggcgccacagaaauccagaugagcucggggaaccuccuguucacggggcauuuaaagugccgguugaggauggacaaacuccaguugaagggaaugagcuauagcaugugcaccgggaaguucaaaguggugaaagagaucgccgaaacccagcacggaaccaucgugauccgggugcaauaugagggggacggaaguccgugcaaaaucccauuugagaucauggaccuggagaagcgcuacguccucggccggcugaucacggugaauccgaucgugaccgaaaaggacaguccggucaauaucgaggcagagccgcccuucggggacagcuacaucauaauuggcguggaaccggggcagcugaaguugaacugguuuaaaaaggguuccucgauaggccagauguuugaaacgaccaugcgcggcgccaagcgcauggcuauccugggcgauaccgccugggacuuugguagucucggcgggguauucacaagcauuggcaaggcccuacaccagguguuuggggccauauauggcgcggcguucuccggcguguccuggaccaugaaaauacuuaucgggguuaucaucacguggaucggcaugaacucccggagcacgucucuaagcgucucccuuguuuuaguggggaucguaacccuguaccugggcguaaugguccaggccgauagcgggugcguugucuccuggaagaauaaagagcugaagugcggcucuggcauuuucaucaccgacaaugugcacaccuggacggaacaauacaaguuucaacccgagagccccuccaaacuugccucggcgauucaaaaagcccaggaggagggcauuugcggcauccgcucagucaccagacuggagaaucuaauguggaagcagaucaccccagagcugaaccacauucuggccgaaaaugaggugaagcucacuauaaugaccggcgacauccgaggcauaaugcaggcagggaagcgaagucugcgaccgcagccuaccgaacugaaguacuccuggaagaccuggggcaaggccaagaugcucagcaccgaguccuacaaccagacguuccugaucgacggccccgaaacugcugagugcccgaacaccaaccgggcuuggaacagccuggagguggaagauuacggguucggcguauucaccaccaacauauggcucaagcuaaaggagaagcaggacgcauucugcgauuccaagcugaugucagccgccauuaaggauaaccgcgcggugcacgccgauaugggguacuggaucgagucagcccucaacgauacauggaagaucgagaaggccuccuucauugaggugaagaacugccauuggcccaagagucauacccuguggagcaacggcguccucgaauccgaaaugaucauuccuaagaaccucgccggccccgugagccagcacaauuaccggccgggguaucacacccagaucgcgggcccuuggcaucuggggaaguuagagauggacuucgacuucugcgacgggacaacgguaaucgucaccgaggauugcgggaaccgcggccccagucucaggaccaccacugccagcggcaagcugauuaccgaauggugcugucgcuccuguacgcugccuccccuccgguaccgcggcgaggauggcugcugguaugggauggagauccggccccugaaagagaaggaggagaaccuugucaacucacucguaaccgcaggucacgggcaagucgauaauuucagccugggcgugcugggcauggcccucuuuuuggaagagaugcugcgcacacggguagggaccaaacacgcgauucuccuggccgccgugucguuuguuacucugauaacuggcaauaugucguucaaggaucuggggcgcguggucgugaugguaggcgccacgauggcggaugacaucgggauggggguaacguaucuggcgcuguuagccgccuucaagguucgaccuacauucgccgccggccugcugcuucguaagcugaccucgaaggagcuaaugaugacgacuaucgggaucgugcuccucagccagagcacgauccccgagaccgugcuggagcucacggacgcgcuggcucugggcaugauggugcuaaagaucgugcgcaacauggagaaauaucagcuggcggucacuaucauggccauacuguguguucccaacgccguuauccugcagaacgcauggaagguaucaugcacaaucuuggcuguggucuccguaagccccuuacuccugaccucuagccaacagaaaacggauuggaucccucuagcccucaccaucaagggccuuaaucccaccgccaucuucuuaaccacgcucucccggacaaacaaaaagcgcagcuggccucuaaacgaggccaucauggcgguggguaugguguccauccuggccagcucccuccugaagaaugauauccccaugaccggccccuuaguugcugggggucuccugacggugugcuauguguugacgggucggagcgccgaccucgagcucgaacgggcuacugacgugaagugggaggaccaggccgagauaucaggcagcucaccgauucuguccaucaccauuagcgaggacgguuccaugagcauaaagaaugaggaggaagagcagacccucaccauucugauacgcacaggccugcucguaaucuccggccuguuuccgaucagcaucccaauaaccgccgccgcaugguaccugugggaggucaagaagcagcgcgcgggugugcucugggaugugccgagcccgccgcccauggggaaggccgagcuggaggauggggcauaccggaucaaacagaaagggauccugggguacagccagauaggagccgguguuuacaaggaggggacuuuucacaccauguggcacgugaccagaggcgccgugcucaugcacaaggggaaacggaucgagcccucaugggcggacgucaaaaaagaccugaucagcuauggcggaggcuggaaguuagagggcgaauggaaggagggugaggagguacagguacucgcccuggaaccagguaaaaacccacgcgcaguucagaccaagccgggucuuuucaaaaccaacaccgggacgaucggugcuguaucucuagacuuuucgcccggcaccaguggcucucccauuaucgacaagaagggaaaaguagugggacuuuacggaaacgggguugugacccggucaggagccuacgucagcgcuaucgcccagacugagaaguccaucgaggauaaccccgagaucgaggacgacaucuuccguaagcgucgccugacgaucauggacuugcaccccggggccgguaagaccaaacgguacuugccugccauaguacgcgaggcaaucaagagggggcugcgaaccuugauccucgcgccuacccggguagucgccgcugagauggaagaggcuuuacgcggccugccuaucagauaccagacgccugcuauccgcgccgagcacaccgggcgagagaucguggaccucaugugucacgccaccuucaccaugcggcugcugagcccugugcgcguuccgaauuacaaucucaucauaauggacgaggcccacuucacggacccugcaucuaucgcggcccggggauacaucucuacccgaguugagaugggcgaagcagccgggauuuuuaugaccgcuacgccgcccggcucgcgggauccauucccgcaguccaacgcgcccaucauagacgaggaacgggaaaucccugagcggaguuggaacuccggucaugagugggucacugauuucaagggcaagaccgucugguucgugccgucaaucaaagccggcaacgacaucgcggcuuguuugcguaaaaacggcaagaaggugauccaacucucccggaaaaccuucgacagcgaauacgucaagacccggacgaaugacugggacuucguggugaccaccgauaucuccgagaugggagcgaauuucaaggcggaacggguuaucgacccacgccgcugcaugaagccaguaauccugaccgacggggaggagcgcgugauccuagccggacccaugccgguaacacacagcuccgccgcccagaggcgcggacggauaggccgaaaccccaagaacgagaacgaccaguacaucuauaugggugaaccccuagaaaacgacgaggacugugcgcacuggaaagaggccaagaugcucuuagacaacaucaacacccccgaggguauuaucccuucuauguucgagcccgagcgggagaagguggacgcaaucgauggugaauaccgccugcgcggggaggccaggaagacuuucguggaccuaaugcgccgcggggaccugccagucuggcuggccuauaagguugcggcggaggggauuaacuacgccgaccgccgauggugcuuugacgggaucaagaacaaccagauccuugaggaaaacguggagguggagaucuggacgaaggaaggagagcggaaaaaauuaaagccgcgcugguuagacgcccgcaucuacuccgacccucucgccuuaaaagaguucaaggaguucgcagcagggcggaaaucccugacucucaaccugauaaccgagaugggacgccugcccaccuuuaugacccagaagacgcgggacgcccuagacaaccuggcugugcugcauaccgcagaggcaggaggucgcgcauauaaccacgcccuauccgagcugccggagacguuggagacccuccugcugcucacguuacuggccaccgucaccgggggcauauuccuguucuuaaugaguggccgggggaucggcaagaugacccugggcauguguuguauuauaaccgcguccauccuccugugguacgcccagauacagccucacuggaucgcugccuccauuauccuggaguucuuucucauagugcuacugauccccgagccugagaagcagcgcacgccucaggauaaccagcugacguacguggucaucgccauucugaccguaguggcugccaccauggccaaugagauggguuucuuggagaagacaaagaaggaccuugggcugggcaguauugccacccaacagccggagagcaacauccuagacaucgaccuccggcccgccuccgcguggacccuguaugccgucgccaccacguucgugacccccaugcugcggcauuccauugagaacagcuccgugaacgucuccuuaaccgccaucgcgaaccaagcuacaguccugaugggacuggguaaaggcuggccacucuccaagauggacaucggggugccucuguuggccaucggguguuauagccagguaaaccccaucacgcucaccgcagcgcuguugcuccugguggcgcacuacgccaucauuggacccggccugcaggcgaaagccacccgggaagcccagaagcgggcggccgcuggaauaaugaagaaccccaccguagacgggauuacgguaaucgaucuugacccgaucccguacgacccuaaguucgagaagcaguuaggccaagugaugcugcuuauccugugcgucacccaaguacucaugaugcggaccacgugggcccucugcgaggcccuaacgcuggcgaccgggcccauauccacccucugggaagguaacccggggcgcuucuggaacaccacgaucgccguaagcauggcaaacaucuuucggggaucuuaccuggccggcgccggucuccucuucuccaucaugaagaacacuaccaacacccgccgaggcacgggcaacaucggcgaaacccugggcgagaaguggaaaucacgccugaaugcgcucggcaagucugaguuccagaucuacaagaaguccggcauccaggaaguggaucggacccucgccaaggaggggaucaagcggggcgagacagaccaucaugcgguuagccgcgguuccgccaaacuucgaugguuuguggagcgcaacaugguaacgccagaaggcaaaguuguggaccucggcugugggcguggcggguggucuuauuacuguggcgggcuuaagaacguccgugagguaaagggccugaccaagggugggccgggacacgaagagccaaucccaaugucaaccuacggguggaaccucgugcgguuacaaagugggguagacguguucuucaucccgcccgagaagugcgacacucugcugugcgacaucggcgagucuagcccgaaccccacgguggaggcgggcaggacacugcggguccugaaccuagucgagaacuggcugaacaacaacacgcaauuuugcaucaaaguuuuaaaucccuacaugcccuccgugaucgagaaaauggaagcccugcagcgcaaauaugggggggcucucguccggaacccgcucagcagaaacagcacccacgagauguacugggugucaaacgccucgggcaacaucgugucgagcgugaacaugauaucuaggaugcugaucaaccgcuucaccaugcggcacaagaaagccacuuaugagccggacguagaccucggaagcggcaccaggaacaucgguaucgaguccgagauucccaacuuagacaucauaggcaagcggauagagaaaauuaagcaggagcaugagacgagcuggcauuacgaccaagaccauccguacaagaccugggcauaccacggguccuacgagaccaagcaaacugggagcgccuccuccauggugaacggcgucgugcgccugcucaccaagccaugggaugugcuacccacggucacgcaaauggccaugaccgacacuaccccauuuggucagcagcgcgucuuuaaggagaagguagacacgcgaacccaggagccaaaggagggcacuaagaaacugaugaagaucacagccgaguggcucuggaaagagcugggaaagaagaaaacaccucgcaugugcacccgcgaggaguucaccagaaagguccggucgaacgccgcccugggggccauauucacggacgaaaacaaguggaaauccgccagagaggcaguagaggacucccgguucugggagcucguggacaaggagcgcaacuuacaccuggagggcaagugcgagacgugcguauauaacaugauggggaaacgggaaaagaagcucggagaguucgggaaagcuaaagggucgcgcgccaucugguacauguggcucggagcucgguuccuggaguucgaggcacucggguuucuaaaugaggaccauugguucagccgagaaaacagccucuccggaguugagggugagggccuccacaaacugggguacauauugcgugaugugucaaagaaagagggcggugccauguaugccgacgacacugcugggugggauacgaggaucacacucgaggaccugaagaaugaggaaaugguuacgaaccauauggagggcgagcacaagaagcuggcugaggccaucuucaagcucacguaccagaacaaagugguucggguccagagacccaccccccgagggaccgugauggacaucauuagccguagggaccaacgcgguuccgggcaagucggcaccuauggguuaaacaccuuuaccaacauggaagcucaacugauacggcagauggagggggagggcguguucaagaauauucaacaccugaccgugacggaggaggucgcggugcauaacuggcuggcccgcguggggcgggagcgacugagccgcauggcgaucuccggggacgacugcgucgucaagccccucgacgaccgguucgccaacgcccugaccgcgcugaacgacaugggcaagauccgcaaggacauacagcagugggaaccaagcaagggguggaacgacuggacgcaggugcccuucugcucccaccacuuccacgagcucauuaugaaagacgggcgaauccuggucgugcccugccgcaaccaggaugagcugaucgggcgggcccggaucagccagggcgccggguggucccuccgggagaccgccugccugggcaagaguuacgcccaaaugugguccuugauguacuuccaccgucgugaccuccgacuggcggccaacgcaaucugcucagccgucccuucccauugggucccgacgagcaggaccacaugguccauucacgccaagcacgaguggaugaccaccgaggacaugcugacgguguggaaccgaguuuggauuagagaaaacccauggauggaggacaagacccccgucgaaagcugggaggagaucccuuaccucggcaagagagaagaccaguggugcgggucccugaucggccugaccucgagagcgacgugggccaagaauauacaagcugcgaucaaccaagugcgcucucucaucgggaacgaggaauacacggacuacaugcccucaaugaaacgguuucgacgcgaggaggaagaggcgggcguucugugguag

SEQ ID NO: 25355 - RNA, 9876 nt, Artificial Sequence
  derived and/or modified CDS sequence (opt11) from DENV-2__FJ547067__SS-prME
ucggcugggaugauaaucaugcuuaucccaaccgugauggccuuccaccucaccacccggaacggcgagccucacaugaucgucgggauccaagagaaaggaaaaagccugcuuuucaaaaccgaggacggcgugaauaugugcacguuaauggcgauggaccugggggaauuaugcgaggacacuauuaccuacaagugccccuuacugcggcagaacgagcccgaagacauugacugcuggugcaauagcaccaguaccugggugaccuacgggacuuguaccacuaccggcgagcaccgaagggaaaagcgcuccguggcccuggucccucauguggguaugggccucgagacgcggaccgagaccuggauguccagcgagggggcuuggaagcacgcccaacgcaucgagaccuggaucuugcgucacccgggcuuuacgaucauggccgcgauccuggcguauaccaucgggaccacucacuuccagaggguccucauuuucauccuucugacggccguggcccccuccaugaccaugcggugcaucggcaucagcaaccgcgacuucguggaaggugucuccggcgggucuuggguggauauagugcucgagcacgggagcugcguaaccaccauggcgaagaacaaacccacucuugacuuugagcugaucaagaccgaggccaagcagcccgccacccuccggaaauauugcaucgaggcaaaguuaacuaacacgaccaccgagagccgcugcccuacccagggggagccgucccuuaaggaagaacaggacaagcgguucguuugcaaacauagcaugguggaccgcggcugggggaacggcugcggccuuuucgguaaaggcgggaucgugacgugcgccauguucacguguaagaagaacauggagggcaagaucgugcagcccgagaaucuggaguacaccaucgugguaacgccucacuccggcgaggagcacgcugugggaaacgacacggggaagcauggccaggagauaaaggugacaccccaaagcucuaucacggaggcagagcugacuggcuacggcaccgucacgauggaguguagcccccggaccggccucgacuucaacgagauggugcugcugcagauggagaacaaggccuggcuggugcaccgucagugguuucucgaccugccccucccuuggcucccgggggcagacaaacaagaauccaacuggauccaaaaggagacccugguuaccuucaagaacccucacgccaagaaacaagacguagucguccugggaagccaggaaggagcaaugcacacggcccuaacgggugcgaccgagauccagaugagcucugggaaccuucuguucacgggccaucugaaaugccggcugcgcauggacaaacuccagcugaagggcaugagcuacuccaugugcacggggaaauuuaagguugucaaggagaucgccgagacccagcacggaaccaucgugauccgggugcaauacgagggggacggcucucccugcaagaucccguuugaaaucauggaucuggagaaacgguacguccuaggccgguuaaucaccgugaacccgaucgugacagagaaggacagucccgucaacaucgaggccgagccgccauucggggacagcuacaucauuaucggaguggagccagggcaacugaagcucaacugguuuaagaagggcucgagcauaggacagauguucgagaccacuaugcggggcgcgaagcgcauggccauccuaggcgacaccgccugggauuucggcucccucggcgggguauucacaagcaucggcaaggcccugcaccaggucuuuggugccauauacggcgcggccuucuccggagugagcuggaccaugaagauccugaucggcgugauaaucaccuggaucggaaugaacucgagaagcaccucccuaagcguuuccuuggucuugguggggauugugacguuauacuuaggcgugaugguccaggccgauagcgggugcguagugucuuggaaaaauaaagagcucaagugcggcagcggaauuuucauuaccgacaacgugcacaccuggaccgaacaguacaaguuccaacccgagucacccuccaaacuggccagcgcgauacagaaggcacaggaggaagggaucugcgguauucgauccgucacucggcuggaaaaccucauguggaagcagaucacccccgagcugaaccacauccuggccgagaacgaggugaagcucaccaucaugacgggcgacaucaagggcaucaugcaggccgggaagcgcucccuucggccgcagcccacggaguuaaaauacuccuggaagacuuggggcaaggccaagaugcucagcaccgaguccuacaaccagaccuuuuuaauagacggcccugagacggcggaaugcccgaauaccaaccgcgccuggaacucccuggaggucgaggacuauggguucggcgucuucaccaccaauauaugguugaagcuaaaggagaagcaggacgccuuuugcgacuccaagcugaugagcgccgccaucaaggacaaccgggccguucacgccgacaugggcuacuggaucgagucggcacucaacgacacguggaagaucgagaaagcgucuuucaucgaagugaagaacugccacuggcccaagucccacacccuguggagcaacggaguccuggagagcgagaugaucauccccaagaaccuagcuggccccgugagccagcacaacuaccgcccgggguaccauacccagaucgcgggacccuggcacuuagggaaacuggaaauggacuuugacuuuugcgaugggaccaccgugaucgucacggaggacugcgggaaucguggccccagccuccgcacaacaaccgcauccgguaaacuuaucacggaauggugcugucggagcugcacgcugcccccgcucagguaucgcggggaagacgguugcugguacgggauggagauaagaccccugaaggagaaggaagaaaaccuagugaacucccucguuaccgcgggccacggacaggucgacaauuucucccugggcgugcuaggcauggccuuguuuuuagaggagaugcugcggacgcgcgucggcacuaagcacgcgauccuccuggucgccaucuccuucguuacccugaucacaggcaacauguccuucaaggaccucggucggguugucgugauggugggcgccaccauggccgacgacaucgggaugggcgucacguaccuggccuuacucgcugccuucaagguacgucccaccuucgccgccggccugcugcuccggaagcugacauccaaggagcugaugaugaccacgaucgggaucguguugcugagccaguccacaauccccgagaccguccuggagcuaaccgacgcccuggcgcugggcaugaugguacucaagaucgugcgcaacauggaaaaguaccaacuggccgucacgaucauggccauccugugcgugccgaacgcuguuauacuccaaaacgccuggaaagucuccugcaccauccucgcggcuguuuccgucucucccuuacucuuaaccuccagccagcagaagaccgacuggaucccccucgcccucaccaucaagggcuugaaccccaccgccauuuuccugaccacccucagccgcacgaacaagaaacggagcuggccgcugaacgaggcgaucauggcagugggcaugguguccaucuuggccagcucccugcugaagaaugauauuccaaugaccggcccccuggucgccgggggccuacugaccgugugcuaugugcugaccggacgcagcgccgaccucgagcuggagcgggcgacggaugucaagugggaggagcaggccgagauauccggcucuagcccaauccuguccaucacgaucagcgaagacggguccaugagcaucaagaacgaggaggaggagcaaacucucaccauucugauccgcacgggccugcucgugaucuccggccuauucccgauaagcaucccaauuaccgccgcagccugguaccugugggaggugaagaagcagcgggcggggguccucugggacgugcccucaccgccgcccaugggcaaggcugagcuggaggauggagccuaccgcaucaagcagaagggcauccugggauacagccagaucggugcgggcguguacaaagaggggaccuuccauaccauguggcaugugacucggggagccgugcucaugcacaaggggaagcguaucgagccuuccugggcggacgugaagaaggaucugaucagcuacgguggaggcuggaagcuggagggcgaguggaaggagggcgaggagguccaggugcucgccuuggagcccggcaagaacccccgggccgugcagacgaagccagggcuguucaagaccaacaccggcaccaucggggcugugagucuugacuucagccccggcacguccggcagccccaucaucgauaagaagggcaaggugguggggcuguacgggaacggcgucgugacccgcuccggcgccuacguuagcgcaaucgcccagaccgagaaguccauagaggauaauccugagaucgaagacgacauuuuccggaaacgccggcuuacuaucauggaccugcaucccggggcuggcaagacgaaaagguaucucccggccaucguccgagaggcgaucaagcgcggguuaagaacccugauauuggccccaacccgcgugguugccgccgagauggaggaggcccugaggggccugcccauuagauaccagacccccgcgauccgagccgagcacacggggcgcgagaucgucgaccugaugugucaugcuaccuuuaccaugcgccugcugagccccgugcgggugccgaacuacaaccucaucauuauggaugaggcccacuuuaccgaccccgccucgaucgcggcccgcgguuacaucagcacgcgcgucgagaugggcgaggccgccgggaucuucaugaccgcuacaccgcccggaagccgcgacccauucccccaauccaacgcgccuauuaucgacgaggagcgggagauccccgagcgcagcuggaacagcgggcacgaaugggugaccgauuucaaggguaagacggugugguucgucccaucuauaaaggccgggaacgacaucgccgccugccuccguaagaacggcaagaaagucauccagcugucacgcaagaccuucgacucagaauacgugaaaacgcggaccaacgacugggacuucguggugaccaccgacauauccgaaaugggcgcgaacuucaaggcggagagagugauugauccccggcgaugcaugaagcccguaauauuaaccgacggugaggagcgggugauacuggccggcccaaugccggugacccacagcagcgccgcucagcgccgugggcgcauuggccggaaccccaagaacgagaacgaccaguacauuuacaugggggagccgcuggagaacgacgaggauugcgcgcacuggaaggaggccaagaugcuccucgacaacaucaacacgccugagggaauaaucccgagcauguucgagcccgaaagggaaaaagucgacgcuaucgauggcgaauaccgccugagaggggaggcccgcaagaccuucgucgaccucaugcggcguggggaccugcccgucugguuagccuacaagguugcggccgaggggauaaacuacgccgaccggcgcugguguuucgacggcaucaagaauaaccaaauccucgaggaaaacguggagguugaaauuuggaccaaggagggggagcgaaagaaacugaagccgcgcuggcuggacgcccguauuuauucagacccccuggcucugaaggaguuuaaggaguucgcggccggccgcaagucacugacccucaaccugaucacggagaugggccggcugcccaccuuuaugacccagaaaacccgcgacgcccucgacaacuuagcaguccugcacacggcggaggccgggggccgggccuacaaccacgcccucuccgagcugcccgagacucuggagacccuccugcuccucacucuacuggccacaguuaccgggggaaucuuccucuucuuaaugucaggccguggcaucggcaagaugacgcuggggaugugcugcauuaucacugcgucuaucuugcugugguacgcccagauccagccgcacuggaucgccgccagcauuauccuagaguucuuccucauaguccuauugaucccagagcccgaaaagcagagaacuccucaagacaaccagcucacguauguggugauagccauccugaccguugucgcggccaccauggccaaugagaugggcuuccuggagaaaaccaagaaggaccucgggcugggcucuaucgccacccagcagcccgagagcaacauccuggacaucgaccuccgacccgccuccgcuuggacccuguaugccguggcuaccaccuucgucacgcccaugcugcgccacagcaucgagaacagcuccgugaacgugagccucaccgcuaucgcgaaccaggcgaccgucuuaaugggccucggaaaggguuggccccucuccaagauggacauuggggucccacugcuggccauaggcugcuacagccaggugaaccccaucacccucacggccgcguugcugcuccuggucgcgcacuacgccauuauagggcccggccuacaggccaaggccacccgugaagcccaaaagcgggcggccgccggcaucaugaagaaccccaccguagacgggaucaccgugaucgaccucgacccgaucccauacgaccccaaguucgaaaagcagcugggucaggucaugcugcucauccugugcgugacccaggugcugaugaugcgcaccacuugggcacucugcgaggcccugacccuggcgacgggucccauuuccacccucugggagggcaacccugggcgauucuggaauaccaccauugcagucucuauggccaacaucuuccgcgggucauaucuggccggcgccggucugcuauucagcauuaugaagaacacgaccaacacacgacggggcacuggaaacaugggugagacacugggagagaaguggaagucucgcuuaaacgcgcucggaaaguccgaguuccagguguauaagaaauccggcauacaggaaguggaccggacccuggccaaagaggggaucaagcggggcgagaccgaccaccacgccguaagccgggguagugcgaagcugcgcugguucguggaacggaacauggugacacccgagggcaaagucgucgaccuaggcuguggacgaggcggguggagcuauuacuguggcgggcugaagaacgugcgggagguaaagggccuaacgaagggugggcccggccacgaggagcccaucccgauguccaccuacggguggaaccuugugcgcuugcaaagcgggguggacgucuucuucaucccgccggagaagugcgacacccugcucugcgacaucggggaguccagccccaaccccaccgucgaggcgggccggacgcugagggugcugaaccucgucgagaacuggcugaauaacaauacucaguucugcaucaagguccuuaaucccuacaugcccucagucaucgagaagauggaggccuuacaacggaaguacggcggagcucuaguccgcaacccguugucacggaacucaacccacgagauguacuggguguccaacgccagcggcaacaucgucucuagcgucaacaugaucucccgcauguuaaucaaucgguucacaaugcgccacaagaaggcaacguacgagcccgacguggaccuugguagcggcacgcggaacaucgggaucgaauccgagaucccuaaccuggacauaaucggcaagcggauugagaagaucaaacaggagcacgagaccuccuggcacuacgaccaggaccaccccuauaagaccugggcguaccacggcuccuacgagaccaagcagacgggcagcgccuccucgauggugaacggcguggugagacuucucaccaagccgugggacguccugccgacugugacccagauggccaugacggacacuacccccuucgggcagcaacgcgucuucaaggaaaaaguagacacccgcacacaagagcccaaggagggcacgaagaaguugaugaagauuaccgccgaguggcucuggaaggagcugggccgaaagaaaacaccgcgcaugugcacacgugaagaguuuacaaggaaagugcgguccaacgccgcguuaggggccaucuucaccgacgaaaacaaguggaaauccgcccgcgaggccguagaagacuccagguucugggagcucguggauaaagagcgcaacuugcaucuggagggcaagugugagaccugcgucuacaacaugauggggaagcgggagaaaaagcucggcgaguucgguaaggcaaaaggcagccgcgccaucugguacauguggcuaggcgcgcgguuccuggaguucgaagcccucggguuucugaacgaggaccacugguuuucacgcgagaacucacugucaggcguggagggagaaggccugcacaaacugggcuauauccugagggacgucagcaagaaggagggcggcgccauguacgcggaugacacugcggggugggacacccgcauuacccucgaggaccugaagaacgaggaaauggugaccaaccacauggagggcgagcacaagaagcuggccgaggccaucuucaagcucaccuaucagaauaaagugguucgggugcagcgccccacgccccgggggacggugauggacaucaucucccgccgggaccagcggggcuccggucaggucggcaccuacggccugaacacuuucaccaauauggaggcccagcuaaucaggcagauggagggggaaggcguguucaagucuauccagcaucucacagucacugaggaagucgcgguacagaacuggcuggcccgcguggggcgugagagacuguccagaauggcaaucagcggcgacgauugugucgucaagccccuagacgaccgguucgcgaacgcccugacggcgcugaacgacaugggcaagauacgcaaggacauccaacagugggagccuuccaagggguggaaugacuggacucaggugcccuucugcucgcaccacuuccacgagcucaucaugaaagacggacgcguccucguggugccaugccgcaaccaggacgagcugaucgggcgggcccgcaucucccagggggcgggguggucuuugcgggagacagccugucuggggaagucauaugcccagauguggagccugauguacuuccaccgccgagacuuacgccuagcugccaacgcaaucugcuccgccgucccgagccauugggugccaaccucacgcacuaccuggagcauucacgccaagcaugaguggaugaccaccgaggacaugcugaccguguggaaccgggucuggaucagggagaaccccuggauggaagauaaaacgcccguggagagcugggaggagauccccuacuuagguaagcgcgaagaucaguggugcgggagccucauaggccugaccagccgggcuaccugggcuaaaaacauacaggcggccaucaaccaggugaggagccucaucgggaacgaggaguacaccgacuauaugccgucuaugaagcgguuccgccgcgaagaggaggaggcgggcguccuaugguaa

SEQ ID NO: 25356 - RNA, 9876 nt, Artificial Sequence
  derived and/or modified CDS sequence (opt11) from DENV-2__JN819418__SS-prME
accgcuggggugaucauaaugcugauacccaccgccauggcguuccaccucaccacccguaauggugaaccccauaugaucgucggucggcaggaaaaggggaagucccugcucuucaagaccgaagauggcgugaacaugugcacgcucauggcuaucgaccugggcgaguugugcgaggauaccaucaccuauaaaugcccccuacugcggcagaacgaaccagaggacaucgacugcugguguaacucgacuucgacgugggugaccuacgggaccugcacaacgacgggcgaacaccggagagagaaacgguccguugcccugguuccccacgugggcaugggcuuagagacgcgcacagagaccuggaugaguagcgagggggccuggaagcacguccaacggaucgagaccuggauccuucggcacccgggauuuacaauaauggccgcgaucuuggcauacacgauugggaccacgcacuuccaacgggcgcugaucuucauccuacucacugcuguggccccguccaugacgaugcgcugcaucggcaucaguaaccgggacuucguggagggugucagcggggguuccuggguggauauugugcucgagcacggcagcugcgucaccaccauggcaaagaauaaaccuaccuuggacuuugaacugaucaagaccgaagcuaagcaacccgcaacccuccgcaaguauugcaucgaagcgaaacugacuaauacaaccacugagucccguugcccuacgcagggcgagcccucccugaacgaggagcaggacaagagguuugugugcaagcacaguaugguagaccggggcugggggaacggaugcggccucuucggcaagggcgggauaguaacaugugcgauguuuacgugcaagaagaacauggagggcaaggugguucuacccgaaaaccuggaauacaccauugucauuacuccccacagcggggaggagcacgccguuggcaaugacacggggaaacacggcaaagagaucaagaucaccccccaauccucuaucaccgaggccgagcucaccggguacggcacggugaccauggagugcagcccaagaaccggccuggauuuuaacgagaugguccuccuccagauggaggauaaggccuggcuggugcaccggcagugguuccuggaccugccccuacccuggcugccgggggccgacacccagggaagcaauuggauccagaaggagacgcuagugacguucaagaacccccacgcgaagaaacaggaugucguuguccuuggaucccaggagggggcgaugcacaccgcccugaccggggcaacugaaauucagaugagcagcggcaaccuccuauucaccgggcacuugaagugccgccugcggauggacaagcuucagcugaaagguaugucguauagcaugugcacaggcaaguuuaagauuguuaaagagaucgccgagacacagcacggcacgaucgugaucaggguccaguacgagggcgacggcucacccugcaaaauccccuuugaaaucauggaccucgagaagcgacacguguuggggcgcuugaucaccgugaacccgaucgucaccgagaaggauagccccgucaacaucgaagcggagccacccuucggcgacucguacauuauuauagggguggagccgggccagcucaagcuuaacugguuuaagaaggggagcucaaucggacagauguucgagaccacgaugcgaggugccaagcggauggccauccugggggacaccgccugggacuucggcagccuggguggggucuucaccuccauugggaaagcccugcaccaaguguuuggcgcaauuuauggugccgccuuuagcggagugucauggaccaugaagauacugaucggagucaucaucacuuggaucgggaugaacagcagauccacuagccucagcgugagccucguguuaguaggcguggugacgcuguaucucggugcuaugguccaggcugacaguggcugcgucguguccuggaaaaacaaggaacugaaguguggauccgggaucuucaucaccgauaacguccacacguggaccgaacaguacaaauuucagcccgaaagccccagcaagcuggccucagccauccagaaggcccacgaggagggcauaugcgggauccgaagcgugacccgccuggaaaaccugauguggaagcagauaacccccgaauuaaaucacauacucucugagaacgaggugaagcugacgaucaugaccggcgacauuaaggguaucaugcaagcuggcaaaaggagcuugcgcccucagcccaccgagcuuaaauauuccuggaagacguggggcaaggcgaagaugcucucaaccgagucccacaaccagacuuuccugauagacggccccgagaccgccgagugcccgaauaccaaccgggccuggaacagccucgaggucgaggauuacggcuucggaguauucucuaccaauaucuggcuaaaacugagagagaaacaggauguauucugcgacagcaagcucaugucugccgcuaucaaagacaaccgagcgguccaugcagacaugggcuacuggaucgagucagcccucaacgacacguggaagauggaaaaggccuccuucaucgaagucaagagcugccacuggccgaagucccacacccuuugguccaacggcgugcucgaguccgagaugaucaucccaaaaaauuucgcagguccuguuucgcagcauaacuauagaccgggcuaucauacgcaaacggcugggcccuggcaucuggguaagcuggagauggacuucgacuucugcgaggggacgacgguuguggucaccgaggacugcggcaaucgcggucccucacuacgcacgacgacggccuccgggaagcugaucacagaauggugcugccggagcugcaccuugcccccucuccgcuaccggggugaggacgguuguugguacggcauggagauucgcccccugaaagagaaggaggaaaaccuggugaacuccuuagugacggccggccauggccagaucgacaacuucagccucgggguauuagggauggcccuuuucuuagaggagaugcugcgaacccgugugggcaccaagcacgcgaucuuacugguggccguauccuucaugacccugaucacugggaacaugagcuuccgggacuugggccgggucauggugauggucggcgcuacuaugaccgacgacaucggcaugggcgugaccuaucuggccuugcuugccgcauuuaaggugcgccccacguucgccgccggacugcuacuucgcaagcugaccuccaaggagcugaugauggccacuauuggcaucgcccuccuuucacaguccaccauccccgagacuaucuuagagcucaccgaugcacuggcccuggguaugaugguccuuaaaaucguccgcaacauggagaaguaccaacuugcggugaccaucauggccaucagcugcguaccgaacgccgugauccugcagaacgccuggaaggugucauguaccauccucgccgcuguaucugugagcccccugcugcuaacgagcagccagcagaaggccgauuggaucccccuugcauugaccauuaagggccucaaucccaccgccaucuuucugaccacguugagccggaccuccaaaaaacguaguuggccgcucaacgaggcuauaauggccguaggcaugguguccauccuggccagcagccugcugaaaaacgauauccccaugacggggccccuaguggcggggggguugcugacgguauguuacgugcucacgggccggagcgcggaccucgagcucgagcgcgccgccgacgucaagugggaagaccaggccgagauuagcggauccucacccauccuguccaucaccaucucggaggacgggucaaugaguaucaagaacgaggaggaagaacaaacacugaccaucuuaauccggaccggccugcuugucaucagugggcucuucccagugagcauccccaucacugcggccgccugguaccugugggagguuaagaagcaacgcgccggcguacugugggacguuccaagcccuccgccuguugggaaggccgaacucgaggacggcgcguaucggauuaagcagaggggaaucuuaggcuacagccagauaggugcgggagucuacaaggaaggcacguuucacaccauguggcaugucacuagaggggcaguccugaugcaccgcgguaagaggaucgaacccuccugggccgaugucaagaaggaccucaucucauaugggggcggcuggaagcuggagggggaguggaaggagggcgaagagguccagguccuggcccucgagcccgggaaaaauccccgcgcuguccagacgaagccaggccuguucaagaccaacaccgguaccaucggcgccgucucguuggauuucucucccggcacgucgggaaguccaaucguggaccggaaaggcaagguuguggggcucuaugggaacggcguggucacucgcucgggggccuacgugucggcuaucgcucagaccgaaaaguccaucgaagauaacccggagauugaggacgacauauuccggaagaagcgccugaccaucauggaucuacaucccggcgccgggaagacgaagcgguauuugcccgccaucgugcgcgaggccaucaaacggggacugcgcaccuugauucuggcuccgacccgcgucguggcggccgagauggaggaagcgcuccggggccugcccauacgcuaccaaacgcccgccauccgggccgagcacacgggucgcgaaaucguggaccugaugugccacgcgaccuucacuaugcggcuccucucucccguucggguuccuaacuacaaucugaucauaauggacgaggcccacuucacagauccugccucuauugcugcccggggcuacaucucgacccgcguggagaugggagaggcggccggcaucuuuaugaccgccacgccgcccgggagccgagacccguucccccagaguaacgcccccaucauggaugaggaacgcgagauccccgagagaagcuggaacuccggccacgagugggucaccgacuucaaagggaagacggugugguucguuccgagcauuaaggcgggcaaugacauagcggccugucuucgcaagaauggcaaaaaggucauccaacuuucccgaaagaccuucgauucagaguacgugaaaacgcgcgcuaacgauugggauuuuguugucaccacggacauauccgagaugggcgccaacuuuaaggccgagcgggucaucgacccccggcguugcaugaagcccgugauccugaccgacggcgaggagcgagucauucucgccgggccaaugcccguuacccacagcuccgccgcucagcgucguggacgcauagggaggaaccccaagaacgagaacgaccaguacaucuacaugggcgagccccuggagaacgacgaggacugcgcacacuggaaggaggcgaagaugcugcuggauaacaucaauacaccagagggcaucauccccucaauguucgaacccgagagggagaaggucgacgccaucgacggcgaguauaggcugcgaggcgaggcccggaagaccuucgucgacuugaugcgccgcggggacuugcccguguggcuggcauaccgcguggccgcggaaggcaucaacuaugcagaucggcgcugguguuucgacgggaucaagaacaaccaaauccuggaggagaauguugagguggagaucuggacgaaggagggcgaacgaaagaagcucaagccgagguggcuagacgcccggauauauuccgauccccuggcucucaaggaguuuaaggaguucgcggccggaaggaagagucugacacugaaccucauuaccgagauggggcgucugccuaccuuuaugacgcaaaaggcccgcgaugccuuggauaacuuagccguccugcacaccgcggaggcuggcgggcgggcguacaaccacgcccuguccgaacucccagagacccucgagacgcugcuacuccucaccuuacuggccaccguuaccggcggcaucuuccuguuccugaugagcggcaagggcaucggcaagaugacgcugggcaugugcugcaucauuaccgcguccauccugcucugguacgcgcagauacaaccccacuggaucgccgccuccauuauacuggaguucuucuugaucgugcuccugauccccgaacccgagaagcagcgcaccccccaggauaaccaguuaaccuacgucgugaucgcaauccuaaccgugguggcggccacgauggccaaugagaugggguuccuggagaaaaccaagaaggaccugggacucgggagcaucaccacccaagaguccgagagcaacauacuggacaucgaccugcggccagccuccgcauggacgcucuacgccguggccacaacguucgugacgcccauguuacgccacucuauagaaaacuccagugucaacguaucccugacagcuauagcgaaucaagcaacuguacucaugggccuggggaagggguggccccuauccaagauggacaucggcgugccucugcuugccaucgggugcuacucccagguaaauccgaucacgcugaccgccgcgcuccucuuacucguagcccacuacgcgaucauuggccccggccugcaagccaaggccacucgggaggcccaaaaacgcgccgccgcagggaucaugaagaacccuacggucgacggcaucaccgugaucgaucuggaccccaucccguacgaucccaaguucgagaagcagcucggccaggucauguugcugauccucugcgucacacagguguugaugaugcgcaccacuugggcucucugcgaggcccucacccuggccaccggccccauaaguacccuaugggaggguaacccagggcgguucuggaacaccaccaucgcgguguccauggccaacauauuccggggcuccuaccucgccggcgccggucugcuguucucgauaaugaagaacacgacaaauacccggcgaggcacaggcaacaucggcgagacccucggggagaaauggaagucccggcugaaugcgcugggaaagucagaguuccaaauuuacaagaaauccgggauccaggagguugaucgaacgcucgccaaggagggaaucaagcgcggagaaaccgaccaccacgccguguccagaggcuccgccaaacuacggugguucguggagcgcaacaugguaacccccgagggcaaagugguggaucuggguugcggucgcggcgggugguccuacuacugcggcgggcucaagaacgucagggaagugaaggggcugaccaagggcggucccgggcaugaggagcccauuccuaugagcacuuacggcuggaacuuagugagacuccagucgggggucgacguguucuucaccccccccgagaaaugcgacacucugcugugcgauaucggugaguccagccccaacccaaccauagaggccgggcgcacgcuucggguguugaaccucguggagaacuggcucaauaacaacacccaauucugcaucaaaguucugaacccguacaugccaucggucaucgaaaaaauggagacccuacagaggaaauacgggggagcgcuggugcgaaauccccucagcaggaacuccacucacgagauguauugggugucaaacgccaccggaaacauagugucaucagucaacaugauuucccgcaugcugauuaaucgcuucaccaugaaacauaagaaggccacuuacgagccugacguggaccuggggagcgggaccagaaacauuggcaucgagagcgagauccccaaccuggacauuauugggaagcggauugagaagaucaaacaggagcacgagaccagcuggcacuacgaccaggaccaccccuauaagacgugggccuaccacggguccuaugaaaccaagcagacgggcucugccuccagcaugguaaacggcgucguacgucuccugaccaagccgugggacgucguaccgauggugacgcagauggcgaugaccgacaccaccccuuucggccaacagaggguauucaaggaaaaaguugacaccagaacucaagagcccaaggagggcaccaaaaaguuaaugaagauuacagccgagugguuguggaaagaguugggaaagaagaagaccccacggaugugcaccagggaggaguucacccggaaggugcgcuccaacgcugcccucggugccauauucaccgacgagaacaaguggaagucugcgcgagaggccguggaggacggaagguuuugggagcuggucgaccgggagcgcaaccugcaccuagaggguaagugugagacuuguguauauaacaugaugggaaagagggagaagaagcuuggcgaguuuggcaaggccaaggggucccgcgcuaucugguacauguggcuaggagcccgguuccucgaauuugaggcccuggguuuccucaacgaggaucacugguucagccgcgagaacucgcucucuggcguggagggggagggucugcacaaacugggcuacauacuccgggacguuagcaagaaggagggaggagccauguacgccgacgacacggccggaugggacacccgcaucacccucgaggaccugaaaaacgaggagauggucacgaaccacauggagggcgagcacaagaaacucgcggaagcaaucuucaagcugacguaucaaaacaaggucgugcgggugcaaagaccgaccccgcgggggaccgucauggacaucaucucgcgccgcgaccagcggggcagcggacagguugggacguaugggcugaauaccuuuaccaauauggaagcacagcucauccgccagauggagggggaggguauuuucaaguccauacaacaccucaccgugaccgaagagauugccguccaaaacuggcuggcccgggugggccgcgagaggcucagccguauggcgauuuccggggacgacuguguggugaagccgcucgacgaccgguucgccuccgcacugaccgcccucaacgacauggggaaagugcgcaaggacauccagcagugggagcccucccggggcuggaaugacuggacccaggugccguucugcagccaccacuuccaugagcugaucaugaaggacggccgcgucuuggugguuccgugucggaaccaggacgaguuaaucgggcgggccaggaucucgcagggcgccggcuggucgcugaaggagaccgcgugcuuggggaaguccuacgcccagauguggacgcucauguacuuccaccgccgggacuuacgccuggcagccaacgcgaucuguagcgccguccccucccacugggugccuacgucacguaccaccugguccauucacgccaaacacgaguggaugaccacggaggacaugcuggccguguggaaccgaguuuggauccaggagaauccguggauggaggacaagacaccaguggagagcugggaagaagugccauaucugggcaagcgggaggaccaguggugcgggucacugaucggucuaaccucacgcgcgaccugggccaaaaacauacagacggcuaucaaccaaguccgaagccugaucgggaacgaggaguacaccgacuauaugccgagcaugaagcgguucagacgggaggaggaggaggcaggcgugcugugguag

SEQ ID NO: 25357 - RNA, 9876 nt, Artificial Sequence
  derived and/or modified CDS sequence (opt11) from DENV-2__EU482640__SS-prME
accgccggcaucaucaucaugaugauccccacugugauggccuuucaccugaccacccgaaacggagagccgcacaugaucgucagccgacaagagaagggcaagagccuccuguucaagaccgagaacggggugaauaugugcacccugauggccauggaucucggagagcugugcgaggauaccaucacauauaacugccccuuauuacgccagaaugagcccgaggauaucgacugcuggugcaacagcaccuccaccuggguaaccuaugggaccugcacagccacgggagagcaucggcgcgagaaacggagcguugcccuugugccccacguaggcaugggucuggagacccgcaccgagaccuggauguccagcgagggcgcauggaagcacgcccagcgcauugagaccuggguccugcgccaucccggguuuaccaucauggcggccauccuggcguacaccauugguaccaccuacuuccagcgggugcugaucuuuauucuccugacgacuguggcacccagcaugaccaugcggugcaucgggaucagcaacagagacuuugucgaaggggucaguggggguucuuggguggacaucguccuggagcacggcagcugcgugacaacgauggcgaagaacaagcccacccucgacuuugaguuaaucaagaccgaggccaaacacccggccacccugcgcaaguacugcauagaggccaagcucaccaacaccacgaccgccagccgaugcccgacgcagggggaacccucacuaaacgaagaacaggacaagcgcuucgugugcaagcacagcauggucgaucgcggcuggggcaacgguugcggacuguucgggaagggcggaaucgugacgugcgccauguucaccuguaagaaaaacauggagggcaagauagugcagcccgagaaccuagaguacaccaucgucaucacuccucacuccggugaagagaacgccguggggaacgacacaggcaagcauggcaaagagauaaaggugaccccucagucgaguaucaccgaagccgagcugaccggcuacgguacggucacgauggagugcucgccccgcaccggcuuggacuuuaacgagauggugcuccugcagauggagaauaaggccugguuggugcaccggcagugguuuuuggacuuaccccugcccuggcucccaggugcagacacccagggguccaacuggauccagaaggagacccuggucaccuucaagaacccccaugcgaagaagcaggacguggucguacugggcagccaggagggggccaugcacaccgccuugaccggcgccacggaaauccagaugagcucggggaaccuguuauucacugggcaucuaaagugccgccugcggauggauaagcugcagcucaaaggcaugagcuauuccaugugcacggggaaauuuaagguggucaaggagaucgccgagacacagcacggaacgaucgugauaagagugcaguacgagggggacggcagccccugcaagauccccuucgagaucauggaccuggagaagcggcacguccugggcagauuaauaaccgugaacccgaucgugacagagaaggacagccccgucaacaucgaggcagaaccgcccuucggggauagcuacaucaucaucggcguggagccggggcaacugaagcugucgugguucaagaagggcagcuccaucgggcagauguucgaaaccacaaugcgcggcgcuaagaggauggccauccucggcgacacugcgugggacuucgggucucugggcgguguguucaccucaaucggcaaggcccugcaccaggucuucggagcgauauauggcgccgccuucagcgggguguccuggaccaugaaaauccucaucgggguggugaucacguggauaggaaugaacucccgcuccacuucccugucggugucccuggugcuggucgggguggugaccuuauaccugggcgucauggugcaggccgacucagggugcguggucagcuggaagaacaaggagcugaagugcggcagcggcaucuucaucaccgacaacgugcacacguggaccgagcaguacaaguuccagcccgaaagucccagcaagcuagcauccgccauccagaaagcccaugaggaggggauuuguggcauccggagcgugacccgccuggaaaacuuaauguggcgacagaucaccccagagcucaaccacauccuguccgagaacgaggucaaacugacgauaaugaccggggacauaaagggcaucaugcaagcagggaagaggucucuccggccccagcccaccgagcugaaguauuccuggaaggcguggggcaaggcaaaaauguuaagcaccgaacuccacaaccacacguuccugaucgacggccccgaaaccgcggagugcccgaacacaaaucgcgcguggaacucccuggagguggaggacuacggguucggcguguucaccacgaacauuuggcucaagcugaaggagcggcaggacgucuucugcgacaguaaguuaauguccgccgcuaucaaggacagccgcgcugugcacgccgauaugggguacuggaucgaguccgcccucaacgacacuuggaagauagagaaggcuagcuucaucgaaguaaaaagcugccacuggcccaagucccauacuuuguggucgaacggcguccuggagagcgagaugaucauacccaagaacuucgccggccccgugagccagcacaauuaucggccuggauaccacacccaaaccgccggccccuggcauuuagggcgccuggagauggauuuugauuucugugagggaacgaccguggucgugaccgaggacugcgggaacagaggccccagucugcgcacgacgaccgccagcggcaagcuaaucaccgaguggugcugccggucgugcacucugcccccucugcgcuacagaggggaggaugggugcugguacgggauggagaucagaccccucaaggaaaaagaggagaaucucguuaacagccuggugaccgcuggccacgggcagaucgacaacuucucccugggcgugcucgggauggcccuguuucucgaggagaugcugcggacccgaaucgggaccaagcacgcgauacugcuuguggcgguuucuuucguaacccuuauaacgggcaacauguccuuccgcgacuuggggcggguuauggucauggugggcgcaaccaugaccgacgacaucggaaugggcgugaccuaucucgcacugcuggccgcguucaagguccgccccacguucgccgccgggcucuugcuuagaaagcucaccucgaaagaguuaaugaugacgaccaucggaauugugcugcucucccagucgacggugcccgagaccauccuggagcugaccgacgcucucgcccugggcaugauggugcugaagauugugcgcaacauggagaaguaccagcucgccgucaccauaauggcuauacugugcgugccgaaugccgucauccugcagaacgccuggaaggucagcuguacgacccucgccguggugagcgucucgccgcugcugcucacgagcucccggcaaaaggcggacuggaucccccuagcccugaccauaaaggggcucaaucccacagccaucuuccucaccacgcugucccgcaccucaaagaaacggagcuggccgcucaacgaagcuaucauggcagugggcaugguuuccaucuuggcgagcagcuugcucaaaaaugauaucccuaugacgggucccuuaguagcagggggucuguugacugugugcuacguacugaccgggcgcuccgcggacuuagaacucgagagggcagcggacgugcgcugggaggagcaagccgagauaagcggcuccagccccauccuguccaucaccauuuccgaggacgguagcaugagcauuaagaaugaggaggaggagcagacgcugaccauccuaauccggaccggccuauuagugaucuccggccucuucccggugaguauccccaucaccgccgcggccugguaccugugggaggucaagaagcagcgcgcggggguucuuugggacgugcccuccccgccacccgucggcaaggccgaacucgaggacggggccuaccggaucaagcagaagggcauccugggguacagccagaucggcgccgguguguacaaggaggggacauuccacaccauguggcaugugacccgcggagcaguccuuaugcauaaggggaagcggaucgagccaagcugggcggacgugaagaaggaccuaauuagcuacggcggcggcuggaaacuugaaggcgaguggaaggagggugaggaagugcagguccuugcccucgagcccgggaagaacccgcgugcugugcagaccaaacccgggcuguuuaaaaccaacacggggacuaucggugccguuuccuuggauuucagcccuggaaccucuggcagccccauugucgacaagaaagggaagguggucggacucuacgggaacggugucguaacccgauccggcacguacguguccgccauagcgcagaccgagaaaaguaucgaggacaaccccgagaucgaggacgacauauuccgaaagaagcggcugaccauuauggaccugcaccccggggccggcaagaccaagcgcuaccugccugccauaguccgggaggcuauuaagcgcgggcuccgcacgcugauccuugcgccgacccggguuguugccgccgagauggaggaggcccuccgcggcuuacccauucgguaucagacacccgccauccgcgcggagcacaccgggcgggagaucgucgaccugaugugccacgccacguucaccaugcgccugcugucccccaucagggugccgaacuacaaccugaucaucauggaugaggcucacuucacagaccccgcgucgaucgccgcgcggggguacaucuccacccggguagagaugggcgaggccgcggggaucuucaugacggcgacaccgccaggaaguagggauccguuuccccagagcaacgcccccaucauggaugaggaacgggagauccccgagcgcagcuggaacuccgggcaugagugggucacagacuucaagggaaagacagugugguuugugccgagcaucaaggcggggaaugacauugccgccugccuccggaagaauggaaagaaggucauccagcugucucguaagacguucgacagcgaguacaucaagacccggacuaacgacugggacuucgugguuacuacugauaucuccgagaugggggcaaacuucaaggcugagagagucauagacccacgacgcuguaugaagcccguaauauugaccgacggugaggagcgggugaucuuggccggccccaugccggugacccauuccuccgccgcccagcgacgcgggagggugggccggaacccaaagaacgagaaugaccaguauaucuacaugggggagccccuugagaacgacgaagacugcgcccacuggaaggaggcgaagaugcugcucgacaacaucaacacccccgaaggcaucauaccgaguauguucgagcccgaaagggagaaaguagaugcuaucgacggcgaguaucgcuuacgcggagaggccaggaagacguucgucgaccucaugcggcgcggggaucuccccguauggcuggcguaccguguagcugcagaagggauuaacuacgccgaccgccgauggugcuucgacggcgugaaaaacaaccaaauacuugaggagaauguggaggucgagaucuggaccaaggaaggcgagcgcaaaaagcuaaagccccgguggcuggacgcacgaaucuauuccgacccccuggcccucaaggaguuuaaggaguuugccgcgggcagaaaaagccugacccugaaccucauaaccgagauggggaggcugcccacguuuaugacgcagaaggcacgaaacgcucucgacaaccucgccguccugcacacagcggaggccggcggucgcgccuacaaccacgcccuaucggagcucccggagacacuggagacgcuacuccuguuaacccuccuggcgaccgugaccgggggcaucuuucuguuccucaugagcggcaaggggauuggaaagaugaccuugggcaugugcuguaucauaacggcgaguauucugcucugguacgcucagauccagccgcacuggaucgccgccuccaucauccuggaguucuuccugauuguucuccugauccccgaacccgagaagcaacggacgccacaggauaaccagcugaccuacguugugaucgccauacucaccguaguggcggccacaauggccaacgagaugggcuuccuggagaagaccaagaaggacuuugggcugggcagcauaaccacccagcagccggaguccaauauccucgacaucgaccugcgcccggcgagcgccuggacgcuguacgcgguggccaccaccuucaucacccccaugcuccggcacuccaucgagaacucauccgucaacgugagccugacggccaucgccaaccaagcuaccgugcugauggggcucgggaagggauggccccuguccaaaauggauaucgggguuccccugcucgcgauuggcugcuacagccaggugaaccccaucacccugaccgcagccuugcuccugcugguggcccauuacgcaaucaucggccccggccuccaggccaaggccacgagagaggcucagaagcgcgcagcggccggcaucaugaagaaccccaccgucgacgggaucaccguaaucgaucuggacccaaucccauaugaccccaaguucgagaaacagcugggccagguuaugcuccugguacugugcgugacccaggugcucaugaugagaacgaccugggcccugugcgaggcccugacccucgccacggggcccaucuccacgcugugggagggcaacccggggcgcuuuuggaacaccacaaucgcggucagcauggccaauaucuuccggggcaguuaccuggcgggcgccgggcuccuguuuaguaucaugaagaauaccgccaacacgagacggggcacagggaacacgggggaaacccucggugagaaguggaagaaccgccuuaacgcgcuggggaaguccgaguuccagauauauaagaaauccggcauacaggaaguagaccgaaccuuagcaaaggaggggaucaagcgcggagagaccgaccaccacgccguguccaggggcagcgccaagcuccgcugguucgucgagcggaaccuggugacgcccgagggcaagguggucgaucugggcugcggacgcggagguuggucguacuacuguggcgggcucaagaacgucaaagaagucaagggcuuaaccaagggcgguccggggcaugaagaacccauccccaugagcacauacggguggaaccugguacgauugcaguccggcguugauguguucuuuacaccgcccgagaagugcgacacacugcugugcgacaucggggagagcagcccaaacccgacggucgaggcgggccgaacccugcggguacugaaccucguggaaaauuggcucaacaacaacacgcaguucuguaucaagguacugaacccuuauaugcccucugugaucgagaagauggaggcccugcagcgcaaguauggcggggcccuggugcggaacccgcucagccgcaacuccacccacgagauguacugggucagcaacgcguccggcaacaucgugagcuccgugaacaugaucagccggaugcugauaaaccgauucaccaugcgccacaagaaggcaacauacgaaccugacguugaccugggguccggaacgcggaacaucggaauugagucagaaacaccgaaccucgacaucaucggaaagcguauugagaaaaucaagcaggaacacgagaccucguggcacuacgaccaggaccaucccuacaagacgugggcguaccacgggagcuacgagacgaagcagaccgguuccgccucauccauggugaacggagugguccggcugcuaacaaagccgugggacgugauucccauggugacgcagauggccaugaccgacaccaccccuuuuggccagcagcgcguguucaaggagaagguugauacccggacacaggagcccaaagagggaaccaagaagcucaugaaaauaaccgccgaguggcuguggaaagagcugggaaagaagaaaacaccgagaaugugcacacgggaggaguucacgcgcaagguccggagcaaugccgcgcucggggccaucuuuaccgacgagaauaaguggaagucggcccgggaggcuguggaagacucgggcuuuugggaacugguugauaaggagcggaaccugcaccucgaagggaaaugcgagaccugcgucuauaacaugaugggcaagcgggagaagaagcugggggaguucggcaaggccaagggcucccgugcgauaugguacauguggcugggcgcccgcuuccuggaguucgaggcccugggauuccuaaacgaagaucacugguucagccgggaaaauagcuugucugggguggagggcgaggggcugcacaagcugggcuacauccuccgcgacguuaguaagaaagagggcggugccauguaugcagaugacacugcuggcugggacaccaggaucacacuggaagaucugaagaacgaggagaugguaaccaaucacauggagggugaacacaaaaagcucgcagaggccaucuucaagcugacauaccagaacaagguggugagggugcagcguccgacgccccgggguaccgucauggacaucaucucccggcgcgaccagcgcgggagcggccagguggucaccuacggacugaacacguucaccaacauggaggcucaacucauucgccagauggagggcgaaggaguauuuaaauccauccagcagcugaccguuacggaagagaucgcggucaaaaacuggcuggcccgaguggggcgggagcgccucucaaggauggcgauuuccggcgacgauugcgucgucaagccccuggacgaccguuucgccagcgcacugacggcgcuuaacgacaugggaaaagugcgaaaggacauccagcaaugggagcccucccgcggguggaacgauuggacucaagugcccuuuugcagccaccauuuccacgagcugaucaugaaagacgggcggguccugguggugcccugccgcaaccaggacgagcugaucgggcgcgcccgcaucucccaaggcgcuggauggagcaugcgugagacggcgugucugggcaaguccuacgcucagauguggagccuuauguacuuccaucgccgggaucuccgccuggcggccaacgccauuuguuccgcuguccccagccacuggguuccgaccucccggacgacgugguccauucacgccacccacgaauggaugacuaccgaggacaugcugacgguguggaaccgcguauggauccaggagaaccccuggauggaggacaagacgcccguggaaagcugggaagagauccccuaccucggcaagcgggaagaccaguggugcgggucacugauaggccugaccagccgcgcuaccugggccaaaaacauccagacggccauuaaccaggugaggucacucaucgggaacgaggaguacaccgauuacaugccgagcaugaagcgguucagacgggaggaggaggaggccgguguacugugguga

SEQ ID NO: 25358 - RNA, 9876 nt, Artificial Sequence
  derived and/or modified CDS sequence (opt11) from DENV-2__EU482641__SS-prME
ucggcggguaugaucauaaugcugaucccgaccgucauggccuuccaccuuaccacccgcaacggggaaccgcacaugauagucgguauccaagaaaagggcaagucgcugcuguucaaaaccgaagacggggugaacaugugcacccucauggcgauggaucugggggaacugugcgaagacaccaucaccuauaagugcccccuccuacggcagaacgagcccgaggacaucgacugcuggugcaacagcaccuccaccugggucaccuacgggacgugcaccauuaccggcgagcaccgccgggaaaagcgcagcgucgcucuggucccucauguggggaugggucucgagacccggacagagaccuggauguccuccgagggggccuggaagcacgcccagcgcaucgaaaccuggauccugcggcacccgggcuucacuaucauggccgcgauauuggcguacacgauugggaccacccacuuucagcgcguccucaucuucaucuuguugaccgccguggccccauccaugaccaugcgaugcaucggcaucaguaaccgugauuucguggaaggcgucagcgggggcagcuggguagauaucgugcucgagcacggguccugcgucacgacgauggcgaagaauaagcccaccuuggacuuugagcugaucaaaacagaggccaaacagcccgccacuuugcggaaguacugcaucgaggcgaaacuuaccaacacgacgaccgaaagccguugcccaacccagggcgagcccucccugaaggaggaacaggacaagcgauuuguauguaagcacagcaugguggaccgaggcuggggcaacgggugcgggcuguuuggcaagggcgggaucgugacgugugccauguucacguguaaaaagaacauggaggguaagaucgugcagccugagaaccuggaguauaccaucguggucacgccgcacucuggggaggagcacgccgugggcaacgauaccgggaagcacggcauggagauaaaggugacgccucagagcagcaucacagaggcggaguuaaccggcuacggcaccgucaccauggagugcucucccagaacgggccuggacuucaacgagauggugcugcugcaaauggagaacaaagccuggcucgugcaccgccaaugguuucuagaccugccccuccccuggcugccgggcgccgacaagcaggaguccaacuggauccagaaggagacccuugugacuuuuaaaaacccccacgcgaaaaagcaggacguggucgugcucggcucccaggagggugcgaugcauaccgcccuaacuggcgcuaccgagauccagaugucauccgggaaccuccuguucaccggccaccugaagugccggcugcgcauggauaagcuccaacugaagggcaugagcuacuccauguguaccgggaaguucaagguagucaaggagauugccgagacgcagcacggcaccaucgucauccggguccaguaugagggggacggcagccccuguaagauucccuuugagauuauggaccuggaaaaacgcuacguccucggcagacugaucaccgugaacccgaucguuaccgaaaaggacuccccggucaacaucgaagccgagccgcccuucggggacuccuauaucaucaucggcgucgagccugggcagcugaaacuuaacugguucaaaaagggcuccagcauugggcaaauguucgagacaacuaugcgcggcgcgaagcgcauggccauccuaggugauacggcgugggauuuugggucccugggcgggguguucaccagcaucgggaaagcccuccaccaggucuucggggccaucuacggugcggcuuucuccggcguuagcuggacgaugaagauucugaucggugucaucauaacauggaucgguaugaacagccggagcacaucccuaagcgucucccuggugcucguggggauugucacccuguaccugggggugauggugcaggccgacagcgguugugucgugucuuggaagaacaaggagcucaaaugcggcagcggcaucuucauuacggacaacgugcauaccuggaccgagcaguacaaguuccagccggaaagcccuucgaaguuagccagcgcgauacaaaaggcccaggaagagggaauuugcggcauccgcucagucacccggcuugagaauuuaauguggaaacagaucacgccagagcugaaccacauccuagccgagaacgaggugaagcugaccauaaugaccggggacauccgcggcauaaugcaagcuggcaagcggagccugcgcccgcagcccaccgagcugaaauauucguggaagacgugggggaaggcuaagaugcucucaaccgagucauauaaucagaccuuccugaucgacggcccggagacugcggaaugcccuaacacgaaccgggccuggaacagcuuagagguugaggacuauggauucggcguuuucaccacaaacaucuggcucaagcugaaggagaaacaggacgccuuuugcgacuccaagcugaugagcgccgccauaaaggacaaccgcgccguucacgccgacauggguuacuggaucgaguccgcgcucaacgacaccuggaagaucgagaaggccagcuucaucgaggugaagaacugucacuggccaaagucccacacgcuguggagcaacgggguccuggaauccgagaugaucauccccaaaaauuuagccgggccggugagccaacacaacuaucggccgggguaccacacccagaucgcuggacccuggcaccuggggaagcuggagauggacuucgacuuuugugacggcaccacuguaaucgucaccgaggacugcgggaaccgaggacccucccuccggaccaccaccgcaagcgggaagcugaucacggagugguguugccgaagcuguacacuacccccgcuccgguaccgcggggaggacggcugcugguacgggauggagauacgaccccugaaagagaaggaggagaaccucguaaacucgcucgugacugccgggcacggucaggucgacaacuucucauugggcgugcuagguauggcccucuuucuggaagagaugcuccggacccggguggggaccaagcaugccauacuacucguagcaguguccuucgugacgcugaucaccggaaacaugucuuucaaggaccucgggagagucguggugauggugggggccacuauggccgaugacaucgggaugggcgugaccuaccucgcccuguuagccgcauucaagguacggcccacguucgcagccggucuccucuuacgcaaacugacauccaaggagcucaugaugacaacuaucgguauuguacucuugagccaguccacaaucccagaaaccgugcuggaacucaccgacgcucuggcgcuggggaugaugguguuaaaaaucguccgcaacauggagaaguaccagcuugcagugacaauuauggcaauuuuauguguuccgaaugccgugauccuacaaaacgcguggaagguuagcugcaccauacuugcggucguuagugucagcccccugcuccuuacguccagccaacagaagaccgacuggauuccccuggcacucacaaucaagggacugaacccaacggccaucuuccuaaccacgcucucccguaccaacaagaagcgaagcuggccgcugaacgaggccaucauggcggugggcauggucucaaucuuggccagcucccuccugaagaacgauauccccaugacgggcccccuggucgcaggcgggcuccugaccgugugcuacgugcugaccgggcgguccgccgaccucgaacuugagcgcgccacggacgugaagugggaggaucaggcggagaucuccggaagcucuccuaucuuguccaucacuaucagugaggacggguccaugagcauaaagaacgaggaggaagaacagacccucaccauacugauucggacaggucuguuagucauauccggccuuuuuccgaucucgaucccaauaacagccgccgccugguaccugugggaagugaagaagcaacgcgcagggguccucugggauguacccuccccgccgccgaugggcaaggcggagcuggaagacggggccuaccggauaaagcagaagggcaucuugggguacagccagauuggcgccggaguauacaaggaggggaccuuccauacuauguggcacgugacccgaggagccguccucaugcacaagggaaaacggaucgaaccaaguugggccgaugugaagaaagaccugaucagcuauggcgguggcuggaagcuggagggcgaauggaaggagggggaggaggugcagguccuagcgcuggagccggguaagaacccccgcgccguacagaccaagcccggacuguucaagacgaacaccggcaccauaggagccgucucgcuggacuucagccccggcaccagcggcucacccaucaucgacaagaagggcaaggucgucggccuguacggaaacggcguggugacucgaagcggcgccuacgugagcgcaaucgcgcagaccgagaaguccaucgaggacaaccccgaaaucgaggacgacaucuuccgcaagcggagacugaccaucauggaccugcaucccggagccggcaagaccaagcguuacuugccugccaucgugcgcgaggccauaaagcgggggcugcgcacccugauccuugcgccgacccggguaguggccgccgagauggaggaggcacuucgcggccugccgauucgguaccagacgcccgcuauccgagcggagcacaccgggcgugaaaucguagacuugaugugccacgccacauucacaaugcgauuacugagccccguccgcgugccaaacuacaaccuaauuauaauggacgaggcccacuuuacagaccccgccagcaucgcagcgcgcggcuacauuagcacacgcguggaaaugggcgaggccgccgggauauuuaugacggccacgccgcccggcucucgggacccguucccgcagucgaacgccccgaucaucgacgaggagcgcgagauuccugaaaggagcuggaacuccggucacgaaugggucaccgacuucaaaggcaagaccguaugguucgugccgagcauuaaggcggguaaugauaucgccgccugccugcggaagaauggcaagaaggucauccaacugagucgcaagaccuucgauagcgaguacgugaagacccgcacuaaugacugggacuucgugguuacaacggacauauccgagaugggcgcaaacuucaaagcagagcgggugaucgauccccgccggugcaugaagcccgugauccucacggacggugaggagcgcgucauccuggcgggccccaugccggugacccacagcagcgcagcccaacggcgcgggagaaucggccguaacccuaaaaacgaaaacgaccaauacaucuauaugggggagccacuagagaacgacgaagauugugcccacuggaaggaggcgaagaugcuccucgacaauauuaacacuccugagggaaucaucccgucaauguuugaacccgaacgggagaagguggacgcgaucgacggcgaguaccgccugagaggggaagcucggaagacguucguagacuugaugcggaggggugaucugccuguguggcuggccuacaaaguggccgcggaggggaucaacuacgccgaccgccggugguguuucgacggcaucaagaauaaucaaauccucgaggagaacguggagguagagaucuggaccaaggaaggggagcgcaagaagcugaagccgagauggcuugacgccagaaucuauuccgauccgcucgcacucaaggaguucaaggaguucgccgcgggucggaaguccuugacccucaaccucaucaccgagaugggccgucugcccacguucaugacccagaaaacacgggacgcgcucgacaaccuggccguccugcacaccgcugaggcagggggcagagccuauaaccacgcccucuccgagcuaccugagacacucgagacccuccugcugcucacgcugcuggccaccguuacgggcgggaucuuccuguuccugaugagcggucgugggaucgggaagaugacccuugggaugugcuguauuaucacggccucaauccuccucugguacgcccagauccagccgcacuggaucgccgccagcaucauucuagaguucuuucucauagugcuacugauccccgaaccugagaagcagcgcacgccccaggacaaccaacuaaccuacgucguuaucgccauccugacgguggucgccgcuaccauggcgaacgagaugggcuuucuggagaagacuaagaaggaucucgguuuaggcucgaucgccacccaacagccagaaagcaacauccuggauauagaccuccggccagcuuccgcuuggacguuauacgcaguagcaaccacguucgugaccccgaugcugaggcacagcaucgagaacucguccguuaacgugagcuuaacggcaaucgcgaaccaggccaccguccugaugggccuggggaagggcuggccccucucaaagauggauaucggcgucccgcuucuagcaaucgguugcuacagccaggucaaucccaucacauugacagccgcucuguugcugcuuguggcccacuaugcuaucaucgggcccggccugcaggccaaggcuacgcgggaagcgcaaaagcgcgccgcggccgguauaaugaagaaucccaccgucgacggcaucaccgugaucgaccucgauccgaucccauaugacccgaaauucgagaagcagcugggccaagugaugcugcugauccuguguguuacccaggugcuuaugaugagaacgaccugggcccucugcgaggcccugacccuggccaccgggcccaucuccacacuaugggagggcaacccgggacgcuucuggaacaccaccaucgcaguguccauggccaacauauuccggggcuccuaccuggcuggcgcagggcuccucuucagcauaaugaagaauaccacgaacacgcgucgaggcacggggaacaucggcgagacucugggcgagaaguggaaaucccggcucaacgcccucggcaagagcgaguuucagauauacaagaagucuggaauacaggaggucgaccgcacgcuggccaaggaagguaucaagcggggcgagaccgaccaucacgcggugagccgcggguccgccaagcugcggugguuuguggagcgcaauauggucacccccgagggcaaagugguggaccucggcugcggacgcggcgguuggucuuauuacuguggugggcugaagaacguccgcgaggugaagggacugaccaagggcggccccggccacgaggagccgaucccgaugucgacguacggcuggaaccucgugagacugcagagcggcguugacguguucuucaucccgcccgaaaagugcgacacccugcucugcgauaucggggaauccagcccaaaccccacgguggaggccgggcgaacucugcgcgugcugaaccucguggagaacuggcuaaacaauaacacgcaguucuguauuaaggugcugaaccccuauaugcccuccgucaucgagaagauggaggcucugcagcgcaaguaugguggggcccucgugcggaacccgcugagccguaauucuacccacgagauguauuggguuuccaacgccagcggcaacauugucuccagcgugaauaugaucuccagaaugcugauuaaccguuucaccaugcgucacaagaaagccaccuacgagcccgacguggacuuaggguccggaacaagaaacaucgggauugaauccgagauccccaaccuggauaucaucggcaagcggaucgagaagaucaagcaagagcacgaaacgagcuggcacuacgaccaagaucaccccuauaagaccugggccuaucacggcaguuaugagaccaagcagaccgggagcgccuccagcauggucaacggcguagugcgccuguuaacuaagccgugggacgugcugccgaccgucacacagauggccaugacagacacgacgccuuucgggcaacagcgcguguucaaagagaaggucgacacccguacgcaggaacccaaagagggcacgaagaaguugaugaaaauaacagccgaguggcuguggaaagaacuaggcaagaagaaaaccccgcggauguguacccgagaggaguucacgagaaaggugcgguccaacgccgcucugggcgcuaucuuuacggaugagaacaaguggaaguccgccagagaggccguggaggacucccgguuuugggagcucgucgauaaggagcgcaacuugcauuuagaggggaagugugaaacuuguguuuacaauaugaugggcaagcgggagaaaaagcucggcgaguucgggaaggccaaaggcaguagagccaucugguacauguggcugggcgcucgguuccuggaguucgaggcccucggguuccuaaacgaagaccacugguucucccgcgagaacagccuaucuggagucgagggugagggauugcacaaacugggguacauacuucgggacgugagcaagaaggagggaggcgccauguacgccgacgauaccgccgggugggacacgcgcaucacccucgaggaucugaaaaacgaggaaauggugaccaaucacauggaaggcgaacacaagaaacuugcggaggccaucuuuaagcucaccuaccagaauaaggucgugcgggugcagcgccccacgccgagagggacugugauggauaucaucagccgccgggaccagcgcggaucggggcaaguaggaacuuacggccugaacacguucacgaacauggaggcacagcugauccgacagauggagggggagggcguuuucaagaacauacagcaccucaccguaaccgaggaaguggccguccacaauuggcuggcccgcguggggcgcgagcggcugagccgcauggcgaucucaggcgacgauugcguggucaaaccccuggacgacagauucgcaaacgcacugacagcgcugaacgacaugggcaagauccgcaaggacauccagcaaugggagccguccaaaggguggaacgacuggacgcagguccccuucugcucccaccacuuccacgagcucaucaugaaggacggaaggauacugguggugccaugucgcaaccaggaugagcugaucgggcgagcgcgcauaucgcaaggcgccggguggucccuccgagaaaccgccuguuugggaaagucauacgcgcagauguggucccucauguacuuccaccgccgggaccuccgucuggccgcgaaugccauaugcagcgccguacccucccauuggguuccgaccucucggacaacgugguccauccacgccaagcacgaauggaugacgaccgaagacaugcucaccguguggaaccgugucuggauucgcgagaaccccuggauggaggacaagacccccguggagucaugggaggagauccccuaccucggcaagcgcgaggaccaguggugugggagccugaucggccugacgagccgggccaccugggcgaaaaacauccaagccgcaaucaaucagguccgcucccucaucgguaacgaagaguacaccgacuacaugccgagcaugaagcgguuccgccgcgaggaagaggaagccggcguccugugguaa

SEQ ID NO: 25359 - RNA, 9876 nt, Artificial Sequence
  derived and/or modified CDS sequence (opt11) from DENV-2__EU482642__SS-prME
uccgcgggcaugaucaucaugcugauccccaccgugauggcguuccaccucacuacacgcaauggggaaccccauaugauugucgggauccaggagaaagggaaaucccugcuguuuaaaaccgaggacggcgugaacaugugcacccucauggcaauggaccugggggaacugugugaggacacaaucaccuauaagugcccgcuccugcgucaaaacgagccagaggauaucgacugcugguguaacagcaccaguaccuggguuaccuacgguaccugcacgacaacaggcgagcaucggcgggagaaacgcagcgucgcccuggugccccacgugggaaugggucucgagaccaggacggagaccuggauguccagcgaaggggcguggaagcacgcacagcguaucgagaccuggauucuacgucaucccggcuucacgauaauggccgcaauccuggccuacacuaucgggaccacgcacuuccagaggguacucaucuucauccugcugacugccguagcccccuccaugacuaugcggugcaucggcaucagcaaccgcgacuucgucgagggcguaucagggggcagcuggguggacauagugcucgagcacggcuccugcgucaccacaauggcgaagaacaaacccacuuuggacuuugagcugaucaagaccgaggccaaacagcccgccacccucaggaaguacuguaucgaggcgaaacuaaccaacacgaccaccgaaagcagaugccccacccagggugagcccucucuuaaggaggagcaggacaagcgcuuuguuugcaagcauagcaugguggaccggggaugggggaacgggugcggucuguucggcaagggcgggaucgugacgugcgcuauguucacgugcaagaagaacauggaggguaagauagugcaacccgagaaccucgaguacaccaucguggucaccccccauucgggggaggagcaugcggucggcaacgauacggggaagcacggaaaggagaucaaggugacaccacagucguccaucaccgaggcugaacugaccggguacggcaccguaacgauggaguguagccccaggacuggccucgacuuuaacgaaaugguguuacugcaaauggagaacaaggcuuggcuagugcaccgacagugguuccuggaccugccccucccgugguugccgggcgccgacaaacaagaguccaacuggauccagaaagaaacccugguuaccuucaagaauccacacgccaagaaacaagacguggucguacucgggagccaagaaggggccaugcauacggcccugaccggggccaccgagauccaaaugucaucugggaaucuccucuucaccggccaccugaagugccggcuacgcauggacaagcuacagcugaaaggcaugaguuacuccauguguacgggaaaguucaagguagucaaggaaaucgccgagacccagcaugguaccauaguuauccggguacaguacgagggggacggcucgccuugcaagauccccuucgaaaucauggaccuggagaagcguuaugugcucggccgguugauuaccgugaaccccauugugacggagaaggacucgcccgucaacauagaggccgagccgcccuucggagacagcuacaucaucaucgggguggagccgggccagcugaagcuaaacugguucaagaagggcaguuccaucggucagauguucgagaccaccaugcgcggggcuaaacgcauggccauccugggcgacaccgccugggacuucgggucccuaggggggguguucaccaguauaggcaaggcccuccaccaagucuucggagcuauauacggcgcugccuucuccggcgugucguggaccaugaagauacugaucggagugaucaucaccuggaucggcaugaacucucggagcaccucccugagcgucucccugguacuaguggggauaguuacgcuguaccugggcguaauggugcaggcagacagcggcugcguuguguccuggaagaacaaggagcucaagugcggcaguggcaucuucaucaccgacaacgugcauaccuggaccgagcaguacaaauuccagcccgagucacccuccaagcuggccagcgcaauccagaaagcucaggaggaggggaucugcggaauucgcucaguuacacgucucgagaacuuaauguggaagcagaucacccccgaacugaaucacauucuggccgagaacgagguuaagcugaccaucaugacgggggacaucaagggcaucaugcaggccgggaaacguagccugcguccccaaccgacggagcugaaguacuccuggaagaccugggggaaagccaagaugcuaagcaccgaguccuauaaccagacauuccugaucgaugggccugaaacggcugagugcccaaacacaaaccgcgcauggaauagccuggagguggaggacuauggauucgguguauuuacgaccaacaucuggcucaagcugaaggaaaagcaggacgccuucugcgauucaaaacugaugagugcugccaucaaggacaaccgcgcggugcacgccgacaugggauacuggaucgaauccgcccucaaugacacguggaagaucgagaaggccagcuucaucgaggugaagaacugccacuggccuaagucacauacccuguggucaaauggaguccuggaguccgagaugaucauccccaagaaccucgccggccccgugucccagcacaacuacagaccgggcuaccacacccagauugcgggccccuggcacuuggggaagcuggagauggacuucgauuucugugacggaaccaccgugaucgucaccgaggacugcgggaacagaggcccgucgcucagaaccaccacugccucuggcaaguugaucacggaguggugcugucguagcugcacccugccuccgcuccgguaccgcggugaggacggcugcugguaugggauggagauccgccccuugaaagagaaggaggagaaccuggugaacucccucgugacugccggccacggacaggucgacaacuucagccugggcgugcugggcauggcccucuuccuggaggaaaugcugcggacccgcguggggacgaaacacgcgauccuccuggucgccguguccuucgugacccucaucaccggcaacaugucguucaaggaucucggacgggucgucgugauggucggcgccacgauggcggacgacaucgggaugggugugacguaccuggcccugcuggcugcuuuuaaggugcgucccacuuucgccgccggccuucugcuacggaagcugaccuccaaagagcuaaugaugacaacgauugggauuguccuccugagccaguccaccauccccgagaccguguucgagcugacagacgcacucgcgcugggaaugauggugcugaagaucguccgcaacauggaaaaguaccagcucgccgugacgaucauggccaucuugugcguuccgaacgccgugauacuccagaacgccuggaaaguuucuugcaccauccucgcgguuguguccgugucuccccuucugcugacaucgagccagcagaagaccgauuggaucccacuggcccugaccaucaaggggcucaacccaaccgcaaucuuucugaccacgcugucacgcacgaacaaaaaacggaguuggccacucaacgaagccaucauggcggucggcauggucaguauccuggcgagcucccugcucaagaacgauaucccaaugacgggaccccugguugccggaggcuuacucaccguguguuacguauuaacagggcguagcgcggacuuagagcucgaaagggcgacggacguuaagugggaggaccaagcggaaaucagcggcucgagucccauccugucuaucacgauaagugaagacggaucgaugagcaucaagaacgaggaggaggagcagacccugacuauucucauccgcacgggccugcuggucaucucugggcucuucccgaucagcauucccaucacugccgccgccugguaucugugggagguaaagaagcagcgugcaggagugcugugggacguccccagcccuccucccaugggaaaggcagaguuggaggacggcgcguaccgcauaaagcagaagggcauccugggguauagccagaucggugccggcguuuauaaggaaggaacauuccacaccauguggcacgugacccguggcgcugucuuaaugcacaaggggaagcgcaucgagccuucuugggccgaugugaagaaggaucucaucuccuacggagggggguggaagcuugagggcgaguggaaggagggggaggaggugcagguccuagcauuagagccugggaagaacccaagggccguacagacgaaacccggccuguucaagacgaacaccggcacuaucggagccgugucacuggacuucagccccggcaccuccgggagccccauaaucgacaagaaaggaaaaguugugggccuguaugggaauggcgugguuacccgcuccggcgcauaugucuccgccauugcccagaccgagaaguccaucgaggacaaccccgagaucgaagacgacaucuuccggaaacgccgucugaccaucauggaucuacaucccggggccggcaagacgaagcgcuacuugcccgccaucgugagggaggcgaucaagcgcgggcuccggacacugaucuuagcgccgaccagggucguagcggcugagauggaagaggcacuccggggccugcccauccgcuaccagacccccgcgauucgggcggagcacacggggcgcgaaauuguggaucuuaugugucacgcaacauuuaccaugcgccuccugagcccgguccgggucccgaacuacaaccugaucaucauggacgaggcucacuucaccgauccagccaguaucgccgcgcguggcuacaucaguacucggguggagaugggcgaagccgcagggauuuucaugacggcaacgccgcccgggucacgcgacccguuuccccagucaaaugcccccaucaucgacgaggaacgggaaauucccgagcgcagcuggaacuccgggcacgagugggucaccgacuucaagggcaagacggugugguucgugccgagcaucaaggcugguaacgacauagccgccugccuucggaagaacggcaagaaggucauccagcugucccgcaagaccuuugacagcgaguaugugaagacccggaccaacgacugggacuucguggucacgacugacauuuccgagaugggcgccaacuucaaggcggagagggugaucgauccccggcgcugcaugaagcccgugauccugaccgacggggaggaacgagucauccucgccggccccaugccggugacccacagcuccgcagcccagcgcagaggacgaaucggccggaaucccaagaacgaaaacgaccaguacauauacaugggugagccucuggagaacgacgaggacugcgcccacuggaaggaggcgaagaugcugcucgacaacaucaauacgcccgaaggcaucauuccaaguauguucgagcccgagcgggaaaagguggacgccauagacggugaauaccggcugcggggggaagcccgaaagaccuuugucgaccugaugcggcguggcgaucuccccguauggcuggcuuacaagguggccgcggagggcauaaacuaugcagaccggcgcuggugcuucgacggcaucaagaacaaccagauacuagaagagaaugucgagguggagaucuggaccaaggagggagagcggaagaagcucaagccgcgguggcuggacgcucggaucuauucggacccccuggccuugaaggaguucaaggaauucgccgcgggccgcaagucacugacccugaaccucauaacggagaugggccggcuccccaccuucaugacgcaaaagacccgugaugcccuagacaauuuggccguccugcacacggcggaggcaggcggcagagccuacaaccacgcccuguccgaacucccggagacucuggagacccuccuccugcugacccuccuggcuacugugaccgggggcaucuuccuuuuucuuaugucagggcgcgggaucgguaagaugacccuggggaugugcugcaucaucaccgccuccauccuccucugguacgcgcaaauccagccacacuggaucgccgccagcaucauccuggaguucuuccugaucgugcuccugauccccgagcccgagaagcagcgaacgccccaggacaaccaacugacuuacgucgugauugccauccucaccgugguggccgcgaccauggccaacgagaugggcuuucuggagaagaccaagaaagaucuggggcucggcuccaucgccacgcagcagcccgagagcaacaucuuagacaucgaccugcgccccgccuccgccuggacccucuacgcaguagccaccaccuucgugacgccaaugcugcggcacagcaucgagaacuccuccguuaaugugagucugacugcuauagccaaccaagccaccgugcugaugggccuugggaaaggauggccacuguccaagauggacaucggggucccgcugcuggcgaucggcugcuacagccagguaaaucccaucacccuaacagcugcccuccugcugcucguggcgcacuaugcgaucaucgggcccggguuacaggccaaggccacccgcgaggcccagaagcgagcagcggccggcauuaugaagaaccccaccgucgacggcaucaccgugaucgaccuggacccgaucccguacgacccuaaguucgagaagcaacucggacaggucaugcugcugauacucugcgucacccaggugcugaugaugcgaaccaccugggcacuuugcgaagcccucacacuggccacggggcccaucuccacgcuaugggaggggaacccggggcgguucuggaacaccaccaucgcugugagcauggccaauaucuucagaggguccuaccucgccggggcugggcugcuguucagcaucaugaaaaacacaacuaacacccggcgcggaaccgggaacaugggcgagacgcucggggaaaaguggaagucccgccugaacgcccuugggaagagugaguuucaaaucuacaagaaguccggcauucaggaggucgaccgaacgcucgcgaaggaggggaucaagcgcggcgagaccgaccaccacgccguaagccggggguccgcaaaguugcgcugguuuguugagcgcaacauggucacccccgagggcaaggucguggaucugggcugcggacgcgggggguggagcuacuacugcggcgggcuaaagaacguucgagaggugaaaggccugacuaagggugguccaggccacgaggagcccauuccgauguccaccuauggguggaaccucgugcgccuccaguccggcgucgacgucuucuuuaucccucccgagaaaugugauacccuguugugcgacauaggggaaucaagcccgaacccgacgguggaggcgggccggacacuacgcguccugaaccugguugagaacuggcuuaauaacaacacgcaguucugcauaaaggugcuuaaccccuacaugcccuccgucauagagaagauggaagcgcugcagcggaaguacggcggggcuuuggugcgaaacccgcucagccggaacagcacccacgagauguacuggguguccaacgccagcggcaacaucgucuccagcgucaacaugaucucccgcaugcuuaucaacagguucaccaugcgccacaagaaagccaccuacgagcccgacguggaccuggggucuggcacgcguaacaucgggaucgaaagugagauccccaaucuugacaucaucggcaagcgcaucgaaaagaucaaacaggagcaugagaccucuuggcacuacgaccaagaccaccccuacaagacgugggccuaccaugguuccuacgagacgaaacaaacgggcagcgccuccucuauggucaacggcgucgugcgguuacugaccaagccgugggacguccuccccacggugacccaaauggccaugacggacaccacgcccuucggucagcagcgcguguucaaggagaaggucgauacccgcacacaggaacccaaggagggcacuaagaagcucaugaagaucaccgccgaaugguuauggaaggagcucggcaagaaaaagaccccgaggauaugcacgcgcgaggaguuuacccggaagguucguuccaacgccgcguugggggcgaucuucaccgacgagaauaaguggaagagcgcccgggaggcgguggaagacucccgguucugggagcugguggacaaggagcgcaaucuccaccuggagggcaagugcgagaccugugucuauaacaugauggggaagcgcgagaagaagcugggugaguuugggaaagccaagggcagccgggccauuugguacauguggcucggcgcgcgcuuucuggaguucgaagcccuaggcuuccugaaugaggaccacugguucuccagagagaacucgcuguccggcguggagggggaaggccugcauaagcucggguacauacugcgggacgugagcaagaaagagggcggcgccauguacgccgaugacacagcggggugggacacccggauaacgcuugaagaccucaagaacgaggagauggugaccaaccacauggagggcgagcacaagaagcuggccgaggcuaucuucaaacugacguaucagaacaaggucgugagggugcagcgucccacgccccgggggaccguuauggacauuaucucccggaaggaucagaggggcucgggacagguggggaccuacggccuaaacacguucacuaacauggaagcccagcugauucgacaaauggagggggaggggguguucaagaauauccagcacuuaacugucacagaagagguggccgugcagaacuggcucgcgcgggucggacgggagaggcugagucguauggccaucuccggcgaugacugcguagugaagccccuggacgaucgguucgccaacgcccuuacggcacugaacgacaugggcaagauccgcaaggauauccagcaaugggagccgagcaagggguggaaugacuggacucagguccccuuuugcucccaucacuuccaugaacugaucaugaaggacggccgggugcugguggucccgugccgcaaccaggacgagcugaucgggcgggcgcgcaucagccagggcgccggauggucucugcgggagaccgccugccucggcaagucguacgcccaaauguggagccugauguacuuccaucgccgugauuugcgcuuggcagcuaaugccaucugcagcgccguccccucccacugggugccgaccagccgaacgaccugguccauccacgccaaacacgaguggaugacgaccgaggacaugcugaccgucuggaaucgggucuggauccaggagaaccccuggauggaggacaagacacccguugagagcugggaggagaucccauaccucgguaagagagaggaccaguggugcgggucccucaucggccugacgucucgcgccacgugggcgaagaauauccaggccgccaucaaccagguccggucccuuaucgggaacgaggaguacacugacuauaugccgagcaugaagcgcuuccggcgcgaggaggaggaggcuggaguucucugguga

SEQ ID NO: 25360 - RNA, 9876 nt, Artificial Sequence
  derived and/or modified CDS sequence (opt11) from DENV-2__EU482643__SS-prME
agcgcgggcaugauaaucaugcugauccccacugugauggccuuccaccucacaacccgaaacggggaaccccauaugauugucggcauacaagagaagggcaaaagccugcuauucaaaaccgaggacggugugaacaugugcacccucauggcgauggaccugggggaguuaugcgaagacaccaucacuuacaaguguccccuccugcggcagaacgagcccgaagauauugacugcuggugcaauagcacuuccaccugggugaccuacgggaccugcacaacaaccggggagcauagacgugaaaagcgcagcgucgcccugguuccccacguggggaugggccucgagacccggaccgaaacguggaugucuagcgagggggcguggaagcacgcccagcgcaucgagaccuggauccugcggcacccgggcuucacgaucauggccgcgauccuggccuacaccaucgggaccacccauuuucaacgcguccucauauucauucugcugacggccguggcccccuccaugacuaugagauguaucggcaucagcaaccgcgacuucguagagggcguauccgggggcagcuggguggauaucguucuagagcauggguccugcgucaccaccauggcgaagaacaagcccacgcuggauuuugagcugaucaagaccgaggccaagcagccagccacccuccggaaguacugcauugaggccaagcugacaaauacgaccacugagagccggugcccgacccaaggcgaacccucccugaaagaagagcaagacaaacgguuugugugcaaacacagcaugguggaccgcggcugggguaacggcugcggccuguucggcaagggcgggaucgucacaugugccauguucaccugcaagaagaacauggagggaaagauugugcagccggagaaccuggaguacacuauagucguuacgccccacucuggcgaggaacacgcggugggcaaugacacggguaagcauggcaaggagaucaagguaaccccgcaaagcuccaucacagaggcggagcugacuggguacgguaccgucacaauggaguguagcccaaggacagggcuagacuucaacgagaugguacuccuucagaugaagaacaaggccuggcuagugcaccgccagugguuccuggaccugccccucccauggcugccgggggcggacaagcaggaguccaacuggauccagaaagagacucugguaacauucaagaacccccacgccaagaagcaagauguggucgugcucgguagccaggagggggcgaugcacacggcccugaccggcgcuaccgaaauccagaugucuuccgggaaccuccucuucaccggucaccucaagugccggcugcgcauggacaaacuccagcugaaaggcaugagcuacagcaugugcacgggaaaguuuaagguugugaaggagauagcagaaacccagcacgggaccauagucauucggguucaguaugaaggugacgggagcccuugcaagauuccguucgagaucauggaccuggagaagcgcuacguccucgggcgccugaucaccgugaacccgaucguaacggagaaggacucccccgucaauaucgaggccgagccgcccuuuggggacucguacaucaucaucgggguggagccgggucagcuaaagcucaacugguucaagaaagguucgagcaucgggcagauguucgagaccacuaugcgcggcgcgaagcgcauggccauacugggugauacggcgugggacuucgggucgcugggcggugucuucacgucaaucggcaaggcacuccaccaggucuucggggcuaucuauggggccgccuuuucgggcgugucuuggacaaugaagauccugaucgggguaauuauaacguggaucggaaugaacucccggaguaccuccuuaagcgucucccuggugcucguugggauugugacacuguacuugggcgugauggugcaggccgauagcgggugcgucguguccuggaagaacaaagaacucaagugcgggagcggaaucuucaucaccgacaaugugcacacauggaccgagcaguacaaguuccagcccgagucaccaucuaagcuugccagcgcgauacaaaaggcgcaggaggaggggaucuguggcauccgcucggucacgcggcuggagaauuugauguggaaacagauuacccccgaacugaaccauauccuggccgagaacgaggugaagcucacaaucaugacaggggacaucaaaggcaucaugcaggccgggaagcgcucgcugcgcccgcagcccacagaacuaaaauacuccuggaaaacauggggcaaggccaagaugcucagcaccgagucuuacaaccagaccuuccugauagacggccccgagacgaccgaaugucccaacaccaaccgcgcguggaacagccuggaaguggaagacuauggauucggcgucuucaccacgaacaucuggcucaagcugaaagagaaacaagaugccuucugcgauuccaaguuaaugagcgccgccaucaaggacaaucgggccgugcacgccgacaugggguacuggaucgaaucugcacucaacgacacguggaaaaucgagaaagccagcuucauugaggucaagaacugccacuggccaaagucccacacccuguggagcaacggcguccucgagucggagaugaucauccccaagaaccucgccgggcccgugagccagcacaacuaucgcccgggguaucacacccagauagccggccccuggcacuugggaaagcuggaaauggacuucgauuuuugcgacgguaccacggugaucgucaccgaagacugcggaaaccgggguccaucgcuucgcaccacgacggcgagcgguaagcugaucaccgagugguguugccggagcugcacccugcccccgcucagguaccgcggggaggacgguugcugguacgggauggagauucgcccacugaaagagaaagaagagaaccuggucaacucacucgugaccgccggccacgggcaggucgacaacuucagccuaggagugcuggguauggcccucuuccuggaggagaugcugcggacgaggguggggaccaagcacgcuauccuccuggucacaguguccuucgucacacugauuacgggcaacaugagcuucaaagacuuagggcgcgucgugguuauggucggcgcgaccauggccgacgacaucgguaugggcgugacauaccucgcccuccucgcugccuucaaggugcgccccaccuucgcggccggacuccuucuccggaagcuaacgucaaaggaacugaugaugaccaccauagggaucguccuucugucucaguccaccaucccagaaacggugcuggaacuaacggaugcccuggcucugggaaugauggugcucaagauaguacgcaacauggagaaguaucagcucgccgugaccauaauggcgauccugugcgucccgaacgccgugauccuccagaacgcuuggaaggugucaugcaccauccucgccguaguauccgugagcccucuccuccugacuuccagccagcagaagacagacuggauuccccuggccuugacuaucaaggggcugaaucccaccgcgaucuuccugacgacacugagucgcaccaacaagaaacggucauggccgcuaaacgaggccauuauggccgucggcauggugaguaucuuggccucaucucuucuuaagaaugacauacccaugaccggcccucugguagcuggcgggcuccugacgguaugcuacguauuaaccgggaggagcgccgaccucgagcuggagcgggccaccgacgugaagugggaagaccaagccgagaucuccgggagcagcccuauacugaguauaaccaucagcgaggacgggucaaugagcauaaagaacgaggaggaggagcagacgcucaccauccugauccgcacaggccugcucguuaucucaggccuguucccgaucagcauccccaucaccgcugcagccugguaccuuugggaggugaagaagcagagggccggcguucucugggacguacccagccccccgcccauggggaaggccgaacuggaagauggggcauaccgcaucaagcaaaaaggcauccugggcuacucucagaucggcgcgggggucuacaaagaggggaccuuucacacgauguggcacgugacccggggcgccguccuaaugcacaaagggaagcguauugagcccuccugggccgaugugaagaaggauuugaucuccuacggcgggggcuggaagcucgagggcgaguggaaggaaggcgaggaggugcagguccucgcacuggagcccggcaagaacccccgggcugugcagaccaaacccgguuuauucaagaccaacacaggcacaaucggggcggugucccucgauuucucucccgguaccagcggcucccccaucaucgacaagaaaggcaaggugguaggccuguacgggaacggcguggucaccagaucaggcgccuacgugagcgccaucgcgcaaacggagaaguccaucgaggacaauccagagaucgaagacgacaucuuccggaagagacggcugaccaucauggaucugcaccccggggccggcaagacaaagcgguaccugcccgccauagugcgggaagcaauaaagcgcgggcugcgaacccugauccucgccccgacgcgcguuguggccgcagagauggaggaggcucugcggggccugcccauacguuaccagacccccgccauacgggcugagcacaccgggcgcgagaucguggaucuaaugugccaugccaccuucacuaugcgccugcugagcccgguccgggugccgaacuacaaccucaucauaauggaugaagcgcacuucacagaccccgccuccauagccgcccgcggcuacaucagcacgcggguggagaugggcgaggcagcggggaucuuuaugaccgcuacgccacccggcagucgcgacccguuuccccaguccaacgcccccaucaucgacgaggagcgggaaauccccgagagaagcuggaacuccgggcacgagugggucaccgacuuuaagggaaaaaccgugugguucgucccuagcaucaaggcagggaacgacaucgccgcgugccuucggaagaacggcaagaaggucauccaacugucccgcaagaccuucgacagcgaguacgugaagacgcguaccaacgacugggacuucguggucaccaccgacaucuccgagaugggcgccaacuucaaggccgagcgcgugauagacccccggcgcugcaugaagccaguaauccucacggacggggaggagagagucauccuggcgggccccaugccggugacccacagcuccgccgcucagcgacgagggcgcaucggcagaaaccccaagaacgaaaacgaccaguacauauauaugggggagcccuuggagaacgacgaggauugcgcccacuggaaggaggccaagaugcugcuugacaauauaaacaccccagagggcaucauaccgucaauguucgagcccgagcgcgagaaggucgacgccaucgacggagaguaccgguuacggggggaggcgcgcaagacguucguggaccuaaugcggcgcggcgaccugccaguguggcuggccuacaagguggcagccgaggggauuaacuacgccgaccggcgcuggugcuucgacggcaucaagaauaaccagauccucgaggagaacguagagguggagaucuggacaaaggagggggagcgcaagaaauugaaaccgcguuggcuggacgcgcggaucuacagugacccccucgcccucaaagaauucaaagaguucgccgccggcagaaaaagccugaccuuaaaucugaucacggagaugggaagacugcccaccuuuaugacgcagaagacccgugaugcccucgacaaccuggcgguccuucacaccgcagaggccgguggccgggccuacaaccacgcguuaagugagcuacccgagacccuggagacacuccugcugcucacccucuuggcaaccgucacugggggcaucuuccuauuuuuaaugagcggccgggggauuggcaagaugacccuggggaugugcuguaucauaacggccaguauucuccugugguacgcccagauccagccgcacuggaucgccgcgagcaucauccuugaguucuuccucaucguucugcugauuccagagccugagaagcagcggaccccccaggacaaccaacuaacguauguagugaucgccauccugacuguuguagcagccacgauggcaaacgagaugggguuccuggagaaaaccaagaaggaucucggucuuggauccauugcgacccagcaaccggagucaaacauauuagacaucgaccuucgcccugccagcgccuggacgcuguacgccguggccacgaccuucgugacacccauguugcgucacagcaucgagaacagcagcgucaacgugucucucaccgcaaucgcaaaccaggcgacggugcugaugggccuggggaagggcuggcccuuauccaagauggacaucggggucccguuacuggccaucggcugcuacagccaggugaaccccaucacauugaccgccgcgcugcugcuccucguugcccacuaugccaucaucgggcccggccugcaagcgaaggcgacccgcgaagcacagaagcgggcagccgccggcaucaugaagaaccccacggucgacgggauaacggucaucgaccucgacccgauccccuacgaccccaaguucgaaaagcaguuaggccagguaaugcuguuaauucugugcgucacccaggugcugaugaugcgaaccacuugggcgcugugcgaggcucucacccuggcgaccgggccaaucuccacccucugggaagguaauccuggccgguucuggaacacgacaaucgccgugagcauggccaacaucuucagggguuccuaucuggcgggcgccgggcuccucuuuagcaucaugaagaacaccaccaacacgcggcggggcaccggcaacauuggcgaaacccugggcgagaaguggaagucccgccuuaaugcauuggggaaguccgaauuccagaucuacaagaaauccggcauccaagaggucgaucggacucuggcaaaggaggggauuaagcguggcgagacggaccaccacgcuguuagccgcgggagcgcuaagcugcgcugguucguggagcguaacauggucacacccgagggcaaagugguggaccucgguugcgggcgcggcggguggagcuacuacugcggcgggcugaagaacguccgcgaggucaaaggccugacuaagggcgggcccggacaugaggaaccaaucccgauguccaccuauggcuggaaccucguaaggcugcagagcggcgucgacguuuucuucauuccacccgagaagugcgacacgcuccucugugacaucggggaguccagccccaacccgaccguggaggcaggccgaacacugcgcguccugaacuuggucgagaacuggcugaacaauaacacccaauuuugcaucaagguccugaaccccuacaugcccuccgucauugagaagauggaggcccugcaaagaaaauacggcggggcucucgugcgcaauccucugagccggaacagcacccaugagauguacugggugucaaacgcgucgggaaacaucgugucaagcguaaacaugauuucgcgcaugcugaucaaucgcuuuacgaugcgccacaagaaggccaccuacgagcccgacguggaccucgguagcggcacccggaacaucggaaucgaguccgagaucccaaaccuagacaucauugggaagcgcaucgagaagaucaagcaggagcacgagaccagcuggcacuacgaccaggaucaccccuacaagacgugggccuaccacggguccuaugagacgaagcagaccgguagcgcguccucaaugguaaacggcguggugcggcugcucacuaagccgugggacguucugccgacggugacccagauggccaugaccgacaccacgcccuucggccagcagcgcguuuucaaggagaaggucgacacccgcacacaggagccuaaggagggcaccaaaaagcugaugaaaauuacagcugaguggcucuggaaggagcugggcaagaagaagacgccgcggaugugcacccgagaggaguucacccgaaaagugcguuccaacgcggcccugggcgccaucuucaccgaugagaacaaauggaagagcgcccgggaagcaguagaggacucgcguuuuugggagcucguugacaaggagcggaaccugcaccuggaaggcaagugcgagacuuguguguacaacaugauggggaagagggagaagaagcucggugaguucggaaaagccaaagggagucgcgccaucugguauauguggcugggugcucgcuuuuuagaauucgaggcccucggguuucugaacgaggaucauugguucuccagagagaacagccuuuccggcgucgagggggagggccuccacaagcuggguuauauuuuacgcgacgugagcaagaaggagggcggcgcgauguacgcagacgacacugccgggugggacacgcggaucacguuggaggaccugaagaaugaggagauggucacgaaccacauggagggcgaacauaagaagcuggccgaggcgaucuucaaacucaccuaccaaaacaaggucgugcgcgugcagagacccacgccccgggggacaguaauggacaucaucagccggcgcgaccagcgcggcuccgggcagguugggaccuacgggcugaauacguucacuaacauggaagcccaguuaauccgccagauggagggggagggugucuuuaagaacauccagcaucucacggucaccgaggaaguggcggugcagaacuggcuggcgcggguaggacgcgagaggcugagcagaauggccaucucgggagaugacugcguugugaagccccucgaugacagguucgcgaacgcccugaccgcccugaacgacauggguaagauccggaaggacauccaacaaugggagccgagcaagggguggaacgacuggacacagguccccuucugcucucaccacuuccacgagcucaucaugaaagacggccgcguccucgugguccccugccggaaccaagacgaacugauugggcgcgcucgcauaagccagggcgcaggguggucacuccgugaaacggcgugccugggcaagucguacgcucagauguggucccugauguacuuccaucgccgcgaucucagguuggccgccaacgccaucugcucggccgugccaucccauugggugccaaccucacggaccaccugguccauccacgccaagcacgaguggaugacgaccgaggacaugcugacugucuggaaccggguguggauacgcgacaaucccuggauggaagauaagacgccgguggagagcugggaggagauaccguaccucggcaagcgggaggaucaguggugugggucccugauuggccugaccagccgcgcaacgugggccaagaacauccaggccgccauuaaucagguccggucccucauggggaacgaagaauacaccgauuacaugccgucuaugaaacgcuuccgaagggaggaggaggaagccggcgugcuaugguga

SEQ ID NO: 25361 - RNA, 9876 nt, Artificial Sequence
  derived and/or modified CDS sequence (opt11) from DENV-2__EU482644__SS-prME
agcgccgggaugaucaucaugcugauccccaccgugauggccuuccaucucaccacucgcaacggcgagccccacaugaucgucggcauccaagagaaaggcaagagccugcuguuuaaaaccgaggauggggugaacaugugcacccuaauggcuauggaccugggggaacugugcgaggacaccaucacauauaaaugcccucuccugaggcagaacgagccagaggacaucgacugcugguguaacagcacguccacgugggugaccuacggcaccugcaccaccaccggcgagcaucgcagggagaagcgcagcguagcccuggugccccacguggggaugggccucgagacgaggacggagaccuggaugaguagcgagggggccuggaagcacgcccagcggaucgagaccuggauccuucggcaccccggcuucacgaucauggcagcgauacuggccuacaccauugggacgacccacuuccagcgcguccucaucuucauucuucugacggccgucgcccccagcaugaccaugcggugcauaggaaucagcaaccgcgauuucguggaaggugucagcggaggaagcuggguggacaucgugcucgagcacggguccugcguuaccaccauggcgaagaacaagcccacgcuagacuucgagcugaucaagaccgaggccaaacagcccgccacccuccgcaaguauugcauagaggccaagcugaccaauacgaccaccgagaguaggugcccgacgcagggggagcccucccuuaaggaagagcaggauaagcgguucgugugcaagcauagcaugguggauagaggcuggggaaacgguugcggccuauucgguaagggcgggaucgugacgugcgccauguucacaugcaagaaaaacauggagggcaagaucgugcagcccgagaaucuggaguacaccauaguagucacgccccacuccggggaggaacaugcggugggcaacgauaccgggaagcacggccaggagaucaaagugaccccgcagagcuccaucaccgaggccgaacuaaccggguacgguaccgucacgauggagugcagcccgcggaccggccucgacuucaacgagauggugcuguuacagauggagaacaaggccuggcucguucaccgccagugguuccuggaccugcccuugccguggcugccuggggcugacaagcaggaauccaacuggauucagaaagagacccuggucaccuucaagaacccccacgcgaaaaagcaggacgugguugugcucggcagccaggagggggcgaugcacaccgccuugacuggcgcuaccgagauccagaugagcuccgggaaccuccuguucacuggccaccugaagugccggcugcgcauggacaagcuucaguuaaagggcaugagcuacuccaugugcacagggaaguucaagguggucaaggagaucgcggagacccagcacggcaccaucgugauccgcgugcaguacgaaggggacggcagccccugcaagauccccuucgagaucauggacuuagagaagcgcuacguccucggccggcugaucaccguuaacccgaucgugacggagaaagauuccccugucaacaucgaagccgagccgcccuucggggacagcuacaucaucauaggcguggagccggggcagcugaagcucaacugguucaagaagggcuccucgaucgggcagauguucgaaacuacuaugagaggcgccaaacgaauggccauccuaggggacaccgcuugggauuucgggucccugggcgggguauucacgagcaucggcaaggcccuccaccagguguucggggccauuuacggcgcggccuucucuggggugucuuggacaaugaagauccugaucggcgugauaaucaccuggaucgggaugaacucccggagcaccucccugagcgucucccuggugcucguggggaucgucacgcuguaccugggcgucauggugcaggccgacagcgggugcgugguguccuggaagaauaaagagcuuaagugcggcucgggcauauucaucaccgacaacgugcauaccuggacggagcaguacaaguuccagcccgagucgcccuccaagcuagccagcgcgauccagaaggcccaggaggaggguaucuguggaauccgcuccgucacgcggcuggagaaccucauguggaagcaaaucacucccgaacugaaccacauacuggcugagaacgaggugaaguuaaccaucaugaccggggacaucaagggcauaaugcaggccggaaagcgcagccugcggccgcagcccacggagcugaaauacuccuggaagacguggggcaaggcgaaaauguuguccaccgaguccuacaaccagaccuuccugaucgacggccccgagacggcggagugcccgaacaccaaccgcgccuggaacucgcuggagguggaggauuacgguuucggcgucuucaccaccaacaucuggcucaaacugaaggagaaacaggacgccuuuugcgacucgaagcucaugagcgccgcgaucaaggauaacagggcggugcaugccgacaugggguacuggauagagagcgcccucaacgauacauggaagaucgagaaggcaagcuuuaucgaggugaagaacugucauuggccaaagucccacacccuguggucaaacggaguccuggaguccgagaugaucauucccaagaaccucgccggcccugugucucagcacaacuaccgcccgggguaccacacccagaucgcgggcccauggcacuuagggaagcuggagauggacuuugacuuuugcgauggcaccacggugaucgucacggaggacugcgggaaccguggccccagucucagaaccaccaccgcgucuggcaaacugaucacggaguggugcugcagguccuguacccugccgccacuccgcuaucgaggggaggacggcuguugguacgggauggagauccgcccccuaaaggagaaggaggagaaccuggugaacuccuuggugaccgccggccacgggcaggucgacaacuucagccuggguguucugggcauggcccuauuucuggaagagaugcugaggacuaggguggggacgaagcacgcgauccuccuggucgccgugucguuugucacccuuaucaccggcaauaugagcuucaaagaccucgggagagucguggucauggucggcgccaccauggccgaugauaucgggacgggcguuaccuaccuggcccugcucgcggccuucaagguucgccccaccuucgcggccggccuccucuugcguaagcugacauccaaggagcugaugaugacuaccaucgggaucguccuccugucucagucgacgauccccgagaccgugcuggagcucacggaugcccuggcgcugggcaugauggugcucaagaucguccgcaacauggagaaguaccagcuggccguaaccauuaugacuauucugugcgucccgaacgccgucauccuccaaaacgccuggaaggugucgugcaccauccuggccgucgugucugugaguccccugcuccuaacauccucgcagcagaaaaccgacuggauccccuuagcgcucaccaucaagggucugaaccccaccgcuaucuuccugacgacccucucccgcaccaacaagaaacggucuuggccacugaacgaggccauuauggccgucggcaugguguccauccuggcgagcucccuccugaagaacgacauacccaugaccggcccucugguggcagggggccuccugaccgucugcuaugugcugaccgggcgcagcgccgaccuugagcuggaacgggccaccgacgugaaaugggaagaccaggccgagauuuccggcagcagucccauccuguccaucacaauuagcgaggacggguccaugagcaucaagaacgaggaggaagagcagacgcucaccauccugauccgcaccggcuuacuugucaucuccggccuauucccgaucagcaucccgaucaccgcggccgcgugguaucugugggaggugaagaagcaacgggccgggguuuugugggacgucccgucaccgccucccaugggaaaagccgagcuggaggacggggcguaccgcaucaaacagaagggcauccugggguacagccaaaucggcgcuggcguauacaaagaggguaccuuccacacgauguggcacgucacgcggggcgccguccucaugcacaaggggaagcguaucgagcccaguugggcggacguuaagaaggaccugaucagcuacggcggcggcuggaaacuggagggcgaguggaaggaaggggaggaggugcagguccucgcccuggagcccggcaaaaacccccgggcggugcagaccaagcccgggcuguucaagaccaacacuggcacaaucggcgcagugucccucgauuuuagccccggcaccuccggcagccccaucaucgacaagaaggggaaggucgugggccuguacgggaacggcguggucacccgcuccggugcauacgugagcgccaucgcccagacggagaaguccaucgaagacaaccccgaaaucgaagacgacaucuuucggaaacgacggcugacgaucauggaucugcaucccggggcgggcaagaccaaacgcuaucuccccgccauuguucgggaggccaucaagcgcgggcugcggacccugauccucgcccccacgcgcguuguugcggcggagauggaggaggcacucaggggcuuaccgauucgcuaccagacccccgccauccgggcggagcacaccgggcgcgagaucguggaccuaaugugccacgcuaccuucacgaugcgucugcugagccccguccgcgugccgaacuauaaccucauuaucauggacgaggcgcacuucacagaccccgccuccauagccgcccgcggcuacauaagcacccggguggagaugggcgaggcggccgggaucuucaugacggccacgccgcccggcagccgcgauccguuuccucagucaaacgcccccauuaucgacgaggagagagagauccccgagcgcagcuggaacaguggacacgagugggucacggacuucaagggcaaaaccgugugguuuguaccaagcaucaaagccggcaacgacaucgcggccugucugcggaagaacggcaagaaggucauccagcugucccgcaagaccuuugacagcgaauacgugaaaacgcguaccaaugauugggacuuuguggucaccaccgacauuuccgagaugggcgccaacuucaaggcggagcgcgugauagacccucggcgcugcaugaagcccgugauccucacggacggggaggagcgggugauacuggcgggccccaugccggugacccacucauccgccgcacagcgccggggacgcaucggcagaaacccuaaaaacgagaacgaucaguacaucuauaugggggaaccccuggagaacgacgaggacugcgcccacuggaaggaggccaagaugcuccuggacaauaucaacacccccgagggcaucaucccgaguauguucgagcccgagcgcgagaaaguggacgcgaucgacggcgaguaucgccugcguggagaggcccgcaagaccuucgucgaccucaugcggcgcggcgacuugcccgugugguuagccuacaagguggccgccgaggggaucaacuacgcggaccggcgcuggugcuuugacggcaucaagaacaaucagauccucgaggagaacgucgaaguggaaaucuggacgaaggagggggagcggaagaagcugaagccgcguuggcuggaugcccggaucuacuccgacccacucgcccugaaggaauucaaggaguucgccgccggccgcaagagccugacgcucaaucugaucaccgagaugggucggcugccuaccuuuaugacgcagaaaacccgcgacgcgcuagauaaccuggcuguacuacacaccgccgaggccgggggccgggcguacaaccacgcccucuccgagcuccccgaaacccuggagacgcuccuguugcuaacgcugcuggcgaccgugaccgggggcauuuuccucuuccugaugagcgggcgcgggaucgggaagaugacccuagggaugugcugcaucaucacggccuccauccuccugugguacgcgcagauccagccccacuggauugcggccagcaucauccuggaguucuuccucauaguacugcugauccccgagcccgagaaacagcggacaccucaagacaaccagcuuacuuauguggugaucgccauccugaccguggucgccgccacgauggcuaacgagaugggcuuccuagaaaagacuaagaaggaccuugggcugggcuccaucgccacccagcagccggagagcaacauccuggacauagaccuccgccccgccuccgccuggacccuguacgccguugcgacgaccuucgugacacccaugcugcggcacucaaucgagaacuccuccgucaacgugagccuaaccgccaucgcgaaucaggcaacgguguuaaugggccucgggaagggcuggccccucucuaaaauggacaucgggguaccgcugcuggccauuggcugcuacucccagguaaaccccaucacucucaccgcggcccugcugcuucugguggcucacuacgcuauuauugggccgggacugcaagcgaaggccacucgugaggcccaaaagcgggccgccgcggggaucaugaagaaccccacggucgaugggaucaccgugaucgaccucgacccgauccccuacgaccccaaguucgagaagcagcuaggccaggugauguuacugauccugugcgucacccaggugcugaugaugcgcaccacgugggccuuaugcgaggcguugacccuggccaccgggccuaucuccacccucugggaggggaacccggggcgguucuggaacacgaccaucgccgugagcauggcgaacaucuuucgcggcucauaccuugccggcgcaggccuccucuucucuauuaugaagaacacgaccaauacccggcgcggcaccgggaacaugggggagacccugggcgagaaauggaagagucgccugaacgcccucgggaaguccgaguuccagaucuacaagaagaguggcauacaggaagucgaccggacccuggccaaggaggggauuaagcgcggcgaaaccgaccaccacgcggugucaaggggguccgccaagcugcgaugguucguggagcggaacauggucacccccgagggcaaggugguggaccucggcugcgggcgcggaggguggagcuacuacugcggcgggcuuaagaacgugcgggaggugaaagggcuuacuaaaggggggcccggacacgaagaacccaucccgauguccaccuacggguggaaucucgugcgccugcagagcggcgucgacguguucuucaucccucccgaaaaaugcgacacgcuguuaugugacaucggggaguccagcccaaauccgaccgucgaggccgggagaacccugcgcguccugaaucucguggagaacuggcucaacaacaacacccaguuuuguaucaaggugcugaaccccuacaugcccuccgucaucgagaagauggaagcccugcagaggaaguauggcggggcgcucgugcgcaacccgcugucacggaacagcacgcacgagauguacugggugucaaacgccuccgggaacaucgucucuucggugaacaugaucucccggaugcuaaucaaccgguucacgaugcgccacaaaaaggcuaccuacgagcccgacguugaccucgggaguggcaccaggaacauagggaucgaguccgagauucccaaccuugacaucaucggcaaaagaaucgagaagaucaagcaggagcacgaaaccucauggcacuacgaucaagaccaucccuauaagaccugggcuuaccacggcuccuacgagaccaagcaaacggguucagcaagcagcauggucaacgggguggugcggcugcucaccaagccgugggacguccugcccacgguaacccagauggcgaugaccgacaccacgcccuucggucagcaacgcguauucaaggagaaggucgacacccgaacccaagagcccaaggagggcaccaagaagcugaugaagaucacugccgaguggcucuggaaggagcuaggcaagaagaagaccccacggaugugcacccgcgaggaguucacccggaaggugcgguccaacgccgcccucggggcgaucuucacagaugagaacaaguggaaauccgcgcgggaggccguggaagauucucgauucugggagcucgucgacaaggagcggaaccugcaccuggagggcaaaugcgagaccugcguguacaacaugauggggaagcgcgagaagaagcucggcgaguucgggaaggccaaaggcagcagagcuaucugguauauguggcugggcgcgcgcuuccuggaguucgaggcacuuggguuucugaaugaggaucacugguucucccgggagaauagccuuucaggcgucgagggggagggccuccacaagcugggguacauccugcgcgacguguccaaaaaggagggcggcgccauguaugccgacgauaccgcggggugggauacccggaucacgcucgaagaccuaaaaaacgaggagauggugaccaaccacauggagggagagcacaagaaacuggccgaggccauuuucaagcucacguaccaaaacaaggucgugcgagugcagcggcccacgccccgggggacggucauggacaucauuagccggcgcgaccaaagaggcagcggccaggucgggaccuacggccugaacaccuucaccaacauggaggcccaacugauccgccaaauggagggggaagggguuuucaagaacauccagcaccucaccgucaccgaagagguggccgugcagaacuggcuggcaagggucgggagggagcgcuugucccgcauggcgaucuccggcgacgauugcgugguuaaaccccuggacgaccgcuucgccaacgcccugaccgcucugaaugacaugggcaagauccggaaggacauccagcagugggagccgagcaagggguggaacgacuggacccaggugccguucugcucccaccacuuccacgagcucaucaugaaggauggcagggugcuagugguccccugccgcaaccaggacgagcucaucgggagggccagaaucagccagggggcuggauggucucuccgcgagacugccugucugggcaaaagcuaugcccagauguggucccugauguauuuccaccggcgcgaccuccgguuggccgcuaaugccauuugcagcgccgugcccucccacugggugccaaccagccgcaccaccugguccauccacgcgaagcacgaguggaugaccacugaggacaugcugaccgucuggaacagaguguggauccgggagaaccccuggauggaggacaagaccccgguggagagcugggaggagauccccuaucuuggaaagcgggaagaccaguggugcgggucccugauuggccugaccagccgagcuacgugggccaagaacauccaggcagccaucaaccaaguccggagccucaucgggaacgaggaguacaccgacuacaugccgagcaugaagcgcuuccggcgcgaggaggaggaggcugguguguugugguga

SEQ ID NO: 25362 - RNA, 9876 nt, Artificial Sequence
  derived and/or modified CDS sequence (opt11) from DENV-2__EU482645__SS-prME
agcgcugggaugaucauaauguuaaucccaaccgugauggcuuuucauuugaccacccggaacggggaaccccacaugaucgugggcauccaggaaaaaggcaagagccugcuguuuaagaccgaagacggggugaauauguguaccuuaauggcgauggaccuaggggaacugugcgaagauacuaucacguacaaaugcccccuccugcggcagaacgaacccgaggacaucgacugcugguguaauuccaccagcaccuggguaaccuacgggaccuguaccaccacgggcgagcaccgccgugaaaaacgcagcgucgcucuugugccccacguggguaugggguuggaaacccggacugagacauggaugagcagcgagggggccuggaagcaugcccagcgcaucgagacuuggaucuuacgccauccagguuucacgauaauggccgcgaucuuggcauauacuaucgggaccacccacuuucagaagguccucaucuuuauccugcugacagccguugcccccagcaugaccaugcgcuguauugguauuuccaaccgggacuuuguagagggcgucagcgguggguccuggguagacaucguacuagagcacgggucgugcgucaccaccauggcgaagaauaagcccacgcuggacuuugaguuaaucaagacggaagccaagcagccugccacccuccgcaaguacuguauagaggcaaagcuaacaaacacaaccacagagucccggugccccacccagggggagcccucccugaaggaagaacaggacaagcgcuuugugugcaagcauuccaugguggaucggggauggggaaacggcugcggucuuuucggcaagggcgggaucguaacgugugccauguucacgugcaagaaaaacauggaggguaagaucguacagcccgagaaccuggaguacaccaucguugucaccccacacuccggggaggaacacgcggugggcaacgacacggggaaacauggccaggagaucaaggugaccccacaaagcucuaucacugaggcggaacuaaccggauauggcacaguuaccauggaauguagcccccgcaccggccucgacuucaaugaaauggugcuguugcagauggagaauaaagccuggcuuguccacaggcaaugguuucuggaccugccucuccccuggcugccgggggccgacaagcaggagaguaacuggauccagaaggagacucuagucaccuuuaagaacccccacgccaagaaacaagacguaguggugcucggcagccaagagggggcaaugcacacggcccugacuggcgccaccgagauccagaugagcuccgguaaccugcuguucacaggucacuugaagugucgucugcggauggauaagcuacagcuuaaagguaugagcuacagcauguguaccgggaaguucaagguggucaaggagaucgccgagacccagcauggcacgaucgugauccgggugcaguacgagggggacggcagccccugcaagauaccuuuugagaucauggaccuugagaaaagguacguccucggccgccucaucacggugaacccgaucgugacagagaaagacucccccguuaacaucgaggcagaaccgcccuuuggagacucauauaucauaaucggcguggaaccggggcagcugaagcucaauugguuuaaaaagggaaguagcaucgggcagauguuugagaccaccaugcggggcgcaaaacgcauggcuauccugggagauaccgcgugggauuuuggcucucugggagggguguucacgucaauaggaaaggcauuacaccaggucuucggggcaaucuacggagcagccuucucaggcgugucguggacaaugaagauccugaucggggugaucauaaccuggaucgggaugaacucccggagcaccucccucucuguaucccugguguuggugggcauaguaacacucuaccuggggguaauggugcaggcagacagugggugugugguguccuggaagaacaaggagcucaagugcgguuccgguaucuucauuacggauaaugugcauaccuggaccgagcaauacaaguuucaacccgaauccccguccaagcuagccagcgcuauacagaaggcccaggaagaggggauaugcggcauccgguccguuacgcgccuggagaaccugauguggaagcagauuaccccugaacugaaccacauccucgccgagaacgaggugaagcucaccauuaugaccggggacaucaagggcaucaugcaggcuggcaaacggucucugcgcccacaacccacugagcugaaguacuccuggaaaaccuggggcaaagccaagaugcucagcaccgagucguacaaccaaacauuccugauagacggucccgagacggcggagugcccgaauaccaaccgggccuggaacagucuggagguggaggacuacggguuuggcgucuucacuaccaacauauggcucaagcugaaggagaaacaggacgcauucugcgauucgaagcugaugagcgccgccaucaaggacaaucgggcggugcacgccgacaugggcuauuggaucgaguccgcccucaacgacacguggaaaaucgagaaagcuaguuuuaucgaggugaagaacugucauuggcccaagucccauacgcuguggagcaacggcguucucgaguccgagaugauuauucccaagaaccucgcaggaccagugagccagcacaacuaucggccgggguaccauacccagaucgcgggcccauggcauuuagggaaacuugaaauggacuucgauuuuugugacgguaccaccgugauagucacggaggauugugggaaucgagggcccucccucaggaccacaaccgcaagcgguaagcucaucacggaguggugcugcaggagcugcacccugcccccgcuccgcuaccguggggaggacgguugcugguacggaauggagauccguccccugaaagagaaggaagagaauuugguaaacucgcucguuacagccggccaugggcaagucgauaacuucagccucggcguacuggguauggcccucuuccuggaagagaugcugagaaccaggguggggacgaagcaugcaaucuuguugguagccgucagcuucgucacccugauaaccgggaacauguccuucaaggacuuagggcgugucguugucauggucggcgccaccauggccgacgauaucgggacaggagugaccuaccuggcgcuccucgcggcauucaaggugagacccacauuugccgccggccucuugcuccgaaaacugaccuccaaggagcugaugaugaccaccaucgggaucguccuccuaucucagucaaccauuccugagaccgugcuggaacuaacagacgcccucgcccuuggaaugauggugcucaagaucgugcggaacauggaaaaguaccagcuggcggugaccauuaugaccauccugugugucccgaacgccgugauccuccagaacgcguggaaggucagcugcacuauccuugcugucguguccguaagcccccuguuguuaacuuccagccagcaaaagaccgacuggaucccacuggcgcucaccaucaaggggcugaaccccacggcuauuuuccuuacgacccuaucccgcaccaacaagaagcgcagcuggccucuuaacgaggcgauaauggcaguuggcaugguuuccauucuggcgucaucacuccucaagaaugauauaccgaugaccgguccccuaguggcagggggcuugcugacggugugcuacguucugaccggacgaagugccgacuuagagcuggagcgcgccaccgacguaaagugggaagaucaggccgaaauuucaggcucuagcccgauacuguccaucaccaucucagaggacggguccaugaguauaaagaacgaggaggaggagcagacacuaacuauauugauucggaccggccuucucguuaucuccggcuuauuccccaucagcauucccaucacggccgcagcaugguaccugugggaggugaagaaacaacgggcggggguuuuaugggacgugccaagcccgccgccgaugggaaaggccgagcucgaagacggcgcguacaggauuaagcaaaaaggcauccugggguauagccaaaucggagccggugucuacaaggaggggacauuccacacgauguggcacgugacccggggcgccguccucaugcacaagggcaaacggauugagcccucaugggccgaugucaaaaaggaccugaucagcuauggcgguggcuggaagcuagagggcgaauggaaggaaggggaggaagugcagguccucgcccuugagcccgguaaaaacccccgugcugugcagaccaagcccgggcuguucaagaccaacacgggcaccaucggggcugucagccuggauuuuucucccggaaccucuggcagccccauaauagauaaaaaggggaaggucgucggccucuacgggaacggcguuguuaccagauccggcgcguaugugagcgccaucgcucagacggagaaauccauugaggauaaccccgagaucgaagacgacaucuuccguaagcggcgcuugaccaucauggaccugcaucccggggccggcaaaaccaagcgauaccuccccgccaucguucgcgaagccauuaagcgggggcugcgcacucugauacuagccccgacgcgcguaguggcggccgagauggaggaggcccuacggggcuuacccauccgguaccaaacgccugcgauacgcgcggagcacacaggucgugagaucguggaccucaugugccacgcgaccuucacgaugaggcugcugagcccgguccgcguaccgaacuacaacuugaucaucauggacgaggcucacuuuaccgaucccgcauccaucgcagcccggggcuacauaagcaccaggguagagaugggcgaggcggccgggauauucaugacugcaacgccgcccggcucacgggacccguucccacaguccaacgccccgaucauagaugaggagcgagagauucccgagcggagcuggaacucuggucacgagugggugacagacuucaagggcaagaccgugugguucgugccgagcaucaaggccgggaacgacaucgcagccugccugagaaagaacggcaaaaagguaauccagcugagucggaaaacuuucgacagcgaauacguaaaaacccgcaccaacgacugggacuucgucgucacgaccgacaucagcgagaugggcgccaacuuuaaggccgagcgggugaucgauccccggcggugcaugaaaccggugauccugaccgacggagaagaacgagucauccuggcaggcccuaugccggugacccacagcucggccgcccagcggcgcggccggauuggcaggaaccccaagaacgagaacgaucaguauaucuauaugggagaaccccuggaaaaugacgaagacugugcccacuggaaggaagcaaagaugcuccucgacaacauuaacacccccgaaggcauuauaccgagcauguucgagccugagcgggaaaaaguggacgcuaucgacggcgaauaccgucugcgaggggaagcccgaaagacguucguggaccucaugcgcagaggcgaccuaccaguguggcuggcguacaagguggccgccgaggguauaaauuaugcggaccgucggugguguuucgauggcauaaagaacaaccaaaucuuagaggagaauguugaaguggagauauggacgaaggagggggagcguaagaagcugaagccgcgguggcuggacgcccguaucuacagcgacccccuggccuuaaaggaguucaaggaguucgcggccgguagaaagucgcugacucucaacuuaaucacagagaugggacgauuacccaccuucaugacgcagaagacucgggaugcgcuggacaaccuggccgugcuccauaccgccgaggcugggggccgcgcguacaaccacgcccucuccgaacugcccgagaccuuagagacgcucuugcuacucacccuguuggccacugugaccgggggcaucuuccuauuccugauguccggccgggggaucggaaagaugacccugggaaugugcugcaucaucacggcaaguauccuccugugguacgcccagauccaaccgcacuggaucgcggccagcauaauccuggaguucuuccucaucguacugcugauccccgaaccagagaagcagcgcacgccccaggacaaccaguugaccuacguggugauugcgauccugacuguagucgccgccacgauggcgaacgagaugggcuucuuggaaaagaccaagaaggaccucggguugggguccaucgccacccagcagccggagucuaacauacuggacaucgaucuacggcccgccucugccuggacccuuuaugccguggcgacgaccuucguaacacccaugcugagacacucaaucgagaauagcucagucaacguaucgcucaccgcuaucgcaaaccaggcgacgguguuaauggggcuggggaaggguuggccgcucucaaaaauggacaucgggguaccauugcuggccauaggcugcuauagccaggugaacccgauaacccucacggcggcccuccugcuucugguggcgcacuacgccauaaucgggccuggcuugcaagcgaaggcuaccagagaagcccaaaaacgugccgccgccgguaucaugaagaaccccacgguagaugggaucacaguaaucgaccucgaccccauaccuuaugaccccaaauucgagaagcagcucggacaggugaugcugcucauacugugugucacccaaguguuaaugaugcggacaacgugggcccuuugugaagcccugacccuagccacggggccuaucucuaccuugugggagggcaacccggggcgcuucuggaacacgacuauugccgugagcauggcgaauauuuuccgaggcuccuaccuugcaggggccggacuccuuuucagcaucaugaaaaacaccaccaacacccguagggggaccgggaacaugggcgagacucugggcgaaaaguggaagucgcgccugaaugcccuaggaaagagcgaguuccagaucuauaagaaauccggcauucaagaagucgaucgcacguuggcgaaggaggggaucaagcggggagagacagaccaucaugccguaucucgcgggagugcgaagcugcggugguucguggagcgcaacaugguuaccccagaggggaaggucguggaccugggcugcgggcggggcggcuggagcuauuacugcggagggcuuaagaacguccgcgaagucaagggccugaccaagggcgggcccgggcacgaagaacccaucccgaugucuacauaugguuggaaccuggucagacugcagagcggugucgacgucuucuucauuccgcccgagaaaugcgauacacuccucugugacaucggggaguccagccccaacccgaccguggaggccgggcguacgcuucggguccugaaccucguggaaaacuggcuaaacaacaacacccaauucugcauuaagguucugaacccguacaugcccuccguaaucgagaaaauggaggcucuacagcgcaaguacggcggagcgcucguccggaacccgcugagucgcaacagcacccacgagauguacuggguauccaacgccagcggcaacaucgucucuuccgugaacaugaucucucggauguuaaucaacagguucacgaugcgccacaagaaagccaccuacgagccggacguagaccucggcagcggcaccagaaacauagggauugagucggaaaucccgaaccuggauaucaucgggaaacggaucgagaagaucaagcaggagcacgagaccagcuggcacuacgaccaggaccaccccuacaagacgugggcguaucacggcucauacgaaaccaagcaaacgggcagcgccuccucuauggucaacggcguggugaggcuacuaaccaagcccugggauguucugcccacaguuacccagauggcgaugaccgacaccacgcccuucgggcagcagagaguuuucaaagaaaagguggacacccggacgcaggagcccaaggaaggcacaaagaagcugaugaagauaacggccgaauggcucuggaaagaguuggguaaaaagaaaacgccgcgcaugugcacccgggaggaguucacccggaaggugcgcaguaacgccgcucugggggccaucuucacggacgagaacaaguggaaguccgcgcgcgaggccguggaagauucccgguucugggagcucgucgacaaggagcgcaaccugcaccuggagggcaaaugcgaaaccugcguguacaauaugauggggaagcgggagaagaagcucggcgaguucgggaaggcaaagggcucuagggccauaugguacauguggcugggcgcacgguucuuagaguucgaggcgcucggguuccucaacgaggaccacugguucucacgcgaaaauucgcucuccggaguugaaggcgaggggcuccacaagcugggcuacauauugcgugacgugucuaagaaggaaggcggcgccauguacgccgacgauacugccgguugggacacgcgcaucacguuggaggacuuaaagaacgaggagaugguuaccaaucacauggagggugagcacaagaagcuggccgaagcgaucuucaaauugaccuaccagaauaagguugugcgggugcagaggcccacgccccgggggacugucauggacaucauaagcagacgggaucagagaggcuccgggcaggucggaacguacgggcugaacaccuucaccaacauggaagcccagcugauccggcagauggagggggagggaguauucaagaacauccaacaccucacggucacggaggagguggcgguccagaacuggcuugcgcgcguagggcgugagcgucugucccgcauggccaucucgggcgacgacugcguaguuaagccucucgacgaucgguucgcuaacgcccucaccgcgcugaacgacaugggaaaaauccgcaaggauauacagcagugggagccgucuaaaggguggaacgacuggacucagguaccuuucugcucccaucauuuucacgagcucauaaugaaggacggccggguacugguuguucccugccgcaaccaagaugagcugauagggcgagcccgcaucucucagggcgcaggauggucacucagagaaacagcuugccuuggcaaguccuacgcucagauguggucccuuauguacuuccacaggcgggaccuccgcuuggccgccaacgcgaucugcagcgcagugcccucucacuggguaccgaccucucggaccaccuggucuauccacgccaagcacgaguggaugacgacggaagacaugcucaccguauggaaccgcgucuggauccgggagaauccauggauggaggacaaaaccccaguggagagcugggaggaaauccccuaucucggcaagcgugaggaccaguggugcgggucccugaucggccuaacuagccgggcuacaugggccaagaacauacaggcugccaucaaccaaguccgaucccucauagguaaugaggaguacacugacuacaugccaaguaugaagcgguucagaagagaggaggaggaggccggcguacugugguga

SEQ ID NO: 25363 - RNA, 9876 nt, Artificial Sequence
  derived and/or modified CDS sequence (opt11) from DENV-2__EU482646__SS-prME
ucggcugggaugaucauuaugcugauccccaccgugauggcauuccaccuuacuacccggaacggggagccccacaugaucgugggaauccaggaaaaggggaagagccucuuguuuaagacggaggacggagugaacaugugcacauugauggcgauggaucugggagagcugugcgaggauaccaucacguacaaaugcccccuccuacggcagaacgagccugaggacaucgacugcugguguaacagcacaagcacgugggugacuuacgggaccugcacuacuaccggcgagcaccgacgcgagaagcgcagcgucgcccuggugccccacguugggaugggccucgagacccgaacagagaccuggauguccagcgagggggccuggaagcacgcacagcgaauugagacauggauucuacgccacccggguuuuacaaucauggccgcgauccuggccuacacgaucgggaccacccauuuccagcgcguccucauauucauacuguugacggcaguggccccuucaaugaccaugcggugcauaggcauuucuaaucgcgacuucguagagggcgucuccgggggcagcuggguggacaucgugcucgagcacgggaguugcgugaccacuauggcgaagaacaagccuacuuuagauuucgaguuaaucaaaaccgaggccaagcagcccgcuacuuuaaggaaguacugcauugaggccaagcugaccaauacgaccacugagucucguugccccacccagggcgagccaucccuuaaggaggagcaggacaagcgguuuaucugcaagcacagcaugguagaccgaggcugggggaacgguugcggacuguucggaaaggguggcaucgucacgugcgccauguucacgugcaaaaagaacauggaaggcaagauaguccagcccgagaaccuggaguacacaaucgugguaacuccccacuccggggaggaacacgcgguagggaacgacacggggaagcacggaaaagaaaucaaggugacuccgcagagcucaaucacggaggccgagcugacgggguaugguaccgugacgauggaguguagccccagaacgggucucgacuucaacgagaugguccuucugcagauggagaacaaagccugguuagugcaccgccagugguuccuggaccugccucucccauggcugccgggggccgacaagcaagagucaaacuggauccagaaagagacgcuggugaccuuuaagaauccccaugccaagaaacaggauguagugguccucggcagccaggagggagcgaugcacaccgcccuuaccggcgcuaccgagauucaaaugucaagcggaaaucuccuuuucacuggccaccugaagugccggcugcgcauggacaagcuccagcugaagggcaugagcuacuccaugugcacggggaaguuuaaggucgugaaggagauugccgagacccagcauggaaccauugucaucagggugcaguacgaaggcgacggcagccccugcaagauccccuuugagaucauggaccuggagaagcgcuacgugcucggccggcugauuaccgucaacccgauagugacggagaaagacaguccugugaacaucgaagccgagccgcccuucggggacagcuauaucaucaucggagucgagcccgggcagcugaaacucaacugguucaagaagggguccagcauagggcaaauguucgaaaccaccaugcgcggcgcgaagcgcauggccauccucggugacaccgcgugggacuucggcucccucgguggugucuucacgagcauaggaaaggcccugcaccagguauucggggccaucuacggcgcggccuucagcggcgucucguggacgaugaagauccugaucggggugauuaucacguggaucggcaugaacuccagaagcaccucccuuagcguaucccuaguucucguagguaucgugacccuguaccugggcgucaugguccaggcugacucagggugcguggucuccuggaagaacaaagagcucaaguguggcagcggcauuuucaucaccgacaacgugcacaccuggaccgagcaguauaaguuccagcccgagagcccauccaaguuggccucggcgauccagaaagcccaggaggaggggaucugcggcaucagguccgugacgaggcuggaaaaccucauguggaagcagauaacaccagagcugaaccacauccuggccgagaacgaggucaagcuuacaaucaugacuggggacauaaagggcaucaugcaggccggaaagcgcagccugcggccgcagcccacggagcugaaguacuccuggaaaacguggggcaaggcaaagaugcucucgaccgaguccuacaaccagaccuuccugaucgauggucccgagacggcggagugcccgaacaccaaccgggcauggaacucuuuagaaguugaggacuacggauucggcguauucacuacuaacauuuggcucaagcugaaggagaagcaggacgcguucugcgacagcaagcuaaugagugccgccaucaaagacaaccgggcgguccacgccgacauggguuacuggaucgaauccgcccugaacgacacguggaagaucgagaaggcuagcuucauagagguaaagaauugccauuggcccaagucccacacccuguggagcaacggaguacuggaaucagagaugaucaucccuaagaaccucgcuggccccguaagccaacacaacuacagacccggguaccacacacagaucgcgggccccuggcaccugggaaaacuggagauggacuucgauuucugcgauggcaccaccgugauaguuacugaggauugcgggaaccggggccccucccuccgcaccaccaccgccagcggcaagcugaucacggaauggugcuguaggucuuguacacugccuccgcuccgcuaccgcggggaggaugggugcugguacgggauggaaauccguccacuaaaggaaaaggaagagaaccuugucaacucgcucgucaccgcgggucacggccagguggauaacuuuagccucggcguccuaggcauggccuuguucuuagaggagaugcugcggacccgcguggguaccaagcaugcgauacuucugguggcugucuccuucgugacgcuuaucaccggcaacaugucauucaaggacuuggggagaguggucgugauggucggugcgacuauggccgacgauaucgggaugggcgucacauaccuggcgcugcucgcggccuucaaggugcgccccaccuuugccgccggccugcuccuacgcaagcuaacuucaaaagagcugaugaugaccacgaucggaaucgugcuccugagccagucaaccauccccgagaccgucuuggagcucaccgacgccuuagcguuaggcaugauggugcucaagaucgucagaaacauggagaaguaucagcuggcugucacuauuauggccauccuaugcgugcccaacgcagucauccuccaaaacgccuggaaaguuagcugcaccauccuggcgguagucuccguuagcccauuacuccugaccuccucgcagcaaaagaccgacuggaucccccuggcccuuacgaucaaggggcugaaucccaccgccaucuuccugaccaccuugucccgcacgaacaagaagcggagcuggccgcugaacgaggccaucauggcggucggaauggucucuauccuggccagcagucuucugaaaaacgauauccccaugaccgggccccugguggccgggggccuacugaccguguguuacguacugaccggacgcagugcagacuuggagcuggagcgggcuacggaugucaagugggaggaccaagccgagauaucaggcagcagccccauucugucgaucacgaucuccgaggacggguccaugagcaucaagaaugaggaggaagagcagacccucacuauccugauacgcacgggccugcucguaaucuccggccuguucccgauuagcauccccauuaccgcagccgccugguaccugugggaggucaagaagcagagggccggagugcucugggacgugccaagccccccccccauggguaaggcggagcuggaggacggggccuaucgcaucaagcagaagggaauacugggguacagccaaaucggggccggcguauauaaagaggggacguuccacaccauguggcacgugaccaggggcgccgugcucaugcacaaggggaagaggauagagccauccugggcggacgucaaaaaggaccugaucagcuauggcgggggguggaagcuggagggcgaauggaaggaaggggaggagguccaagugcucgcgcucgagcccggcaagaacccacgugccguccagacgaaacccgggcuguuuaagacuaauaccgggaccaucggggcagugucacucgacuucagucccggcacguccggcucucccaucaucgacaaaaaaggcaagguggucggccuguacggaaacggcguuguuacccgcuccggcgccuacgucagcgccaucgcgcagaccgagaaguccauugaggacaaccccgagauagaggacgacauauuccggaaacgccgguuaaccaucauggaccugcacccgggggccggcaagaccaagcgcuaucuccccgccaucgugcgggaggccaucaagcgcgggcuacggacccugauucuagcgccgacccgcguggucgccgccgagauggaagaagcccuucggggcuuaccgauccgcuaccagacccccgcaauacgcgccgagcacacggggcgagagaucguugacuuaaugugucacgcaaccuuuacgaugcgccuguugagccccgucagagucccgaacuacaaucucaucaucauggacgaagcgcacuucaccgaucccgcauccaucgcagcgcgcgguuacaucagcacgaggguggagaugggcgaggccgccgggaucuucaugaccgcaacgccgcccggcagccgcgauccguucccccagaguaacgcccccauaaucgacgaggagcgggaaaucccugagcgcagcuggaacagugggcacgagugggugacggacuucaagggcaagacggucugguucgugccgagcaucaaggcagggaaugacauagccgccugccucaggaaaaacggcaagaaggucauccagcugagcaggaagaccuucgauagcgaguacgugaagacccggaccaacgacugggacuuugugguuacgacagacaucucggagaugggcgcaaacuucaaggcggagcgcgucaucgacccccgccgcugcaugaagccggucauccucaccgacggggaggagagggugauccuggcuggccccaugccggucacccauagcuccgccgcccagcgacgggggcgcaucggccggaacccuaagaacgagaacgaccaguauauauacaugggggagccccucgaaaacgacgaggauugcgcccauuggaaggaagcgaaaaugcuccuggacaauauuaauacgcccgagggcaucauaccaucuauguuugagcccgagagggagaaaguggacgcgauagacggcgaguaccgacuccgcggggaggcccgcaagaccuucguggaccucaugcgccgcggcgaccuccccgucugguuggcauacaaaguggccgcagaggggaucaacuacgcugaccggcguuggugcuucgacggcaucaagaacaaccagauccucgaggagaacguagaggucgaaaucuggaccaaggaaggggagagaaagaaacugaaaccucgauggcuggaugcccggaucuacuccgaucccuuggcccugaaggaguucaaggaguucgccgcgggccgcaagagccugacccucaaccugauuacggagaugggucggcugcccaccuucaugacccaaaagacccgcgacgcguuggauaaccuggcagugcugcacacggcggaagccggugggcgggccuacaaccacgcccucagugagcugcccgagaccuuagagacgcuccuucuccucacccuguuagccaccgucaccggaggcauauuccucuuccugaugaguggacggggcaucgguaagaugacccuggggauguguugcaucaccaccgcuuccauccuccugugguacgcacagauccagccccacuggaucgcagccagcaucauucuggaguucuuucucauagugcuucucauccccgagcccgagaagcagcguacgccccaagacaaccagcucacauauguggucaucgcaaucuugaccgugguggccgcaaccauggccaacgagaugggcuuccuggaaaagacgaagaaggaucucgggcuggggucuaucgcaacccagcagccggaaucuaacauauuggauaucgaccucagaccagccagcgccuggacgcuguacgcagucgccaccacguucgugacccccaugcuacggcacagcauagagaauagcuccguaaacguuucacucaccgccauagccaaccaggccaccgugcugauggggcuggggaaaggcuggccccucuccaagauggacaucggagugccgcugcuggcgaucggcuguuacucgcaggucaaccccaucacccuaaccgccgcccuguuacuccugguugcccauuacgcgaucauuggaccgggacuccaggccaaggcuacgcgggaagcccagaagcgagccgcagcgggcaucaugaagaaccccaccguggacggcaucacugucaucgaucuggauccgauucccuacgaccccaaguuugaaaagcagcuggggcaggugaugcugcucauacugugcguuacccagguccugaugaugcgcacuaccugggcacucugugaggcccuuacgcuggccaccgggcccaucucgacccucugggagggaaauccagggcgguucuggaacaccaccauugcgguaagcauggccaacaucuuucgcggcuccuaccuggcaggagccggccuccuguuuuccaucaugaagaauaccacaaacaccagacgcgggacgggcaauaugggagagacauuaggcgagaaguggaagucccgccuuaacgcccuagggaaauccgaguuccagauuuacaagcgguccggcauccaggagguggaccgcaccuuagcgaaggagggaaucaagcggggagaaaccgaucaccaugccgucagccgcgguucggcuaaauugagaugguuuguggagaggaacaugguuacaccagagggaaaagucguggaccucggcugcgggcggggaggguggagcuacuacuguggcggguugaaaaacgugcgugaggucaagggccugaccaaagguggucccggacacgaggagccgaucccuaugucuacuuauggguggaaccucguucgccugcagagcggcguggacgucuuuuucaucccgccagagaagugcgacaccuuacucugcgacauuggggaguccagccccaacccgacgguugaggccggacgcacccugcgggugcuaaaccucgucgagaacugguugaacaacaacacccaguucuguaucaaggugcugaaucccuacaugcccuccgucaucgagaagauggaggcgcuacagcggaaauacggcggggcucucguccggaacccacucucccgcaacucaacccacgagauguacuggguuuccaacgcgucaggcaacaucgugucuagcguuaauaugaucucccgcaugcugaucaaucguuuuaccaugcgucacaaaaaggccacguacgaacccgacguugaccucggaucagguaccagaaacauugggaucgaguccgagauccccaaccuggacaucaucgguaagcggaucgagaagaucaaacaggagcacgagaccagcuggcacuaugaccaggaccacccguacaaaaccugggccuaccacggauccuaugagacaaagcagaccgggucugcgucguccauggugaauggcguaguucgcuugcuaaccaaaccaugggauguacugcccaccgugacacagauggccaugaccgauaccacccccuuugggcagcagcgcguauucaaagagaagguggacacgcggacccaggagcccaaagagggcaccaagaagcugaugaaaauuaccgcggaauggcucuggaaggagcugggcaagaagaagacgccgcgcaugugcacacgggaagaguucacgcgaaagguacguuccaacgccgcgcucggggcgaucuucaccgacgaaaauaaguggaagucggcccgagaggcuguugaagacucccgauuuugggaauuaguagauaaagaacguaacuuacaccuugagggcaagugcgaaacguguguauacaacaugauggggaaacgggagaagaagcuaggggaguucgggaaggccaagggaagccgcgccauaugguacauguggcugggugcccgguuccuggaguucgaagcucucggguuccucaacgaggaccacugguucucccgagagaacagucugagcggcgucgagggagaggggcuacacaagcugggguacauccuccgagacgugucgaagaaggaaggcggggcaauguacgcugacgacacggcggggugggauacucggaucacacucgaggauuuaaagaacgaggagauggugacaaaucauauggagggagaacauaagaagcuggcggaggccaucuuuaaacucaccuaucagaauaagguuguccgggugcagcgccccaccccucgcgggacagucauggauaucaucucgcgccgggaccagcguggcuccggucaggucgguacguauggucuaaauaccuuuacaaacauggaggcacagcugauacggcagauggagggcgaaggcguguuuaagaacauacagcaucucaccgugacggaggagguugccgugcagaacuggcuagcgagggugggcagggaacggcugagccggauggcaauuuccggcgacgacugcgucguaaagccccucgacgacagguuugccaaugcgcugacagcucugaacgacaugggcaagauacggaaagacauccagcagugggagccuagcaaggguuggaacgauuggacccaaguccccuucugcucccaucacuuccaugagcucauaaugaaggacggccggguacuggugguucccugcaggaaccaggaugaacugaucgggcgggcgcgcaucagccagggcgcggguuggucuuugcgugagaccgccugucugggcaagagcuacgcucagauguggucccugauguacuuccaucgucgggacuuacgccuggcggcgaacgccauaugcagcgccguccccucccacugggugccgaccagccgcacgaccuggagcauacaugccaagcacgaauggaugacgaccgaggacaugcugacgguuuggaaccgcgucuggauucgugagaacccguggauggaggacaagacccccguggagagcugggaagaaauacccuaccucggcaagcgggaggaucaguggugcggcucucuaauuggccugaccucacgggccacgugggcaaagaacauccaggccgccaucaaucaggugcgcucccucaucggaaacgaagaguacacggacuauaugccuucuaugaagcgguuccgccgcgaggaagaggaggcgggcguccugugguga

SEQ ID NO: 25364 - RNA, 9876 nt, Artificial Sequence
  derived and/or modified CDS sequence (opt11) from DENV-2__EU482647__SS-prME
uccgccggcaugaucaucaugcugauacccacugugauggccuuucaccucacuacccgcaacggcgaaccgcacaugauagucgguauucaggaaaaggggaagucccuacucuucaaaaccgaggacggugugaacaugugcacucucauggcgauggaccugggggaauuaugcgaagacacaaucaccuauaagugcccgcugcuucggcagaacgaacccgaggacaucgacugcugguguaacagcacaaguaccugggugacuuacgggacuugcaccaccaccggcgagcaccgcagggagaagcgcucagucgcccuggugccucacgugggaaugggccuagagaccagaacagagacauggauguccuccgagggggcuuggaagcaugcacagcguauagagacguggauauuacgacacccaggauucaccaucauggcagcgauucuggccuacaccaucgggaccacccacuuccaacgcguccucaucuucauacuguuaacggcuguggccccauccaugacuaugcgguguaucggcaucagcaaccgagauuucgucgaaggcguguccgggggcagcugggucgauaucgugcuagagcacggguccugcgucacaaccauggcgaagaacaagccaaccuuggacuucgaguugaucaagacggaggccaagcagcccgcaacccuacggaaguauugcauagaggcaaaacugaccaacacaaccaccgagagccgcugccccacccagggcgagccuuccuugaaagaggagcaggacaaacgcuuugugugcaagcacagcaugguggacaggggcugggggaauggcugcggccuuuuuggcaagggcggcaucguaacuugcgcuauguuuacguguaaaaagaauauggagggcaagauugugcagcccgagaaccuggaauacaccaucgucgucacgccacacuccggagaggagcacgcagucgggaacgacacgggaaagcauggcaaagagauaaagguuaccccgcagagcuccauuaccgaggccgaacugaccggguacggcaccgucaccauggagugcagcccccggaccggacucgacuucaaugagauggugcuacugcagaugaaaaacaaggccuggcuuguacaccgacagugguucuuagaccugccccuccccuggcugccaggugcugacaagcaggagagcaacuggauccagaaggaaacccuggucaccuucaagaacccccacgcuaagaagcaggacguggugguacucggcagccaggaaggcgcgaugcacacggcccugaccggcgcuaccgagauccaaaugucauccgggaacuuacuguucaccggucaccuuaagugccggcugcggauggacaaacuucagcugaaagggaugagcuacuccaugugcacggggaaguucaaagugguuaaagagaucgcagagacccagcacggcaccauugugauccggguucaguacgaaggggacggcagcccuugcaagaucccauuugagaucauggaccuagaaaagcgcuacguccucggccgccugauaacggugaacccaaucgugacggagaaggauucuccggucaacaucgaggccgaaccgcccuucggagacagcuacaucaucaucggcgucgagccggggcagcucaaguugaacugguuuaagaagggcuccagcaucgggcagauguuugagacgaccaugaggggcgcgaagcgcauggccauccugggggacacagccugggauuucgggucccugggcggggucuucacgagcaucggcaaagcccuucaccagguguucggggccauuuauggcgcugcauucuccggcguaagcuggaccaugaagauacugaucggggugaucaucaccuggaucggcaugaacucccgcagcacaagucugucagugucccuggugcucguggggaucgucacgcucuaccuuggagugauggugcaggccgacagcgggugcgucguguccuggaagaacaaagaacucaagugcgguucuggcauauucaucaccgauaacgugcacacguggaccgagcaauacaaguuccagccugagagccccuccaagcuggcgucugcgauccagaaggcccaggaggaaggaauaugcggaauccgcucggucacgcggcuggagaaccucauguggaaacagaucacccccgaguugaaccacauacuggcugagaacgaggugaagcucaccaucaugaccggggacaucaagggcauuaugcaggccggaaaacgcaguuuacggccccagcccacagaacugaaguacuccuggaagacguggggcaaggccaagaugcucagcaccgaaucauauaaucagaccuuucugaucgauggacccgagacggcggagugcccgaacaccaaccgggcauggaauagccuggagguggaggacuaugguuuuggcguauucaccacuaacauuuggcucaagcugaaggagaagcaggacgccuucugcgauuccaaguugaugagcgcagcaaucaaagacaaccgcgcgguacacgccgacaugggguacuggauugaguccgcccugaacgacacguggaaaauugagaaggccuccuucaucgaggugaaaaacugccacuggcccaagucccacacccuauggagcaaugggguuuuggaauccgaaaugaucauccccaaaaaccuggccggccccgugagccagcacaacuaccgcccgggguaucauacccaaauagccggcccuuggcaccuggggaaauuggagauggacuucgacuucugcgacgggaccaccguuauagugacggaggacugcgggaaccggggccccagucuccguaccacuaccgccagcggaaaguugaucacggaguggugcuguagauccugcacccuucccccgcuccgcuaucguggggaggacggcugcugguacgggauggagauucgucccuuaaaggagaaggaggaaaaccucgugaacuccuuagugaccgccggccacgggcagguagacaacuuuucucugggcgugcucggcauggcccuuuuccuugaggagauguugcggacccgaguugggacgaaacacgcgauccuccuuguugccguguccuucgucacccugaucaccggcaacaugagcuucaaggacuuagggcgaguaguggugaugguaggcgcgaccauggcugacgacaucgguaugggcguaacauaccuggcucugcucgcggccuucaaggugcgacccacauucgcugccggucuccugcuccggaaacucacauccaaagagcugaugaugaccacaaucgggaucguccucuugagccaguccaccauccccgagaccguucuggaguuaaccgacgcccuggcgcucggcaugaugguccucaagaucguccgcaacauggagaaauaucagcuggccgugacgauuauggcaauccugugugucccgaacgccguuauccuccaaaacgccuggaaggugagcuguaccauucuggcggucgucuccguguccccuuuacuccugaccuccucccaacagaagacggacuggauaccccuugccuugacgaucaagggacugaaucccaccgccaucuuccugaccacccuaucccgcacgaacaagaagaggucguggccgcuuaacgaggcgauuauggcggucggcaugguauccauccuggcgucgucccuacugaaaaacgauauccccaugaccggcccuuugguggccgguggccuucuuaccgugugcuacgugcugaccgggcggucagccgaucucgagcuggaacgggccacggacgucaaaugggaggaucaggcggagauuuccgguuccucaccgauccuguccaucaccauuagcgaggacggguccaugagcauuaaaaaugaagaggaggagcagacacucacgauccugauaaggacgggccugcucgucaucuccggcuuauucccuaucagcaucccaaucaccgcggcggcuugguaucugugggagguaaagaaacaacgggccggcgugcucugggauguccccagcccgccgccaaugggcaaggcggagcuugaggacggggccuaccgaaucaagcagaaaggaauccugggcuacagccagaucggcgccggcguguauaaggaaggaaccuuucauaccauguggcaugugacucggggcgcggugcucaugcacaaggggaagcgcaucgagcccaguugggccgacgugaagaaggaccuuauuagcuacggcgguggcuggaagcuggagggggaguggaaggagggagaggaaguacaggugcuagcuuuagagcccggcaagaacccccgggccgugcagacgaagccagggcuguucaagacaaauacgggcaccauaggcgcgguuucccucgacuucagcccagggacguccggaagccccaucaucgacaagaaggggaaggucgucggccuguauggcaauggggucguaacccgcuccggcgccuacgugagcgcaaucgcccagaccgaaaaguccauagaggacaacccugagaucgaggacgacaucuucaggaagcgucggcugaccaucauggaccugcaucccggggccggcaagacaaaacgguaucucccagccauaguccgggaggccauuaagcgggggcugagaacccucauacucgcgccgacucgggucguggccgcugagauggaggaggcacugcggggccuucccauccgcuaucagacccccgcgaucagagcugagcacacgggccgcgaaaucguggaccucaugugccacgcuacuuucacuaugcgccuacugagcccaguacggguaccgaacuauaaccucauuaucauggacgaagcacacuuuaccgaccccgcguccaucgccgcgcgcggcuacaucagcacgcgaguggagaugggagaagcggccgggauauucaugacggcaacgccgcccggcucacgcgacccguucccucagucaaacgcccccaucaucgacgaagaacgggaaauccccgagcgcucauggaacuccggccaugaguggguuaccgacuucaagggcaagacggucugguucgugccgucaauaaaggcggggaacgacaucgccgccugccugcggaagaacggcaagaaggucauccagcucucccgcaagaccuucgacagcgaauaugugaagacccgcacuaacgacugggacuucguggucacgaccgacaucuccgagaugggcgcuaacuucaaggcggagcgcgugaucgacccacggcgcugcaugaagcccgugauacucaccgacggugaggaaagaguuauacuagccgguccaaugccggugacccacagcagugccgcgcagcgccggggccgcaucggccggaaccccaagaaugagaacgaccaguacauuuacaugggggagccucuggagaacgacgaggacugugcccauuggaaggaggcaaagaugcuucuagacaacaucaacacgcccgagggaaucauaccgucgauguucgagcccgagcgcgaaaagguggacgccaucgacggcgaguaccggcugcgcggagaggcccgcaagacuuucgucgaccucaugcgacgcggagaccugccgguguggcuggccuacaaaguggccgccgagggcaucaacuaugcagaccggcgcuggugcuucgacggcaucaagaauaaccagauccucgaggagaacgucgagguggagaucuggacaaaggagggggaacggaagaaguuaaagccgcgcuggcuagacgccagaaucuacuccgauccccucgcccugaaggaguucaaggaauuugcugcgggccgcaagucguuaacccugaaccugauuacagagaugggucggcucccgaccuucaugacccagaagacgcgcgaugcccucgauaaucuggcaguguuacacaccgccgaggcuggagggcgggcauacaaccaugcccucucagagcugcccgagacccuggagacgcuccugcugcuaaccuugcuggccacggugaccgggggcaucuuuuuauucuugaugagcggacgcgggaucggcaagaugacgcugggcauguguugcauuauaaccgcauccauccuccugugguacgcgcagauccagccacacuggaucgcagccucgauuauccuggaguucuucuugauugugcugcuuauuccggaacccgaaaagcagcggacgccgcaggacaaucaauuaacguacgucgugaucgccauccuuaccgugguggccgcgacuauggcgaacgagaugggcuuccuugaaaagacaaagaaggaccucgggcuggggucuaucgccacgcagcagccggaaagcaauauccuugacaucgaccuccgccccgcgucggccuggacccuauacgcuguggccaccaccuuuguaacacccaugcugaggcacucaaucgagaauagcuccgucaacgugagccucacggccauagcuaaccaggcgaccguguugaugggucuugggaagggcuggccccucuccaagauggacaucggggucccgcuccuggcgauugggugcuacagccaggugaacccgauaacacugacggccgcuuugcugcuucuggucgcucauuacgcgauuaucggaccgggucugcaggcaaaggccacucgcgaggcccagaaacgggccgcggccggaaucaugaagaaccccaccguagacggcaucacagugaucgacuuggauccgauacccuacgacccaaaguuugaaaagcaauugggccaggugaugcugcucauccugugugucacccagguguugaugaugaggaccaccugggcccucugcgaagccuugacccuggcaacgggacccauuuccacgcucugggagggcaacccggggagauuuuggaacaccacuauugccgugagcauggccaauaucuuucgcggcucuuaccuggccggcgcgggccuacucuucaguauuaugaagaacacgaccaacacacguaggggaaccgggaacaucggcgagacucugggcgaaaaguggaagagucgccugaacgccuuggggaagucugaguuucaaaccuacaagaaguccgggauccaagaggucgaccggacccuggccaaggagggcaucaaacgcggcgaaaccgaccaccacgccgugagcagggggagugccaagcugcgcugguucgucgagcggaauauggucacgccagagggcaagguuguggaccucggcugcgggcgcggcggcuggagcuacuacugcggcgggcuaaagaauguccgggagguaaagggccugaccaaagggggaccgggucacgaggagccuaucccgauguccaccuacggguggaaccucgugcgcuuacagucaggcguugacguauucuucaucccgcccgagaagugugacacgcugcuuugcgacaucggggagaguagccccaacccgacuguggaggcuggccguacccugcgggucuuaaaccucguggaaaacuggcugaauaacaauacccaauucugcaucaaggugcugaauccauacaugcccagugucaucgagaagauggaggcacugcagcggaaauacggcggggcgcucguacguaacccucuaagccgcaauagcacgcacgaaauguacugggucagcaaugccagcggcaacaucgucuccagugugaacaugauuucccgcaugcugauaaaccgguucaccaugcggcacaagaaagccacguacgagcccgacguggaucucgggucagggaccagaaauaucgggaucgaguccgagaucccaaacuuagacaucauuggcaagcgcaucgagaagaucaagcaggagcacgagaccucguggcacuacgaccaggaccaccccuacaagaccugggcguaccacggcuccuacgagacaaagcagacagggagcgcgucgagcauggucaauggcguggugcggcuacucaccaaaccaugggacguccugcccacggugacucagauggcgaugaccgauaccacucccuucggccagcagcgaguguucaaggaaaaaguggacacacgcacccaggagcccaaggagggcaccaagaagcuaaugaagaucaccgccgaguggcucuggaaggagcugggcaagaaaaagaccccgcggaugugcaccagggaggaguucacgcggaaaguucgcuccaacgccgcccuuggggccaucuuuaccgaugagaacaaauggaagucggccagggaggcuguggaggauucccgcuucugggaacucgucgacaaggagcggaaucugcaucucgagggcaagugcgagacaugcguguacaauaugauggggaagcgcgagaaaaaguuaggcgaguucgggaaagccaagggcagcagagcuaucugguacauguggcugggggcaagguuccuggaguucgaggcacucggauuccugaacgaggaccacugguucucccgggaaaauucgcuguccggugucgagggggagggcuuacacaaguuaggguacaucuugcgcgacgucagcaagaaggaagggggcgccauguaugccgacgacaccgcggggugggacacccgcaucacauuggaagaccuaaagaacgaggagauggucaccaaccauauggagggcgagcacaagaagcuggccgaggcuauauucaagcugacauaucaaaauaaggucgugcgcguacagcggccuacgccucgggguacugucauggacaucaucagcaggcgagaccaacggggcagcggccaaguggggacuuacggccugaacaccuuuacgaacauggaggcccagcucauccgccagauggaaggggaggguguauucaagaauauccagcaucucacggucacggaggagguagccgugcaaaacuggcuggcgcgggucgggcgcgagcgccugagccggauggccaucucaggcgacgacugcgucgugaagccccucgaugaccgcuucgccaacgcgcugaccgcgcuaaacgacaugggcaaaauccggaaggauauccagcagugggagccgagcaagggguggaacgacuggacccagguccccuucugcucucaucacuuccacgagcucaucaugaaagacggccgggugcuggugguccccugccguaaccaggacgaacugauaggucgcgcgcggauaucacaaggcgccggauggagucuccgugaaaccgccugucuuggcaaguccuacgcgcagauguggagccuaauguacuuccaccggcgcgaccuacggcuggccgcuaaugccauaugcucugccguacccucccacugggugccgacgucccguaccacaugguccauacacgccaagcacgaguggaugacuaccgaggacaugcucacggucuggaaccggguguggauacgcgagaacccguggauggaagacaagacgcccguggaguccugggaggagauccccuaccucggaaagagagaggaccaauggugcgggucccugaucggccugaccucccgcgccaccugggcgaagaauauccaggccgccauaaaucagguccguucccucaucgggaacgaggaguauacggacuacaugcccaguaugaagcgcuuucgucgcgaagaggaagaagccggcgugcucugguag

SEQ ID NO: 25365 - RNA, 9876 nt, Artificial Sequence
  derived and/or modified CDS sequence (opt11) from DENV-2__EU482648__SS-prME
accgccgggguuauaaucaugcugauacccacggccauggcguuccaccuaaccacucgcaacggggagccccacaugaucgucggccggcaagaaaagggcaaaucccuguuauucaagaccgaggauggagugaacaugugcacccucauggccaucgaucugggagagcugugugaggacacgaucaccuacaagugcccccugcugcgccagaacgagcccgaagauauugacuguuggugcaacagcaccagcaccugggugacguauggaaccuguaccaccacgggcgagcaccggagggaaaagcgauccguagcccuggugccccacguggggaugggccuggagacccgcaccgagaccuggaugagcuccgaaggggccuggaagcacgcucagcggauagaaacguggauccuacgccacccagguuucaccaucauggcugccaucuuggccuacacgaucggaaccacgcacuuucagcgggcgcucaucuuuauccuacugacagcgguagcccccuccaugacuaugcgcugcaucggcaucucaaaccgggacuucguggagggcguguccggcggcuccugggucgacaucgugcucgagcauggguccuguguaacgacgauggccaagaacaagccuacgcuugacuucgaacugaucaagacggaggccaagcaacccgccacgcuccgaaaguacugcaucgaagcgaagcuaacgaacaccacuacugaaucccggugcccgacgcagggugaacccagcuuaaacgaggagcaagacaagcgcuucgucugcaagcacucgaugguggaccggggcugggggaauggcugcggucuguucggcaagggcggcaucgugacgugcgccauguucacgugcaagaagaacauggagggcaagaucguccaacccgagaaucuggaauacaccaucgugaucacgccccacagcggggaggagcacgccguaggcaacgacaccggcaaacacggaaaagaaaucaagauuacgccgcagaguagcauaaccgaggcggagcugacgggcuacggcacagucaccauggaaugcagccccagaaccggccucgauuucaacgagauggugcugcugcaaauggaggacaaagccuggcucguacaccggcaaugguuccuggaccugccgcuccccuggcuuccgggggcugacacccaaggcagcaauuggauccagaaggagacguuggucaccuuuaaaaacccccacgccaaaaagcaggacguggugguccucgggucccaggagggggccaugcauaccgcccugaccggggccacggaaauucagauguccagcgggaaccucuuauucacaggccaccucaaaugccgacugcgcauggacaagcuacagcugaaggggauguccuacagcaugugcaccggcaaguucaagaucguaaaagaaaucgcggagacgcagcacgggacgaucgucauccgggugcaguacgagggcgacggcucccccugcaagauccccuuugagaucauggaucuagagaaacggcacguucucggucgccucaucacugucaacccgauagugacugaaaaagacagccccgugaacauagaggccgagccacccuuuggugauagcuacauuauuaucggggucgagccgggucagcucaagcucaacugguuuaagaaggggagcucgauaggacagauguuugagacaaccaugcgcggcgcaaagcggauggccauccucggcgauaccgcuugggacuucggcagccuugggggcguguucacauccaucgggaaggcgcuucaccaaguguucggggcaaucuacggugccgccuuuagcggggucucauggaccaugaaaauucuuaucggagcgaucaucacguggaucgguaugaauagccgcuccacaucucugagcgucaguuuaguucuggucggcgugaucacccucuacuugggcgccauggugcaggccgacuccggcugugucgugagcuggaagaacaaggagcucaagugugggagugggaucuucaucacugacaacgugcacaccuggaccgagcaguacaaguuccagccagaaagcccgagcaagcucgccuccgcuauccagaaggcgcacgaggagggcaucugugggauccggagcgucacacgccucgagaaccucauguggaagcagaucaccccagagcugaaccacauacuguccgagaacgaagugaagcucaccaucaugaccggggacaucaaggggaucaugcaagccggcaagcggagccuuaggccgcagccuaccgagcugaaguacuccuggaagacuugggguaaggccaagaugcuaagcacugagucccacaaucagaccuuccuuaucgaugggccugagacagcagaauguccgaacaccaacagagccuggaacagccuggaaguggaggacuacggcuuugguguuuuuacgaccaacaucuggcucaagcugcgcgagaaacaagacguguucugcgacucuaaauugaugucugccgccaucaaggacaaucgggccgugcaugccgacaugggguacuggaucgaguccgcuuugaacgacaccuggaaaauggaaaaagcgagcuucaucgaggucaagaguugccacuggcccaagucacauacccucuggaguaacggugugcucgagagugagaugaucauacccaaguccuuugcgggacccgugucucaacacaacuaccgccccggcuacuacacccaaacugccgggccauggcaccuaggcaagcuagagauggauuuugacuuuugcgaggggacgaccgucguagugaccgaagauugcggcaaucggggccccagcuuaagaacuacgacggccagugguaagcucaucaccgagugguguugccggagcugcacgcugcccccacuucgcuaucggggcgaggaugggugcugguacggcauggagauccgcccacucaaagaaaaggaggagaaccugguaaacucccuggucaccgcgggucacggccagaucgauaacuucucauuagggguccugggcauggcgcuguuucucgaggaaaugcuuagaacgcgcgucggcacgaagcacgcuauccugcucguggccgugagcuucaugacgcugauaacaggaaacaugucauuucgggaucuuggcagggucaugguaaugguaggggccaccaugaccgacgacauuggcaugggggucacguacuuagcguugcuggccgccuuuaaagugcggcccaccuucgccgccgggcuccugcuucggaagcucaccuccaaagagcugaugauggcgaccaucggcaucgcccuccucagccaguccacgauaccagagacgaucuuggagcuaacugacgcccuagccuugggaaugauggugcuuaaaauaguaagaaacauggagaaguaccagcucgccgucaccauuauggcgaucagcugcgugccuaacgcggucaucuugcaaaaugcuuggaaggugaguuguacgauccuagcugcggugagcgucagcccccuccuucuaaccagcucccagcaaaaggcggacuggauaccccucgcacugaccaucaaaggacugaaccccacugccaucuucuugaccacccugagccgcaccucuaagaagcgcagcuggccgcugaacgaagcuaucauggcggucggaauggugucaauucucgccagcagccugcugaagaacgacaucccgaugaccggaccacuuguagccggugguuuacugacggugugcuacguccucaccggccgguccgccgauuuggagcuggaaagggcaaccgacgugaagugggaagaccaggcugagaucucgggguccucgcccauccucagcauaacgaucagcgaggacggcuccaugagcauaaagaacgaggaggaagaacagacgcuaacuauucucauccgaacgggccuucuggugaucuccggucuguucccgguuagcauucccaucaccgccgccgcgugguacuugugggaagugaagaagcagcgcgccggugugcugugggauguccccagcccgccgcccguggguaaggcggagcuggaggacggcgccuaucguauaaagcagaaggggauccucggauacagccagauaggcgccgggguguauaaggaggguaccuuccacacuauguggcacgucaccaggggggccguccuuaugcaccggggcaagcgcaucgagcccucgugggcugacgugaagaaggaucugaucucguacgggggcgguuggaagcuugaaggggaguggaaagaaggcgaggaaguccaggugcuggcgcuggagccugggaagaacccccgcgccguccaaaccaagcccggccucuucaagacuaauacgggaaccaucggagccgucucgcuggacuucagccccggcaccuccgggagucccauuguggacaggaagggcaagguagucgggcucuacgguaacggcguggugaccaggucgggggccuacgucagcgcgaucgcccagacagagaagucuaucgaggacaacccugagaucgaggacgacaucuucagaaagaagcggcucaccaucauggaccugcaccccggcgccgggaagaccaagcgguaccugcccgcgaucgugcgagaggcgaucaaacggggccugagaacccucauccuagcaccaaccagagugguagccgccgagauggaagaagcccugcgcggucuccccaucagguaccagacccccgccauccgggcggaacacaccggccgggagaucguagaccugaugugccacgcuacguucacgaugcgucugcucaguccugugcggguuccgaacuacaacuugauaaucauggacgaggcccacuuuaccgaccccgcaagcauugcugcgcgcggauacaucuccacacggguagagaugggugaggccgcggggaucuuuaugaccgccacgccgcccgggucucgagacccguucccgcagucaaaugcgcccaucaucgacgaggagcgggaaaucccugagagaucguggaacucgggccacgagugggugaccgacuucaaggggaagacagucugguucgugccgucuaucaaagccggcaacgacaucgccgcaugccuccguaagaacggcaagaaggucauucaacucucccgcaagaccuucgacagcgaguacgucaagacgcggacuaaugauugggacuucguggucaccaccgacauauccgagaugggggccaacuucaaggcggagcgcgucaucgauccaaggcgcuguaugaagcccguaauacuuacggacggugaagagcgcgugauccuggccgguccgaugcccguuacccauagcuccgcagcccagcgacggggccgcauaggccgcaacccaaaaaaugaaaacgaucaguacaucuacaugggagagccucucgaaaacgacgaggacugugcccacuggaaagaggcgaagaugcuccuggacaacauuaacacgccagaaggcaucauuccgucaauguucgagcccgagcgggaaaagguggacgccaucgacggggaauaucgccuacggggcgaagccaggaagacuuuuguggaucugaugcggcgcggggaccugcccgucuggcucgccuaccggguggccgcggagggcauuaacuacgccgaccgccggugguguuuugauggagucaagaacaaccagauacuggaggagaacgucgaggucgagaucuggaccaaggagggcgagcguaagaaacugaagccgcgguggcuagacgcacgcaucuauagugacccccuggcccugaaggaguuuaaggaauucgcggccggccgcaaaucccuaacacugaaccugaucaccgaaauggggcgccucccaacguuuaugacgcagaaggcucgggaugcuuuggacaaucuggccguucuccacacggcugaggcaggcggacgcgcauacaaccacgcccugagugaguugcccgaaacacucgagacucugcuguuacugacgcuguuagccaccgucacgggcggcaucuuccuguuccugaugagcgggaagggcguggggaagaugaccuuggggaugugcuguaucaucacugcguccauuuugcuaugguacgcccagauccaaccucacuggauugcggccagcaucauccucgaguucuuccugaucguguuacucauccccgagccagagaagcaacggacaccccaggauaaccagcugacguacgucgugaucgccauucugaccgucgucgcggcaacuauggccaacgagaugggguuucucgagaagacgaagaaggaccuggggcugggcucgaucgcgacacaagagcccgaauccaacauccucgauaucgaccugcgccccgcgucagcauggaccuuguacgccguggcaacaaccuucgugacccccauguugcggcacuccaucgagaacagcucugugaacguuucacugacagcgaucgcuaaccaggcaacggucuuaauggggcucggcaagggguggccccugucuaagauggacauuggcgugccacugcucgccaucggguguuacagccagguuaaccccaucacucuuaccgcugcccugcuccugcugaucgcgcauuacgcuaucauaggcccgggccuucaggccaaagcaacccgcgaagcucagaagcgggcggcugccggcaucaugaagaauccaaccguugacggcauaacggugaucgaccuggacccuauccccuaugaccccaaguucgaaaagcagcugggccaagugaugcuccuaauccugugcgucacccagguucucaugaugcgcaccacgugggcccugugcgaagcccugacgcucgcgacaggccccauuucuacgcugugggaagggaacccgggacgcuucuggaacaccacgaucgccgugagcauggcaaacaucuucagaggguccuaccucgcgggggcgggacuccuuuucuccaucaugaagaacaccaccaacacgcgccgcggcacagguaauaucggcgagacacuuggggagaaguggaagucgcgccucaacgcccugggaaaaucugaguuccagaucuauaaaaaguccgggauccaagaagucgacagaaccuuggcaaaggaaggaaucaagcgcggcgagaccgaccaccacgcagucucucggggcucugccaaacuacgcugguucguggaaaggaacaugguaacgccugagggcaaaguuguugaccuggggugcggucgcgggggcuggagcuacuacugugggggccuuaagaauguccgggagguuaagggccucacaaagggaggcccugggcaugaagagcccaucccgaugaguaccuacggauggaaccuggugcgccugcagucugggguugaugucuucuucacaccgcccgagaagugcgacacccuucugugcgacauuggggagagcagccccaacccuaccauagaggcaggccggaccuugcgcguguuaucuuuggucgagaacugguuaaacaacgacacccaguucugcaucaaggugcuaaaccccuacaugccuuccgugaucgagaagauggaaaccuuacagcguaaguacgggggcgcccugguccgcaacccgcugagccggaacagcacacacgagauguauugggugagcaaugccaccgggaacaucgugucgagcgucaacaugauaagucgcaugcucaucaacagauucaccaugaagcacaagaaggccacuuacgagcccgacguggaccugggcagcgggacacgcaacaucggcaucgagucagaaauccccaaccuggacaucauagggaagcgaaucgagaagaucaaacaggagcacgagaccuccuggcauuacgaccaggaccacccuuacaaaaccugggccuaucaugggucguacgagaccaagcagacggguagcgcgucgagcauggugaaugguguggugagguuacuuaccaagccaugggacgugguccccauggugacccaaauggccaugacggacacgacucccuucggccagcaaagaguauucaaggagaaggucgacaccagaacccaggagcccaaggaaggcacgaagaaacucaugaagaucaccgcagaguggcucuggaaggaguugggaaagaagaagaccccacggaugugcaccagagaggaauucacgcgcaaggugcggucgaacgcggcacuaggagcgaucuucaccgacgagaacaaguggaaguccgcacgcgaagccguggaggacucccgguucugggagcucgucgacaaggagcggaaccuccaucuggagggaaagugcgagacaugcguguacaacaugauggggaagcgugagaagaagcucggggaauuuggaaaagccaaggguagccgggcgauuugguacauguggcuaggggcacgauuccucgaguucgaagccuugggcuuccuuaacgaggaccauugguucucacgugagaacucucuaagugggguggagggcgaggggcuacauaagcucggcuacauccugcgggacguguccaaaaaggaaggaggggcaauguaugcugacgacaccgcgggcugggauacucgcaucacccucgaggaccugaagaaugaggaaauggucaccaaccacauggaaggggagcauaagcgucuggccgaggccauauuuaagcucacguaccagaacaaggugguccgagugcaacggcccacgccccgcggcaccguaauggauaucaucucgaggcgggaccagcgcggguccggccagguuggcacuuauggacugaacacauucaccaacauggaggcccagcugauccgccaaauggaaggggaagggaucuucaagagcauacagcauuugacugugaccgaggagaucgccguccagaacuggcuggcgcgcgugggcagggagcgucugaguaggauggccaucucgggagacgacugcgugguuaagccccucgaugacagauuugcaucugcucugaccgcccugaacgauauggggaagguucgcaaggauauccagcagugggagccgagcaagggauggaacgacuggacacagguucccuucuguucccaccauuuccacgagcugauaaugaaggacgggcgcguccuuguggugcccugccgcaaucaggacgagcugaucggccgggcgcggauaagccagggggccggcuggucccuuaaggagacugcgugccuggguaagagcuacgcccaaauguggucccugauguacuuccaccggcgagaccuuaggcuggcggcgaacgcgaucugcagcgccguccccucacauuggguacccaccagucggaccacuuggagcauccacgcuaagcacgaguggaugaccaccgaggauaugcucaccgucuggaaccgagucuggauccaagagaaccccuggauggaggauaagaccccgguggaguccugggaggaagugcccuaccucgggaagcgggaggaucaguggugcggcagcuuaaucggccugacuagucgcgcgacuugggcuaagaauauccagaccgccauuaaucagguacggucacuaaucggaaacgaggaguacacugacuauaugccuucaaugaagagguuccgucgggaggaggaggaggcuggagugcugugguag

SEQ ID NO: 25366 - RNA, 9876 nt, Artificial Sequence
  derived and/or modified CDS sequence (opt11) from DENV-2__EU482649__SS-prME
agcgcaggcaugauaaucaugcugauuccaacggugauggcguuccaccuuacaacccggaacggggagccccacaugaucguaggcauccaggagaagggcaagagccugcuguucaagaccgaggacggagugaacaugugcacacucauggcuauggaccugggggagcugugcgaggacaccaucaccuacaagugcccccuccuccgacagaacgagcccgaggacaucgacugcuggugcaacagcaccaguaccugggugaccuacgggaccuguaccaccacuggcgagcaccgucgggagaagcgcagcgucgcccuggugccccacguggggaugggccucgagacgcggaccgagacguggaugagcagcgagggugccuggaaacaugcccagcguauugagaccuggauuuugcggcaucccggguucacgaucauggccgcgauccuggcuuacaccaucggcaccacccacuuucaacgcguuuugaucuucauccugcucacggccaucgccccuucgaugaccaugcggugcaucggcaucucaaaccgcgacuucguggagggcguuuccgggggcagcugggucgacaucguccucgagcacgggucuugugucaccacgauggcgaagaacaagccuacguuagacuucgagcugauuaagacagaggcuaagcaacccgcuacccuccggaaguacugcaucgaggcgaagcuaacgaacacgacaaccgagagccggugccccacgcagggcgagcccuccuugaaagaggagcaggacaagcguuucgucuguaagcacagcaugguggaccgcggcugggggaacggaugcggacuguucggcaagggggggaucguuacgugcgccauguucacgugcaagaagaacauggagggcaagaucguacaaccugagaaccuggaguacaccaucguggugacgccccacuccggggaggagcacgcggucggcaacgacacggggaagcacgguaaagaaaucaagguaaccccacagagcuccaucaccgaggccgagcugacgggguacgggacggugacgauggagugcucaccccggaccggccucgacuucaacgagaugguccugcugcagauggagaacaaagccuggcucgugcaccgccagugguuccuggaccugccccuccccuggcugccaggagcggacaaacaggaguccaacuggauccaaaaggaaacccuggugaccuucaagaacccccacgccaagaagcaggacgucguaguucucggcucgcaggagggggcgaugcacacagcgcugaccggcgccaccgagauacagaugagcuccgggaaccuacuguucacuggacauuuaaagugccgguugcgcauggacaaacuccagcugaagggcaugagcuacaguaugugcacggggaaguucaaggugguaaaggagaucgccgagacccagcacggcaccaucgucauccguguacaguacgagggggacggaucucccugcaagaucccuuucgagaucauggaccuggagaagcguuacguacucggccgguuaauuacugucaacccgaucgucacggagaaggacuccccgguuaacaucgaggccgagccgcccuucggggacagcuacaucaucaucggcguagagccgggucagcugaagcucaacugguucaagaagggcucgaguaucgggcagauguucgagaccaccaugcgcggagcgaagcgcauggcuaucuuaggcgacaccgccugggauuuugggucccugggcggcguauucacgagcaucggcaaagcauugcaccaggucuucggggcuaucuacggcgcggccuucaguggcgucagcuggaccaugaaaauccucaucggggugaucaucacauggaucggcaugaacucccggagcaccucacugagcgugucccugguuuuaguggggaucgugacgcuguaccucggcgucauggugcaggccgacagcggaugcguggucuccuggaagaacaaggagcucaagugcggcagcggcauauucaucaccgauaacgugcauaccuggaccgagcaguauaaguuccagcccgagagcccguccaaacuugccuccgcgauccagaaggcucaggaggaagggaucugcggcauccgcuccgugacgcggcuugagaaccucauguggaagcagaucaccccugagcugaaccacaucuuagccgagaacgaggucaaacucaccaucaugaccggggacaucaagggcaucaugcaggccgggaagcgcagucugaggccgcagcccacggagcugaaguacuccuggaagaccugggggaaggccaaaaugcucagcaccgaguccuacaaccagacguuccugaucgacggccccgagacggcggagugcccgaacaccaaccgcgccuggaacagccuggagguggaggacuacggguuuggcguguucaccaccaauaucuggcucaagcugaaggagaaacaggaugccuucugugacuccaagcugaugagcgccgccaucaaggacaaccgggcgguccacgccgacaugggguacuggaucgaguccgcacucaacgauacguggaagaucgagaaagccagcuucaucgaggugaagaacugucacuggcccaagucccacacccuguggucuaacggcgugcuagaguccgagaugaucauccccaaaaacuuggccggccccgucagccaacacaacuaccgcccgggguaccacacccagaucgcgggccccuggcaccuggggaagcuugaaauggacuucgacuucugcgacggcacuaccgugaucgugacggaggacugcgggaaccgcggccccagccuccgcaccacaaccgccagcggcaaacugaucacggagugguguugccgguccugcacacugccgccgcuccgcuaccggggggaggacggcugcugguaugggauggagauccgcccccugaaggagaaagaggagaaccuggucaacagccucguaaccgcaggacacggccagguggauaauuuuagccugggcguucugggcauggcuuuguuccuugaggagaugcugcggacccgcguggggacgaagcacgcgauccuucugguggccgucuccuucgugacguuaaucacgggaaacaugagcuucaaggaccuugggagagugguugugauggugggagcaaccauggccgaugacaucgggaugggcguuuccuaccuggcccugcucgcggccuucaaggugcgccccaccuucgcugccggacuguugcuccggaagcugaccaguaaggaauuaaugaugaccaccaucgggaucgugcuccugucccaguccacgauucccgagaccguccuggaacucaccgacgcccuggcgcugggcaugauggugcucaagaucgugagaaacauggagaaguaccagcuggccgucaccaucauggccauccugugcgugccgaacgccgucgugcuccagaacgccuggaagguguccuguacgauccuggcggucgugagcgugaguccccugcuccugaccagcucccagcagaagaccgacuggaucccccuggcccucaccaucaagggguuaaaccccacggccauauuccugaccacccucagccgcaccaacaagaagcgguccuggccgcugaaugaggccaucauggcagugggcauggugagcauccuggcguccagccuccugaagaacgacaucccaaugacgggcccccugguggccggaggcuugcugaccgucugcuacgugcuuacuggccgaucagcugaccucgagcuggagcgagcgacggacgugaagugggaggaccaggcggagaucagcggcagcuccccuauacugagcaucacgaucuccgaggacggaagcauguccauaaagaacgaggaggaggagcaaacccuuaccauccugauucgcaccggccuacucgucaucagcggccuguucccgaucuccauccccauaacggccgccgcuugguaucugugggaagugaagaagcagagggccggggugcuaugggacguccccuccccaccgcccaugggcaaggccgagcucgaggauggggcauaucgcauuaagcagaagggcauucugggguacucccagaucggugccggcguguauaaggaggggaccuuccacaccauguggcacguuacccggggagccguccucaugcacaaggggaaacgcaucgagccuagcugggccgacgugaagaaagaccugaucucguacggugggggcuggaagcuggagggagaguggaaagagggcgaggaggugcagguccucgcgcuggagcccggcaaaaacccucgggcuguccagacuaaacccgggcuguucaagacgaauaccgggaccaucggggccgugagccuagacuucucccccggaaccagcggcucccccaucaucgacaaaaaggggaaggucgucggcuuguaugggaacgguguagucacgcguagcggcgccuacgucucagcgaucgcgcagaccgagaagucgaucgaggacaaccccgagaucgaggaugauauauucagaaagcgcagacugaccauaauggaccugcaccccggggcuggcaaaaccaagcgcuaccuccccgccauugugcgggaggccaucaaacgcgggcuucggacucugauccucgcgccgacccgcgucguggccgcggagauggaagaggcccuacggggucugcccauucgcuaccagacccccgccaucaaggcggagcacaccgggcgggagauuguggaccucaugugccacgccacguucaccaugcgccugcugagucccgugcgcgugccgaacuacaacuugaucauuauggacgaggcacacuucaccgaucccgccagcauugccgcgcggggcuauaucagcacccgcguagagaugggggaggcagccgggaucuucaugacggccacgccgcccggcucccgggacccguuuccgcagagcaaugcccccaucauugacgaggagcgcgagauaccggagcgguccuggaacagcgggcacgagugggugaccgacuucaagggcaaaaccgugugguucgugccguccaucaaggcggggaacgacaucgccgcuugccugcgcaagaacggaaagaaggucauccagcugagccggaaaacguucgacuccgaguacgugaagacccgcaccaacgacugggacuucguggucaccacggacaucagcgagaugggcgcgaacuucaaggcggagcgggugaucgacccccgccggugcaugaagcccgugaucuugaccgacggggaggagcgcgucauccuugccggacccaugccaguaacccacuccucggccgcccagcggagggggcggaucggccgcaaccccaaaaacgagaacgaccaguauaucuacaugggggaaccccuggagaacgacgaggacugcgcccacuggaaggaggcuaagaugcuccuggacaauaucaacacccccgagggcaucauuccguccauguucgagcccgaacgggaaaagguggacgccaucgacggcgaguaccgccugcguggagaggcccgcaagacguucgucgaccucaugcgccggggugacuuacccguguggcuugccuacaagguggccgcggagggaaucaacuacgccgaccgccgguggugcuucgacgggaucaagaacaaccagauccucgaggagaacgucgaagucgaaaucuggaccaaggagggggaacgaaagaaguuaaagccuagauggcuggacgcccgcaucuacagcgauccacucgcccugaaggaguucaaggaauucgccgcaggcaggaagucccugacccucaaccugaucacggaaaugggccgccugcccacguuuaugacccagaagaccagagacgcgcuagauaaccuggccguccugcacaccgccgaagccggcggacgcgccuacaaccacgcccucagcgagcugccugagacgcuggagacccuccugcugcucacccugcuggccaccgugaccggcgggaucuuccucuuccugauguccgggcgggguaucggaaagaugacccugggcaugugcugcaucauaaccgccagcauccuccugugguaugcgcagauccagccccacuggaucgccgccuccaucauccuugaguucuuccucaucguccugcugaucccggagcccgaaaagcagcgcacgccccaggacaaccagcucaccuacgucgugauagccauccugacgguggucgccgcgaccauggccaacgagaugggcuuccuagaaaagaccaaaaaggaccucggucugggcagcaucgcgacccagcagccggaauccaacauccuggacaucgaccuccggcccgccucugccuggacccuuuacgcgguggccaccaccuucgugacccccaugcugcggcacagcaucgaaaacuccagcguaaacgugucccucacggccaucgcgaaccaggccaccgugcugaugggccuggggaagggcuggccccucagcaagauggacaucggggucccgcugcuggccaucgguugcuacucccaggucaaccccaucacccucaccgccgcccugcugcuccugguggcccacuacgcgaucaucgggcccggccugcaggcuaaggcgacucgggaagcccagaagcgcgcggcggccggcaucaugaagaaccccaccgucgacgggaucaccgugaucgaccucgauccgauccccuacgaccccaaguucgagaagcagcuggggcaggugaugcugcuaaucuuaugugucacccaggugcuaaugaugcggacgaccugggcccucugcgaggcccugacccuggccaccgggcccaucagcacgcucugggagggcaacccggggcgcuucuggaacacuaccaucgcggucuccauggccaacaucuuucguggcucuuaucuagccggcgccgggcuccucuucuccaucaugaagaacaccacgaacacucgccggggcacgggaaacaucggcgagacccugggagaaaaguggaaguccaggcugaacgcucucgggaaguccgaguuccagaucuacaagaaguccggcauccaggaggucgaccgcacgcuggcgaaggaggggaucaagcggggcgaaaccgaccaucacgccgugucccgcgggagugccaagcugcggugguuuguggagcgcaacauggucacccccgaggggaaggugguggaccucggcugcgggcggggcgggugguccuacuacugcggcggcuugaagaacguacgcgaggugaaaggccugaccaagggcggucccggccacgaggagccaaucccgaugagcacguacggguggaaccucgugcggcugcagaguggggucgacguguucuucaucccgcccgagaagugcgacacccuguugugcgacaucggggagagcucccccaauccgaccguggaggcagggcgcacgcugcggguucugaaccucguugagaacuggcucaacaacaacacgcaguucugcauuaagguguugaaccccuacaugcccagcgucaucgagaagauggaggcgcuacagcgcaaguacggcggggcccucgugcgcaacccgcuaagccguaacuccacccacgagauguacugggugagcaacgccuccggcaacauugucagcuccgugaacaugaucagccgcaugcugaucaaccgcuucaccaugcggcacaagaaggccaccuacgagcccgacguggacuuaggcuccggcacccgcaacaucgggaucgaaagcgagauccccaaccuggauaucauuggcaaacggaucgagaagaucaagcaggagcacgagacguccuggcacuacgaccaggaccaccccuacaagaccugggccuaccacggcagcuacgagaccaagcagaccggguccgcgagcuccauggucaacggcguggugaggcugcucacgaagccgugggacgucuuacccacgguaacccagauggccaugacggacacgaccccguucgggcagcagcggguguucaaggaaaaggucgacacccgcacgcaggagcccaaggagggcacaaagaagcugaugaagaucaccgccgaguggcucuggaaggagcugggcaagaagaagaccccgcgcaugugcacccgcgaggaguuuacgcguaaagugcggagcaacgccgcccugggggccauauucaccgacgagaacaaguggaaguccgcccgcgaggccguggaagacagccgguucugggaacucgucgacaaggaacgcaaccugcaccuggagggcaagugcgagaccugcguuuacaacaugaugggcaagcgggagaagaagcucggcgaauucgggaaggccaagggcagucgcgccaucugguacauguggcugggcgcgcgguuccuggaguucgaggcccucggguuucugaacgaggaccauugguuuagccgcgagaacucccugagcggcgucgagggggagggccuccacaagcugggguacauucugcgggacguguccaagaaggaaggcggcgccauguacgccgacgacaccgccgggugggacacgcgcaucacucucgaggaccugaagaacgaggagauggugacuaaccacauggagggagagcacaaaaagcucgccgaggcuauuuuuaagcucaccuaccagaacaaggucgugagagugcagcgacccacgccccgggggaccgucauggacauaaucucccgccgggaccagcgcggcuccggccaagucgggaccuacggccuuaacaccuucacgaacauggaggcccagcugauccggcaaauggagggggagggcguguuuaagaacauccagaaccucaccgucaccgaggagguugccgugcagaauuggcuggcgcgcgucggacgggagcgccuaucaagaauggccaucagcggcgacgacugcguggugaagccccuagacgaccgguuugccaacgccuuaaccgcccugaacgacaugggcaagauccgcaaggacauacaacagugggagccuagcaaggguuggaacgacuggacgcagguccccuucugcagucaccacuuccacgaguuaaucaugaaggacgggcggguucuggugguccccugccgcaaucaggacgagcugaucgggcgagcgaggaucucccaaggcgccggcuggagccuccgugagaccgccugucugggcaaguccuacgcccagauguggucacugauguacuuccaccgccgggaccuacgccuggcggcgaacgccaucugcuccgccgugcccagccacugggugccgaccucccggacgacguggagcauccacgccaagcacgaguggaugaccaccgaggacaugcugaccgucuggaaccgcguguggauccgggaaaaccccuggauggaggacaagacucccguggaguccugggaggagauccccuaccucgguaaacgcgaggaccaguggugcgggagccugaucggccuuacgucgcgggcgaccugggcgaagaacauccaggccgccaucaaccagguucgcagccucaucgggaacgaggaguacaccgacuacaugccgucuaugaagcgcuuucgccgggaggaggaggaggccggcgugcugugguag

SEQ ID NO: 25367 - RNA, 9876 nt, Artificial Sequence
  derived and/or modified CDS sequence (opt11) from DENV-2__EU482650__SS-prME
agcgcgggcaugauuauuaugcugaucccgacggugauggcguuccaccucaccacccggaacggggaaccccacaugaucguagggauucaggagaagggcaagucccuccuguucaaaaccgaagauggggugaacaugugcacccucauggcgauggaccuaggggagcuuugcgaggacacaauaacguacaagugcccccuccuccgacagaacgaacccgaggacaucgacuguuggugcaacagcaccucgaccugggucaccuacgggacaugcacgaccaccggcgagcaccgccgggagaagcgcagcgucgcacuggugccccacgugggcaugggucucgagacccggaccgagaccuggauguccagcgaaggggcguggaaacacgcccagcgcaucgagaccuggauacugcgccauccgggcuucacuaucauggcggccauuuuagcguacacuauugggaccacccacuuccagcgcguccucauauucauacugcugacggccguggcccccuccaugaccaugcggugcaucgggaucucgaaucgcgacuucguggaaggcgucuccgggggcagcuggguggacaucguguuagagcacggguccugcgugacgaccauggcgaaaaacaagccuacgcuggacuucgagcuaaucaagaccgaggccaagcagcccgccacccuaagaaaguacugcaucgaggcgaagcugaccaacacgaccaccgagagccgcugucccacccaaggcgagcccucucugaaggaggagcaagacaagcgguucgugugcaaacacucgaugguggaccguggcuggggaaacggcugcggucuguucggaaagggcgggauugucacgugcgcaauguucacgugcaaaaagaauauggagggcaagaucgugcagccagagaaucuggaauacaccauagugguuacgccccacuccggggaagaacacgcggugggcaacgacacggggaagcacggccaggagauuaaggugaccccgcagagcuccaucaccgaggccgagcugaccggguacgguacggucacgauggagugcagcccccggaccggccucgacuucaacgagauggugcugcuccaaauggagaacaaggccuggcucgugcaccgccagugguuccuggacuugcccuugccuuggcugccgggggcggacaaacaggaaucgaacuggauccagaaggagacccuggucaccuucaagaacccccacgccaagaagcaggacguggucgugcucggcagccaggagggggcaaugcacaccgcccugacaggcgcaaccgaaauccagaugagcucggggaaccucuuauucacuggccacuuaaagugccgguugcgcauggacaaacuccagcugaaaggcaugagcuauuccaugugcacggggaaguucaaggucgucaaggagaucgcagaaacccagcacggcaccaucgucauccgggugcaguacgagggggacggcagucccugcaagauccccuucgagauaauggaccuggagaagcguuacguccuaggcaggcugauaacggucaacccgauuguaacggagaaggacucucccgucaacauugaggcugagccucccuucggggacuccuacaucaucaucggcgucgagccggggcagcugaagcucaacugguucaaaaagggcuccucuauuggucagauguucgagaccacuaugcgcggcgcuaagcgaauggccauccugggcgacacagccugggacuucgguucccugggcgguguguucacgagcaucggcaaggcacuccaccagguauucggggcaaucuacggagcggccuuuuccggcgugagcuggaccaugaagauccugaucggcgugauaaucaccuggaucggcaugaacucccggagcaccagcuugagcgucucccugguguuaguagggaucgucacgcuauaccugggggugauggugcaggccgacagcgggugugucguguccuggaagaacaaggagcucaagugcggcucuggcaucuucauuaccgacaaugugcacaccuggaccgaacaauauaaguuccagcccgagucgcccucgaagcuggccagcgcgauccagaaagcccaagaggagggaauaugcggcauccgcuccgucacgcgguuagagaaccucauguggaagcagauuacccccgagcugaaccacauccuggccgaaaaugaggugaagcuaaccaucaugaccggggauaucaagggcaucaugcaggccggcaagcgcagccugcggccacagcccacggagcugaaguauagcuggaagaccuggggaaaggccaagaugcuuucgaccgaguccuacaaccagaccuuccuuaucgacggcccagagacggcggaaugcccgaauaccaaucgcgcuuggaauagccuggagguggaggauuacgguuucggcgucuucaccaccaacaucuggcucaagcucaaggagaagcaggacgccuucugugacuccaagcugaugucugcagccaucaaggacaaccgggcagugcacgccgauaugggguauuggauugaauccgcccucaaugacacguggaagaucgagaaagccagcuucaucgaaguaaagaacugccacuggcccaagucccacacccuguggagcaacggaguccuggaguccgagaugauuaucccgaagaaccucgccggccccgugucccagcacaacuaccggccgggguaccacacccaaaucgcgggccccuggcacuuggggaagcuggagauggacuuugacuucugcgacggcaccaccgugauaguaacggaggacugugggaauaggggcccgucccuccgaaccaccaccgccucgggcaaacuuaucacggaguggugcugucggagcugcacccugcccccgcugcgcuaccgcggugaggauggaugcugguacgggauggagauacgcccucugaaggaaaaggaggagaaccugguaaauucccuaguuaccgcgggucacgggcaggucgacaacuucagucuggguguguugggcauggcacucuuucuggaggagaugcugcguacccgcguggggacgaagcacgcgauccuucucgucgccguguccuucgugacccugaucaccggcaacauguccuucaaggacuuggggcguguaguggugauggucggcgcaaccauggccgacgauaucgggaugggcgugacguaccuggcccuucuagcggccuucaaggucagacccaccuucgccgccggguuacucuugcggaaguuaaccucuaaggagcuaaugaugaccacgauugggaucguucuccugagucagucuacgaucccugagaccgugcuggagcucaccgacgcgcuggcccuaggcaugaugguccucaagaucguccgcaacauggagaaguaccaacuggccgugacgauuauggccauacugugcgucccaaaugccgugauucuccagaacgcuuggaagguaucguguaccauccuggcagucguguccguaagcccacugcuccuaaccuccucacagcagaagacggacuggauccccuuggcccucacgaucaaaggguuaaaccccacagcaaucuuccugacaacccucagccggaccaacaagaagcggagcuggccgcugaacgaagccaucauggcaguuggcaugguguccauacuggccagcucgcuccugaagaaugacaucccaaugaccggcccccugguagccgggggccuacugacugucugcuacgugcugaccgggcgcucggcugaucuggaacuggagagggccacggacgugaagugggaggaucaggcggagaucuccggaagcucucccauccuguccaucaccauaagcgaggacgguuccaugucgauaaagaacgaggaggaggagcaaacacucaccaucuugauccgcacgggucuccuagucaucuccggcuuguucccgaucagcaucccgaucacggccgcugcaugguaccugugggaggugaagaagcagcgcgccgggguguuaugggacguccccucgccaccgcccaugggcaaggcggagcucgaggacggagccuaccguaucaaacagaagggaauccugggguacagccagaucggcgcuggcguuuacaaagagggcaccuuccacaccauguggcacgugacccggggagccguucucaugcacaaggggaagagaaucgagccauccugggccgacgugaaaaaggaucuuaucucauacggcgggggauggaagcuggagggcgaauggaaagagggggaggaaguacagguccuugcgcucgaaccuggaaagaacccccgggccgugcagacuaaacccgggcuguucaagacgaauaccggcaccaucggggccgugucccucgauuucagcccuggcacgaguggcagccccaucaucgauaagaaggggaaagucgugggacuguacgggaacggcguugucacacgcuccggcgccuacgugagcgcuaucgcgcagacagagaaauccaucgaggacaaccccgagaucgaggacgacaucuuccggaagcgccggcugacaaucauggaccugcacccgggggccggaaagacaaagcgguaccuuccagccauugugcgggaggccaucaagcgcggacugcggaccuuaauccucgcaccgacucgcgucguggcggccgagauggaggaggcccuacggggccuccccauacgcuaucaaacuccggccauccgggcugaacacacggggcgcgagaucgucgaccugaugugccacgccaccuuuaccaugcggcugcucagucccguccgggugccaaacuacaaucucaucaucauggacgaggcccacuucacagacccggccuccaucgccgcgcgcgguuacaucuccacacggguggagaugggggaggcggcggggaucuucaugaccgccacgccucccggcucgcgcgacccguuuccccaauccaacgcccccaucaucgaugaggagcgugaaauacccgagcggucguggaacucugggcacgagugggucaccgacuucaagggcaagacggugugguucguuccgagcaucaaagcggguaacgacaucgccgcgugccuacggaagaacggcaagaaggucauccagcugucccgcaagacauucgacucugaguacgugaagacacguacaaacgacugggacuucgucgugaccaccgauaucuccgaaaugggcgccaauuucaaggcagagcgugugauagacccccggcgcuguaugaagccugugauuuuaaccgacggggaggagagagucauccuggcgggucccaugccggugacccacagcucggcugcccagcgccgggggcgcauuggacggaaccccaagaacgagaacgaccaauacaucuacaugggugagcccuuagagaacgacgaagacugcgcccacuggaaggaggcgaagaugcucuuggacaacaucaacacgcccgaaggcaucauaccgagcauguucgagcccgagcgcgaaaagguugacgcgauugacggugaguaccggcuacgcggggaagcccgcaagaccuucguugacuugaugcggcgcggcgaccugcccguguggcuggcguauaagguggccgcggaggggaucaauuacgccgacaggcgguggugcuuugacggcaucaagaacaaccagauacuugaggaaaacguugagguugagaucuggaccaaggagggugaacggaagaaacugaagccgcgguggcuggaugcccggaucuacuccgacccccucgcucucaaggaguucaaagaguucgccgcaggccgcaagucucuaacgcucaaucuuaucacugagaugggccggcugccuaccuucaugacucagaagacccgcgacgcccucgacaacuuggccguccugcacacggccgaggccggcgggcgggccuacaaccacgcccucuccgagcugccggagacccuggagacccuccugcugcucacccugcuggccacggugaccgguggcauuuuccucuuccuuaugagcggccgggggaucggcaagaugaccuuggggaugugcugcaucauuaccgccuccauccuccugugguaugcucaaauccagccccacuggauugcagccagcaucauucuugaguucuucuugaucgugcugcugauccccgagcccgagaagcagcggacgccccaggacaaccagcucacguacgucgugauugcaauccucacuguggucgcggcgaccauggccaacgagauggguuuccuggagaagaccaagaaggaccucgggcugggcuccauugccacgcaacagccggagaguaacauccuggacaucgaccuccgcccugccagugccuggaccuuguacgcggucgccacaacuuucgugacgcccaugcuacggcacagcaucgagaauagcuccguaaaugugagccucacugccauugcuaaucaggcaaccgugcugaugggccuggggaagggcuggccccuauccaagauggacaucggggugccgcugcuggcgaucggcugcuacagccagguaaaccccaucacccucacagccgcccuguuacuccugguggcccauuacgcgaucauugggcccggccugcaggccaaggccacacgcgaggcgcaaaagcgggccgcggcgggaaucaugaagaaccccacagucgacgggaucaccgugaucgaccucgacccgauacccuaugaccccaaguuugagaagcaacugggccaaguuaugcuucugauccugugugucacccaggugcugaugaugcgcacuaccugggcccucugcgaagcgcugacucuggcaacugggcccaucuccacacugugggagggcaacccggggaaguucuggaacaccaccaucgcggugagcauggcuaacauauuccggggauccuaccuggcaggcgccggccucuuauucucaaucaugaagaacacgacuaacaccagacggggcaccgggaacaugggggaaacgcugggagagaaguggaaaagccggcugaauacccucgggaaguccgaguuccagaucuacaaaaagagcggcauccaggagguagaucgcacccuggccaaggaagggaucaagcgaggcgaaaccgaccaccacgcgguuagccgcggcuccgccaaguuacggugguucgucgagcguaauauggucacgcccgagggcaaggugguggaccugggaugugggcgggguggguggagcuacuacugcggcggacugaagaacgugagagaggugaagggcuuaaccaagggcgggcccggccacgaagaacccaucccgaugucgaccuacggcuggaaccugguucggcugcagagcggcgucgacgucuucuucaucccgcccgagaagugcgacacauugcucugcgacauaggagaguccucgcccaacccgacgguugaggcuggccgcacccugcgaguccugaacuuaguagagaacuggcugaacaacaacacccaguucugcaucaagguacugaacccauauaugccuuccgucaucgagaaaauggaggcccugcaacgcaaguauggcggggcgcucgugcgcaacccgcucagccggaacuccacccacgagauguacugggucuccaacgccagcggcaacaucgucuccagcgugaacaugauaucccggaugcugaucaaccgauuuaccaugcgacacaagaaagccacguaugagccggauguugaccucgggaguggcaccagaaacauuggaaucgaguccgagauccccaaccuggacaucauuggaaagcguaucgagaagaucaagcaggaacacgagaccagcuggcacuacgaccaggaccacccauacaagaccugggccuaucacggcuccuacgaaacgaagcaaacggggucugcguccagcauggucaacggcgucguaagacugcucaccaagccgugggacguacugcccaccgugacacagauggcuaugacagacacaacccccuuugggcagcagcggguguucaaggagaaggucgacacgcgcacccaggagccuaaggaggggaccaagaagcugaugaagaucaccgccgaguggcucuggaaggaguuaggcaagaagaaaacgccgcgcaugugcaccagggaggaguucacccgcaagguucguuccaaugccgcauuaggggccaucuucaccgacgagaacaaguggaaaagcgcgcgcgaggccguagaggacucccgguucugggaacucgucgacaaggagcgaaaucugcaccuggagggcaagugcgagacgugcguguacaacaugauggggaagagagagaagaagcucggcgaguucgguaaggccaagggcagccgugcuaucugguacauguggcugggcgccagguuccuggaguuugaggcgcucggauuccugaacgaagaucauugguucuccagggagaacagucugucaggcgucgagggugagggccuccacaagcugggguacauccugcgggacguuagcaagaaggaaggcggcgccauguacgccgacgauacagccgggugggacacccguaucaccuuggaggaucugaaaaacgaggagauggugacgaaucacauggagggugaacacaagaagcuggcggaggccaucuucaagcucacauaccagaacaagguggugcgugugcagcgccccacgccccgggggaccgucauggacaucaucagccgacgggaccagcgcggcuccggccaaguggggacauauggccugaauaccuucacgaacauggaagcccagcucauccggcagauggagggggagggcguguuuaagaauauacagcaccucacaguuacagaggagguggccgugcagaauuggcuagcucgagucggcagggagcgccuuagccgcauggcgaucucuggcgacgacugcguggugaagcccuuagaugauagauucgccaacgcucugaccgcccugaaugauaugggcaaaaucagaaaagacauccagcagugggagccuucuaagggguggaacgacuggacccaaguccccuucuguucacaccacuuccacgaacucaucaugaaggacggcagaguccuagugguccccugccguaaccaggaugagcugaucggccgggcccgcaucagccagggcgcuggcuggucccuccgggaaaccgccugcuugggcaaaucuuacgcccagauguggucccuaauguauuuccaccgccgggaccucagacuggccgccaacgcgaucugcagcgccgugccgucccacugggugccuacuagccggaccacuuggagcauccacgcuaagcacgaauggaugacgaccgaggacaugcugacaguguggaaccgcguguggauccgagaaaaccccuggauggaggacaagacccccguggagucgugggaggagauccccuaccucgggaagcgcgaggaccaguggugcgggucccugauaggccugaccagccgagcgacuugggccaagaacauccaggccgccaucaaccagguccgcuccuuaaucgggaaugaggaguacacggacuacaugccaaguaugaagcgguucaggcgagaagaggaggaggcaggcguucugugguag

SEQ ID NO: 25368 - RNA, 9876 nt, Artificial Sequence
  derived and/or modified CDS sequence (opt11) from DENV-2__EU482651__SS-prME
agcgcggggaugaucaucaugcugauccccaccguaauggccuuccacuugaccacacgcaauggagaaccucacaugaucgucggcauccaagaaaaaggcaagucucugcuguucaagaccgaggauggcgugaacaugugcacccugauggcuauggaucucggggagcucugcgaggacaccaucaccuacaaaugcccccuccugcggcaaaacgaacccgaggacaucgacugcuggugcaacucuaccuccacuugggugacguacgggaccuguacaacaaccggcgagcaccgccgggaaaagcgcagcguagcucuggugccacacguaggcaugggccucgagacccggacagagacuuggaugucaagcgaaggggcauggaaacacgcccagagaaucgagacguggauacugcgucaucccggauucacgaucauggccgcgauccuggccuacaccaucggaaccacccacuuccagcgcguccucaucuucauccugcugacagccguggcccccuccaugaccaugcggugcaucggcauaucuaaccgcgacuucgucgaaggcgucucugggggcagcuggguggacaucgugcucgagcacggauccugcgucaccaccauggccaagaacaaacccacgcuagacuucgagcuaaucaagaccgaagccaaacagccggcaacccuacggaaguacuguaucgaggcaaagcugacaaacacgaccacugagagccgcugcccuacccagggcgagcccucccugaaagaagagcaggacaagcgguucgugugcaagcacagcaugguagaucgcgguugggggaacggcugcggcuuguucggcaaaggcgggauugucacgugcgccauguucacuugcaaaaagaacauggagggaaagaucgugcagcccgagaaucuggaguacaccaucguggucacgccccacucuggggaagaacacgcggugggcaacgacacggggaagcacggcaaggaaaucaaggugaccccgcaguccuccaucaccgaggccgagcugacaggauacggaaccgucacuauggagugcagucccaggacuggccucgacuucaacgagaugguguugcugcaaauggagaacaaggccuggcugguacaccgccaaugguuccuggaccugccuuuacccuggcucccgggggccgacaagcaggaguccaauuggauacagaaggagacccugguaacguuuaaaaacccccaugccaagaagcaggacgugguggugcucggcagccaggaaggggccaugcacacggcccugaccggcgccaccgaaauccaaaugagcuccgggaaccuccuauucaccgggcaccugaaaugucggcugcgcauggacaagcuccagcugaagggaauguccuacuccaugugcacgggaaaguucaagguggucaaggagaucgcagaaacccagcacggcacaauaguaauccgggugcaguacgagggggacggcagccccugcaagauucccuucgagauaauggaccuggagaagcgguaugugcucggccggcugaucaccguaaacccgaucguaacggaaaaggacucccccgucaacaucgaggcagagccacccuucggcgacaguuacauuaucauugggguggaaccggggcagcugaagcucaacugguucaagaagggguccagcaucggucaaauguucgagaccacaaugcgcggagcgaagcgcauggcgauccucggcgacaccgcuugggacuucggaucgcuaggcggcguguucacgagcaucgguaaggccuugcaccagguguucggggccaucuauggggcugcauucuccggcgugucuuggaccaugaagauccugaucggaguuauaaucaccuggaucggaaugaacucccggagcaccucguuguccguaucccucgugcucguggggaucguaacucuguaccugggcgugauggugcaggcggauagcgggugcgucguguccuggaagaauaaagagcuuaaaugcggcagugguaucuuuauaacugacaacgugcacaccuggaccgagcaguacaaguuucagcccgagagccccuccaagcuggccagcgcgauccaaaaggcccaagaggaggggaucugcggcauccgcuccgucacgaggcucgagaaccucauguggaagcagauaacccccgagcucaaccacauccuggccgaaaaugaggugaagcucaccaucaugacuggggacaucaaagguaucaugcaggccgggaagcgcagccuacggccucagcccacggagcugaaauacuccuggaagaccuggggcaaggccaagauguugagcacggaguccuacaaccaaaccuuccugaucgacggucccgagacugcggagugcccgaacaccaacagggccuggaacagccuggagguggaggacuacggguucggcguauucaccaccaauaucuggcuccggcugaaggagaagcaggaugccuucugcgacuccaaacugaugagcgccgcuaucaaggauaaccgcgcggugcacgcugacaugggguacuggauugaguccgcccuuaacgacacguggaagaucgagaaagccagcuucauugagguuaagaacugccacuggcccaagagccacacccuuuggagcaacggcguccuggaauccgagaugaucauccccaagaacuuggccggcccaguuagccaacacaacuacagaccgggguaccauacccagaucaccggccccuggcaccuggggaagcucgagauggauuucgacuucugugauggcaccacagugauagucaccgaggauugcgggaaccgcggcccaucccuucggaccacgaccgcaagcggaaagcugauuaccgaauggugcugccgcagcugcacccugcccccgcuacguuaccguggggaggauggcugcugguacgggauggagauccggccccugaaggaaaaggaggaaaaccuggugaacucccucgugaccgccggucacgggcaggucgauaacuucagcuugggcguucugggcauggcacucuuccuggaggagauguuacgcacgaggguggggaccaagcaugccauccugcuggucaccgugagcuucguaacuuugauaacggguaacaugagcuucaaggacuuagggcgagucguugugauggucggggcuaccauggccgaugacaucggaaugggagugaccuaucuggcucugcucgccgccuucaaagugcggcccaccuucgccgcaggucugcuguugagaaaacugacguccaaggagcugaugaugacuaccaucgggauuguuuugcugagccaguccaccaucccagagacggugcuggagcucaccgaugcguuggcccugggcaugauggugcucaagauuguccgcaauauggagaaauaccagcuggccgugaccauaauggcgauccucugcgucccgaacgcuguggugcuccagaacgccuggaaggucagcugcaccauacuggccgucguuuccgucucgccccugcuccucacguccucgcagcaaaagaccgauuggaucccccuagcacugaccaucaaggggcugaacccuaccgcgaucuuccugacgacccuuucccggacuaacaagaagagaagcuggccgcugaacgaggccauaauggcagugggcaugguguccauauuggcuagcucccugcugaagaacgauauccccaugacgggcccccuggucgcaggcggucuccucacggucugcuacguucugacugggcguagcgccgaccucgagcuugagcgugccaccgaugucaagugggaggaccaggccgagaucuccgggagcagcccaauacuguccaucacgauuagcgaggauggaucuaugucaaucaagaacgaggaggaggagcagacucuaacaauccuuaucaggaccggccugcucgugaucucaggauuauucccuaucucuaucccgauuaccgccgcggccugguaccugugggaggugaagaagcagagggccgggguacuaugggaugugcccagcccgccccccauggggaaagcugaauuggaggacggcgccuaccggaucaagcagaagggaauacuaggcuacagccagaucggugccggugucuacaaagaggggaccuuccacacgauguggcacgucaccaggggcgccguucucaugcacaaggggaagagaauagagccauccugggccgaugugaagaaggaccugaucagcuacggggggggcuggaaacuggagggcgaguggaaggagggggaggagguccagguucuggcauuggagcccggcaagaacccccgcgccgugcagaccaagcccgggcuguucaaaaccaacacuggcaccaucggggccgucucccucgauuucagccccggcaccucaggcucccccaucauagacaagaaagggaaaguggugggccuguacgggaauggcgucguuacccguuccggggccuacgugagcgcaauagcccagacggagaaauccaucgaggacaaccccgagauagaggacgacaucuuccgcaagcggcgccugaccaucauggaucugcaccccggggccggcaagaccaaacgguaccuccccgcgaucguccgcgaagcgaucaagcgggggcugcgcacccugaucuuggccccgacacgggugguggccgcggagauggaagaggcccugcgcggacugcccauccgguaucaaacucccgccauaaaagcagaacacaccggucgagagaucgucgauuugaugugccacgccaccuucacgaugcgacugcugagccccgugcgggugccgaacuacaaccucaucauuauggacgaggcgcauuucaccgaccccgcauccaucgccgcuagaggcuacauaagcaccagagucgagaugggcgaagccgcugggaucuucaugaccgccacgccacccggcucacgcgacccguuuccccaguccaacgcccccaucaucgacgaggagcgggagauccccgagaggagcuggaacuccggacacgaguggguuacagacuucaagggcaagacagugugguuugucccguccauaaaagccggcaacgauaucgccgcgugcuuacggaagaacggcaagaaagugauucagcugucccgcaaaacuuuugauagugaguacgugaagacgcggacgaaugacugggauuucgucguuaccacagauauuuccgagaugggcgcuaacuucaaggccgaacgcgugauugacccccgacgcugcaugaagcccguuauccucacggacggggaggagcgagugauccuggccggccccaugccggucacacacucauccgcggcccagaggcgggggcgcaucggccggaacccuaagaaugagaacgaccaguacaucuauaugggagagccccucgagaacgaugaggacugcgcccacuggaaggaggccaagaugcuccuggacaacauuaacaccccugagggcaucauaccuagcauguucgagcccgagagggagaaggucgaugcaaucgacggagaguaucgacugcgaggggaggcgcgcaagaccuucguagaccucaugcggcgcggcgaccuccccgucugguuggcguacaagguagcugcugaagggaucaacuacgcugaccggcgcugguguuucgacggcaucaagaacaaccagauccucgaggagaacguggaggucgagaucuggaccaaggagggggagcggaagaagcugaagccgcgauggcuggacgcgcggaucuacuccgacccccucgcgcugaaagaguucaaggaguucgcggccggccgcaagagccugacucucaaucugaucaccgaaaugggccgucugcccaccuucaugacgcagaagacccgcgacgcccucgacaaccuggcgguacugcacacagcggaggccgggggccgggcguacaaccacgcgcucagcgagcugcccgagacccuggagacgcuccuccugcugacauugcuggccaccgucacgggggguaucuuccucuuccugaugagcggucgcgggaucggcaagaugaccuuagggaugugcugcaucaucacggccagcauccuccugugguaugcccagauccagccgcacuggaucgccgcgagcaucauccuagaauucuuccucaucguucugcugauccccgagccagagaagcagcggacgccccaggauaaccagcucacuuacgucgugaucgcaauccugaccgucguggccgccacgauggccaacgagauggguuuccuggagaagaccaagaaagacuuagggcugggcuccauagcgacccagcagccggagagcaacauccuggacauagaccuccgccccgcguccgccuggaccuuguaugccguggcaacgaccuucguaaccccuaugcugcggcacuccauagagaacagcuccgugaaugucagucucaccgcgauagcuaaccaggcaacggucuugaugggccuggggaagggcuggccccucuccaagauggauaucggggugccgcuguuagccaucgggugcuauagccaggugaaccccaucacccucaccgcagcucugcugcuauuagucgcccacuacgccaucaucgggcccggccuccaagccaaggcuacgcgcgaggcucagaaacgggcagccgcgggcaucaugaagaaucccacaguggacgggaucaccgugaucgaucucgacccgauccccuacgaccccaaguucgaaaagcagcugggccaggucauguugcucauccuuugugugacccaggugcugaugaugaggaccacgugggcguugugcgaggcccugaccuuagccacugggcccaucagcacccuaugggagggcaacccggggagauucuggaacacgacuaucgccguaagcauggccaacaucuuccgcggcagcuaccuggcgggcgcgggacugcucuucagcauuaugaagaacacuacgaacacgcggcgcggcacgggaaacaucggugaaacucuaggcgagaaauggaaaucccgccugaacgcccuaggcaaguccgaauuccagaucuacaagaagucggggauccaggagguagaucgcacccuggcaaaggagggaauuaaacgaggcgaaacggaccaccacgcggugagccggggguccgcaaagcugcgcugguuugucgagcguaacauggucaccccggagggcaagguggucgacuuggguugcgggaggggcggguggagcuauuauugcggcgggcugaagaacgugcgggaagugaagggcuugaccaagggcgggcccggccaugaggagcccaucccgaugucuacuuacggguggaaccucguccgccugcagagcggcguggacguguucuuuaucccgcccgagaagugugacacgcugcucugcgacauaggggagucgagcccuaauccgaccgucgaggcuggacggacucuaagagugcugaaccugguggagaacuggcugaacaacaauacccaguucuguauaaagguccugaaccccuacaugccuagcgugaucgagaagauggaggcccugcagcggaaguauggaggggcccuuguucgcaacccacucagcaggaacaguacccacgaaauguacugggucuccaacgcgagcggcaacaucguguccagcgugaacaugaucucccgcauguugaucaaccgguucacaaugcgccauaagaaggccacauacgagcccgacgucgaccucggcagcggaaccagaaacauaggaauagaguccgagaucccaaaccuggacaucaucggcaagaggaucgaaaagaucaagcaggagcaugagacuagcuggcauuacgaccaggaccaccccuacaagacgugggcauaccacggcucguacgagaccaaacagaccggguccgccuccagcauggugaacggcgugguccggcugcugaccaagccgugggacgugcuucccacggucacccagauggcuaugaccgauaccacacccuucgggcagcagcgcgucuucaaagagaagguugacaccagaacucaggagcccaaggagggcaccaagaagcugaugaaaaucacagcggagugguuguggaaggagcuuggaaagaagaagaccccgcggaugugcacccgcgaggaguucacccggaaagugcgcuccaaugcggcccuuggggccaucuuuacggacgaaaacaaguggaaguccgcacgggaggcggucgaagauuccagguucugggaguugguugacaaggaaaggaaucuccaucuggaaggcaagugugagaccugcguuuacaacaugauggggaaacgcgagaagaagcucggugaguuugggaaggccaaaggaagccgggccauaugguacauguggcugggagcccgcuucuuggaguucgaggcccucggguuccugaacgaagaucauugguucucucgggagaacagccuguccggcguggagggggagggcuuacacaagcugggguacauccugcgcgacgugucgaagaaagagggcggcgcuauguacgccgacgacaccgccggaugggacacacggauaacucucgaggaccugaagaacgaggaaauggucacuaaccauauggagggagaacacaagaaguuagccgaggcgauauucaagcucaccuaccagaacaagguggugcgcgugcagcgaccgacgccccgcgggacggucauggauauaauuucgcggcgcgaccaacggggaucaggccaagucggcaccuacggccugaacaccuucaccaacauggaggcccagcuuauacgccaaauggagggcgaaggugucuuuaagaacauccagcaccucacugugaccgaggagguggcuguccaaaacugguuagccagaguggggcgcgagcgucugucucggauggccaucuccggcgacgacugcguggucaagccucucgacgaccgcuuugcgaacgcccugaccgcuuugaacgacaugggcaagauccguaaggacauccagcaaugggagccguccaagggauggaacgacuggacgcagguacccuuuugcucgcaucauuuccaugaguuaaucaugaaggacggccggguccuggucgugcccugucggaaccaggacgaguuaaucgggcgcgcccggaucagccagggcgcgggguggucccucagagagacggcuugccugggcaaaucuuacgcccagauguggucccugauguacuuccaccggcgcgaucuccggcuggcugcuaacgcaauaugcagcgcaguccccucccacugggugccgaccagccgcaccacgugguccauacacgccaagcacgaguggaugacuacggaggauaugcugaccguguggaaccgaguguggauccgcgagaacccauggauggaagacaagacccccguggagagcugggaggagauccccuauuuaggcaagcgggaagaccaguggugcggaucccugauuggccucaccagccgcgccacgugggcuaagaauauccaggccgcgauaaaccaagugagaucgcucaucgggaaugaggaguacacggauuacaugccgucuaugaagcgcuuccggcgcgaagaggaagaggccggagugcuuugguag

SEQ ID NO: 25369 - RNA, 9876 nt, Artificial Sequence
  derived and/or modified CDS sequence (opt11) from DENV-2__EU482652__SS-prME
agcgcgggaaugauuaucaugcugauccccaccgugauggccuuucaccucaccacccggaauggcgagccgcacaugaucgucggcauccaggagaaggggaagucccugcuguucaaaacggaggacggcgugaauaugugcacacucauggcaauggaucugggggaacuaugcgaggacaccauuaccuacaagugcccccuccugcggcagaacgagcccgaggacaucgacugcuggugcaacagcaccuccaccugggugaccuacgggaccugcacgaccaccggcgagcaccgccgggagaagcgcagcgucgcccugguuccccauguggggaugggccuggagacgcggacagagacguggaugucuagugagggggccuggaaacacgcccagcgcaucgagaccuggauccugcggcaccccggcuucacgaucauggccgcgauccuggccuacaccaucgggaccacccacuuccagcgcguucucaucuucauacugcugacugccguggcccccuccaugaccaugagaugcaucggcaucagcaaccgcgacuucguggagggcguauccgggggcagcuggguggacauagugcucgagcacggauccugcguaaccaccauggcgaagaacaagcccacgcuggacuucgaguuaaucaagacggaggccaagcagcccgccacccuccggaaguacugcauugaggccaagcuaaccaacacgaccaccgagagccgcuguccgacccagggcgagcccucccugaaggaggagcaggacaagcgguucgugugcaagcacagcaugguggaccgcggcugggggaacggcugcggccuauucgggaagggcgggaucgucacgugcgccauguucacgugcaagaagaacauggagggcaagaucgugcagcccgagaaccuagaauacaccauaguggucacgccccauuccggugaggagcacgcggugggcaacgacacggggaagcacggccaggagaucaaggugaccccgcaaagcaguaucaccgaggccgagcugaccggguacggcaccgucacgauggagugcagccccaggacuggccucgacuuuaacgagauggugcugcugcagauggagaacaaggccuggcucguucaccgccagugguuccuggaucugccccuccccuggcugccaggggccgauaagcaggaguccaauuggauucagaaggagaccuuggucaccuucaagaacccccacgccaagaagcaggacguggucgugcucggcagccaggagggggcgaugcacacggcccuaaccggcgccaccgagauccagaugagcuccgggaaccuccucuucaccggccaccugaagugccggcugcgcauggacaaguuacagcugaagggaaugagcuauucccuuugcaccgggaaguucaagguggucaaagagaucgccgagacccagcacggcacuaucgugauccgggugcaguacgagggagacggcucucccugcaagauccccuuugagaucauggaccuugagaagcgauacguccugggccggcugaucaccgugaauccuaucgugaccgagaaagacucccccgucaacaucgaggccgagccgcccuucggggauagcuacaucaucaucggcguagagccggggcagcucaagcugaacugguucaagaagggcuccagcaucgggcagauguuugagaccaccaugcgcggcgcgaagcgcauggccauccugggcgacaccgccugggacuucgggucauuaggggggguauucacgagcaucggcaaggcccugcaucaagucuucggagccaucuacggcgcggccuucuccggcgugagcuggaccaugaagauccugaucggagugaucaucaccuggauagggaugaacucccggagcaccucccugagcgucucacucgugcugguggggaucgucacgcuguaccucggcgugauggugcaagccgacagcggcugcgucguguccuggaagaacaaggagcugaagugcggcucuggcaucuucauaaccgacaacguucacacauggaccgagcaguacaaguuccagcccgagagccccuccaagcucgcaagcgcgauccagaaggcccaggaggaggguaucugcggcauccgcuccgucacgagacucgagaaccugauguggaagcagaucacccccgagcugaaccacauccucgcagagaaugaagugaaguuaaccaucaugaccggggacaucaaaggcaucaugcaggccgggaaacguagccugcggccgcagcccaccgagcuuaaguacuccuggaagaccuggggcaaggcgaagaugcugagcaccgagaguuacaaccagaccuuccugaucgacggcccugagacggcggagugcccgaacaccaaccgagccuggaacagccuggagguggaggacuacgguuucggcgucuucaccacgaauaucuggcugaagcugaaggagaagcaggacgccuucugugacuccaaacugaugagcgccgccaucaaggauaacagggcggugcaugccgacaugggguacuggaucgaguccgcccugaacgacacguggaagaucgagaaggccagcuucaucgaggugaaaaacugucacuggcccaagucccacacccuguggagcaacggcguccucgaguccgagaugaucaucccuaagaaccuggccggccccgugagccagcauaacuaccgcccgggguaccacacccagaucgcgggccccuggcaccuggggaagcucgagauggacuucgacuucugcgacggcaccaccgucaucgucacggaggacugcgggaaccggggcccuagccugcgcaccaccaccgcuagcggcaagcugaucacggaguggugcugccgcagcugcacccucccgccacugcgcuaccgcggggaggacggcugcugguacgggauggagauccgcccacugaaggagaaagaggagaacuuagugaacucccuggugaccgccggccaugggcagguagacaacuucagccugggcgugcucgggauggcgcucuuccuggaggagaugcucagaacccgcguggggacgaaacacgcgauacugcuggucgccguguccuucgugacccucaucaccgggaacaugagcuucaaggacuuaggucggguuguagugauggucggggccaccaugaccgacgauaucgggaugggcgugaccuaccuggcccuccuggccgcguucaagguucgcccuacuuucgccgccggccuguugcugcggaagcugacaucgaaagagcucaugaugacgacaaucgggaucgucuuacuaagccaguccgccauccccgagaccguguuggaacugaccgaugcccuggcgcugggcaugauggugcugaagaucguccgcaacauggaaaaguaccagcucgccgugacgaucauggccauccucugcguccccaacgccgugauccugcagaaugccuggaaagugagcugcacgauccuugcagucguguccgugagcccuuuacugcugaccuccagccagcagaagaccgacuggaucccccucgcccugacgauuaaagggcugaaucccaccgccaucuuccucacgacccugucccgcacuaacaagaagcggagcuggccgcugaacgaggccaucauggcggucggcaugguguccauacucgccagcucccugcugaagaacgacauccccaugaccgguccccucguggccgggggccuguuaaccgucugcuacgugcucaccgggcgaagcgccgaccuggaguuggagcgggcuacggacgugaagugggaggaucaagcggagaucuccggcagcucacccauccucucgaucaccaucagcgaggacgggucuaugagcaucaagaaugaggaagaggagcagacacugaccauccugauccgcacgggucuccugguaaucucaggccuguuuccgauuagcaucccuaucaccgccgccgccugguaccucugggaggugaagaagcaaagggcaggggugcugugggacguccccaguccgccgcccaugggcaaggcggagcuggaggacggggccuaccgcaucaagcagaagggcauccucggguacagccagaucggcgccggcguauacaaggaggggaccuuccacaccauguggcacgugaccaggggcgccguccugaugcauaaggggaagcggaucgagccuuccugggccgacgugaagaaggaucugaucucauacggcgggggcuggaagcucgaaggcgaguggaaggagggggaggagguacaaguccuggcgcuggaacccggcaaaaauccccgggccguccagacgaagcccggcuuauucaagaccaacaccggcaccauuggggccguaucccucgacuucagccccggcacguccgggagcccuaucaucgacaagaaggguaaggucgugggccuuuacgguaacgggguaguuacccgcuccggcgccuaugucagcgccaucgcgcagaccgagaaguccaucgaggacaaccccgaaaucgaggacgauaucuuccggaagcgacggcugaccaucauggaccuccaucccggggccggcaagacaaagcgcuaccugccugccaucguucgggaggcaaucaagcgcggacugcggacccucauccuggcgccgacgcgcguaguggccgccgagauggaggaggcccuacggggccuccccauccgcuaccagaccccggcgauccgggcggagcauacgggucgcgagaucguggaccugaugugccaugccaccuucaccaugcgccugcucagcccgguccgggugccgaacuacaaccugaucaucauggacgaggcccacuuuaccgaccccgccuccaucgcugcucggggcuacaucagcacgcggguggagaugggcgaggccgccgggaucuucaugaccgccacgccgcccggcagccgcgacccguucccccagucaaaugcucccauaaucgacgaagagcgggagauccccgagagaagcuggaacuccgggcacgagugggucaccgacuucaagggcaagacggucugguuugugccuucuaucaaggcggggaacgacauugccgccugcuugcggaagaauggcaaaaaggucauccagcucucccgcaagaccuuugacagcgaguacgugaaaacccgcaccaacgacugggacuucguggucacgaccgacaucuccgagaugggggccaacuuuaaggcugagagggugaucgacccccggcgcugcaugaagcccgugauccugaccgacggggaggaacgggucauccuagcgggccccaugccgguaacccacuccuccgccgcacagcgccgggggcgcaucggccggaaccccaagaacgagaacgaccaauacaucuacaugggggagccccucgagaacgacgaggacugcgcacacuggaaggaggcgaagaugcuacuggacaacaucaacacgcccgaagguaucaucccgagcauguucgagcccgagagagagaagguggacgcaaucgacggcgaguaccggcuacgcggggaggcccgcaagacauucgucgaccugaugcggcgcggcgaccuacccguauggcucgccuacaagguggccgcggagggcaucaacuaugccgaucggcguugguguuucgacggcaucaagaacaaccagauccuggaggagaacgucgagguggagaucuggaccaaggagggggaacggaagaagcuuaagccucgcuggcucgacgcccggaucuacuccgacccccuggcccugaaggaguucaaggaguucgccgcgggccgcaagucgcucacccugaaccugaucacagagaugggccggcuacccacuuucaugacccaaaagacccgagacgcccuggacaaccuggccguccuucacacggccgaggccggcgggcgggccuacaaccacgcccuguccgaacugcccgagacccucgagacccugcugcuccucacucugcucgccacggugacaggaggcaucuucuuauucuugaugagcggccgugggaucgguaagaugacccucgggaugugcugcaucaucaccgcauccacccugcugugguacgcgcagauccaaccgcacuggaucgcagccagcaucauccucgaguucuuccugaucguucugcuuauccccgagcccgagaagcagcggacaccacaggacaaccagcugaccuacgucgugaucgccauccugaccguggucgccgcuaccauggccaacgagaugggguuccuggagaagacgaagaaggacuuagggcugggguccaucgccacccagcagccggagagcaacauccucgacaucgaccugcgccccgccuccgccuggacccuguacgcgguagccaccacguucgugacccccaugcuucggcacagcaucgagaacucauccgucaacgugagccugaccgccauugccaaucaagccaccgugcugaugggccucgggaagggcuggccccugucaaagauggauaucggcgucccgcugcuugcaaucgguuguuacagccaggugaaucccaucacucuuacagcggcccugcuccugcugguugcccacuacgcgaucauaggcccuggucuacaggccaaggccacccgcgaggcccagaagcgggccgcggccggcaucaugaaaaaccccaccgucgacgggaucacggugaucgaccuggacccgauccccuacgaccccaaguucgaaaagcagcugggucaggugaugcucuugauccugugcgucacccagguguuaaugaugcguaccaccugggcccugugcgaggcuuuaacgcucgccaccgggcccaucuccacccugugggaaggcaacccggggcgguucuggaacaccacgaucgccgugagcauggcaaacaucuuucgcggcuccuaucuggcaggcgcggggcugcuguucagcaucaugaaaaacaccaccaacacacggcguggcaccgggaacaugggugaaacccugggagagaaguggaagucccgccucaacgcccugggaaagagcgaguuucagaucuacaaaaaauccgggauccaggagguggaccggacccuggcgaaggaggggaucaaacgcggcgagaccgaccaccacgccgugagccggggguccgccaagcuccgcugguucguggagcgaaacauggucacgcccgagggcaagguggucgaccugggcugcgggcgcggcggguggagcuacuacugcggcgggcugaagaauguccgggaggugaagggccucaccaagggcgggcccggccacgaggagcccaucccgauguccaccuacggguggaaccucgugcgccugcagagcggcgucgacguguuuuucaucccacccgagaagugugacacccuucuuugcgacaucggggaguccagcccaaaccccacgguggaggccggccggacccugcgcguucucaaccugguggagaacuggcugaacaacaauacccaauucugcauuaaggugcugaaccccuacaugcccuccguuaucgaaaagauggaggcguugcagcggaaguacggcggggcccuggugcgcaacccgcuuagccggaacagcacccacgaaauguauuggguguccaacgccagcggcaacaucgucucaagcgugaacaugaucucccgcaugcucaucaaccgguucaccaugcgucacaagaaggccacguacgagcccgauguggacuugggcagcggcacccggaacaucgggaucgagucggaaauacccaaccuugacaucaucggcaagcgcauugagaagaucaagcaggaacaugagaccagcuggcacuacgaccaggaccaccccuacaagacgugggccuaccacggcucguacgagacaaagcagaccggcagcgcguccagcauggucaacggcguggugagacuccuuaccaagccgugggacguccugcccaccgugacgcagauggccaugaccgacacaacgcccuucgggcagcagcggguguucaaggagaaggucgacacgcgcacucaggagcccaaggagggaaccaagaagcucaugaaaaucacugccgaguggcuguggaaggaacugggcaagaagaagacgccgcggaugugcacccgcgaggaguucacccggaaggugcgcuccaacgccgcccucggggcgaucuucaccgaugagaacaaguggaaguccgcccgggaagccguugaggacucacgcuuuugggagcuggucgacaaagagcggaaucugcaccucgaggggaagugcgagacaugcguguacaacaugauggguaagcgcgaaaagaagcugggcgaguucgguaaggccaagggcucgcgcgccauaugguacaugugguuaggcgcgcgcuuccucgaguucgaggcccugggguuccugaacgaggaccacugguucucccgcgagaacucccucuccggcgucgagggggaaggccugcacaagcugggguacauccuccgcgacgugagcaaaaaggaaggcggcgcaauguacgccgacgacaccgcggggugggacaccagaaucacccuggaggaucugaagaacgaggagauggucacgaaccacauggagggggagcacaagaagcucgccgaagcaaucuucaagcugaccuaccagaacaaggucgugcgcgugcagcggcccacgccucgcgggaccguaauggacaucaucagccgucgggaccagcggggguccggccagguggggaccuacggucugaacacguuuacuaacauggaggcccaacucauccgucagauggagggcgagggcguguucaagaacauccagcaccucaccgucacggaggagguggcagugaagaacuggcuugcgcgggucgggcgagagcgccucagccggauggccaucuccggcgacgacugcguggugaagccccuggaugaccgcuucgccaacgcccugaccgcccuaaacgacaugggcaagauccggaaggacauccagcagugggaaccgaguaagggguggaacgacuggacccaagugcccuucugcucccaccacuuccacgaguuaaucaugaaggacggccgcgugcuggugguccccugccggaaccaggacgagcucaucggucgcgcgcggaucagccagggcgccgggugguccuuacgcgagaccgccugccugggcaagaguuacgcccagauguggagucucauguacuuucaucggcgcgaccugcggcuggcggcgaacgccaucugcagcgccgugcccucccacuggguuccuacgagcaggacuaccugguccauccacgcuaagcacgaguggaugaccaccgaggauaugcucacggucuggaaccgaguauggauccgcgagaaucccuggauggaggacaagacccccguggagagcugggaggagaucccauaccugggcaagcgggaggaucagugguguggaagucugaucggccuuaccagccgcgcgaccugggcgaaaaacauccaggccgccaucaaccagguaaggucccugauugggaaugaggaguacgccgacuacaugccgagcaugaagcgcuuccggagagaggaggaggaggcgggcgugcugugguga

SEQ ID NO: 25370 - RNA, 9876 nt, Artificial Sequence
  derived and/or modified CDS sequence (opt11) from DENV-2__EU482653__SS-prME
uccgccggaaugauaaucaugcugaucccgacgguaauggcuuuccaccuaaccacccgcaauggcgagccgcauaugauaguaggcauacaagagaaagggaaaagucugcuauucaaaacggaagauggcgucaauaugugcacgcucauggccauggaucugggggagcuaugcgaagauacaauuaccuacaaaugcccccucuugcgacagaacgagccagaggauauugauugcuggugcaauagcacaagcaccuggguaacauauggaaccugcaccacaacuggagaacaccgacgggaaaaacgcagugucgcauuggugccacacgucgguauggggcuugagacucgcaccgagacauggaugagcagugaaggagcguggaaacacgcccaaagaauagagaccuggauccuucggcacccgggguuuacgauaauggcggcuauacuggcguauaccaucggaacaacacauuuucagcguguacuaauuuucauccuccuaacugcgguggccccgucuaugaccaugagguguaucggcaucuccaacagggacuucguugaaggggugagcggagguagcuggguggacauugugcuggaacacggcucgugcguaacgacgauggcuaagaauaagcccacgcuagauuucgagcuaauuaaaacagaagcaaaacagccggcgacccuccguaaauacugcaucgaagccaagcugacgaauacuaccacugaaagccgcuguccuacacagggcgaaccaagccuaaaggaagaacaagacaaaagauucguguguaagcauucaaugguagaccggggauggggcaacggaugcgggcucuuuggcaagggaggcauugugacgugugccauguucacguguaagaaaaacauggaggguaagauuguccaaccggaaaaccucgaguauacaauaguuguaacaccgcacagcggcgaagaacacgcgguaggaaacgacaccggcaaacacggaaaagaaaucaaggucaccccacaaagcucgaucacagaagcugagcuaacgggcuacgguaccguuacgauggaauguagccccagaacgggacuagacuucaaugaaauggucuugcuccaaauggagaauaaagcauggcuaguccaccgacaaugguuucucgacuuacccuugcccuggcuccccggcgcagacaaacaggaaagcaacuggauccaaaaagagacccugguuacauucaaaaauccacaugcuaagaagcaggacgugguaguacucggaagccaagaaggagcgaugcacacggcuuuaacaggggcaacagaaauccaaauguccagcgggaauuugcuauuuacaggccaccugaagugcaggcuuagaauggauaaacugcaacugaagggcaugagcuacaguaugugcacggguaaauucaagguagucaaagaaaucgcggagacccaacauggaaccaucguaaucagaguucaauaugagggagauggaagucccugcaaaauaccguuugagaucauggaucuggagaaaagauacguccuaggccgacuaauaaccguaaacccgauaguaaccgagaaagacucacccguaaacaucgaagcggagccuccauucggagacuccuauauaauaauagggguggaaccagggcagcuaaaacuaaacugguucaaaaagggaucaucgaucgggcaaauguucgagaccacaaugagaggcgcaaaacggauggcaauacuaggagauacggcuugggacuucgggagccuuggcggggucuuuacaucgauagguaaagcccuucaccaggucuucggagcgaucuacggugccgccuucaguggcguaagcuggaccaugaaaauacuaaucggaguaaucauaacauggauuggaaugaacuccagaucaaccagucuguccgucucacuuguacugguagggaucgugacccucuacuuaggcguaaugguucaggcagacagugggugcguagugagcuggaaaaauaaagaacuaaaaugcggcaguggaaucuucguaaccgacaacguacacacauggacagagcaguauaaguuccaaccggaaucgccauccaaacuugcgagugcuauucaaaaagcacaggaagaagggauuugugggauccgcagugucacaagacuagagaaccugauguggaaacagaucacgcccgaguuaaaccauauccuagcagaaaaugaagugaaacugacaauaaugacgggggacauaaaaggaauaaugcaagccggaaaaaggagccugcguccccaaccaaccgagcucaaguacucauggaagaccugggggaaggcaaaaaugcucucaacagagagccacaaucaaaccuuccuaauagacggaccagaaaccgcggaaugcccgaacacgaaucgggcguggaacagccuagaaguagaagauuacggauucggcgucuucacuacgaacaucuggcuaaggcugaaggaaaaacaggacgcguucugcgacuccaaauuaaugucagcggcaauaaaagacaaccgcgcaguacacgcggauaugggguauuggauagaguccgcgcucaacgauaccuggaaaaucgaaaaggccucauucauugaagugaaaaauugccacuggccaaaaagccacacacuuuggucgaacggaguucucgagagcgaaaugaucauccccaagaaccucgcgggcccggucucgcaacacaacuaccgaccgggcuaccacacacaaauagccgggccauggcaucuagguaaacuggagauggacuucgacuuuugcgacggcaccacggucaucgucacagaagacugugggaaccgaggcccaucccuacguaccacgaccgcauccggaaaacuaaucacagaaugguguugucguucauguacacucccaccacuccgauaccgcggcgaggacggaugcugguaugguauggagauacgaccacuaaaagaaaaggaagaaaacuugguaaacucccucgucaccgcagggcacggccagguugauaacuucagccucggcgugcucgguauggcuuuguuccuugaagaaaugcuacggacgaggguaggaacaaaacaugcaauccuccugguugcaguaucauuugugacauugaucaccggaaacaugagcuucaaagauuuaggaagagugguggucaugguaggcgcgacaauggcagacgacaucggaaugggcgucaccuacuuagcgcugcucgcagccuucaagguacgcccgacauucgcggccggcuuacuacuacguaaacugacaucgaaagagcuaaugaugacgacgauagguauagugcuacuaagccagucuaccauccccgagacagugcuggagcuuacagacgcacucgcgcuggggaugaugguccugaaaauaguacgcaacauggaaaaauaccagcuagcaguuacaauaauggcaauacugugcgugcccaaugccgucauacuucaaaaugcuuggaaaguaucauguaccauacuagcggugguuagcgucaguccgcuacuccuaacgucaucacagcagaaaacggacuggaucccacuagcguuaacaaucaaggggcucaacccaacagccauauuccucaccacucuaaguagaacaaauaaaaagcgcaguuggccccugaacgaggcaauaauggccguagggaugguaaguauacuagcuucaagccucuugaaaaaugacaucccgaugacagggccgcucguggcagggggccuacugaccgucugcuacguacugacgggccgcagcgcagaucucgagcucgaacgagcgacggacgucaagugggaagaccaagcggagauuucgggaucaaguccgauccucaguauaacaauauccgaggacggcuccauguccaucaaaaaugaagaagaagaacaaacccugacaauacuaauccguacgggacuucucgucaucucgggccuuuuucccaucagcauccccaucacggcagcagcuugguaccucugggaagucaaaaagcaacgggcuggcguauuaugggacguccccagcccgcccccaaugggcaaggcggagcuugaagacggagcauaccgcaucaaacagaaaggaauauucggcuacagccaaauaggcgcggggguguacaaggagggaaccuuccacacaauguggcacguaacuaggggagccguacugaugcacaaaggaaaacggauagagccauccugggccgacguaaagaaagaucucaucagcuauggugggggauggaaguuggagggagaauggaaggaaggcgaggaaguacaaguacuggccuuagagccaggcaagaacccgcgagccguccagacgaaacccggccucuucaaaacaaacacaggcaccauaggcgcugucagccuagacuuuucucccggcacgagcgguucaccgauaauugacaaaaaggguaaaguaguugguuuguauggaaacggcgucgugacgaggagcggugcauaugugucugcaauagcccaaaccgaaaaaucaauugaagacaaccccgaaauagaagacgacauuuucagaaaacggaggcugacaaucauggaucuucauccaggggcaggaaagacgaagcgguaccuuccggcgaucguccgagaggcaaucaagcgaggacuacgaacgcugauccuggccccaacccgcguugucgcggcggagauggaggaagcauugcgaggcuugccaauccgguaccaaacccccgcgaucagagcggaacauacgggaagggagauagucgaucugaugugccacgccacauuuaccaugcgguuacucagcccggugagagucccaaauuacaacuuaaucaucauggacgaggcccacuucacugaccccgcgagcauagcggccagaggauacaucucaacgagaguggaaaugggcgaagcagcaggaaucuucaugaccgccacgccacccggcucgagagauccauucccacaaagcaacgcuccgauaauagacgaggaaagggaaauuccagagcgcagcuggaacagcggacacgaauggguaacagacuucaagggaaagacaguaugguucguaccgucaauaaaagcaggcaacgacauagccgcgugccuaagaaagaacggaaagaaaguaauacagcuaagccgaaaaaccuucgacucagaguacguuaaaaccagaacuaaugacugggacuucguggucacgacagacauaagcgaaaugggcgcaaacuucaaagcagagcggguaauagacccgcgaagaugcaugaaacccguaauccuaaccgacggggaagaacggguaauccucgcuggaccgaugccagugacacacucaucggcagcccaaagaagaggccgcauaggccgcaaccccaaaaacgagaacgaccaguacaucuacaugggcgagccucuggagaaugacgaggacugcgcacacuggaaagaagcuaaaaugcucuuagacaauaucaacacaccagaaggcauaauuccaucgauguucgaacccgaaagagaaaaaguugacgcuauugacggagaguaccgacuccgcggagaagcacgcaaaacauuugucgacuuaaugcgccggggugaucugccugucuggcucgccuacaaaguugcggcggaaggcauuaacuacgcggacagaagauggugcuucgacggaaucaaaaacaaccagauacucgaagaaaacguggagguggagauauggacaaaagagggggaacgcaagaaauuaaaaccaagauggcucgaugcacgcaucuacagcgacccgcuggcacugaaggaguuuaaggaguucgccgccgggcggaaaucucugacacuaaacuugauaacggaaaugggaaggcugcccacguucaugacccaaaagacacgggaugcuuuggacaaucucgcgguucugcacaccgcagaagcggguggacgagcauacaaccacgcucucagcgagcugccggaaaccuuggaaacccuccuccuauugacucugcucgcgaccguaacgggaggaauauuccucuuccuaauguccggccgaggaauagggaaaaugacccugggaaugugcuguauuauaacagcgucaauccucuuaugguacgcucaaauacagccccacuggauagcagcgagcaucauacuugaguucuuccucaucguucuccucauaccggagcccgaaaaacagcgaacaccacaggacaaccaacugacuuacgugguaaucgcaauacucacuguuguggcggcgacaauggccaacgaaaugggguuccuggaaaagaccaagaaagaccuaggacucgguagcauagcgacccagcagccggaauccaacauccucgacauugaccuacggcccgccagcgccuggacccuuuacgccguagcaaccacguucguuaccccgaugcuuagacauagcauugagaacucauccguuaacgugagucuuacagcaauagccaaucaggcgacaguacuuaugggacucggcaaaggauggccauugucgaaaauggacauuggugucccauuacuagcgauaggcugcuacagccaggucaaucccauaacucuaacugcggcgcucuugcugcuuguggcucacuacgcaaucauuggccccggauuacaggcgaaggcgacccgcgaagcgcagaagcgagcagcugcgggaauaaugaaaaaccccacgguggacggcauaaccguuaucgaucucgauccaaucccauaugacccgaaauuugaaaagcagcucggccaaguaaugcuacugaucuugugcgucacacaggucuugaugaugcgaaccaccugggcccucugcgaggcgcugacacuagccacggggcccauaucgacacuuugggaaggcaaccccggucgcuucuggaacaccaccauagcggucuccauggcaaacauauuccgggggucguaccuagccggagcgggccuguuguuuagcauuaugaagaauaccaccaaugcccgccguggaaccggaaacaugggggaaacacucggagagaaauggaaaucucgucugaacgcacucgggaaaagugaauuucagauauacaagaaaaguggaauccaagagguggaucggacccucgcaaaagaagggaucaaacggggagaaacagaucaucaugcaguaucgcgggguucugcgaaacucaggugguucguagagcgcaacauggucacuccggagggaaaaguggucgaccucggcugcggcaggggcggcugguccuauuacuguggcgggcucaagaacguacgugaagugaagggccuaacaaaaggcgggccgggacacgaggagccuaucccgaugucaaccuacggguggaaccuagugaggcuccaaucaggcguagacguauucuucauacccccggaaaagugcgacacacuacuaugcgacauaggagaaaguagccccaacccaacugucgaagcaggaagaacgcuccguguacucaaccugguggaaaacugguuaaacaacaacacccaauucugcauaaagguccuaaacccauacaugccauccgugauagagaaaauggaggcccuacaacgcaaguacggaggugcguuggucagaaacccacucagcaggaacucaacccacgaaauguauuggguaucaaacgcgagcgggaauaucguuucgucaguaaacaugauuucacgaaugcuuauaaacagguucacuaugagacacaaaaaggcaacguaugagccggacguggaucugggcaguggcaccagaaacauaggaauagaaagcgaaauccccaaccuggacauaauaggaaaacggaucgagaaaaucaaacaagagcacgaaaccagcuggcacuacgaccaagaccaccccuauaaaacaugggcauaccacgguagcuaugaaacaaaacagacgggaagcgcgucgagcaugguaaacgggguaguaaggcuacuaaccaaaccaugggacguccucccaacagugacacagauggccaugaccgacaccaccccauucgggcagcaacgagucuucaaagagaagguagacacccgcacacaggaaccgaaagaggguacuaagaaacuuaugaaaaucacugccgaauggcuauggaaagaauuaggcaagaagaaaacaccccguaugugcaccagagaagaauuuacacggaaggucagaucaaacgcagcgcuaggagcgaucuuuaccgacgagaauaaauggaaguccgcaagagaagcagucgaagauucacgcuuuugggaacugguggauaaggaacgaaaccuacaucuagaaggaaaaugcgagaccugcgucuacaacaugaugggaaaacgggagaaaaagcucggcgaguucggcaaagcgaaagguagcagggccaucugguacauguggcugggggcgcgguuccuugaauuugaggcccucggauuuuuaaacgaagaucauugguucagcagagagaacagucuaagcggcgucgaaggcgagggacuacauaaacuuggguacauauuacgggauguuagcaaaaaggagggcggggcuauguacgcagacgacacugcgggaugggacacgaggaucacgcuagaagaccucaaaaaugaagaaaugguaacaaaccacauggaaggggaacacaagaaacucgcggaagccauauucaaauuaacguaccagaauaaagucguacgcguccaacgacccaccccuaggggaacugugauggauauaaucagccggcgggaccaacguggaucgggccaagugggaacguacggucucaauacguucaccaacauggaggcacaauugauacgccaaauggagggcgaaggaguauuuaaaaacauacagcauuuaaccgugaccgaagaaguagcgguucagaauuggcuagcacgggucggucgagagagacucucgcgcauggccaucucgggcgacgacugugucgugaaaccacuagacgacagguucgccaaugcgcuuaccgcacucaacgacaugggaaagauuaggaaggauauccagcaaugggaaccgagcaaagguuggaacgacuggacccagguccccuucugcucacaccacuuccacgaauuaaucaugaaggauggccgggugcuaguagucccaugccgaaaucaagacgaauuaaucgggcgagcccgaaucucacagggggcggguuggucucucagagagacagccugccugggaaaguccuacgcccagauguggaguuuaauguacuuccaccgccgagacuuaaggcuggcagcgaacgcgauaugcucggccguccccagccacuggguuccgaccagccguacgacauggucaauccacgcaaaacaugaguggaugacaacagaagauaugcugacgguauggaacaggguuuggauccgagaaaacccguggauggaagacaagacgcccguggaauccugggaagagauaccauaucuugguaagagagaagaccaauggugcgggucgcuaaucggacuaaccagucgagccacgugggccaagaacauccaagcagcaaucaaccagguacguuccuuaauagggaacgaagaauacacugacuacaugccgucgaugaagcgguuccgacgcgaagaagaagaggcaggaguccugugguga

SEQ ID NO: 25371 - RNA, 9876 nt, Artificial Sequence
  derived and/or modified CDS sequence (opt11) from DENV-2__EU482654__SS-prME
ucagccggaaugauaauaauguugauaccuaccgucauggcauuccacuuaaccacgcggaacggggaaccccacaugaucgugggcauucaggaaaagggaaagucgcuucuuuucaaaaccgaagacgggguaaacaugugcacacuaauggcaauggaccuaggcgaacucugcgaagacacuauaaccuacaaaugcccguuguugaggcagaaugaaccagaagacauagauuguugguguaauucaaccagcaccugggugacauacggcaccuguacaaccaccggugaacaccgcagggagaaacgauccguagcguuaguaccccauguuggaaugggccuggaaacacggaccgaaacuuggauguccucggaaggggcauggaagcacgcacagcgcaucgaaaccuggauacuacgacaucccgguuucacaauuauggcagcaauacuggcguacacuaucggaacaacgcacuuccagcgaguacugaucuucauauuacuuaccgccguagcgccauccaugacuaugcggugcaucggaaucucaaacagggacuucgucgaaggcgucagcggcggcagcugggucgacauaguacuggaacacgggagcugcguaacuacaauggcgaaaaacaaacccacccuagacuucgagcucaucaaaacagaggcaaaacaacccgccacccuacggaaauacugcauagaagccaaacuuacaaacacgacaacggaaucccgguguccaacacagggcgaaccgagccucaaagaagaacaggauaaacgauucguaugcaagcacaguauggucgaucgagguugggguaaugggugcgguuuauucgggaaaggcggcauuguaaccugcgcaauguuuaccugcaagaaaaacauggagggcaaaaucguccagcccgagaaccuugaauacaccauaguaguaacaccacacucuggagaagaacaugccguaggcaacgacaccgggaaacacggacaggaaauaaagguaacgccacaaucgagcauaaccgaggcggaacuaacaggcuacggcacaguaaccauggaauguuccccacgcacuggccuagacuucaaugagaugguccuccugcagauggaaaacaaggcauggcuggugcacagacagugguuccuggaccuuccacuaccauggcuaccaggagcagacaaacaggagaguaacuggauccagaaggaaacccucgucacuuucaaaaacccucacgcgaaaaagcaggacgucgucguccucgguagucaggaaggggcuaugcacacugcccucacaggagccacagaaauccaaaugucuagcggcaaccuucucuuuacgggacacuugaaaugcaggcuucggauggauaaguugcaacugaagggcaugucauacagcauguguacggguaaguucaaagugguaaaagaaauugccgaaacccagcacggaacgaucgucauccgaguacaguaugagggcgacgggucgccgugcaagauccccuucgagaucauggaccuggagaagcgauauguacucggacgccuaauuacggucaauccaauagugaccgaaaaggacagcccagucaauaucgaagccgaaccaccauucggcgacuccuauauuaucaucgggguggaacccggucagcugaaacucaacugguuuaagaaaggaaguuccauaggacagauguucgaaacaaccaugcgaggggccaaaaggauggcgauacuuggugacacugccugggacuucggaucacucgggggaguauucaccagcaucggcaaggcacuacaucaaguauucggcgccaucuauggagcggcguucagcggaguuagcuggacuaugaagauacuaaucggggucaucaucaccuggaucggaaugaacucaagaagcaccagccugaguguaagucugguccugguagggauaguaacccuguacuuaggggucaugguucaagccgacagcggcugugucgugagcuggaaaaacaaggagcugaaauguggcuccgguauauucaucacugacaauguacacacauggacagaacaguacaaguuccaacccgaauccccuucgaagcuggccuccgcgauacagaaggcccaggaagagggaauaugcggaauuaggucugugacuaggcuagaaaaccuaauguggaaacagauuacuccggaauuaaaccacauauuagcggaaaaugaagucaaaaugacuauaaugacgggugacauuaaaggcaucaugcaggcugggaaacgcagccuacguccacaaccaacagagcuuaaauauagcuggaagacuuggggcaaagccaaaaugcuuuccaccgaauccuacaaccaaacauuccucaucgauggacccgaaacggccgaaugcccgaacacaaacagagccuggaacucccucgaagucgaggauuauggauucggaguuuucaccacaaacauauggcucaaacucaaggaaaaacaagacgcauuuugugacagcaaauuaaugucagcggcuauaaaagacaacagagccgugcacgcagauaugggauauuggauagaaagcgcccuaaaugacaccuggaaaauagaaaaagccagcuuuauagaaguaaagaauugucauuggcccaagucccacacccuauggagcaacggcguccuugaauccgaaaugaucauccccaaaaaucuagccggacccguaucgcagcauaacuaccggccaggauaucacacccagaucgcagguccuuggcauuugggcaaacuugaaauggacuucgacuuuugcgauggaacuacaguuaucguaacugaggacugcggaaaccgcgggccgucacugcgcacgacaaccgcgucagguaaacugauaacagagugguguugccgaaguuguacccucccaccacuacgcuacagaggcgaggacggaugcugguacggaauggagauacggccgcugaaggagaaggaggaaaaucuaguuaacagucucgugaccgcagggcacggccaaguggacaacuucucccucggcgugcucggcauggcacucuuucucgaagaaaugcuacguaccagagugggcaccaaacacgccauauuacucguagccgugagcuucguuacgcugauaaccggaaacauguccuucaaggaucuaggacgcgugguuguaaugguaggcgcaacaauggccgaugauauaggcaugggagucacauaccuagcacuccuugcugccuucaagguuagaccgaccuuugccgccggacuccuucugagaaaacuaacgucaaaagaacugaugaugacuaccaucgggaucgugcugcucagccaaaguacaauaccggaaacuguacuagaauugacagacgccuuggcacucggcaugaugguacucaaaauaguacgaaacauggagaaauaccaacucgccguaacaauuauggccauuuuauguguacccaaugccgucauacuacaaaacgcguggaaggucucgugcacgauccuagcaguaguaucggugagcccucuacuacucacuucgucccagcagaaaacggauuggauccccuuagcacuuacaauuaagggucugaauccuacggcgauauuccucacaaccuugucccgcacgaacaaaaagcggagcuggccccuaaaugaagccaucauggccgugggcaugguuaguauccuagcgagcagcuugcucaaaaacgacauccccaugacaggcccccucgucgcagggggacuccuaacgguaugcuacgugcuaacagggcgguccgccgacuuggagcuagaaagagcuaccgacgugaagugggaggaucaggcagaaaucagcggauccaguccuauccugagcauaacgaucagcgaagaugggaguaugagcaucaaaaaugaggaagaggaacaaacauuaaccaucuuaauacggacagggcuauuagugauuucgggacuuuucccaauauccauacccaucacagcagcggcgugguacuugugggagguaaagaaacagcgggcaggcgugcucugggacguuccuaguccaccuccaaugggaaaagcagaauuagaagacggagccuaccgaaucaagcagaaaggaauccucggauacagccagaucggggcaggaguguacaaggaagggaccuuccacacaauguggcacgucacaaggggcgcaguccuaaugcauaaggggaaaagaauugaaccaucgugggccgauguuaagaaggaccugaucagcuacggcgguggguggaaguuagagggagaguggaaagagggggaggaaguacagguguuggcacuggagccuggcaaaaacccacgagccguccaaacuaaacccggccuuuucaagacaaauacgggcacaauaggggccguuucucuagauuucucacccgggaccuccggaucccccauaaucgauaaaaagggcaagguaguugggcuguauggaaacggggucgugacccggucgggagccuacguuucagcaauagcccaaaccgaaaaauccauagaagauaauccugaaauugaggacgacaucuuccgcaaacgaagacuaacaauaauggaccuccaccccggugcgggcaaaacaaagcgauaccuacccgcaaucguacgcgaggcgauuaagcgcggacuacgaacacuuauucuagccccaacaagaguggucgcagcggagauggaagaagcccugcggggccugcccauccgcuaccaaacacccgcaaucagggcggaacauacgggccgcgaaauuguugaccuaaugugccacgcaacuuuuacuaugcgccuucucagcccaguccgcguaccgaauuacaaucuaauaauaauggaugaggcacacuucacagaccccgccuccauugcggcgaggggguacauuaguacacgcguagagaugggugaagcugcggggauuuuuaugacugcgacacccccaggcagcagggacccauuuccgcagucuaacgcgccgaucauagacgaggaaagggaaauuccugaacggaguuggaacagcggacacgagugggucacggacuucaagggcaaaacgguuugguuugucccaagcaucaaagcagguaacgacauagcugcaugccuacgcaaaaacgggaagaaaguaauccaauuauccagaaaaaccuucgauuccgaguacguaaagacacgaaccaaugauugggacuucguaguaacgacggacauaucagaaaugggcgcaaauuucaaggcagagcgcgucaucgacccaagaagaugcaugaaaccaguaauacucacagacggcgaggaaagagucauauuggcgggucccaugccagucacacacucaucugcggcgcagaggcgcggucggaucgggagaaaucccaaaaacgaaaacgaccaauacauauacaugggcgaaccccucgagaacgaugaagacugugcgcacuggaaagaggcgaagauguuacuagacaacauaaacaccccagaagggaucauaccuagcauguucgagccagaacgugagaaagucgacgcaauugacggggaauaccgccuacgcggagaagcuaggaaaacauucguagauuuaaugcgacgaggugaucuacccgucuggcucgccuacaaaguagcggccgagggcauuaacuacgcagaccgccgcuggugcuucgacgguaucaaaaauaaccaaauucuugaagagaacguagagguagaaauauggacgaaagaaggcgaacgcaaaaagcugaagccacgguggcuugacgcuagaauauacuccgacccucuagcgcugaaagaguuuaaggaguucgcggccggacggaaaucccucacucuaaaccucaucaccgaaaugggccgacugccgaccuucaugacccagaagacccgggacgcacuagauaaccucgcaguccuccacaccgcggaggccggcggaagggcuuacaaccaugcucucucggaacugccagagacccuagagacgcuucuucuacugacacugcuagccaccgucaccggagguauuuuccucuuccugaugagcggacggggcauaggaaaaaugacccuagggauguguugcauaaucacagccagcauccugcugugguacgcgcaaauccaaccgcauuggauagcagcuucaaucauacucgaauuuuuccuuauagucuuacugauaccugaacccgaaaaacagcgaacaccccaagauaaccaacuaaccuacgucgugauagcgauacugacagugguagcggcaaccauggcaaacgagaugggguuucuagagaagacuaagaaagaccucggccuaggaucaaucgccacacaacaaccagaaucaaauauccuggacauagaccuaaggccugcuagcgcauggacccuguacgccgucgccaccacguucguaacuccgaugcuucgacacuccaucgagaacagcucaguaaacgugagccuaaccgcgauagcaaaccaggcaacaguacucauggggcuaggaaagggguggccccuguccaagauggacaucggggugccacucuuagccauaggauguuacucacaggucaauccaauaacgcucaccgcagcuuuacuucugcucgucgcccacuaugcgauaauaggacccggucuacaagcgaaggccacucgagaggcucagaaaagggccgccgccggcaucaugaagaaucccacgguggacggcaucaccguaauagaccuugaucccauacccuacgauccuaaauucgaaaaacaacuaggccagguuauguugcuuauucugugcgucacucaaguucucaugaugaggaccaccugggcccucugcgaagcacuaacacuggcaaccgggcccauuaguacccugugggaagggaacccgggccgauuuuggaacaccaccaucgcaguaucuauggcgaacauauucagaggcucauaucucgcuggcgcaggccuguuauucuccaucaugaaaaacacuaccaacaccaggcgaggaaccggaaacaugggcgaaacucucggcgaaaaguggaagucccgacucaauacguuggggaaguccgaguuccaaaucuacaagaaauccgggauucaagaggucgaccguacccucgcgaaagagggaauaaagcgaggggagaccgaccaccacgcaguuuccaggggaucggcgaaacuccguugguucguugaacgaaauaugguaaccccggaggggaaaguaguagaucucgggugugggcggggcggauggaguuacuauugcggagggcucaaaaacguucgcgaaguaaagggccucacaaaaggaggaccgggccacgaggaacccauccccaugagcaccuauggauggaaccucgugcgccugcaauccggaguggacguauucuucauaccaccagagaaaugcgauacucuccuaugcgacaucggcgaaagcaguccaaauccaaccguggaagccggcagaacuuugcgcguacugaacuuaguugaaaacugguugaacaauaacacccaauuuugcauaaagguccuaaaucccuacaugcccagcguaauugagaaaauggaagcacuucagagaaaauacggcggggcacucgugcguaauccgcuaucccgaaacaguacgcacgaaauguacugggucaguaacgcaucugguaauaucguauccagcgucaacaugauaagcagaaugcucaucaaccguuuuaccaugaggcacaagaaagcaaccuacgagccagauguagaucucgggucaggaacaagaaacauuggaaucgagucagaaaccccaaaucucgacaucauagggaagcgaauagaaaagaucaaacaagaacaugagacaucguggcacuacgaccaagaccacccguacaaaacaugggccuaccacgggaguuacgaaacaaagcaaacgggaagcgcgucgaguauggucaacggaguaguacgccucuuaacgaaaccaugggacguccuaccuaccguaacacagauggcaaugacggacacgaccccauuuggucagcagcguguauucaaggaaaaaguagacaccaggacgcaggaaccaaaggagggaaccaagaaacuaaugaaaaucacagccgaguggcucuggaaggaacuaggcaaaaagaaaaccccaagaaugugcacgagggaagaguucacccggaaaguaagaucuaacgccgcgcuaggcgcgaucuuuaccgacgaaaacaaauggaagucagcacgcgaagcaguagaagauucgagauucugggagcucguagauaaggaaagaaaccuacaucucgaaggaaaaugcgagacaugugucuacaauaugaugggaaaaagggagaaaaagcuaggcgaguucggcaaggccaaaggaucacgagcuauaugguacaugugguugggagcgcgcuuucucgaguucgaagcgcuaggguuccuuaacgaggaccacugguucaguagagaaaacagccucucaggagucgaaggagaagggcuccauaagcugggauacaucuugcgggacgucagcaaaaaggagggcggugccauguacgcagacgacacagcagggugggacacgaggauuacacucgaggaccuuaagaacgaggaaauggugacgaaucauauggaaggcgaacauaaaaagcucgccgaggcaauauuuaaauugacauaucagaacaaggucguacgcguacaacguccuaccccgcgagguaccguaauggacaucaucagucgacgcgaccagagagggucgggccagguaggcaccuauggacugaauacguucacaaacauggaggcccagcucauccgccaaauggagggagagggcgucuuuaagaacauccagcaccuuaccgugaccgaagagguagccguacaaaauuggcucgcaagagucggacgugaacgauuaagcaggauggccauaagcggagacgacugcguuguaaaaccgcuugacgauagguucgcaaaugcccugacagcacugaacgauaugggcaaaauacggaaagauauccaacaaugggagccuagcaaggguuggaacgacuggacgcaagucccauucugcagccaucacuuucaugagcuuauaaugaaggacggccgcguacuugugguaccauguagaaaccaagacgaacucauagggcgggcccguauaagccaaggagccggcuggagccuccgagaaaccgcaugccucggcaagagcuacgcccagaugugguccuuaauguauuuccauagacgagaccuacgacuagcggcaaacgcaaucugcagcgccguuccgucccacugggucccgaccagccgcacaaccuggucuauucacgcaaaacaugaauggaugacaacggaagacaugcuaacagucuggaaccgcgucuggaucagagaaaauccguggauggaggacaaaaccccggucgaaucgugggaagagauuccauaucucggaaaacgagaggaucaauggugcggaucauuaaucggccugacgucacgggccacgugggcgaaaaauauccaagcagcgaucaaccagguucguagucucauaggaaacgaagaguacacagacuacaugccauccaugaaacgcuuccgcagagaagaggaggaagcuggaguacuaugguaa

SEQ ID NO: 25372 - RNA, 9876 nt, Artificial Sequence
  derived and/or modified CDS sequence (opt11) from DENV-2__EU482656__SS-prME
ucagcggggaugaucauuauguuaauccccaccguaauggccuuccaucucaccacucgcaauggggaaccucacaugauaguagggauacaagaaaaggggaagucccugcuuuucaagaccgaagacggagugaacauguguacauugauggcgauggaccugggggaacugugcgaggauacgaucacuuacaagugcccgcugcuucggcagaacgagcccgaggauaucgacugcuggugcaacagcaccagcaccugggugacauacgggaccugcacgaccacuggagaacaucgccgcgaaaagcgaagcgucgcccuggugccccacguaggcaugggucucgagacccgaacagaaaccuggaugucaagcgagggggccuggaagcacgcgcagagaauugagaccuggauccuccgucacccgggcuucacaaucauggccgcgauauuagccuauacgaucgguacaacucacuuccagcgcguccuuauauuuauucuacugaccgccgucgccccuucuaugaccaugcgcugcauuggcauuaguaaccgcgacuucguggagggcguaucagggggcagcuggguggacaucguuuuggaacacggcucuugcgucacuacuauggcgaagaacaagcccacgcuagacuuugaguugaucaagaccgaggcuaagcagccugccacgcucaggaaguacugcauagaggccaaacuuaccaacacgaccaccgaaagccgcuguccaacccagggcgagcccucacugaaggaggaacaggacaagcgguuuguguguaagcauagcaugguggaucgcggcuggggaaauggcuguggacuguucggcaagggcggaaucgucacgugcgccauguucacgugcaagaagaacauggagggcaagauaguucaacccgagaaccucgaguauacgaucguggucacgccucacuccggcgaggagcacgcggugggaaaugacaccgggaagcacggcaaggagaucaaggugacuccgcaaagcuccaucaccgaggccgaauuaacgggguacggcacggucacgauggaguguagucccagaacaggccucgacuucaacgagauggugcugcuccagauggagaacaaagccuggcucgugcaucgccagugguuccuggaucuccccuugcccuggcugccgggggccgacaagcaggaguccaacuggauccagaaggaaacccugguuaccuucaagaacccacacgcaaagaagcaagacguagucgugcuuggcucgcaagagggggccaugcacacggccuuaacgggcgccaccgagauacagaugagcuccgggaaccuucuguuuacgggacacuuaaagugccgucugcgcauggauaagcuacagcugaagggaaugucauauuccaugugcacgggaaaguucaagguggucaaggagauugcggagacacaacacggaaccaucgugauacgcgugcaguacgagggggacggcagccccuguaagauacccuucgagauuauggaccuggagaagcgcuauguccugggccgcuugaucacggugaacccuauugugacggagaaggacucccccgucaacaucgaagcggagccgcccuucggcgacucguauaucauaaucggcguggagccggggcagcugaagcucaacugguucaagaagggauccuccaucggacagauguucgagaccaccaugagaggcgccaagcgcauggccauccuaggcgacacugccugggacuucggaucacucgggggaguguucacgagcaucggcaaggcccuacaccagguauucggggccaucuacggcgcggcauuuuccggagugucauggacgaugaaaauucugaucggugucauuaucaccuggaucggcaugaacucccggucuaccagccuuagcguaucucuuguguuagugggcauagucacgcuguauuuaggcgugauggugcaggccgacucugggugcguugugaguuggaagaauaaggagcucaagugcggcucuggcaucuuugugacagacaacguccacaccuggaccgagcaguacaaguuucaacccgagagccccuccaaacuugcuucagcgauccaaaaggcccaggaggaagggaucugcggcauacgcucagugacgcggcucgagaaccucauguggaagcagaucacccccgagcugaaucacauccuagccgagaacgaggugaaacuuaccaucaugacgggggauauaaagggcaucaugcaggccgggaagcgcagccuaagaccgcaaccaacagagcuuaaauacucuuggaagacgugggggaaggcuaagaugcucagcacggagucccacaaccagaccuuucugaucgauggcccugagacggcggaguguccgaauaccaaccgcgccuggaacagccuggaagucgaggacuauggauuuggcguguuuaccacaaacaucuggcucaagcugaaggagaaacaagacgccuucugcgacucaaagcugaugucagccgccauaaaggacaaccgcgcagugcacgcagauaugggcuauuggaucgagucugcacucaacgauacguggaagaucgagaaagccagcuucaucgagguaaagaacugucacuggcccaagucccacacccuguggagcaacggcguacuggagucggagaugaucauaccgaagaaccuugcaggacccguuagucaacacaacuaucgcccaggcuaccauacccagaucgcgggccccuggcaccuggggaagcuggagauggacuucgauuucugugacgggaccaccgucaucguuaccgaggauugcgggaaccggggacccucguugcggacgaccacggccagcggcaagcugaucacggaguggugcugccggagcuguacacugccaccccugcgcuaccgaggcgaggacgggugcugguacggaauggaaauccgccccuuaaaggagaaagaggagaaccuagugaacuccuuagucaccgcgggccacggccagguggacaacuucagucugggagugcuggguauggcccuauuccuggaggagaugcugcggacucgcgucgggacgaaacacgcgaucuugcugguggccguauccuucgucacccuaaucacgggcaacaugagcuuuaaggaccuggggcggguggugguaauggugggcgccaccauggccgaugauauugggaugggcguuacguaucuggcgcuacucgcugccuucaaggugcgccccaccuucgcggccggccugcuccuccggaagcugacguccaaagagcugaugaugaccacgaucgguaucguccuucugagccagucuaccaucccagagacuguccuggaacucaccgacgcacuggcgcuaggcaugaugguccugaaaauugugcgcaacauggagaaguaccagcuggccgucacgauaauggccauacuaugcgugccgaaugcgguuauccuccagaacgcuuggaaggucucgugcaccauccuggcggugguaagcgucagcccacuuuugcugaccuccagucagcagaagaccgacuggaucccccuggcacucacgauaaagggguugaacccuacagccaucuuucugaccacucuaagucguacgaacaagaagcgcucuuggccgcugaacgaggccaucauggccgucggcaugguuagcauccuagcgagcucgcucuuaaagaacgacaucccuaugaccgggccucuggucgccgggggccuucugaccgugugcuacgugcucaccgggaggagcgcagaccuagaacuggagcgggccacggacgucaagugggaggaccaggcggagaucuccggcagcagcccuauucuguccaucaccaucagugaggacgggaguaugagcaucaaaaacgaggaggaggagcagaccuugaccauucugaucaggacgggccuauuagugaucuccggccuguucccgauuucuauccccaucacugccgcggcgugguaccugugggaggugaagaaacaacgggccgggguccugugggacguacccagcccuccgcccaugggcaaggcggagcuggaggauggagccuaccggauuaaacaaaagggcauccugggcuacagccaaaucggcgccggcguguacaaggaggggacguuccacaccauguggcacgucacgcggggagccgugcucaugcauaaggggaagagaaucgagccuuccugggccgacgugaagaaggacuugaucagcuacggagggggcuggaaacuugagggcgaauggaaagagggcgaggaaguccaggugcuggcucuagagccaggcaagaauccacgugcaguacagacaaagcccgggcuguucaagacgaacaccggcacuaucggggccgucucucucgacuucagcccgggcacauccggcagcccuauaaucgauaagaaagggaagguaguggggcucuacggcaauggcgucgucacuaggucgggcgccuacguaagcgcuauugcgcaaaccgagaaguccauagaggacaaccccgagauugaggacgacauuuuccggaagcgccgccuaaccaucauggaucugcaccccggcgcgggcaaaacgaagcgauaccuccccgcuaucguccgggaggcaaucaagcgugguuugcggacccugauucucgcgccgacccgcgucguggcggcagagauggaggaggccuuacggggacugcccauccgcuaccagaccccggccauccgagccgaacacacggggcgcgagaucguugaucucaugugccacgcgacguucacuaugcgccuccugucaccagucagggugccgaacuauaaccucaucaucauggacgaagcucacuuuacagaccccgccucaauagccgcgcgaggcuacaucagcacccgggucgagaugggggaggcugccgggaucuucaugaccgccacgccgcccggcagccgagaccccuuuccccagucgaaugcccccauucuggacgaggagagggagauccccgagcgcucauggaacuccggacacgagugggugaccgacuuugaaggcaagacggugugguucguaccgagcauaaaggcggggaacgauaucgccgcuugccuacggaaaaacggcaagaaggugauucagcuuucccgcaaaaccuucgauucugaauacgugaagacccgcaccaacgacugggacuucguaguaaccacagauaucuccgagaugggcgcgaacuucaaagcugagcgggugaucgauccucggcgcugcaugaagccugucauccuaaccgacggagaggagcgggugauccuggcaggccccaugccuguuacccauagcagugccgcccagaggcggggacggaucggccguaacccuaaaaaugagaacgaucaguacauuuacaugggggagccccucgagaacgaugaggacugcgcccauuggaaagaggcgaagaugcuguuggacaacauaaacacgcccgagggcaucauaccgagcauguucgagcccgagcgcgaaaagguggaugccaucgacggugaguaccggcuccgcggggaagcucgcaagacauuuguugaucugaugcggagaggcgaccuucccguguggcuugccuacaaaguggcagcggaagguaucaacuacgccgaucgucgcuggugcuucgacggcaucaagaauaaccagauccuggaggagaacgucgaaguugaaaucuggaccaaagagggagagcggaagaagcugaaaccgcguuggcucgaugcucguauauauuccgacccacuggcccugaaggaguucaaggaguucgccgcgggccguaagucgcucacgcuuaaccugaucacagagaugggacggcuccccaccuucaugacccagaagacacgcgacgcccuggacaaucuggccguacuccacacggccgaggccggagguagggccuacaaccacgcccuaagcgaguuacccgagacccucgaaacgcugcugcuccugacucuucuggccacgguuacugggggcaucuuccuguuucugaugaguggccgcggcaucgguaagaugacgcuggggauguguugcaucauaaccgccuccauccugcugugguaugcucagauccagccucacuggauagccgccagcauaauucucgaguucuuccugauaguccuucucauccccgagcccgagaaacagcgaacaccccaggacaaccagcugacguacguugucauugcgauccugaccgucguggccgcgaccauggccaacgagaugggcuuccucgagaaaaccaagaaggaccuggggcugggcagcgucgcaacccagcagccggaaagcaacauucucgauaucgacuugcggccugccuccgccuggacguuguacgcgguagcuaccacguucgugacucccaugcugcggcacagcaucgaaaacagcuccgucaacgucagccugacugccauugccaaccaggcuacaguacugaugggucuugggaaggguuggccucuuuccaaaauggacaucggggugccgcuguuagcgaucgggugcuacagccagguuaaccccaucacccuaacggccgcuuuauuauugcuaguggcccacuacgcuauuaucgggcccggccuccaggcuaaggccacgcgcgaagcccagaaacgggccgcggcuggcaucaugaagaaucccacgguggacggcaucacugucaucgaccuggaccccauuccuuacgacccaaaguuugaaaaacaacuaggacaggugaugcucuuaauucuaugcgugacucagguccucaugaugcgcacgacaugggcauuaugcgaggcacugacccucgccacgggccccauaucgacccugugggaggggaauccgggacgguucuggaacaccaccauagccguaaguauggcgaauauuuuucgcggcuccuauuuggccggcgcgggacuccuguucucuauuaugaaaaacacgaccaacacacggagaggcaccgggaacaugggcgagacgcugggcgaaaaguggaagucucgacucaacgcgcuggggaagucggaguuccaaaucuacaaaaagagcggcauacaagagguugaccggacguuggcgaaggaagggaucaagcgcggugagaccgaccaccacgcaguaagccggggguccgcaaagcuccggugguuuguugaacguaacauggugacccccgagggcaaggucguggaccucgguugcgggcgcggcggguggucauauuacugcggcgggcugaagaacgugcgggaggucaaggggcucacaaagggugggccgggccacgaggaaccgauuccaauguccacguacggguggaaccuggugaggcuucagagcgguguagacguguuuuucaucccgccagaaaaaugcgacacguugcugugcgacaucggggaaucaagccccaacccgaccguggaagccggccgcacgcugcgcgugcucaaccugguggagaacuggcuaaacaacaacacccaguuuugcaucaaagugcugaaccccuacaugccauccguuaucgagaagauggaggcguuacagcggaaguauggaggcgcccugguccgcaacccgcugagccggaacagcacgcacgagauguacuggguauccaaugcuagcggcaacaucguaucuagcgucaauaugaucagucgcaugcucauuaaccgguucaccaugcgccauaaaaaggcgaccuaugaaccagacgucgaccuagggucaggcacgcguaacauugggaucgaguccgagauccccaaccuggauauaauuggcaagcggauagagaagaucaagcaggaacacgagaccagcuggcacuacgaccaggaccaccccuauaagacaugggccuaucacggcuccuacgagaccaagcaaaccggaagcgcgucuucgauggugaauggagucgugcggcuucucaccaagccgugggacguacugcccaccgucacccagauggccaugacggacaccacccccuucgggcagcagcgcgucuucaaagagaagguugacacgagaacacaggagcccaaggaaggaaccaagaagcucaugaaaauuacugccgaauggcuguggaaggaguuaggcaagaagaagacgccucggaugugcacgcgcgaggaguucacccggaagguccgcucuaaugcugcucucggggcgaucuucaccgaugagaacaaguggaaauccgcucgcgaggcuguggaagauuccagguucugggaguuaguagacaaggagcggaaccugcacuuggagggcaaaugcgagacaugcguuuauaacaugauggggaagagagagaagaaguugggcgaguucggcaaagcuaaagguucucgggcgaucugguacauguggcugggcgcaagauuccucgaauuugaagcacugggguuccucaaugaggaucacugguucucccgggagaacagccuguccgguguggagggggagggacugcacaagcugggguauaucuuacgcgacgucagcaagaaggagggcggcgccauguaugccgaugacacugcagggugggauacccggaucacccuggaggaucuuaagaacgaggagauggugacaaaccacauggagggcgagcacaagaagcucgccgaggcgaucuucaagcuaacguaucaaaauaagguagugcgcguccagcgccccacgccccgagggacaguaauggacauuauaucgcgucgcgaccagcgggguuccgggcaggucggcacauacggccugaauacguucaccaacauggaggcccaacucauccgccaaauggagggggaagggguguucaagaacauccaacaccugaccgugacggaggaggucgccgugcagaacuggcuggcacggguugggcgcgagcggcuuagccggauggccaucuccggcgacgacugcgucgugaagccccuggaugaccgcuucgccaacgcccugacggccuugaacgacauggguaagauccgaaaagacauccaacagugggagccguccaagggcuggaaugacuggacacaggugcccuucugcucucaccauuuccacgagcucaucaugaaggacggccggguccugguagugcccugucggaaccaggaugagcucauugggcgcgcgagaauaagucagggagcaggguggagccugcgcgagaccgcuugccugggaaagagcuacgcccaaauguggucccucauguacuuccaccggagagacuuacgacuagccgcgaaugccauuuguuccgcaguuccgucccacuggguaccgaccagccgcaccacgugguccauacacgccaagcacgaguggaugaccacugaggauaugcucacaguguggaaucggguauggauccgcgagaacccauggauggaggacaagacacccguggagagcugggaggagaucccauacuuggguaagcgagaagaccaguggugcggaucacugaucggccucaccagcagagccaccugggccaagaauauccaggccgccaucaaccaggugcguagcuuaaucgguaacgaagaguacacugauuauaugccgagcaugaagcgcuuccgacgcgaggaagaggaagccggcguccuuugguaa

SEQ ID NO: 25373 - RNA, 9876 nt, Artificial Sequence
  derived and/or modified CDS sequence (opt11) from DENV-2__EU482657__SS-prME
agcgcgggcaugaucaucauguuaauucccaccgugauggccuuccaucugacaaccaggaauggugaaccccacaugauuguaggaauccaggaaaaggggaaguccuuacuguucaagacagaggacggcguuaacauguguacccuaauggcgauggaccugggggagcuuugugaagauaccauaaccuacaaauguccucuccuucggcagaacgaaccggaagacaucgacugcuggugcaacagcacaagcacgugggugacuuacgggacgugcaccacaaccggcgaacaccgccgggagaagcgcagcgucgcccuggugccccacguugggauggguuuagagacgcggacagagaccuggauguccagcgagggggccuggaagcacgcccaacgcaucgaaacauggaucaugcggcacccgggcuuuaccauaauggcugcgauccuggccuauaccaucggcacgacccacuuccagagaguccuaaucuucauccuguugacagccguggcacccaguaugaccaugagaugcaucgguaucaguaaccgcgacuucguggagggcgucuccggcggcagcuggguggacauaguguuggagcacgggagcugcgucaccacaauggcgaagaauaagcccacgcucgauuucgagcucauuaagacugaggccaagcagcccgccacucugcggaaguacugcaucgaggcgaagcucacgaacacgaccaccgagagccgcugcccaacccagggggagccuucacugaaggaagaacaggacaagcgguucgugugcaagcacagcaugguagaucgcggcugggguaacggcugcggguuguuuggcaagggugggauagucacuugugccauguucacuugcaagaagaacauggagggcaagaucguccagcccgagaaccucgaguauaccauuguugucacgccccacucgggcgaggaacacgcuguugguaacgacacgggaaagcacggcaaggagauaaaaguuaccccgcagagcuccaucaccgaggccgaacugacaggcuacggaaccgucacaauggaguguagcccccggaccggccuggacuucaacgaaauggugcuccugcagauggaaaauaaggccuggcucgugcaucgccaaugguuccucgaucucccccugcccuggcucccgggggccgacaagcaggaguccaacuggauccagaaggagacucuggucaccuucaagaacccccacgccaaaaagcaggacguugucgugcuuggcucgcaggagggggcgaugcacacagcccuaaccggcgcuacagaaauccagaugagcucgggcaaccuguuguucacaggacacuugaagugccggcugcgcauggacaaacugcagcucaaaggcaugucauauuccauguguacggggaaguucaagguggucaaggaaaucgcggagacccaacacggcacaauagucauccgggugcaguaugagggagauggcucccccuguaaaauucccuuugagauuauggaccuagagaaacgcuacguacugggcagguugaucaccgugaacccgaucgugacggagaaggauucuccugucaacaucgaagccgagccgcccuuuggagacaguuauaucaucaucggaguggaaccugggcagcugaagcuaaacugguucaagaaagggucaucgaucgggcagauguucgagaccacaaugaggggagcuaagcgcauggccauucucggggacaccgccugggacuucgggucccugggcggaguauuuacaagcaucggcaaggcccugcaucaggucuucggggccaucuauggcgcagccuucucgggugugagcuggaccaugaaaauauuaaucggggugaucaucaccuggauaggcaugaauucccggagcaccucccugucaguuagucuggugcuggugggcaucgucacgcuguaccugggcgugaugguucaggccgacucggggugcguuguuuccuggaagaacaaggaacugaagugcggcuccggaaucuucaucaccgacaacgugcauaccuggaccgagcaguacaaguuucagccagaaagcccuuccaagcucgccagcgcgauucagaaagcccaggaagaagggauaugcggaauccguuccgugacgcgacuugagaauuugauguggaagcagaucacgccggaacucaaccauauccuggcggaaaacgaggugaagcugacgaucaugaccggggacauccgcggaauuaugcaggccgguaaacggucucuccgcccucagcccacggaauuaaaguacucguggaagaccuggggcaaggccaagaugcugucuacugaauccuauaaccagaccuuccucaucgacggccccgagacggcugagugcccgaacaccaaccgggccuggaauagccuggagguggaggacuacggcuucggggucuuuaccaccaacauauggcugaagcuaaaggaaaaacaggacgcuuucugugacuccaagcugaugucggcugccaucaaggacaaucgcgcgguucacgccgacaugggauauuggauggaauccgcacucaaugacacguggaagaucgagaaggcaagcuucauagaggugaaaaauugucacuggccuaagucccacaccuuguggucgaacggcguccuggaguccgagaugaucauccccaagaacuuggccggccccgugagccagcacaauuaccggccgggguaccacacccagaucgccggccccuggcaucucggaaaguuagagauggacuuugacuucugcgacgguaccacuguuaucgucacggaggacugugggaaccggggccccagccuccggaccaccaccgccagcggcaagcucauuacggagugguguugccgcagcugcacccugccgccgcugcgguaccgcggugaggacggcugcugguacggaauggagauccggccccuaaaggagaaggaagagaaccugguuaacucccugguaaccgcaggacacgggcaggucgacaacuucagucuaggcgugcugggcauggcccucuuccucgaggagaugcuccgcacccgggucgggacaaagcacgcgauccugcucgucgccguguccuucgugacucugauuacgggcaauaugagcuuuaaggaccuugggcgcguaguugugauggugggugccaccauggccgacgacauagggaugggggugacguaccucgcccugcuggccgccuucaaggugcguccgacuuucgccgcgggccuucugcuccgcaaacucacuaguaaggagcugaugaugaccacaauagguaucguccugcucucacaguccacgauccccgagaccgugcuggagcugacugaugcccucgcucugggcaugaugguucugaagauuguccgcaacauggagaaauaccagcucgcugugacgaucauggcuauccugugcgucccgaacgcugugauccuccagaacgccuggaaggugagcuguaccauucuugcggucguguccguaucaccccuguuacuaacguccagccagcagaaaacugacuggauuccccuggcccugaccauaaaagggcucaaucccacagccauauuccugacaacccucucccggacgaacaagaagcgcagcuggccguuaaacgaggcgauuauggcugucggcaugguguccauacuggccucuucccuccugaagaaugacauccccaugacaggcccgcugguggccgggggacugcuaacagucugcuacgugcugaccgggcggagcgccgaccuggagcuggagagggccacggacguaaagugggaggaucaggcggagaucuccggcagcagcccuauccugucaauuaccaucagcgaggacggguccauguccauuaagaacgaggaagaagagcaaacacucaccauacucauccgaacuggcuuacuagucaucuccggccuguucccgauaagcauccccauaaccgcagccgccugguacuuaugggagguaaagaagcagcgcgccggggugcugugggauguccccucaccgccgcccaugggcaaggccgagcucgaggacggggccuaccggaucaagcagaagggcauccugggguacagccaaaucggugccgguguguacaaggaggggaccuuccacacaauguggcacgugacaagaggcgccguccuuaugcacaaggggaagaggaucgagcccaguugggccgauguaaagaaggaucucaucagcuacggggggggcuggaagcuggagggcgaguggaaggagggugaggaaguucagguacuggcacucgagccuggcaagaauccucgcgccgugcagacaaaacccggacuuuucaagacgaauaccggaaccauaggggccgugucccuugauuucucacccggcacgaguggcagccccaucauugacaagaaggggaaggucgugggccucuauggcaacggaguggucacccgauccggcgcauacgucagcgccaucgcgcagacggaaaaguccaucgaggauaaucccgagaucgaggaugauauuuuccgcaagcggcgcuuaaccaucauggacuuacaccccggugccggcaaaacuaagcgauaccugccagcaaucgugcgcgaggccaucaagagagggcuaagaacccugaucuuagcuccgacccgagugguagccgccgagauggaggaggcgcuucggggccugcccauccgguaccagaccccugccauccgggcggaacacacgggucgcgagauaguggaucugaugugucacgccacuuucacgaugaggcuccugagccccgucaggguaccaaacuauaaucugaucauaauggaugaagcccacuucaccgaccccgccuccaucgcagcacgagguuacauuucaacgcgcguggagaugggcgaggcugcgggcaucuucaugacagccacgccgccgggaagcagagacccuuucccccaguccaacgcacccaucaucgacgaggagcgcgagaucccagagcggaguuggaacucuggccacgagugggucacugacuucaaggggaagacagugugguucgugccgagcauaaaggcgggaaacgacaucgcugcaugucuccgcaagaacggcaagaagguaauccaacugucccggaagaccuucgacagcgaguacgugaagacacgcaccaacgauugggauuucguugucacgacggauaucuccgagaugggcgccaacuuuaaggcggagagggugaucgacccccgccguuguaugaagcccgugauccugaccgacggggaggaacgcguuauccuugccggcccaaugccggugacccacuccucggccgcgcagcgccgcgggcggaucggcaggaaccccaaaaacgaaaacgaccaguauaucuacaugggggagccccuugagaaugacgaggacugugcccacuggaaggaagcuaagaugcuguuagacaacaucaacacaccugagggcaucaucccgucgauguucgagcccgagcgggagaaaguggacgccaucgacggggaauaccgccugcgcggcgaggcccguaagaccuuugucgaccuaaugcgucgaggggaucuccccguguggcucgccuacaaaguggcugcggagggaauuaacuacgccgaccgccgguggugcuucgacggcauaaagaauaaccaaauccuagaggagaacgucgagguggagaucuggaccaaggagggggaacggaaaaaacuaaagccgcgguggcuggaugcccggaucuacagcgacccgcuggcauugaaagaauucaaggaguucgcagcgggccguaagucuuugacccugaaccucaucacggagaugggccgucugcccaccuucaugacacagaaaacccgggacgcccuagauaaccucgccguuuuacacacggccgaagcuggcgggcgcgccuacaaccaugcccuguccgaguugcccgagacccucgagacccugcucuuacuuacccuccuggccacggugaccgggggcaucuuccuuuucuuaaugagcgggcgggggauuggcaaaaugacccuggggaugugcugcaucaucaccgccuccaccuugcugugguacgcgcagauccagccgcacuggaucgccgccucaauaauccuggaguuuuuccugaucguucuccugaucccggagccugagaagcagagaacgccgcaggacaaccaacuuacguaugucgugaucgccauccucacugugguggccgcgacuauggcuaaugagaugggguuccuggagaagacgaagaaagaccugggguuaggcagcaucgccacccagcagccggaaagcaacauccuggacaucgaccugcggccggccuccgccuggacgcucuacgcgguggcgaccacguuuguaacccccaugcugcgacacagcauagagaauagcuccgugaaugugagccugacugccaucgccaaccaggccaccgugcucaugggacuggggaaggguuggccccucuccaaaauggauaucggggucccauugcuggcgauaggcuguuacagccaggugaauccaaucacgcugaccgcggcacuccugcugcugguagcacacuacgcgaucauuggacccggccugcaggcaaaagccacccgggaggcccagaaacgcgccgcggccggcaucaugaaaaaccccaccguagacgggauuacggugaucgacuuggaccccaucccuuacgacccgaaguucgaaaaacaacugggccaggugaugcuacugauccucugcgucacccagguacugaugaugaggaccaccugggcccugugugaggccuuaacgcuggccacugggcccaucuccaccuugugggagggcaacccggggcgcuucuggaacacaacuaucgcggugagcauggcuaacauuuuccgggguucuuaccuugccggcgccggucugcuguucucaaucaugaaaaacacaaccaacacccgccgcggcacggguaacaucggcgagacccucggcgaaaaauggaagucccgucugaacgcccuggguaagagcgaguuucaaaucuacaagaaguccggaauccaagaggucgaccgcaccuuggccaaggaggggauaaagcggggcgagaccgaucaccacgccgugucccgcggguccgcuaaguugcgcugguucguggagcgcaacauggucacuccugaggguaagguuguggauuugggcugugggcggggcggguggucguacuacugcggcgggcuuaagaaugugcgcgaggucaagggacugacuaagggaggccccgggcaugaggagcccauuccgauguccaccuacggguggaaccuggugcggcuccaaagcggcguggacguauucuucaucccgccggaaaaaugcgacacccugcugugugacaucggggagaguagcccuaacccaacgguggaggccggccgcacccuccggguccugaaccugguggagaacugguuaaacaacaacacacaauucugcauaaagguauugaaccccuacaugccguccgucauagagaaaauggaggcguugcagcgcaaguacggcggagcccuagugcggaacccgcuaagccgcaacagcacacacgagauguauuggguaucuaacgcaagcggcaacaucgucucuagcguaaacaugauuucccggaugcugaucaaccgcuucaccaugagacacaaaaaggcuacguacgagcccgacguggauuuagguagcggcacucgaaacaucgggaucgaauccgagauccccaaucucgauaucaucgguaagcgaaucgagaagaucaagcaggagcaugaggccucuuggcacuacgaccaggaucacccauacaagaccugggcguaccacggcucauacgagaccaaacagacggggagcgccuccagcauggucaacggaguggugagacugcugaccaagccgugggacguccucccaaccgugacucagauggcuaugacggacacgacccccuucggucagcagcgcguguucaaggagaaagucgacaccagaacccaggagcccaaggaaggcaccaaaaagcugaugaagaucaccgccgaguggcucuggaaggagcucggcaagaagaagaccccgcgcauguguacgcgugaggaguucacucgcaaggugcggucuaacgccgcgcugggggcgaucuucacggacgagaacaaguggaaguccgcacgcgaggcgguggaggacuccagauucugggaacuagucgacaaggaacgcaacuugcaccuggagggcaaaugcgagaccugcguauacaauaugaugggcaaacgggaaaagaagcugggggaguuugggaaggccaagggaucacgcgcgaucugguacauguggcucggcgcccguuuccuggaguucgaggcccugggguuccucaacgaggaccacugguucagccgcgagaacucuuuguccggcgucgagggggagggacugcacaaacucggguacauccugcgcgacgugagcaagaaagagggcggcgcuauguacgcggacgacacggcugggugggacacccgcaucacccuggaggaccucaaaaacgaggagauggugaccaaccauauggagggagaacacaaaaaacuggccgaggccaucuucaaacuuacguaucagaacaaagucgugcgggugcagaggcccacgccccgggggaccguuauggacaucaucagucgacgggaccaacgcggcuccggccaggugggaaccuacggccucaacacguucaccaacauggaagcucagcugauucgucaaauggagggggagggcguguucaagaacauccagcaccuaacggucaccgaggagguagcggugcauaacuggcucgccagagucggaagagagaggcugagccgcauggcaaucuccggcgacgacugcguggugaaaccccuagaugaccgguucgccaacgcacucacggccuuaaacgacaugggaaagauccgcaaggauauccagcagugggagccgagcaaaggguggaacgacuggacccaaguacccuucugcucccaccacuuccacgaacugaucaugaaggacgggcggguguugguuguucccugccgcaaucaggaugaacugauagggcgcgcccgcauaagccaaggcgcaggaugguccuugcgggaaaccgccugucucggcaagagcuacgcccaaaugugguccuuaauguacuuucaccgccgggaccugcgcuuagcggccaacgccaucugcuccgccgugccgucccacuggguaccgacuucccggacgacaugguccauacaugccaaacacgaauggaugaccaccgaggacaugcugacggucuggaacagaguguggauaagagagaaucccuggauggaggauaagacgccaguggagagcugggaagagaucccguaccugggcaagcgcgaggaccaguggugcgggucucucaucggccucaccucacgggcgaccugggcgaagaauauccaggccgccauaaaccagguccgcucccugaucggcaacgaggaguacaccgacuacaugccgagcaugaaacgguucaggcgcgaggaggaggaggcgggcguguugugguag

SEQ ID NO: 25374 - RNA, 9876 nt, Artificial Sequence
  derived and/or modified CDS sequence (opt11) from DENV-2__EU482658__SS-prME
agcgcggggaugaucaucaugcugauccccacugugauggccuuccaccucaccacccgcaacggggaaccccacaugauuguaggcauccaggaaaaggguaagagcuuacuguucaaaaccgaggauggagugaacauguguacccucauggcgauggaccugggggaacucugcgaggacaccaucacauacaaaugcccauuacugcggcaaaacgagcccgaggacaucgacuguuggugcaacucaaccuccacgugggucacauacgggacuugcacgaccacgggggagcaucgccgcgagaaacggagcgucgcccuggugccccacguagggaugggucuagagaccaggaccgagaccuggauguccagcgagggggccuggaagcacgcccagagaauagagaccuggauccugcggcacccgggauucacgaucauggccgcgauucucgcguacaccauugggaccacccacuuccagcgcguucucauauucauccugcugacggcuguggccccauccaugaccaugcggugcaucggcauuagcaaucgcgacuucguggaaggcgucuccggcggcucguggguggauauugugcuggagcacggguccugcgucaccacaauggccaagaacaagcccacucuggacuucgagcuuaucaaaaccgaggcaaagcagcccgccacccuccgcaaauacugcauugaagcgaagcugaccaacacgaccaccgagagccgcugcccgacccaaggcgagccuagccucaaggaggagcaagauaagcgguucguguguaagcacagcaugguggaucgcggcugggggaacggcugcggccuguuuggcaagggagggaucgugacgugcgccauguuuacgugcaagaagaacauggagggcaagaucguucagcccgagaaccuggaguacacuaucguggugacaccccacuccggggaggagcacgccguaggcaacgacacugggaaacacggcaaggagaucaaggugacgccgcaaagcuccaucaccgaagccgagcugaccggguacggcaccgucacgauggagugcagcccccggaccggccucgauuucaaugagauggugcugcugcagauggagaacaaggccuggcucgugcaucgccagugguuccuggaccucccccucccuuggcugccgggugcggacaagcaggaguccaacuggauccagaaggagacccucguuaccuuuaaaaauccccacgccaagaagcaggaugugaucgugcuuggcagccaggagggggcgaugcacacggcccuaaccggugccaccgagauacaaaugagcuccggcaaucuccuguucaccggccaccugaagugucgacuucgcauggacaagcuccagcuaaaagguaugucuuauuccaugugcacggggaaguucaaaguagugaaggaaauugcugagacccagcacggcaccaucgucauucggguccaguacgagggggacggcagcccgugcaaaaucccguucgagaucauggaccuagagaaacgcuaugugcucggccggcugaucaccgucaacccgaucgugacggagaaagauagcccagucaacaucgaggcagagccucccuucggggacucauacauuauaauuggggucgaaccggggcagcugaaguugaauugguucaagaaaggaaguagcaucggacagauguuugagacgacaaugagaggcgcaaaacgcauggccauccugggcgacaccgccugggacuucgggagucugggcgggguguuuacuagcauuggaaaggcccuccaucagguguucggggccaucuacggcgccgccuucuccggugucagcuggaccaugaagauacugaucggggucaucaucacauggaucggaaugaacucccggagcaccucccugagugugucccugguauuaguugggaucguaacgcuguaccugggcgucauggugcaggcggacucggggugcguggucuccuggaaaaacaaggaacucaagugcgggagcggcaucuucaucacggacaacgugcacacauggaccgagcaauacaaguuccaaccggagagccccuccaaacuugcuagcgcgauccaaaaggcgcaggaggaggggaucugcggcauacgguccgugacgcggcuggagaaccucauguggaagcagaucacucccgaacugaaccacauucuggccgagaacgaggucaaacuuaccaucaugaccggggacaucaagggcauuaugcaggcagggaagcgcagcuugcggccgcagcccaccgagcugaaguacaguuggaagaccuggggaaaggccaagaugcucucuaccgaguccuacaaccagacauuucugaucgacggccccgagacuaccgagugccccaacaccaaccgcgcguggaacagccuggaaguugaggacuacggguucggaguguucaccacgaacauauggcuuaagcuaaaggagaagcaggacgccuuuugugacucaaaacuaaugucugccgccauuaaggacaaccgggcaguccacgcggauaugggcuacuggauugaguccgccuuaaacgacacauggaagauagaaaaggccagcuuuauagaagugaagaacugccacuggcccaagucacacacccuguggaguaacgggguauuagagucugagaugauaauacccaagaaccucgccgggccgguaucccaacacaacuaccgcccgggguaccacacucaaaucgccggacccuggcaccugggcaagcuggagauggacuucgacuucugcgauggaaccacgguuaucguaacggaggacugcggaaacagaggccccucccuuaggaccaccacugcgaguggcaagcugaucaccgaauggugcugccggagcugcacccugcccccgcuccgcuaucgaggagaggacgguuguugguacgggauggagauccgcccacugaaagagaaagaggagaaccuggucaacagucucguuaccgccgggcauggccaaguggauaauuuuucucugggcguccuggggauggcccucuuccuggaggaaaugcugaggacuagaguggggaccaaacacgcuauauuguuagugacugucuccuuugugacccugaucacgggcaacaugucuuuuaaagaccucggacggguagucguaauggugggcgcgacuauggccgaugauaucgggaugggcgucaccuaucuggcccuccuggccgcuuucaagguccgccccaccuuugcggccggccuccuguuacguaaauugacguccaaagaacucaugaugacuacgaucgggauagugcuccugagccagaguacgauucccgagaccguccuggagcucaccgacgcccucgcccuuggaaugauggugcucaagauagugcgcaacauggagaaguaucaauuggccgucaccaucauggccauccugugcgugccgaacgcggucauccugcaaaacgccuggaagguuagcugcaccauccuggcgguggucagcgugagcccccugcuccugacguccagccagcagaaaacugauuggaucccccuggcccugaccaucaaggguuuaaacccgaccgcuauauuccuaacuacccuaucccgcaccaauaagaagcggaguuggccgcugaacgaagccaucauggccguaggcauggucuccauccuagccucuucccugcugaagaacgacaucccaaugacggggccccugguggcuggcgggcuccugacggugugcuacguguuaaccgggcgcucugccgaucuggagcuggagcgugccaccgacgugaaaugggaagaccaggccgagaucuccgggagcagccccauccugagcaucacgauuagcgaggacggguccaugagcaucaagaacgaagaagaggagcagacguuaaccauacugauacgcacaggcuuacucgugauaucaggccuguucccgaucucuauucccaucaccgccgcugccugguaccugugggaggugaagaagcagcgcgcgggggugcucugggacguucccagcccgccgcccaugggcaaagcugagcuggaggacggugccuaccgcaucaagcagaaaggcauccugggguauucacaaaucggggcgggcguauauaaggaggggaccuuccacacgauguggcaugugaccaggggcgcuguccugaugcacaaggggaagcggauagaacccagcugggccgacguuaagaaggaccugaucagcuacggcgguggguggaagcuggagggcgaguggaaggaaggugaagagguccaggugcucgcccuggagcccggcaagaacccgcgagcgguccagaccaagcccggccuguucaagacuaauacggggaccaucggggcugugucccucgauuucucgcccgggacuagcgguagcccuaucaucgacaaaaaggggaaaguggucggccuguaugggaacggcguggugaccagaagcggagccuacgucucagccaucgcccagacggaaaaguccauugaagacaacccggaaaucgaggacgacaucuucagaaagcgccggcucaccaucauggaccugcaccccggggcuggaaagaccaagcgcuauuuacccgcaaucgugcgggaagcgaucaaacgcgggcugcgcacgcugauccuggccccuacgcgaguagucgccgcggagauggaggaggcccugcggggcuuaccgaucagauaccaaacacccgcgauccgggccgagcauacggggcgcgagaucguggaccucaugugucaugccacuuuuaccaugcguuuacugagcccagugagagucccaaacuauaaccucaucauaauggacgaggcccacuucaccgacccagccagcaucgcggcccgcggguacauaagcacccggguggaaaugggcgaggcagcagggauuuucaugaccgccacgccacccggcucgcgcgacccuuucccccaguccaacgcacccaucaucgacgaggagcgggagauccccgaaagaagcuggaacuccggucaugagugggugaccgacuucaagggcaagaccgugugguucguuccuucuaucaaggccgggaaugacauagccgcgugucugcggaagaaugggaagaaggugauccagcugucgcggaagacuuucgacagugaauacgucaagacccgaacgaaugacugggacuucguggugaccacggacaucucugagaugggggcuaacuucaaggcugagcgaguaauagacccccggcgcuguaugaagccagucauccucaccgacggggaggagcgcguuauccuggccggcccaaugcccgucacccacuccagugcugcccagcgucgggggcgcaucggcaggaaucccaagaacgagaacgaccaguacaucuacaugggagagccccuggagaacgacgaggacugugcccacuggaaggaggccaagaugcuccuggacaacauaaacacaccagagggaauuaucccaagcauguucgagccagagagagagaaggucgacgcgaucgacggcgaguaccggcugcgcggggaggcacguaagaccuucguggaccucaugcgccgcggcgaccugccggucuggcuugccuauaagguggcagccgagggcaucaacuacgccgaccggcgcuggugcuucgauggcaucaagaacaaccagauccuagaggagaacgucgaggucgagaucuggacgaaggagggggagcggaagaaacuuaaaccgcgcuggcuggacgcgagaauuuauucugacccccuggcccugaaggaguucaaggaguucgccgccggcaggaagucacugacccucaaccugaucaccgaaaugggccggcugcccacuuuuaugacgcagaagacccgcgacgcucucgacaaccucgcggugcugcacacugccgaagccgggggacgggccuacaaccaugcgcucagcgagcuuccagaaaccuuagaaacgcuacugcugcucacucuguuagccacggucaccgguggcauuuuccucuuucugaugucgggccgcgguaucggcaaaaugacgcucggaaugugcuguauaaucacggccuccauccucuugugguacgcgcaaauccagccacacuggaucgccgcaucaaucauccuugaguucuuccucaucgugcugcugauacccgagcccgagaagcagcggacgccccaggacaaccagcuaacguaugugguuaucgccauccugaccgucguggcagcaacgauggccaacgaaaugggcuuccuggaaaagaccaagaaggaccucgggcugggcaguaucgcgacccaacagccggaaucgaacauccuugacauagaccuccgcccagccucagccuggaccuuguacgccguggcgacuaccuuuguaacccccaugcuacggcacucuaucgagaauagcucugugaacgucucucuaacggcgauagccaaccaggcuacugugcugaugggccuggggaagggcuggccccugucgaagauggacaucggggucccguuacuggccaucggcugcuauagccaggucaacccgaucacccucaccgccgcacuccugcuccugguggcgcacuacgccauaaucgggcccggguuacaagccaaagcuacacgcgaggcccagaaacgggccgccgcgggcaucaugaaaaaccccacggucgacggaauuaccgucauugaccucgauccgauucccuacgaucccaaguucgagaagcaguuaggccaagugaugcugcuaauacugugugucacccagguauugaugaugcgcaccacuugggcacucugcgaagcccugacacuagcgaccgggccuaucuccacgcucugggagggcaauccaggucgauucuggaacacgacuauagccgugucuauggccaacaucuuccgcggcucuuaccuggcgggggcagggcuccucuucagcaucaugaagaauacgaccaacacacgacgcgguacagguaacaucggagagaccuugggcgagaaguggaagagucgcuugaacgcucuaggaaaguccgaguuccagauuuauaaaaagucgggcauucaggagguggaucggacccucgcgaaggaaggcaucaagcgcggcgaaacggaccaccacgccgugagucggggguccgcgaaauugcgcugguucguggagaggaacauggugacccccgaaggcaaggucguggaucucggcugcgggcgcggggguuggaguuacuacuguggcgggcugaagaacgugagagaggucaagggccugaccaaaggcgggcccggccacgaggaaccuauaccgauguccaccuauggauggaacuugguccguuuacagagcggcguggacgucuucuucauuccgccagagaaaugcgacacacugcuuugcgacaucggggagucgagccccaauccgaccgucgaggccggucguacccuucgcguguuaaaccucguagagaacuggcucaacaacaacacccaguucugcaucaaggugcugaauccguacaugcccuccgucaucgagaaaauggaggcguugcaacggaaauacggcggggcccucgugcgcaauccgcugagccggaacagcacccacgagauguacuggguguccaaugcgagcgguaacaucgucagcuccgucaauaugaucuccagaaugcugaucaaccgguucacgaugcgccacaagaaagccacguacgagcccgacguggacuuagguucuggcacccggaacaucgguauugaguccgagaucccuaaccuggacaucaucgggaagcgaaucgagaaaaucaagcaagagcaugagaccucguggcauuaugaccaggaccaucccuacaagaccugggccuaccacggcucguacgaaaccaagcagaccggcagcgccuccagcauggugaacggcguagugcggcuacucaccaagccgugggacguccugcccaccgucacucagauggccaugacugauaccacaccguucggacagcagcgcguuuucaaggaaaagguugacacccgcacccaggagccuaaggaggguaccaagaagcugaugaaaaucacggcugaguggcuuuggaaggagcugggaaagaagaaaaccccgcggaugugcacacgggaagaguucaccagaaagguccgguccaacgcagcccugggugccaucuucacagacgagaacaaguggaaauccgcacgggaggcgguggaggauucccgcuucugggaacucguggacaaggaacgaaaccugcaccuggaaggcaagugcgagaccuguguguacaacaugauggggaagcgcgagaagaaauuaggcgaguucgggaaggcuaagggcagucgggcuaucugguacauguggcugggcgcucgcuuucucgaguuugaagccuugggguucuugaacgaggaccauugguucucccgugagaauagccuauccggcguggagggcgagggacuccacaaguuaggguacauccugcgcgacgucucaaagaaggagggcggcgcuauguacgccgaugacaccgccggcugggacacgcggaucacguuagaggacuuaaagaacgaggaaaugguaaccaaccacauggagggagagcacaagaagcuggccgaggcgauauucaaauuaaccuaucaaaacaaaguaguccgcgugcagcggcccacgccccgggggacggugauggacauaauuagccgucgcgaccagcggggguccgggcaggucggcacguacggucugaauacauucacuaacauggaggcacagcugauucgccagauggagggggagggcguguucaagaacauccaacacuugacggugaccgaggaggucgcagugcaaaacuggcuggcccgcgucgggagggagaggcugagccggauggccaucuccggcgacgacugcguagugaagccgcuagaugaccgcuucgcuaacgcccucaccgcccugaacgacaugggcaagauacggaaggacauccagcagugggaaccgagcaagggguggaacgacuggacccaggugcccuucugcagccaccacuuccacgagcugaucaugaaggacgggcguguccucguggugcccuguaggaaccaagacgaacugauaggacgcgcccgcaucucacagggcgccggguggucccucagggaaaccgcgugccugggcaaauccuacgcccagauguggucgcugauguacuuccaccggagggaccuccggcuggcugccaacgcaaucugcagugcuguccccucccacugggugccgaccagccggacgaccuggaguauccacgccaagcacgaauggaugacaacggaggacaugcugaccguguggaaccgggucuggauacgcgacaacccauggauggaggacaagacccccguugaaagcugggaggagauaccauaccucggcaaacgggaggaccaguggugcgggucccugauuggccuaaccagccgcgccacgugggccaagaauauccaggccgcgaucaaccaggugcgauccuuaauagggaacgaggaguauaccgauuacaugccgaguaugaaacgcuuccggcgcgaggaggaggaggccgguguccugugguga

SEQ ID NO: 25375 - RNA, 9876 nt, Artificial Sequence
  derived and/or modified CDS sequence (opt11) from DENV-2__EU482659__SS-prME
ucggccgggaugauaaucaugcugauaccaaccgugauggccuuucaccucacgacccgcaacggggagccccacaugaucguuggcauccaggagaagggcaagucccucuuguuuaagaccgaggacggugugaacaugugcacccucauggcgauggaccuaggggagcugugcgaggacacuaucaccuacaagugcccccuuuuacggcagaacgagcccgaggauauagacugcuggugcaacucuacaaguaccugggugaccuaugggaccuguacuaccaccggcgagcaccgucgagagaagcgcagcgucgcccuaguuccccacguggggaugggccucgagacccggacagagaccuggaugagcucagagggggccuggaaacacgcccagcgcauugagacuuggauucugcgacacccgggcuucacuauuauggccgcgauccuggcguauaccaucgggaccacacacuuccaacgcguucucauuuucauccuguugacggccguggcccccuccaugaccaugcgguguauaggcaucagcaacagagauuucguggaaggcgucuccgggggcagcuggguggacaucgugcucgagcacgggagcugcgucaccacuauggcgaagaacaagccuacgcuggacuucgaauugaucaagaccgaagccaagcagcccgccacacuacggaaguacugcaucgaggcgaagcugaccaacacgaccacagagagucgcugcccgacacagggcgagcccucgcugaaggaggagcaggacaaaagauucgugugcaagcacagcaugguggaccgcggcugggggaacggcugcggccuguucggcaagggcggcaucgucacgugugccauguucacaugcaagaagaacauggaggguaagaucgugcagcccgagaaccuggaguacacaaucgucguaaccccccacuccggugaggagcacgcgguuggcaacgacacggggaagcauggcaaggagauuaaggugacgccgcagagcuccaucaccgaggccgagcugaccggguacgggaccguaacgauggagugcagcccacggaccggccucgauuucaacgagaugguccugcugcagauggagaacaaggccugguuggugcacaggcagugguuucuggaccugccacucccuuggcugccgggggccgacaagcaggaguccaacuggauucagaaggagacuuugguuaccuucaagaacccccacgccaaaaagcaggacguaguugucuuggggagccaagagggcgcaaugcauacggcucugacaggagccaccgaaauacagaugagcucagggaaccucuuguucaccggccaccucaagugccggcugcgaauggacaaacuccagcucaaggggaugaguuacuccaugugcacggggaaguucaagguagucaaggaaauugccgagacgcaacacggcacgaucgugaucagggugcaguacgagggggacgguagccccugcaaaauccccuucgagaucauggaccuagagaaacgcuauguccucggccggcugaucaccgugaacccgaucgugacggaaaaggacuccccgguuaauauagaagccgaaccccccuucggagauagcuacauuaucaucggcguggagccgggccagcugaagcucaacugguucaagaaaggcucuucgaucggacagauguucgagaccaccaugcgcggggcgaaacguauggcgauucugggcgacaccgccugggacuuuggaucccugggcgggguguucacgagcaucgggaaggcacuccaccagguuuucggagcaauuuauggcgcggcguucuccggagugagcuggacaaugaagauccugauugggguaaucaucaccuggaucggcaugaacucgcggagcacuagccugaguguuucccuggugcucguggggauagucacgcucuaccuggggguaaugguccaggcagacagcggcugugucgugucauggaaaaacaaggagcucaagugcggcucugguauauucauaaccgacaaugugcacaccuggacugaacaauacaaguuccagcccgagagcccaucgaagcucgcaagcgcgauacaaaaggcccaggaggaaggcaucugcgggauccgcuccgucacgagacuggagaaucucauguggaaacagaucacucccgaauugaaccauaucuuggccgagaacgagguuaagcuuacgaucaugacgggagacaucaagggcaucaugcaggccgguaagcgcucgcugcggccgcagcccacggagcugaaguacagcuggaagacauggggcaaggccaagaugcucagcacugaguccuacaaccagaccuuucucaucgacggucccgagacgacugaaugcccuaauacuaaucgcgcguggaauagccuggagguggaagauuacggauucggcguguucaccacgaacaucuggcucaaacugaaagagaagcaggacgccuucugugacuccaagcugaugagcgccgccaucaaggacaaccgggccgugcacgcggacaugggguacuggaucgagagcgcccucaacgacaccuggaagauagagaaggcuagcuucaucgaggugaagaacugucacuggcccaagucccacacccuuuggagcaacggcguccuggaauccgaaaugaucauccccaagaaccucgccggcccagugagccagcacaacuaccgaccgggguaccauacccagaucgccgguccguggcaccuugggaaacuggaaauggacuucgacuucugcgacggaaccacggugaucgucacugaagacugcgggaaccggggccccucccucaggacuacgacugcgagcggcaagcucaucaccgaguggugcugccgcuccugcacccugcccccgcuccgcuaucgcggggaggacggcugcugguaugguauggaaauccgcccacucaaagagaaagaggagaaccuggugaauucccucguaaccgccggccacgggcaagucgacaacuucagccugggagugcuggguauggcccucuuccuggaggagaugcugcguacgcgaguggggaccaagcacgccauucuccugguagcugugagcuucguaacgcuuauuaccggcaauaugagcuucaaggaucuggggcggguaguggugauggugggcgccacgauggcggacgacaucgggaugggcgugacauaccuggcccugcucgcggcguuuaaagugcgacccaccuucgccgccggcuugcuguugcggaagcugacauccaaggagcugaugaugacgacuauugggaucguccuucuuagccaguccaccauccccgagaccguguuggaguugacugacgcccuggccuuaggcaugauggugcucaagaucgugcgcaacauggagaaguaucagcuagccgugaccauaauggccauccugugcgucccgaacgccgugauccugcagaaugcguggaaggugagcugcaccauccuugcagugguguccgugucgccguugcuccugaccucgagccagcagaagacggauuggauuccacuggcguuaacuaucaaggggcucaaccccacugcuaucuuccugacuacccucagccgcaccaauaagaagcggagcuggccguuaaacgaggccaucauggccgucgggaugguguccauccucgcgaguucgcugcugaaaaacgauauucccaugaccggaccuuugguggccgggggccugcugaccgucuguuacguucugaccgggcgcagcgccgaccuagaacuugagcgagccacggacguuaaaugggaggaccaggccgagaucuccggcucgagcccuauucugucgaucaccaucagcgaagacggguccaugucaauaaagaacgaggaggaggagcagacgcucacgauccucauccgcaccggcuuguuggucaucuccggccuguucccgaucagcauacccauaacagcagcugccugguacuugugggagguaaagaagcagcgggccgguguguugugggacguucccaguccgccgcccaugggcaaagccgaacucgaggacggagcauaucgcauuaagcagaagggcaucuuaggguauucucagaucggcgcuggcguauacaaggaggggaccuuucacaccauguggcacguaacgaggggcgccguucucaugcacaaggggaagcgcaucgaaccuuccugggcagacguaaagaaggaccugauuuccuacggcgguggcuggaaacuggagggcgaauggaaggaaggggaggagguccagguuuuggccuuagagcccggcaagaacccccgggcggugcagaccaagccggggcuguucaagaccaauacgggcacuaucggggccgucucccucgacuucagccccggcacgucagguagucccaucauagacaaaaagggcaagguagugggucucuacgggaauggcgucgucacccgcuccggcgccuacgugagcgccaucgcccagaccgagaagagcaucgaagacaaccccgaaauagaggacgacaucuuucgcaaacgccgacugaccaucauggaccugcacccgggggcgggcaagaccaaacgcuaucuccccgccaucgugcgggaagccauuaaacgcggccugcggacccuaauccucgcuccaacgcgcguuguggccgccgaaauggaggaagcguuacggggccugcccauccgcuaccagacccccgccauccgggcugagcauaccgggcgugaaauugucgaucucaugugucacgcgaccuuuaccaugcgccuguugagcccuguccgggugcccaauuacaaccucaucaucauggacgaagcgcacuucacggaucccgccuccaucgccgcccgcggguauaucucaacccgcguggagaugggagaggcggccgggaucuucaugaccgccacgccgcccggcagcagagauccguucccccaauccaacgccccgaucaucgacgaggagagagagauccccgagcgcagcuggaacacggggcacgagugggucaccgacuuuaaagggaagaccgugugguuugugccgucgauaaaggccgguaacgacauagccgccuguuugcgcaagaacggcaagaaggucauccagcugucacgcaagaccuucgauuccgaguacguuaagacgcggacuaacgauugggacuucguggucaccaccgacauaagcgaaaugggcgccaacuuuaaagcugagcgagugaucgacccccgccgcugcaugaagcccgugauccucacugauggugaggagagagugauccuggcgggccccaugccgguaacccacuccagcgccgcgcaaaggcggggcaggaucggucggaaucccaagaacgaaaacgaccaguacaucuacaugggugagccccuagagaacgaugaagacugugcccacuggaaggaagccaaaaugcuacuggacaacauuaacacucccgagggcauaauccccagcauguucgagcccgagagggagaagguggacgccaucgacggcgaauauaggcugcgcggggaggcccgaaagacauuugucgaccucaugcggcguggcgaccugccuguguggcuagcguacaaagucgccgccgaggguaucaacuacgcugaucggcgcuggugcuucgacgggaucaagaacaaccagauacucgaagagaacgucgagguggagauauggaccaaggagggggagcggaagaaacugaaaccgcgguggcuggacgcgcggaucuacagcgacccacuugcccugaaggaguucaaggaguuugccgccggccgcaagucacugacccuuaaccuaaucaccgagaugggacggcugcccacuuucaugacgcaaaagacccgagacgcgcucgacaaccuggcagucuuacacacggcagaggcaggaggccgggcguacaaccacgcccucagcgagcugcccgagacccuggagacgcuccuacuacuaaccuuacuggcgaccgugaccggggggaucuuccucuuccuuaugucuggcagggggaucgggaagaugacacugggaaugugcugcaucaucacggcuuccauucuccuuugguacgcccagauccaaccgcauuggaucgcggccuccaucaucuuagaauuuuuccugauaguguugcugauccccgagcccgagaaacagcggacgccacaggacaaccaacucaccuaugucgugaucgcgauucugacuguuguagccgccacgauggcaaacgagaugggcuuccuggagaaaaccaagaaggaccucgggcuggguagcaucgcaacccagcagccggagucuaacauccuggauaucgaccuccgcccagccucugccuggacccuguaugcgguggcgacgaccuucgugacccccaugcugcgccacuccaucgaaaacucgaguguuaacgugucccucacagccauagccaaccaagcaacggugcugaugggcuuagggaagggcuggcccuuaagcaagauggauaucgggguaccgcugcuagccaucggcugcuacucccagguaaaccccaucacccucaccgcggcccugcugcuauuagucgcucauuaugccauuauugggcccggucugcaggcgaaggccacgagggaggcccaaaagagagcagccgccggcaucaugaagaaucccacugucgacgggaucaccguuaucgaccucgacccaauccccuacgaccccaaguucgagaagcaguugggccagguaaugcuguuaaucuuaugcguaacccaggugcuaaugaugaggacaacaugggcacucugugaagcccuuacgcuggccaccggcccgaucagcacccucugggagggcaacccugggcguuuuuggaacaccacuaucgccguuucgauggcuaacaucuucagaggcagcuaucuggccggugcagggcuccuauuuucaaucaugaagaacaccaccaacacgcgccggggcacuggcaacaucggcgagacccugggagagaaguggaaguccagacucaaugcccucgggaagagugaauuccagaucuacaagaaguccggcauccaggaggucgaucggaccuuggcuaaagaggggaucaaaaggggagaaacggaccaccacgccguuuccagggggagcgccaagcugcgcugguuuguggagcggaacauggucacccccgaagggaaagugguggaucucggaugcgggcguggcgggugguccuauuacugcggugggcugaagaacgucagggaggucaaggggcugaccaagggcgggcccggucacgaggaacccauaccgaugagcacguauggguggaaccucguacgccuccaauccggcguagacguguucuucaucccuccugagaagugugacacgcugcugugcgauaucggggaaagcuccccgaacccgacaguggaggccggccggacacuucgcguccugaaccucguagaaaacuggcugaacaauaacacacaguucugcaucaagguucugaacccguacaugccaucggucaucgagaagauggaagcccuacagaggaagcacggcggggcgcuaguccgcaacccgcugucccggaacaguacccacgagauguauuggguuagcaacgccagcggcaacauugucagcuccgugaauaugaucagccgcaugcuuauuaaccgguuuaccaugcgacauaagaaagccaccuaugagcccgacguggauuugggcuccggcaccagaaacauuggaaucgagucugagauccccaaucuugacaucauagggaagcgcaucgaaaagaucaaacaggagcacgagacguccuggcacuacgaccaagaccaucccuacaagaccugggccuaccacgguucguacgagacgaaacagaccggguccgcaucaucaauggucaacggcguggugcgguuacuuaccaagccgugggacguccugcccacggugacccagauggcgaugacagacaccacgcccuuugggcagcagcgcguguucaaggagaaggucgacaccaggacccaggagcccaaagagggcaccaagaagcugaugaaaaucacggcggagugguuauggaaagagcucggcaaaaagaagaccccacggaugugcacccgcgaggaauucacucgcaaggugcgcagcaacgccgcccugggggccaucuucacggaugagaacaaguggaaguccgcgcgggaagccguugaagacagccgcuucugggagcucgucgauaaggagcgcaaucugcauuuggagggcaagugcgagaccugcguguacaacaugauggggaagcgcgagaagaagcucggcgaauucgggaaagccaaggggucccgggcaaucugguacauguggcucggcgcccgcuuccucgaauucgaggcgcucggguuccugaacgaggaccacugguucagucgggagaacucccugagcggcgucgaaggggagggccuccacaagcugggguauauccugcgcgacgugagcaaaaaggaggguggcgccauguacgccgaugacaccgccggaugggacacaaggaucacgcucgaagaccugaagaaugaggagaugguuaccaaccauauggagggcgagcacaagaagcuggccgaggcaauauuuaaguugaccuaccagaauaagguagugcgcguucagcggcccacgccgcgggggacugucauggacauaaucuccaggcgcgaccagagaggcagcggucaaguggggaccuacggccucaacaccuucaccaauauggaggcccagcugauccggcagauggaaggggaaggcguguuuaagaacauccaacaccucacggucaccgaggagguugccgugcagaacuggcuagcacgaguugggcgcgaaaggcugucccggauggcaaucucuggcgacgacugcguuguaaagccccuggaugacagauucgccaacgcacugaccgcccugaacgacaugggaaagauacggaaagacauccagcaaugggagccuuccaagggguggaaugauuggacccagguccccuucugcucucaccacuuccacgagcucaucaugaaagacggccgcgugcugguuguaccgugccggaaccaagaugagcugaucggacgcgccaggauaucccagggcgcgggguggagccuccgcgaaacggccugccugggcaaguccuacgcucagauguggagccuuauguacuuucaccggagggaccuccggcuggccgcgaaugcgaucugcuccgccgugccaucucacugggugccgaccucccgcaccacauggagcauccacgccaagcaugaguggaugaccaccgaggacauguuaacaguuuggaaccggguguggauccgcgagaaccccuggauggaggacaagacccccguugaauccugggaagagauccccuaccucggcaagcgggaggaccaguggugcggaagccugauuggccucacaucccgcgccacgugggccaaaaacauccaggcggccauuaaccagguucggucacucaucggggaugaggaguacaccgacuacaugccuuccaugaagcgcuuccgacgcgaggaggaagaagccggcguauugugguaa

SEQ ID NO: 25376 - RNA, 9876 nt, Artificial Sequence
  derived and/or modified CDS sequence (opt11) from DENV-2__EU482661__SS-prME
agcgccgggaugaucaucauguuaauuccaacggugauggcuuuccaccucacuacccgaaacggggagccccacaugaucgucgggauccaggaaaaggggaagucccugcuguuuaagacugaagacggcgugaacaugugcacucuuauggcgauggaccugggggagcugugcgaggauaccaucaccuacaagugcccgcuccugcggcagaacgagcccgaggacaucgacugcugguguaauagcacgagcaccugggucacguacgggaccugcaccacaaccggcgagcaccgccgugagaaacgcucggucgcccugguaccccacgucgguaugggacucgaaacccgcaccgagaccuggauguccagcgagggugccuggaagcacgcccaaaggaucgagaccuggauucugcgacacccugguuucacgaucauggccgcgauccuggccuacacgauugggaccacccauuuucagcgcguccucaucuuuauccuacugacggcaguggcaccuuccaugacgaugcggugcaucggaauauccaaccgcgacuucguagagggcgucaguggcggcagcuggguggacaucguucuggaacacgggaguugcgugacuaccauggcaaagaacaagcccacgcuugacuucgagcugaucaagaccgaggccaaacagcccgccaccuugcggaaguacuguaucgaagcgaaacugacgaacacgaccacagagagccguugccccacccagggcgagcccucccugaaggaagaacaggacaaacgauucgugugcaagcacucgaugguggaccgaggcuggggaaauggcugcggcuuguucggcaagggcggcaucgucacgugcgcaauguucaccuguaaaaaaaacauggaaggcaagaucgugcagcccgagaacuuggaguauaccauuguggucaccccccacucaggugaggagcacgcgguggggaacgacaccgguaagcauggaaaggagaucaaggugacaccgcaaagcuccauuaccgaagcagagcugaccggguacggcacagucaccauggagugcagcccgcggaccggcuuagauuucaacgaaauggugcugcugcagauggaaaacaaggccuggcucgugcaucgccagugguuccuggaccuaccccuccccuggcuaccgggggccgauaaacaagaguccaacuggauacaaaaggaaacccuagucaccuucaaaaacccccacgcgaagaaacaggacguugucgugcugggcucccaagaaggggcgaugcacacggcccuuaccggcgccaccgagauccagaugagcucggggaaccuccuguuuaccggccaccugaaaugccgccugcgaauggauaagcuccagcucaagggcauguccuacagcaugugcacggggaaguucaagguggucaaggagaucgccgagacccagcacggcaccaucgucauccgagugcaauacgagggggauggaucgccgugcaagaucccguucgaaaucauggaccucgagaaaagguacguccucggccggcugauuaccgugaaccccauugucacugagaaggacucccccgucaauaucgaggccgagccgcccuucggcgauucuuacaucaucaucgguguggagccggggcaguugaagcuaaauugguucaagaagggcuccaguaucgggcagauguucgagaccaccaugagaggugcgaagcgcauggccauccugggcgacacugccugggacuucgggucccuuggcgggguauucacgaguauuggcaaagcacuccaccaagucuucggagcuaucuauggcgcggccuucaguggcgugucuuggacaaugaagauccugaucgguguuaucaucaccuggaucggcaugaacucccgcagcacaucccucagcguuucgcuggugcuuguggggauugucacgcuguaccugggcgugauggugcaggccgacuccgggugcgugguguccuggaaaaauaaggagcucaagugcggcagcggcaucuucaucacggauaacgugcacaccuggaccgagcaguacaaguuccagccggaaucucccucaaagcuggccagcgcgauccagaaggcucaggaggaggggaucuguggcauccgcuccgucacacggcuggagaaccucauguggaagcaaaucacccccgaacugaaccacauauuagcagagaacgaagucaagcuaaccaucaugacuggggacaucaaggguauuaugcaggccgggaagcgcagccuccgcccgcagcccacggagcuuaaauacuccuggaagaccugggggaaggccaagaugcucucuacagaguccuacaaccagaccuucuuaaucgauggucccgagacggccgagugcccgaauaccaaccgcgccuggaacagccuggagguggaagacuacgguuucggugucuucacuaccaauaucugguugaagcugaaagagaagcaggaugcuuucugcgauuccaaacugaugagcgccgcuaucaaagacaaccgggccgugcaugccgacaugggcuauuggauagaguccgcccucaacgacaccuggaagauugagaaagccagcuucauagagguuaagaacugccacuggcccaagucacacacccuguggucgaacggcguccuggaguccgaaaugaucauuccaaagaaucucgccggucccgugagccagcacaacuaccgcccgggguaccacacacaaaucgcaggacccuggcaccugggaaagcuugagauggacuucgacuucugcgacggcaccacuguuaucguuacggaggacugcgggaaccgcggcccuuccuuacgcaccacuaccgccucuggcaaacugaucacggaguggugcugccggagcugcacccugccuccgcuccgcuaccgcggagaggacggcugcugguacgggauggagauucgcccacucaaggagaaggaggaaaaccuggugaacucccuagugacggccggccacgggcaggucgauaacuucucacuaggcgugcugggcauggcgcucuuccuggaggagaugcugcgaacccgugugggaacgaagcacgcgauccuccuagucgccgugucguucgugacgcugaucacgggcaacaugagcuucaaggaucucggccgggugguggugaugguuggcgccacgauggcggacgacauagggaugggagugacguaucuggcucuacucgcagcuuucaaggugaggcccaccuucgcugccggccugcugcucaggaaacucaccuccaaggagcucaugaugaccacgaucgggaucguccuccuaagccaauccaccauacccgagaccguuuuggagcucaccgacgccuuggcccuuggcaugauggugcuaaagaucguccgcaacauggagaaguaccagcuggcggucacuaucauggccauccucugcguaccgaaugccgugauccuccagaacgccuggaaggugagcugcaccauacuggcggucguguccgugagcccccugcuacugaccuccucccagcagaagaccgacuggaucccccuggcacucacgaucaaagggcugaaccccacagcaaucuuccugaccacucugucccguacgaauaaaaagagaagcuggccguuaaacgaggccaucauggccgucgggauggugucgauucuagccagcucucugcugaagaacgacauccccaugaccggcccccugguugccggggggcuccugaccguuugcuacguucugacggggcgcagcgccgaccucgagcuggagagggcuacggacgugaagugggaggaccaggcugagaucuccggcagcucacccauucuuuccaucacaauaagcgaggacgggucuaugagcauaaagaacgaggaggaggagcagacccuaacuauccugauacgcacgggccuguuagucaucuccggccuguucccgaucagcauacccauuaccgcugccgccugguaccugugggaggugaagaagcagcgggcuggggugcucugggauguccccagcccgccgcccaugggcaaggcagagcuggaggacggggccuaccguaucaagcaaaaggggauccugggguacagccagaucggcgcaggcguguauaaggaggggacuuuucacacgauguggcacgugacccggggagccguguugaugcacaaagguaagcgaauugagcccuccugggccgacgugaagaaggaccugaucaguuauggcgguggcuggaagcuugaaggcgaguggaaggagggggaggagguccagguccucgcgcuggagccuggcaagaauccaagagcggugcagacgaagccugguuuauuuaagaccaacaccggcacaauuggcgcuguuuccuuagacuucagccccggcacuuccggcagucccaucaucgacaagaaagggaaagucguuggacuguacgggaacggaguggucacccgaaguggcgccuacgugucggccaucgcgcaaaccgaaaagucgaucgaggauaauccggagaucgagggggacaucuuucggaagcgaaggcugacgauuauggacuugcaccccggcgccgggaagaccaagcgcuacuuacccgccaucguucgggaggccaucaagcgcggccugcggacccugauauuggcaccaacccgcgucguggcugcagaaauggaggaggcccugcggggacugcccaucagguaccagaccccggcuauucgggcggaacacacuggcagagagaucguugaucucaugugccacgccaccuuuaccaugcgccuacugagccccguccgcgugccgaacuauaaccucaucaucauggacgaggcccacuucaccgauccggccaguaucgccgcgcgcggguacaucagcacgagaguagagaugggggaggcugcuggcaucuucaugaccgcgaccccccccgggucacgcgacccguuuccgcaguccaaugccccaaucaucgaugaggagcgugaaauacccgagaggucuuggaacuccggccacgagugggucaccgacuucaaggggaagacggugugguucgugccaagcauaaaggcagggaacgacauagccgccugccuucgaaaaaacgguaagaaggucauccagcugucccguaagaccuuugauucugaauacgugaagacgcggaccaacgacugggacuucgucgucacuaccgacaucuccgaaaugggggccaacuucaaggcggagcgcgugaucgauccccgccgcugcaugaagcccguaauucucacggauggcgaagagcgggugauucuggcgggucccaugccagucacccauaguuccgccgcgcagcgcaggggcagaauugggagaaaucccaagaacgagaacgaccaguauauauacaugggcgaacccuuagagaacgacgaagacugcgcacacuggaaggaggccaagaugcuccuggacaacaucaauacacccgagggcaucaucccuaguauguucgagcccgagcgagagaagguggacgccaucgacggggaauaucggcugcggggcgaagcgagaaagaccuucgucgaucuuaugcggcguggggaccuccccgucuggcuugcuuacaagguggccgccgagggcaucaacuacgccgaccggcgcuggugcuucgacggaaucaagaauaaccaaauccucgaggagaacguagaaguagagauuuggacgaaagagggcgagaggaagaagcuuaagccgcgcugguuggacgcacgaaucuauuccgacccgcucgcccuuaaggaguucaaggaauucgccgccggccgaaaaagccuaacgcucaaccuuaucacggagaugggaaggcugccaaccuucaugacccagaaaacgcgcgacgcgcuugacaaccucgcggugcuccauacggccgaagcgggcgggcgggccuacaaccacgcucucuccgagcucccggaaaccuuagaaacauugcuguuacucacccuguuagccacggucaccggcggcaucuuccucuuccuuaugagcgggcgcggcauugggaagaugacgcuuggcauguguugcaucaucaccgccagcauacucuuaugguacgcgcagauccaaccgcauuggaucgcugccagcaucauccucgaguucuuccucauugugcucuuaauccccgaacccgagaagcagaggacgccacaggacaaccaacucacguacgucgugaucgcgauucugaccguggucgccgcgaccauggccaaugaaaugggguuccuagagaagaccaagaaggaccuaggccugggauccauagccacccaacagccggaaagcaauauccuggacaucgaccugcgcccugccagugcguggacccuguacgcgguggccaccaccuucguaacgcccaugcugcggcacagcaucgagaacagcagugucaacgugagccucaccgcaauagcuaaccaggccaccgugcugauggggcuagguaagggauggccgcucagcaagauggacaucggcgucccguugcuggccaucgguugcuacagccaagugaaccccaucaccuuaacagcggcuuugcugcuccugguggcccacuaugcgaucauaggcccuggccuccaggccaaggccacucgcgaggcacagaaacgggcggcggccgguaucaugaaaaaccccaccgucgacggcaucacaguuauugaccucgacccgauccccuacgacccaaaguucgagaagcaguugggucaggugaugcugcucauccucugcguuacucagguguugaugaugcgaaccaccugggccuuaugcgaggcccugacccuugccacgggucccaucuccacucucugggagggaaauccgggccgguucuggaauacaaccaucgcagugagcauggcaaacaucuuccgcggcuccuaccuggcuggggcuggcuugcucuuuagcauaaugaagaacaccaccaacacccgucgagggaccgguaauaucggcgagacgcuaggggagaaguggaagagccgucugaacgcccucggcaaguccgaguuccagaucuauaaaaagagcggaauccaggaggucgaccggacgcuagcaaaggaggggaucaaacgcggagaaacggaccaccacgcuguuucaagagguucugccaagcugcgcugguucguggagcggaacauggucacucccgagggcaagguggucgauuuagggugcggucgcgggggcuggucuuacuacugcgggggccugaagaacgucagggaggugaaggggcugacgaagggcgggcccggccacgaagagcccauccccauguccaccuaugguuggaaccucgugcgccugcaaagcgggguggauguuuucuucauaccuccggagaagugugacacucuguugugcgacaucggugaauccagccccaauccgaccguggaagcuggacggacccugcgcguauugaaccucguggagaacuggcugaacaacaacacgcaguucugcaucaagguauugaaucccuacaugcccuccgucaucgagaaaauggaagcccugcagcggaaauacggaggcgcucuagugcgcaauccguuaagccggaacucuacacaugagauguauugggugagcaacgccagcggaaacaucgucuccagcgugaauaugauaagucgaaugcuaauuaaucgguucacaaugcgucauaaaaaggccacuuacgagcccgacguggaccuuggcucuggaacgcggaacaucgguaucgaauccgaaauuccgaaccuggacaucaucggcaagcgcaucgaaaagaucaagcaggagcacgagaccagcuggcauuacgaccaggaucaccccuacaagaccugggccuaccacggguccuacgagaccaaacagacgggcagcgcguccagcaugguaaacggggugguucgacuccucaccaaaccgugggacguccugcccacagugacucagauggccaugacugauaccacccccuucggacagcaacgcguguuuaaagagaaggucgacacccguacgcaagagcccaaggaggguaccaagaaguugaugaagauuaccgcagaguggcuauggaaagaacuggggaagaagaagaccccgagaaugugcacgagggaggaguucacccgcaaggugcgcaguaacgcagcccucggagcgauuuucaccgacgagaacaaguggaagucugcccgggaggcaguugaagacucccgcuucugggaguuagucgacaaggagcggaaccuucaccuggaaggcaagugcgagaccugcgucuauaacaugaugggcaagcgagagaagaagcucggagaguucggcaaggcuaagggcucccgggccauaugguacaugugguugggggcacgcuuuuuagaguucgaggcccucggcuuccugaacgaggaccacugguucucccgggagaacagccugagcggggucgagggggaggggcuccauaagcucgguuacaucuuacgcgacgugucgaaaaaagagggcggggccauguacgcagacgauacggcgggaugggacacccggauuacccucgaagaucugaagaacgaggagauggugaccaaccacauggaaggcgagcacaaaaaguuggccgaggccaucuuuaaacuuacguaucagaacaagguugugcguguucagcggccuaccccucggggcaccguaauggauaucaucagccggagagaccagcgaggguccggucaagugggcacuuacgggcucaauacguucacaaacauggaagcucagcugauccgccaaauggagggcgaggguguauucaagaacauccaacaccucaccguuaccgaggaaguagccguucagaacuggcuggcgcgggucggcagggagcgucugucucggauggccaucuccggugacgauuguguagugaagccccucgaugaccgguucgccaacgcauugacggcgcugaacgacauggggaagauucggaaagacauccaacaaugggaaccgagcaagggguggaacgacuggacccaaguccccuucugcucgcaccacuuucacgaguuaaucaugaaggacgggcgaguccuggugguaccgugccggaaccaggacgagcugauuggccgagcgagaauuagccagggggccggcuggucccuccgggagaccgccugccuuggcaaaaguuaugcgcagauguggucccugauguacuuccaccgucgagauuugcggcuggcggccaaugcuaucugcagcgcuguaccgucccacugggugccgacuuccaggacgaccuggagcauccacgcuaagcaugaguggaugacgacugaggauaugcugacgguauggaaccgggucuggauccgcgaaaacccauggauggaggacaaaacgcccguggaaagcugggaggaaauccccuaccucgggaagcgggaggaccaguggugcggcucccugaucgggcugaccagccgcgcuacaugggcgaagaauauccaggcugccauuaaccagguucguucacucaucggcaacgaggaguauaccgauuacaugccgagcaugaaaagauuccgccgcgaggaggaggaggccggggugcucugguaa

SEQ ID NO: 25377 - RNA, 9876 nt, Artificial Sequence
  derived and/or modified CDS sequence (opt11) from DENV-2__EU482662__SS-prME
accgccggggugaucauuaugcugauccccaccgccauggcguuccaccucaccacgcggaacggggaaccccacaugauugucggccggcaggagaagggcaagagccugcuguuuaagacugaggacggggugaacaugugcacgcucauggccaucgaccugggcgagcugugugaggacacgaucacuuauaagugcccacuccugcggcagaacgagcccgaggauaucgauugcuggugcaacuccacaagcacgugggucacguacgggaccugcaccacaacaggcgagcaccgaagggagaagcgcuccgucgcccuggugccccacguggguaugggucucgagacccggaccgagacauggaugucuuccgagggagccuggaagcacgcccagcggauugagacguggauccugcgccaccccggcuuuacuaucauggcggccauccucgccuacaccauagggaccacgcauuuccagaaggcccucaucuuuauccugcugaccgccguggcccccucuaugaccaugcgguguaucggcaucuccaaccgggacuuuguggagggugucuccgggggcuccugggucgauaucguccucgagcacgggagcugcgucacuacgauggcaaagaacaagccuacccuggacuucgagcuaaucaagacggaggccaagcagcccgcuacgcuccguaaguauugcauugaggcgaagcucacgaacaccaccaccgagucccgcugcccgacgcagggcgagcccagccugaacgaggagcaggacaaaagauucgucuguaagcauuccaugguagaccgaggcugggggaauggcugcggccucuucgguaagggcggcaucguaaccugcgccauguuuaccugcaaaaagaacauggaaggcaagaucguccagcccgagaaucuggaguacaccaucgugaucacuccacacagcggggaggaacaugccgugggcaacgauacugggaagcacgguaaggagaucaagaucaccccgcaauccuccaucaccgaagccgagcugacaggcuauggcacggucacgauggagugcagcccccggacuggccucgauuucaacgagaugguucugcugcagauggaggauaaagccuggcucgugcaccgacagugguuccuggaccugccccucccguggcugccaggggcggacacacaggguagcaacuggauucagaaagagacgcuggucacuuucaagaacccccacgcgaagaaacaggacguaguggucuuggggucgcaggagggcgccaugcacaccgcccugacgggggcuaccgaaauccagaugucgucagguaaccuccucuucaccggccaccugaaaugccgccugcgcauggacaagcuccagcugaaggguauguccuacagcaugugcaccgggaaguucaagaucgugaaggagauugcggagacccagcacgggaccaucgucauccgcgugcaauacgagggcgacgggucccccugcaagauccccuuugagaucauggaccuggagaaacgccaugugcucgggcggcugaucaccgucaacccgaucgucaccgagaaggacagccccgugaacauagaggccgaaccacccuucggcgacuccuacaucauaaucgguguagagccugggcaacugaaguuaaauugguucaaaaaggggagcuccaucggccagauguucgaaaccacgaugcgcggcgccaagcgcauggcaauccugggugacaccgccugggacuucggcucccucggcgguguauucaccucgaucgggaaggcgcuccaccagguuuucggggccaucuauggagccgcguucucuggggucuccuggacuaugaagauccugaucggcgcgaucaucacguggaucgggaugaacagccgguccaccucccuguccgugagccucgugcucgucggugugaucacccuguaucugggggcuauggugcaagccgacagcggcugcgucgugagcuggaagaacaaggagcucaagugcggcuccgggaucuuuaucacggacaacgugcacacguggacggaacaguacaaauuccaaccggagucgcccagcaaacuggcauccgccauacaaaaggcgcacgaagaggggauuugcgguauacguucggucacccggcuggagaaucuaauguggaagcaaauuaccccugagcugaaccacauccuauccgagaaugaggugaagcucacgaucaugacaggcgacaucaaagggauuaugcaggccggcaagcgcagccugcggccgcagcccacggagcugaaguacuccuggaagaccuggggaaaagccaagauguuaagcacggagucccacaaccagaccuuccugaucgacgggcccgaaaccgccgagugcccuaacaccaaccgagcguggaacucucuggaaguggaggacuauggcuucggggucuuuacuaccaacaucuggcucaagcugagggagaagcaggacguguucugcgauuccaagcugaugagcgcggccaucaaggacaaucgagccgugcacgccgauaugggguacuggaucgaguccgcacuaaaugauaccuggaaaauggagaaagcuagcuucaucgaggucaaguccugucauuggcccaagagccacacucugugguccaacggcgugcuagagagcgaaaugauaauccccaaauccuucgcuggcccugucagccagcacaauuaccggccgggcuacuacacccagacggccggacccuggcaucucgguaaacuugagauggacuucgacuuuugcgaagggaccaccguaguggugaccgaggacugcggcaaccgcggacccagccuccggacgaccaccgcgagcgguaagcucauuaccgaguggugcugucgcagcugcacgcugcccccguuacgguaucgcggcgaagacgguugcugguauggcauggagauccggccccucaaagaaaaggaggagaaccuggugaacucccuugucaccgcggggcauggccagauugacaacuucagccuaggcgugcuugggauggcacuguuccucgaggaaaugcugcgcacucgggucgguaccaagcacgccauccugcuagucgccguguccuucaugacguuaaucaccgggaacaugagcuuccgggauuuggggcguguuaugguuauggugggugccaccaugaccgacgacaucggcaugggcguaacguacuuagcucugcuggccgccuucaaggugaggcccacuuucgcugccgggcuccuucugcgcaagcucacauccaaggaacugaugauggccacaaucgguauagcccuguugagccagucgacaauccccgagaccauccuggaacuaaccgacgcacuggcccuggggaugauggucuugaaaaucguccggaacauggagaaauaccagcucgccgugaccauaauggcgaucagcugcguaccaaacgccgucauucugcagaacgcauggaaggucaguugcacuauacuggccgcggugagcgucucuccucugcugcugacuagcucgcaacagaaggccgacuggaucccccuggccuuaacuaucaaaggcuuaaaccccacugcuaucuuucugacgacccugagccgcaccuccaagaaacggagcuggccgcugaacgaggccaucauggcugugggaauggugagcauccuggccagcagccugcugaagaacgacauccccaugacugggccucucgucgccggcgggcuuuuaacgguguguuacguccucaccggccguuccgccgacuuagaguuagagcgggccacagaugucaagugggaggaccaggccgaaaucagcgggaguucgcccauccucuccaucaccauuagcgaagacgggagcauguccaucaaaaacgaggaggaggaacaaacgcucaccaucuugauccgcaccggccuccuggugauuucggggcuguucccggucagcaucccuaucacggccgccgcgugguaccucugggaggucaagaagcaacgagccgggguguugugggacgucccuagcccaccgcccgugggcaaggccgagcuggaggauggagccuaccguaucaagcagaagggcaucuuaggguacucucagaucggugccggcguguacaaagagggcaccuuccacaccauguggcacgucacccgaggugcuguacucaugcaccgcggcaagcgcauugagcccuccugggccgacgugaaaaaggaccuaauaagcuacgggggcggcuggaagcucgagggggaguggaaggagggugaggagguccaggugcucgcgcucgagcccgggaaaaacccccgcgccgugcagacuaagcccggccuguuuaaaaccaacacggggaccaucggggccguuagucuugauuuuuccccaggcacguccggcagcccgauaguagaccguaaagguaaagucgucgggcuauacggaaauggcguggugacccgcuccggggccuacgugagcgcgaucgcccagacggaaaaguccaucgaggauaaucccgagaucgaggacgacaucuuucgcaagaagcgucucaccaucauggaccugcaccccggugccggaaagaccaagcgguacuugccagcaauuguccgcgaagccaucaaacggggucugcgcacccuuauccuggcgccgacacgcgucgucgccgcggagauggaggaggcccuucgugggcugccuauccgcuaccagacccccgccauuagagcggagcacacagggcgcgagauuguggaccucaugugccacgccaccuucacgaugcggcugcucucccccgugcgagucccaaauuacaaccugaucauaauggacgaggcccauuucaccgaccccgccagcauugcugcgcggggcuauauaucaacccgaguugaaaugggggaagccgccggcauauucaugaccgccacaccgccggggagccgggacccguucccucaguccaacgcccccauaaucgacgaggaacgcgagauccccgaacggucguggaacuccggccacgagugggucaccgacuucaaggggaagaccguaugguucguaccgucuaucaaggcuggaaacgacaucgccgccugcuuacgcaagaauggcaagaaggugauccagcuauccaggaagaccuucgacagcgaguacguaaaaacccgaacgaacgacugggacuuuguggugacgacggacauauccgagaugggggccaauuucaaggcggagcgagucaucgacccccgucggugcaugaagcccgugauacucacggacggagaggagagagucauacuagccggccccaugccggugacccacagcucggcggcccaacggagaggccggaucgggcgcaacccuaagaaugagaacgaccaguacaucuacaugggcgaaccccucgaaaacgacgaggauugcgcgcacuggaaggaggcaaaaaugcuguuggacaacaucaacacccccgagggcaucaucccaagcauguucgagccggagcgcgaaaagguggacgcgaucgauggggaauaccggcuccgcggcgaagcccgaaagacuuuuguggaccugaugcggcgcggggaccugcccguauggcucgccuaccggguggcugcggaaggcaucaauuacgccgaucggagguggugcuucgacggggugaaaaacaaccagauccuggaggaaaacguggaaguggagaucuggacgaaggagggcgagcggaaaaagcugaagccacgcuggcuugacgcccggaucuacagcgacccccuggcgcuuaaggaguucaaggaguuugcagccggccgcaagagccucaccuugaaccugaucacugagauggggcggcuccccaccuucaugacacaaaaggcccgggaugcacuugacaaccuggcugugcuccacaccgcugaggccggcggacgcgccuacaaucacgccuuguccgaacugcccgagacccuggagaccuuacuacuccugacguuacucgcgaccgucaccgguggcauauuucuguuccugaugagcgggaagggcguugggaaaaugacucucggcauguguugcaucauaaccgcaucuauucugcugugguacgcccagauucaaccccauuggauugccgccagcauaauccucgaguucuuucugaucgugcugcucauccccgagcccgagaagcagcgcacgccgcaggacaaccaacugaccuacgucgugaucgcaauccucacagucguggcugcaaccauggccaacgagaugggguuccucgaaaagacgaaaaaggaucugggucugggcagcaucgcaacucaggagccggaguccaauauccucgacaucgaucugcggcccgccagcgccuggaccuuauacgccgucgccacgacuuucgucacacccaugcuaagacauucaaucgagaacucguccguaaacgugagccugaccgccaucgcgaaccaagcaaccguucugauggggcuaggcaagggguggccccuguccaagauggacaucggcgugccacugcuagccauagggugcuacagccaggugaaucccauaacgcuaaccgccgccuuacuccuucuuaucgcgcacuaugcaaucauuggcccuggacuccaggccaaggcaacucgugaggcccagaagcgcgccgccgccgggauaaugaagaaccccacggucgacggcaucacagucaucgacuuagacccgauucccuacgaucccaaguuugagaagcaacugggccaggugaugcugcuuauccugugcguuacccaggugcuuaugaugcggacuacgugggccuuaugugaggccuugacgcuggcgaccgguccgaucuccacccucugggaggggaacccaggccgcuucuggaacaccacgaucgcggugagcauggccaacaucuuccgaggauccuaccuagccggggcgggccucuuguuuagcaucaugaagaauaccaccaacacccgccgcgggacggguaacauuggcgagacccugggcgagaaauggaaaagccggcuaaacgcacugggcaagagcgaguuccaaaucuacaagaagucugggauccaggaggucgaucggacccuggccaaggagggcauuaagaggggugagaccgaucaccacgcugugucacgcggcagugccaaguuacggugguuuguggagcgcaacauggucacccccgagggcaaagugguggaucuggggugcggccgcgggggcuggagcuacuacugcggaggccuuaagaacguccgcgagguuaagggccucacuaaaggcggccccgggcaugaggagcccauuccgaugucuaccuacggcuggaaccugguccggcugcagagcggggucgacguguucuucaccccgccggaaaaaugcgacacccuccuuugcgacauuggugagagcuccccuaacccgaccauagaagcgggucgcacccugcgagugcucagccugguugagaacuggcugaauaacgauacccaauucuguaucaagguucucaaccccuacaugcccuccgugaucgagaaaauggagacccuacagcgcaaguacggaggcgcuuuaguccguaacccgcugagccgcaacuccacgcacgagauguacuggguaagcaacgccacggggaacaucguuuccagcgucaacaugauuucccgaaugcucaucaaucgcuucacaaugaaacauaagaaagccaccuacgagccugacguugaucuggggagcgguacgcggaacaucgggauugaauccgaaauacccaaccuggauaucaucggcaagcgcaucgagaagauaaagcaggagcacgagaccagcuggcacuacgaccaagaucaccccuacaagaccugggccuaccacggguccuacgagaccaagcagacgggcagcgcuuccagcauggugaacggggugguacgucuccugaccaagccgugggacgugguccccaugguuacacagauggccaugaccgacacgacccccuucggccagcagcggguuuucaaggagaaggucgauacucgcacccaagagccaaaggaaggcacgaagaagcugaugaagauuaccgccgaguggcuguggaaagaauuggggaaaaagaagacuccgagaauguguacccgcgaggaguucacucggaagguucguuccaacgccgcgcucggcgcuaucuucacugacgaaaacaaguggaaguccgcccgugaagcuguagaggacuccagguucugggagcucgucgacaaggagcggaaccuucaucuggagggaaaaugcgagaccugcguguacaauaugaugggcaagcgcgagaagaagcucggggaguucggcaaagcgaaggguagccgggcaaucugguacauguggcugggggcgcguuuccucgaguucgaggccuuaggcuuccugaacgaggaccacugguucucgcgggagaacucccugagcggcgucgaaggcgaggggcuccacaaacuuggcuauauacugcgcgacgucuccaagaaagaaggaggggccauguacgccgacgacaccgccggcugggacacucgcaucacccucgaggaccugaagaaugaggagauggugaccaaccacauggagggugagcacaagcgccuggccgaggcaauauucaagcugaccuaccagaauaagguuguccgggugcagcgcccgacgccccgaggcaccguuauggacaucaucucucgccgggaccagcguggguccggucaggugggcaccuacgggcuaaauacauucacgaauauggaggcccaacugauccgccaaauggagggcgagggaauauucaagucgauccagcaccuaaccgugaccgaggagaucgccguucagaacuggcuugcgcggguaggccgggagcggcugucccgcauggcuauaucuggcgacgacugcguugucaagccccucgacgaccguuucgcuuccgcccugaccgcccugaaugacaugggaaaggugcgcaaggauauccagcaaugggagccuagcaagggcuggaacgauuggacccaagugccuuuuugcucccaccacuuccacgagcucaucaugaaggacggccguguccuggugguucccugcagaaaucaggaugaacugaucggucgggcacgcaucagccagggggcuggcuggucucucaaagagaccgccugccugggcaaaagcuacgcgcagauguggucccugauguacuuccaccggcgcgacuugaggcuggccgcuaacgccaucugcagcgccguaccaagccauugggugccuaccagccgcacaacguggagcauacacgccaagcacgaguggaugaccacagaggauaugcugaccguguggaaccgcgucuggauccaagagaaucccuggauggaggauaagaccccggucgaauccugggaggagguucccuaccuagggaagcgagaggaccaguggugcggaagucugaucggucugacgagcagagcgaccugggccaaaaauauccaaaccgcuaucaaccagguccgcucucugaucggcaaugaagaguacaccgacuauaugccguccaugaagcgguuccgccgcgaggaagaagaggcgggcguguugugguga

SEQ ID NO: 25378 - RNA, 9876 nt, Artificial Sequence
  derived and/or modified CDS sequence (opt11) from DENV-2__EU482663__SS-prME
agcgccgggaugaucauaaugcuuauccccaccgugauggccuuucaccucaccacccggaacggagagccacacaugaucgucggaauccaggagaagggcaagagccugcuguucaagacagaagacggcguuaacaugugcaccuuaauggcuauggacuuaggggagcuuugcgaggacacgaucaccuacaagugcccccuccugcggcagaacgagcccgaggacaucgacugcuggugcaacagcacauccaccugggugaccuacggcaccugcacuacuaccggcgagcaccgccgggaaaagcgcucagucgcccuggugccgcacguggggaugggccucgagacccggaccgagaccuggaugagcagcgagggggccuggaagcaugcccagcgcauagagaccuggauccugcggcacccgggcuucacgauuauggcugcgauccuggccuacacgaucgggaccacccauuuccagaggguccucauauucauucugcugacggccguggcccccuccaugacgaugagaugcaucggcaucucgaaccgcgauuucguggagggcgucuccgggggcagcugggucgacaucguucucgagcacggguccugcgucaccaccauggcgaagaacaagcccacccuggacuuugagcugaucaagaccgaggcaaagcagcccgcuaccuugcggaaguauuguaucgaggccaagcugaccaacacgacaaccgagagccggugcccgacucagggcgagccuucccugaaggaggagcaggacaagcgguucguuugcaagcauagcaugguggaccgcggcugggggaacggcugcggccuguucggcaagggcgggaucguaacgugcgccauguucaccugcaagaaaaauauggagggcaagaucgugcagcccgagaaccucgaguauaccaucguggucacgccccacuccggggaggagcaugcggugggcaacgauacggggaagcacgggaaggagaucaaggugacaccgcagagcucgaucaccgaggcugagcugacgggguacggcacugugacgauggagugcucacccagaaccggccucgacuucaacgagauggugcuucugcagauggagaacaaagcauggcuggugcaccgccaaugguuucucgaccuuccacuucccuggcugccuggggccgacaagcaggagucaaacuggauucagaaagaaacccuggucaccuucaagaacccucaugccaagaagcaagacguggucgugcucggcagccaagagggggccaugcacacggcccugacaggcgccaccgagauccagaugagcuccggaaaccuccucuucaccggacaccugaagugccggcugcgcauggacaagcuccaguuaaagggcaugucuuacuccauguguacggggaaguucaaaguaguaaaggagauagccgagacccagcacggcaccaucguaauccggguacaguacgagggggacggcagccccuguaagauccccuucgagaucauggacuuagagaagagauacguccucggccggcugauuaccgugaauccgaucgugacggagaaagacaguccugucaacaucgaggccgaaccacccuucggggacagcuauaucauuaucggcguggagccggggcagcugaagcucaacugguuuaagaagggauccucuaucggacaaauguucgagaccacgaugcggggagcgaagagaauggccauccuuggagacaccgccugggauuucgggucccugggagggguguucacaaguaucggcaaggcucuccaccaggucuucggugcuaucuauggugcggcguucucuggggugagcuggacuaugaagauccugaucgggguaaucaucaccuggaucgguaugaacagccgguccacaucccugagcgucagccugguguuaguggggaucgucacgcuguaccugggcgugauggugcaggccgauagcgguuguguuguauccuggaagaacaaggagcucaaguguggcaguggcauuuuuaucaccgacaacgugcacacguggaccgagcaguacaaguuccagccugagagccccaguaagcuggccagcgcgauccagaaggcccaggaggaagggaucugcggcauccgcagcgucacgcgguuggagaaccucauguggaagcagaucacccccgagcuuaaccauauucuggccgagaacgaggucaagcucaccaucaugaccggggacaucaagggaaucaugcaggccgggaaacggagccugcggccgcaacccacggaguuaaaguauuccuggaaaaccuggggcaaagccaagauguuaagcaccgaguccuacaaccagaccuuccugaucgacggacccgagaccgcggagugcccgaacaccaacagagccuggaacagccuggagguggaggacuacggguucggcgucuucaccaccaacaucuggcucaaguugaaggagaagcaagacguguucugcgacaguaagcugaugagcgcagccaucaaggacaaccgggccgugcacgcugacaugggguacuggaucgagucagcacucaacgacacguggaagaucgagaaagccucguucaucgaaguaaagaacugccauuggcccaagucccacacccuguggagcaacggcgugcuggaguccgagaugaucauuccaaaaaaucuagccggccccgugucgcagcacaacuaccgcccgggauaucacacccagaucgcuggucccuggcaucuggggaagcuggagauggacuucgacuucugcgacggcaccaccgugaucgugacagaggacugcggcaaccggggucccucccuacgcaccaccaccgcgagcggcaagcugaucacggaguggugcugccggucaugcacccuacccccgcuucgcuaccgaggagaggacggcugcugguacgggauggagauccgccccuugaaggagaaggaggagaauuuggugaacucccucgucaccgccggccacggccaaguggacaacuucagccucggcgugcugggcauggcccucuuccuggaggaaaugcugcggacccgagucgggacgaagcaugccauccuccugguggcagucuccuucgucacccucaucaccggcaacaugaguuucaaggacuuggggcggguaguggucaugguuggcgccaccauggccgacgacaucggcaugggcgugaccuacuuggcgcuccucgccgcguucaaaguccgccccaccuucgccgccggauugcugcuaaggaaauuaaccucaaaggagcugaugaugaccacgaucggaaucgugcuccugagccaguccaccauccccgagaccgugcuggagcucaccgacgcccuagcccugggcaugaugguccucaagaucgugcgcaacauggagaaguaccagcuggcagucacgaucauggccauccuguguguaccgaaugcugugauucuccagaacgccuggaaggucagcugcaccauccuggccguggugucagucucacccuugcuccuuacaucuucacagcagaagaccgacuggauaccccuggcgcucaccaucaagggguugaaccccaccgcaaucuuccugaccacccucucccgcacgaauaaaaagcgcagcuggccacugaacgaggccaucauggccgugggcauggugagcauccuggcgagcucccuccuuaagaaugauauucccaugaccggcccccuggucgccgggggccuccuaacagucugcuacgugcugaccgggcgcagcgcugaccucgagcuggagcgggcgacggacgucaagugggaggaccaggccgagaucucgggcagcagccccauacuguccauaaccaucucugaggacgggucaaugucaaucaaaaaugaagaagaagagcagacacucaccauccugaucagaacgggccugcucgugauuuccggccuauucccgaucagcauccccaucacggcggccgcgugguaccugugggaggucaagaagcagcgggccggaguacucugggaugugcccucaccgccucccaugggcaaggccgagcuggaggacggggcauaccgcaucaagcagaagggcauucugggguacagccaaaucggggccggaguguacaaggaaggcacguuccacacuauguggcacgucacccgcggcgcuguccuaaugcacaaagggaagcggaucgagcccuccugggccgaugugaagaaagaccuuaucucguacggcgggggcuggaagcuggaaggcgaguggaaggagggggaggagguccagguguuggcccuggagcccggcaagaacccgcgggcgguccagacgaaacccggguuauucaagaccaacaccggcaccauuggagcggucucccucgauuuuagccccggcaccuccggcagccccaucaucgacaagaaagggaagguggugggccuauacgggaauggcgugguuacccgcuccggcgccuacgugagcgccaucgcccagaccgagaagagcauagaggacaaccccgagauugaggacgacaucuuccggaaacgccggcugaccaucauggaccugcaccccggagcagguaagacuaagcgcuaccuccccgccaucguccgggaggccaucaagcgcgggcuccgaacacugauccucgcgcccacccgcgugguggcggccgagauggaggaggcccugcggggccugccgauccgcuaccagacucccgccauccgggcggagcacacggggcgcgaaaucgucgaccucaugugccacgcgaccuucaccaugcgccugcugagccccguacgggugccgaacuacaaccucaucaucauggacgaagcgcacuucacggaccccgcuuccaucgcagcccgcggcuacauuagcacgagggucgagaugggagaggcggcggguauuuucaugaccgccacgccgccggguagccgagacccuuucccccaauccaacgcacccaucauugacgaggagcgggagauacccgagcgcagcuggaauuccgggcacgaguggguuaccgacuucaagggcaaaaccgugugguucgucccgagcaucaaagccgggaacgacaucgcugccugucugcggaagaacggcaagaaggugauacagcugucccgcaagaccuuugacagcgaguacgugaaaacccggacaaacgacugggacuucgucguuacgaccgacaucuccgagaugggcgccaacuucaaggccgagcgcgugauagacccccggcgaugcaugaaacccgucauccucaccgacggagaggagagggugauccuggcgggucccaugccggugacacacagcuccgccgcccagcgccgggggcgcauagggcggaaccccaagaacgagaacgaucaguacaucuacaugggggagccacuggaaaacgacgaagacugugcucacuggaaggaggcaaagaugcuccuggacaacaucaacacgcccgaaggcauuauuccuucuauguucgagcccgaacgcgagaaggucgacgcgaucgauggcgaguacaggcuacgcggggaggcgcgaaagacauuuguagaccucaugcgccgcggcgaccugcccguguggcuugccuacaaggucgcagccgaagggaucaacuacgcggaccggcgcuggugcuucgacggcaucaagaacaaucagauccucgaggagaacguggagguggagaucuggaccaaggagggggagcggaaaaagcugaagccgcgcuggcucgacgccaggaucuacucagauccccucgcccugaaggaguucaaggaguucgccgcuggccgcaaaagccuaacccucaaccuaauaacggaaaugggccggcugcccaccuucaugacccaaaagacccgcgaugcgcucgacaacuuggccgugcugcacacugccgaagccggcggccgagcuuacaaccacgcccucuccgagcuucccgagacccuggaaacccuccugcugcucacccugcuggccacuguuaccggcggcauauuccucuuccugaugagcggcagggguaucggcaagaugacucuggggaugugcugcaucaucaccgccuccauacuccugugguacgcccaaauucagccgcacuggaucgccgccuccaucauccuggaauucuuccucaucguccugcugauccccgagcccgagaagcagcggacgccccaggacaaccaacucacguacguggugaucgccauccugaccgucguggccgccaccauggcgaacgagaugggcuucuuggagaagaccaagaaggacuuugggcucggauccaucgccacgcagcagccggaaaguaacaucuuagacauagacuuacgccccgccuccgcuuggacccucuaugccguugcaaccaccuuugucacgcccauguugcggcacagcaucgagaacagcucugugaaugugagccugaccgccaucgccaaucaggcaacgguccucaugggccuggggaagggcuggccccuguccaagauggacaucggugugccgcuccuagccauuggauguuacagccaggucaaccccaucacccugacggcggcccuucugcugcucguagcucacuacgccaucaucgggccaggccugcaagcgaaggccacucgcgaggcccagaagcgagccgcggcgggcaucaugaagaaccccaccguggacgggauaaccgugaucgaccuggacccgauccccuacgaccccaaauucgagaaacagcucggacaggucaugcugcugauucucugcgugacccaggugcugaugaugcgcaccaccugggcccucugcgaggcccucacccuggccaccgggccaaucuccacccugugggagggcaacccgggccgguucuggaacaccaccaucgccgucagcauggcgaacaucuucaggggcuccuaccucgccggcgcaggacugcuguuuagcaucaugaagaacacgaccaacacacggcgcggcaccgggaacaucggcgagacgcucggggagaaguggaagagucgccugaacgcccucgggaaguccgaguuccaaaucuacaagaaguccggcauucaggagguggaccggacccucgccaaggaggggaucaagcgcggcgagaccgaccaccacgcggugagccggggguccgccaagcugcgcugguucguggagaggaacauggugacccccgagggcaagguggucgaucugggcugcgggcguggcggguggagcuacuacugcggcgggcuucggaacgugcgcgaggugaagggccugacgaagggcgggcccggccacgaggagccuaucccgauguccacuuauggguggaaccugguccggcuccagagcggcguggauguguuuuucaucccgcccgagaagugcgacacccugcugugcgacaucggggaauccagccccaacccgaccgucgaggccggccgcacgcuccggguccugaaccugguugagaacuggcucaacaacaauacccaguucugcauaaagguccucaaccccuacaugcccuccgugaucgagaagauggaggcccugcagcgcaaguacggcggggcgcugguccggaacccacucagccgaaacagcacccacgagauguauugggucucuaacgccagcggcaacauuguguccagugugaauaugaucucccggaugcugaucaaccgauucacgaugcggcacaagaaggccaccuaugagcccgacguugaccuggggucaggcacgaggaacaucggcaucgaauccgagauacccaaccucgauaucaucggcaagcggaucgagaagaucaagcaagagcacgaaaccagcuggcacuacgaccaagaccaccccuauaagaccugggcauaccacgggagcuacgagaccaaacagacgggcucugccaguucgauggugaauggcgugguucgccuacugacaaagccgugggacgugcuccccacagugacccagauggcgaugacggacaccacgcccuuugggcagcagcgggucuucaaggagaaaguggacacccggacgcaggagcccaaggagggcacuaagaagcugaugaagauaacugccgaguggcuguggaaggagcucggcaagaagaaaaccccccgcauguguacgcgggaggaguucacccgcaaggugcggucaaacgccgcgcugggggccaucuucacggacgagaacaaguggaaguccgcgcgcgaggccgucgaggacuccagauuuugggagcugguggacaaggagcgcaaccuccaccuggagggcaagugcgagaccugcgucuacaauaugauggggaaacgggaaaagaagcuuggcgaguucgggaaggcgaagggcagccgcgccaucugguacauguggcucggcgcccgguuccucgaguucgaggcgcugggguuucucaacgaggaccacugguuuucccgcgagaacagccuguccggaguggagggggagggccugcauaagcucggguacauccugcgggaugucaguaagaaggaggguggcgccauguacgccgacgacacagcugggugggacacccgaauaacccuggaggacuugaaaaaugaggaaaugguuaccaaccacauggagggggagcacaaaaagcuagcggaggccaucuucaaacuaacguaccaaaacaagguggugcggguacagcgccccacgccccgggggaccgugauggacaucaucagccgccgggaccagcgcggcagcgggcaggugggcaccuacggccucaacacguucaccaacauggaggcccaacugaucaggcaaauggagggggagggcgucuucaagaacauccaacaccugaccgugaccgaagagguggccguccaaaacuggcucgcccgcguggggcgcgaacggcugagccgcauggcgauauccggcgacgacugcguugucaagccccuggacgaccgguucgccaacgcccugaccgcccuuaaugauauggguaaaauccgcaaggacauccaacaaugggagccgagcaagggguggaacgacuggacccaggugccuuucugcucccaccacuuccaugaacugauuaugaaggacggccggguguuagucgugcccugccgcaaccaggacgagcugauugggcgggcuagaauaagccaaggcgcgggguggucccugagggagaccgcgugccucggcaagucauacgcacaaauguggucguuaauguacuuccaccgccgggaccugcgccucgcggcgaacgcgaucugcagcgccguuccuucccauuggguccccaccagccggaccaccuggucgauccacgccaaacacgaauggaugaccacggaggacaugcugaccguguggaaccgcguguggauucgggaaaacccauggauggaggacaagacgcccguugagagcugggaggaaauccccuacuuaggcaagcgcgaggaccagugguguggaucccucaucggcuuaaccagccgggcgacgugggccaaaaacauccaagcggccaucaaccaggugcgcagucugaucgggaacgaggaguauaucgacuacaugccgucaaugaagcgguuccgccgcgaggaggaggaagccggugugcucugguga

SEQ ID NO: 25379 - RNA, 9876 nt, Artificial Sequence
  derived and/or modified CDS sequence (opt11) from DENV-2__EU482664__SS-prME
accgcaggggucaucaucaugcugauccccaccgcuauggcguuccaccucaccacccgcaauggggaaccucacaugaucgucggucggcaggagaaggggaaaucgcuguuauucaagaccgaggacggcgucaacaugugcacccucauggccaucgaccugggggagcugugcgaggacacgaucaccuauaaguguccccuccuccgccagaacgagcccgaggacaucgauugcuggugcaacagcaccagcaccugggugacguacgguaccugcaccacgacgggcgagcaccggagggagaaacggucaguagcccugguuccccacgugggcaugggccucgaaacccgcaccgagaccuggaugagcuccgagggggcauggaaacacgcccagaggauugaaacguggauccugcgucaccccggcuucaccaucauggcggccaucuuggcuuacaccaucgggaccacgcacuuucagcgagcccucaucuucauucugcugaccgcggucgcccccagcaugacaaugcgcugcaucggcaucuccaaccgggacuucguugagggcgugagcgguggguccuggguagacaucguccucgagcacgggagcugcguuaccacgauggccaagaacaagcccacccuggacuuugagcugaucaagaccgaggccaaacagcccgccacccuccgcaaguauugcaucgaggcgaagcugaccaacaccacaaccgaaucccggugcccgacgcagggcgagcccagcuuaaacgaggagcaagacaagagguucgucugcaagcacuccaugguggaccgcgggugggggaacggcugcggguuguucggcaagggugggaucgugaccugcgccauguuuaccugcaagaagaacauggagggcaagaucguccagcccgagaaccuggaguacaccauugugauaacgccccacagcggggaggagcaugccgugggaaacgauaccggcaagcacgguaaggagaucaagaucaccccgcaguccagcaucaccgaggcggagcugaccggguacggcacggucacuauggagugcaguccucguaccggccucgacuucaacgagauggugcugcugcagauggaggacaaggcguggcuagugcaccggcaaugguuccuggaccuucccuugcccuggcugccgggggcggacacgcaggguagcaacuggauccaaaaagaaacgcuggucaccuucaaaaacccgcacgccaagaaacaggacguggugguccucgggucccaggagggcgccaugcacaccgccuugaccggggcaacggagauacagaugagcaguggcaaccuccucuucaccggccaccugaagugccgacugcggauggacaaacuccagcugaaggggaugucguacagcauguguaccggcaaguucaagaucgugaaggagaucgcggagacccagcaugggacgauagucauacgcguucaguaugagggugacggcucccccuguaagauccccuucgagaucauggauuuggagaagcggcacguccucgggcgcuugaucaccgucaacccgaucgucaccgagaaggacagccccgugaacaucgaggcggagccgcccuucggcgacuccuacaucauaauuggggucgaaccgggccaguugaagcucaacugguucaagaaggggagcuccaucgggcagauguucgagacaacgaugcgcggcgccaagcggauggccaucuugggggacaccgccugggacuucggcagccucggagggguauucacuucuaucgggaaggcacuccaccagguuuucggggccaucuacggagccgcuuucuccgggguuuccuggacuaugaagauccucaucggcgcaaucaucacguggaucggaaugaacagccgcuccacaagccugagugugucacuggugcuuguuggugucaucacacuguaccugggugccauggugcaggccgacuccggcugcgucgugagcuggaagaauaaagagcucaagugcggcuccgggaucuucaucaccgacaacgugcacacuuggaccgagcaguacaaguuccagccugagagccccagcaagcuggccagugccauccagaaggcgcacgaggagggcaucugcgggauccguagcgucacccgccuggagaaucucauguggaagcagaucaccccggagcugaaccacauccuguccgaaaacgaggugaagcucaccauuaugaccggcgacaucaaggggauuaugcaggccgggaagcggagccugcgcccccagcccaccgagcuuaaguacuccuggaagaccugggguaaggccaaaaugcucagcacagagucccauaaccaaaccuuccugaucgacgggcccgagacggccgaguguccaaacaccaaccgggccuggaauagccuggagguggaggacuacgguuucggggucuucacgaccaauaucuggcucaagcugagggagaagcaagacguauucugcgacaguaagcugaugagcgcggccaucaaggauaaucgagcagugcacgccgacaugggcuacuggaucgagucugcacucaacgauacguggaagauggagaaggcgagcuucauagaggucaaguccugccacuggcccaagagccauacacuguggucgaauggcguguuggaaagcgagaugaucauccccaaauccuucgccgggccggugagccagcacaacuacagaccgggcuacuacacccagacggccggacccuggcaccucggcaagcuggaaauggacuucgacuucugcgaggggaccacagugguggugaccgaggacugcggcaaccggggccccucucugcgcacgaccaccgcuucagggaagcucaucaccgaauggugcugccgaagcugcacgcugcccccacuccgcuaucggggcgaggaugggugcugguacggcauggagauacgaccacuaaaggagaaggaggagaaccuggucaacagcuugguaacggcggggcauggccagauugacaauuucagccucggcgugcuggggauggcccuguucuuagaggagauguugcguacccgagucggcaccaagcacgccauccuguuaguggccguguccuucgucacgcugaucaccgggaacaugagcuuccgggaccugggucgcgugaugguaauggucggcgccaccaugacggacgacaucggcaugggggugaccuaccuugcgcugcuggccgccuucaaagugaggcccaccuucgccgccgggcuccugcugcggaaacuuacaagcaaggagcucaugauggcgaccaucgguauugcccugcucagccagucuacaauccccgagacaauccuggagcugaccgaugcccucgccuugggcaugaugguccugaagaucgugcgcaacauggagaaguaucagcucgccguaacgaucauggcgaucagcugcgucccgaacgccgugauacugcaaaacgccuggaagguguccugcacgauccucgccgcggucagcgugagcccccuccugcugaccagcucccagcagaaggcagacuggaucccauuggccuugaccaucaagggccugaacccgaccgccaucuuuuuaaccacacugagccggacauccaaaaagcgcucuuggccacugaacgaagccaucauggcggucgggauggucuccauucucgcgagcagccugcuaaagaacgacauccccaugaccgggccccucguugccggcgggcugcuuacggucugcuacguacucaccggccgguccgccgaccuggagcuggagcgagccaccgacgugaagugggaggaccaggcggaaaucucugggaguucccccauccucuccaucaccaucagcgaggacggcuccaugagcaucaagaacgaggaggaggaacagacgcuaaccauccugauccggaccggccuccuagucaucuccgggcuguucccggugagcauccccauaaccgccgccgccugguaccucugggaggugaagaagcagcgcgccggcguccugugggacgugccaagcccgccacccguggggaaggcggagcucgaggauggcgccuaccguaucaagcagaagggaauccuagguuacucgcaaaucggcgccggagucuacaaggagggcaccuuccacacgauguggcacgugacccguggggccgugcugaugcaccggggcaaacgcaucgagccguccugggccgacguuaagaaggaccugaucagcuacgggggcggcuggaagcucgagggugaguggaaggagggcgaggagguccaaguacuggcgcuggaacccgggaagaacccccgggccguacagaccaaacccggacucuuuaagaccaauacggggaccaucggugccgugucccuggauuucagucccggcaccuccggcucucccaucguggaucgcaagggcaaggucguggggcuguacgggaacggcguggucacccggaguggugcguacgugagcgcuauugcccagacggagaaauccaucgaggacaaccccgaaaucgaggacgacauuuuccggaagaagcggcucaccaucauggaccugcaccccggggccgggaagaccaagagauaccugcccgcaauugugcgggaggccaucaagcgaggcuugcggacccucaucuuggcgccuacgcgcgucgucgccgcggagauggaggaagcccugcgugggcuccccaucagguaccagaccccagccaucagggcggagcacacgggcagagagaucguggaucuaaugugccacgccaccuucacgaugcgccuacucucgcccguacgcgugccgaacuacaaccugaucaucauggaugaagcccauuucacagacccagccaguaucgccgcgcgcgguuacaucucuacccguguagagaugggggaggccgcgggaauauucaugaccgccacgccgcccgggagccgugacccguuuccccagucuaacgcuccaaucauagacgaggagcgugaaauacccgagcgcagcuggaacuccggacaugagugggucacggauuucaaggggaagaccgugugguuugugccgagcaucaaggcgggaaacgacaucgccgccugccugcggaagaacggcaagaaggucauccaguugagccgcaagaccuucgacuccgaguacgugaagacgcggaccaacgauugggauuucguggucaccaccgacaucuccgaaaugggggcaaacuucaaagcggaacgcgugaucgaccccaggcgcugcaugaagcccguuauccugacggacggagaggagcgggucauccuggccgggcccaugccggugacccacucuuccgccgcccagcgucggggucgcaucgggcgcaaccccaagaacgagaacgaccaguacauauacaugggcgagccacuugaaaacgacgaggacugcgcccacuggaaggaggcgaagaugcugcuggacaauaucaacacccccgaggggauuaucccuagcauguucgaacccgaacgggagaagguggacgccaucgacggggaguaucgccuacggggcgaagcccgcaagacguucgucgaccuuaugcggcgaggcgaccuuccuguguggcucgccuaccggguggccgcggaaggcaucaauuaugccgaccgacguuggugcuucgacggggucaagaacaaccagauccuggaggagaacguggagguugagauauggacgaaggagggcgagcgcaagaagcugaagccgcguuggcucgacgcaaggaucuauagugacccccuggcccugaaggaguucaaggaguucgcggccggccggaaguccuugacccugaaccugaucaccgagauggggcgccuacccaccuuuaugacgcagaaggcccgcgaugcguuagacaacuuagccguccuccauaccgcggaggccggcgggcgcgccuacaaccacgcacuguccgagcugcccgagacccuggagacacugcugcuucugacguugcucgccaccgugaccggcggcaucuuccuauuccugaugagugggaaaggcgucggaaagaugacccucggcaugugcugcaucaucaccgcguccauuuugcugugguacgcgcagauccagccgcacuggaucgcagccucuaucaucuuggaguucuuccugaucguccugcuuauccccgagcccgagaagcaacggacgccccaagacaaccagcuuacuuacguagucaucgccauccuuacagugguugcggcgaccauggcgaacgagaugggauuuuuagagaagacgaagaaggaccugggccucggcagcgucgccacccaagagccggaguccaacauucucgacauagaccugcgcccggcuagcgcguggacccuguacgcgguggccacgacguucgugacccccaugcuccggcacuccaucgagaacagcuccgucaacgugagccugaccgccauagcgaaccaggcuaccgugcugauggggcucggcaaaggguggccccuguccaagauggacauuggggucccgcugcuggccaucgggugcuauucgcaagucaacccaaucacucuaacagcagcccuacuccugcugaucgcacauuacgccauuaucggccccggccuccaggccaaggccacccgugaggcccagaagcgggcggccgcggggaucaugaaaaaccccaccguugacgggaucacggucaucgaccuggacccgauccccuacgacccgaaguucgagaagcagcugggccaggugaugcuccuaauccugugcgugacccagguccucaugaugcgcaccacaugggcccuaugugaggcccugacgcucgcgaccggccccauauccaccuugugggaggggaacccgggccgcuucuggaacaccaccaucgccgugagcauggcaaacaucuuucggggcuccuaccuggccggggcgggcuugcuguucagcaucaugaagaacacgaccaauacacgcagagggacuggcaacauaggagagacccugggggagaaguggaaaagccggcucaacgccuuaggcaaguccgaguuccagaucuauaaaaaguccgggauccaggagguggaccggacccuggccaaggaaggaauuaagcgcggggagacagaccaccacgccgucagccggggcuccgccaagcuccgcugguucguggagcggaacauggucacucccgagggcaaggucguggaccuggggugcggccgcggagguuggagcuacuacugcgggggccugaagaacgugcgggagguuaaggggcucacgaagggcggccccgggcacgaggagcccauaccgauguccaccuacggguggaaccuggugcgccuccagagcgggguggacguguuuuucacgccgcccgaaaagugcgauacgcuccugugugacaucggcgaaaguucccccaacccuaccaucgaggcgggcagaacucugcgcgugcugucgcuuguggagaacuggcugaacaacgacacccaguucugcaucaaaguccucaaucccuacaugcccuccgugaucgagaagauggagacccuacagcguaaguauggaggggcucucguucgcaacccgcugagcagaaacuccacgcacgaaauguacugggucagcaacgccacugggaacaucguguccagcgugaacaugaucucccgcaugcucaucaacagauuuaccaugaagcacaagaaggccacguacgagcccgacgucgaccuagguagcggaacucgcaacauaggcauugagagcgagauccccaaccuggacaucaucggcaaacgcaucgaaaagauuaaacaggagcaugagaccucuuggcacuacgaccaagaccaucccuacaagacaugggccuaccacgguuccuaugagaccaaacagacgggcagcgcguccagcauggugaauggggugguaaggcugcugaccaagccgugggacguggugcccauggucacucagauggccaugaccgauacgacccccuucggccagcagcgcguguucaaggagaagguagacacccguacccaggagcccaaggagggcaccaagaagcugaugaagaucaccgcggaguggcucuggaaggagcuggggaagaaaaagaccccgcgcaugugcacacgggaggaguucacgcgcaaaguccgguccaacgccgcccugggugcgaucuucacagacgagaacaaguggaaguccgccagagaggccgucgaggacucccgguucugggagcucguggacaaggagcgcaaccugcacuuagaggggaagugcgagacgugcgucuacaauaugauggguaagcgggagaagaaguugggggaguuugguaaggccaaaggcagcagagcaaucugguacauguggcugggggcccgguuucuggaguucgaggcucucgguuuccugaaugaggaccacugguucagccgcgagaacucccugucuggugucgagggcgaagggcuccacaaacugggcuauauccugcgggacguauccaagaaggaagguggcgcaauguacgccgacgacaccgcuggcugggacacgcgcaucacccucgaagaucucaagaacgaggagauggucaccaaucacauggagggggagcacaagcgucuggccgaggccaucuuuaaacucacuuaccaaaacaaagugguccgcgugcagcgccccacgccccgcgggaccguaauggacaucaucucacggcgcgaucaacgcggguccggucaggucggaaccuacgggcugaacaccuuuacgaacauggaggcccagcuuauccggcagauggagggagaggggauuuuuaaaagcauccaacaccucaccgugaccgaagagaucgccguacaaaacuggcuggcgcgcgugggacgggagcgucugucccggauggcaaucagcggagacgacugcguggugaagccccucgacgaccgcuucgccagugcccugaccgcccugaaugacauggguaaggugcggaaggacauccagcagugggaaccgagcaagggcuggaaugacuggacccaaguccccuucugcucccaccacuuccacgaacucaucaugaaagacgggcgagugcuggucgugcccugccggaaccaggacgagcugauaggccgcgcgcggaucagccagggugccggcuggucccucaaggagacugccugccuggggaagucuuacgcccagauguggucccugauguacuuccaccgacgugaccuccgccuggccgccaacgcgaucugcagcgccgugcccucccacuggguaccgaccucucggaccaccuggaguauccacgccaagcacgaguggaugacgaccgaggacaugcugaccgucuggaaccgaguguggauccaggagaaccccuggauggaggacaagacccccgucgaguccugggaggagguccccuaccucgggaagcgggaggaccaguggugcggaagucugaucggacuuacaucgagggcgaccugggccaaaaacauccagaccgccaucaaccaggugcggagucuuauaggcaacgaggaguacaccgacuacaugccgagcaugaaacgguuccgacgggaggaggaggaggcagggguccugugguga

SEQ ID NO: 25380 - RNA, 9876 nt, Artificial Sequence
  derived and/or modified CDS sequence (opt11) from DENV-2__EU482665__SS-prME
agcgcuggcaugaucauuaugcugaucccuaccgugauggccuuccaccucaccacccgcaacggggagccccacaugaucgucgggauccaggagaaggggaagucccugcucuucaagaccgaggacggcgugaauaugugcacccucauggcgauggaccugggggaacugugcgaagacaccaucaccuacaaguguccccuccugcggcagaacgagcccgaggauaucgacugcuggugcaacucaaccagcacgugggugaccuacgguaccugcaccacgaccggcgagcaccgccgggagaagcgcucuguggcccuggugccccacguggggaugggccucgagacccggacggaaacguggaugucuuccgagggagccuggaagcacgcccagcgcaucgagaccuggauacugcgacacccgggcuuuacgaucauggcggcgauacuggcuuacaccaucgggaccacccacuuccaacgcgucuugaucuucauccugcucacggccguggcccccuccaugacaaugcggugcaucggcaucagcaaccgcgacuuuguggagggcgucuccggcggcaguuggguggacaucgugcucgagcacggcuccugcguuacaaccauggcuaagaacaagcccacccuggacuuugagcugaucaagaccgaggccaagcaacccgccacccuccggaaguacugcaucgaggccaagcugaccaauacgaccaccgagagccgcugucccacccaaggcgagccgucccugaaggaggagcaggacaagcgcuuugugugcaaacacagcaugguggaccgcggcuggggcaauggcugcggccuguucggcaagggcgggaucgucacgugcgccauguucacguguaagaagaacauggagggcaagaucgugcagcccgagaaccuggaauacaccaucguagucacgccccacagcggggaggagcacgcggugggcaacgacacagggaagcacggcaaggagaucaaagugaccccccagagcuccaucaccgaggcagagcugacuggauacggaaccgucacgauggagugcagcccccggaccggcuuagauuucaacgagauggugcugcuccagauggagaacaaggccuggcucgugcaucggcagugguucuuggaccugccccucccauggcugccgggugccgauaagcaggaguccaacuggauccagaaggagacccugguaacuuucaagaauccccacgccaagaaacaggacguagucgugcugggcucucaggagggggcgaugcacacagcccuaacaggcgccaccgagauccagaugagcuccgggaaccuucuguucaccggccaccugaagugccggcugcgcauggacaagcuccagcugaagggcaugucauauaguaugugcacugggaaguucaagguggucaaggagaucgccgagacccagcauggcaccaucguuauccgcgugcaguacgagggugauggcucucccugcaaaauccccuucgagaucauggaccuggagaagcgcuacguccucggcagacugaucaccguaaacccaaucgugacggagaaggacucccccgucaacaucgaggccgagccgcccuucggugacucauacauuaucaucggcguggagccgggccagcugaagcucaacugguucaagaagggcuccucgauaggccagauguucgagacgacaaugcgcggcgcgaagcgcauggccauccugggcgauaccgccugggacuucgggucccugggcgggguguucacgagcaucggcaaggcccuccaucagguauucggugccaucuacggcgcggccuucuccggcgugagcuggaccaugaagauccuaaucggggugaucauaacauggaucgggaugaacucccggagcaccucccugagcgucucccuggugcucguggggaucgugacacuguaccugggcguaauggugcaggccgacagcgggugcgucgugucguggaagaauaaggagcuaaagugcgggagcgggaucuucauaaccgacaacgugcacaccuggaccgagcaguacaaguuccaacccgagagcccguccaagcucgccagcgcgauucagaaagcccaggaggaggggaucugcggcaucagguccgucacgcgguuagagaaccucauguggaagcagaucacgccugagcugaaucauauccuggccgaaaacgaggugaagcucaccauaaugaccggggacaucaagggcaucaugcaggccggaaagcgcagccuucggccgcagcccacggagcugaaguacucauggaagaccuggggcaaggccaagaugcucucuacagaguccuacaaccagaccuuucuaaucgacggccccgagacggccgagugcccaaacaccaacagggccuggaacucucuggagguggaggacuauggcuucggcgucuucaccaccaacauuuggcucaagcugaaggagaaacaagacgccuucugcgauucuaagcugaugagcgccgccaucaaggacaaccgggcggugcaugccgacaugggguauuggaucgaguccgcgcucaacgacacguggaaaauagagaaggccagcuucaucgaggucaagaacugccacuggcccaagucccauacccuguggagcaacggcgucuuggaguccgagaugaucauccccaagaaccuggccggccccguaagccagcacaauuaucgcccgggguaccauacccagaucgcaggccccuggcacuuagggaagcuggagauggacuucgacuucugcgacggcaccaccgugaucgucacggaggacugugggaaccgggggcccucccuccgcacgaccaccgccagcggcaagcuaauuacggaguggugcugccggucaugcacccuacccccgcuacgauacagaggggaggacggcugcugguacgggauggaaauccgcccccugaaggagaaggaggagaaccuggugaacucccucgugacugccggucacggccagguggacaacuucucucugggcgugcucggcauggcccucuuccuggaggagaugcuacggacccgcguagggacgaagcaugcaauccuccuggucgccguguccuuugugacccuaaucaccggaaacaugagcuucaaggaccucgggcgggucguugugaugguaggcgccaccauggccgaugacaucgggaugggcgucacguacuuagcccugcucgcggccuucaaggugcgccccacuuucgccgccggcuugcuacuccguaagcugaccuccaaggagcugaugaugaccacgaucgggaucguccuccugagccagaguaccauucccgagaccgugcuggaguuaaccgacgcccuggcgcugggcaugaugguguugaagaucguccgcaacauggagaaguaccagcuggcugugaccaucauggccauccugugcgucccgaacgcuguaauacuccaaaaugccuggaaggugagcugcacaauccuggcggucguguccgugagcccccuccuccugaccuccagccagcagaagaccgacuggauaccucuggcccucacgaucaaggggcugaaucccaccgccaucuuccugaccacccucucccgcacgaauaagaagcggagcuggccucugaacgaagcaaucauggcggucggcauggugaguauccucgcgagcagccuccucaagaacgacauccccaugacaggcccccugguugccggaggccuacugaccguuugcuaugugcucaccggucgcagcgcugaccucgagcuggagcgggcaacggacgugaagugggaggaccaggcggagaucuccggcuccagccccauccuuucaaucaccaucagcgaggacggguccaugagcaucaaaaacgaggaggaggagcagaccuugacuauccugauccgcacggggcuguuagucaucuccggccuguuccccaucagcauccccauuaccgccgcggcaugguaccugugggaagugaagaagcagcgagccgggguguuaugggacguccccagcccgccgcccaugggcaaggccgagcuggaggauggggccuacagaaucaagcagaagggaauccugggguauagccagaucggagccgggguguacaaggaagggacauuucacaccauguggcacgugacucgcggcgcugugcucaugcacaaggggaaacgcaucgaacccucgugggcggacgucaagaaagaccugaucagcuauggcgggggcuggaagcuggaaggugaguggaaggagggggaggaggugcaaguucucgcgcuggaacccgguaaaaacccccgggccgugcagacgaaaccagggcuguucaagacgaacaccggcacaaucggcgccguaucccucgacuuuucgccagggacguccggcagccccaucaucgacaagaaggggaaaguaguagggcuguacgggaacggcguggucacucgcuccggggccuacgucagcgccaucgcucagacggagaaguccauagaggacaacccugagaucgaagaugacaucuuccggaagcgccggcugaccauaauggaucugcacccuggggcaggcaagacgaagcgcuaccuccccgccaucgugcgggaggccaucaagagagggcugcggacccugauccucgcgccaacucgcgucguggccgccgagauggaggaggccuuacggggccugccuauccgcuaccagacccccgccauccgggcagagcacacgggccgcgagaucguggaccucaugugccacgccaccuucaccaugcgccuacugagccccguccggguucccaacuacaaccuuaucaucauggacgaggcccacuucaccgaccccgccuccaucgccgcgcgcggcuauaucagcacucggguggagaugggggaggccgcugggaucuucaugaccgcgacgccgccuggcucaagagacccguucccccagaguaacgccccuaucaucgacgaggagcgggagauuccagagagaagcuggaacuccgggcacgaguggguaacggauuucaagggcaaaacggugugguucgugccaagcaucaaggcggggaacgacaucgcggccugcuugcggaagaacggcaagaaggucauccagcugucccgcaagaccuucgacagcgaguacgugaagacccguaccaacgauugggacuucguggucacgaccgauaucucugagaugggcgccaacuucaaggcggagcgaguuaucgacccucggcgcuguaugaagcccgugauucucaccgacggggaggaacgggucauccuggccggcccaaugcccgugacccacagcucggccgcccagcgccgugggcgcaucggacggaaccccaagaacgagaacgaccaguauauuuacaugggggaaccucuggagaacgacgaggauugugcccacuggaaggaggcgaaaaugcuucuggacaacaucaacacccccgagggcaucauaccgagcauguucgagcccgagcgggagaagguggacgccaucgauggcgaguaucgcuuacgcggggaggcccguaagaccuuugucgaccucaugcgccguggcgaccuccccguguggcuggccuacaaaguggccgcggaggggaucaacuaugccgacaggcgcuggugcuucgaugguaucaagaacaaucaaauccucgaggagaacgucgagguggagaucuggacaaaagagggggagcggaagaagcugaagccgcgcuggcuagacgcgcggauuuacucagacccucucgcccucaaggaguucaaggaauucgccgcgggucguaagucucugacccucaaccugaucacggagaugggccggcugcccaccuucaugacccagaagacccgagacgcccucgacaaccuagccguucugcacacggccgaggccggcgggcgggccuacaaccacgcccucuccgagcugcccgagacccuggagaccuuacuguuacucacccugcuggcgacggugacagggggcaucuuccucuuucugauguccggccgaggcaucggcaaaaugacgcuagggaugugcuguaucaucaccgccuccauccuccuuugguacgcgcagauccagccucauuggaucgccgccucaaucauucuggaguucuuucucaucgugcuccuuauccccgagcccgagaagcagcguacgccccaagauaaccagcucacguacgucguuaucgcuauccuuaccguggucgcagcgaccauggccaacgagaugggcuuccuggagaaaacaaagaaggauuuuggccucggcuccaucgcaacgcagcagccggagagcaacauccuggacaucgaucuacgccccgcauccgccuggacccucuacgcgguagccaccaccuucguaacccccaugcuacggcacagcauugagaacuccuccgucaaugugucccugaccgcuaucgccaaccaggcaacaguccucaugggucuggggaaggguuggccccugucgaagauggacaucggggucccgcuucuggcgaucggcugcuacagccaggugaaccccaucacccugacagccgcccuccugcuacucguggcccacuacgcgaucaucgggcccggccugcaggccaaggccacgcgcgaggcccagaaacgggccgcggccggcaucaugaagaaccccaccgucgacgggaucacugugauagacuuagacccgauucccuaugaccccaaguucgagaaacagcucgggcaggucaugcuacugauauuaugcguuacccaggugcuaaugaugcgcaccaccugggcucugugcgaggcccucacccuugccacggggcccaucagcacccugugggagggcaacccggggcgguuuuggaacacaacgaucgcggugagcauggccaacauuuuccgcgguucguaccucgccggcgcaggucugcuguuuagcaucaugaagaacacgaccaacacccggcgcggcaccgguaacauaggcgagacgcuaggcgagaaguggaagagucgccugaacgcccugggcaaguccgaguuccaaaucuacaagaaguccggcauacaggaagucgaccggaccuuagccaaggaggggaucaagcguggcgagaccgaccaucacgccgugagcaggggcagcgccaagcugcgcugguucguggagcggaauauggucacccccgaggggaaggugguggaccuagggugcgggcggggcggguggagcuauuacugcggaggccucaagaacguccgggaggucaagggccugacgaaaggcgggcccggccacgaagagccgaucccgauguccacauacgguuggaaccuggugcguuugcagucaggcgucgacguguucuucaucccgccugaaaagugcgacacccuccuaugugauaucggggaauccagcccuaaccccaccguggaggccggcagaacgcuccgcguccugaaccuaguggagaacugguugaauaauaacacgcaguucuguauuaaggugcugaaccccuauaugccuuccguaaucgagaagauggaggcgcugcagcggaaguacggcggggcccuggugcgcaacccgcucuccaggaacucaacccacgaaauguacuggguguccaacgccagcggcaacaucguauccagcgugaacaugaucucccgcaugcugaucaaccguuucaccaugcggcacaagaaggccaccuacgagcccgacguugacuuagggagcggcacacggaacauaggaaucgaguccgaaauccccaaccuggacauaaucggcaagaggaucgagaagaucaagcaagagcacgagaccagcuggcacuaugaucaggaccaccccuacaagaccugggccuaucacggcuccuacgagacaaagcaaacugguucggcguccagcauggucaacggcgugguucggcuguugaccaagccgugggacguccuccccaccguaacacagauggccaugacggacacuacuccguucgggcagcagcgcguguucaaggagaaggucgacacgcgcacacaggagcccaaggagggcaccaaaaagcugaugaagauaaccgcggaguggcuguggaaggagcucgguaagaagaaaaccccgcggaugugcacucgggaggaguucacccggaagguccgcuccaacgccgcgcugggggcuaucuucacggacgagaacaaguggaaaagugcucgggaggccguggaggacucccguuucugggagcuggucgacaaggagcggaaccuccaccuggagggcaagugcgagaccugcguguacaacaugauggggaagcgcgagaagaagcugggggaauucgggaaggccaaggggucacgggccaucugguacauguggcucggcgcgcgcuuccuggaauucgaggcucugggguuccucaacgaggaucacugguucuccagagaaaacagccuguccggcgucgaaggggaggggcugcacaaguugggguacauccuccgcgauguguccaagaaggagggcggcgccauguacgccgacgacaccgccggaugggauacccggaucacccuugaagaccucaagaaugaggagauggucacaaaucacauggagggcgaacacaagaagcuggccgaggccaucuucaagcugacguaccagaacaaggucgugcgcguccagagacccacgccccgggggaccgucauggacaucaucagccggcgcgaccagcggggcuccggccaggucgggacauacggccucaacacguucacuaacauggaggcgcaacuuauccgccagauggaaggggagggcguuuucaagaauauccagcaccuuaccgucaccgaggagguugcugugcagaauuggcucgcgcgggucggucgcgagcggcugucccggauggccaucuccggcgacgauugcguggugaagccccuggacgaccguuucgccaacgcacucacggcccuuaaugacaugggcaagauccggaaggacauccagcagugggagccgagcaagggguggaacgacuggacccagguccccuucugcucgcaccacuuccaugaacugaucaugaaagacggccgagugcuaguuguccccugccggaaccaggacgagcugaucggucgcgcgcggauuucacaaggcgccggguggucucuucgcgagaccgccugccucggcaagagcuacgcccagauguggagucugauguacuuccaccggagggaccuacggcuugccgcgaacgcaauaugcagcgccgugcccucccacugggugccgaccagcagaacgaccugguccauccacgccaagcacgaguggaugaccaccgaggacaugcugacugucuggaaccggguauggauccgcgagaaucccuggauggaggacaagacaccuguggagagcugggaggagauuccguaucugggcaagcgugaagaccaauggugcgggucccucaucggucugacaagccgcgcuaccugggcgaagaacauccaggccgccaucaaccaaguccggagucugaucggaaaugaggaguacaccgacuauaugccuucaaugaagcgcuuccggcgugaggaagaggaggccggcgugcuaugguag

SEQ ID NO: 25381 - RNA, 9876 nt, Artificial Sequence
  derived and/or modified CDS sequence (opt11) from DENV-2__EU482666__SS-prME
accgccggcgugaucauaaugcuuauccccaccgccauggcguuccaucucaccacccgcaacggggagccccacaugauugucggccgccaggagaaggggaagaguuuacuauucaagacagaggauggcgugaacaugugcacccugauggcgauugauuuaggggagcugugugaggacacgaucaccuacaagugcccgcuccugcgccagaacgaacccgaggacaucgacugcuggugcaacagcaccucuaccuggguuacguacgguacgugcacgaccacgggggaacaccggcgggagaagcgcuccguggcacuggugccccauguggggaugggacucgagacccgaacugagaccuggaugagcucagagggggccuggaaacacgcccaacggauugagacguggauccugcgccaccccggcuucaccaucauggcggccauccuggccuacacgaucgggaccacgcacuuccagcgggcccucaucuucauacuccugacugccguagcccccagcaugaccaugcgcugcaucggcauuuccaaccgcgacuucgucgagggcgucagcgggggguccugggucgacaucguucucgagcacggguccugcgugacuacuauggccaaaaauaagccuacauuggauuucgagcuuaucaagaccgaagccaagcagccugcgacccuccgcaaguacugcaucgaagcgaagcucacuaacaccaccaccgagucccggugcccgacccagggcgagccaagcuuaaacgaggagcaggacaagcgcuucgucugcaagcacuccaugguggaccgggggugggggaacggcuguggacuguucggcaagggcgggaucgugacuugcgccauguucacaugcaagaagaacauggagggaaagaucguccagccggagaaccuggaguacacaaucgugaucacgccccacagcggggaggaacacgccguaggcaacgacaccgggaagcacggcaaggagaucaagaucacaccgcaguccucgaucacagaggccgagcuaacaggguacgggacggucaccauggaguguagcccgagaaccggccucgacuucaacgaaaugguccuauugcagauggaggacaaggccuggcucguacaucggcagugguuccuggaucugccccuccccuggcugccgggcgcggacacccagggcagcaacuggauacagaaggagacgcuggucaccuucaagaacccacacgcaaagaagcaggacguggugguacucgggucccaggaaggcgccaugcacacugcccugaccggcgccaccgagauacagaugaguagugggaacuuacuauucacuggccaccuaaagugccgccugcggauggacaagcuacaacugaagggaaugucguacagcaugugcacgggcaaguucaagauaguaaaggagaucgcggagacucagcacgggacgauagucauccgcguacaguacgagggagauggcucacccugcaagaucccauucgagaucauggacuuggagaaacggcacgugcuugggaggcugaucacagugaacccgaucguuaccgagaaggacagccccgugaacaucgaggccgagccgcccuucggcgauucauacaucaucaucggggucgaaccuggccagcuuaaguugaacugguucaagaaggguaguuccaucgggcagauguucgagaccacaaugcgaggcgccaagcggauggccauucugggggacaccgccugggacuucgguagccucggcgggguguucacgucgaucggaaaggcgcuucaucaaguauucggggccaucuacggcgcggccuucagcggggucagcuggaccaugaagaucuuaaucggggcgaucaucacguggaucggaaugaauagucgcuccacuucccuguccgugagccuggugcucgucggcguuaucacccuguacuuaggggcaaugguccaagccgacuccggcugcguggugagcuggaaaaacaaagagcucaaaugcgguuccgguaucuucauaaccgacaacgugcacacguggaccgagcaguacaaauuccagccugagagccccucuaaguuagccucagcgauccagaaggcgcacgaggaagggauaugcgguauccggagcgucacccgccuggagaacuugauguggaagcagaucacuccugagcugaaccacauccuguccgaaaacgaggucaaguugacgaucaugaccggcgacaucaaggggaucaugcaggccggcaagcggagccugcgcccgcagcccaccgaauugaaguacucauggaagacauggggcaaggcaaaaaugcucucuacugagucccacaaccagaccuuccugaucgacgggcccgagaccgccgagugcccgaacaccaaccgggccuggaauagucuugagguggaagacuacggcuuugguguuuuuacgaccaacaucuggcucaagcuccgcgagaagcaagacguguuuugugacaguaagcugaugucagcagcuauaaaggacaaccgggccguccaugccgacaugggcuacuggaucgaguccgcccucaaugacaccuggaagauggagaaggcgagcuuuaucgaggugaaauccugucacuggcccaagagccacaccuuaugguccaacggcgugcuggagagcgagaugauaaucccaaagagcuucgccgggccggugagccagcacaacuacaggccgggcuaccacacacagacggcugggcccuggcaccuuggcaaguuggagauggacuuugacuucugcgaggguaccacugucguugugaccgaagacugcggcaaccguggccccagccugcguaccaccaccgcguccgggaagcucauuaccgaguggugcugccggagcugcacguuaccaccgcucagauaucggggcgaggacgguuguugguacggcauggagauccgcccccuaaaggagaaagaggagaaucuggucaauucccuagugacagcgggucacggccagauugauaacuucagccucggcguauuagggauggcccuguuccucgaggagaugcugcggacccgcguggguaccaagcacgccauacuguuaguagccguuuccuucaugacgcucaucacggguaacauguccuuccgggacuugggcagagucauggugauggucggggccaccaugacggacgacaucggcaugggcgugacguaccuagcgcugcuggcugccuucaagguacgccccaccuucgcggcagggcuccuccugcgcaagcugaccuccaaggagcugaugauggcgaccaucgggaucgcccugcuaagucaguccacuauccccgagaccauccuggagcugaccgacgcccucgcucuggggaugauggugcugaagaucaugcgcaacauggagaaguaccagcucgccgucaccauuauggcgaucagcugcguaccgaacgccguaauccugcagaacgcguggaaggucuccugcaccauacuggcugcggugagcguuaguccgcuccugcugacgagcucccagcagaaagccgacuggaucccccuggcccuaaccaucaagggccugaaccccaccgccauauuccucacgacccugagccggaccuccaaaaagcgcaguuggcccuugaacgaggcaauuauggcagucggcaugguguccauccucgccaguagccuguugaagaacgauauacccaugacggggccccuuguggccggcgggcugcuaacggucuguuacgugcucaccgggcggucugccgaccuggagcuggaacgcgccaccgaugucaagugggaggaccaggcggagaucagcggguccagucccauccucuccaucaccauuucugaggacgguuccaugagcauaaagaacgaggaggaagagcagacgcugaccauacugauccggaccgggcuacuggugaucuccgggcuguucccggugucuauccccaucacggcugcggcuugguaccuaugggaggugaagaagcagcgcgccgggguucugugggacgugccaagcccuccgccagucggcaaggcggagcuugaggacggcgccuaucggauaaagcagaaggggauccucggcuauagccagaucggcgcugggguguacaaggagggcaccuuccauacaauguggcacguuaccaggggggccgugcucaugcacaggggcaaacgcauugaacccuccugggcagacgugaagaaggaccugauuagcuacggggggggcuggaagcucgagggugaguggaaggaaggcgaggaagugcagguccuggcgcuggagcccgggaagaaccccagagccgugcagaccaagcccgggcucuuuaagaccaauacggggaccauuggugcagugucccuggacuucagccccggcaccuccgggagccccauuguugaccgcaagggaaagguggucgggcuguacggcaacggcguggugaccaggucgggggcuuacgugagcgcaaucgcccagacggagaaguccauagaggauaaccccgagaucgaggacgacaucuucaggaagaagaggcucaccaucauggaccugcaucccggcgccgggaaaaccaagcgcuacuugcccgcaaucguccgggaggcuauaaagcgcggccugcggacccucauccucgcgccgacgcgcgugguggccgccgagauggaagaagcacugcgcgggcuccccauccgguaccagacuccggccauccgcgcggagcacaccggccgagagauagucgaccugaugugucacgccaccuucacgaugcggcuguuguccccaguucgggugccuaacuacaaccugauuaucauggacgaggcccacuucacagacccagccagcauugccgcgcgcggcuacauuucaacgcgggucgagaugggggaggcggccggaaucuuuaugaccgccacgccgcccgggagccgcgacccauucccccaguccaacgcgcccaucaucgacgaagaacgggagaucccggagcgaagcuggaacuccggccacgagugggucaccgacuuuaaggggaaaaccgugugguuuguccccagcaucaaagcgggcaaugacaucgccgccugccugcguaaaaacggcaagaaagugauccagcucucccgcaaaaccuucgacagcgaauacguaaagacgcggaccaacgauugggacuucgucgugaccaccgacaucuccgagaugggggcuaacuucaaagcggagcgcgugauugacccccggagaugcaugaagcccgugauccugacggacggcgaagagcgggugauccucgccgggcccaugccggugacccauagcuccgccgcccagcgccggggcaggaucggacgcaacccgaagaacgagaacgaucaguacaucuacaugggggagccacucgagaacgaugaggacugcgcccacuggaaggaggcgaagaugcuucuggacaacaucaauaccccggagggcaucaucccguccauguucgagcccgagagagaaaaggucgacgccauugacggggaauaccgccucagaggagaagccaggaagaccuucguggaccugaugcggaggggggaccugcccguguggcucgccuaccgggucgcagcggagggcauaaacuacgccgaccgccgcuggugcuucgacggggucaagaacaaucagauuuuagaagaaaacguugaggucgagaucuggacgaaggaaggcgagcgcaagaagcugaagccgcgguggcucgacgcccgcaucuacuccgauccgcuggccuuaaaggaguuuaaggaguucgcggccgggcggaagagccucacccuuaaccugaucaccgagauggggcgccuccccaccuucaugacgcagaaggcccgggacgcccuggacaaccucgcggugcuccacaccgcggaggccggggggcgcgccuacaaucacgcccuauccgaacugcccgagacccucgaaacccucuuacuccugacgcugcucgccaccgugaccggcggcauuuuccuguuccugaugagcgggaagggcgucgggaaaaugaccuuaggcauguguuguaucaucacugcguccaucuuacugugguaugcgcagauacagccgcacuggaucgccgccucgaucauucucgaguucuucuugauuguguuacuaauccccgagcccgaaaagcagcggacgccgcaggacaaucagcugaccuacgugguuaucgccauccuaaccgucgucgcggccaccauggccaacgagaugggguuucucgagaagacgaagaaagaccugggccugggcagcaucgccacccaggagccggaguccaauaucuuggacaucgaccuucguccugccucugcguggacccuguacgcaguggccacuacguucgucacucccaugcuccgccacucuaucgagaacagcuccgucaacguuagucugaccgccaucgcgaaucaggccaccguccuuauggggcuuggaaagggguggccccuguccaagauggacaucgguguaccgcugcucgccaucgggugcuacagccaggugaaucccaucacucugacugccgcccuccuccugcucauagcgcauuaugcaaucaucggccccggccuccaagccaaagccacccgcgaggcccaaaaacgcgcggccgcggggaucaugaagaacccuaccguggacggaaucacggucaucgacuuagauccgauccccuacgaccccaaguucgagaagcagcuggggcaggugaugcugcugauccugugcgucacacagguccugaugaugcgcaccaccugggcccugugugaggcccugacgcucgcgacgggcccgaucuccacccugugggaagggaauccgggccgcuucuggaacacuacgauugccguaagcauggccaacauuuuccgaggauccuacuuagccggcgcgggccuccuguucagcauuaugaagaauaccaccaauacccgccgggggacggggaacaucggcgagacccugggagagaaguggaaguccagacucaacgcccucgggaagagugaguuucagauauacaagaaguccgggauccaggagguggaucggacccuggcaaaggaggggaucaagcgaggggagaccgaccaccaugcugucagccggggcuccgcaaagcuccgcugguucguggagcggaauauggugacacccgagggcaaaguaguggauuuaggaugugggcgcgggggcuggagcuacuacugcgggggccucaagaaugugcgggaagucaagggccucaccaagggcggccccgggcacgaggagcccaucccgauguccaccuacggauggaaccugguucgccuccagagcgggguggacguguucuucacgccaccagagaagugcgacacgcuucugugcgacauaggcgagagcucccccaacccgaccaucgaggcgggccggacccugcgcguuuuaucccugguggagaacuggcugaacaacgacacccaguuuugcaucaagguccuaaaucccuacaugcccucagugaucgagaagauggagacccuacagcggaaguauggcggcgcgcuugugcgcaacccccuaagcagaaacuccacacacgaaauguauugggucagcaacgcgaccgggaacaucguguccucuguaaacaugaucucgcgcaugcuuauaaaccgguucaccaugaagcacaagaaggccaccuaugagcccgacgucgaccuggggagcgggacgcguaauaucggcauagaguccgagaucccgaaucucgacaucaucgggaaacgcaucgaaaagaucaagcaggagcacgaaaccaguuggcauuaugaccaggaccaucccuacaagaccugggccuaccacggcuccuacgagacuaagcagacgggcucugcguccucuaugguuaaugggguggucagacucuugaccaaaccgugggacguggugcccaugguuacccaaauggccaugacugacaccacccccuucggccagcagcgcguguuuaaggagaagguggacacccggacccaggagcccaaggagggcacgaagaagcugaugaagaucaccgccgaguggcucuggaaggaacuggggaaaaaaaagaccccacgcaugugcacccgggaggaguucacgcgaaagguccgguccaacgcggccuugggcgcgaucuucaccgacgagaacaaauggaagucagcccgugaggccguagaggacucccgguucugggaguugguggacaaggagagaaaccugcaccucgagggaaaaugcgagaccugcgucuacaauaugaugggcaagcgagagaagaagcucggggaguuuggcaaggccaagggcagccgcgcgaucugguauaugugguugggggcccgguuccuggaguucgaggcgcucggcuuccugaaugaggaccacugguucagccgcgagaacucccucaguggggucgagggcgaaggguugcacaaguuaggcuacauccugcgugacguguccaaaaaggagggcggggcgauguaugcugacgacaccgcgggcugggacacgcgcauuaccuuggaagaccuaaagaacgaagagauggucaccaaccacauggagggggagcacaagcgacuugccgaggccaucuucaagcucaccuaccagaacaagguggugaggguccagcggcccacaccccgcgggacaguaauggacaucaucagccggcgcgaccagcgcgggaguggccaggucggcacauaugggcugaacaccuucacgaacauggaggcgcagcuaauccggcagauggaaggcgaggggaucuucaagagcauccagcaucucaccgugaccgaggagaucgccgugcagaacuggcuggcccgcgucggucgcgagcgcuuaucccggauggcaaucagcggugacgacugcguggucaagccccucgacgacagguucgccuccgcucugaccgcucuuaacgacauggggaaaguccgaaaggacauccagcagugggagccgagcaaaggguggaacgacuggacgcaggugccuuuuugcucccaccacuuccaugaauuaauuaugaaggaugggcgcgugcugguagugccgugccggaaucaagacgagcugaucggccgcgcgcggaucucacagggugcuggguggucccucaaggagacagcuugccuggggaagaguuacgcacagauguggucccugauguacuuccaccggcgggaccuccgccuagccgcgaaugcgaucugcagcgccgugcccucacacugggucccgaccagucggacaaccugguccauccacgccaagcaugaguggaugacgaccgaggacaugcuaaccguguggaaucgcguguggauacaagagaaccccuggauggaggacaagacccccgucgaguccugggaggaggugcccuacuugggaaagcgggaagaucagugguguggcagccugaucggguugacaucccgcgcgaccugggccaagaacauucagacagcuaucaaccaggugcggagucucaucggcaacgaagaauacaccgacuacaugccguccaugaagcgauucagacgggaggaggaggaggccggcguccugugguga

SEQ ID NO: 25382 - RNA, 9876 nt, Artificial Sequence
  derived and/or modified CDS sequence (opt11) from DENV-2__EU482667__SS-prME
agcgcggggaugaucauuaugcugauccccaccgugauggcauuccaccucacgaccaggaacggggagccccacaugaucgugggaauccaagagaaggggaaaagucugcuuuucaagaccgaagacggcgucaacaugugcacccuaauggcgauggaccugggggagcugugcgaggauaccauuaccuacaaguguccacuccugcggcaaaacgagcccgaagacaucgacugcuggugcaauagcacguccaccuggguaaccuacgggacgugcaccacgaccggagaacaccgccgggagaagcguucagucgcacuggugccacacguggggauggguuuagagacgcggaccgaaaccuggauguccagcgagggggccuggaagcacgcacaacgcauagagaccuggauccugcggcauccgggcuuuacgaucauggccgcgaucuuggcguacaccaucgggacgacacacuuccaacgcguacuuauuuucauccugcugacagccguggcacccuccaugaccaugcgcuguauugggaucagcaaccgcgacuucguggagggugucuccggaggcagcuggguggacaucguucuagagcacgguuccugugucacaaccauggcgaagaacaagcccacucuggacuucgaacugaucaagaccgaagcaaagcagcccgcgacacuccggaaguacugcaucgaggccaaacugaccaacacgaccaccgagagccgcugucccacccagggcgagcccagccuuaaggaggagcaagacaagcgguucgugugcaagcacagcaugguggaccgcggaugggguaacggcugcggcuuguucggcaagggcgggaucgucacaugugccauguucacguguaagaagaacauggagggcaaaaucgugcagccggagaaccuggaguacacgaucguggucacgccccacuccggggaggaacacgcggugggcaacgauacggggaagcacggcaaggaaaucaaggugaccccgcagucauccaucaccgaggccgagcugaccggguacgguacagucacgauggagugcagcccgagaaccggccucgauuucaaugagauggugcugcugcaaauggaaaacaaagcuuggcucgugcaccgccagugguuucuggauuugccccuccccuggcugccgggggccgauaagcaggaauccaauuggauccagaaggaggcccugguaaccuucaagaacccccacgcgaaaaagcaagacguggucguucucggcagucaggagggggccaugcacacagcccuuacaggagcgaccgagauccagaugucauccgggaaccuccucuucaccggccacuuaaagugccggcugcgcauggauaagcuacagcugaaggguaugagcuacucuaugugcacagggaaguucaagguggucaaagagaucgcagagacacaacacgguacuaucgugaucaagguacaguacgagggggacggcagccccugcaagauacccuucgaaaucauggaccuggagaagcgauacguccucggacgccugaucaccgugaacccuauagugacagaaaaggacucccccgucaacaucgaggcggagccgcccuucggggacagcuacaucauaauaggcgucgaaccugggcagcugaagcuuaacugguucaagaagggcuccagcaucgggcagauguucgagacgaccaugcggggcgccaaacgcauggccauccuuggcgacaccgccugggauuucgggucccuaggcgggguguucaccucgaucggcaaagcguugcaccaggucuucggggcgauauauggcgccgccuucucaggcgugagcuggacgaugaagauccugauuggcgugaucaucaccuggaucggcaugaacucacgcagcaccucccugagcguaaguuuagugcuuguggggaucgucaccuuauaccugggcgugauggugcaggccgacagcgggugcgucguguccuggaagaacaaggagcucaagugugguucaggcaucuucauaacggacaacguccauaccuggacggagcaguacaaguuccaaccagagagccccaguaaauuagcauccgccauccagaaggcccaggaggaggggauaugcggaauccgguccguuacccgccuggagaaccucauguggaagcaaauuacgcccgaguuaaaccacauccuggcagagaacgagguuaaacugaccaucaugaccggggacaucaaaggcauuaugcaagccgggaagcgaagccugcgcccgcagccuaccgagcugaaauacuccuggaaaacguggggaaaggcgaagaugcucagcaccgagaguuacaaccagaccuuccuuaucgacggucccgagaccgcggaaugcccgaacacgaaccgggccuggaacagccucgagguggaggacuacggguucggcgucuuuacaacuaacaucuggcucaagcugaaggagaagcaagacguguucugcgacuccaagcugaugagcgccgcaauuaaggacaaccgcgcagugcacgccgacaugggguauuggauugaguccgcccucaacgacaccuggaagaucgagaaggccagcuucaucgaggucaagaacugucacuggccgaaaucccacacgcuguggagcaacggcgugcuggagagcgagaugaucaucccuaaaaaccucgccggaccugugagccaacacaacuaccggcccggguaucacacacagaucgccggccccuggcaccuuggcaagcuggagauggauuucgacuucugcgauggcaccacggucaucgugaccgaggacugcgggaaccgugggccgucucuccggacgaccaccgcuagcggcaagcugauaaccgaguggugcugucgcagcugcacgcuacccccgcuccgcuacaggggcgaggacggcugcugguacgggauggagauacgcccgcuuaaggagaaggaggagaaccuggugaacucccucgugaccgcaggccacgggcagguggacaacuucucacugggcgugcugggaauggcccucuucuuggaggagaugcugcgaacccgggucgggaccaaacacgcgauccuccuuguggccguguccuuugucacacugaucaccggcaacaugagcuucaaagaccucgggcgaguaguggucauggugggcgccaccauggccgacgacauugggaugggcgugacuuaucuggcccuacucgcggccuucaaagugagacccacuuucgcagccgggcugcuguugcgcaaacugaccuccaaggagcugaugaugaccacaaucgggaucgugcucuuaagccaguccaccauccccgagacaguacuggagcucaccgacgcccuggcucugggcaugaugguccucaaaauugugcggaauauggagaaguaccaacuggcugucaccaucauggcuauccuguguguuccgaacgccgugauccuccagaacgcauggaaggucagcugcacgauacuggcagugguuuccgucagcccccugcugcuuacgaguagccaacagaagaccgacuggaucccccuugcuuugaccaucaagggguugaacccaacugccaucuuccugaccacccugucgcgcaccaacaaaaagcgcagcuggccgcugaacgaagccauaauggcggucgguaugguguccauccuggcaagcucccuccugaagaacgauauccccaugacuggccccuugguugcgggcggacuccugaccgugugcuaugugcugacagggcggagcgccgaccucgaguuagagcgcgccaccgacguaaagugggaggaccaggcugagauuuccggcagcagccccauccuguccaucacuauaagcgaggacgguuccaugagcaucaagaacgaagaggaggagcagacacucaccauccugauacggaccggccuguuggucaucuccggccuguuuccgaucucgauacccauaacagccgccgccugguaccucugggaaguaaagaagcagcgcgccgggguacucugggacgugcccaguccaccgcccaugggcaaggcggagcuggaggacggugccuaccggaucaagcagaagggcauccuuggauacucccagaucggcgccggcguguacaaagaggggaccuuccauacgauguggcacguuacacgcggcgccgugcuuaugcacaaggguaagcguauagagcccagcugggccgacgugaagaaggaccugauuagcuauggcggcggcuggaagcuggagggcgaguggaaggagggggaggaggugcaggugcucgcgcuggagccgggcaaaaacccccgcgccguacaaaccaagcccggccucuucaaaacgaacaccggcaccaucggagccguuucccuggacuuuucgcccgggaccuccggcagccccaucauagacaagaaggggaaaguagugggccuguacggaaacggugucgugacgcgguccggcgccuacgugucggccauugcgcagaccgagaaguccaucgaggacaauccagagauugaggacgacaucuuccgcaagaggcgucugaccauaauggauuuacacccaggagccggcaagaccaagcgguaccuccccgcgauugugcgcgaggccauaaaacggggucugcgcacgcugauccucgcgccgacccgagugguagccgccgagauggaggaagcccugaggggacuucccauucgguaucagacgcccgccauccgcgcggagcacacggggcgggagaucgucgaccucaugugccacgcuacguucaccaugcgccugcugagccccgugcgcgugccuaacuacaaccucaucaucauggacgaggcccacuuuacagaccccgcaucgaucgcagcccggggcuacaucagcacucgcgucgagaugggagaggccgccgggaucuuuaugacggcgacgccaccaggcagccgggacccauucccccaguccaacgcccccaucaucgacgaggagcgcgagauaccggagagaagcuggaacucuggacacgaauggguaaccgacuucaagggcaagaccgugugguucgucccgagcaucaaggcggggaacgacauagccgccugccugcggaaaaacggcaagaagguaauccagcugucuaggaagacguucgauagcgaguacguaaagacgcgcaccaacgacugggacuuugucgugacgacggauauauccgagaugggcgcaaacuucaaggcggaacgggugaucgacccccgccgguguaugaagccggucauucuuaccgacggcgaggagcgcguaauucuggcaggcccgaugccggugacucacagcuccgccgcacaacggcgcggacggaucggccgcaaccccaagaacgagaacgaccaguacauauacaugggggagccucuggaaaacgacgaagacugcgcccacuggaaggaagcuaagaugcuccuggacaacauuaacaccccagagggcaucaucccuagcauguucgaaccugagcgggaaaaggucgaugccaucgauggggaguaccgccugcguggggaggcucggaagacguuuguggaccucaugcggcguggcgaccugcccgugugguuggccuacaaaguagccgcagaggggauuaacuacgcugaccgccgguggugcuucgacgggaucaaaaacaaccagaucuuggaggagaacguugaggucgagaucuggacaaaggagggagagcgcaagaagcuuaagccgcggugguuagacgcucgcauuuacuccgaccccuuagcuuuaaaggaguucaaagaguucgccgcgggccggaagagucuaacccucaaucugaucacagagaugggccgccugcccacguucaugacccagaagacccgagacgcucucgacaaccuggccguucugcacaccgccgaggccggcggucgagccuacaaccacgcucuuuccgagcuaccggagacgcuggaaacccuccuccugcucacucuucucgcaaccguaaccggcgggaucuuccucuuccugaugagcgggagagggaucggcaagaugacccuugggaugugcugcauuaucaccgccuccauacuccugugguacgcgcagauacaaccgcacuggauagccgcgucaauuauucuagaguucuuccucaucguccugcuaauccccgagcccgagaagcagcgaacuccccaagacaaccaacucacauaugucgugaucgccauucugacggucguggcagcgaccauggccaacgagaugggcuuccuggaaaagaccaagaaagacuucggccucggcucuaucgccacccagcagccggagucgaacauccucgacauugaccucagacccgccagcgccuggacgcucuacgcgguggcaaccacguuugucacacccaugcucagacacagcaucgaaaauuccuccgugaacguguccuugacggccaucgcaaaccaggccacgguccucaugggccuggggaagggcuggccccuguccaaaauggacaucggggugccacucuuggcgaucggcugcuacagccaagugaaccccaucacccuuaccgccgcccuccuucuccucgucgcccacuacgcgaucaucgggcccggccuccaggcaaaggccacgcgggaggcccagaagagagccgcggccggcaucaugaagaauccgacuguggacgggauuaccgucauugaccuggacccgaucccauacgauccaaaguuugagaagcaacucggacagguuaugcugcuuauccucugcgugacccagguucugaugaugagaacgaccugggcgcugugcgaggcccuuacccuggcaaccggacccaucuccacgcugugggaaggcaacccgggaagauucuggaacacuacgaucgcggucuccauggccaacaucuuccggggcuccuaccucgccggcgccgggcuguuauucagcaucaugaaaaacacaacuaauacccggcgaggcaccggcaacauuggcgaaacccuaggggaaaaguggaaguccaggcugaacgcacuggguaaaucggaguuucagaucuacaaaaagucaggcauccaggaaguggaccgcacucucgcgaaggagggaaucaagcggggcgaaacggaccaucacgccguaagucgcggguccgccaagcugaggugguucguggagcgcaacaugguaacccccgaggggaaggugguugaucuuggcugcgggcgaggaggguggucauacuacugcggcgggcucaagaacgucagggagguaaagggccugaccaagggcgggcccggccacgaagaacccaucccgaugucuacguacggguggaaccuuguucgucuacaaagcgguguggacguguuuuucaucccccccgagaagugugacacccugcugugcgacaucggagagucaagccccaauccuaccgucgaggcgggccgcacgcuccgcgugcugaaccugguggagaacugguugaacaacaacacgcaauucuguauaaagguccugaaccccuacaugccuuccgugaucgagaaaauggaggcgcugcagcgaaaauacgguggugcgcuugugcggaauccgcucucgaggaacaguacccacgagauguacugggucuccaaugccuccggcaacaucguuuccagcgugaacaugaucucgcggauguugaucaaccgcuucaccaugcggcacaagaaggccaccuacgaaccagacgucgaccuggggucagguacccgaaacaucggaaucgaguccgagauccccaaccuggacaucaucggcaagcggaucgagaagauuaagcaggagcaugaaacaagcuggcacuacgaccaagaucacccauacaagacaugggccuaccacggauccuacgagaccaaacaaacagggagcgcauccagcaugguuaacggcgugguuaggcugcugacgaaaccgugggacgugcuccccaccgugacccaaauggccaugacggacacgacccccuuugggcagcagcguguuuucaaggagaaaguggacacgaggacccaagagcccaaagagggcacgaagaagcuaaugaaaauuaccgcggaguggcuguggaaagaacucggcaagaagaaaacaccgcguaugugcacccgcgaggaguucacucgcaaggugcgguccaacgccgcgcugggggcgauuuucaccgacgagaacaaguggaaguccgcccgcgaggccgucgaggacucccgauucugggagcugguugacaaggagcgcaaccuccaccuggaggguaagugcgagaccugcgucuacaacaugauggggaagcgugagaagaagcugggcgaguucgggaaggcuaagggcagccgggccauuugguacauguggcucggcgcgcgguuccuggaguucgaggcccugggguucuugaacgaggaccacugguuuucccgcgagaacagccugucuggcguggagggggagggccugcacaagcugggguauauucugcgggacgugucgaaaaaggagggcggcgccauguaugccgacgacacggcggggugggacacccgaaucacccuggaggaccucaaaaacgaggaaauggucaccaaccacauggagggcgaacacaagaaguuggccgaggccaucuucaagcugaccuaccagaacaagguggugaggguccaacgccccacaccccgggggaccgugauggacaucaucucacgccgggaucagcgaggcaguggccagguuggcaccuauggccucaacacguucacuaacauggaggcccaacugauccggcaaauggagggagagggcgucuucaagaauauucagcacuuaacagucaccgaggagguggcuguccagaacuggcuugcucgcguagggcgcgagaggcugagccgcauggccaucuccggggacgacugcgucgugaagccacuagaugacagguucgccaacgcccucaccgccuugaacgacaugggcaagauucgcaaggacauccaacagugggagccuagcaagggguggaaugacuggacgcagguccccuucugcucccaccacuuccacgaacugaucaugaaggauggcagagugcucgucgugcccugccgcaaccaagacgagcugaucggacgggcgcgcauuagccaaggcgcuggcuggucccuuagggagaccgccugccucgggaagagcuacgcucagauguggucccugauguacuuccaccgacgggaucugcgccuugcagccaacgcuaucugcagcgccgugcccucccacuggguaccgacuucccggaccacguggucaauccacgccaagcacgaguggaugacuaccgaggauaugcugacggucuggaaccgagucuggauaagagagaacccuuggauggaggauaagaccccagucgagucgugggaggagauacccuacuuggguaagcgcgaggaccaauggugugggucccuuaucggccugacgucgcgggccaccugggcaaaaaacauucaggccgccauaaaccaaguccgcucccuuaucggcaaugaggaguacacagacuacaugccgagcaugaagcgguuuagacgggaggaggaagaggccggagugcugugguga

SEQ ID NO: 25383 - RNA, 9876 nt, Artificial Sequence
  derived and/or modified CDS sequence (opt11) from DENV-2__EU482668__SS-prME
uccgcggggaugaucaucauguugaucccgaccgugauggccuuccaccucaccacccgcaauggugaaccgcacaugaucguggggauccaggagaaggggaaaucccugcuguuuaagaccgaggacggcgugaacaugugcacccuuauggcuauggaccugggggagcugugcgaggacaccaucaccuacaagugcccccuccugcggcagaaugaacccgaggacaucgacuguuggugcaauagcaccucgaccugggugaccuacgggaccugcaccacgaccggggagcaccggcgggagaagcggagugucgcccuggugccccauguggggaugggucucgagacgcggaccgagacuuggaugucaagcgaaggggccuggaaacacgcacagcgcauugagaccuggauccugcggcacccaggauucacgauuauggcugcgauccuggccuacaccaucggcaccacccacuuucagcggguccucaucuucauacugcugacggccguggcaccauccaugaccaugcggugcaucggcauuagcaaucgcgauuucguggaaggcguguccgggggcagcuggguggauauugugcucgaacacggauccugugucaccaccauggcgaagaacaagcccacgcucgacuucgaacuaaucaaaaccgaggccaagcagcccgccacccuccggaaguacuguauugaggccaagcugacgaacacgaccaccgagagccguugccccacccaaggugaacccucccugaaggaggagcaggacaagcgauucgugugcaagcacucaaugguggauaggggaugggggaacggcugcggccuguucggcaagggcgggaucgugacgugcgccauguuuacgugcaagaagaauauggagggcaagaucguccagccagaaaacuuggaguauaccaucguggucacgccccauuccggggaggagcaugcgguggguaacgauacggggaagcacggaauggagaucaaggugaccccacagagcagcauuaccgaggcggagcucaccggguacggcacugucacaauggagugcagcccucggaccggccucgacuucaacgaaauggugcugcugcagauggagaacaaggcuuggcucgugcacagacagugguuccuggaccuaccucuccccuggcugccaggggcggacaagcaagaguccaauuggauccagaaggagacccuggucacuuucaagaacccccacgccaaaaagcaagaugucgucgugcucggcagccaggagggcgcuaugcacacggcccugaccggggccaccgagauccagauguccuccgggaaccugcuguucaccggccaccugaagugccgcuuacguauggauaagcuccagcugaaggguaugagcuacuccaugugcacggggaaauucaagguggucaaggagaucgccgaaacccaacacggcaccaucguuauacgggugcaguaugagggggacggcagccccugcaagauccccuucgagauaauggaccuggaaaagcgcuacgucuuaggccggcugauuacugugaauccuaucgugacggaaaaggacucccccguuaacauugaggcggagccgccauucggggacagcuacaucauaaucgguguggagccgggucagcugaaacucaacugguuuaagaagggauccagcaucggccagauguucgagaccaccaugcgcggcgcuaagcgcauggccauccucggcgacaccgcgugggacuucgggucccugggcgggguguucacuagcaucggcaaggcgcuccaccaaguguucggggcuaucuacggagcggcguucuccggagugagcuggaccaugaagauacugaucggggucauuauuacauggaucggcaugaacucccggucgaccucccugagcgucucgcuggugcucguggggauaguaacacuguaccugggcgugauggugcaggcagacuccgggugcgucguuuccuggaaaaacaaggagcuuaaaugcggcuccgguauuuuuaucacggacaacgugcacaccuggaccgagcaguacaaguuccagcccgagagcccgucuaagcuggccagcgcgauccagaaggcccaggaggaggggaucuguggcauacgcuccgucacccggcuggagaaccuuauguggaagcagaucacaccggagcugaaccacauacuggcggagaacgaggugaaacuaaccaucaugacuggggacauccgggguaucaugcaagcggggaagcggagccuucgaccgcagcccacggaacugaaguacuccuggaagacguggggcaaggccaagaugcucucaaccgaguccuauaaccagaccuuccugaucgacggccccgagacggcggaguguccgaacaccaaccgggccuggaauagcuuagagguagaggacuacggguucggcgucuucacuaccaauauuuggcucaagcugaaggagaagcaggacgccuuuugcgacucgaagcucaugagcgccgccauaaaggauaaccgcgcggugcaugccgacaugggguacuggaucgaguccgcacucaacgacacauggaagaucgagaaagccagcuucaucgagguuaagaauugccauuggcccaagucccacacccuauggagcaacggcguccuggaguccgaaaugauaauccccaagaaccucgccggcccugugagccagcacaacuaccggccaggguaccacacccagaucgcuggccccuggcacuuggggaaacuggagauggacuucgacuucugcgacggcacuaccgugauugucacggaggacugugguaaccgcggccccucccuccgaaccaccaccgccagcggcaagcugaucacggaguggugcuguaggucauguacccugcccccgcuccguuaccgcggugaggacggcuguugguacggcauggagauccguccccugaaggagaaggaagaaaaccuggugaacucccuugugacugccggccacgggcaagucgacaauuucucacugggcgugcugggaauggcccucuuccuggaagagaugcuccgcaccaggguggggacgaagcaugcgauccuccuggucgccgugaguuucguuacuuuaaucacuggcaacaugucauucaaggacuuggggcgcgucgugguuauggucggugcaaccauggcggacgacaucgguaugggcgugacguaccuggcccugcucgcugcauucaaggugaggcccaccuucgccgccggucugcugcugcgaaaguuaaccuccaaggagcugaugaugaccacuaucgggaucguccuacugagccaguccaccauccccgagaccgugcuggaacucaccgacgcucuggcgcuggggaugauggugcucaagauaguacgcaacauggagaaguaucaacuggccguuacgaucauggccauccuaugcgucccaaacgcggugaucuugcagaacgccuggaagguguccugcaccauccuugcggucguaagugucagcccacuucucuugaccuccagccaacaaaagaccgacuggaucccccuggcgcucacgaucaaggggcugaaucccaccgccaucuuccugacuaccuuguccaggacgaauaagaagcgcucuuggccgcugaacgaggccauaauggcggucggcaugguauccauccuggccagcucccugcugaaaaacgacauccccaugaccggccccuuagucgccgggggcuugcugacugucuguuacguguugacggggagaagcgcugaccuagagcuggaaagggccacggacguaaagugggaggaccaggcggagaucuccggcagcagcccuauccuuuccauuaccauuagcgaggauggaucaaugagcauuaaaaacgaggaggaggaacagacccucaccauccugauccggacgggcuugcucgucaucagcggccuguucccgauaagcauccccauuaccgccgcugccugguaccugugggaggugaaaaagcagcgcgccggagugcucugggacguccccagcccaccucccaugggcaaggcugagcuugaagacggggcguaccggauaaaacagaagggcauucugggguacagccagaucggcgcugguguguacaaggaagggaccuuucacaccauguggcacguuacccgcggagcuguccucaugcauaaggggaagcgaaucgagcccuccugggccgacgugaagaaggacuuaaucucauacggcgggggcuggaagcucgagggcgaguggaaagagggggaggagguucagguccucgcgcuagagcccgggaaaaacccgcgcgccgugcaaaccaagcccggccuuuuuaagaccaacaccgguacgauuggcgcagugaguuuagauuucagcccuggcacguccggcucaccaauaaucgacaaaaaggguaaggucgugggcuuauacgggaacggcguggucacucgcucaggcgcauacguguccgccauugcgcagaccgagaagaguaucgaagacaaccccgagaucgaagacgauaucuuccgcaagcgaagacugacuauaauggaccuccaccccggggccggaaagacgaagcgguaucuccccgccaucguucgcgaggccaucaagcggggccugcgcacccugauccucgcgccgacccgaguggucgccgcggagauggaagaggcucugcgcggccuucccauacgguaucagacacccgccauccgugcggagcacacggggcgugagauugucgaucuuaugugccaugcgacuuucacuaugcgucuguuaagccccguccgcgugccgaacuacaaccucaucaucauggaugaggcacacuucacggaucccgccuccauagccgcgagaggcuacauauccacccgcguugagaugggcgaagccgcggggaucuucaugaccgccacuccucccggcagccgagacccguucccccaguccaacgcccccauaaucgaugaagagagagagaucccggagcggagcuggaacuccgggcacgagugggucacagacuucaagggcaagacggugugguucguuccgagcauaaaggccgggaacgacaucgcagccugccugcgcaagaacggcaagaaggucauccagcugagucggaagaccuucgacagcgaauacgugaagacgcgcaccaaugacugggacuucguugucacgaccgacaucuccgaaaugggggccaacuuuaaggcggagcgggugaucgauccccgccgguguaugaagcccgugauccucaccgacggggaagaacgcgucaucuuagcaggacccaugcccgugacccacagcuccgcggcccagcggcgggggcgaauuggucgcaaccccaagaaugagaacgaucaguacaucuacaugggugagccccuggagaacgacgaggacugcgcccacuggaaggaagcgaagaugcuccuggacaacaucaacacccccgagggcaucaucccgucaauguuugagcccgaacgggagaaaguggaugccauagauggcgaguaccgccugcgcggggaggcccguaagaccuuuguggaucugaugcguagaggggaccugccggugugguuggccuacaaaguggccgccgaggggaucaacuacgccgaccgccguuggugcuucgacgguauuaagaauaaccagauccucgaggagaacgucgaggucgagaucuggaccaaagagggugagcgcaagaagcugaaaccgcgguggcuggacgcccgaaucuacuccgacccccucgcccugaaggaguucaaggaguucgccgccggccggaaaagccugacgcucaacuuaaucacggagaugggccgccugcccaccuucaugacucaaaagacccgugacgcacuagacaaccuggccguccugcacacggcugaggccggcgggcgcgccuacaaucacgcccucuccgagcuacccgagacccuggagacccuccugcugcucacgcuguuagccacggugaccgggggcauauuuuuauuccucaugaguggccgggggaucggcaagaugaccuuggggaugugcugcauuaucaccgccuccauccuucugugguacgcucagauccaaccacacuggauagccgcuucuauuauccuggaguucuuccugauagugcugcugauccccgagcccgaaaaacagcgcacaccccaggacaaccaacucacuuacgugguaaucgcuauucuuaccguuguggccgcgacgauggccaacgagaugggcuuucuggagaagaccaagaaagaccucggauugggcuccaucgcaacacagcagccggagagcaacauccuggauauagaccuccggccggccucugcauggacccuguacgcgguggccaccacguucgugacucccaugcugcgccacagcaucgagaacucuuccgucaacgugagccugacugccaucgccaaccaggcaacugugcugauggggcuggggaagggcuggccccucagcaagauggacaucgguguuccacugcuggcgaucggcugcuacagccaaguaaaucccaucacccucacggccgcuuuacuccuccugguggcccacuacgcgauaauagggcccggucugcaggccaaggccacccgggaggcucagaagcgcgccgcugccggcauaaugaagaaccccaccguagacgggaucacagugauugacuuagauccgauccccuacgaccccaaguucgagaaacagcugggccaagugaugcugcucauacugugcgucacccaagugcugaugaugcggaccaccugggcccugugcgaggcccugacccuggccacggggcccauauccacccucugggagggcaacccggggcgcuucuggaauaccaccaucgccguuagcauggccaauaucuuccgcggcuccuaucuggccggcgccgggcuguuauucaguaucaugaagaauacaacuaacacccgccguggaaccgggaacaucggagagacgcucggagagaaguggaagucccggcugaacgcgcucgggaaaucugaguuccagauauauaagaaguccgguauucaggaggucgaccgaacccuggcaaaggaggggaucaaaagaggcgagaccgaccaccaugcugugagccgcggguccgccaaacugcguugguucguggagaggaacaugguuaccccagagggcaaggucguagaccugggcugcgggcgugguggguggagcuacuacugcggcgggcugaagaacgucagggaggugaagggacugacgaagggcggucccggccacgaggaaccaaucccgaugagcacuuacggguggaaccucgugaggcugcagagcggcguagacguguucuucaucccgcccgagaagugcgacacccugcucugcgacauuggggaguccagcccuaacccgaccguggaggccgggcgcacucugagggucuuaaaccucguggagaacuggcuuaacaacaacacccaguucugcaucaagguccugaaccccuacaugccauccgucauagagaagauggaggcccuucaacgcaaguacggcggggcccucgugcggaacccguugagcaggaauagcacgcacgagauguacugggugucaaacgccucgggcaacaucgucagcagcguaaacaugaucucccggaugcugaucaaccguuucaccaugcggcacaagaaggcgacauacgagcccgacguggaccucggcagcggcacgcgcaacaucggaauugaguccgaaauccccaaccuggacauaaucggcaagagaaucgaaaagaucaagcaggaacacgagaccagcuggcacuacgaccaggaccaucccuacaaaaccugggccuaccacggcuccuaugagaccaagcagacgggaagugcguccucaauggucaauggcguggugcgccugcugacuaagcccugggacgucuuacccaccgugacacagauggccaugacggacaccacuccguucgggcagcagcgcguuuucaaggagaagguugacacccggacgcaggagccuaaggaggguaccaaaaagcugaugaaaaucaccgccgaguggcucuggaaggagcugggcaaaaagaagaccccgcgcaugugcacgcgggaggaguucacccgcaaggugcgguccaacgccgcccugggggcgauauucaccgaugagaacaaguggaaguccgccagagaggccguggaggacucccgguucugggaguuagucgacaaagaacgcaaccugcaccuggagggaaagugcgagaccugcguuuacaacaugauggguaaacgggagaagaaacuuggcgaguuugggaaggccaagggcagucgcgccaucugguacauguggcugggggcgcgcuuccuggaguucgaggcccucggguuccugaacgaagaccacugguucucccgggagaacucuuugucgggcgucgaaggggagggccuccacaagcugggguacauacugcgggacgugucaaagaaagagggcggugccauguacgccgacgauacggcggggugggauacccgcaucacccucgaggaccugaagaacgaggagaugguaaccaaucacauggagggggagcauaaaaagcuggccgaggccaucuuuaaacugacguaccaaaauaaggucgugagggugcagcgccccacgccccggggcaccgugauggacaucauuagccgacgggaccagagagguuccggacagguggggacauacgggcuaaacacguucacuaauauggaggcccagcugauccggcagauggaaggggagggcguguuuaaaaacauacagcaccucaccgucacggaggaagucgccguccacaacuggcuggcgcgcgucgggagagagcggcugagccgcauggccaucuccggugacgacugcgugguaaagccccuugacgaucgguucgcaaacgcacugacggcucugaacgacaugggcaagauccggaaggacauacagcagugggagcccagcaaggguuggaacgacuggacgcagguccccuuuugcucccaccacuuccaugagcucaucaugaaggacggccggauacugguggugcccugccgcaaccaggacgagcugauagggcgggcgcgcaucucgcagggcgccggauggucccuccgggagaccgcgugucuuggcaagaguuacgcccagauguggucccugauguacuuccaccgucgggacuuacgccucgccgcgaacgcaaucugcagcgcgguaccuucccacuggguuccuaccagccggacgaccuggagcauccacgccaagcacgaguggaugaccacugaggacaugcugaccguauggaacagaguauggauccgagagaacccguggauggaggacaagacgccgguagagucaugggaggagaucccguaccucggcaagcgcgaggaccaguggugcgggucccugauuggccugaccagcagagcuacuugggcgaagaacauucaggccgcaaucaaccaggugagaucucucaucggcaacgaagaauacaccgacuacaugccgagcaugaagcgguuucgccgcgaggaggaggaggcuggcguccugugguaa

SEQ ID NO: 25384 - RNA, 9876 nt, Artificial Sequence
  derived and/or modified CDS sequence (opt11) from DENV-2__EU482669__SS-prME
agcgcaggaaugauaauaaugcugauacccaccgugauggcguuccaccucaccacccggaauggggaaccccacaugaucgucggcauacaggaaaagggcaagagcuuacuguucaagacggaggacggcgugaauaugugcacccugauggcgauggacuugggggaguugugcgaggacacgaucaccuauaagugccccuuacugcgccagaacgagcccgaggacaucgacugcuggugcaacagcaccuccgcgugggugaccuacgggaccugcacgacaaccggcgagcaucggcgggagaagcgcucagucgcacuggugccccacguagggaugggcuuggagacccggacggagaccuggaugucgagcgagggggccuggaaacacgcccagaggaucgagaccuggauacugcggcacccgggcuucacaaucauggcugccauccucgccuacaccaucggaaccacacacuuccagcgcguccuuaucuucauccugcugacggccguagcgcccuccaugacaaugcggugcaucggcaucagcaaccgcgacuucguggagggggugagugggggaagcuggguggacauaguacuugagcacggguccugcgucaccaccauggccaagaauaaacccacccuggauuucgaacugaucaagacggaggccaagcagcccgcuacauuacggaaguacugcaucgaggccaagcugaccaacaccacgacggagagccggugccccacucaaggcgaacccagucugaaggaggagcaagacaagcgguucgucugcaagcacagcaugguggaucgagguugggggaacggcugcggccuguucgguaagggcgggauagugacaugcgcgauguucacgugcaagaaaaacauggaaggcaaaauugugcagcccgaaaaccuggaguauaccaucgucgucacgccccacaguggggaggagcacgccgugggcaacgacaccggaaaacacggcaaggagaucaaggugacgccgcaaagcuccaucaccgaggucgagcugaccggguacggcacugucaccauggagugcagcccccggacuggccucgacuucaacgagaugguuuuacugcagauggagaauaaggccuggcucgugcaccgccagugguuccuagaccugccacucccguggcugcccggggccgauaagcaagaauccaacuggauacagaaggagacccuaguuaccuucaagaacccacacgccaagaaacaggacgucgucguccucgggucccaggagggggcgaugcacaccgcacugaccggugcuaccgagauccagauguccagugggaaucuccuguuuaccggccaccugaagugcaggcuuagaauggacaagcuccagcuuaaggggaugucguacaguaugugcaccgggaaauuuaaggucgugaaagagaucgccgaaacgcagcacgguacuaucgugauccggguccaauacgagggggacggcagucccugcaagauccccuuugaaauuauggaucuggagaaacgcuacguacucggccggcuuaucacagugaacccgaucguaaccgagaaggacaguccggucaacaucgaggccgagccgcccuucggagauagcuacaucaucaucggcguggagccgggacagcugaagcucaauugguuuaaaaagggcagcagcauaggacagauguucgaaaccaccaugcgcggcgcgaagagaauggccauauuaggugacacugccugggacuucgggucccuugguggggucuucaccagcaucggcaaagcccugcaucagguguucggggccaucuacggugcagccuucuccggagugagcuggacgaugaagauacugaucgguguuaucaucaccuggauugggaugaacucccgauccaccucccuauccguaucccuugugcucgugggcaucgugacccuguaccugggcgugauggugcaagccgacuccgggugcguggugucguggaagaacaaggaacucaagugcggcaguggaaucuucaucacggacaauguucacaccuggaccgagcaguacaaguuucagccggaaagcccuuccaagcuggcgagcgcuauccagaaggcccaagaagaggggaucuguggcauccgcucagugacccggcuggagaaccuaauguggaaacagauuacgcccgagcugaaccacaucuuagccgagaacgaggugaagcucaccaucaugaccggagacaucaaaggcauaaugcaggccgggaaacgcagccuacguccacagcccaccgaauugaaguacuccuggaaaacguggggcaaagcaaagaugcuaucgaccgaguccuacaaucagaccuuccugaucgacggcccugagacggcugaaugcccgaacacgaaccgcgccuggaacucccuggaaguugaggacuacggguucggggucuucacuacgaacaucuggcuaaagcucaaagagaaacaggacgccuucugcgauuccaagcugaugagcgcugcgaucaaagacaaccgggcggugcacgccgacaugggcuacuggauagagucugcgcucaacgauaccuggaagaucgagaaggccuccuucauagaggucaagaacugccacuggcccaaaucccacacacuauggucgaacggcguuuuagaguccgaaaugauaauccccaagaaucuugccgggcccgugagccagcacaacuaccguccgggguaccacacgcagaucgcuggccccuggcaucuagggaaguuagagauggacuucgauuucugcgacgguaccaccgugaucgugacagaggacugcgguaacagaggccccagucugcgcacgacaaccgcaucaggcaagcugaucaccgaguggugcugcagaucuugcacccugccaccccuucgcuaucgcggcgaggauggcugcugguacgggauggagaucagaccccugaaagaaaaagaggagaaccuugugaacucccucgucaccgccggccacggacaaguggacaacuucagucuuggggugcuggguauggcgcuauuccuugaggagaugcuacgaacucgcgucgggaccaagcaugcgauccuccugguagccgugucuuucguaaccuugauaaccgguaauaugagcuucaaagaccugggccgagugguggucaugguuggcgccacaauggccgacgacaucggaaugggggugacauaccuugcccuacucgcggcguucaaaguucgccccacguucgcugccggccuguuacuccggaaguuaaccagcaaagagcugaugaugaccacuaucgggaucgugcuccugagccaguccacgauccccgagaccguucuggagcucacagacgcccuggcgcuggguaugaugguccuaaagauagugcgcaacauggaaaaguaccaacuggccgucacaaucauggccauccuuugcgugccgaacgccgucauacugcagaacgccuggaaagucucuugcacuauucuggccguaguguccgucagcccccuccuccugacguccucgcagcagaagacggacuggauaccccuggcacuaaccauuaaggggcuuaacccaacggccaucuuucugaccaccuuaagucgcacgaacaaaaagagaagcuggccguugaacgaggccaucauggcgguugggauggucagcauccuugcuucaucacucuugaagaacgacauccccaugacgggcccucuggucgccgggggccuccugacaguuugcuacguccugacggggcgcagugccgaccucgaguuagagcgggcaaccgacgucaagugggaggaucaggccgagauuuccggcagcucgcccaucuugucaauuacgaucagcgaggacgggaguauguccauaaagaacgaagaggaggagcagacucucacuauacugauccgcaccggccugcuggugauauccggccuguucccgaucagcauaccgaucacggccgccgccugguaccugugggaagugaagaaacagcgggcuggaguccugugggacgugcccagcccgccgcccaugggcaaggcggagcuggaggacggcgccuaccgaaucaagcagaaaggcauucugggguauagccaaauaggcgcgggaguguauaaagaggggaccuuccacacgauguggcauguaacaaggggcgccguucuuaugcacaaggggaagaggaucgagcccucaugggccgacgugaagaaagaccugaucagcuacggcggcggcuggaagcuggagggcgaguggaaagagggggaggagguccaggugcucgcucuugagcccggcaagaacccccgggccguacagacuaagcccggacucuucaagacgaauaccggcaccaucggggccgucucccucgacuucucccccggcacuucagguagccccaucaucgacaagaaggggaagguuguugggcuguacggcaauggagucgugacgcgcuccggagccuacgugucagccaucgcccaaaccgagaaguccauagaggacaaccccgagaucgaggacgauaucuuccgaaagcgccggcugacuaucauggacuugcacccuggggccggcaagaccaagcgcuaccuccccgccaucguccgggaggcgaucaagcgcgggcuacggacgcugauccuagcgccaacccgcgucguggcggccgagauggaggaggcacugcggggccugccaauccgcuaccagacccccgcuaucaaagcagagcacacggggcgggagaucgucgaccuuaugugucacgccacauucaccaugaggcuguugucucccguccgcgugcccaacuacaacuuaaucaucauggacgaagcccauuuuaccgauccggcguccaucgccgcaaggggcuacaucagcacccgcgucgagaugggugaggccgcgggcauuuucaugacugcuacgccgcccgguucaagagacccguuuccccagaguaacgccccuaucaucgacgaagaacgcgagauucccgagcggagcuggaacuccgggcaugagugggugaccgauuacaaagggaagaccgugugguucgucccgucuaucaaggcugguaacgauaucgccgcgugccuccggaagaacggcaagaaggugauccaguuaucccggaagaccuucgacagugaguaugugaagacccgcaccaaugacugggacuuugucgucaccacggacauuuccgagaugggcgccaacuucaaggcggagcggguuaucgacccccgucgcugcaugaagcccguuauccucacugacggggaggagcgcgugauccuggccggccccaugccggugacccacagcuccgcagcccagcggcgugggcgcaucggccggaaccccaagaacgagaacgaccaguacaucuacaugggggagccucuggagaaugacgaagacugugcccacuggaaggaggccaagaugcuacuggacaacaucaacaccccagagggcauuaucccgagcauguucgaaccggagcgagaaaaggucgacgccaucgauggcgaguaccgucugcgaggggaagccaggaagacauuuguggaccucaugcgccggggcgaucugcccguguggcuagccuacaaagucgcggcugaggggaucaacuacgccgaccgccgguggugcuuugauggcaucaagaacaaccagaucuuagaagagaaugucgaagucgagauuuggaccaaggagggggagcgcaagaagcuaaagccgcgcugguuggacgcgcgcaucuacagcgacccccucgcacugaaggaguucaaggaguucgcggcgggccgaaagucccugacgcucaaccugaucacugagaugggccgcuuaccaacguucaugacccagaagacccgggacgcucuggacaacuuggccguucugcauaccgccgaagccggcggcagagccuauaaccacgcuuuaucagagcuccccgaaacgcucgagacccuccuucugcucacucugcucgcuacugugaccgguggaaucuuucuguuuuugaugagugggcgggggaucggcaagaugacccuggggaugugcuguauuauuaccgccagcauauugcugugguaugcgcagauccagccgcacuggaucgccgcuucaaucaucuuagaguucuuccucaucgucuugcugaucccagagccagagaaacagaggacgccccaggauaaccaacucaccuacguggugaucgccauccugaccgucguggccgcuaccauggccaacgagaugggcuuccuggagaagaccaagaaggaccucggccugggauccauugccacccaacagccggagagcaacauccuggauaucgaccucaggccggccuccgccuggacgcuguacgcgguggcgaccaccuucguaacuccgaugcugcgccacucaauagagaacagcucggucaacgugucucugacugccaucgccaaccaggccaccguucugaugggccuuggcaaggguuggccccucaguaagauggacaucggugugccgcugcuggcgaucggcugcuauagccaggugaaucccaucaccuuaaccgccgcacugcugcucuuagucgcccacuacgcgauuaucgggcccggcuugcaggccaaggccacccgggaagcccagaagagagcagcugcugggaucaugaaaaauccaacuguggaugggaucacggucauugaccucgauccgauccccuacgacccuaaguucgagaagcagcuuggucaggucaugcugcucauacugugcgugacccaggugcuaaugaugcggaccaccugggcccucugcgaggcgcugacuuuggccacggggcccaucagcacccucugggaggggaacccgggacgcuucuggaauaccaccauagcgguaagcauggccaacaucuucaggggcagcuaccuggcuggugccgggcuacuauucagcaucaugaagaacaccacgaacacccgcagagggaccgggaacaucggcgagacccugggugagaaguggaagucccgccugaacgcccucggaaagagcgaguuccagaucuacaagaaauccggaauccaggagguggauagaacgcuggcgaaggaagggauaaagagaggcgagacggaccaccacgccgugagccgcgguucggcuaagcugcggugguuugucgaacgcaacauggugacccccgagggcaaagucgucgacuuaggcugcggccggggcggguggagcuacuauugcggcgggcugaagaacgugcgcgaagugaaaggccugaccaagggcgggcccggacacgaggagcccaucccaauguccacguacggguggaaucucguccggcuccagagcggcgucgacguguucuucaucccgcccgagaaaugcgauacccuguuaugugacaucggugaauccucccccaacccgacaguagaggccggccgcacccugagagugcugaaucucguggagaauuggcugaauaacaauacgcaguucuguauuaaaguccugaaccccuacaugccgucagugaucgagaaaauggaagcgcuucagagaaaguacggaggggccuuggugcggaauccucugagccgcaacaguacucacgagauguacuggguauccaaugccagcggcaauaucguuucaagcguaaacaugaucucccgaaugcucaucaaccgcuucacaaugcggcacaagaaggccacuuacgagcccgaugucgaccucgggagcggcacacgaaacaucgggauugagagugagauccccaaccuggacaucaucggaaagcggauagagaagaucaagcaggaacaugagacgagcuggcacuacgaccaggaccaccccuacaagaccugggccuaccacggaaguuaugagaccaagcagaccggaagcgcguccagcauggugaacggcgucgugcggcugcucacgaagccgugggaugugcuacccaccgugacccagauggccaugaccgacacgacccccuucgggcagcagcggguuuucaaggagaaaguggauacccgcacccaggaacccaaggaagggacgaagaagcugaugaagaucacggcagaguggcucuggaaagagcuuggcaagaagaagacaccgcgcaugugcacccgcgaggaguuuacgcgcaaggugcggaguaacgcggcgcugggagcgauauucaccgacgagaacaaguggaaguccgcucgcgaggccguggaggacaguagauuuugggagcucguggacaaagagcgcaaccugcaccuggagggcaagugcgaaaccugcgucuacaacaugaugggcaagcgagagaaaaagcucggcgaguucgggaaagccaagggcagccgcgcgauuugguacauguggcugggcgcgcgguuccucgaguuugaggcccucggguuccugaaugaggaucacugguucucccgagagaacagccuuagcggcgucgagggggagggcuuacacaaacuuggguacauccuucgggacgugagcaaaaaggagggcggcgccauguacgccgacgauacagcggggugggacaccagaaucacauuagaagaccugaagaaugaggagauggucacgaaccacauggagggcgaacacaagaagcuggcugaggccaucuuuaagcucaccuaccagaacaaggucgugcgggugcagcgccccacgccccgagggacuguaauggacauuaucagccgacgggaccagcgcgguucuggccagguagguaccuauggcuuaaacacuuucacgaacauggaggcacaauugauacggcaaauggagggggagggcguguucaagaccauacaacaccucaccgugaccgaggagguggccguccagaacuggcuggcgcgcguggggcgggagagguugagccgaauggccaucuccggcgacgacugcguagucaaaccccuugaugaucgguucgcaaacgcccugacggcgcugaacgacaugggcaagaucaggaaggauauccagcagugggaaccgagcaagggguggaacgacuggacccaaguuccguucugcagucaucacuuccacgaguugauuaugaaggacggccgugugcugguagucccaugccgcaaucaggaugagcugaucgggcgggcgcgcaucagccagggagccggguggucccugcgggagaccgccugccugggcaaaagcuacgcccagauguggucccugauguacuuccaccgacgggaccuccgcuuggcagccaacgcgaucugcagcgccgugcccucucacugggucccgaccucgaggacgaccugguccauucacgccaagcacgaguggaugacgaccgaggacaugcugacaguguggaacaggguguggauccgggagaacccguggauggaggauaagacgcccgucgaaagcugggaggaaauccccuaccugggcaagcgcgaggaucaguggugugggucccugauuggccugaccucccgggccaccugggcgaaaaacauacaggcagccaucaaccaggugcggucacucaucgggaaugaagaguacaccgacuacaugccgagcaugaagagauuccgccgggaggaggaagaggccggugugcugugguga

SEQ ID NO: 25385 - RNA, 9876 nt, Artificial Sequence
  derived and/or modified CDS sequence (opt11) from DENV-2__EU482670__SS-prME
ucugcggggaugaucaucaugcugauccccaccgugauggcauuccaccucaccacccgcaacggggagccccacaugaucgugggaauucaggagaagggcaagucccugcuguucaagacugaggacggcgugaacaugugcacccugauggcuauggaccugggggagcucugcgaggauacaaucaccuauaaguguccacuccuccggcagaacgagcccgaggacauugacugcuggugcaacagcacgagcaccugggugaccuacgggacaugcaccacaaccggugagcaccgcagagagaagcgcagcgucgcccucgugccccaugucgggaugggccuagaaacacggacagagaccuggauguccagcgagggugcguggaagcacgcccagcguaucgagacuuggauccugcggcacccgggcuucacgaucauggcagcuauccuggcuuacaccauugggaccacccacuuccagcgcguguugauauucauccugcugacggccguggcaccauccaugaccaugcgguguauuggcauuagcaaucgagacuucguggaaggcgucuccggggggucuuggguggauaucgugcucgaacaugggaguugugucacuaccauggcaaagaacaaacccacccuagacuuugagcugaucaagaccgaggccaagcaacccgcgacccuucgaaaauacugcaucgaggccaaacugaccaacaccaccaccgagucucguugccccacccagggcgaaccuucacugaaggaggagcaagacaagcgguucgugugcaagcauagcaugguggaccgcggaugggggaacggaugcggccuguucggcaagggcgggaucgucacaugugcgauguucacaugcaagaagaacauggaggguaaaauugugcagccggagaaccuggaguauacgaucguggucacgccgcacuccggggaggaacacgcugugggcaacgauacagguaagcauggaaaggagaucaagguuaccccgcagagcucaauuacggaagccgagcugaccggguacggcaccguaacgauggaaugcagcccccggacugggcucgacuucaacgagauggugcugcugcagauggagaacaaagccuggcucguacaccgccagugguucuuggaccugccccucccauggcugccgggagccgacaagcaggaguccaacuggauccaaaaagagacccuggucaccuucaaaaauccucaugcuaagaagcaggauguagucguccucgguagccaggagggggcgaugcacacggcccuaaccggcgccaccgagauccagaugagcuccgggaaccucuuguucaccggccaccugaaaugccgucugcggauggacaagcuccagcugaagggcaugucauacuccauguguacgggcaaguucaaggugaugaaagagaucgccgagacgcaacauggcacuaucgucauacgggugcaauaugaaggggacggcagccccugcaagauucccuucgaaaucauggaccuggaaaaacgcuauguguuaggcagacugauuaccgugaauccgauugugacggaaaaggacucccccgugaacaucgaagccgagccucccuucggugacagcuacaucaucaucggcgucgagccgggucagcugaagcucaacugguuuaagaaaggcuccaguauugggcagauguuugagacaaccaugcgcggagcgaagcguauggcgauucugggcgauacagccugggacuucggcucucugggagggguguucacgagcaucgggaaggcccuccaccaaguguucggcgccaucuacggcgcggccuucuccggcguuaguuggaccaugaagauccugaucggggugaucaucaccuggaucggcaugaacucccggagcacaucgcuaagcguuucccugguccucguggggaucguuacgcuuuaccugggcgucaugguccaggccgacagcgggugcgugguuuccuggaagaacaaggagcucaagugcggaagcggcaucuucaucacugacaacgugcacaccuggaccgagcaguacaaguuucagccagaaagccccucuaagcuggcaagcgcgauccagaaggcccaggaggagggcaucuguggcaucaggagcgugacgcgguuagagaaucucauguggaaacagauuacaccggagcucaaccacauccuggcagaaaacgaagucaaacucaccaucaugaccggagacaucaagggcaucaugcaagcugggaagcgcucguuacggccgcagccuacggagcugaaauacuccuggaaaacuuggggcaaggccaagaugcucagcaccgaaucccauaaccagaccuuucuaaucgacggccccgagacggcggagugcccgaacacgaaucgcgcauggaacagccuggagguggaggacuacggguucggaguauucaccacaaauaucuggcucaagcugaaggaaaagcaggacgccuucugcgacucuaaacucaugucugcugccauaaaagacaaccgggcgguccacgcugacaugggguacuggaucgagagcgccuuaaaugacacguggaagauagaaaaagccagcuucaucgagguaaagaauugucauuggcccaagucgcacaccuuauggucgaacggcguucuggaguccgagaugaucaucccaaagaaccucgcgggucccgucagccagcauaacuaccgcccgggguaccacacccagguggcggguccuuggcaccugggaaagcuggaaauggacuucgacuucugcgacggcaccaccgugaucgucacggaggacugcgggaauagaggccccucccuccgcaccaccacugccucuggcaagcugaucacggaguggugcugccggagcugcacacugcccccccuccgcuacagaggggaagacgguugcugguacgggauggagauccgcccccugaaggagaaggaggagaaccuggucaacucccucguuaccgcgggccacgggcagguagacaauuucagccugggcgugcugggcauggcccucuuccuggaggagaugcugcggacuagaguggggacgaaacacgcaauucuauuggucgccguguccuucgugacccugauaaccgguaauaugagcuuuaaagaucuggguagagucguugugaugguaggcgcaacuauggccgacgacaucgggaugggcguuaccuacuuagcccugcuggcggccuuuaaggugcgcccuaccuuugcugccggccuacugcuccggaagcugaccucgaaggaguugaugaugacgacuaucgggauugugcucuugagucaguccaccauccccgagaccgugcuggaacucaccgaugcccuggcacuggguaugaugguucucaagaucguccgcaacauggagaaguaccagcuggcggugacgaucauggcuauccugugcguuccgaacgccgugauccuccagaacgccuggaaggugagcugcaccauccuggccgucguguccgugagcccgcuguuauugaccuccagccagcagaagaccgacuggauuccacuggcacugacgaucaaggggcuaaacccuacggcuaucuuccugaccacacucucccgcacgaacaagaagcggagcuggccgcugaaugaagccauaauggcaguaggcaugguaucgauccuggccagcucccuucucaagaacgacauccccaugaccggcccucuaguggccgguggacuccuaaccgucugcuacgugcugaccggccgcagcgccgaccuugagcuggagcgggccacggacguuaagugggaggaccaggcggaaaucuccggcagcucgccuauccucuccaucaccauuagcgaggacggguccaugagcaucaaaaaugaagaggaggagcaaacccuuaccauccugauccgcacgggccugcucgugauauccggccuguucccgaucucuauccccaucaccgccgccgccugguaccucugggaggugaaaaagcagcgggcuggggugcucugggacguccccagcccgccgcccaugggcaaagcggagcuggaggacggagcguaccggauuaaacaaaaagguauccugggguacagccagaucggcgccggcguguacaaagaagggaccuuucacacgauguggcacgugacgcggggcgccguccuaaugcacaaaggaaagagaaucgagcccuccugggccgacguaaagaaggaucuuaucagcuacggcgggggcuggaagcuggagggcgaauggaaggagggggaggaggugcagguucucgcgcuggagcccggcaaaaauccacgggcaguucagacgaagccaggauuguucaagacuaacaccggaacuaucggggcagugucccucgacuucagcccuggaacguccggcucaccaaucauagacaagaaagggaaggucgugggccuguacgggaacggcguggucacccgcuccggcgccuacgugagcgccaucgcgcaaaccgagaaguccaucgaggacaaccccgagauugaggacgacaucuuccggaagcggcgguuaacuaucauggaccugcacccgggggcuggcaagacgaagcgcuaccucccagcuaucgugcgggaggcaauaaagcgcggccugcguacccugauucuggcaccgacccgagucguggccgcugaaauggaggaggccuugcgggggcugcccauccgcuaccagacgcccgccauccgggcggagcauacgggucgcgagaucguggaccucaugugccacgcaaccuucaccaugagacugcugagccccguccgcgugccaaacuauaaccucaucaucauggacgaggcucacuucacugaccccgccaguaucgccgcgcgcggcuacaucagcacgcggguggagaugggcgaggccgcagggaucuucaugaccgcuacaccgccaggaagccgagacccguucccccaguccaacgcccccaucaucgacgaggagcgggagauccccgagcguagcuggaacucugggcaugagugggucacagauuucaaagguaaaacggucugguucgugccuagcauuaaggcggggaacgauaucgccgccugccugagaaagaacggaaaaaaagucauccaacugucucgcaagaccuuugacagcgaguacgugaagacccggaccaacgacugggacuucgugguaacgaccgacaucucggagaugggcgccaacuucaaggcggagcgcgugauugauccccggcgguguaugaaacccgugauccucaccgacggggaggagcgggucauucuggccggcccuaugccagugacccauagcuccgcagcccagcgucgggggcgcaucggccggaaccccaagaacgaaaacgaccaauacauuuauaugggugagccgcuggaaaacgacgaggacugcgcccacuggaaggaggcgaagaugcuccuggacaacaucaacacgcccgagggcaucaucccguccauguucgagcccgaacgcgagaagguggacgccaucgacggugaauacaggcugcgcggugaggcccgcaagaccuucgucgaccucaugcggcggggugaccugccaguguggcuggcauacaagguggccgcggagggaaucaacuacgcagaccggcgcuggugcuucgacggcauuaagaacaaccagauacucgaggaaaacgucgagguggagaucuggaccaaggagggggagcggaagaaguuaaagccgcgcuggcuggacgcccggaucuacuccgauccccucgcccugaaggaguucaaggaauucgccgcuggccggaagagccugacccucaaucuaaucacggagaugggccggcugccaaccuuuaugacccagaagacccgcgacgcccucgacaaccuagcuguucugcauacggcagaggcaggggggcgcgccuauaaucacgcccucuccgagcugccggagacccuugagaccuuauugcuucugacccugcuggcaacggugaccgggggcaucuuccucuuccugaugucaggccgcgggaucggcaagaugacccuggggaugugcugcaucaucacagcuuccauucuccugugguacgcacagauccagccgcacuggaucgccgccucuaucauccuugaguucuuuuugaucgugcugcugaucccugagccagagaagcagcggaccccacaggacaaccagcuaacuuacgucguaauugccauccugaccguggucgccgcgacgauggcaaaugagaugggcuucuuggagaagacgaagaaagaucucgggcuaggauccaucgcgacgcagcagccggagagcaacauccuggacaucgaccuccgacccgccuccgcauggacccuguacgcgguggccaccaccuucguuacucccauguugcggcacagcaucgaaaacagcuccgucaacgugagccuuaccgccaucgcgaaucaagccacugugcugaugggacuagggaaggguuggccccucucuaagauggauauaggggucccucugcucgcgauuggcugcuacucgcaggucaacccaauaacccucaccgccgcccugcugcuucugguagcucacuacgcaaucaucgguccuggccugcaggccaaggccacccgcgaggcccagaagcgggccgccgccggcauuaugaagaaccccaccgucgacgggauaacggugaucgaccucgauccgauccccuacgaucccaaguuugagaagcagcugggacagguuaugcugcucauccuuugcgucacccagguucugaugaugcgcaccaccugggcccucugcgaggcccugacccuagcaacgggcccuaucuccacccucugggagggcaacccggggagguucuggaacaccaccaucgcggugucgauggccaacaucuuccgcggcuccuaucuggccggcgccgggcucuuauucagcauuaugaagaacacgaccaacacccggcgcggcacagggaacaugggcgagacucugggcgagaaguggaagucucgccugaacgcccucgggaaauccgaguuccagauuuacaagaaguccggcauccaagaagucgacaggacucuggcgaaggaagguaucaagcgcggagagacggaccaccacgccguguccagaggguccgcaaagcugcgcugguucguggaaagaaacauggucaccccggagggcaaggugguggauuuaggcugcgggcgcggcggguggagcuacuacugcggcggguuaaagaaugucagggaaguuaagggccugacuaagggcgggcccggccaugaagagccuaucccgaugagcaccuacgguuggaaccucgugcgccugcaaaguggaguagacguuuucuuuaucccgcccgagaaaugcgacacccuguuaugcgacaucggggaguccagcccuaacccgacgguggaagcgggccgcacacugcgcguccugaaccugguggaaaacuggcugaacaauaacacccaguuuuguauaaagguccuuaaccccuacaugccaucggucaucgagaagauggaggcgcuccagcggaaguacggcggggcccucgugcgcaacccguugagccggaacagcacgcacgagauguacugggugaguaacgcuucgggaaauaucguuuccuccgugaacaugauuucccgcaugcugaucaaccgguuuaccaugcgccacaagaaggccacauacgagcccgauguagaucucgggagcgggacaagaaacaucgggaucgaauccgaaauuccgaacuuggacaucaucggcaagcgcaucgagaaaauaaagcaggaacacgagacuucguggcacuacgaccaagaccacccguauaagaccugggccuaccacggguccuaugagacgaagcagacugggagcgcuuccagcauggucaacggcguggugcggcugcucacgaaaccgugggacgucuugcccaccguaacacagauggccaugacggauacuacccccuuugggcagcagcgcguguucaaggagaaggucgacacgcgcacccaggaacccaaggagggcaccaagaagcugaugaaaaucaccgcggaguggcuauggaaggagcugggcaagaagaagaccccgcggaugugcacccgcgaggaguucacccggaaggugcgcuccaacgccgcgcugggggcuaucuucaccgaugagaacaaguggaaauccgcucgggaggccguggaagacucccgcuucugggaacucguagacaaggagcggaaccuacaccuggagggcaagugcgagacaugcguguacaacaugauggggaagcgcgagaagaaguuaggcgaguucgggaaggcuaagggaucucgggccaucugguacauguggcugggcgcgagguuccucgaauuugaggcccucggguuccugaaugaggaccacugguucucccgggagaauucucugaguggcgucgagggggaggggcuccacaaacugggguacauccugagggacgugagcaagaaggagggcggcgccauguaugccgacgacacggcgggcugggacacccggaucaccuuggaggaccugaagaacgaagagauggugaccaaucauauggagggcgagcacaagaagcuagccgaagcgaucuucaagcucacguaccagaacaaggucgugagagugcagcgcccuacuccccgggggaccgucauggacaucaucagccggcgcgaucagcggggguccggccagguagguacguacggccugaacacguucaccaauauggaggcccagcugauccgccagauggaaggcgagggcguguucaagaacauccagcaccucaccgucacugaggagguggccgugcagaacuggcuggcgagagucgggcgagaacgccugagccggauggcuaucuccggcgaugacugugucgugaaaccccuugacgaucgcuucgccaacgcccuuaccgcguugaacgacaugggcaagauucguaaagauauccagcagugggagccaagcaaaggguggaaugacuggacccaggucccauucugcucccaccacuuccacgaacuuauuaugaaggacggccguauccuggucgugccgugccgaaaccaggacgagcugaucgggcgggcucggaucagccagggcgccggguggucgcuccgcgaaaccgccugccugggcaagagcuaugcgcagauguggucgcuuauguacuuccaccggagggaccuccggcuggcggcgaaugcgauuugcucugcuguacccucccacugggugccgacuagccgcacgaccuggagcauccacgccaagcacgaguggaugaccacugaggacaugcucacaguguggaaucguguguggauccgcgagaaccccuggauggaggacaagacccccguggagagcugggaagagauaccauaccucggcaagcgggaagaccagugguguggaucccugaucggcuuaaccucccgggccaccugggccaagaauauccaagccgcgaucaaccagguccgaucccucaucgggaacgaggaguacaccgauuacaugccaaguaugaagcgcuuccgucgcgaggaggaggaggccggcguacuuugguga

SEQ ID NO: 25386 - RNA, 9876 nt, Artificial Sequence
  derived and/or modified CDS sequence (opt11) from DENV-2__EU482671__SS-prME
agcgcggggaugauaaucaugcugauccccaccgugauggcauuccaccucaccacgcgcaacggggagccccauaugaucguugggauacaggagaaggggaaauccuuacuguucaagaccgaagacggcgugaauaugugcacccucauggcuauggaccugggugagcugugcgaggacacuaucaccuacaagugcccccuccugaggcagaacgagcccgaggacaucgauugcuggugcaauucaacgagcaccugggugaccuacgggaccugcacuacuaccggcgagcaccgccgggagaagcgcagcguggcccuggucccccacguugggaugggacucgaaacucguaccgagaccuggauguccagcgagggggccuggaaacacgcacagcgcaucgagaccuggauccuucggcacccgggcuucacuauaauggcagcgauccuggccuacaccauugggaccacccacuuucagcgcguccucaucuuuauccugcuaacggcgguggccccuucgaugaccaugcggugcaucggcaucagcaaucgcgacuuuguggagggagucuccggcggcagcuggguggacauagugcuugagcacgguuccugcgucaccaccauggcgaagaacaagcccacguuggacuucgagcugaucaaaaccgaggccaagcaacccgccacccuccggaaguacugcaucgaggccaaacugaccaacacgaccaccgagucgcgcugccccacccagggcgagcccucccuuaaggaagaacaggacaagcgguucaucugcaagcauagcaugguggaucgcggcugggguaacggcugcggccuguucggcaagggcgggaucgugaccugcgccauguucacgugcaagaagaacauggagggcaagaucguacagcccgagaaccuggaguacaccaucguggugacgccccauuccggggaggagcacgcggucggaaacgauaccgggaagcacggcaaggagaucaaggucaccccgcaaagcuccauaaccgaggccgagcugaccggguacggcaccgugacgauggaguguucuccccggaccggacucgacuucaacgagaugguccugcugcagauggagaacaaagcauggcucgugcaccgucagugguuccuggaucugccccuccccuggcuuccgggggccgacaagcaggaguccaacuggauccaaaaggagacccuggugacguucaagaacccccacgccaaaaagcaggacgucguggucuuaggcagccaggagggggccaugcacacggcccugaccggcgccaccgagauccagaugagcuccgggaaccuucuguucacagggcaccugaaaugccggcugcgcauggacaagcuccagcugaagggcaugucguacuccaugugcacggggaaguucaagguggugcgggagaucgccgagacgcagcacgggaccaucgucauccgcgugcaguacgagggggacggcucgcccugcaagauccccuuugagaucauggaucuggagaagcgguacgugcucggccgacugaucaccgucaacccgaucgugacggaaaaggacucccccgugaacaucgaggccgagccgcccuucggggauagcuacaucaucaucggugucgagccaggccagcugaagcucaacugguuuaagaaggguuccagcaucggacagauguucgagaccaccaugcgcggcgcgaaacggauggccauccugggcgacaccgccugggacuucgguuccuuaggcgggguguucacgagcaucggcaaggcccuccaccagguguucggggccauuuacggagccgcguucuccggcgucagcuggaccaugaagauccugauaggggugauaaucaccuggauuggcaugaacagcagaagcaccagucugagcgugucccugguacucguuggaaucgucacgcuguaccugggcgucaugguacaagccgacagcgggugcguggucuccuggaaaaauaaagagcugaagugcgguagcggcauuuuuaucacugacaacgugcacaccuggaccgagcaguacaaguuccagcccgagagcccgagcaagcuggccagcgcuauccagaaggcccaggaggaggggaucugcggcauccguuccgugacacgccuggagaaucucauguggaaacagaucacccccgagcuaaaccacauucuggccgaaaaugaggucaagcucaccauuaugaccggggacaucaagggcaucaugcaagcggggaagcgaagccugcgcccgcagcccaccgagcugaaauacuccuggaagacuugggggaaggcuaagaugcucagcaccgaguccuauaaccagaccuuccugauugacggcccagagacggcggagugcccgaacacuaaccgcgccuggaacagccuggagguggaggacuacggguuuggcguguuuaccaccaacaucuggcucaaacugaaggagaagcaggaugccuuuugcgacucuaagcugaugagcgcggccaucaaagauaaccgcgcgguccacgccgacaugggguacuggaucgagucagcccucaacgacacguggaagaucgagaaggccagcuucaucgaggugaagaacugccauuggcccaagagucacacgcucuggucuaacggcgugcuggagagugagaugaucauccccaagaaccuggccggcccagucagccagcacaacuaccggccgggcuaccacacccaaaucgcgggacccuggcaccuagggaagcuggagauggacuucgacuucugcgacggcaccaccgugaucguuacggaggacugcgggaaccgcggccccucccuccggaccaccacugccagugggaagcucaucacggaauggugcugccguagcuguacccugcccccucuacgguaccgcggggaagacgguugcugguacgggauggaaauucggccccugaaggagaaagaggagaaucuggugaacucccuggugaccgccggacacggccaggucgacaacuucucacugggcguccuuggcauggcguuguuuuuagaggagaugcugcgcacccggguggggacgaagcacgcaaucuugcuuguggccguauccuucgugacucugaucacgggcaacaugagcuucaaggaccucgggcgcguggucgugaugguaggcgcuaccauggccgacgacaucgggauggggguuacguacuuagcguugcucgccgccuucaaagugcggccgaccuucgcagccggccugcuccuccgcaagcugaccaguaaggagcugaugaugacuacuauugggauagugcuccugagccaguccacuauccccgagaccguccuggaacucacggaugcccuggcgcugggaaugaugguacucaaaaucguucgcaauauggagaaguaucagcuggccgucaccauaauggccauauugugcgugccgaacgccguaauacuccagaacgcuuggaaggucagcugcaccauccuggcggugguuuccgugagcccacugcuccugaccuccagccagcagaagacagacuggauaccccuggccuugacaaucaaggggcugaaccccaccgccaucuuccugaccacucucucccggacgaacaagaaacgcagcuggccacugaacgaggcuaucauggcggugggcauggucuccauccuggccucaagccuccucaagaacgacauucccaugaccgguccccugguggccggggguuuacugaccgugugcuauguccugaccgggcggucugccgacuuggaauuggagagagcaacggacgugaagugggaggaccaggcggagaucuccggaagcagcccaauccuguccaucaccaucagcgaggacgggaguaugagcaucaagaaugaggaggaggagcagacccucaccauccugauccguacgggccugcucgugaucuccggacuguuuccgaucagcauccccaucaccgccgccgcuugguaccucugggaggucaagaagcagcgcgccggggugcucugggacgugcccagcccgccacccaugggcaaggcggagcuggaagacggggccuaccggaucaagcagaagggcauccugggauacagccagauuggcgccggcguauacaaggaagggaccuuucacaccauguggcacgugacucgcggcgcugugcucaugcacaaggggaagaggaucgagcccuccugggccgacgucaagaaggaccugaucagcuacggcgguggcuggaagcuggagggagaguggaaggagggggaggagguacaggugcuggcguuagagccuggcaagaacccccgcgccguccagacgaagcccgggcuguucaagaccaauacgggcaccaucggugccgugucccucgauuucagccccggcacguccggcagccccaucaucgacaaaaagggcaaaguaguuggauuauacgggaacggcgugguuacccggucgggcgccuacgucagcgcuaucgcgcagaccgagaagucuauugaggacaaucccgagauagaggacgauauuuuccggaagcggcgccugacaaucauggaucugcaccccggcgcuggcaagacgaaacgguaccuucccgccaucgugcgcgaggcaaucaagcgggggcuucgcacccuaauccucgcgccaacccgcguggucgccgcagagauggaagaggcccugcgcggccuuccuauccgguaccagacuccggcgauccgcgcggaacacacggggcgcgagauaguggaccucaugugucaugccacauucaccaugcggcugcugagccccgugcgcgucccuaacuacaaccucaucauuauggacgaggcccauuucaccgaucccgccuccaucgccgcgcgaggauacaucagcacacgcgucgagaugggcgaggccgcagggauauuuaugaccgccacgccgcccggcagccgagauccauucccacaguccaacgcucccaucauagacgaggagcgggagaucccugagcggagcuggaacagugggcaugagugggugaccgacuuuaagggaaagacagucugguucguaccgagcauaaaggcggggaacgacaucgccgccugccugcgcaaaaacggcaagaagguaauccagcugucccguaagaccuucgacagcgaguacguuaagacacguacgaacgauugggacuucguggugacgacggacauaagcgagaugggugccaacuucaaggcggagcgggucaucgacccgcgccgcugcaugaagcccgugauucucaccgacggugaagaacgcguaauucuggccggacccaugccagugacccacucuagcgccgcccaacggcgcgggcggaucggccgcaaccccaagaacgagaacgaccaguacaucuacaugggggagccacuggagaacgaugaggauugcgcacacuggaaggaggcgaagaugcucuuagacaauaucaacacgcccgaggggaucaucccgagcauguucgagcccgagcgggaaaagguggaugccaucgacggcgaguaccgccugcgcggggaggcccggaagaccuucguggaccucaugcggcgaggcgaccugcccgucuggcucgccuacaagguggcagcugaggguauaaacuacgcugaccgacgguggugcuucgacggcaucaaaaacaaccagauccucgaggaaaauguggagguggagaucuggacaaaggagggggaacggaaaaagcugaagccgagauggcuggacgcgcgcaucuacuccgacccccucgcccuuaaggaguucaaggaguucgccgcaggccggaagucccugacccucaaccugauuacugagaugggccgcuuaccaaccuucaugacccagaaaacccgugacgcccucgacaaccuggccgugcugcacacggcagaggccggcggccgcgccuacaaccacgcccucuccgaacugcccgagacccuggagacucucuugcugcucacccuguuagccacaguaaccgggggcaucuuccucuuccugaugagcggaagggggaucggaaagaugacccuaggcaugugcugcaucaucaccgccaguauucuccuaugguacgcgcagauccagccccacuggauugcggccagcauuauccuggaguucuucuuaaucgugcugcugauccccgagcccgagaagcagcgaacgccccaggacaaccagcuaaccuauguggucaucgccauccugaccguuguggccgcgaccauggcuaacgagaugggcuuccuggagaagaccaagaaggaccucggacugggauccaucgccacgcagcagccagagagcaauauccuggacauagaucuccggcccgccuccgccuggacccuguacgcggucgcgacaaccuucgucacgccgaugcugcgccacucgaucgagaacagcucggugaacgucucucucaccgccaucgccaaccaggccaccguguugaugggucuggggaagggcuggccucucucaaagauggauaucggugucccguuacuggcgaucggcugcuacagccaggucaaccccaucacccucacugccgcccugcuguugcugguggcccacuacgcaaucaucgggcccgggcugcaggccaaggccacccgggaggcucagaaacgcgccgcggcuggaaucaugaaaaaccccaccguggaugggaucacagugaucgaccuugacccgauccccuacgaccccaaguucgaaaagcagcugggccaggugaugcuccucaucuugugcgugacgcagguccugaugaugaggaccaccugggcccucugcgaggcccugacgcuggcaacggggcccauauccacgcucugggaggguaacccggggcgcuuuuggaacacaaccauagcgguuagcauggccaacaucuuccggggcucauaucuggcuggcgcagggcucuuguucagcaucaugaagaacacgaccaacacacgccgcggcacugggaacaugggugagacacugggugagaaauggaaaucccggcugaacgcccucggcaaaagcgaguuccagaucuacaagcgguccggcauacaggagguggaccguacucuggcgaaggaggggauuaagcgaggcgagaccgaccaccacgccguuagccggggauccgccaagcugcgcugguuuguggagcggaacauggugaccccggaaggcaaggucgucgaccucggcugcgggcgcggcggguggucguauuacugcggcgggcugaagaauguacgcgaggucaagggucucacgaagggcgggcccgggcaugaagaacccauuccgauguccaccuacggguggaaucucgugcgccugcaaagcgguguggaugucuuuuucaucccgcccgagaaaugcgacacccuguugugcgacauaggggaguccagccccaacccgaccguggaggccgggcgaacgcugcgcguacugaaccucguagagaacuggcugaacaacaacacccaguucugcaucaaagugcugaacccauacaugcccuccgugauagagaagauggaagcgcugcagcguaaguacggaggggcccugguccgcaacccgcugucacgaaacagcacccacgagauguacuggguguccaacgccaguggcaacauaguauccagcgucaacaugaucagucgcaugcugaucaaccgguucacaaugcgccacaagaaggccaccuacgagcccgacguggaccuagggagcgggacgcggaauaucgggaucgaguccgagauccccaaucuggacaucaucggcaagcgcaucgagaagaucaagcaggagcacgaaaccagcuggcacuacgaccaagaccacccguacaagacuugggccuaucacggcuccuacgagaccaagcaaacggggucugcguccucgauggugaacggcgucgugcgccugcucaccaagccgugggacgugcugcccaccgucacccagauggccaugacggacaccacacccuucggucagcagcggguauucaaagagaagguggacacucguacgcaggagcccaaggaaggaacgaagaagcugaugaagaucacggcugaguggcuguggaaggagcugggcaagaagaaaacaccccggaugugcacgcgcgaggaguucacccggaagguucgcuccaacgcggcccuaggggcgaucuucacagacgaaaacaaguggaaguccgccagggaggccguugaggacucgcguuuuugggagcugguggauaaggagcggaaccugcaccuggagggcaaaugcgagacaugcgucuacaacaugauggggaagcgcgagaagaagcucggagaguucggcaaagccaagggcagccgggccaucugguacauguggcugggcgcgcguuuccuagaguucgaggcccucggguucuuaaacgaggaccacugguucuccagggaaaauucucuguccggcguggaaggggagggccuccacaagcuggguuacauccuccgcgacgugagcaagaaggagggcggggccauguacgccgacgacacggcggggugggacacucggaucacccucgaggaucugaagaacgaagagauggugaccaaucauauggaaggcgaacacaagaaacuggcugaggccaucuucaagcucacguaucagaauaaggugguccgcgugcagcgacccacgccccgcgggaccgugauggacaucaucucccggcgagaccagcggggcuccgggcaggucggcaccuauggccugaacacguucaccaacauggaggcccagcucauccgccagauggagggggagggcguuuuuaagaacauccagcaccucaccgugacugaggaagucgcugugcaaaacuggcuggcgcgcguaggacgggagcgccuaagccggauggcgaucuccggcgacgacugcgucgugaagccccucgacgaccgcuuugcgaacgcccugaccgcccuuaacgacaugggcaaaauccggaaggacauccagcagugggagccgagcaagggguggaaugacuggacccaggugccuuucugcucccaccauuuucacgagcucauuaugaaggacggccgcguccuuguggugccgugccggaaucaagacgagcugauuggacgcgcgcguaucagccagggcgccggcuggucccuccgcgagaccgccugccugggaaaguccuacgcgcagauguggucccucauguacuuccaucggcgcgaucuccggcuggccgcgaaugcgaucugcagcgcaguccccucgcacugggugccgaccagccgcacgaccugguccauccacgccaagcacgaauggaugaccaccgaggacaugcugacgguguggaacagggucuggauccgcgagaaccccuggauggaggauaaaacgcccguagagucaugggaggaaauccccuaucucggcaagagggaggaccaauggugcggcucccugauaggccugaccagccgcgccaccugggcgaagaauauccaggcggccaucaaccaggugcggucccucaucgggaacgaggaguacaccgacuacaugccaaguaugaagcgcuuccgccgggaagaggaagaggccggcguccugugguga

SEQ ID NO: 25387 - RNA, 9876 nt, Artificial Sequence
  derived and/or modified CDS sequence (opt11) from DENV-2__EU482674__SS-prME
agcgccggcaugaucauaaugcugauccccaccgugauggccuuccaccucaccacccggaacggcgagccccacaugaucgucagcauucaggagaagggaaagucccuucuguucaagacagaggacggggugaauaugugcacccucauggcgauggaccugggugagcugugcgaggauacuaucaccuacaagugcccccuccuccggcaaaacgagccggaggacaucgacugcuggugcaacaguacuagcacgugggugaccuacgggacaugcacuaccaccggcgagcaccggagagagaagcgcuccguugcucuggugccccacguaggcaugggccuggagacccggaccgagaccuggaugagcagugagggcgccuggaagcacgcgcagcggaucgaaaccuggauccugcgucacccgggguuuacgaucauggccgcaauccuggcuuacaccaucggcaccacgcauuuccagcgcguccucaucuucauccugcugaccgccguggccccgagcaugaccaugcggugcauugggaucucuaaccgcgacuucguagagggcgucagcggcggguccuggguggacaucguccucgagcacggaagcugcgucaccaccauggcuaagaacaagcccacccuggacuucgagcugauaaagaccgaggccaagcagcccgccacucuccggaaguacugcaucgaagccaagcugaccaacacgaccaccgagucccgcugucccacccagggggagcccagccugaaggaggaacaggacaagcguuuugugugcaagcacuccaugguggaccgaggcuggggaaacggaugcggccucuucgggaaaggagggaucgugacgugcgcaauguucacgugcaagaagaauauggaaggcaaaaucguacagcccgagaaccuggaauacaccauaguggucacgccccacagcggcgaggagcacgcgguggggaacgacacugguaagcacgggaaggagaucaaggugaccccgcaguccagcaucaccgaggcagagcugaccggguacgggacagucacgauggaaugcagccccagaaccggcuuagauuucaacgagauggugcugcuucaaauggagaacaaggcuuggcucgugcaccgccaaugguuccuggaccuaccucuccccuggcugccgggcgccgauaagcaggagagcaacuggauccagaaggagacucuuguuaccuucaagaacccccacgcaaagaaacaggacgugguggugcuugguagccaggagggcgcgaugcacacggcgcugacgggggccacagagauccagauguccagcggcaacuugcuguucaccgggcacuuaaagugccgguuacgcauggauaagcuccagcugaaaggcauguccuauagcaugugcacaggcaaguuuaaggucguuaaggagaucgccgagacccagcacgggacgauugucaucaggguacaguacgaaggcgacgggucccccugcaagauucccuucgagaucauggaccuggagaagcgcuaugucuuaggcagacugaucaccgugaacccuauugugacggagaaggauucucccgucaacaucgaggcagagccgccguucggcgacuccuacaucaucaucgggguggaaccuggccagcugaaacucaacugguucaaaaaggggagcuccaucggccagauguucgagacuacuaugcgcggggcaaagagaauggccauccuuggggacaccgccugggacuucggcagccucggcgggguuuuuacguccauugggaaggcccuccaucaagucuucggugcaaucuacggggcggcguucuccggcguuuccuggaccaugaagauacugauuggagugauaaucaccuggaucgggaugaauagucgcuccacgucccuguccguaagccuggugcucgugggcaucgucacguuauaccugggggucauggugcaggccgacucaggcugcguagugagcuggaagaacaaggagcugaagugcggguccggcaucuucaucaccgacaacgugcacaccuggacugagcaauacaaguuccagcccgagucuccaagcaagcuagccuccgcgauccagaaggcgcaggaggagggcaucugcggcauccguucggucacgcggcuggagaaccucauguggaagcaaaucacccccgaacugaaccacauccuggccgagaacgaggugaagcucacuauuaugaccggcgacauccgcgggaucaugcaggcggguaagcggucucugcgcccgcagcccacugagcugaaauacagcuggaagaccugggggaaggccaagaugcuuagcaccgagagcuacaaccaaacuuuccugaucgacggcccagaaacggcugaaugcccgaacaccaaucgggccuggaacucccuggagguugaagauuauggcuucggagucuucacaaccaauaucuggcucaagcugaaggagaagcaagaugccuucugugauuccaaacugaugucagccgccaucaaggacaaccgcgcggugcacgcugauaugggcuacuggaucgagagcgcccugaacgacacguggaagaucgagaaggccuccuucaucgaagugaagaacugccacuggcccaagagucacacccuuuggagcaacggcguccuggagagcgagaugaucauacccaagaaccucgcuggccccgugucccagcauaacuaccggccggguuaccacacacagaucgcgggucccuggcacuugggcaagcuggagauggacuucgacuucugcgacgggacgaccgugauagucacggaggacuguggcaaccgcgggcccucccuccggacaacaacugccagcggcaagcuaaucacggaguggugcugccgcuccugcacccugcccccgcuccgauaccgcggagaggacgggugcugguacggcauggagauccgaccccugaaggagaaggaggagaaccuggugaacagccucguuaccgccgggcacggccaggucgacaacuucagucugggggugcuggggauggcacucuuccuggaagagaugcugcgcaccagggugggcacgaagcacgcgauccuccucguagccgugagcuucgugacccugaucaccgggaacaugucauucaaagaccucggccgcgucguagugaugguaggugccaccauggcggacgacaucggcaugggggugacguaccuggcccugcucgcggcuuucaagguucggccuaccuucgccgccggccugcuucucagaaaguugacaagcaaggagcugaugaugacgacgaucggcaucgucuuguugucccaaagcaccauccccgagaccgugcuggagcucaccgacgcccuugcgcucgggaugaugguacucaagaucguccggaacauggaaaaguaucagcuggcaguaacuaucauggccauccugugcguaccaaacgccgugauccuccagaacgcauggaaggugaguugcaccauccuggcggucgugucggucagcccccuacuccugacaagcucccaacagaaaaccgacuggaucccccuggcgcucacgaucaagggccugaaccccaccgccaucuuccugacuacccucagccggacgaacaaaaagcgcaguuggccgcugaaugaggccaucauggcugucgggauggucagcauucuggccuccagccuucugaagaaugacauucccaugacuggcccccugguggcuggcgggcugcugacgguaugcuaugugcugaccggucgguccgccgaccucgagcuggagcgagcaacggacgugaagugggaagaccaggcggagaucucugggagcucccccauccugagcaucacaaucuccgaggacggcagcauguccaucaaaaacgaggaggaagagcaaacccucaccauacugauccggacggggcugcucgucaucagcggccuguucccgauuuccauuccgauaaccgccgcggccugguaucugugggaggugaagaagcagagggccggcguccucugggacguucccuccccgccgcccauggggaaggcggagcucgaggacggagccuaccgaaucaagcagaaggggauucugggccauagucagaucggggccggcguguacaaggagggaaccuuccacaccauguggcacgugacacgcggggcaguccucaugcacaagggaaagcggauugagcccagcugggcugacgugaagaaagaccuaaucucguacgggggcggguggaagcuagaaggcgaguggaaggagggcgaggaagugcaaguccuugcgcuggagcccgggaagaacccgcgcgccguucagacgaagcccggucuauuuaagacuaacaccggaaccauuggcgccgugucgcuugacuucucccccgggacgucuggcucccccauaaucgacaagaaaggcaaggucguggggcuguacggcaacggcguggucacccggagcggcgccuacguguccgccaucgcgcagaccgagaaaaacaucgaggauaaucccgagaucgaagacgacaucuuccgcaagcggcgccucacaauaauggacuugcaccccggggccgggaagacgaagcgguaccuccccgccauagugcgcgaggccaucaagcggggccugcgcacccugaucuuagccccgacccgggucguagcagccgagauggaggaagccuugcgcgggcugccuaucagauaccagacccccgcgaucagagcugagcacacggggagggaaaucguggaccucaugugccacgccaccuucaccaugcgucugcugagcccgguacgcgugccgaacuacaaccucaucaucauggaugaggcacacuucaccgacccggccucgaucgccgcgcggggguacauuucaacucgcguggagaugggagaggccgccgguaucuucaugaccgcaacgccucccgggagccgagacccguucccccaguccaacgcccccaucaucgaugaagagcgcgagauccccgagcgaaguuggaacuccggacacgagugggucacagacuuuaaagguaagacggugugguucgugccaucgaucaaggcgggcaaugacaucgccgccugccugcgcaagaacgggaagaaggucauccagcugucucggaagaccuucgacagcgaguacguaaagacccgcaccaacgacugggacuucguggugacuaccgacaucucggagaugggagccaacuucaaggcugagcggguaaucgacccccgccggugcaugaagcccgugaucuuaaccgauggcgaggagcgcgucauccucgccgggcccaugccaguuacccacagcuccgccgcccaacgucguggccggaucgggcgcaacccuaagaaugagaacgaccaguauaucuacaugggggagcccuuagagaacgacgaggacugcgcccacuggaaggaggcgaaaaugcuucuggacaacaucaacacgcccgaggggaucaucccgagcauguucgagcccgagcgggagaagguggaugcuaucgacggcgaauaccgccuccgcggcgaggcccguaagaccuucguugaccuuaugcgccgcggggaccugccggugugguuagcauacaagguggcugcagagggcauaaacuacgccgaccgccgguggugcuucgacgggauuaagaacaaccaaauacucgaggagaacguagagguggagaucuggaccaaggaaggcgagcgcaagaaacugaagccgagguggcuugacgcccgcaucuacagugacccccucgcucucaaggaguucaaagaauucgcggcggggcguaaguccuuaacucucaaccugaucacggagaugggacgcuuacccaccuucaugacccagaagacgagagaugcucuugacaaucuggccguccugcacacggcugaggcgggcgggcgcgcuuauaaccacgcgcucuccgagcuucccgagacccuggagacccuccugcuccuuacacugcuggccacggugacuggcgguaucuuccucuucuugaugucugggcggggcaucgggaagaugacccugggcaugugcugcauuaucaccgccuccauacucuuaugguacgcgcagauccaaccgcauuggaucgccgccagcaucauccuggaguucuuucucaucgugcugcugauccccgaaccugaaaagcagcgcacgccucaggacaaucagcucacguacguuguuaucgccauccugacggugguugccgcaaccauggcgaacgagaugggguucuuagagaagaccaagaaggaccuaggccuggggagcauagccacgcagcagccggagagcaacauccucgacaucgaccuccggccugccuccgccuggacccuguacgcgguggccaccaccuucgugacgccuaugcuacgccacucuauagagaacagcuccgucaacguuagccucacggccaucgccaaccaggcaacggugcugaugggccugggcaaggguuggccccucuccaagauggacaucggcgucccgcugcuggcgaucggauguuauagccaggugaaccccaucacccucacggccgcucugcugcuccugguggcgcacuacgcgaucauuggccccggauuacaggcuaaggccacgcgggaggcccagaagcgcgccgcugcagggaucaugaagaacccgaccgucgacggcaucaccguuaucgaucuugacccgauccccuacgacccuaaguuugagaagcagcugggccaggugaugcugcuaauccugugugucacccagguguuaaugaugcggaccacgugggccuuaugcgaggcgcugacccuggccacgggccccauuucgacccucugggaggggaacccgggcagguucuggaacaccaccauugcggugagcauggccaacaucuuccgggggucauaccuggccggcgccggccuccuguuuagcauaaugaagaacacuaccaacacccgccgcgggacuggcaacauaggggagacgcugggcgagaaauggaaaucacgguugaacgcccugggcaaaagcgaguuccaaauuuacaagaagucggggauccaagaggucgaccgcacccuggcgaaagaaggcauaaagcgcggagagaccgaccaucaugccgugagccguggcucggccaagcugcggugguucguggagcgcaacauggucaccccugaggggaaggugguagaccucggcugcggccgcggcggguggagcuacuacugcggcggccugaaaaacguccgagaggugaaggggcuuacgaagggagggcccgggcacgaggagcccaucccgaugaguaccuacggcuggaacuuagugcggcugcagagcggggucgacguguucuucauuccucccgagaagugcgacaccuuacucugcgacaucggcgagucgagccccaacccgacuguggaggccgggcgcacgcuacggguccugaaccucguggagaacugguuaaacaacaacacccaguucugcauuaaagugcugaaccccuacaugcccagcgucauagagaagauggaggcgcugcagcgcaaguacgggggcgcccucgugcggaacccgcugagccgcaacagcacgcacgagauguacugggugaguaaugccagcgggaacaucgucaguuccgugaacaugaucucccggaugcucaucaaccguuucaccaugcggcacaagaaagccaccuacgagcccgacguugaccucggcagcgguacccgaaauauuggcaucgagucagagaagcccaaccuggacaucaucgggaagagaaucgagaagauuaagcaggagcacgagaccagcuggcacuacgaccaggaccacccuuauaagacuugggccuaccauggcucuuacgagaccaagcagaccggcagcgcgucgagcauggucaacgggguuguacgccuucucaccaaaccgugggauguucugcccaccgugacacaaauggccaugacggacacuacccccuucggccagcagcgcguguuuaaggagaaggucgacacccggacgcaggagcccaaggaggggaccaagaaacuaaugaaaaucacagccgaguggcuauggaaggaguugggcaagaagaagacgccgcgcauguguacgcgggaggaguucacccgcaaggugcgcuccaacgccgcgcugggcgcuaucuucacggacgagaauaaguggaaguccgcuagggaagccguggaagacuccagguucugggagcuggucgacaaggagcgcaaccugcaccuggaggggaagugcgagaccugcguguacaacaugaugggcaaacgagagaagaaguuaggggaguucgguaaggccaaagggagccgcgccaucugguacauguggcugggcgcacgguuccuggaguucgaggcacucggcuuccugaacgaagaccauugguucucccgcgagaacagccuguccggggucgaaggcgagggguuacacaaguuaggcuacauccugcgggacgugucuaagaaggagggcggggccauguacgccgacgacacggcgggcugggauacccgcaucacccucgaggaucugaagaacgaggagaugguuaccaaccauauggaaggggagcacaagaagcuggccgaggccaucuuuaagcucaccuaccaaaacaaggucgugcggguccaacgacccacgccucggggcaccgucauggacaucaucagccgccgggaucagcgcggcucuggacagguagggacuuacggccugaacacguucaccaacauggaggcacaacugauccggcagauggagggugagggggucuuuaagaacauccagcaccucaccguaaccgaagagguggccgugcauaacuggcuggcgcgcgucggcagggagcggcuaagccgcauggccaucuccggggacgacugcguggugaaaccccucgacgaccgguucgcaaacgcccugacagcccuuaacgacaugggaaagauccgcaaagacauccagcagugggagccgagcaagggcuggaaugacuggacccagguccccuuuugcucucaccacuuccacgaauuaaucaugaaggauggccgggugcuggugguccccugccgcaaccaggacgaguugaucggccgggcgcgcaucagccagggggccggcuggucccuccgggaaaccgccugccugggcaagagcuacgcccagaugugguccuugauguacuuucacagacgagaucuccgccuggccgcgaaugcaaucugcagcgccgugccaucucacugggugccgacuucccggacgaccugguccauccacgccaagcacgaguggaugaccaccgaggacaugcugacuguuuggaaccgcguguggauucgggagaaccccuggauggaggacaagacgcccguggaaagcugggaggagauccccuaccucgggaaaagggaggaccaguggugcggcucccugauagggcugaccagccgcgcuaccugggcgaagaacauccaggccgccaucaaccagguccggucccucaucggaaacgaggaguauaccgacuacaugccgagcaugaaacgguuccgccgcgaagaggaggaggccggugugcugugguga

SEQ ID NO: 25388 - RNA, 9876 nt, Artificial Sequence
  derived and/or modified CDS sequence (opt11) from DENV-2__EU482676__SS-prME
ucggcuucuaugauaauuaugcugauccccaccgucauggccuuucaccucaccacccgcaauggcgagccccacaugaucgucgggauccaggaaaagggcaagagccuucuguucaagaccgaggacggggucaauaugugcacauuaauggcgauggacuugggcgaacucugcgaagauaccaucaccuacaagugcccccugcugcgucagaacgagccagaggacaucgacugcuggugcaacucgaccucaaccugggugaccuacgggaccugcaccaccacuggcgagcaccgccgggagaagcgcuccgucgcccuggugccccaugugggcauggggcucgagacccggaccgagaccuggaugucuagugagggcgccuggaagcacgcccaacgcaucgagacuuggauacugcggcacccgggguucacgaucauggccgcaauucuggccuacaccauuggaacaacccacuuccagcggguccucauuuuuauccuccuaacggccguggcucccagcaugaccaugcggugcaucgggaucuccaaucgcgacuucguggagggcgucaguggcgguuccuggguggacaucgugcucgaacacggcagcugcgucacuacuauggcgaagaacaagcccacguuagauuucgaacugauaaagaccgaggcaaaacaaccugccacccucagaaaguacugcauaaaggccaaacugaccaacacgacgacugagagucgcugcccuacucaaggggagcccagccugaaggaggagcaggacaagcgguucgugugcaagcacuccaugguggaccgcggcugggguaacgggugcggccucuucgggaaaggcgggaucgucacgugugcaauguuuacgugcaagaagaacauggagggccggauaguacagcccgagaaccuggaguacaccaucguggucacaccccacagcggcgaggaacaugcggucgggaaugacacgggcaaacauggaaaggagaucaagguaacaccccaguccucgaucacagaggcggaacucaccgguuaugggaccgucacgauggaaugcaguccucggaccggcuuggacuucaacgaaauggugcugcugcagauggaaaacaaggcaugguuagugcaucggcagugguuccuggaccugccccucccguggcugccuggcgccgauaagcaggagagcaauuggauccagaaggagacccuggucaccuuuaagaauccccacgccaagaagcaggacguggucgugcuggggagccaggagggcgcaaugcauaccgcccuaaccggggccaccgagauccagauguccagcggaaaccuacuguuuacugggcaccugaaaugccgccugcguauggacaagcuccaguuaaagggcaugucuuacaguaugugcacgggaaaguucaaaguugucaaggaaauugccgaaacucagcacgggaccauaguaauccgagugcaguacgaaggggaugguucucccugcaagauucccuucgaaaucauggacuuggagaagcgauacguccuuggucgcuuaaucacggucaacccuaucgugacggagaaagacagccccgucaacaucgaggccgagccgcccuucggugacuccuacauaaucaucgggguggagccgggccaacugaagcucaacugguucaagaaggguuccuccaucggccagauguucgaaacaaccaugcgcggggcgaagcggauggccauccugggggauaccgcgugggacuuuggaucucucggcgggguguuuacauccauugggaaggcccuccaccaggucuucggggccauauauggggcggcauuuagcggcgugagcuggaccaugaagauccugaucggagucaucaucaccuggaucggaaugaacagccgcucgacuagccuuuccgugaguuuagugcucguggggaucgucacucuguaccuggggguaauggugcaagcggauaguggaugcgucgugagcuggaagaacaaggagcucaaguguggguccggcaucuuuaucaccgacaacgugcacaccuggaccgagcaauauaaguuccagcccgagucccccagcaaacuugccuccgcgauccagaaggcccaggaggagggcaucugcggcaucaggagcgucacgcgccuggagaaccucauguggaagcaaaucacaccagagcugaaccacauucucgcagagaacgaggugaagcucacgaucaugacuggcgacaucaaggguaucaugcaggcagggaagcgcuccuuacgcccacagcccacggagcuuaaguacucauggaagaccugggggaaagccaagaugcucuccacggagagcuacaaccagacauuccuuaucgacggcccagagacagcggagugcccgaacaccaaccgggccuggaacucgcucgagguggaggacuacggguucgggguauuuacaaccaacaucuggcucaaacucaaagagaagcaggacguguucugcgacucaaagcugaugagcgccgccaucaaggacaaccgugccgugcaugcggacaugggcuacuggauagaaagcgcccucaacgauacguggaagaucgaacgcgcuuccuuuaucgaggucaagaauugccacuggcccaagucacacacccugugguccaauggggugcucgaaucggagaugaucauccccaagaaccucgcgggcccugugucccaacacaacuaccguccgggcuaccacacucagaucgccgggcccuggcaucuuggcaagcuggagauggacuucgacuuuugcgacgggacuaccguuaucguuacugaggauugcggcaaccggggaccuagccuccguaccaccaccgcgagcgguaaacugaucaccgaauggugcugccggucgugcacucugccgccguuacgcuaccggggugaagacgggugcugguacggcauggagauccgcccucugaaggagaaggaggagaaccuggugaauagccucgucaccgccggucacggucagguggacaacuucucccugggggugcuuggcauggcccuguuccuggaggagaugcugcggacccgcgucgggacgaaacacgccauccuuuuaguagcggugagcuucguuacccugaucaccgggaacauguccuucaaggacuuaggccgggugguggucauggugggcgccaccauggcggaugacaucggcaugggggugaccuaucuggcccugcucgccgcauuuaagguccgcccaacauucgccgcuggccugcugcuccgcaagcugacaucuaaggagcugaugaugacgacgaucggcaucguguuacugucucagaguaccauccccgaaaccgugcuggaacugaccgaugccuuagcccuggggaugaugguucucaagaucgugcguaauauggaaaaguaccagcuagcggucacuauuauggccauccugugcgugccgaaugccgugauccuccagaacgccuggaaggucuccuguacuauccuggccgugguuagcgucagcccccugcucuuaacgagcucccaacagaagacagacuggaucccccucgcguuaacgauaaagggauuaaaccccaccgcaaucuuccugaccacccucagccgcacgaacaagaagcggaguuggccgcugaaugaggccaucauggccgugggaauggugagcauccuagcguccagccuccucaaaaaugacaucccaaugaccgggccccucgucgccggcgggcuccugacagugugcuacguccugaccggccgguccgccgaccucgagcuggaacgggccaccgacguaaagugggaggaccaggccgagauaagcgggagcucccccauucuuagcauaaccauuucugaggacggcagcauguccaucaagaacgaggaagaggaacagacccugaccauccuaauucgcacgggauuacucgugauaagcggacuguuccccauaucgaucccgaucaccgcggcagcuugguauuuaugggagguaaagaagcagcgugcaggcguccucugggacguacccaguccgccgcccauggguaaagccgagcuggaggacggcgcguauagaaucaaacagaagggcauucugggcuacucccagaucggggcuggugucuacaaggagggcacuuuccacaccauguggcacgucacccgcggagcggugcucaugcacaaagguaagagaaucgagccgagcugggccgacgugaagaaagacuugaucuccuacgggggcggguggaagcuggagggcgaguggaaggagggcgaggagguccaggugcucgcccuggagcccgggaagaacccccgggccgugcagacuaagccaggacuguucaagaccaacaccgggacgaucggugcugucucccucgacuucucccccgggacgagcggcucucccaucaucgacaaaaagggcaagguuguggggcuuuacgguaacggugucgugaccagguccggugccuauguauccgccauagcccagaccgagaaguccaucgaggauaaccccgagaucgaggacgacaucuuccggaagcgcagacugaccaucauggaccugcaccccggagcagggaagacgaagcgcuaccuccccgccaucguucgggaggccaucaagcgcggccugcggacccugauccucgccccgacgcgcgugguagcggcugagauggaggaggcucugcggggguuacccauccgcuaccagacucccgccauccgcgcggagcacacgggccgggaaaucguggaccucaugugccacgcgacuuuuaccaugcgcuugcugucccccgugaggguuccgaacuacaaccucaucaucauggacgaggcccauuucaccgaccccgccucuaucgccgcgcgugguuacaucagcacacgggucgagaugggcgaggcugccggcaucuucaugaccgccacgccgcccgggucccgcgacccguucccacagagcaacgccccaaucaucgacgaggagcgggaaauccccgagcgcuccuggaacagcgggcacgagugggucaccgacuucaaggggaagacugugugguucgugccguccaucaaggccgguaacgacaucgcggccugccugcguaagaauggcaagaaggucauccagcugagccgcaagacuuucgauagcgaauaugugaagacgagaacaaacgauugggacuucgucgugacgacugacaucagugagaugggugccaacuuuaaagccgaacgcgugauugacccucggcgcugcaugaagcccgucauccucaccgacggcgaggagcggguuauccuggcggggcccaugccggugacccauuccagcgccgcccagcgccgugguagaaucggccggaaccccaagaacgagaacgaccaguacaucuacaugggcgaaccccuagagaacgacgaggauugcgcccacuggaaggaggccaagaugcuccuggauaacaucaacacucccgaggguaucaucccguccauguucgagcccgagcgugagaagguggacgcgauagacggcgaauaccgccugagaggggaggcccgcaaaacguucguggacuuaaugcgucgcggagaucugccaguguggcuggcauacaagguugcggccgagggcaucaacuacgcggaccggcgcuggugcuucgauggaaucaagaacaaccagauccucgaggagaacguagaggucgagauuuggaccaaagaaggagagcgaaagaagcugaaaccucgcugguuggacgcccggauauacagcgacccccuggcccugaaagaauuuaaagaguucgcggccgggcgaaagucccuuaccuugaacuuaaucacagaaaugggccgguugccuaccuucaugacccagaagacccgugacgcauuagacaaucuggccgugcugcacacagccgaggccggagggcgagcguacaaccacgcccucagcgagcuccccgagacacuggagacucuccugcugcuaacccugcuggccaccgugacaggcgggauauuccuuuuccugauguccggacgcggcauagggaagaugacccugggcaugugcugcauuaucaccgccagcauccuccugugguacgcucagauccagccccacuggauagcggccuccauuauacucgaguucuuuuuaauuguccuguuaauccccgaacccgaaaagcaacggacgccccaggacaaccagcucaccuacgucgugaucgccauccugaccgucguggccgccaccauggcgaaugagaugggauucuuagaaaagaccaagaaagacuucggcuuagguagcaucgccacucagcaaccggagaguaacauacuggacauugaccugcgacccgccagcgccuggacccucuacgccguggcgacuaccuucgucacucccaugcugcggcauagcauugaaaauuccucggugaaugugucucugaccgccaucgcuaaccaggccaccguccucaugggccugggcaaggguuggccacugagcaagauggacaucggcgugccgcucuuggccaucggguguuacagccaagucaaccccaucacccucaccgcggcucuccugcugcucgucgcccacuacgcgauuaucggccccgggcugcaggcgaaggccacccgggaggcccaaaaacgggcggcugcgggcaucaugaagaacccaacuguggaugggauuaccgugaucgaucuggauccgauccccuacgaccccaaguucgagaagcagcuaggucaggucaugcuucugauacucugcgugacccagguguugaugaugcgcacgaccugggccuuaugcgaggcucucacacuggccacaggcccuaucagcacccugugggagggaaacccgggucgguucuggaacacuaccaucgccgucuccauggcgaacaucuuccgcggaagcuaccucgccggcgcuggccugcuguucuccaucaugaagaacacgaccaacacacgcagggggaccgguaacauaggcgaaacucucggcgagaaguggaaaucccgccugaacgcccugggcaaguccgaguuccagaucuacaagaaguccgggauucaggagguggaccggacgcucgcaaaagaaggcauaaagcgcggggagaccgaccaccacgcggugucccgggggucugccaagcugcgcugguucguagagcggaacauggucaccccugaggguaagguggucgaucugggcugcggccgcggggguugguccuacuacuguggaggguuacggaacgugcgggaggugaaggggcugacgaagggcggccccgggcaugaggaacccaucccgaugagcacauacggcuggaacuuaguccggcuccaguccggcgucgacguguucuucauaccgcccgagaagugcgacacccugcucugcgacauaggcgagucuuccccgaacccgaccgucgaagccggucgcacccugcgggugcugaacuugguggagaacugguuaaacaacaacacccaguucugcaucaaggucuuaaaccccuacaugcccagcgugaucgagaagauggaggcccugcagcgcaaguacggcggcgcguuggugagaaacccgcucucucgcaacuccacucaugagauguacugggucuccaacgcauccggaaacaucguuagcucugugaacaugaucagccggaugcugaucaaccguuuuacuaugcggcacaagaaagccaccuacgagccugacgucgaccuaggcuccgggacgcgcaacauuggcauugagucggagauccccaaucucgauauaaucgggaagcgcaucgaaaagaucaagcaggagcaugagaccuccuggcacuacgaccaggaccacccuuauaagaccugggcguaccacggaagcuacgaaaccaagcagacgggcuccgccagcuccauggugaacgggguaguccggcugcugaccaagccgugggacguacuucccaccguaacucagauggcgaugacggacaccaccccguuugggcagcaaagggucuucaaagagaaaguggacacgcggacgcaggaacccaaagaggguaccaagaagcugaugaagaucaccgcagaguggcuguggaaggaacucggaaagaagaaaaccccgcgcaugugcacgcgggaggaguuuacucguaaggugcggucaaaugccgcccugggcgcaaucuuuacugacgagaacaaguggaaaagcgcgcgcgaggccgucgaggacucccgguucugggaacugguggacaaggaacgcaaccuucaccuggaggggaagugugagaccugugucuacaacaugaugggcaaacgggagaagaaacuuggggaguucgguaaggcaaagggaucgcgcgccauaugguacauguggcucggcgcucgguuucuggaauuugaggcuuugggguuccucaacgaggaccacugguucagccgggagaacucccucagcgggguggagggcgaaggccugcacaaacuuggcuacauccugcgggacguaagcaagaaggaaggcggugccauguacgccgacgacacggccggcugggacacccgcaucacccuugaagaccugaagaaugaagagaugguuaccaaucacauggagggggaacacaagaaacucgcugaggcaaucuucaagcugacguaccagaacaaagucguacggguucagcggccuacgccgcggggcaccgugauggacauaaucuccaggagggaucagcgcggaagcggccagguggguacguacggccucaacacguucaccaacauggaggcgcagcugauacgccagauggagggcgaaggggucuucaagaacauacagcaccugaccgugacagaggagguugcggugcagaacugguuagccagagucggccgagagcggcugucccgcauggcgauaagcggggacgauugcguagucaagccccuggacgacagguucgccaaugcccucacugcacucaacgauaugggcaagauccgcaaggauauccaacagugggagccgucuaagggcuggaaugacuggacccaggugcccuucugcagccaccacuuccacgaacuuaucaugaaagacggccgagugcucguagugcccugucgaaaucaagacgagcugaucggacgggcucgcaucucgcagggggcgggcuggucccuacgggagaccgcaugccucgggaagaguuacgcccagauguggagccuaauguacuuccaccgccgggaccugcgcuuagccgccaacgcgaucugcucagccguccccucccauugggucccgaccucccggacgacauggucuauccacgccaagcacgaguggaugacaacugaggacaugcuggccguguggaaccgcguuuggauccgggagaauccuuggauggaggacaagacccccguugaauccugggaggagauccccuaccugggcaagcgcgaggaccaguggugcggcagccucaucgggcugacgucccgggcgacuugggcgaaaaacauccaggccgccaucaaccagguacgcucacugaucggcaacgaggaguacaccgacuacaugccgucuaugaagcgcuuccgacgagaggaggaagaggcggggguacucugguga

SEQ ID NO: 25389 - RNA, 9876 nt, Artificial Sequence
  derived and/or modified CDS sequence (opt11) from DENV-2__EU482677__SS-prME
agcgccgggaugaucauuaugcugauccccacggugauggcguuccaccuaaccacccggaacggugagccucauaugaucgucggcauacaggagaagggcaagucucuucuguucaagaccgaagacggcgugaacaugugcacccucauggcgauggaccugggcgaacugugcgaggauaccaucaccuauaagugcccccuccuccggcaaaacgagcccgaagacauugacugcuggugcaauagcacgucaaccugggugaccuacgguaccugcaccaccacgggcgagcacagacgggagaagcgcagcgucgcccugguaccccacguggggauggggcucgagacgcggaccgaaaccuggaugucgagcgagggagcguggaagcaugcacagcgcaucgaaaccuggauccugcggcacccuggauucaccaucauggccgcgauucuggccuacaccaucggaacuacgcacuuccagcggguccucaucuucaucuuacugaccgccguggcucccucuaugaccaugagauguaucgggauuagcaaccgugacuucguggagggcgucagcgggggcagcugggucgauaucgugcucgaacauggguccugcgugaccaccauggcgaaaaacaagcccacgcuggacuucgagcuuauaaagacggaggccaagcagcccgcuacccuccgaaaguacuguauugaggccaagcugaccaacacgaccaccgagagccggugcccuacccagggcgagcccucgcugaaagaagaacaggacaaacgguuugugugcaagcauucaaugguggaccgcggcugggggaacgguugcggccuguucggcaaaggcgggaucguaaccugcgccauguucacgugcaagaagaacauggagggaaagaucgugcagcccgaaaaccuggaguauaccaucguggucacgccccauuccggggaggaacaugccguuggcaacgacaccgggaaacacggcaaggagauuaaggugacgccccagagcagcaucaccgaagcagagcuaaccggguacggcaccguaaccauggagugcagcccgcggacaggucucgacuuuaacgagaugguccugcugcagauggagaacaaggccuggcucgugcaccgccagugguuccuggaccugccccuccccugguugccuggggcggacaagcaggaguccaauuggauccagaaggagacccucgucaccuuuaagaacccccacgccaaaaagcaggacguggucguccuaggcagccaggagggugcuaugcauacggcucucacuggcgccacagagauccagaugagcuccgggaaccucuuguucaccggccaccugaagugucggcuccgcauggacaaguuacaguuaaagggcaugagcuacucaaugugcacggggaaguucaaagugguaaaggagaucgcggagacccaacacgggaccaucgugauccgugugcaguacgagggggacggaagcccgugcaaaaucccauuugagaucauggaccuggagaagcgcuacguccucggccggcuaaucacagucaacccgaucgugacggaaaaggacuccccugucaacaucgaagccgagccacccuucggggacagcuacaucaucaucggcguggagccgggucagcugaaacucaacugguucaagaagggcuccuccaucgggcagauguucgaaaccacgaugcgcggcgcgaagcgcauggccauucugggcgacaccgccugggacuucgggucccugggcgggguguucacgagcaucggcaaggcccuccaccaggucuucggggcaaucuacggcgcggccuucuccggcgugagcuggaccaugaagauccucaucggcguuauuauaaccuggaucggcaugaacucccggagcaccagucugucugucucccuugugcucguugggaucguuacgcuguaucugggcgugauggugcaggccgacagcgggugcguuguguccuggaaaaacaaggaguugaagugcggcagcggaauuuucguuacugacaacgugcacaccuggaccgagcaguacaaguuccaaccagagagccccucgaaacuggcgagcgcgauccagaaggcucaagaggaggggauuugcgggaucaggagugugacgcggcuggagaaccuaauguggaagcaaauuacccccgaguugaaccacaucuuggccgagaacgaggugaaguuaaccaucaugaccggggacaucaagggaaucaugcaggcagggaagcggagccugcguccgcagcccacggagcugaaauacucguggaagaccuggggcaaggccaagaugcucagcaccgagucuuacaaccaaaccuuccugaucgacggccccgagacggcugagugcccgaauaccaaccgcgccuggaauagccuggagguggaggacuacggguuuggcguguucaccaccaacaucuggcucaaguuaaaggagaagcaggacgcguucugcgacuccaaacugaugucggccgccaucaaggacaaccgggcagugcacgccgacaugggguacuggaucgaguccgcccucaacgacacguggaagaucgagaaggcuuccuuuaucgaggucaagaacugccacuggcccaagucccacacccuguggagcaacggggugcuggagagcgagaugaucauacccaagaaccucgccggcccggugucccaacacaacuacagacccggguaccacacucaaaucgcgggccccuggcaucuggggaagcuggaaauggacuuugacuucugcgacggaaccacugucaucgugacggaggacugcgggaaucgggggcccucccuccguacgaccaccgccagcggcaaacugaucacugaauggugcugcagaagcugcacccugcccccgcucagauaccgcggggaggacgggugcugguacgggauggagauccgcccccucaaggagaaggaggaaaaucuggugaacuccuuggugaccgccggccacggccagguggauaacuucagccucggcguacugggcauggcacucuuccuggaggagauguugcggacccgcgucgggacgaagcacgcaaucuuacugguggcagugucauucgugacccugaucaccgguaacaugucuuucaaggaccucgggagaguuguggugauggucggcgccaccauggccgacgacaucgggaugggagugacguacuuagcccuguuggcggcauucaagguccgccccaccuucgcggccggucugcugcuccggaagcucacuuccaaagagcugaugaugaccacgaucggcaucgugcuccugagccagagcacgauucccgagacggugcucgagcucaccgacgcccuggcgcugggcaugaugguccucaagaucgugcgcaacauggagaaguaccagcucgcagucacaauuauggccaucuuaugcgugccgaaugccgugauacuccagaacgccuggaaggucuccugcaccauacucgcggugguguccguaagcccccugcuccugacguccagccagcagaagacggacuggaucccccuggcccucacgauuaaagggcuuaaccccaccgccaucuuucuaaccacucucagucgaacuaacaagaagcgguccuggccacuaaacgaggcuauuauggcagugggcauggugucaaucuuagccagcucgcuccucaagaacgacauccccaugacuggcccucuaguagccgggggccuccuuaccguguguuacguguugacgggacgcagcgccgaucuagaauuagagcgggccacggacgucaagugggaggaccaggcugagauuucgggcagcagccccaucuuaagcaucaccaucucggaggaugggaguaugagcaucaagaacgaggaggaggagcagacacucacgauccugauucgaacgggucuccuuguuaucuccggccuguucccgauaaguauccccauaaccgccgccgccugguaccugugggaggugaagaagcaacgggccgggguccucugggauguccccucgccgccgccgauggggaaagcggagcuggaggacggggcauaccgcaucaagcagaagggcauccugggguauagccagaucggggccgguguguauaaagaaggaaccuuccauacaauguggcacgugacccggggcgccguccucaugcauaaggggaagcgcauugaaccaagcugggccgacgugaagaaggaccugauuaguuacggcggcggcuggaagcucgaaggcgaauggaaggagggggaggaaguccaggugcucgcgcuggaacccgggaagaaccccagagcuguucagacaaagcccgggcuguucaaaacgagcaccggcaccaucggggccgucagccucgauuucagcccuggcacgagcggaucgccgaucaucgacaagaaagggaaggucgugggccuguacggcaacggcgucgugacucgcagcggcgccuacguuuccgcaaucgcgcagacggaaaagagcaucgaggacaaccccgaaauugaggacgacaucuuccggaaacgcagacugacgaucauggacuuacaccccggggcggguaagacgaaacgcuaucuccccgcaaucguccgggaggccaucaagcgcgggcugcgaacccugauccucgcgccgacgagagucguggcggccgagauggaggaggcacuucggggcuuacccauccgcuaccaaacgccagccauacgugcugagcacacggggcgcgagaucgucgaucucaugugucacgccaccuucaccaugaggcugcugucccccguucgggugccgaauuacaaccucaucaucauggacgaggcccauuucacagacccugccuccaucgccgcucgcggcuacaucagcacgcgggucgagaugggcgaggcggcggguaucuuuaugaccgcaacaccacccggcucccgugacccauucccacagagcaaugcccccaucauagacgaggaaagagagauccccgaacgcuccuggaauagcgggcacgaguggguaacugacuucaagggcaagacggucugguucguccccagcauaaaggccgggaacgacaucgcugccugccuucggaagaacggcaagaaggugauccaguuaucccgcaagaccuuugacucugaguacgugaagacaaagacgaacgacugggacuucgucgugacgacggacauaagcgagaugggcgccaauuucaaggcugagcgggugaucgauccccgacguugcaugaagccggucauccucaccgacggggaggagcgcgugauccuggccggccccaugccagugacucauuccucggcagcccagcggcgcgggcggaucggcagaaaccccaagaacgagaacgaccaguacaucuacaugggggagccccuggagaacgaugaagacugcgcccacuggaaggaggcgaagaugcuccuggacaacaucaacacgcccgaaggcaucaucccgucgauguucgagccggagcgggagaaggucgacgcuaucgacggagaguaccgccugcgcggcgaggcccgcaagaccuuuguggaucugaugcgccggggcgaccugccuguguggcuggccuacaaggucgcggcggagggcaucaacuaugccgacaggcgguggugcuucgacggcaucaagaacaaccagauccucgaggagaacgucgaggucgagauauggacgaaggagggggagcggaaaaagcugaagcccagguggcuggacgcccgcaucuacucggacccucuggcccuuaaggaguuuaaggaguucgccgcgggccggaagucucugacccucaaccugauaacggagaugggccgccuacccaccuucaugacccagaaggcccgggacgcacucgacaaccuggccgugcugcauacggcagaggccggcggucgagcuuauaaccacgccuugagcgaguuacccgagacgcuggagacccuccugcugcucacccuccuggccaccgucacuggugguaucuuucuauuccugauguccgggcggggcaucggcaaaaugacccuggggaugugcugcaucauuaccgcaucaauucuccugugguacgcgcagauccagccgcacuggauagccgccuccauaauccuggaguucuuccuuaucguccuacugauacccgagcccgagaagcagcgcacgccccaggauaaucaacuaaccuacguggugauagcuauccugacgguuguggcggccacuauggccaacgaaaugggcuuccuggagaagaccaagaaggaccucgggcugggcagcaucgcgacccaacagccugaguccaacauccuagacaucgaccugcgcccggcaagcgcguggacccuguacgccguagccacgacauuuguuacuccaaugcuucggcacagcauagaaaacagcagcgugaacguguccuuaacggccaucgccaaccaggcgaccguucugaugggccuggggaagggcuggccccucagcaaaauggacaucggggugccgcugcuggccaucggcugcuacucccaggugaaccccaucacucucaccgcggcccuacugcuccuaguugcgcacuacgccaucaucgggcccggguuacaggcgaaggccacgcgggaggcccagaagcgcgcggccgcgggcaucaugaagaaccccaccguggacgggauaaccgugaucgaccuugacccgauccccuacgacccgaaguucgagaaacagcugggccaaguuaugcuguugauccucugcgugacacaggugcuuaugaugcgcacgacgugggcccucugcgaggcucucacgcuggcgaccgggcccauuagcacacucugggagggcaacccugggcgcuucuggaauaccaccaucgccgucuccauggccaacaucuuuagaggcagcuaccuggccggcgccgggcucuuauucucgaucaugaagaacaccacgaacacccgucggggcaccgguaauauaggugagacacugggcgagaaguggaagucccgccugaacgcucuagggaaguccgaauuucagacguauaagaaguccggcauccaggaaguggacaggacauuagccaaggaggggauuaagcguggcgagacggaccaucaugcugugagccgggggagcgccaagcugcggugguucgucgagcgcaacaugguaacgcccgagggcaaggucgucgacuugggcugcggucggggcggguggucguacuacugcgggggucuuaagaaugugcgggaagugaagggccucaccaaaggagggcccggccacgaggagccgaucccgaugagcacauacggcuggaaccucguccggcugcaauccggcguggacguguucuuuaucccgcccgagaagugcgacacccugcucugugacaucggagagagcagccccaacccgacaguugaagcgggccgcacgcugcgggugcugaacuugguugagaacuggcugaauaacaacacccaguucuguaucaagguccucaaccccuacaugcccagcgugauugaaaagauggaagcccugcagaggaaguacggcggggcccucguacggaacccgcugagucgcaacucaacgcacgaaauguacugggucucgaacgcuuccggcaacauuguaagcucaguaaauaugaucagccggauguuaaucaaccgguucacgaugcggcacaaaaaggccacauacgagcccgacgucgaccuuggguccggcacgagaaauaucgggaacgaguccgagauccccaaucuagauauuaucggcaagcgcaucgagaagauuaagcaggagcaugagacguccuggcacuacgaccaagaccacccguauaagaccugggcuuaccacggaagcuacgaaacaaagcagacgggguccgccucgagcauggugaacggcgugguccgcuugcucaccaagccuugggacguucuccccaccgugacacaaauggcgaugacggauaccacccccuuuggccaacaacgggucuucaaggagaagguggacacccgaacgcaggagcccaaggagggcaccaagaaguuaaugaagauaaccgccgaguggcucuggaaagagcugggcaagaagaaaaccccacguaugugcacgcgggaggaguucacccguaaggugcggagcaacgccgcgcugggcgcgaucuucaccgacgagaacaaguggaaguccgcccgcgaggcuguggaggacagccgguucugggagcucguggacaaggaacgcaaccugcaucuggaggggaagugcgagacuugcgucuacaacaugaugggcaagcgggagaaaaagcucggcgaguucgggaaggccaagggcuccagggcgaucugguacauguggcugggcgcccgguuucuggaguucgaggcguuaggguuccucaacgaggaccacugguucagccgagagaacucccuuagcggcgucgagggggaaggucuucacaaacugggguacauccugcgggacgugagcaagaaggagggcggcgcaauguacgcggacgacacggccgggugggacacccgcaucacccucgaagacuuaaagaacgaggaaauggucacgaaccacauggagggugaacacaaaaagcuggccgaggccaucuucaagcucacguaucagaacaaggugguccgggugcagcgccccacgccccgggguaccguuauggacaucaucagccgccgagaucagcgcgguucaggccagguggggacuuacggcuugaacacguucaccaacauggaagcccagcugauccggcagauggagggggagggcgucuucaaaaacauccagcaccucaccgugacagaggaaguggcgguccagaacuggcucgcccgcgucgggcgggagagacugucccgcauggccaucagcggagacgacugcguggucaaacccuuggacgaccgcuucgccaacgccuugacggcgcugaaugacaugggcaagaucagaaaggacauccagcagugggagccguccaaaggguggaacgauuggacccaggugcccuuuuguucgcaccacuuccaugagcucaucaugaaggacggccgggucuuggugguaccuugccgcaaccaggacgagcugaucgggcgcgcccgcaucucccagggcgccggguggagccugagggagacugcuugccugggcaaguccuacgcccagauguggucguugauguacuuccaucgccgggaucuccggcuggcggccaaugccaucugcuccgccgugcccucgcacugggucccgaccucucggacgaccuggucuauccacgcuaagcacgaguggaugacgaccgaggacaugcugacgguauggaacaggguuuggauccgcgagaacccauggauggaggacaaaacccccgucgaaagcugggaggagauccccuaccucggcaaaagggaggaucaguggugcggcagccugaucggccugacuucccgggcaaccugggccaagaacauacaagucgccauuaaccaggugcguagccucaucgggaacgaggaguacacggacuacaugcccagcaugaagcgguuucgcagggaggaggaagaggccggcgucuuaugguga

SEQ ID NO: 25390 - RNA, 9876 nt, Artificial Sequence
  derived and/or modified CDS sequence (opt11) from DENV-2__EU482678__SS-prME
agcgcgggcaugaucaucaugcugauccccacggucauggccuuccaccucaccacccguaacggggagccccacaugaucguggggauccaagagaaggggaaaagccugcuguucaagaccgaggacggcgugaacaugugcacccucauggcgauggaccugggggagcugugcgaggacaccauaaccuacaagugcccccuccuucggcagaacgagcccgaggacaucgacugcugguguaacagcaccagcaccuggguuacguacgggaccugcaccaccaccggcgagcaccgcagagaaaagcguagcgucgcccuggugccccacguugggaugggccucgagacacggaccgagaccuggauguccagcgagggggcuuggaagcacgcccagcgaaucgagaccuggauccugcgucaucccggcuucacgaucauggccgcgauucuggccuacaccaucgggaccacgcacuuccagcgcguccucaucuucauccugcugacugccguugcccccucgaugaccaugcggugcaucggcaucagcaaucgggacuucguggagggcgucuccgggggcagcuggguggacaucgugcucgagcacggguccugcgucaccaccauggcuaagaacaagcccacgcuggacuucgaguugaucaagacggaggccaagcagcccgccacucucagaaaguacugcaucgaggccaagcugaccaacacgacuaccgagagccguugccccacucagggcgagcccucccugaaggaggagcaggacaaacgguucgugugcaaacacagcaugguggaucgcggcugggggaacggcugcggccuguucggcaagggcgggauaguuacuugcgccauguucacgugcaagaagaauauggagggcaagaucgugcaaccggagaacuuggaguacaccaucguggucacgccgcacuccggcgaggaacacgcggugggcaacgacacggggaagcacggcaaggagaucaaggugaccccucagagcuccaucacagaggccgagcugaccggguacggcacagucaccauggagugcagcccacggaccggccucgacuucaaugagaugguacugcugcagauggagaacaaggccuggcuggugcacagacagugguuucuggaccuaccccucccuuggcugccgggggccgacgagcaggaguccaauuggauacagaaggagacccuggucaccuucaagaacccccacgccaagaagcaagacguagucgugcucggcagccaggagggugccaugcacacugcccugacuggcgccaccgagauccagaugagcuccgggaaccuccuguuuaccggccaucugaaaugccggcugaggauggacaagcuccagcugaagggcaugagcuacuccaugugcacggggaaauuuaagguggucaaggagaucgccgagacccagcacggcaccauagugauccgcguucaguacgagggggacggcagccccugcaagauccccuucgagauaauggaccuggagaagcgcuacguccucgggcgacugaucaccgucaauccgaucgugacggagaaagauucccccgucaacaucgaggccgagcccccauuuggggacagcuacaucaucaucggcguagagccagggcaacugaagcucaacugguucaagaagggcuccagcaucgggcagauguucgagaccaccaugcgcggagcaaagcgcauggcaauccugggggauaccgccugggacuucgggucccugggcgggguguucaccagcaucggcaaggcccuccaccaaguguuuggggccaucuacggcgcggcuuucuccggcguguccuggaccaugaaaauccugaucggggugauuaucaccuggaucggcaugaacagucggagcaccucacugagugucucccuggugcucgugggaaucgucacacuguaccugggcgugauggugcaggcugacucugguugcgucguuuccuggaagaacaaggagcucaagugcggcagcggcaucuucauaaccgacaacgugcacaccuggaccgagcaguacaaguuccagcccgagagucccaguaagcuggccagcgcgauccagaaagcccaggaggagggcaucugcggcauccgcuccgucacgcgguuggagaaccucauguggaaacagauaacccccgagcugaaccauauccuggcagaaaacgaggugaagcugacuauaaugaccggugacaucaagggcaucaugcaagccgggaagcgcagccuucggccgcagcccacggagcugaaguacuccuggaaaaccugggggaaggccaagaugcugagcaccgaguccuacaaccagaccuuccugaucgacggccccgagacgaccgagugcccgaacacuaaccgcgccuggaacagccuggagguggaggacuacggguucggcguuuucacaacgaacaucuggcucaagcugaaggagaagcaggacgccuucugcgacuccaagcugaugagcgccgccaucaaggacaaucgggccgugcacgccgacaugggguacuggaucgaauccgcccucaaugacaccuggaagaucgagaaggccagcuucauugaggugaagaacugccacuggcccaagucccacacccuaugguccaacggcguccuggaguccgagaugaucauacccaagaaccucgccgggcccgugagccagcacaacuaccgcccgggguaccacacccagaucgccggccccuggcacuuggggaagcuggagauggacuucgacuucugcgacggaaccacggugaucgucacggaggacugugggaaccggggccccucccuccgcaccaccaccgcgucuggcaaacugaucaccgaguggugcugccggagcugcacccugcccccgcuccgcuaccguggggaggacggcugcugguacgggauggagauacgccccuuaaaggagaaggaggagaaucuggugaacucccucgugaccgccggucacgggcaggucgacaacuucagccugggcgugcugggcauggcccucuuucuggaggaaaugcugcggacgcgcguggggacgaaacacgccauccuccuggucgcgguguccuucgugacccugaucaccggcaacaugagcuucaaggaccucgggcgggugguaguuauggucggcgccacgauggccgacgacaucgguaugggggugaccuaucuggcccuccucgccgcguucaagguacgcccgaccuucgccgccggccugcugcuucguaagcugaccucgaaggagcucaugaugacgaccaucgguaucguccuccuuagccaguccacgauccccgagaccguauuagagcuuacggacgcccuggcccugggcaugaugguauugaagaucguccgcaauauggaaaaguaccagcuggcggugaccaucauggccauccugugcgucccgaacgccgucauccuccagaaugcguggaaggugucaugcaccauccucgccguaguguccgucucuccccuguuacugaccuccagccagcagaaaacggacuggaucccccuggccuuagcaaucaaagggcugaaccccaccgccaucuuccucaccacccucucccgaacgaacaagaagcggagcuggccgcugaacgaggcgauaauggcugugggaaugguguccauccuggccagcucccuccugaaaaacgacauccccaugaccggcccgcugguggccgggggucuccugacugucugcuacgugcugaccgggcgcagcgccgaccucgaacuagagcgggccacggacgugaagugggaggaccaggcagagaucuccggcuccagccccauucuguccauaaccaucagcgaggauggguccaugagcaucaagaacgaggaggaggagcagacccucaccauucugauacgcaccggucugcuggucauuuccggguuguucccgaucagcauccccaucaccgcagccgccugguaccugugggaggugaagaagcagcgggccggggugcucugggacguccccagcccgccgccaaugggcaaggcggagcucgaggacggggccuaccgcaucaagcagaagggcauccugggguacagccagaucggcgccggaguguacaaggaggguaccuuucacaccauguggcacgugacccggggcgccgugcuaaugcacaagggcaagcgcaucgagcccuccugggccgaugugaagaaggacuuaaucagcuacggcgggggcuggaagcucgagggcgaguggaaggagggggaggaggugcaagugcucgcgcuggagcccggcaagaacccccgagccgugcagacgaaaccggggcuguuuaagacuaacaccggcacgaucggggccgugucccucgacuucucucccggcacguccggcagccccaucauagauaagaaggggaaggucgugggccuguacgggaacggcguggucacccgcuccggcgcauaugugagcgccaucgcgcaaaccgagaaguccaucgaggacaaccccgagaucgaggacgacaucuuucggaagcgccggcugaccaucauggaucugcaccccggggccggcaaaacaaagcgcuaccuccccgccauagugcgggaagccaucaagcgcggacugcggacccucauccucgcuccgaccagaguuguggcagccgagauggaggaggcucugcggggccugccuauccgauaccagacccccgccauccgggcggaacacacggggcgcgagaucguggacuuaaugugucaugccacguucacgaugcgccugcuuagccccguccggguaccaaauuauaaccugaucauuauggacgaggcccacuucaccgaccccgccuccaucgccgcacgcggguacaucagcacgcggguggagaugggcgaggccgccgguaucuucaugacagccacgccgcccggcagccgugacccguucccucaaucgaacgcgcccaucaucgacgaggagcgggagauccccgagcgcagcuggaacacggggcacgaguggguuacggacuucaagggcaagaccgucugguucgugccauccaucaaggcggggaacgacaucgccgccugcuugcggaagaacgguaagaaggucauccagcugagccgcaagaccuucgauuccgaauacgugaagacccggacgaacgacugggauuucgugguuaccaccgauaucagcgagaugggcgccaacuucaaggccgagagaguuaucgacccccggcggugcaugaagcccgugauccucaccgacggggaggagcguguuauucuugccgggcccaugccgguuacgcacuccagcgccgcccagcgccgggggcgcaucggccggaacccgaagaacgagaacgaccaguacaucuacaugggggagccccuggagaaugacgaggacugcgcucacuggaaggaggcgaagauguuacuggauaacaucaacacacccgagggcaucauaccguccauguucgagccggagcgcgagaagguggacgccaucgacggagaguaccggcuccgcggcgaggccagaaagaccuucguugaccucaugcggcguggcgacuugcccguguggcuggccuacaagguggccgcggaggggaucaacuacgcugaccggcgcuggugcuucgacggcaucaagaacaaccagauccucgaggagaacgucgaaguggaaaucuggacuaaggagggugagcggaagaagcugaagccgcgcugguuggaugcccggaucuacagcgacccccucgcccugaaagaguucaaggaguucgccgcgggccgcaagucccuaacgcucaaccugaucaccgagaugggccggcugcccaccuucaugacccagaaaacgcgcgacgcccucgacaaccuggccgucuuacacacugccgaggccggagggcgggccuauaaccacgcccucucagagcugcccgagaccuuagagacccuccugcuguugacgcugcuugccaccgugaccgggggcauauuccucuuccugaugucaggccgcgggaucggcaagaugacccuagggaugugcugcaucaucaccgccagcauucuccugugguacgcgcagauccagccgcacuggaucgccgccuccauuauccuggaguucuucuugauugugcugcugauccccgagcccgagaagcagcgcacgccccaggacaaccagcucaccuacgucguuaucgcuauccugaccguggucgccgcgaccauggccaacgagauggguuuccuggagaagacgaagaaggaccucggguugggcagcaucgccacccagcagccggagucaaacaucuuggacauugaccuccgccccgccagcgccuggaccuuguacgcgguggccacaaccuucguuacgcccaugcugcgucacuccaucgaaaacagcagcgucaacgugucccucaccgccaucgccaaccaggccaccgugcugaugggccuggggaagggcuggccccucuccaagauggacaucggggucccgcugcuggcgaucggauguuacagccaggugaaucccaucacgcucaccgccgcauuacuacuccugguggcccacuacgcaaucaucgggccgggucugcaggccaaagccacccgcgaggcccagaagcgggcugcggccggcaucaugaagaaucccacugucgacgggaucacggugaucgacuuagacccgauccccuacgaccccaaguucgagaagcagcugggccaagugaugcugcucauucugugcguaacccagguguugaugaugcguaccaccugggcccucugugaggcccugacccuggcgacaggccccaucagcacccucugggagggcaauccggggcgguucuggaacaccacgaucgcgguguccauggccaacauauuccguggcagcuaccuggcuggagcagggcuccucuucuccaucaugaagaacaccacuaauacccggagaggcacggggaacaucggcgagacguuaggcgagaaguggaagucccgccugaacgcacucgggaaguccgaauuccagaucuacaaaaaauccggcauucaggaggucgaccggacccuggcaaaagagggcaucaagcgcggcgagaccgaccaccacgccgugucccgggggagcgccaagcugcgcugguuuguggagcggaacauggucacgcccgagggcaagguggucgaccucggcugcgggcgcggcgggugguccuacuacugcggcgggcugaagaacgugcgagaggugaagggccugacaaaaggagggcccgggcacgaagagccuaucccgaugagcaccuauggguggaaccucgugcgccugcagucggguguggacguguucuucaucccucccgagaagugugacacucugcucugcgacaucggggagagcucccccaacccgacgguggaggccggccggacucugcgcguccugaaucucguggagaacuggcugaacaacaacacccaguuuugcaucaaggugcugaaccccuacaugccgucggucaucgagaaaauggaggcccuccagcguaaguacggcggggcucucgugcgcaacccgcuguccaggaacagcacccaugagauguacugggugagcaacgcguccggcaacauuguaaguuccgugaacaugaucagccgcaugcuuaucaaccgguucacaaugcgccacaaaaaagccacguacgagcccgacguugaccucgguuccggcacccggaacaucgggaucgagagcgagaucccaaaccuggacauaaucggcaagcguaucgagaaaaucaagcaagaacacgagaccuccuggcacuacgaccaggaccaccccuacaagaccugggcguaccacggcagcuacgaaacgaagcagaccggguccgcgagcuccauggucaacggcguuguucggcugcucaccaagccgugggacguccugccgaccgugacucagauggccaugaccgacaccacccccuuugggcagcagcgcguguucaaggagaaggucgacacgcgcacccaggaacccaaggaggguaccaagaaguugaugaagaucaccgccgaauggcucuggaaggaacucggcaagaagaagacgccgagaaugugcacucgcgaggaguucacccggaaggugcgcagcaacgccgcccugggagcgauuuucacggacgagaacaaguggaagucagccagagaggcugucgaggacagccgguucugggagcuggucgacaaggagcggaaccugcaccuggagggaaagugcgagacgugcguguacaacaugaugggaaagcgcgagaagaagcucggcgaauucgggaaggcgaagggcuccagagccauuugguauauguggcugggcgcacgguuccuagaguucgaggcccucggguuccugaacgaggaccacugguucagccgggagaacucccugagcggcgucgagggggagggguuacauaagcugggguacauccuacgcgacgugucaaagaaggagggcggcgccauguaugccgaugacaccgcggggugggauaccagaaucacacucgaggaccucaagaacgaagagauggugacgaaccacaugaagggcgagcacaagaagcuggccgaggccaucuucaaacucaccuaccagaacaagguggugcgcguacagcggcccacgccccgggggaccgucauggacauaauuagccggcgcgaccagcggggcucaggccagguggguacguacggccugaacaccuucaccaacauggaagcacagcugauccgccagauggaaggggagggcguauucaagaauauacagcaccucacggucacggaggagguggccgugcagaacuggcuggcgcgugucgggcgcgagcgccugucccggauggccaucagcggcgaugacugcguggugaagccccucgaugaccgcuucgccaacgcccugaccgcccugaacgacaugggcaagauccggaaggacauccagcagugggagccguccaagggguggaacgacuggacccagguccccuucugcagccaccauuuccacgaguugaucaugaaggacggccgggugcugguuguccccugccggaaucaggacgagcugauugggcgcgcucggaucucccagggcgccggguggagccugcgcgagaccgccugccugggcaaguccuacgcccagauguggagccuuauguacuuccaccggcgcgacuuacggcuggccgcuaacgccaucugcuccgcggugcccagccauugggugccgacgagccgcaccaccuggagcauccacgccaaacaugaguggaugaccaccgaggacaugcugacagucuggaaccggguguggauccgcgagaaccccuggauggaggacaagacgcccguagaguccugggaggagauccccuaccucggcaagcgggaggaucaguggugcgggucgcugaucggccugaccucccgcgccaccugggcgaagaacauccaggccgccaucaaccagguccggagccucaucgggaacgaggaauacacggacuauaugccguccaugaagcgcuuccggcgcgaggaggaggaggccggcgugcugugguga

SEQ ID NO: 25391 - RNA, 9876 nt, Artificial Sequence
  derived and/or modified CDS sequence (opt11) from DENV-2__EU482679__SS-prME
agcgccggaaugauaauuaugcucaucccaaccgugauggcguuccaccucacgacccgcaauggagagccacauaugaucgucggcauccaggaaaaggguaagagccugcuguucaagacggaagauggggucaacauguguaccuugauggcaauggaccugggggaacugugcgaggacaccaucacauacaaguguccccugcuacgucagaacgagcccgaggauaucgacugcuggugcaacuccaccagcaccugggucacauacgggaccugcacgaccacaggggaacaccgccgggagaagcgcagcgucgcccuggucccgcacguagggaugggccucgagacccgaaccgagaccuggaugucuagcgaaggggccuggaagcacgcacagcgaaucgaaacuuggauccuuaggcaccccgguuucacgauaauggccgccauccucgcguacaccaucgggaccacccacuuccaacgaguccucauuuuuauccuguugacggccgucgccccgucuaugacaaugcguugcaucgguaucucaaaccgcgauuuuguggagggcgucuccggcgguagcuggguugacaucguucucgaacacgguuccugcgugacgaccauggcgaaaaacaagcccacguuggauuuugaacuuauuaagacagaggccaagcagcccgccacacuccgaaaauacugcaucgaagccaaacugaccaacacaaccaccgagucccgaugucccacgcagggcgagcccagucugaaggaggagcaggacaagcguuucgugugcaaacacucaaugguggaucgcggaugggggaacgggugcggcuuguucggcaagggcggaaucgucacgugugccauguucacuugcaaaaagaacauggagggcaagaucgugcagcccgaaaaccucgaauacacaaucguggucacgccccauuccggcgaggagcaugcaguugggaacgacacggguaagcauggaaaagagauuaaggugaccccgcagucgaguaucaccgaggccgaacugaccggguauggcaccgucacgauggaguguucaccccggacgggccuagauuucaacgagauggugcugcuccaaauggagaacaaagccuggcucgugcaccgccagugguucuuagaccugcccuuaccguggcucccgggugccgacaagcaggagucaaacuggauccaaaaggagacccuuguuaccuucaagaauccgcacgcaaagaagcaggacgugguagugcuuggcucgcaggagggggcgaugcacacugcccuuacgggcgccacugaaauccagaugaguuccggcaaccuccuguucaccgggcaccugaagugucgucuucgcauggacaagcuccaacuaaaagggaugagcuacuccaugugcacugggaaguucaagguugucaaggaaauugccgagacccaacauggcaccaucgugauccggguacaauacgagggugacgggagucccugcaagauccccuuugaaaucauggaccucgagaagcgcuauguacucggucgucugaucacggucaacccaauugucacagagaaggauuccccugucaacauagaggcugaaccgcccuuuggggacagcuauaucauaaucggagucgagccgggucagcuuaagcuaaacugguucaagaagggcuccagcaucgggcaaauguucgagacgacaaugcgcggcgcgaagagaauggcaauccugggcgacacggcaugggacuucggguccuugggcggggucuucacuagcaucggcaaggcccuccaccaagucuucggggccaucuacggcgcggccuucagugggguuaguuggaccaugaagaucuugauuggggucaucaucaccuggaucggcaugaauucccgaagcaccuccuugagcguuagccugguccucguaggaaucgucacgcuguacuugggcgucaugguccaggcugacagcggaugcgucguuucauggaagaacaaggagcucaagugcggcagcggaaucuucauaaccgacaacgugcacacauggacagagcaguacaaguuccagcccgagagcccauccaagcuggccagcgcgauccagaaggcacaggaggaagggauuugugguauacgcagcgucacgcgguuagaaaaucugauguggaagcaaaucacccccgaacugaaucauauucuggccgagaacgagguaaaacucacgauaaugaccggcgacaucaaggggauaaugcaagccgggaagaggagccugcggccgcagcccacugagcuaaaguacuccuggaaaaccuggggcaaggccaagaugcucagcaccgaaucucacaaccagacuuuccugaucgacggccccgaaacagcggagugcccuaauaccaaucgcgccuggaacucacuggaaguggaggacuacggcuucggcguguucaccaccaacauauggcugaagcuaaaggagaagcaggacgcauuuugcgacaguaagcugaugagcgccgcgauuaaggauaaucgggcgguucacgccgauaugggauacuggauugagucugcgcucaacgacacguggaaaaucgaaaaggcuagcuucaucgaggugaaaaacugccacuggccuaagucgcacacccuguggagcaacggcgugcuagaguccgaaaugauaauccccaagaaccucgcgggucccguaagccagcauaacuaccgcccgggguaccacacccaaaucgcaggccccuggcaccuuggcaagcuagagauggacuucgauuucugcgacggcacgaccgugauugucacggaggacugcgggaacaggggcccuucccuccgaaccaccaccgcgucaggcaagcucauuacggaguggugcugccgaagcugcaccuuacccccacuccgcuaccggggagaggacggaugcugguacggcauggaaauccgcccccuaaaggagaaggaagagaaccugguuaauucccucgugaccgccggccacgggcaagucgauaacuucagccugggagugcucgggauggcccucuuccuggaggagaugcugcggacccgcguagguacgaagcacgcaauccuccuggucgccgugagcuucgugaccuuaauuacgggcaacaugagcuucaaggaccucgggcgggucguggugaugguuggcgccaccauggcggacgacaucgggaugggcgugacguaucuggcgcuacucgcggccuucaagguucgccccaccuucgccgccggccugcugcuccggaaguugaccuccaaggaacugaugaugaccacgaucgggaucguccugcugagucagucaacgauuccggaaaccguccuggagcugaccgacgcccuggcuuuaggcaugauggugcucaagauagucaggaacauggaaaaauaccagcuggcggucacgauuauggccauccugugcgucccgaacgccgugauacuccagaacgcguggaaggugagcugcacgauucuggcgguugugagcguaucuccucugcuccugaccuccucacagcagaaaacggacuggaucccacuggccuugacgaucaaggggcugaaccccaccgccaucuucuugaccacacucucccggaccaauaaaaaacggucguggccgcugaacgaagccaucauggcgguaggcauggugucgaucuuggcuagcucccuccugaagaacgacauccccaugaccggcccgcuggucgccgggggccuccugaccguuugcuacgugcugacggggcguagcgcggaucucgagcuggagcgggccaccgaugugaagugggaggaccaggcugagaucuccgguucgagccccauccuguccauaaccaucucggaggacggguccaugagcaucaaaaacgaggaggaggagcagacgcugaccauccuaauccgcacgggauugcucgucaucuccggcuuauuuccgaucagcaucccuauaaccgccgccgccugguaccugugggaggucaaaaagcagcgugccggggugcucugggacguuccgagcccgccgcccaugggcaaagcggagcuagaggauggggccuaucgcauaaagcagaagggcauccuggguuacagccagauuggcgccggcguuuacaaggaggggacuuuccauaccauguggcacgugacacggggcgccguccucaugcacaagggaaagcgaaucgagcccuccugggcggacgugaagaaagaucugauuuccuacggggggggguggaagcuagaaggcgaauggaaggagggugaggagguccaggugcucgcucuggaaccuggcaagaacccacgagcgguacagacgaaacccgggcuauucaagaccaauacgggcacgaucggggccgugucccucgacuucagcccuggcacguccgggagucccaucaucgacaagaaagggaaggucgugggccuguacgggaacggaguggucacccguuccggggccuaugucuccgccaucgcccagaccgagaaauccaucgaggauaacccugagaucgaggacgacaucuuccggaaacgccgcuuaaccaucauggaccugcacccgggugccggcaagacgaagcguuaccucccggccaucgugagggaagccauaaagcgcgguuuacggacgcugauccucgcgcccacccgcgugguggccgcugagauggaagaggcccuccggggccugcccauccgcuaucaaacccccgccauccgcgcggagcacacaggucgcgagaucguagaccuaaugugccacgccaccuucacuaugaggcugcuguccccgauccgggucccgaacuacaaccucaucaucauggacgaggcgcacuucaccgaccccgcauccaucgccgcuagaggcuacaucuccacgagaguggaaaugggugaggcugccggaauuuucaugaccgccacgccgccugggagccgcgacccguuuccccaauccaaugcccccauuauugacgaggaacgugaaauuccagagaggucuuggaauucugggcaugagugggugaccgacuuuaagggcaagacuguuugguucgugccgagcauaaaggcggggaacgacaucgcagccugccugaggaagaacggcaagaaggucauccagcucucccgcaagaccuuugacagugaguacgucaagacaagaaccaaugacugggauuucgucgugacuacagacauuuccgaaaugggcgccaacuucaaggcggagagagucaucgacccgcggcggugcaugaagccagugauccucaccgacggggaggaacgugugauccuggccggccccaugccggucacucacucguccgcagcccagcggcggggaaggaucggccggaacccgaagaacgagaacgaccaauacaucuauaugggcgagccccuggagaacgacgaggauugcgcacacuggaaagaggcgaagaugcuccuagacaacaucaacacuccugagggcauuaucccgagcauguucgaacccgagcgcgaaaaaguagacgccaucgacggggaguaccggcugcgcggagaggcccguaagaccuucguggacuuaaugcgccgcggcgauuuacccgucugguuagccuacaaaguagccgccgaggggaucaacuacgccgaccgacgguggugcuucgaugguauuaaaaauaaccagauccucgaggagaacguggaagucgagauuuggaccaaggagggugaacguaaaaagcugaagccccgcuggcuggacgcgcguauuuacuccgacccacucgcccugaaggaguucaaggaguucgccgcgggccggaagagccugacacucaaccugauaaccgagaugggccggcugcccacuuucaugacccagaaaacucgcgacgcccuagacaaccuggccgugcugcauacugcggaggccggggggcgggcuuauaaccaugcccuuagcgagcugcccgaaacgcuggagacccugcuucuacucacucuacuggccacggucaccggcggcauuuucuuauuccugaugaguggccgcggaaucggcaagaugacacuggggaugugcuguaucaucacggccuccauacuccugugguacgcucaaauccagccccacuggauagccgcuaguauaauccucgaauuuuuccuuauagugcugcugauaccugagcccgagaaacagcgcacuccccaggacaaucagcuaacguacguagucauugcgauccugaccguggucgccgcgaccauggccaacgagaugggcuuucuggagaagaccaagaaggauuuagggcugggcucgauugccacgcagcagccggagagcaacauucucgacaucgacuuacgccccgcauccgcguggacccuguacgcggucgcaaccacauucguuacccccauguuacggcacagcaucgagaacagcuccgucaacgucucccuaaccgccaucgcuaaccaggcgaccgugcugaugggacuagggaaaggcuggccccucucuaaaauggauaucggaguaccgcuccuggccaucggcugcuacagccaggucaaccccaucacgcuaacggccgcccuccuacuccugguggcacacuacgcuaucauugggcccgggcugcaggccaaagccacccgcgaggcacagaagcgggccgcggccggaauuaugaagaaccccaccguggacgguaucaccguuaucgaccucgacccgauucccuacgaucccaaauucgaaaagcagcuaggccaggugaugcuguuaauccugugcgugacccaggucuuaaugaugagaaccaccugggcccucugcgaggcccugacccuggccacggggcccauaagcacccugugggaggguaacccugggcguuucuggaacaccaccaucgcggugucaauggccaacauuuuccggggcuccuaccuggccggagccgggcuccucuuuagcaucaugaaaaacacuaccaacacgcgacguggcacugggaacaugggagagacgcugggagaaaaguggaagagccgccugaacgcccucggcaaguccgaguuccagaucuacaagaaaucaggcauccaagagguggaucggacgcuagcgaaggaggggauaaaacgcggagagacagaccaccacgccguaagccggggguccgccaaguuaaggugguucguagagcggaauauggugacccccgagggcaaggucguggaccuaggcugugggcgcgguggauggaguuacuauugcggcggguuaaagaacguuagagaggugaagggcuugacgaagggcgggcccggccacgaagaacccauaccuauguccaccuacggguggaaccucguacgacuccagagcggaguggacguauuuuuuauuccgcccgagaagugcgauacccugcucugugacaucggugaguccucucccaacccuacgguugaagcuggccgcacacugcgcgugcugaaccucguagagaacuggcugaacaauaacacucaguucugcaucaagguacugaaucccuacaugcccucugugaucgagaagauggaggcgcuccaacggaaguauggcggcgcccuuguucgcaauccguugucccggaacucaacucacgagauguacuggguuuccaacgccuccggcaacauuguguccagcguaaacaugauuucacgcauguugaucaaccgguucacuaugcggcacaaaaaggcaaccuacgagcccgacguggaucucggaagcggcacgcggaacauugggaucgagucagagauccccaaucuggauaucaucggcaagcggaucgagaagaucaagcaggagcacgagacaaguuggcacuacgaccaggaccauccuuacaagacuugggcauaccacggguccuacgagacgaaacaaacggggucagcguccagcauggugaacggcgucgugcgguuauuaaccaaaccgugggacguucugccuaccgucacccaaauggcaaugacagauaccacccccuucgggcagcagcggguguuuaaggagaagguggacacccgcacgcaggagcccaaggaggguacuaagaagcugaugaagaucaccgcggaaugguuguggaaagagcugggcaaaaagaagaccccgcgaauggggacgcgcgaggaguucacccgcaaaguacgauccaacgcagcccugggagcgaucuucacugacgagaacaaauggaaguccgcucgcgaggccguggaggacucgcgcuucugggagcuaguggacaaggaacggaaccugcaucuggaggggaagugcgagaccugcgucuacaauaugaugggcaagcgcgaaaagaaguugggggaauucggcaaggccaaagguagccgggccaucugguauauguggcugggggccagauuucuggaguucgaggcccucggcuucuugaacgaggaccacugguucucaagggaaaacucgcugaguggggucgagggcgaggggcugcacaagcugggcuacaucuuaagggacgucaguaagaaagagggcggggcaauguacgccgacgacacggcuggcugggacacccggaucacccuagaggaucuuaagaacgaagaaaugguaacuaaccacauggagggagaacacaagaaacuggcugaggccaucuuuaagcucacuuaccagaacaagguuguccgugugcagaggcccacuccgcgcgguaccgugauggacauaaucagccggcgcgaccagcgugggaguggacaagucggcaccuacgggcugaauacguucacuaauauggaggcgcagcuaauccgccagauggaaggugagggaguauuuaagaacauccagcacuuaaccgugaccgaggaagucgccgugcagaauuggcuggcgcgcgugggcagagagcgccuuucucggauggccaucuccggcgaugauugcgucgucaagccucucgacgaccgcuucgccaacgccuugacggccuuaaacgauaugggcaaaauccggaaagacauacagcagugggagcccagcaagggcuggaacgauuggacccaaguccccuucugcucccaucacuuccacgaguugauaaugaaggacggacgcguccuggugguccccugccggaaccaggacgaacugauugggcgcgcgcgcaucucccagggggccggcuggucccuccgcgagaccgccugccuagggaaaagcuacgcccagauguggucgcugauguacuuucaccggcgcgaucugcggcuugcugcgaacgccauuugcuccgcaguacccucccacugggugccgaccagccgcacgacgugguccauccaugcgaagcacgaauggaugaccacagaggauaugcuuaccguguggaaccgggucuggauccgcgagaaucccuggauggaggacaagacacccguggaguccugggaagagauccccuaccucgggaagcgugaggaccaauggugcggcucccuaaucgggcugaccagccgugcgaccugggcgaagaauauucaggcggccaucaaccaggugcgaucucuuaucggcaaugaagaguacacugacuauaugccgagcaugaagcgguuccggagggaggaagaggaggccggggucuugugguag

SEQ ID NO: 25392 - RNA, 9876 nt, Artificial Sequence
  derived and/or modified CDS sequence (opt11) from DENV-2__EU482774__SS-prME
agcgcggggaugauuaucaugcugauccccaccgugauggcauuccaccucaccacgcggaacggagagccccacaugaucgucggcauccaggagaaggguaagucccugcuguucaaaaccgaggacggugugaacaugugcacccucauggccauggaccugggggagcugugcgaggacaccaucaccuacaaguguccccuccugcggcagaaugagccagaggacauagacugcugguguaacagcaccagcaccugggugaccuacgggaccugcacuaccaccggugaacaccggcgggagaagcgcagcgucgcccuggugccacacgucgggaugggccucgagacccggacggagaccuggauguccagcgagggggccuggaagcacgcacagcgcauugaaacuuggauccugcggcacccgggcuucacgauaauggccgcaauccuggccuacaccaucgggaccacccacuuccagcgcguccucaucuucauccugcucacggccguggcccccuccaugaccaugcgcugcauagguaucagcaaccgcgacuucguggagggcguaucugggggauccuggguggacaucgugcucgagcacgggucuugcgucaccacuauggcuaagaacaagcccacgcuggacuuugagcugaucaaaaccgaggccaagcagcccgccacccuccggaaguacugcauagaggccaaacuaaccaacacaacaaccgagagccgcugcccuacccagggggagcccucccuaaaagaagagcaggauaagcgguucguaugcaagcacuccaugguggaucgcggcugggguaacggcugcggccuguucggcaagggcgguauagucacaugcgccauguucacgugcaagaagaacauggagggcaagaucgugcagcccgagaaccuggaguauaccaucguggucacgccacacuccggggaagagcacgcaguagguaacgacacggguaagcacggcaaggagauuaaggugaccccgcagagcuccaucaccgaggccgagcugacuggguacggcaccgucacgauggaguguagcccccggaccggccucgacuucaacgagaugguucuguuacaaauggagaauaaggccuggcuagugcaccgccagugguuccuggaccugccccuucccuggcugccgggugcugacaagcaagaguccaacuggauacagaaggagacccuggucaccuucaagaacccccacgccaaaaagcaggacguugucguguuaggcucucaggaaggggcgaugcacacggcacugaccggcgccacugagauccagaugagcuccgggaaccucuuauucaccggccaccugaagugccggcugcgcauggacaagcuccagcugaagggcaugagcuacuccaugugcacggggaaauuuaagguggucaaggaaaucgccgaaacccagcacgggaccaucgugauacgggugcaguaugagggggacggcagccccuguaagauccccuucgaaaucauggaccuagagaagagguacguccucggccggcugaucaccgucaacccgauagugacggagaaggacucccccgucaacaucgaggccgagccgccuuucggagacagcuacauaaucauuggcguagagccgggucagcuaaaguuaaauugguucaagaagggauccucgaucgggcaaauguucgagaccaccaugcgcggcgccaagcgcauggccauccugggcgacacagccugggacuucgggucccugggcgggguuuucacgagcaucggcaaggcccugcaccaggucuucggugcaaucuauggcgccgcauucuccggcgugucuuggaccaugaagaucuucaucgggguaaucauaaccuggauaggcaugaacucccgcucgaccucccugagcgucucccuggugcugguggggauugucacacucuaucugggcgugaugguucaggcagacagugggugugugguguccuggaagaacaaggagcugaagugcggcagcggcauuuucaucaccgacaacgugcacaccuggaccgagcaguacaaguuccagcccgagagucccucaaagcucgccagcgcaauucaaaaggcccaggaggaggggauaugcggcauccgcuccgucacgaggcuggagaaccugauguggaaacagaucacccccgagcucaaccacauccuggcggagaacgaagucaagcugaccaucaugaccggggacaucaagggcaucaugcaggccgggaagcguagucuucggccgcaacccacagagcugaaguacuccuggaaaaccuggggcaaggcgaagaugcuaaguacugaaagucacaaccagacauuccucaucgauggccccgagacugcggagugcccgaacacuaaccgcgccuggaauagccuggagguggaggacuacggauucggcguuuucaccaccaacaucuggcugaagcucaaggagaagcaggacgccuucugcgacuccaagcucaugagcgccgcaaucaaggacaacagagcggugcacgccgauaugggauauuggaucgaguccgcacugaacgauacguggaagauugagaaggccagcuuuaucgaggugaagaacugccacuggcccaagucccacacccuguggagcaacggcguccuggagucugagaugaucaucccaaagaacuuggccggccccgugagccagcacaacuaccgcccgggcuaccacacccagaucgcgggcccuuggcacuuaggcaagcuggaaauggacuuugacuucugcgauggcacgaccgugaucgucacggaggacugcgggaaccgcggccccucccugcgcaccaccaccgccagcggcaaacucauaacggaguggugcugucggagcugcacccugcccccacugcgcuaccgcggggaggauggcugcugguacgggauggagauucggccccucaaggagaaggaggaaaaucuggugaacucccugguuaccgccggccaugggcaggucgacaacuucagccugggugugcuggguauggcccuguuccuggaggagaugcuucguacucggguggggacgaagcaugcaauacuguuaguugcugugucauucgucaccuuaaucaccggcaacaugagcuucaaggaccuggggagaguaguggugauggucggcgccaccauggccgacgacaucgggaugggggucaccuaccucgcccugcuggcggcauucaaggugcgccccacuuucgcggccggccucuuacugcgcaagcucacauccaaagagcugaugaugaccacgaucgggaucguccugcucagccaguccaccauccccgagaccgugcuggagcucaccgacgcccuggcgcuagggaugaugguccuuaagauaguucgcaacauggaaaaguaccagcucgcggucacgauaauggcuauucugugcgucccgaaugcaguggugcugcagaacgccuggaaggucagcugcaccauccucgcugugguguccguaagucccuugcugcucaccuccagucagcagaagacggacuggauccccuuggcccugacgaucaaggggcugaacccuaccgcaaucuuccuaaccacccugucacgcacgaacaagaagcggucuuggccgcucaaugaggcaauaauggcggugggcaugguguccauccuggccagcucgcuguugaagaacgacauccccaugaccggcccccuggucgccggcggccugcucaccgugugcuacgugcugaccgggagaagcgccgaccuggagcucgagcgggccacggacgucaagugggaggaucaagcggaaauaagugguagcuccccuauccuguccauaaccaucagcgaagacgggucgaugagcauaaagaacgaggaagaggaacaaacccugaccauccucauccgcacuggcuugcuggugaucuccggccucuucccgauaagcauccccaucacugccgccgccugguaccugugggaggugaaaaagcagcgggccgggguccugugggacgugcccagcccuccccccauggguaaggcagagcucgaggacggggccuaccgcaucaaacagaagggcauccugggguauagccagaucggagccggcguguauaaagaggggacauuccacaccauguggcacgucacccggggcgcuguacugaugcacaaggggaagcgcaucgagccuagcugggccgaugugaaaaaagacuugaucagcuauggcgggggcuggaagcuggagggcgaguggaaggaaggggaggaaguccaggugcuggcgcucgagcccggaaagaacccccgggccguucaaacgaagcccggguuauucaagaccaacaccgggaccaucggggcggucucccuggauuucagccccggcacguccggcagccccaucaucgacaagaaggggaaaguggucggucuauaugggaacggcgucgugaccagguccggcgccuacgugagcgccaucgcucagaccgaaaaguccaucgaggacaaccccgagaucgaagacgacaucuuccggaagcgccggcugaccauuauggaccugcaccccggggccgguaagacgaagcgcuacuuaccggccaucguccgggaagccaucaagcgcggguuacggacccugauccuggcgccgacccgcguaguggccgccgaaauggaggaggcccuccguggccugcccauucgcuaucagacccccgccauuaaggcggagcacacggggcgggaaaucgucgaccugaugugccacgcuaccuucacgaugcgccuccuuagcccugugcgcgugccgaacuacaaccucaucaucauggacgaggcccacuuuaccgaccccgccuccaucgccgcgcgcggguacauaagcacgcgcgucgagaugggagaggccgccggaaucuucaugaccgccaccccgcccgguagucgggaccccuuuccccaguccaacgcccccaucaucgaugaggagcgcgagauccccgagcggagcuggaacagugggcacgaaugggugaccgacuucaaaggcaagacggugugguuugucccuagcaucaaggcggggaacgacaucgccgcuugccuccgcaagaacggcaagaaggugauccaacugucccggaagaccuucgacagcgaauacgugaagacccgcacuaacgauugggacuuugucgugacgaccgauaucuccgagaugggcgccaauuucaaggcggagcgggugaucgacccgcggcggugcaugaagcccgucauccugaccgacggggaagagcgcgugauccucgccggacccaugccggucacccacagcuccgccgcucagcggcgaggccggauuggccgcaaccccaagaacgagaacgaccaguacauauacaugggggagccccuggagaacgacgaggacugcgcccacuggaaggaggcuaagaugcugcucgacaacauaaacacgcccgagggcaucaucccgagcauguucgagcccgagcgggagaaagucgacgccauugacggcgaguaccgccugcgaggggaggcccgcaagaccuucguggaccugaugcggcggggggaccuccccguuuggcuggccuacaagguggccgcggaagguauuaauuacgccgaccgccgguggugcuucgacggcaucaagaacaaccagauccuggaggagaacgucgaaguggagaucuggaccaaggagggggagagaaagaagcucaagccucgcuggcuggacgcccguaucuacuccgauccccuggcccucaaagaguucaaagaguucgccgcgggaaggaagucccugacccugaacuuaaucacggagaugggccgucugcccaccuuuaugacccagaagacccgcgacgcccuggacaaccuggccguucugcacacggccgaggccggcgggagagccuacaaucaugcccuguccgagcuccccgagacccuggagacacugcucuuacugacccuccuggcgacagugaccgggggcauauuucuguuccucaugagcggccgggggaucgguaagaugacccuggggauguguugcauaaucacugccaguauacugcucugguacgcgcagauacagccacacuggaucgccgccagcaucauccuggaguucuuccucaucgugcuccugauccccgaacccgagaagcagcgcacgccgcaggacaaccaacugacguacgucgugaucgccauccucaccgucguggccgcgaccauggccaacgagaugggcuuucuggagaaaaccaagaaggaccuggguuuaggcucgaucgcuacgcagcagccggagagcaacauccuggacauagaccuacggcccgcauccgccuggacgcucuaugcgguggccaccaccuucgucacgcccaugcuucgccacaguaucgagaacuccuccgugaaugugagccugacugccaucgcuaaucaggcuaccguccucaugggccuggggaagggcuggccccugagcaagauggacaucgggguuccucucuuagcgauugggugcuacagccaggugaaccccaucacccugacggccgcccuccugcuauuggucgcccauuacgcgauaaucggacccggccugcaggccaaggccacccgggaggcccagaagagggccgcggccggcaucaugaagaaucccaccguggaugggaucaccgugauagaccuggacccgauacccuacgaccccaaguucgagaagcaacuaggacagguaaugcugcugauauugugcgugacgcaggugcugaugaugcguaccaccugggcucugugugaagccuuaacgcuggcuacagggcccaucuccacccugugggagggcaacccgggucgcuuuuggaacaccaccaucgccgucucuauggccaacaucuuccggggcuccuacuuggccggcgccgggcugcuguucagcauaaugaagaacacgacaaacacccgcagaggcaccgggaacaucggcgagacucucggcgagaaguggaagucccgccugaacgcccugggcaaaagcgaguuucagaucuacaagaaguccgggauucaggagguagauagaacccucgcuaaagaggggaucaagcgcggcgagaccgaccaccacgccgugagccgcggcuccgcuaagcugcggugguucguggagcgcaacaugguaacacccgagggaaagguagucgaccugggcugcgggcgggguggguggagcuacuacugcggcgggcucaagaacgugcgcgaggugaaaggccugacgaagggcgggcccggccacgaagagcccauccccaugucgaccuacggguggaaccucgucagacuccagagcggcguggacguauucuucaucccuccugagaagugcgacacccugcugugcgacauaggggagucaagucccaacccgaccgucgaggcaggccgcacacuccgcguguuaaaucugguggagaacuggcucaauaacaacacccaguucugcaucaagguccugaacccauacaugccuuccgugauugagaagauggaggcgcugcagcgcaaguacgguggggcccuggugcgaaacccgcucagccgcaacucaacccacgagauguacugggucucaaacgccucgggaaacaucguguccagcgugaacaugaucucccggauguuaaucaaccguuucaccaugcgccacaagaaggccacguacgaacccgacgucgaccuugggagcggcacgaggaauaucgggauugagucggaaauucccaaccuagauaucaucggcaagcggaucgagaagaucaagcaggagcacgagacuagcuggcacuacgaccaagaccaccccuacaagaccugggcuuaccacggguccuaugagaccaagcagacagggagcgcgaguagcauggugaauggcguaguccgccuauugacuaagcccugggaugugcuccccaccgugacgcagauggccaugacggacaccacccccuucgggcaacagcguguuuucaaggagaaggucgacacacgcacucaggagcccaaggagggcaccaagaagcugaugaagaucaccgccaaguggcuguggaaggaacucggcaagaagaagacaccgcgcaugugcacgcgggaggaauuuacccguaaggugcggucgaaugccgcccugggagcgaucuuuaccgacgagaacaaguggaaauccgcccgcgaggccgucgaagacucccgguucugggagcugguggauaaggagcgcaacuuacaccuggagggcaagugugagacgugcgucuacaacaugauggggaagcgugagaagaagcugggcgaauucgguaaggccaaggguagccgcgccaucugguacauguggcucggcgcgcgguuucuggaguucgaggcccugggguuccugaacgaggaccauugguucucccgcgagaauagucuaucaggcguggagggggaggggcugcacaaacuuggguacauccugagagacguuagcaagaaggagggaggcgcaauguacgccgacgacacugcggggugggacacacgcauuacccuggaggaccucaagaacgaggagauggucaccaaccauauggagggcgaacacaagaagcuggccgaggcuauauucaaacugacguaccagaacaagguugugcggguccagcgccccacuccccggggaaccgugauggacauaauuuccagacgggaccagcggggcuccggccagguggggacguacggccucaacacguucacaaacauggaagcccagcugauucggcagauggagggggagggcgucuucaaaaacauacagcaccugaccgugaccgaggagguagcgguccagaacuggcucgcgagaguggggagagaacgccugagcagaauggccaucuccggggacgacugcguggucaagccccucgacgaccgguucgcaaacgcccucacggcgcuuaacgauauggguaagauccgcaaggacauccagcaaugggagccgucuaagggguggaacgacuggacccaggugcccuucuguagccaccacuuccacgagcugaucaugaaggacggucgggugcucgucgugcccugccgcaaccaggacgagcugauugggcgggcgcgcaucagccagggggccggguggucccugcgggagacagccugccucggcaagagcuacgcccagauguggucccugauguauuuccaccgccgggaccugcgacucgcggcgaacgcuaucugcagcgccgugcccucccacugggucccgaccagccggacgaccuggaguauucacgccaagcacgaguggaugaccaccgaggacaugcugaccguguggaaccgcguguggauccgggagaacccuuggauggaggacaagacgccuguagagagcugggaggagauccccuaccugggcaaacgcgaggaccaguggugcgggagccucauaggccugaccagccgggccaccugggcgaagaacauacaggccgcuaucaaccaggugcgcagcuuaaucgggaacgaggaauacaccgacuacaugccauccaugaagcgguuucgccgggaggaggaggaagcgggcgugcuuugguga

SEQ ID NO: 25393 - RNA, 9876 nt, Artificial Sequence
  derived and/or modified CDS sequence (opt11) from DENV-2__EU482775__SS-prME
agugcggggaugaucauuaugcuaaucccaacggugauggcuuuccaccucaccacccgcaacggggagccccacaugaucguaggcauccaggagaaggguaagaguuuacuguucaagaccgaggacggagugaacaugugcacgcugauggccauggacuuaggggagcugugcgaggauaccaucacauacaagugcccgcuccugcggcagaacgagcccgaggacaucgauugcuggugcaacuccaccaguaccugggugaccuaugggaccuguaccaccaccggcgagcacagacgggagaagcgaaguguggcccugguuccucacgugggaaugggccucgaaacucggaccgagacguggaugaguucggaaggggcguggaagcacgcccagcgcaucgagaccuggauccugcggcacccgggguucacgaucauggcggcgauccuggccuacacgauagggacaacccacuuucagaggguccucauauucauccugcugacggccguggcccccagcaugacaaugcggugcauuggaauaagcaaccgcgacuucguagagggcguuucgggaggcucguggguggacaucgugcuagagcacggguccugcgucaccacuauggcaaaaaacaagcccacucuggacuuugagcugauuaaaacagaggccaaacaaccggccacccuccggaaguacuguaucgaggccaagcuaaccaacacgaccaccgagucgcgcugccccacccagggcgagcccucuuuaaaggaggagcaggacaagcgguucgugugcaagcacagcaugguggaccgcgggugggggaacggcuguggcuuguucggcaaaggcgguauugucacgugcgcaauguucacgugcaagaagaacauggagggcaagaucgugcagccagaaaaccuggaguacaccauuguggucacaccacacuccggggaggagcacgcggugggaaacgacacggggaagcacggcaaagaaaucaagguuaccccccagagcucuauuaccgaagccgagcugacagguuauggcaccgucacgauggaaugcucgccccguaccggguuagacuucaacgagauggugcugcuccagauggagaacaaggcgugguugguacaccgccagugguuccuggaccugccccuacccuggcugccgggggccgauaagcaggaaucuaacuggauccagaaggaaacccuggucaccuucaagaauccccaugccaaaaagcaggacguuguugugcucggcagccaggagggggcaaugcauacggcacugacgggagcgaccgagauccagaugucuagugggaaccuccuguucaccggccaccuuaagugcagacugcgcauggacaagcuccagcugaagggcaugagcuacuccaugugcacagggaaauucaaggugguaaaggaaaucgcugagacccagcacggcaccaucgucauccggguacaguaugagggcgauggcagccccuguaagauccccuucgagauaauggaccuggagaagcgcuauguccucggucggcugauaaccguuaacccgauuguuacggagaaggacucccccgucaacauugaagcagagccgcccuucggggacagcuauaucauuauuggcguggagccggggcagcugaagcucaacugguucaagaagggcaguagcauugggcagauguucgagaccacaaugcgaggggcaaagcgcauggccauccugggcgauacagccugggacuuugggucccuuggcggaguguuuacgagcaucgggaaggccuugcaucaggucuuuggggcgauuuauggcgcugccuucucuggaguauccuggaccaugaagauccugaucggggugaucaucaccuggauugggaugaacucccggagcaccucccugucuguaagucuagugcucguuggcaucguuacguuauaccucgggguuaugguucaggccgacucggggugcgugguguccuggaagaacaaggagcuuaagugcggcaguggcaucuucaucacggacaacgugcacacuuggaccgaacaguauaaguuccagcccgagagucccuccaaguuagcuucugcgauccagaaggcccaggaagaggggaucugcggaauccgcuccgucacgcggcuagagaaccucauguggaagcagaucacucccgagcuaaaccacauacuggccgaaaacgaggugaagcucaccauaaugaccggcgacauccgcggcauuaugcaagcagggaaacggucacuccguccgcaacccacggagcugaaauacucauggaagacuuggggcaaggcaaagaugcucagcaccgagucauacaaucagacauuccucauagacgggcccgagacggccgagugccccaacaccaauagggccuggaacucccuggaaguggaggacuacggguuuggcgucuuuaccacaaacaucuggcucaagcugaaggagaagcaggacgcauuuugcgacucuaaguuaaugagcgcggccaucaaagacaaccgcgccgugcacgccgacaugggcuacuggaucgaguccgcccucaaugacacguggaagauugagaaggccagcuucaucgaggucaagaauugccacuggccgaagucucacacgcucuggagcaacggcguccuggagucagagaugauuauccccaagaaccuugcaggccccgugagccagcacaacuaccgaccuggguaccacacccagauagcgggccccuggcaccuggggaagcucgaaauggacuuugacuuuugcgacggcaccacugugaucguaacggaggacugugggaaucgcggccccuccuuacggaccaccaccgccagugguaaguuaaucacggaguggugcugccgcagcuguacucugcccccgcuccgauaccgcggagaggacggcugcugguaugggauggagauccggccccugaaggagaaggaagagaacuuagucaacagccucguuaccgccgggcaugggcaggucgacaauuuuagccuuggcgugcugggcauggcccucuuccucgaagagaugcuccgcacccggguagggaccaagcacgcgaucuuguuaguugccgucucauucgugacccugaucaccggcaacaugagcuucaaggacuuggggcgcguagugguuauggucggcgccacuauggccgaugacauagggaugggagucacguaucuggcccugcucgcggcguucaagguucggcccaccuucgccgcuggccuguugcuccguaaauuaaccuccaaagagcugaugaugacgaccaucggcauugucuuacugucucagucuaccaucccggagacggugcuggagcucaccgacgcccuggcgcuggguaugaugguguugaagaucguacgcaacauggagaaguaucagcucgccgugacgauuauggccauauuaugcgugccaaacgccgucaucuuacagaacgccuggaaggucagcuguaccauccuugccgucgucuccgugagcccccuacucuuaacaucuagccagcagaagacggauuggauaccgcuggcgcucacgaucaaggggcuuaaccccaccgcaaucuuccugaccacguugucuagaacgaauaaaaagcgcagcuggccgcugaacgaggcuaucauggcgguaggcauggugucaauccuugccagcagucuccugaagaacgacauuccaaugaccgggcccuugguggccggaggccugcugacggucugcuacguauugaccggccggucugcggaucucgagcuagagcgcgccacagacguaaagugggaggaccaggcggagaucucgggcucuucccccauccuguccaucaccaucucugaggaugggagcaugucuaucaaaaacgaggaggaggagcagacucucaccauccuaauacggacgggauuacuuguaaucucgggacuguucccgaucagcaucccuauuaccgcugcugccugguaccugugggaggugaagaagcagcgcgcuggggugcuaugggauguccccagcccgccccccaugggcaaggcggagcucgaagacggagccuaccggaucaagcaaaagggcauccucggguauagccagaucggcgccgguguguauaaggaggggaccuuccacaccauguggcacguuacgcgcggcgccguucucaugcacaaggggaagcggaucgagcccuccugggccgaugugcgcaaagaucugauaagcuaugguggaggcuggaagcuggagggagaguggaaggagggcgaggaggugcaggugcucgcacuagagcccgggaaaaacccacgggcgguucagacgaaacccggauuauucaaaaccaacacaggcaccaucggggccguaagccucgauuuuagcccggggaccucuggcucgccgaucaucgauaagaaggggaaggucgugggucuguacgggaacggcguggucacccgcucgggcgccuacgugagcgccaucgcgcaaaccgagaagucgaucgaggacaaccccgagaucgaagacgacauauuccguaaaaggcggcugaccaucauggaccugcaucccggggccggcaagacgaaacgcuaccuucccgccaucgugcgggaagccauaaaacgcgggcugcggacgcuaauccuagcgccgaccagagugguggccgccgagauggaagaggcgcugcguggccuacccauccgcuaucagaccccugccauccgcgcggagcacacgggccgggagaucguggaccucaugugucacgcuacauucaccaugcgacuauuaagccccguccgggugcccaacuacaaccucaucaucauggaugaggcucacuucacggaucccgccucgaucgccgcgcgcggauauauaagcacgcgggucgagaugggcgaggccgccggaaucuuuaugaccgcuaccccgcccggcagccgcgacccguucccucaguccaacgcacccauuaucgacgaagagagggaaauaccggagcgcuccuggaacuccggccaugagugggucaccgacuucaaggggaaaacggucugguuugugccgucgauaaaagcugguaacgacaucgcagcaugccugcggaaaaauggcaagaagguaauccagcuaucccguaagacguuugacucagaauacgugaagaccaggaccaacgacugggacuucguggucacgacagacaucuccgagaugggcgccaauuuuaaggcugagcgcgugauugacccccggcgaugcaugaagccugugaucuuaaccgacggagaggagcgggucauccuggccggccccaugccaguuacccacagcucagccgcccaacgccgcggccgcaucggccggaauccgaagaaugagaacgaccaguacaucuauaugggggagccccucgagaacgacgaggauugugcccacuggaaggaagcaaaaaugcuccuggacaacaucaacacgccggaaggcaucaucccgucaauguucgagccugagcgcgaaaagguggacgccauagacggcgaguacagauuacgcggggaggcgcgcaaaaccuucgucgaccucaugcggcguggcgauuugcccguguggcuggcguacaaggucgccgcggaggggaucaacuacgccgaccggcgcuggugcuucgacggcaucaagaacaaccagauccucgaggagaacgucgagguggagaucuggaccaaggagggggagcggaagaaacuuaagccgcgcuggcuggacgcccggaucuacuccgacccucucgcccugaaggaauucaaggaauucgccgcaggccgcaagagccuaacgcucaaccucauaacagagaugggccggcuccccacuuucaugacacagaagacccgagacgcccuagauaaccuggcgguccugcacacggcugaggccggcgggcgggccuacaaccacgcucucuccgagcuacccgagacucuggagaccuugcugcuacuaaccuuacuggcuacggugaccggugguaucuuccucuuccugaugagcggccgcggaaucggcaaaaugacacucggcauguguuguaucaucaccgccuccauacuccugugguacgcgcagauacagccgcauuggaucgccgccaguauaauucuggaauucuuccucauuguucuucugauccccgagccggaaaagcaacgcacgccccaggacaaucagcuuaccuacgucguaaucgcgauccucacggugguagccgcaaccauggcgaacgagaugggcuuccuggagaaaaccaagaaggaccuagggcugggcuccauugccacucagcagccggagaguaacauccuggacaucgaucuccgccccgcgagcgccuggacgcuguacgcgguggccaccaccuucgucacacccaugcuucggcacucuauugaaaauagcucggucaacgugucucuaaccgccaucgccaaucaggcaacaguguuaaugggccuaggcaagggcuggccgcuuucgaagauggauaucggggucccacugcucgcaaucggcugcuacucgcaggugaaccccaucacuuugacggccgcccugcuccuccugguugcccauuacgccaucaucggcccgggucugcaggcaaaagcaacaagagaggcucaaaagagagcggcggccggcaucaugaagaaucccaccguggacggaaucaccgugaucgaccucgauccgauccccuacgaccccaaguuugagaaacagcugggccagguaaugcugcucauccucugugucacccaaguacugaugaugcgcaccaccugggcccucugcgaggcccuaacccuggccacugggcccauauccacccucugggaaggcaacccggggcgguucuggaacaccaccaucgcugugagcauggccaacaucuuccgcgguuccuaucuggcgggcgccgggcuccucuucaguaucaugaaaaauacgaccaauacccgccggggcaccggaaacaucggcgagacccugggcgaaaaguggaagucccgccugaaugcccucggaaaguccgaguuccagaucuacaagaaaucaggcauucaagaagucgaccggacccuggcgaaggaggggaucaaacgcggggagacggaccaccacgccgugagucggggauccgccaagcugcgcugguucguggagcgcaacauggugacccccgagggaaaggugguggaccucggcugugggcgcggcggguggagcuauuauugcggcgggcugaagaacgugcgggagguaaagggccucacuaagggagggcccggccaugaggagccaaucccuauguccaccuacggguggaacuuagugcgccuacagucaggcgucgauguguucuuuaucccccccgagaagugcgauacucugcugugugacaucggggagagcagcccgaacccuacaguggaggccggacggacacugcgggugcuuaaccuaguggaaaacuggcugaacaacaacacccaguucuguaucaaggugcugaauccauacaugcccucagucaucgagaagauggaggcguugcaacggaaguacgggggggcccucguccgcaacccgcuaagccggaacaguacacacgagauguauuggguguccaacgcaagcggcaacaucguuucaagcgugaacaugaucucccgcaugcugaucaaccgguucaccaugcgucauaagaaggccaccuacgagcccgacgucgaccuggggagcgggacgcggaacaucgggaucgaauccgagauucccaaucuggacaucaucggcaagcgcaucgagaagauuaagcaggagcacgagacgagcuggcacuacgaccaggaccaccccuacaagaccugggcauaccacggcuccuacgagacaaagcagacuggcagcgcguccucaauggucaacggcguggugcgccugcucaccaagccgugggacgugcugcccacgguuacccagauggcuaugacggauaccacccccuucgggcagcagcgcguguucaaggagaagguagacacccgcacacaggagcccaaagagggcaccaagaagcugaugaagaucaccgcggaguggcucuggaaggagcugggcaagaagaagacgccgaggaugugcacacgggaagaguucacccggaaggugcgcucgaacgcggcccucggugcgaucuucacugacgagaacaaguggaaguccgcccgggaagccguggaggauuccagguucugggagcuagucgacaaggagcggaaccuccaccuggagggaaagugugagacuugcguuuauaacaugauggggaagcgcgagaagaaacucggcgaguucgggaaagccaagggcagccgugccaucugguacauguggcugggugcucgcuuccuggaguucgaagcccucggguucuuaaacgaggaccacugguucucccgggagaacagcuuaucuggaguagaaggagagggacuccacaagcugggguacauccugcgcgaugugagcaaaaaggaaggcggcgccauguacgccgacgacacggcugggugggacacucggaucaccuuggaggaccugaagaacgaggagauggucaccaaucacauggaaggcgaacauaagaaacucgcagaggccaucuucaagcucacguaucagaacaaagugguucgcguccagcggcccacgccuagaggaaccgucauggacaucaucucacggcgagaucaacgggguucuggucaaguaggaacauacggccugaauacguucaccaacauggaagcccaacugauccgucagauggagggggagggcguauucaagaacauccaacaucucaccgugacggaggagguggccguccacaacuggcuggcgcgcgucgggcgggagcgcuuaagccggauggcgaucucaggagacgacugcguggugaagccccucgacgaccgcuucgccaacgcccuaacggcgcucaacgacaugggcaagauacggaaggacauacagcagugggagccgagcaagggguggaacgauuggacucaggugcccuucugcucccaccacuuccacgaacucaucaugaaggauggccgcguucuggugguccccugccggaaccaagacgagcugaucggcagggcgcggaucagccagggugcgggguggucccuccgcgagacagcaugccugggcaagagcuaugcccaaauguggucccuuauguacuuccaucggcgcgauuuacggcuggccgcgaacgccauuugcagcgccguacccucacacugggugcccaccagccggacuacuugguccauccacgcuaagcacgaguggaugaccaccgaggacaugcugaccguuuggaaccggguguggauaagggaaaacccauggauggaggauaagacgcccguugagucgugggaggagauccccuaccucggcaagcgcgaggaccagugguguggaaguuugauaggccugaccucucgcgccacuugggcgaagaacauccaggcggccaucaaccaggugcggucucuaaucgggaacgaggaguacaccgauuacaugccgagcaugaagcgcuuucgccgcgaggaggaggaagccggugugcugugguaa

SEQ ID NO: 25394 - RNA, 9876 nt, Artificial Sequence
  derived and/or modified CDS sequence (opt11) from DENV-2__EU482776__SS-prME
agcgcagggaugauuaucaugcugauacccaccguaauggccuuccaccucaccacccggaauggagagccucacaugaucguggggauccaggagaagggcaagagccuacuguucaagaccgaggacgguguaaacaugugcacccucauggcgauggaccuuggcgagcugugugaggacaccaucacguacaagugcccccugcuucggcagaacgagccugaggacauagacugcuggugcaacagcaccuccaccugggugacguacggaacuugcaccaccaccggcgaacaucgccgggagaagcgaagcguugcccugguaccccacguggggaugggccucgagacgcggaccgagaccuggauguccagcgagggugccuggaaacacgcccagcgcaucgagacguggaucuugcggcacccgggcuucacgauuauggccgcgauccuggccuacaccaucgguaccacccauuuccagcgcguucucaucuucauccugcugacggccguggcccccuccaugacaaugcggugcaucggcaucagcaaccgcgacuucguggagggcgucuccgguggcagcuggguggacauugugcucgaacacgggucgugcguaaccaccauggcgaaaaacaagcccacgcuggacuuugagcugaucaagaccgaggccaagcagcccgccacccuccggaaguacuguaucgaggccaaacugacuaacacgaccacggagagccgcugucccacgcagggcgagccgucccugaaggaggagcaggacaaacgguuugugugcaagcacuccaugguggaccgcggcugggggaacggcugcggccuguucggcaagggcggcaucgucacgugcgccauguucacgugcaagaagaacauggagggcaagauagugcagcccgagaaccuagaguacaccaucgugguaaccccccacuccggggaggagcacgcggugggcaacgacacggggaagcauggcaaggagaucaaggugacuccgcagagcucuaucacugaggcagagcugaccggcuacggcaccgucacgauggaguguagcccccggaccggucucgacuucaacgagauggugcugcuucaaauggaaaacaaggccuggcucguucaucgucagugguuccuggaccugccccuccccuggcugcccggggccgacaagcaggaguccaacuggauccagaaggagacauuaguuaccuucaagaacccccacgccaagaagcaagacguggucgugcucgggagccaggagggcgcgaugcacacggccuugacgggcgccaccgagauacagaugagcuccgguaaccugcuauucacgggccaccugaaaugccgucuacgcauggacaagcuccaguugaagggcaugucguauucuaugugcacggggaaguucaagguggucaaggagauagccgagacccagcacggcaccaucguuauucgggugcaguacgagggggacggcagcccuugcaagauacccuucgagaucauggaccuggagaagcgguauguccucggccggcugaucaccgugaacccgauugucacggagaaggacuccccagucaauaucgaggcugagccgcccuucggugacagcuacaucaucaucgggguggagccggggcagcugaagcucaauugguucaaaaagggauccagcauuggucaaauguucgagaccaccaugcgcggggccaagcgcauggcaauucugggggacaccgccugggauuuugggucccugggcgggguguuuaccuccaucggcaaagcccuccaccaagucuucggggccaucuauggugcggccuucuccggcguuagcuggaccaugaagauccugaucggggucauaauaaccuggauagguaugaacucccggagcacaucccucagcguaucccugguccucguugggaucgucacgcuuuaccugggcgugauggugcaagccgacagcgggugcgucgugucuuggaagaauaaagaauuaaagugcgguagcggaaucuuuaucaccgacaacguccacacauggacagagcaauacaaguuccagcccgagagcccuuccaagcuggccagcgcgauucagaaggcccaggaggaggggaucugcggcauacgcuccgucacccgauuggagaaucucauguggaagcaaaucacgcccgagcuaaaccacauccuggccgagaacgaggugaagcucaccaucaugaccggggacauucgaggcaucaugcaggccgggaagaggagccugcgcccgcagcccacggagcugaaauacuccuggaagacauggggcaaggccaagaugcucagcaccgaaaguuacaaccaaaccuuccuuaucgauggccccgagacggcggagugcccgaacaccaaccgggcguggaacagccuggagguugaggacuacggguuuggcgucuuuaccaccaacaucuggcucaagcugaaggagaagcaggacgccuucugcgacuccaagcugaugagcgccgccaucaaggacaaccgcgcggugcaugcagacaugggguacuggauugaguccgcccuaaacgacacauggaagaucgagaaggccagcuucauagaggugaagaacugccacuggcccaagucccacacccuguggagcaacggcguccuggaaagugagaugaucaucccaaagaaccucgccggccccguaucucaacacaacuaucggccaggguaccacacccagaucgcgggccccuggcauuuagggaagcuggagauggauuucgacuucugcgacggcaccaccgugaucgucacggaggacugcgggaaccgcggccccagucuccggaccaccacagccagcggcaagcuaauuacggaguggugcugccgcagcugcacccugccuccgcuccgguaccggggcgaggacgggugcugguacgggauggagauccggccccugaaggagaaagaggagaaccuggugaacucccucgugaccgccggccaugggcaagucgacaacuucagccugggcgugcugggcauggcccucuuuuuagaggagaugcugcgcacccgggugggaacgaagcaugcgauccuccucgucgccguguccuucgugacccugaucaccggcaauaugagcuucaaggaccuagggagagucguuguuauggucggcgccaccauggccgacgauauaggaaugggcgugaccuacuuagcccugcucgcggccuauaaggugcggccuacguuugcugcuggucuccugcuccgcaagcugaccuccaaggagcugaugaugacaaccaucgggaucgugcuccugucccaguccacgauccccgagacagugcuggagcucaccgacgcgcuggcgcuaggcaugauggugcucaagaucguccgcaauauggaaaaguaccagcuggccgugacaaucauggcuauccugugcgucccuaaugccgugauccuccagaacgccuggaaggcgagcuguacuauccuggccguggucucggugagcccccuccuccugaccuccucccagcagaagaccgacuggaucccucuggcccugacgaucaaggguuugaaucccaccgccaucuucuuaaccacccuuucacggacuaacaagaaacgcagcuggccgcugaaugaggcgaucauggcggucggcaugguauccauccuggcuagcuccuuacugaagaacgacaucccgaugacaggcccccugguggccgggggccuccucacugugugcuacguacuuaccggacgguccgccgaccuagagcuggagcgcgcgacggacgugaagugggaggaccaggccgaaaucuccggcuccagccccauccuguccaucaccaucagugaggauggguccaugucuaucaagaacgaggaggaggagcagaccuugaccaucuuaauccguacgggcuugcuugucaucagcggacuguucccgaucagcauucccaucaccgcagcggccugguaccugugggaagucaagaagcagcgcgcgggggugcuaugggacgugcccagcccgccgcccaugggcaaggccgagcuggaggacggggccuaccggaucaagcaaaagggcaucuugggguacagccagaucggugccggcguuuacaaggagggaaccuuccacaccauguggcaugugacccguggcgccgugcucaugcacaaggggaaaaggaucgagcccaguugggcggacgucaagaaggaccugauuagcuacgguggggguuggaagcuggagggcgaguggaaggagggggaggagguccaggugcucgcgcuggaacccggcaagaacccccgugcaguccaaaccaagcccggucuguucaagaccaacaccgggaccaucggggccguguccuuagacuucucaccuggcaccuccgguagccccauaauugauaagaaggguaagguugucggauuguacgggaacggcguggugacucgguccggagccuacgucucagcuaucgcccagacugagaaguccaucgaggauaacccagagaucgaggaugacaucuuccgcaagcggcgcuuaaccaucauggaccugcacccaggggccggcaagacgaagcgguaccuucccgccauagugcgcgaggcgauaaagcgggggcugcgcacgcugauccucgccccgacgagaguggucgccgcugaaauggaggaggccuugcgaggcuuacccauccgguaucagacucccgcgauccgcgcggagcacacggggcgcgagaucguggaccucaugugccaugccaccuucaccaugcggcugcugaguccgguacgcgucccgaacuacaaccucauuaucauggacgaggcacacuucaccgaccccgcguccaucgcggcccggggcuacauaucgacgcgcguggaaaugggcgaggcagccgguaucuucaugaccgccaccccacccggcagcagggacccguucccccaguccaacgcgccuaucauugacgaggagcgggagauccccgagcggagcuggaauuccgggcaugagugggugacggacuucaagggcaagacgguaugguucguacccagcaucaaggccgggaacgacaucgccgcaugccugcgcaaaaacggcaagaagguaauccagcugucccggaagaccuuugacagcgaguacguaaagacccgcaccaacgacugggacuucguggugacgacagacaucuccgagaugggggcgaauuucaaggccgagcgggucaucgaccccagacggugcaugaaacccgugauccucaccgacggggaggagaggguaauccuggcaggccccaugccggugacucacucuuccgccgcccaacggagagggcguaucggacgcaaccccaagaaugagaaugaccaguauaucuacaugggggagccccuggagaacgacgaggauugcgcgcacuggaaagaagccaaaaugcuccuggacaacaucaauacgccugaggggaucaucccuagcauguuugagcccgagcgggagaagguggacgccaucgacggugaauaccgcuuacgcggggaagcacggaaaaccuucguggaccucaugcgccggggcgaccugcccguauggcuggccuauaagguggcggccgaggguaucaacuacgccgaucgucgguggugcuucgacgggaucaagaauaaccagauccucgaggaaaacauggagguggagaucuggaccaaggagggggagcgcaagaaacugaagccgcgguggcucgacgcccgaaucuacucagacccccucgcacugaaggaguucaaggaguuugcugccggccggaaaucccugaccuuaaacuuaauuacugaaaugggccggcugccuaccuucaugacccagaagacccgggaugcgcucgauaaccuggccguccugcauacagcggaagccgggggccgcgccuacaaccacgcccuguccgaacugcccgagacccuggaaacccuccuucuucucacccuacuggccacgguaaccggggggauuuuucucuuccuuaugagcggacgggggauugguaagaugacccuggggaugugcugcaucaucaccgcguccaucuugcugugguacgcacagauccaaccgcacuggauugccgccagcauuauccuggaauucuuccucauuguccugcuuauccccgagccggagaagcagcgcacgccccaggacaaccagcucaccuacgucgugaucgccauccugaccgucguggccgcaaccauggccaacgaaaugggcuuccuggagaagaccaagaaggacuuaggccugggcuccaucgcgacgcagcagccggagagcaacauccuggauaucgaccuccggcccgcauccgcguggacccuguacgccguggccacaacuuucguuacucccaugcugaggcacagcaucgagaacucguccgucaacgugagccucaccgccaucgccaaccaggccaccguccugaugggccugggcaagggcuggccccucagcaagauggacauuggcgugccacugcucgccaucggcugcuacagccaggugaacccuaucaccuugacggcagcucuucugcuccuggucgcgcacuacgcgaucauugggccaggccugcaggccaaggccacccgggaggcccaaaagcgcgcggccgcaggcaucaugaagaacccuaccgucgacgggaucaccgugauagaccucgacccgauccccuacgacccgaaguucgagaagcagcugggacaggucaugcugcucaucuugugcgugacccaggugcugaugaugcggacaaccugggcccucugcgaggcccugacccuggcgacggggcccaucuccacccucugggagggcaacccggggcgcuucuggaacaccaccaucgccgucagcauggccaacaucuuccggggaucauaccuggccggcgccggacuucucuucagcaucaugaagaacacgaccaacacacgccgcggcaccgggaacaucggugagacguugggcgagaaauggaagucccggcugaaugcgcucggcaagagcgaguuccagaucuacaagaaaaguggcauccaggagguggaccgcaccuuggccaaggaggggaucaagcggggcgagaccgaccaccacgccgucagucgcggguccgccaagcuccgcugguucgucgagcgcaacauggugacccccgagggcaagguggucgaccucggcugcgggcggggcggguggaguuacuacugcggcggacugaagaacguacgcgaggugaaaggccuuacgaagggggggccgggccacgaggagccgaucccgaugaguaccuacggguggaaccucguccgucugcagagcgguguggacguguucuucaucccgcccgagaagugcgauaccuugcucugcgacaucggggaguccagccccaacccuaccguagaggcgggucgcacgcugcggaucuugaaccuaguggagaacuggcuuaacaacaacacccaguucugcaucaaggugcugaaucccuacaugccuuccgucaucgaaaagauggaagcgcuacagcgcaaguacggcggggcgcugguccggaauccucuuagccgcaacagcacccacgagauguacuggguguccaacgccagcggcaacaucguauccagcgugaacaugaucucccggaugcugaucaaucgcuucaccaugcggcacaaaaaggccaccuacgagcccgauguggaccucggguccggaacgaggaacaucgggaucgagucggagauccccaaccucgacauuaucggcaagcggaucgaaaagaucaagcaggagcacgaggcgagcuggcacuacgaccaggaucaccccuacaaaaccugggccuaucacggcagcuacgagaccaagcagaccgggucugccuccagcauggucaacggcguggugcggcuuuugacgaagccgugggacguccugcccaccgugacccagauggccaugaccgacacaacacccuucgggcaacagcgcguguucaaggagaagguggacacccggacccaggagcccaaagagggcacaaagaagcuuaugaaaaucacugccgagugguuauggaaagaacugggcaagaagaagaccccucgcaugugcacccgugaggaguucacgcgcaagguccgguccaacgcggcccugggggccaucuuuaccgaugaaaacaaauggaaauccgcgcgcgaggccguggaggacagccgguucugggaguuggucgacaaagagcgaaaccuucaccuggagggcaagugcgagaccugcguauacaauaugauggggaagcgggagaagaaacuuggugaguucgggaaggcgaagggcagccgcgccaucugguacauguggcugggggcccgguuucuggaguucgaggcccucgguuuccugaacgaggaccacugguucucccgagagaacagccugucaggcguggagggggaaggccuccacaagcugggcuacauccugcgggacgucagcaagaaagagggcggcgcuauguacgcagacgacaccgccgggugggacacccgcaucacccucgaagaccugaagaacgaggagauggugaccaaccacauggagggcgagcacaagaaacuggcugaggccauuuucaagcucaccuaccagaauaagguugugcgggugcagaggcccacgccccgggggaccgucauggacauuaucucacgccgagaccagcgcggcagcggccaggugggcaccuacggccugaacaccuucaccaacauggaggcgcagcuuauccggcagauggaaggagagggcguguucaagaacauacagcaccucaccgucaccgaggagguggcggugcacaacuggcucgcccgcgucgggugugagcggcugagccguauggccaucuccggcgacgacugcguggugaagccccucgacgauagauucgccaacgcguuaaccgcccugaaugauaugggcaagauacggaaggacauccaacagugggagccgagcaagggguggaacgauuggacgcagguccccuucugcucacaccacuuccacgagcucaucaugaaggacgggcgcgugcuagucguccccugucggaaccaggacgaacucaucgggcgcgcccggaucagccagggcgccgggugguccuugcgcgagaccgccugccugggcaagagcuacgcucagauguggucccugauguacuuccaucggcgcgaccucagguuagccgccaaugccaucugcagugccgugcccucccauugggugccgaccagccgcaccacgugguccauccacgcgaagcacgaguggaugacgaccgaggacaugcugaccgucuggaacagaguguggauccucgagaaccccuggauggaggacaagaccccuguggaaagcugggaggagauccccuaccugggcaaacgcgaggaucaguggugcgggucguugaucggccucacaucucgggccaccugggccaagaacauccaggcagcaaucaaccagguccguucccugaucgggaacgaggaguacaccgacuacaugccgagcaugaagcguuuccgccgggaggaggaggaggccggcgugcugugguga

SEQ ID NO: 25395 - RNA, 9876 nt, Artificial Sequence
  derived and/or modified CDS sequence (opt11) from DENV-2__EU482777__SS-prME
agcgcgggcaugauaaucaugcugauccccacagucauggccuuccaucucaccacacgcaacggggagccccacaugaucgucggaauccaggagaaggggaagucccuucuguucaaaaccgaggauggcgucaauaugugcacccuaauggcgauggaucuaggugagcuuugcgaggacaccaucacauacaagugcccccuccugcgccagaacgaacccgaggacauagacugcugguguaacagcacuagcacaugggugaccuacggcaccugcacgaccaccggugagcaucggcgggaaaagcgaagcgucgccuuggugccacauguggggaugggucuugagaccaggaccgagacauggauguccagcgagggggcauggaagcacgcccagcgcauugaaaccuggauccugcggcacccgggcuucacgaucauggcugcgaucuuggccuacaccauagggacaacccacuuucagcgcguacucaucuucauccucuuaaccgccgucgcccccuccaugaccaugcgguguaucggcauuaguaaccgcgacuucguggaaggcgucuccggcggcagcuggguugacauagugcucgagcacgggaguugcgucaccacgauggcgaagaacaaacccacgcuggacuucgaauuaauuaagaccgaggcuaagcagcccgccacucugcggaaguauugcaucgaggcuaagcugaccaacacgaccacggagagucgcuguccaacccagggcgagcccucccugaaagaggagcaggauaaacguuucguaugcaagcacucuaugguggaccgcggcugggggaacggcuguggcuuauucggcaagggcgggauagugacgugcgccauguucacgugcaaaaagaacauggagggcaagaucgugcaacccgaaaaccuagaauacaccaucgugguuacuccccacuccggggaggaacacgcggucggcaacgacacgggaaagcacggcaaggagauaaaggucaccccacagagcuccaucaccgaagccgaacuaaccggguaugggacugucacgauggagugcucuccccguaccggccucgacuucaaugagaugguguugcugcagauggagaacaaggccugguuaguucaucgccaaugguuucuggauuuaccccuccccuggcugccuggagcagacaagcaggaguccaacuggauccagaaggaaacccugguaacuuucaagaacccccaugcaaagaaacaagacguggucguacucgggagccaagagggggcgaugcacaccgcgcugacgggcgcuacggagauacagaugagcuccgggaaccuucuguucaccggccaccugaagugccggcugcgaauggauaagcuccagcuaaagggcaugucguauuccaugugcacggggaaguuuaaagucgucaaagagaucgcugagacccagcauggcaccaucgugauccgugugcaguaugagggggacgggagccccuguaagaucccguucgagauuauggaucuggagaagcgcuacguauuggguaggcugaucaccgugaacccgaucguaacugagaaggacucccccguaaacaucgaggcugaaccccccuucggcgacagcuacaucaucaucgguguugaaccagggcagcucaagcucaacugguucaagaagggcagcucgaucgggcagauguucgagaccaccaugcgcggcgccaaacguauggccaucuuaggcgacaccgccugggacuucgggucccugggcggcguuuucacgucaaucggcaaggcacuccaccagguguucggggcuauuuacggcgcggcuuucuccggugugagcuggaccaugaagauccugauuggggugauaaucaccuggauaggcaugaacagucgaagcacgucccugagcgucucccuuguacuaguugggaucgucacgcuguaccugggcgucaugguacaggccgauagcgggugcgucguaagcuggaagaacaaggaacucaaguguggcuccggaaucuuuaucaccgacaacgugcacacguggacggagcaguacaaguuccaacccgagagucccuccaaacuggccagcgcgauccaaaaggcccaggaggaggggaucugcgggauccgcuccguaacgcggcuggagaaucucauguggaagcagaucaccccggagcugaaucauauccucgccgaaaacgaaguaaagcucaccaucaugaccggggacaucaagggcaucaugcaagcagggaagcgcagccugcggccccagcccacggagcuaaaguacuccuggaagaccugggggaaggcgaagaugcucagcacugagucauacaaccaaaccuucuuaauagacgggccagagacggcggagugcccgaauaccaaccgcgcauggaacucucuggagguggaggacuacggguucggcguguucaccaccaacaucugguuaaaguugaaggagaaacaggacgccuucugcgacuccaagcuuaugagcgccgccauaaaggacaaccgggccgugcacgccgacaugggguacuggaucgaguccgcgcucaacgauacguggaagauagagaaggccagcuucaucgaggugaagaacugccacuggcccaagucccacacccugugguccaacggcguccuggaguccgagaugauaauuccuaagaacuuggccggccccgugagccagcauaacuauaggccgggguaccauacccagauagcaggacccuggcacuuagguaagcuugagauggacuucgacuucugugacggcacgacugucauagucacggaggacugcgggaaucggggccccucccuccgcaccaccaccgccagcggcaagcugaucacggaguggugcugccgaagcugcaccuuacccccgcuccgcuaccgcggggaggacggaugcugguacggcauggagauccgcccccugaaggagaaagaggagaacuuagucaacucccucgucaccgccggacaugggcagguggacaacuucagcuuaggggugcuggggauggcccucuuccuggaggagaugcugaggacccgcguggggaccaagcacgcaauccuuuuggucgccguguccuucgucacccugaucaccggcaauaugagcuucaaagaccucgggcgagucguugugauggucggcgccaccauggcggacgacaucgggaugggaguuacguaccuggcccugcucgcggcuuucaaggugcgucccacguucgcagcaggccuccuacucaggaaguuaaccuccaaggagcugaugaugaccacgaucggcaucguacugcugagccaguccacaauaccugagacgguacuggaacuaaccgacgcgcuggcgcugggcaugauggugcucaagaucgucaggaacauggagaaguaccaguuagccgugacuaucauggcaauccugugcguccccaacgccgugauccuacagaacgcguggaaagugagcugcaccauccuggcgguaguauccguaagcccacugcuccugacuuccagccagcagaagaccgacuggaucccucuggccuugacaaucaaggggcucaaucccaccgccaucuuccugacuacccucagucgcacgaacaagaagaggagcuggccgcugaacgaggccauaauggcggucggaaugguauccaucuuagccagcucucuccugaaaaacgacaucccaaugacaggcccccuaguggccgggggccuccugacugucugcuacguguugaccggucgcagcgccgaccuugagcuggagcgggccaccgacguaaaaugggaagaucaagcggagaucuccggcagcucccccauccuguccaucaccaucagugaggacgggucgaugucuauaaaaaacgaggaggaggagcagacucucaccauccugauccggacaggccugcucgucaucuccggccuuuucccgaucucgauccccauuaccgccgcggccugguaccugugggaggugaagaagcagcgggccggggugcucugggacguccccagcccgccgcccaugggaaaggcggaguuggaggauggugccuaucguaucaaacagaaggggauccucggguacagccagaucggcgccggcguguacaaggaggggaccuuccacaccauguggcacgugacucggggcgccguauuaaugcacaaagggaagcgcaucgagccguccugggcggacgugaagaaagaucugauaagcuacggcggaggcuggaaguuggagggcgaguggaaagagggggaggagguacaaguccuagcucuggagccaggcaagaauccccgggccgugcagacaaagccagggcuguucaagacaaacaccgguacgaucggggccgugucccucgacuucucucccggcacuaguggcagcccgauuauugauaagaaggggaaggucgugggccuguacggaaacggcgugguuacccgcagcggcgccuacguguccgcaauagcgcaaaccgaaaaguccaucgaggacaacccagagaucgaggacgacaucuuuagaaagcgccggcugacuaucauggaucugcaccccggggccgguaagaccaagcgcuaucuccccgcgauagugcgggaagcuaucaagcgcggguugcggacccuaauccucgccccgacacgggucguggccgccgagauggaggaggccuugcggggccugcccauccgcuaccagacccccgcgauucgggcggaacacacuggacgcgagaucguugaccucaugugccacgccacauucacaaugcgucugcugucucccguccgcgucccuaacuacaacuuaauaaucauggaugaagcacacuuuaccgaucccgccagcaucgccgcgcggggauacaucagcacccggguggaaaugggcgaggcagccgggaucuuuaugaccgccacgccacccggcagccgcgauccguucccccaguccaacgccccgauuaucgacgaggagcgggaaauccccgagcgaagcuggaacagcggccaugagugggucaccgacuucaagggcaagacgguuugguucgugcccuccaucaaggcggggaacgacaucgccgccugccugcggaagaauggcaagaagguuauccaacuaucccgcaagaccuucgauagcgaguacgugaagacucggaccaaugacugggacuuuguagucacgaccgacaucuccgagaugggcgccaacuucaaagcggaacgcgugaucgacccccggcgcugcaugaagcccgugauacucaccgacggggaggagcgggucauucuggcaggcccgaugccugugacucauucaucggccgcucagcgccgcgggcgaaucggacggaacccgaaaaacgagaaugaccaguauaucuacaugggcgagccccuggagaaugaugaggacugugcccacuggaaggaagccaaaaugcugcuggacaauaucaacacucccgagggcaucaucccgucuauguucgagcccgagcgcgagaagguggacgccaucgauggcgaguaccgacugagaggagaggccagaaagaccuucgucgaccucaugcggcgcggagaccugcccguauggcuggccuacaagguggcugcggaggggaucaauuacgccgaucggcgcuggugcuuugauggcaucaaaaauaaccagauucucgaggaaaaugucgagguggaaauuuggacgaaggagggggagcggaagaaacugaagccgcgcuggcuggacgcucggaucuauuccgauccccucgcccugaaggaguucaaggaguuugcagcgggccgcaagaguuuaacccuuaaucugauaacggagaugggcaggcucccuaccuuuaugacucagaagacccgcgacgcacuagacaaccuggccgucuugcacacggccgaggccggcggccgagccuacaaccaugccuuauccgagcugcccgagacccuggagacgcuccugcugcucacccugcucgccaccgugaccgggggcaucuucuuauuccugaugagcggccgcgggaucgguaagaugacgcuggggaugugcugcauaaucaccgccucgauucuccugugguacgcacaaauacagccgcauuggaucgccgccucuauuauccuggaguucuucuuaaucgugcugcugauacccgagcccgaaaagcagcggacuccccaggacaaccagcucacguacgucgugaucgccauccugaccguggucgcugcgaccauggccaacgagaugggcuuccuggagaagaccaaaaaggacuuggggcuuggcucgaucgcgacgcagcagccggagaguaacauucuggacaucgaccuccgcccugccuccgcuuggacccuguacgcgguggccacuaccuucgugaccccaaugcugcggcauagcauagagaacagcuccgucaaugugagccucaccgccaucgccaaccaagccaccgugcugaugggcuuggggaaaggcuggccccucuccaagauggacaucgggguuccgcugcuggccaucgggugcuacagccaagugaaccccaucacccucacggccgcccugcuguuacucguugcccacuacgcgaucauuggccccggucugcaggccaaggccacucgcgaggcccagaagagagcugcggcuggaaucaugaagaaccccacggucgacgggaucaccgugauagauuuggacccaauccccuaugacccgaaguucgagaagcagcucggccagguaaugcuccugauccugugcgucacccaggugcuaaugaugcggacuaccugggccuuaugcgaggcccugacucuggccacggggcccaucuccacacucugggagggcaacccggggcgguuuuggaacaccaccaucgcgguaagcauggcuaacaucuuccgcggcagcuaccuggcuggcgccgggcuccucuucuccaucaugaaaaacacgaccaacacccggcgcggcaccgggaacaugggcgagacgcuaggcgagaaguggaagucucgacugaacgcccuagggaaguccgaguuucagaucuacaagaaguccggcauccaagaagucgaucggaccuuagcgaaagaggguaucaagcgcggugaaaccgaucaccacgcgguaagucggggguccgccaaguuacgcugguucguggaacggaacauggucacccccgaaggcaaggugguagaucucgguugcgggagaggcggguggagcuacuauugcggcggacugaagaacguccgggaggugaagggucugaccaaaggcggccccggacacgaggagcccaucccuauguccaccuacggguggaaccuuguccgccugcagaguggugucgacguguucuucaucccucccgagaaaugcgacacccugcucugugacaucggcgagucuagccccaacccgaccguggaggccggccggacucugcggguccugaaccucguggagaacuggcugaauaauaacacccaauucugcaucaaggugcugaacccuuacaugccauccgucauugagaagauggaggcgcugcagcggaaauaugggggagcuuuggugcguaacccacugagccggaauagcacccacgagauguauuggguguccaacgccagcggcaacaucgucuccagcgugaacaugaucuccaggaugcuuauaaaucguuucacaaugcgccacaagaaggccaccuacgaaccugacguggaccucgggucgggcacacggaacauagggauagagagugagauccccaaccuggacaucauaggcaagagaaucgagaagaucaagcaggagcacgagacuuccuggcacuaugaucaggaccaccccuacaagaccugggccuaccacggcuccuacgagacaaagcagacggggagcgcguccagcauggucaacggcguggugcgacuguuaaccaagccaugggacguacugcccacagugacccagauggccaugacggacacgacacccuuuggucagcagagagucuucaaggagaaggucgacacccgcacucaggagccuaaggagggcaccaaaaagcugaugaagauaaccgccgaguggcucuggaaggagcuuggcaagaaaaagacgccacguaugugcacgagggaggaguucacccggaaggugcgcuccaaugccgcccugggagcgaucuucaccgacgagaacaaguggaaguccgcccgagaagccguugaggacucccguuuuugggagcucguugacaaggagcggaaccuccaucuggaaggcaaaugcgagaccugcguguacaacaugauggggaagcgggagaagaaacucggggaguuugggaaagccaagggcagccgggccaucugguauauguggcugggcgcccgcuuucuagaguucgaggcccucggguuccugaacgaggaccacugguucucccgagagaauagccuguccggugucgagggcgagggccuccacaagcugggguacauacugcgcgacgugagcaaaaaggaagguggcgccauguacgccgacgacacggcgggaugggacacgcggaucacccucgaggaccucaagaacgaggagauggugacgaaccacauggagggugaacacaagaaacuggcggaagccaucuucaagcucacguaccagaacaaggucguacgcgugcagcggcccacgccccgugguaccgucauggacaucaucagccggcgcgaccaacggggcuccggccaggucgguacguacggucugaacacguucacgaacauggaagcucagcugauccgacaaauggagggggagggcguguuuaagaacauccagcaucucaccgucacggaagagguggccgugcagaacuggcuggcgagagucgggcgcgagcgccugagucggauggccaucuccggcgacgacugcgugguaaaaccccucgaugaccgcuucgccaacgcccugacugccuugaaugacauggguaagauacggaaggacauucagcaaugggagccuagcaagggguggaacgacuggacccaagucccuuucugcucccaccacuuucacgagcucaucaugaaggacggaagggugcuggugguccccugccggaaccaggacgagcugaucgggcgcgcgcggauuagccagggcgcuggcuggucccugagggagaccgccugccugggaaagagcuacgcccagauguggucccugauguacuuccaccggcgcgauuuacgacucgccgcgaaugccauaugcagcgccgugcccucccacugggugccgaccagccgcacgaccugguccauucacgcgaagcacgaguggaugacuaccgaggacaugcugaccgucuggaaccgcguguggauccgcgagaacccguggauggaggacaaaacgcccguugagucuugggaagaaauacccuaucucggcaagcgggaggaccaguggugcggguccuugaucggccugaccagccgcgccaccugggcgaagaacauucaggccgccauaaaccagguccgaucccucauagguaacgaggaguauaccgacuacaugccgagcaugaagcgcuuccggcgugaggaggaggaggccggcgugcugugguag

SEQ ID NO: 25396 - RNA, 9876 nt, Artificial Sequence
  derived and/or modified CDS sequence (opt11) from DENV-2__EU482778__SS-prME
accgccggcgugaucauaaugcugauccccaccgccauggcguuccaccucaccacccggaacggggagccccacaugaucgucggccggcaggagaaggggaagucccuguuauuuaagacagaggacggcgugaacaugugcacccugauggccaucgaccucggggaguuaugcgaggacacaaucaccuacaagugccccuuacugcgucagaaugagcccgaagauaucgacugcuggugcaacagcacaagcaccugggugaccuacgggaccuguacaaccacgggcgagcaucgccgcgagaagcgguccgucgcccuggugccucacguggggaugggccucgagacccggaccgagaccuggaugagcagcgagggugccuggaagcacgcccagcggaucgagaccuggauccugaggcacccgggcuucaccaucauggcggccauccuggccuacaccgucgggaccacccacuuccagagagcccucaucuucauccuguuagcggccguggcccccaguaugacaaugagaugcaucggcaucuccaaccgggacuucguggagggcguuuccggaggcucauggguugauaucguacuugagcaugggagcugugugaccaccauggccaagaacaaacccacgcucgacuucgagcugaucaagaccgaggcaaagcagccagccacccuccgcaaguacugcaucgaggccaagcuuaccaacacaaccaccgagucccggugcccgacccagggugagcccucucugaacgaggagcaggacaagcgcuucgugugcaaacacuccaugguggaccggggcugggggaacggaugcgggcuauucggcaagggaggcaucgugacgugcgcuauguucacguguaagaagaacauggagggcaagaucgugcagcccgaaaaccuggaguacaccaucgugaucacuccccauagcggggaggagcaugccgucggcaacgacaccgggaagcacggcaaggagaucaagaucaccccucagucccccaucaccgaggccgagcugaccggguauggcacagugacgauggagugcuccccccguaccggccucgacuucaacgagaugguacuacugcagauggaggacaaagcauggcugguccaccggcaaugguuccuggaucugccccugccuuggcugcccggggccgacacucagggcuccaacuggauccagaaggagaccuuagugacguucaaaaacccccacgccaaaaaacaggacguugucgugcuagggagccaggagggugccaugcacaccgcccugaccggggcuaccgagauccaaauguccagcggcaaccuccuguucacgggccaccugaagugucgccuccggauggacaagcuccagcugaaggggaugagcuacuccaugugcacgggcaaguucaagaucgucaaggagaucgccgagacccagcacgggacgaucgucauaagggugcaauacgagggcgacggcucaccuugcaagaucccauucgaaaucauggaucuggagaagcggcacguccucgggcgguugaucacggugaacccaaucgugaccgagaaggacucgccagucaauaucgaggcggagccaccguucggugacagcuacaucaucaucggugucgaaccaggccagcugaaacucaacugguuuaaaaagggguccucaaucggccagauguucgagaccaccaugaggggggccaaacggauggccauccugggggacacggcgugggacuucggcucccucggaggcguguucacaagcaucggcaaggccuugcaccaggucuucggcgcaaucuauggcgccgcguuuuccgggguuagcuggaccaugaagauccucaucggcgugaucaucaccuggaucgggaugaauuccaggucuacgucccugagcgucucccuggugcucgugggcgucaucacccucuacuugggggccauggugcaggccgacagcgguugcguggucucuuggaagaacaaggagcugaagugcggaagcgggaucuucauaaccgacaauguacacaccuggacagagcaguacaaguuccagcccgagucccccagcaagcuggccucggccauacagaaggcgcacgaagagggcaucugcgggaucagauccgugacacgacuggaaaaccucauguggaagcagaucaccccggagcugaaccacauccugagcgaaaacgaagucaagcucacgauaaugacgggcgacaucaaggggaucaugcaggccggcaagcggagccugaggccccagcccaccgagcugaaguacucauggaagacaugggggaaggccaagauguuaucgaccgagagccacaaccagacuuuccugauugacgggccggagacugccgagugccccaauaccaaucgggccuggaacucccuggagguggaggacuacggcuucgguguguucacaaccaacauauggcucaaacugcgcgagaaacaggauguguucugcgacaguaagcucauguccgcggccauuaaggacaaccgcgccgugcaugccgacaugggauacuggaucgaaagcgcccucaacgacaccuggaaaauggaaaaggcguccuucaucgaggugaagaacugccacuggccgaagagccacacucugugguccaauggcgucuuggagagugagaugaucauccccaaguccuuugccgggccugucucacagcacaacuaccgccccggcuacuacacucagaccgccgggcccuggcaucucgguaagcuggagauggauuucgacuucugcgaggggacgaccguagucgugaccgaggauugcgguaaccggggcccaucccugaggaccacgaccgccagcgggaaacucaucaccgaguggugcugccggagcugcacccuaccgccccugagguaccggggggaagacgggugcugguauggcauggagauccgaccacucaaggagaaggaggagaaccuggucaacagccugguaaccgcggggcacggucagauugacaacuucagccucggcgugcuggggauggcucuguuccucgaggaaaugcugaggacccgcgugggcaccaagcacgccauccugcucgucgccguguccuucgugacccugaucacggggaacaugagcuuccgggaucugggacgcgucauggugauggugggugccgcuaugaccgaugacaucggcaucggcgucaccuaccucgcccugcuagccgcauucaaggugcgccccacauucgccgcggggcuccugcugcggaagcucacguccaaggagcugaugauggcgacgaucggcaucgccuugcucucgcaaagcacuaucccggagaccauccuggagcugacggacgcccucgcccugggaaugauggugcugaagaucguuaggaacauggagaaguaccaacucgcggugaccaucauggccaucagcugcgugccuaacgccgucauccugcagaacgccuggaaaguaucuuguaccauccuggcgacugugagcgugagcccccucuugcuaacgagcucccaacagaaggccgacuggauccccuuggcucugaccaucaaaggccucaacccgaccgccaucuuccucaccacguugagccggacuuccaaaaagcgcuccuggccccugaacgaggccauuauggcgguggguauggucaguauccuagcaagcucgcugcugaagaaugauauacccaugaccgggccccucguggccggugggcugcuuaccgugugcuacguccucacgggccggagcgccgaccuggagcuagagagagcaaccgacgucaaaugggaggaccaggcagaaauuagcgggucuagcccgaucuuauccauuaccaucgcagaggacggauccauguccaucaagaacgaggaagaggagcaaacccugacgauccugauccgaaccgggcuccuggucaucagcgggcuguuccccguauccauccccaucaccgccgccgccugguaccucugggaggucaagaagcagcgcgcgggcgugcugugggacgugccgagcccgccacccguggggaaggccgagcuggaggacggcgccuaccggauaaagcagaaggggauccucggcuacucccaaaucggcgccgggguuuacaaggagggcaccuuccacaccauguggcacguuacgcgcggcgccgugcugaugcaccggggcaagcgcaucgagccaucuugggcugacgugaagaaggaccugaucuccuauggaggugguuggaagcucgaaggggaguggaaagagggcgaggaggugcaggugcuggcccuggaacccgggaagaacccccgggccguccagacgaagcccggacuuuucaaaaccaacacagggaccauaggcgccgucagcuuggacuucucccccggcaccagcgguucccccaucguggauaaaaagggcaagguagucggauuauauggcaauggcguagugaccaggagcggagcguacguuucugccauugcccagaccgagaagagcaucgaggacaaccccgagauagaggacgacauuuucagaaagaagcgccucaccauuauggaccugcaccccggcgccgggaagaccaagcgguaccugccggccaucgugcgcgaagcgaucaagcggggcuugcgcacacucauccuggccccuacccggguggucgccgcugagauggaggaggcgcuacgcggccugcccauucgguaccagacacccgcgauacgggccgagcacacaggcagagagaucguggacuugaugugccacgcuaccuuuacuaugcggcugcucuccccggugcgcguuccgaacuacaaccugauuauaauggacgaggcccauuucacugacccggccagcauugcggccaggggcuacaucucgacccgcguggagaugggggaggccgccggcaucuucaugaccgcgacgccgcccgggucgcgggaccccuucccccagagcaacgcccccaucauggacgaggagcgggaaauccccgagagaaguuggaacagcgggcacgagugggugacggacuucaaggggaaaaccgucugguucgugcccuccaucaaggccggcaacgacauagccgccugccugcgaaagaacggcaagaaggugauccagcucagucggaagacauucgacagcgaauacgucaagacccgcacuaacgacugggacuucguggugaccaccgacauuuccgagaugggggcgaacuucaaagccgagcgggucauagacccccgucggugcaugaaacccgugauccugaccgacggcgaggagcgcgugauccuggcugggccgaugcccgucacgcacuccagcgccgcccagcggcgcggacgaauaggacgcaaccccaaaaacgagaacgaucaguacaucuacaugggcgagccauuagagaacgaugaggacugcgcgcacuggaaggaggccaagaugcuccuggacaacaucaauaccccggagggcaucauccccuccauguucgagccagagcgcgagaagguugacgccauugacggggaguaccgguugagaggcgaggcccggaaaaccuucguggaccucaugcgccgcggggaucugccggucuggcucgccuaccgcguggcugcagaggggaucaacuacgccgacagacgcuggugcuucgacgggguuaagaacaaccagauccuggaggagaacgucgagguggagaucuggacuaaggagggggaacggaagaagcugaagccucgcuggcucgaugcccggaucuacucugacccucuagcgcucaaggaguucaaggaauucgccgccggccgcaagucccucacgcugaaccugauaaccgaaaugggacgucuccccacuuucaugacccagaaagccagagacgcacuggacaacuuagcgguccuccacacggccgaagccggcgggcgggccuacaaccacgcccugucggagcuaccggagacccucgaaaccuuacugcuccugacccugcucgccacuguaacaggcggcaucuuccuuuuccugauguccgggaaaggcguggggaagaugacguuaggcaugugcugcaucauaacugccagcaucuuacuguggcacgcacagauacagccucacuggaucgcagccuccauuauacucgaguucuuccugaucguccuacucaucccugaacccgagaagcagagaaccccgcaagacaaucagcucacguacguggugaucgcgauccugaccgucguagccgccaccauggccaaugagaugggguuccucgagaagaccaagaaggaccugggucugggcagcaucgccacgcaggagcccgaauccaacauccucgacaucgaccugagacccgccagcgccuggacccuguacgcaguggccaccaccuucgucacgcccaugcuucgccauagcauugagaacucgagcguuaaugugucgcugaccgcgaucgcgaaccaggcaacuguucuuauggggcucggcaagggguggccgcuguccaaaauggacaucggcgugccgcuccucgccaucggguguuacucucaaguuaaccccaucaccuugacugccgcgcugcuccuucuggucgcgcacuacgccaucaucggucccggccuccaggccaaggccaccagagaggcgcaaaagcgcgccgccgccgggaucaugaagaacccgacuguggacggaaucaccguuauagaccuggaccccauccccuacgaccccaaauucgagaagcaacugggacaagucaugcuccugauccucugugugacccaggugcucaugaugcggaccacaugggcauugugcgaggcucugacccuagccacuggcccgaucaguaccuuaugggaggggaaucccggccgcuucuggaacaccaccaucgccgucuccauggccaacauauuccgcgguagcuaccuggcgggggccggucuccuguuuuccaucaugaagaacacgaccaacacucggcgcgggaccggcaacaucggcgagacgcugggggagaaguggaagucucggcucaacgccuugggcaagucagaguuccagaucuacaagaaguccggaauccaggagguggaucgcacccuggccaaggaaggcaucaagcgcggggagaccgaccaccacgcugugucccgaggcucugcgaagcugcggugguucgucgagcgcaacauggugacccccgaagggaagguggucgaccuggggugcggcagagggggcugguccuacuacugcgggggucugaagaacgugcgcgaggugaagggccugacgaagggcggucccggacacgaggagccgguccccaugagcaccuacggcuggaaccuggugcggcugcaguccggggucgacgucuuuuuuacgccgcccgagaagugcgacacccuccugugugauaucggcgagagcuccccaaacccuacgaucgaggccggccgcacccuacgcguguuaagucugguggagaacuggcugaacaacgacacccaguucugcaucaagguccucaacccauacaugccgagcgugaucgagaagauggaaacacugcagcgcaaguacggcggcgcccuggugcggaacccccugucccguaacagcacccaugagauguacugggucuccaacgccacgggcaacaucgugagcuccgugaauaugaucagccggaugcucaucaaccguuucaccaugaagcauaaaaaggccaccuacgagcccgaugucgaccugggcuccgggaccaggaacaucgggaucgagagcgagauccccaaccuggacaucaucgggaagcgcaucgaaaagaucaagcaggagcacgagacuuccuggcauuacgaccaagaccacccguacaaaacaugggcguaccaugggucguacgagaccaagcagaccggcuccgccucauccauggugaacggggugguccggcuccugacgaagcccugggacgucgugcccauggucacccaaauggcaaugaccgacaccacgcccuucggccagcagcgggucuucaaggagaagguggacacccgcacccaggagccgaaagaaggcacgaagaagcugaugaagauaacugccgaguggcuauggaaggaguugggaaaaaagaagacgccccggaugugcacccgcgaggaauucacgcggaagguccgcagcaacgccgcgcugggcgccauuuucacugacgagaacaaguggaagagcgcccgggaagcugucgaggacagcagauucugggagcucguggacaaagagcggaaccugcaccuggaagggaagugcgaaaccugcgucuacaauaugaugggcaagcgcgagaaaaagcucggggaguucggaaaagcgaagggcucccgggccaucugguacauguggcugggggcccguuuccuggaauucgaggcccucggauuccugaacgaagaccacugguucagccgggaaaacucauugagcggaguggagggcgagggucuccacaagcuaggcuacauccugcgcgacguuucgaagaaggagggcggggcaauguacgcggacgacaccgccgguugggacacccggaucacgcucgaggaccugaaaaacgaggagaugguuaccaaccacauggagggggagcacaagaagcucgccgaagccaucuucaagcucacuuaccagaacaagguaguccgggugcagcgaccaaccccccggggcacggugauggauaucaucuccaggcgcgaccagcgcgguagcgggcaggucggcaccuacgggcugaacacauucaccaacauggaagcccaauugauucgccagauggaaggggaagggauauuuaaguccauacagcaccuaaccgugaccgaggagaucgcggugcagaacuggcuggcccgcgucgguagagagcgccugagccggauggccaucuccggcgacgauugcguggugaaaccgcucgacgaccgcuuugccagcgccuugacagcgcugaacgauauggggaagguccggaaggacauccagcagugggagcccucacgcggcuggaacgacuggacccaggugccguucuguagccaccacuuccacgaguugaucaugaaggaugggcggguucuggucguucccugccgcaaccaggacgaacuuaucggccgggcccgcaucucgcaaggggcgggcuggagccucaaggagacugccugccugggcaaauccuacgcgcagauguggagccugauguacuuucacaggcgcgaccucaggcuagcggccaacgccaucuguuccgccgugcccucgcacuggguucccaccucccgcaccaccuggucaauccacgcgaagcacgaguggaugaccacggaggacaugcugaccgucuggaaccggguguggauccaggagaaccccuggauggaggacaaaacacccgucgaguccugggaagaggugccguaccucgggaagagagaggaccaguggugcggcagccugauugggcuuaccagccgugccacgugggccaaaaauauacaaaccgccaucaaccaggugcgcucccucaucggcaacgaggaguauaccgacuacaugcccucuaugaagcgguuccggcgagaggaggaggaggccgggguccugugguga

SEQ ID NO: 25397 - RNA, 9876 nt, Artificial Sequence
  derived and/or modified CDS sequence (opt11) from DENV-2__EU482779__SS-prME
acggcgggugugaucaucaugcugauccccaccgccauggcguuccacuugaccacccgcaacggcgagccccauaugaucgugggcagacaggagaagggcaagucccucuuauuuaagaccgaggacggagucaacaugugcaccuuaauggccauagacuuaggagagcugugcgaggauaccauaaccuacaagugcccccuccugcgccagaacgaaccggaggacaucgacugcuggugcaacagcaccucaaccugggugaccuacgggaccuguacuaccacgggagagcaccggcgcgagaaaagguccgucgcccugguaccccacguaggcaugggccucgagacacgcaccgagaccuggaugaguucggagggcgccuggaaacacgcacagcgcaucgaaacguggauacugcgccacccgggguucacuaucauggccgccauucuggccuacacggucgggaccacccacuuccaaagagcccuuaucuucauccucuuggcugccguagcccccagcaugaccaugcgaugcauaggcauauccaacagagacuucgucgagggagucagcgguggcucauggguggacaucguacucgagcacgggagcugcgucaccacgauggccaagaacaagcccacccuggacuucgaacugaucaagaccgaggccaagcagcccgcgacccuccgcaaguacugcaucgaggcuaagcugaccaacacgacgaccgagucccggugcccgacccagggcgaacccagccugaacgaggagcaggacaagcgcuucgugugcaagcacaguaugguugaccgagggugggggaauggaugcggguuauucggaaagggcggaauugucaccugcgcgauguucacguguaagaagaacauggaaggcaagauuguacagccggagaaccuggaguacaccaucgugaucaccccucacaguggugaggagcacgccgucgguaacgacacggggaaacacggcaaggagauaaagaucaccccccagucccccaucaccgaggcggagcugaccggcuacggcaccguuacgauggagugcuccccgaggaccggccucgacuucaacgagauggugcugcuucagauggaggacaaggccuggcuuguccaucggcagugguuucuugaccugccccuaccgugguuaccaggggccgacacgcaggguuccaacuggauccagaaagagacccucgugacguuuaaaaacccacacgccaaaaagcaagaugugguuguacucgggucucaggagggcgcaaugcacaccgcgcugaccggagcgaccgagauucagaugucuagcgguaaccuccuguucacgggccaccugaagugccgccugcguauggauaagcugcagcugaaggggaugagcuauucgaugugcaccggcaaguucaaaaucguaaaggagauagccgagacccagcacgggaccaucgugauccgugugcaguaugagggcgacggcagucccugcaagaucccguucgagaucauggaccuugagaagcggcauguccuugggcgucugaucacggugaaccccaucgugaccgagaaagacuccccuguaaacaucgaggcggagcccccauucggcgacucguauaucauuaucgguguggagccgggccagcugaagcucaacugguucaagaaaggguccagcauaggacagauguucgagaccaccaugcgcggcgccaagcggauggccauucugggggacacugcgugggacuucggcucucugggcggagucuucacaaguaucgggaaggcccuccaccaggucuuuggcgccaucuacggcgccgcguucagcggggugagcuggaccaugaagauuuugauuggcgugauaaucaccuggaucgggaugaacucccgcagcacgucgcugucagucuccuugguuuuaguuggagucaucacccuguaccuaggggccauggugcaggccgauucagggugcguggucaguuggaagaacaaggagcucaagugcgggagcgggaucuucaucaccgauaacgugcacacauggacggaacaguauaaguuccagccugagucccccagcaaguuagcuucagccauucagaaagcgcacgaggaaggcaucugcgguauccggucugugacgcgccuggagaauuuaauguggaagcagaucaccccggaacugaaucacauucuuucagaaaaugagguaaagcucacgaucaugacgggcgauauuaaggggaucaugcaagccggaaaacguucccuucggccacagccuaccgagcugaaguauagcuggaagaccuggggaaaggccaagaugcucucaacugagagucauaaccagacauuccugaucgacgggccggagaccgccgaauguccgaacacuaaccgagcguggaauucacuugagguggaggacuacggguucgggguuuuuaccacgaacaucuggcugaagcugcgcgagaagcaagacgucuucugcgacagcaaacuaaugagcgcugccaucaaggacaacagggccgugcacgccgacaugggcuacuggaucgaaagugcccuuaacgacaccuggaagauggagaaggcauccuuuaucgaagucaagucuugccacuggcccaaaucccauacccuauggagcaacggcguguuagaaucugaaaugaucauucccaagucauucgccgggccgguaucccaacauaacuacagacccggcuacuacacccagaccgcaggacccuggcaucucggcaagcuggagauggacuucgacuucugcgagggcacgacgguggucgugaccgaggacugcggcaaccggggccccagcuugcguacgaccaccgcuagcgguaagcucaucaccgaguggugcugucggucaugcacgcugccgccacugcgcuaccguggcgaagaugggugcugguauggcauggagaucagaccccucaaggagaaggaggagaaccuggugaacagccuggucacggcgggucauggucagaucgacaacuuuucccuaggagugcuggggauggcacuguuccucgaagagaugcugcggacgagggugggcaccaagcacgcuauacugcuagucaccgugucauucguuacguugaucacugggaacaugaguuuccgggaccucgggcgagucauggucaugguaggggcagcaaugaccgacgacauaggaaugggagucacguaccuagccuugcuggcagccuucaaagugcgccccacguuugccgcagggcucuugcugcggaaacugaccaguaaagagcugaugauggcgaccaucgggaucgcccugcucucccaaagcacuaucccggagacgauccuugagcugaccgaugcccucgcacuggggaugauggugcugaagaucgugagaaacauggagaaauaccagcuagccgugacaauaauggcgauuuccugcgugccgaacgccgucauucugcaaaacgcguggaaggugagcugcaccaucuuagcugcgguguccgucagcccccuccugcugacguccucacagcagaaggcagacuggaucccacucgcccugaccauaaagggccugaauccgaccgcaaucuuucugaccacgcuuucacggacaagcaagaagcgauccuggcccuugaacgaagccaucauggcgguaggaaugguguccauccucgcuuccucccucuuaaagaacgacauacccaugacugggccccucguggcaggaggacugcugaccguguguuacguacucacgggacggagcgcggaccuggaacuggagagggccacagacgugaagugggaagaucaggcggagaucuccgggagcuccccgauccuaagcaucaccaucgcagaggacggcagcaugagcaucaagaaugaagaggaggagcaaacccugacgauucucauccggaccggccuccuggugauuuccgggcuguuccccgucagcaucccuaucaccgcugcggccugguaccucugggaggugaagaagcagcgcgcaggagugcucugggacguucccagcccgccacccguggggaaggccgagcuggaggauggcgccuaccggauuaagcagaaggggauacucgguuacagccagaucggcgccggcguuuauaaggagggaacauuccacacuauguggcaugucacgcgcggggccguucugaugcaccggggcaagcgcaucgagccuuccugggcggacgugaagaaagaccugaucucguacggaggcggcuggaaacucgaaggggaauggaaggaaggugaggaaguacaggucuuagcgcuggagccgggcaagaauccucgggcuguucagaccaagcccggucucuucaagaccaauacugggacgaucggcgccgucucccuggacuucagcccgggaacuucggggagccccaucgucgaucggaagggaaaaguagucgggcuguacggaaacggaguggugacccggucuggggcguacgugagcgccauagcccagaccgagaagaguaucgaggacaaccccgagauagaagacgacaucuuucgcaagaagcgccucaccaucauggaccuacacccgggugccgggaaaaccaagcgcuaccugccugcuauaguacgugaggcgaucaagcgcggccuccgcacccucauucuagcccccaccagggugguugccgccgagauggaggaggcucugcgcgggcucccgauccgguaccagacaccagcgauccgcgcggagcacaccggccgggagaucguugaccugaugugccacgccacguucaccaugcggcugcucagcccaguucgggucccgaacuacaaccugauuaucauggacgaggcgcauuucacagaccccgccagcauugcggcacgcggcuacaucucgacgcguguggagaugggggaggccgccggcauauucaugacagcgacgcccccggggagccgcgauccuuuuccccaaucaaacgccccgaucauggaugaggagcgggagaucccagaaagauccuggaauucgggccaugagugggugacggacuucaaggggaagaccgucugguuugugcccaguaucaaggccggcaacgacauugccgccugccugcggaagaacggcaagaaggugauccaacugucccgcaagaccuuugacagcgaguacgucaagacucggacgaacgauugggacuucgugguuaccacugacaucuccgaaaugggcgcgaacuucaaagccgaacgcgucauugacccacguagaugcaugaagcccguuauacugaccgacggagaggagcgggugauccuggccgggccgaugcccgucacgcacagcuccgcggcacagaggcggggccgcaucgggcgcaauccgaagaacgagaacgaccaguacaucuacaugggcgaaccccucgaaaacgacgaggacugcgcgcacuggaaggaggccaagaugcugcuggacaacaucaauaccccggagggcauaauuccgagcauguucgaaccugaacgcgagaaggucgaugcgaucgacggggaauaccgccuacggggcgaagcccgcaaaacuuucguggaucugaugcggagaggggaccugccgguguggcucgcuuaucgggucgccgcggaggggauaaacuacgccgaccgccgcuggugcuuugauggggugaagaacaaccagauccuggaagagaacgucgagguggaaaucuggaccaaagagggcgagcgcaagaagcugaagccccgguggcucgacgcacgcaucuauuccgacccccucgcguuaaaggaguucaaagaguucgccgcgggucgcaagucacuuacgcugaacuuaaucaccgaaauggggcgccuucccaccuucaugacccagaaggcccgcgacgcccuggauaaccucgcggugcuccauacggccgaggcgggcgggcgugccuacaaccaugccuuauccgagcugccggagacccuugagacccugcugcuccugacccugcuagcuacgguaaccggcggcaucuuccuguuccugaugagcggcaagggaguggggaagaugacccucggcaugugcuguaucaucacagccucgauucugcugugguaugcgcagauccaaccacacuggaucgccgcgagcaucauccuggaguuuuucuuaauuguccuguugaucccugagccugaaaagcagcggaccccucaagacaaccagcucacguacguggugaucgcgaucuuaaccgucguggccgccaccauggcuaacgaaauggguuuccucgaaaaaacuaagaaggaucuggggcugggcuccaucgccacgcaggaacccgagaguaacauacucgauaucgaccugcgccccgcgucagcuuggacccuuuaugccguggccaccacauucguaacucccaugcucaggcacucaauugagaacagcuccgugaacgugagccuaaccgcuaucgccaaucaggccacaguccucauggggcucggcaagggguggccgcucuccaaaauggacaucggcgugcccuugcuugccauagguugcuauagccagguaaaccccaucacccugacggccgcgcugcucuuguuaguggcgcacuacgccaucaucggcccgggccuccaggccaaagccacccgcgaggcgcaaaagcgugccgccgccgggaucaugaagaaccccacuguggacggagucaccgucaucgaucucgaccccauccccuacgaccccaaauuugaaaagcaacugggccaggugauguugcugaucuugugugucacccaaguucucaugaugaggaccacgugggcccugugcgaagcgcugacacucgccacgggcccuauauccacccugugggaaggaaaccccggccgcuucuggaacacuacaaucgcagugagcauggccaacauauuccggggcuccuaccuggcgggugcaggccuccucuuuaguaucaugaaaaacacgacuaacacccgccgaggcaccggcaacaucggcgagacgcuuggggaaaaguggaaguccagacuaaacgcuuuaggcaagagcgaguuccagauauacaaaaaguccgggauucaggaggucgaccggaccuuagcgaaggaggguaucaagcguggggaaaccgaccaccaugcagucagccggggcuccgccaagcuccgcugguucguagaacggaacaugguaacacccgagggcaaggucguggaucuugguugcggccgcgggggauggagcuauuacuguggaggccugaaagacguaagagaggugaagggccucacgaaaggagggcccgggcacgaggagccgauccccauguccaccuacgguuggaauuuggugagacugcagucagggguggacguauuuuucacaccgccggaaaagugcgacacccuccugugcgacaucggcgaaucaagcccaaaccccacgaucgaggcuggucggacccugcgcguacucagcuuaguggagaacuggcuaaacaaugauacccaguuuuguaucaagguuuuaaacccuuauaugccguccgugaucgagaaaauggagacccuacagcggaaguacgggggcgcccuggugcgcaacccauuaagccggaacuccacccacgagauguacuggguuagcaacgcuacggggaauaucguuuccucugugaacaugauaagccguauguugaucaaccguuuuaccaugaagcacaaaaaggccacauacgaacccgacgucgaccugggcagcgguacacggaauauugggauugagagcgaaauacccaaucuugacauaauaggcaagcguaucgaaaagaucaagcaggagcacgagacuagcuggcacuaugaucaggaccacccauacaagaccugggcguaccaugggucauacgagaccaaacagaccggcagcgcuuccagcauggugaacggggugguccggcuccugacgaagcccugggauguggugccaauggucacccagauggccaugaccgacaccacgccuuucggacagcagagaguguuuaaggagaaggucgacacccggacccaggagccgaaggagggcacgaagaagcuaaugaaaaucacggcugaguggcucuggaaggagcuggggaaaaagaagacgccacgcaugugcacgcgagaggaauuuaccaggaaggugcgguccaacgccgcgcugggcgcgaucuucacggacgagaacaaguggaagagugcccgcgaagccguggaggacucccgguuuugggagcuuguagauaaggagcgcaaccugcaccuugaggggaagugcgagaccugcguauacaacaugaugggcaagcgggaaaagaagcuaggggaguuuggcaaggcgaagggcagccgcgccaucugguacauguggcuaggggcgcgguuccuggaguucgaagcccucggcuuccugaaugaggaccacugguucucgcgcgagaacucauugucggggguagagggcgaagggcuccauaaauuaggcuauauacugagggacgucucgaagaaggagggcggggccauguacgcggacgacaccgccggcugggauacccgcaucacccucgaggaucuaaagaacgaggagauggugacuaaccacauggagggggaacacaaaaagcuagcggaggcuaucuucaagcucaccuaccagaacaaggugguccgggugcagcgccccacccccagaggcacagugauggauaucaucagccgccgggaccaacgcggguccgggcagguagguaccuacggccugaacaccuuuaccaacauggaggcgcaacugauccgccaaauggagggcgaggggguguuuaaguccauucagcgacucacggugaccgaggagaucgcgguccaaaacuggcuagcacgcgugggccgggagagacugucacggauggccaucagcggcgacgacugcguggucaagccguuggaugaccgcuucgccuccgcucuuacagcgcugaacgacauggggaagguacggaaggacauccagcagugggagccaagccgcggcuggaacgacuggacccagguccccuucugcucccaccacuuccacgagcuuaucaugaaggacgguagaguucugguggugcccugucgcaaccaggacgaacugauaggccgcgcccgcauaucacagggagccggcuggagccucaaggagaccgcaugccugggcaagagcuacgcccaaauguggucccugauguacuuccaccggcgagaccuccggcuggcugcaaacgccaucugcagcgccguccccucgcacugggugcccacaucaaggaccaccugguccauccacgcgaagcacgaguggaugacgacggaggacaugcuuaccguguggaacagggucuggauucaggagaaccccuggauggaggacaagaccccaguggagucgugggaagaggugcccuaccucgggaagcgcgaggaccaauggugcggaagcuuaaucggucugacuucacgggccacgugggccaaaaacauacagacugccauaaaccaaguccguagccuaauaggcaacgaagaguacacagauuauaugcccucuaugaagagauuccggcgugaggaggaagaggccggcgugcugugguga

SEQ ID NO: 25398 - RNA, 9876 nt, Artificial Sequence
  derived and/or modified CDS sequence (opt11) from DENV-2__EU482780__SS-prME
acagccggcgugaucaucaugcucauccccacagccauggcguuucacuuaaccacgagaaacggggagccccauaugauaguuggccggcaggagaagggaaaaucauugcuguuuaagaccgaggacggcguaaacauguguacguuaauggccaucgacuugggggaguuaugcgaggacaccaucaccuacaagugcccccuccugcgccagaaugaaccagaagacaucgauuguuggugcaacagcaccagcaccugggugacuuacgggaccugcaccaccaccggcgagcaccggcgcgagaaaaggucagucgcccuggugccccauguggguaugggccuagagacccgcacugagaccuggaugagcagcgagggggcuuggaagcacgcccagcggaucgaaaccuggauccuaagacacccgggguucacuauuauggcggccauccuggccuacaccgucgggaccacccacuuccaacgggcccucaucuucauccugcuggccgccguggccccgagcaugacgaugcgcugcaucggaaucuccaaccgggauuuuguugagggcgugagcgggggcucauggguggacauugugcucgagcauggcuccugcguaacgacuauggccaaaaacaagcccacccuggacuucgaacugaucaagaccgaagcgaagcagcccgcaacgcuccgcaaguacugcauagaggccaaacugacuaauacgacuaccgaguccaggugcccuacccaaggcgaacccagccugaacgaggagcaggauaaacgcuucgugugcaagcacucgaugguggacaggggcuggggaaacggaugcgggcucuucggcaagggcggcaucgucacgugcgcuauguucacaugcaagaagaacauggaggggaagaucgugcagcccgagaaccuggaguauaccauugugaucacgccgcacuccggggaggagcacgcaguaggcaacgacacggggaagcacggcaaggagauuaagaucaccccgcaguccccgaucacggaggccgagcugaccgguuauggaacugugacgauggaaugcagcccgcgcaccgguuuagacuucaacgagauggugcuguugcagauggaggacaaggcauggcucguacacaggcagugguuccuggaccugccccucccguggcugcccggggccgacacccagggcaguaacuggauucagaaggagacgcuggucacguucaagaacccccacgccaagaagcaggaugugguagugcucgggucgcaagagggagcaaugcacaccgcccucaccggagcgacugagauacaaauguccagcggaaaccucuuguucacgggccauuuaaagugccgccugaggauggacaaacuccagcugaaggggaugagcuacuccaugugcaccggcaaguucaaaaucgucaaggagaucgccgaaacccaacacgggacgaucgugauccgcguucaguacgagggcgacggcagcccaugcaagaucccguucgagauaauggaccuggagaagcgccacgucuuagguaggcugaucacagugaaucccaucgugacagagaaggacucccccgucaacauagaggcggagcccccauuuggcgacucguacauaaucaucgggguagagcccggccagcugaagcucaacugguucaagaagggcuccagcaucggccagauguucgagaccaccaugcggggcgcuaagcgaauggcaauccugggggacacggcgugggacuucggcucccucggcgggguguuuaccaguaucgggaaggcucuccaucaggucuuuggggccaucuacggcgcugcguucuccggggugagcuggacgaugaagauccugaucggugucaucaucaccuggaucgggaugaacucccguagcacgucccuguccgucucccugguacucguaggcgucaucacauuauaucugggggccauggugcaggccgacuccggcugcguggucuccuggaagaacaaggagcucaagugcggcagugggaucuucaucacggacaacgugcacaccuggacggagcaguauaaguuccaacccgagucccccagcaaacuagccagugccauccagaaggcgcacgaggaaggcaucugcgggauacgguccgugacccgccuagagaacuuaauguggaagcagauuacccccgagcuuaaccacaucuuauccgagaacgaagucaagcucaccaucaugacuggagacaucaaggggaucaugcaggccggcaagcggucccugcgaccccaaccgacggaauugaaguacagcuggaagaccugggguaaggcgaaaauguuguccaccgaaagccacaaccagacuuuccugaucgacgggcccgagacagccgaaugccccaacaccaacagagccuggaacucccuggagguggaggacuacggcuucgggguguucaccacgaacauauggcucaaacugcgcgagaagcaagacgucuucugugacagcaagcugaugagugcggccaucaaggacaacagagccgugcacgccgacaugggcuacuggaucgagucugccuuaaaugauaccuggaaaauggagaaggcauccuucauagaggucaagucgugccacuggcccaaaucacacacccuuuggagcaacggcgugcuugagucggagaugaucaucccuaagagcuucgccgggccuguaucccagcacaacuaccgccccggcuacuacacccagaccgccgggccuuggcaccugggcaagcuagagauggacuucgacuucugcgagggaacgaccguggucgucaccgaggauugcggcaaccggggacccagcuuacgcaccacaaccgccucagggaaacucaucacagaguggugcugccggaguugcacccugccuccccugcguuaucgaggcgaggaugggugcugguacggcauggagauucggccacuaaaggagaaggaggagaaccuggucaacucguuagucacggcggggcacggacagauugacaacuucucgcucggugugcuggggauggcccuguuccucgaggaaaugcugcggacccgcgugggaaccaagcacgccauccugcucgucaccguguccuucgugacgcugaucaccggcaacauguccuuccgggaccugggccgcguaauggucauggugggggccgcuaugaccgacgacaucggcaugggcgucaccuaccucgcgcuacuggccgccuuuaaggugagacccacauucgccgccgggcuccugcuccggaagcucaccagcaaggaguugaugauggcaaccauaggcaucgccuuacucucccagaguaccaucccggagacgauccuggagcugaccgaugcccucgcccuugggaugaugguguuaaagaucguccggaacauggagaaauaccaacucgccguaaccauuauggcaaucuccugugugcccaaugcagucauccugcaaaacgccuggaaagugucuugcaccaucuuggccgcgguuagcguguccccccuccuucuaacguccucgcaacagaaggccgacuggaucccacucgcccuuacaaucaagggccugaacccgacggccaucuuucuuacaacacugucccggaccagcaagaagcgcuccuggccccugaaugaagccaucauggcggucgguauggucagcauccucgccucaucacugcugaagaacgauauccccaugacuggaccccucguugccggaggccuccugaccgugugcuacgucuugacgggccguagcgccgaccuggagcuggagcgcgccacagacgugaagugggaggaccaggcggagaucuccgggucgucaccgaucuuaagcauuaccauagccgaggacgguuccaugagcauuaagaaugaggaggaggagcagacccugacuauccugauccggaccggccuccugguuauauccgggcuguuccccgucagcauacccaucaccgcugccgccugguaccucugggaggugaagaaacagcgcgcgggcguucugugggacgugcccuccccaccccccgucgggaaggccgagcuggaggacggcgcauaccggauaaaacagaaggggauccucggcuacucccagaucggugccgggguguauaaagagggcaccuuccacaccauguggcacgucacgcgcggcgcggugcugaugcaccgcggcaagcggaucgagccuuccugggcggacgugaagaaagaccugauaagcuacgggggcggcuggaagcuggagggugaguggaaggagggcgaggaggugcaggugcuggcccucgagcccgggaaaaacccccgggccgugcagaccaagccaggccucuucaagaccaacaccgggacgaucggugccgucucccuggacuucagcccuggaaccuccgggagccccaucguagaccgcaaaggcaagguggucgggcuguacggcaacggcguggugacccgguccggagcauacgucagcgccaucgcacagaccgagaaguccaucgaggacaacccggagaucgaggacgacauuuuccgaaagaagcggcucacgaucauggaucuccacccuggggccggcaaaaccaagcguuaccugccggccauagucagggaggccauaaagcgcggucuccggacccucauccuggcccccacucgcguggucgccgccgaaauggaagaggcccugcgggggcuccccauccgguaccagacgccugcgaucagagccgagcacacaggccgggagaucguugaccugaugugucacgccacauucaccaugcgccugcucucgccggugcggguccccaacuacaaccugaucaucauggacgaagcucauuucacggaccccgccagcauagcugcccgcggcuauaucagcacuaggguggagaugggggaagccgcgggcaucuucaugaccgcaaccccacccgggagccgcgaccccuucccccagucuaacgcccccauuauggacgaagagcgggaaauccccgagcgcagcuggaacuccggccacgagugggucacggacuucaaggggaaaacugucugguuugugcccagcauuaaggccggcaacgacaucgccgcgugccuucggaagaaugggaagaaggucauccaauugagccgaaagacguuugacagcgaguaugucaagacacgaacgaacgacugggauuuuguggucaccaccgacaucucggagaugggggcgaacuucaaggccgagcgcgugauagauccccggagaugcaugaagcccguaauccugaccgacggcgaggagcgggugauccuggccggaccgaugcccgugacgcacuccucagccgcccagcgccgaggacgcaucgggaggaaccccaagaacgagaacgaccaguacauauacaugggcgagccccucgagaacgacgaggauugcgcgcacuggaaagaggccaagaugcugcuggacaacaucaacacccccgagggcauaauccccagcauguucgagcccgagcgggaaaagguggacgcaaucgacggggaguaccgacuccggggcgaggcccguaagaccuucguagaucuaaugcggcgcggcgaccugccugucuggcucgccuacagaguggcggccgagggcaucaacuaugcugaccgccgguggugcuucgacggggugaagaacaaccagauccuggaggagaauguugagguggagauauggaccaaggagggcgagcgaaagaaguugaagccccgguggcucgacgcccguaucuacucugacccacuggcgcugaaggaguucaaagaguuugccgcuggccgcaagucuuugacgcugaaccugaucacugagauggggcgccuccccacuuucaugacccagaaggcccgggacgcccuggacaaccuggcggugcuccacacggccgaggccggcggccgcgccuacaaccacgcgcuguccgagcugccggagacccucgagacacugcuguugcugacccugcucgcgacggucaccgguggcaucuuccuguuccugaugagcgggaagggcguggggaagaugacccucggcaugugcugcaucaucaccgcuuccauccugcugugguacgcccaaauccagccccacuggauugccgccucaaucauccucgaauucuucuuaaucguccugcuaauccccgagccagagaagcagaggaccccgcaggauaaccagcugacguacgugguaauagcaauccugaccgucguggccgccacgauggcgaacgagaugggguuccuagaaaagaccaagaaggaccuagguuuaggcuccaucgccacccaggagcccgaaucaaacauucucgacaucgacuugcguccugcaagugccuggacccuguacgcaguggccaccaccuucgugacaccgaugcuccggcacaguaucgagaacagcuccguuaacgugagccugaccgcaaucgccaaccaagccacgguacugauggggcucgguaagggcuggccguuguccaagauggauaucggcgucccacugcuggccauaggcugcuacagccaggugaacccaaucaccuuaacggccgcgcuguugcugcuugucgcccacuacgccauaaucggccccggacuccaagcuaaggcuacccgcgaagcgcagaagcgggccgccgcggggaucaugaagaacccgaccguggacggugugaccguuaucgaccuggacccuauacccuacgaccccaaauucgaaaagcaguugggccaagugaugcuccugauccugugugugacgcaaguccucaugaugcgcacaaccugggcccugugcgaggcgcuaacccucgcuacugguccgauuuccacccugugggaggggaaccccggacgcuucuggaacacaacuaucgccgugagcauggccaauaucuucagaggguccuacuuagcgggggccgguuugcuguucagcaucaugaagaacacgaccaacacccggcgggggacaggcaauauaggggagacgcucggggagaaguggaagucucgacucaacgcccuugguaagucagaguuccaaaucuacaaaaagucaggaauccaggaaguggaccggaccuuggccaaggagggcaucaagcgcggggagaccgaccaccacgcagugagcaggggauccgcgaaguugcgcugguucguggaaaggaacaugguaaccccggaggggaaggucguggaucuggggugcggccgugggggguggucuuacuacugcggggggcugaaggauguccgggaagucaagggcuuaacgaaaggggggcccggucacgaggaaccuaucccuauguccacauacggauggaaccuggugcgcuuacaaucggggguggacgucuucuucacgccgcccgagaagugcgacacccucuuaugcgacauuggcgaguccuccccgaacccaacgaucgaggccggccggacacugcgcgugcucucucugguggagaacuggcugaauaaugacacccaauucugcaucaaagucuuaaaccccuacaugcccuccgugauugagaagauggagacccugcagcggaaguacggaggcgcccuggugcgcaaccccuugagccggaacuccacccacgagauguauuggguaagcaaugcgacggguaacaucgugucaagcgugaacaugaucucccgcaugcucaucaaccgguuuacgaugaaacacaagaaagcaacuuaugagcccgacgucgaccugggaagcgggacccgcaacauuggcaucgaguccgagauacccaaccuggauauaaucggcaagcgaaucgagaagauuaagcaggagcaugaaacgagcuggcacuaugaccaggaccacccguacaagaccugggcguaccauggguccuacgagaccaagcagaccggcucugccagcagcauggugaacggggugguccgccuccugacgaagcccugggacgugguacccauggucacucagauggccaugaccgacaccacacccuucggacagcaacgcguauucaaggaaaaaguggacacccggacccaggagccaaaagaggggacgaagaaguuaaugaaaaucaccgcggaguggcucuggaaggaacuggggaagaaaaagacgccccggaugugcacucgcgaggaguucacccgcaagguacggucgaacgccgcgcugggcgccaucuucacggaugagaacaaguggaaguccgcccgcgaggcaguggaggacuccagguucugggagcugguggauaaggagcgcaaccugcaucuggaggggaagugcgaaaccugcguuuacaacaugaugggcaagcgcgagaagaaacucggggaguucggcaaagcgaaaggcagccgcgccaucugguauauguggcuaggcgcgcgguuucuggaguucgaagcucuuggcuuccugaacgaagaccacugguucucuagagagaacagccugagcgggguggagggugagggguugcacaagcugggguacauucugcgggauguguccaaaaaggaagggggggccauguacgcggacgacaccgcaggcugggacacuaggaucacguuggaggaccugaagaacgaggagauggugaccaaucacauggagggggagcacaagaaacucgccgaagccauauucaagcuaacauaccaaaacaaggugguccggguacagcgcccuacgcccaggggcacggugauggacaucaucagccgccgugaccagcgcggguccggccagguaggcaccuacggacugaacaccuucaccaacauggaggcccagcugauucgacaaauggagggcgaggggguguucaagucuauccaacggcucacggugaccgaggagaucgcgguccagaauuggcuagcccgcgugggccgggagcgccuguccagaauggcuaucagcggcgaugauugcgucguaaagccgcuugaugaucgauucgcuucagcacugacagcgcugaaugacauggguaaggugcguaaggacauccagcagugggaaccaagccggggguggaacgacuggacccaggugccguucuguucccaccauuuccacgaacucaucaugaaggacgggagaaugcuagucgugccuugucgcaaccaggaugaguuaaucggccgggcccguauaucccagggggcggguuggucccucaaggagacggccugucugggcaagagcuacgcccagauguggucccugauguacuuucaccggcgcgaucuccggcuggcggcaaacgccauuugcagcgccguuccgucucacuggguccccaccucgcgcaccaccuggaguauccacgcgaagcacgaauggaugaccacggaggacaugcugaccguauggaaccgaguguggauccaggagaaccccuggauggaggacaagacccccgucgagagcugggaggagguuccguaccuugggaagcgcgaggaccaauggugcggaucauugaucgggcugacaucccgugcgacgugggccaagaacauccagaccgccaucaaccaagugcgcagccuaaucggcaacgaggaguauaccgacuauaugcccuccaugaagcgauuccgaagagaggaagaggaggccggggucuugugguga

SEQ ID NO: 25399 - RNA, 9876 nt, Artificial Sequence
  derived and/or modified CDS sequence (opt11) from DENV-2__EU482781__SS-prME
accgccggugugauaaucaugcuaauccccacagcaauggcguuccaucucacgacccguaacggugagccgcauaugaucgucgggcggcaggagaaggggaaaagccugcuguucaagaccgaggauggggugaacaugugcacccucauggcgauugaccucggggagcugugcgaggauacaaucaccuacaaaugcccgcucuuacgccaaaacgagcccgaggacauugacugcuggugcaauagcaccucgacgugggugaccuacgguaccugcacgacgacgggcgaacaccggcgcgagaaacgauccguggcccuggugccgcacguggggauggggcucgagacccggaccgagacguggaugagcuccgagggugccuggaaacacgcucaacggaucgagaccuggaucuugcgccacccuggauucaccaucauggcggccauccuggccuacaccgucgggaccacccacuuucagagggcccucauuuucaucuuguuagcugccguggcacccucgaugacuaugagguguaucggcaucucuaaccgugacuuuguggagggcgugagcggagggaguuggguggauaucguacucgagcacgggagcugcgucaccaccauggcuaaaaacaagcccacgcuggacuucgaacugaucaagaccgaggccaagcaacccgcuacgcugcgcaaguacugcauugaagccaaguugacgaacacuaccaccgagucaagaugcccgacccagggcgagccgagccugaacgaggagcaggacaagcgguucgugugcaagcacuccaugguggaccggggcugggggaacggcugcgggcuguucgggaagggugggauagucaccugugccauguuuacgugcaagaagaacauggagggaaagaucgugcaacccgagaaucuggaguacacuaucgugaucacgccucacagcggggaggaacacgcggucggcaacgacacgggaaagcacggcaaagagauaaagauuacuccgcaaagccccaucaccgaggccgagcugacaggguacggcaccgugacaauggagugcagcccccgcacgggcuuagacuucaacgagauggugcuucuucagauggaggacaaggcguggcugguccaccggcagugguuccuggaccugccccucccguggcugcccggugcugacacccaaggcuccaacuggauccagaaggagacacugguuacguuuaaaaacccccacgcuaagaagcaagacgucguagugcucggcucacaggagggagcgaugcauacagcccugaccggggcgacugagauccaaauguccagcggaaaccuccuguucacggggcaccugaagugucgccugcggauggacaagcuccaacugaaggggaugagcuacuccaugugcaccggcaaguucaagaucguaaaggagaucgcugagacacaacacgggaccaucgugauccgcguacaguacgaaggcgacggcagccccugcaaaauaccguuugagaucauggaccuggaaaagcggcacgugcucgggcgccugaucaccgugaaccccaucgugaccgagaaggacucccccguaaauaucgaggccgagcccccguuuggagacagcuacaucaucaucgggguggaacccggccaacuaaagcucaauugguucaaaaagggguccucgauugggcagauguucgaaacuaccaugcguggagccaagcggauggccauccucggcgacacagcuugggacuuuggcuccuugggcgguguguucacuagcauagguaaggccuuacaucaagucuucggggccaucuacggcgccgcguucuccgggguaagcuggacgaugaagauccuaaucggcgucaucauaaccuggaucggcaugaacucccgcagcacgucccugagcguuuccuugguguuagugggcgugaucacguuauaccugggggcaaugguccaggccgacucaggaugcguggugucuuggaagaacaaggagcucaagugcggcagcgggauuuucauuaccgacaacguccauaccuggacggagcaguacaaguuccagcccgagucccccucgaagcuggcuagcgccauccagaaggcgcacgaggaggguaucugcgggauccgguccgucacgcgccuggagaacuuaauguggaagcagaucacccccgagcugaaccacauccugagcgaaaacgaagucaagcugaccaucaugacaggcgacaucaaagggauuaugcagccuggcaaacggucgcugcgcccccagccgaccgagcugaaguacucuuggaagaccuggggcaaggccaagaugcucuccaccgagagccauaaccagacguuuuugauugacggaccagagaccgccgagugucccaacaccaaccgggccuggaacucccuggagguggaggacuacggauucggggucuucaccacgaauaucuggcuaaagcugcgcgagaagcaggaugucuuuugugacaguaagcugauguccgccgcgaucaaagacaaccgggccgugcacgcugacaugggguacuggaucgaaucagcccucaacgacaccuggaagauggaaaaagccuccuucaucgaggucaagucgugccacuggcccaagucccacacgcuguggucgaauggaguguuggagucggagaugaucauaccgaaauccuucgcggggcccgugucccagcacaacuaccgcccaggcuauuacacgcagacugccgggccauggcaccucggaaaacuggagauggauuucgauuucugugagggaacaaccguagucgugaccgaggacugcggcaaccggggccccucccuuagaaccacaacagcuagcgggaaacucaucacugaguggugcugccgguccugcacccugccgccguugcgcuacaggggagaggacgggugcugguacgguauggagauccguccucucaaagagaaggaggagaaucugguuaacucucuggucacggccgggcacggacagaucgacaacuuuucccucggcguguuagggauggcccuguuucuugaagagaugcugcguacccgcguggguaccaagcacgccauucugcuagucaccgugucauucgugacguuaaucaccgggaauaugucuuuccgggaccugggccgcgucauggucauggugggggcagccaugaccgacgacauaggaaugggggugacuuaccuagcccuguuagcggcguucaaggugcgcccgacguuugcggccggguuacuauuaagaaagcucacaucgaaggagcugaugauggcgacuaucggcauagcccuguugucccagagcaccauccccgagacgauucuggaguugaccgacgcccucgcccuggggaugauggucuugaagaucguccgcaacauggagaaguaccaacucgcagugacgaucauggccaucuccugcgugcccaacgcgguaauucugcagaacgcauggaagguuucaugcaccauccuggccgccguuuccgugagcccccugcugcuaacguccagccagcagaaggcggacuggaucccacucgcccugaccaucaagggcuuaaacccuaccgccaucuuucucaccacucugucgcggaccagcaagaagcgcuccuggccgcugaacgaggcgaucauggccguggggauggucagcauccucgcguccagccugcucaagaacgacauccccaugaccggcccgcuuguggccggagggcuguuaaccgugugcuaugucuuaacgggccggagcgccgaucuggagcuggagcgcgccaccgacgugaagugggaggaccaggccgagaucuccggcagcucccccauccucagcaucaccaucgcggaggacggauccaugucuaucaagaacgaggaagaagaacagacucuuacgauccuaauccggaccggcuuacugguaaucuccgggcuguuccccguuagcauacccaucaccgcugccgcaugguacuugugggaggugaagaagcaacgcgccggcguacugugggacgucccuagcccuccgcccgucgggaaggcggagcuggaggacggcgccuaccggauuaagcagaaggggaucuugggcuacagccagaucggagcugggguauauaaagaggguacuuuccacaccauguggcacgucacgcgcggagccgugcugaugcaccguggcaagcgcauugagcccuccugggccgacgugaagaaagaccugaucagcuacggaggcggcuggaaacuggaaggcgaguggaaggaaggcgaagaggugcaagugcuggcacuggagcccggcaagaacccccgggccgugcaaacgaagcccggccucuucaagaccaauacagggacaaucggagcugucucgcuggacuucagcccgggaaccuccgggucuccaaucguggaucgcaagggcaagguggucggccucuacggcaaugggguggugacccgguccggggccuacgucagcgcgaucgcccagaccgagaaguccaucgaggacaaccccgagaucgaagaugacaucuuccggaagaaacgguugacgauuauggaccugcacccgggcgccgggaagaccaaacgcuaccugccggccaucgugcgcgaggccaucaagcgaggcuugagaacauuaauccuugcgccaacucgcgugguggccgccgagauggaagaggcccugcgcgggcuccccauccgguaucagacgccggccauucgcgcggagcacacuggccgggagaucguggaccuaaugugccacgccaccuucaccaugcgcuugcucagucccguccgggugcccaacuauaaucugaucaucauggaugaagcacauuucacggaccccgccagcaucgccgcgcgcgguuacaucuccacccggguggagaugggggaggccgccggcaucuucaugaccgccacuccgcccggcagccgggaccccuucccccagucaaacgcuccgauuauggacgaggaacgagagauccccgagcguucauggaacuccggccaugaaugggugacggacuucaaggguaagaccgucugguucgugcccucgauaaaggccgggaaugauaucgccgcgugcuugcggaaaaacggcaagaaggucauccaacucucacguaagaccuuugacagcgaguaugugaagacccggacuaacgacugggauuucguagugacaaccgacaucuccgagaugggggccaacuucaaggccgagcgcgucaucgacccccggcgcugcaugaagccggugauccucaccgauggcgaggaacgggugauccuggccgggcccaugcccgucacgcacucguccgcugcccagcgcagaggccgcauuggucgcaaccccaagaacgagaacgaucaauacaucuacaugggcgagcccuuagagaacgacgaggauugcgcccacuggaaagaggccaagaugcugcuggacaacaucaacaccccugaaggcaucauucccagcauguucgagccggagcgggagaaaguggacgccauugacggggaguaccgccucagaggcgaggcccgcaagaccuuuguggaccucaugcggcgcggggaccugcccgucugguuggccuaccgggucgcugcagaaggcaucaacuacgcggaccgccgcuggugcuucgacggcgugaagaauaaccagauuuuggaggagaacguugagguggagaucuggacaaaggagggggagcgcaagaagcugaagccccggugguuagacgcacguaucuacuccgauccccucgccuuaaaggaguucaaggaguucgcggcgggucgcaaaagccuuaccuugaaccuaauaacagagauggggcgccucccuaccuucaugacccagaaagcccgggacgccuuggacaaccuggcugugcuccacacggcggaggccggcggccgggccuacaaccacgcacuauccgagcugccagagacucucgaaacccugcuccuccugacccuucucgcgacugucacgggcgguauauuccuuuuucugaugagcgggaagggaguggguaagaugacccuagggauguguugcaucaucacugcguccauacugcugugguacgcccagauccagccccacuggaucgccgccagcaucauccucgaguucuuccugauuguccucuugauaccugagccggagaagcagcggacgccccaggauaaccaguuaacuuacguggugaucgccauccugaccgucguagcggcgaccauggccaacgagaugggguuccucgagaagacuaagaaggaucuaggccucggcuccauugccacccaggagccggagucaaauauccucgacaucgaccugcgccccgcgucugcguggacccuguacgcgguggcuaccaccuucgugacgccgaugcugcgucacuccaucgagaacagcucggugaacgugagccuuaccgcaaucgcgaaccaggccacaguccugauggggcucggcaagggauggccccuguccaagauggauaucggcgugccccugcuugccaucgggugcuacagccaggugaaccccaucacccugacggcugccuuacuccugcugguggcgcacuacgccaucaucggcccgggccuacaggccaaagccacucgcgaagcccagaagagggcggccgccggcauaaugaagaacccuaccguggacggcgugaccgucaucgacuuggaccccauaccguaugacccgaaauucgagaagcagcugggccaagugaugcuccugauccugugcgugacgcagguccucaugaugcgcacgaccugggcgcugugcgaggcacugacccucgcgacgggccccaucucaacguuaugggaggggaaccccggccgcuucuggaacaccacuaucgccgugagcauggccaacaucuuuaggggcuccuaccuggccggggcaggccuccucuuuagcauaaugaagaacacgaccaacacccgccgcgggaccggcaacaucggcgagacacugggggagaaguggaaaagucgacucaacgcccugggaaaaagcgaguuccagaucuacaaaaaguccggcauacaagaggucgaccggacacuggccaaggaggguaucaagagaggggagaccgaccaccacgccgucucacggggcagcgccaagcuccgcugguuuguggagcggaacauggucacccccgaagguaaggucguagaccuagguugcggccgcgggggcuggagcuacuacugcgggggccugaaagacgugcgggaggucaagggccucaccaagggcggcccgggccacgaggaacccauaccuauguccacguacggcuggaaccuggugcgccugcagagcggggucgacgucuucuucacuccgcccgaaaagugcgacacucuccucugcgacaucggcgaaagcagccccaaccccacaauagaggcugggcggacccugcgcguacucucauuaguugagaacuggcuuaauaacgacacccaguucugcaucaagguccucaaccccuacaugccauccguaaucgagaagauggaaacccuacagcggaaauacggaggcgcucuggugcgcaacccccugagccguaacucaacccacgaaauguacugggucucuaacgccacggggaacaucgugagcagcgugaauaugaucucgcgcaugcucauaaaccgguucacuaugaagcacaagaaggccaccuaugagcccgacguggacuuaggcagcgggacucgcaacaucggcauagaguccgaaauucccaacuuagacaucaucggcaagcgcaucgagaagauuaaacaggagcaugagacgucguggcacuaugaccaggaucacccuuacaaaaccugggcauaccacggauccuacgagaccaagcaaaccgguagcgcguccagcauggugaacgguguaguccgucuccugacgaagccaugggacguggugccuauggucacccagauggccaugacugacacaacgccuuucggccagcagcgaguguucaaggagaagguugacacgcggacacaggagcccaaggagggcaccaagaagcugaugaagaucacggccgaguggcucuggaaggaacuggggaagaagaagaccccgcggaugugcacccgggaggaauuuacccgcaagguucggucaaacgcugcccugggcgcgaucuucacggacgagaacaaauggaaguccgcccgcgaggccguggaggacuccagauucuggaaauuagucgacaaggaaagaaaccugcaccuggaagggaagugcgagaccugcgucuacaacaugaugggcaaacgggagaagaagcuaggggaguucggcaaggccaaagguucucgggcgaucugguacauguggcugggggcccgcuuccuggaguucgaagcacucggguuccugaacgaggaccacugguucuccagggagaacucgcuuagcggcguugagggcgaggggcuccacaagcugggcuacauccugagagaugucuccaagaaagaggguggggcgauguacgccgaugacaccgcgggcugggauacccgcaucacguuagaagaccugaagaacgaggagauggucaccaaccacauggagggggagcacaagaaacuggccgaggccauuuucaagcucaccuaccagaacaaaguggugcgggugcagcgccccaccccacgggggaccgucauggacaucaucucgcgucgagaucaacguggguccggccaagucggcacuuacgggcugaacaccuucacuaacauggaagcacagcugauacgacagauggagggcgaggggguuuucaagagcauccagcggcucacugugacggaggagauugcaguccagaacuggcuggcgcgcgugggucgggagcgucucuccagaauggccaucuccggagacgacugcguugugaagccccucgacgaccgcuuugcauccgcccugaccgcgcugaaugacauggggaaggugagaaaggacauccaacagugggagccaagcaggggcuggaacgauuggacccaggugcccuucuguucccaccacuuccacgagcucauaaugaaggacggacggguccugguggugcccugcaggaaccaagacgaguugauaggccgggcgaggaucagccagggggccggcuggucacucaaagagacugccugccugggaaagagcuacgcccaaauguggagccucauguacuuccaccggcgcgaccuccggcuggccgcgaaugccaucuguagcgcaguccccucccauugggugccgaccucccgcaccaccuggaguauccacgccaagcaugaauggaugaccacggaggacaugcuaaccgucuggaaccggguguggauccaagagaaucccuggauggaagacaagaccccgguggagaguugggaagaagugcccuacuuaggaaagagagaagaccagugguguggcagcuugauagggcuaaccuccagagccacgugggccaagaauauucagaccgccaucaaccaggugcgcagccucaucggcaacgaggaguacacugacuacaugccgagcaugaagcgcuucaggcgcgaggaagaagaagccggagugcugugguga

SEQ ID NO: 25400 - RNA, 9876 nt, Artificial Sequence
  derived and/or modified CDS sequence (opt11) from DENV-2__EU482782__SS-prME
agcgcggggaugaucaucaugcugauccccaccguaauggcuuuccaccucacaacaagaaacggcgagccccauaugaucguggggauccaggagaagggcaagucccugcuguucaagaccgaggaugggguaaacaugugcacucugauggcgauggaccugggcgagcugugcgaggacaccaucaccuacaaaugcccccuccugcggcagaacgagccugaggacauagacugcuggugcaacagcacuuccaccugggugaccuacgggacuugcacgaccaccggagagcaccggcgggagaagcgcagcguagcccuggugccgcacguggggaugggccucgagacccggacggaaaccuggauguccagcgagggggcuuggaagcacgcccagagaauagagacguggauccugcggcacccuggauucacgaucauggccgccaucuuagccuacaccaucgggacgacccauuuccagcgcguucugaucuucauccuacugaccgccguggcuccguccaugaccaugcggugcaucggcauaagcaaccgcgacuucguggagggcgucagcgggggcagcuggguggacaucgugcucgagcauggauccugcgucacuaccauggcuaagaauaagcccacacucgacuucgaacugaucaaaacugaggcuaagcagcccgcgacccuccggaaguauugcaucgaggcaaagcuaacgaacacgaccaccgagagccguugccccacacagggcgagcccucccugaaggaggagcaggacaaacgcuuugugugcaagcacucaaugguggaccgcggcugggggaacgguugcggccuuuucgggaagggcgggaucgucacgugugccauguucacgugcaagaagaacauggagggcaagaucgugcagccagaaaaccuggaguacaccaucguaguaacaccccacuccggggaggagcacgcggugggcaacgauacugggaaacauggcaaagagaucaaggugaccccgcaaagcuccaucaccgaggccgagcugaccggguacgguaccgucacgauggaaugcagcccgcggacaggccucgauuucaacgagauggucuugcugcagauggaaaacaaggccuggcucgugcaccgccagugguuuuuggaccugccccuccccuggcuaccgggggcugacaagcaagagucuaacuggauccaaaaggagacccugguuaccuuuaagaacccccaugcuaagaagcaggacguggucgugcucggcagccaagagggggcgaugcacacagcccugaccggcgccaccgaaauccagaugagcuccgggaaccuccuguuuaccggccaccugaaaugccggcugcgcauggacaagcuccagcucaagggcaugucguacuccaugugcacggggaaguucaagguugucaaggagaucgcugagacccaacacggcaccaucguuauccgugugcaguacgaaggggacggcucccccugcaagauccccuucgagaucauggaccuggaaaagcgcuacguccucggccggcugaucaccgugaauccaaucgugacggagaaggacuccccugucaacaucgaggccgagccacccuucggggacagcuacaucaucaucggaguggagccgggccagcugaaguugaacugguucaagaagggguccagcauagggcagauguucgagaccaccaugaggggcgcgaagcgcauggccauccugggcgauaccgccugggacuuugggucccugggcgggguguuuacgaguaucggcaaggcccuccaccagguguucggggccaucuacggugcggccuucuccggcgugagcuggaccaugaaaauccugauuggugugauaauaaccuggaucggcaugaacuccagaagcaccagucugagcgucucccuggugcucgucgggauuguaacguuauaccugggcgugauggugcaggccgauagcgggugcgucgugucuuggaagaacaaggaguugaagugcgguucugggaucuuuaucaccgacaacgugcacaccuggaccgagcaguacaaguuccagcccgagagcccgucaaagcuggccucugcgauccagaaggcccaggaggaagguaucugcggcauccgcuccgucacgcggcuagagaaccucauguggaaacaaaucacccccgagcugaaccacauccuggccgagaacgaggugaagcugaccauuaugaccggggacauccgcggcaucaugcaggccgggaagcggucauugcgcccccagcccacggagcugaaguauucguggaagacuuggggcaaggccaagaugcucagcacugagagcuacaaccagaccuuccugaucgauggcccggagacugcggagugcccgaacaccaaucgggccuggaacagccuggagguggaagacuacggguucggcgucuuuaccacgaacaucuggcuaaagcugaaggagaaacaggacgccuucugcgacuccaagcugaugagcgcagccaucaaggauaaccgcgcggugcacgccgacauggguuacuggauugaguccgcucucaacgauacguggaagaucgagaaagccucuuucaucgagguuaagaauugccauuggcccaagucccacaccuuguggagcaacggcguccuggaguccgagaugaucauccccaagaacuuagccggucccgugagucagcauaacuaccgcccggguuaccauacucagauugcgggucccuggcaccuggggaagcuggagauggacuuugacuucugcgaugguaccaccguaaucgucacggaggacugcgggaaccgcggccccucccuccggacaaccaccgccagcgguaagcugaucaccgagugguguugucgcagcugcacucugcccccgcuucgguaccgcggcgaagacggcugcugguaugggauggagauccggccucugaaggagaaggaggagaacuuggugaacucccucgucacugccggccacgggcaggucgacaacuuuagccugggcguucuuggcauggcccucuuccuggaggagaugcuacgcaccaggguggggacgaagcacgcuauacuccugguagccgugucauucgugacccuaaucaccggcaacaugagcuucaaagaccuugggcgcgucguagugauggucggcgcaaccauggccgacgacaucgggaugggcgugacguaccuggcccugcucgcagcauucaaggugcggcccaccuucgucgcaggccuacugcuccgcaaacugacuuccaaagagcugaugaugaccacgauagggaucguccuccuaagccaguccaccauaccggagaccguacuggaauuaaccgacgcucuggcccucgggaugaugguccucaagauagugcgcaacauggagaaguaccagcuggcagucacgaucauggccaucuuaugcgugccgaaugccgugauccuccagaacgcuuggaagguaagcugcaccauacuggccguggucucugucuccccccugcuauugaccuccagccagcagaagaccgacuggauaccucuggcgcucacgaucaaggggcugaaucccacagccaucuuccugacgacccucuccagaacgaacaagaagcgcagcuggccgcugaacgaggcgauaauggcugugggcaugguguccauccuggcgagcucccuccuuaagaacgauaucccaaugaccggaccccuggucgcgggagggcuccugaccgugugcuaugugcugaccgggcggagcgccgaucucgagcuggagcgcgccacggacgucaagugggaggaccaagccgagaucuccggcagcagcccuauccugucgauuacgauaagcgaggacggguccaugagcaucaagaacgaagaggaggagcagaccuuaacgauccugauccggacgggccuauuggugaucaguggccuguucccgaucagcauccccaucaccgcggccgcaugguaccugugggagguuaaaaaacagcgcgccgggguccucugggacgugccgagcccgccgcccaugggcaaagccgaguuggaggacggugccuaccgcauaaagcagaagggcauccugggauacagccagaucggcgcgggcguguacaaggaggggaccuuccacaccauguggcauguuacacgcggcgccgucuugaugcacaaggggaagcgaauagagcccucaugggccgacgugaagaaggaucugaucagcuacggcgggggcuggaagcuggagggcgaguggaaagagggggaggagguccagguacuggcccuggagcccggaaagaacccccgagccgugcagacgaagccugggcuguucaagacaaacacgggcaccaucggggccguaucccucgacuucagcccuggcacgagugguucgcccauaaucgauaaaaaggggaagguggugggucucuacgggaacggugucgucacccgguccggagccuacgucagcgccaucgcccagaccgagaaguccaucgaggacaaccccgagaucgaggacgacauuuuccgcaaacggcggcugaccaucauggaucugcaccccggggcgggcaagacuaagcgguaccucccagcgaucguccgcgaggccaucaagcggggacugcgcacccugauauuggccccaacccgggugguggcggccgagauggaagaggcccugcgcggccugcccauccgguaucagacccccgccauccgcgccgagcacacggggcgggagaucgucgaccucaugugccacgccacguuuacuaugcggcugcucagcccagugcgcguuccgaacuacaaccucauaaucauggacgaggcccacuuuacagaccccgccuccaucgcggcccggggauacaucucuacgcgcgucgagaugggcgaggcggccgggauauucaugaccgcaaccccgcccggcagccgggacccguucccccaguccaacgcccccaucaucgacgaggagcgagaaauccccgagcgguccuggaacuccgggcacgagugggugaccgacuucaagggcaagacggugugguucgucccgagcaucaaagcuggaaacgacaucgcggccugucuccguaaaaaugguaagaaggugauccaacugucccggaagaccuucgacagcgaguacgugaagacucgcaccaacgacugggacuuuguagugacuaccgacaucuccgagaugggagccaacuucaaggccgaacgggugaucgacccccguaggugcaugaagcccgucauccucacugauggggaggaacgcgugauccuggcgggccccaugccugugacccacagcucggcagcccagcggcgcgggcggauaggccgcaacccaaagaacgaaaaugaccaguacaucuacaugggggaaccccuggagaacgacgaggacugugcccacuggaaggaggccaagaugcuccucgacaacaucaacacgcccgagggcaucaucccgagcauguucgagccagagcgggaaaaggucgaugccauagacggugaguaucgccugcgaggugaggcccggaaaaccuuuguagaccucaugcgccggggugaccugcccguguggcuggcuuacaaggucgccgcagaggggaucaacuacgcugaccgccgguggugcuucgacgguaucaagaacaaucagauccuagaggagaacguggagguagaaaucuggaccaaggagggggaacgcaagaaguugaagccgagguggcuugacgcccgcaucuacuccgacccccucgcucugaaggaguucaaggaguucgcugcuggccggaagucccuuacuuugaaucucauuacggagaugggccgucuccccaccuucaugacccagaagacccgggaugcguuagacaaccuggccgugcugcacacggccgaggccgggggccgcgcguacaaucaugcccucuccgagcuacccgagacccuggagacccuccugcugcucacucuacuggcgaccgugaccgggggcaucuuccucuucuuaaugagcggccggggcauuggaaagaugacccuggggaugugcugcaucaucaccgccaguauccuccugugguacgcccagauccaaccgcacuggaucgcggccagcaucaucuuggaguucuuccucauuguccugcugauccccgagcccgaaaagcagcgcacgccccaggacaaccagcucacguacgugguuaucgccauacugaccgucguggcugcaaccauggccaacgagaugggcuucuuggagaagacuaagaaggaccucgggcugggcucaaucgccacgcagcagccggagucuaacauacuggacaucgaccuucggcccgccucggccuggacccuguacgccguggcaaccacuuucgugacgcccaugcugcgccacagcauagagaacuccuccgugaacguuagccucaccgcuaucgccaaccaggccacaguucugaugggacuggggaaaggcuggccccucuccaagauggacaucggggugccguugcuggcaauuggcugcuacagccaggugaaccccaucacccuuacagcggcccugcugcuccuggucgcccacuacgcaaucaucgggccgggcuuacaggcgaaggccacccgggaggcccaaaagcgcgccgccgcgggcauaaugaaaaaccccaccguggacgggaucaccgugauugaucucgauccgaucccuuacgaccccaaauuugagaaacaacugggccagguaaugcugcucauccugugcguaacgcaggugcugaugaugcguacaaccugggcacucugcgaggcccugacccuggccacggggcccaucuccacgcucugggagggcaacccggggcgcuucuggaacacaaccaucgccguaagcauggcgaauaucuuccggggcucauaucuggccggcgcgggguugcucuucagcauuaugaaaaauacaaccaacacccgccgcgggaccgggaacaucggagaaacgcugggcgagaaguggaagucgcgacuaaacgcccucgggaagagcgaguuccagaucuacaagaaaucaggaauccaggagguggacagaaccuuagcaaaggaggggaucaagcgcggugagaccgaucaccacgcagugagccgcggguccgccaagcugcggugguuugucgagagaaacauggugacucccgagggcaaggugguggaucucggcugcggacggggcggguggagcuacuacugcggcggccugaagaacgugcgcgaggucaagggccugacgaagggcgggcccggccacgaggagccuaucccgauguccaccuacggguggaaccucgugcggcugcagagcgguguggacguguucuucaucccaccagagaaaugugacacccugcucugcgacaucggggaguccuccccgaaccccacggucgaggccggacgaacgcugagagugcugaacuugguggagaauugguuaaacaacaacacccaauucugcauaaaagucuuaaaccccuacaugcccucggugaucgagaagauggaagcccugcagagaaaguacggcggggcgcucgugcggaaucccuugagccgcaauagcacccacgaaauguacuggguguccaacgccuccgggaacaucguauccagcgugaacaugaucucccggaugcugauaaaccgcuucaccaugcggcacaagaaggcaaccuacgagcccgacgucgaccuugguagcggcacgcgcaacaucgggaucgagucugaaauccccaaccuggauauuaucggcaaacggaucgagaagaucaagcaagagcacgagaccagcuggcauuacgaccaggaucaccccuacaagaccugggccuaucacggcuccuacgagaccaagcagacgggaagcgccuccagcauggugaacggcgugguccggcuacugaccaagccgugggacgugcugcccaccgugacgcagauggcgaugacagauaccacccccuucgggcagcagcgcgucuucaaagagaagguggauaccagaacgcaagagccuaaggagggcaccaagaaacucaugaaaaucaccgcggaguggcucuggaaggaacugggcaagaagaagaccccgaggaugugcacgcgggaggaguucacgcguaaggugcgguccaacgcagcccugggggccaucuucaccgacgagaacaaguggaaguccgcgcgugaggccgucgaggacucccgguuuugggagcugguugacaaggaaaggaaccugcaccuggaggggaagugcgagacaugcgucuacaauaugauggggaagagggaaaagaagcucggugaguucgggaaagcaaagggcagccgggccaucugguacauguggcugggcgcccgguuccuggaguucgaggcgcucggauuccuaaacgaagaccauugguucagccgcgagaacagccuguccggcguggagggggagggccuccauaagcucggguauaucuuacgggacguuagcaagaaggagggcggcgccauguacgccgaugauacagccggcugggauacccgcauuacccucgaggaccuuaagaacgaggagauggucaccaaccacauggagggcgagcacaagaagcuggcugaggccaucuucaagcucacguaccagaacaaagugguacggguucaacgccccacaccccgggggaccgugauggauaucaucagccgccgggaccagcgcggcuccggccagguuggaacuuacggucugaacacguucacaaauauggaggcccagcugauccggcagauggaaggggagggcguauucaaaaacauccagcaccucacugugaccgaggagguggccguacauaauuggcuggcgcgcguggggcgcgagcgguuaagccgcauggcgaucuccggcgacgacugcguggucaaaccccucgacgacagauucgcuaacgccuugaccgcccugaacgauaugggcaagauccgcaaggacauccagcagugggagcccucgaagggguggaacgacuggacccaggugcccuucuguucccaccacuuccacgagcucaucaugaaggacggccggguucugguugugcccugccgcaaccaggacgagcugaucgggcgggcgcggaucagccagggagcgggguggucccuccgggagacggcgugccugggcaagucuuacgcucagauguggucccugauguacuuucaucgccgggaccucagguuagccgccaacgccaucugcuccgcaguccccucccauugggucccgacuagccggaccaccuggagcauccacgcuaagcacgaauggaugaccaccgaagauauguuaaccguguggaaccgcguuuggaucagggagaaccccuggauggaggacaagacacccgucgagagcugggaggagauccccuaccucgggaagcgcgaggaccaguggugcgggagucugauaggccugaccagccgggccacgugggccaagaacauccaggcggcaaucaaccagguucgcucccuuaucgggaaugaggaguacaccgacuacaugccgucuaugaagcgguuccgccgcgaggaagaagaggccggcgugcugugguaa

SEQ ID NO: 25401 - RNA, 9876 nt, Artificial Sequence
  derived and/or modified CDS sequence (opt11) from DENV-2__EU482783__SS-prME
accgccgguguaauuauaaugcugauccccaccgccauggcguuccaucucacgacucggaauggugaaccccacaugaucguugggcggcaggaaaagggaaaaagccugcuauucaagacugaagacggcgugaacauguguacccucauggccaucgaucugggagagcucugcgaagacacgaucaccuacaaaugucccuuacugcgacaaaacgaacccgaggauaucgauugcuggugcaacucuacgagcaccugggugaccuacggaacgugcaccaccacgggcgaacaccggcgcgaaaagcguuccguagcgcugguaccccacguggguaugggccucgagacccgcaccgagacuuggauguccuccgaaggcgcguggaagcacgcccagcgaaucgaaaccuggauacugcgccacccggguuuuaccauaauggcagcuauccuugccuauaccgucgggacaacccacuuccagcgggcccuuauuuuuauccugcuggcggccguggcgccaagcaugaccaugcgcugcaucggcaucuccaaccgggacuucgucgaagggguauccgggggaucguggguggacaucgugcuagagcacgguucgugcguuaccacgauggcuaagaacaagcccacguuggacuucgagcugaucaagaccgaggccaagcagcccgcgacgcuucgcaaguacugcaucgaggcuaaguuaaccaacaccaccaccgaaagucgcuguccuacccagggggagcccaguuugaacgaggaacaggacaagagguucguguguaagcacucuauggucgacaggggcugggggaacggcugcgggcuauucgggaagggcgggaucgucacgugcgccauguucacgugcaaaaagaacauggaaggaaagaucguacagccggagaaccuggaauacacuaucgugauuaccccccacucgggggaggagcacgccgucggcaaugacacugguaagcauggcaaagagauaaagauaaccccccagucccccaucaccgaagccgagcucacugguuacggcaccgugacgauggagugcagcccccguaccggacucgauuucaacgagaugguacugcuucagauggaggacaaggcguggcugguccacagacagugguucuuagaccugccgcuaccuugguuacccggggccgauacccagggguccaauuggauccagaaggagacccuggugaccuucaagaauccccacgccaagaagcaggauguggucgugcucgguagucaggagggcgccaugcacaccgcacugacgggggcgaccgagauccagauguccagcggcaaccuccucuucacgggccaucucaagugccgccugcggauggacaaacuucaacugaaggggaugucauacuccaugugcaccggcaaguucaagaucgucaaggagauugccgagacccagcaugggaccaucgugauccgugugcaguaugagggcgacgggucgcccuguaagauaccguuugaaaucauggaccuggagaaacgacacguccuggggcgccugauaacggugaaccccaucgugaccgaaaaggacucacccguaaauauagaggccgagccuccuuuuggggacucauacaucaucauugggguggagcccggacaacugaaacucaacugguuuaagaaaggcaguaguauagggcaaauguucgagaccacaaugcgcggcgcaaagcggauggccauacugggggacacggcgugggacuucggcucccucgggggaguguucacuagcauagggaaggcccuccaccaggucuucggggccaucuacggcgccgcguucuccggggugagcuggaccaugaagauacugaucggcgugaucaucacguggaucgggaugaacucgcgcagcacuucauugucugucagccucguacuagugggcguaaucacccuuuaccugggggcaaugguacaagccgacaguggcugcguggucucguggaagaacaaggagcucaaguguggaagugguauauucaucacggauaacguacacaccuggacggaacaguacaaguuccagccggagucccccucuaagcuggccuccgccauacagaaggcgcaugaggaagguaucugcgggauucgguccgugacacgacuggagaaccucauguggaaacagauuacaccagagcugaaccauauccugucggagaacgaggucaaacucacgaucaugacaggcgggauuaaggggaucaugcaggcaggcaaacggagucugagaccacaacccaccgagcugaaguacagcuggaagaccugggggaaggccaagaugcuuuccaccgagagccacaaccagacguuccugauugacggccccgagacggcagagugccccaauaccaaccgggccuggaauucccuggagguggaggacuacggguucggcguguucaccaccaacaucuggcuaaagcuacgggagaagcaggacgucuucugcgacucuaaacuaaugucggcagccaucaaggacaaucgugccgugcacgcagauauggguuacuggaucgagagugcgcugaacgacacuuggaagauggaaaaggcaaguuucaucgaggucaaaagcugccacuggccgaagucccauaccuuauggagcaacggcgugcucgagucagagaugaucauccccaagagcuucgccggaccggucagccagcacaacuaccgcccgggauacuacacccaaacagccggcccauggcaucuugggaagcuggagauggacuucgacuucugcgagggcacgaccguugucgugacagaggacugcggcaaucgggggcccagccugcgcaccacgaccgcauccggcaagcucaucaccgaaugguguugccgguccugcacuuuaccgccccugcgcuaccggggggaagacggcugcugguacgguauggagauucguccacucaaagagaaggaggagaacuuagugaacagccuggucacggcuggccacggccagaucgacaauuuuucccucgggguccuggguauggcccuguuccucgaggagaugcuccggacuaggguugggaccaagcacgccauccuacuaguaaccgugucguucgucacucugaucaccggcaacauguccuuccgggaccuggggcgcgucauggucauggugggcgccgccaugacggacgacaucggcaugggcgugaccuaccuugcgcugcuggccgcauucaaagugcgcccgacguucgccgccggcuugcuccugcggaaacucaccucuaaagaacugaugauggcgaccaucgggaucgcgcugcucucccagucuacaaucccggagacgauacuggagcucaccgacgcucucgcacuggguaugauggugcugaagaucguacgcaauauggagaaauaccaacucgccguuaccaucauggcgauuucuugcgugccaaaugccgucauacugcaaaaugccuggaaaguuucuugcaccauccuggcugcggucaguguaaguccccuccugcugaccuccagccagcagaaggccgacuggauuccccuagcucugaccaucaagggccuaaacccgaccgcuaucuuucucacaacgcugucucggaccagcaagaagaggucauggccccugaacgaagccaucauggcuguggggauggucuccauccucgccucgagccugcugaaaaacgacauucccaugaccggcccccucguggccgggggauuauuaaccgugugcuacguccugacggggcggagcgccgaccuagaguuagagcgggccacggacgugaagugggaggaccaggcagagauaucuggcucuucaccgauccuguccaucacuaucgcggaagacggaagcaugagcauaaagaacgaggaggaggagcagacccugacgauucugauucggacuggccuucucgucaucuccggccuguuccccgucucaauccccaucaccgcagccgccugguacuuaugggaggugaagaagcaacgagcgggggugcugugggacguccccaguccgccaccugugggcaaggccgagcuagaggacggcgccuaccggaucaagcagaagggcaucuugggguauucucagaucggggcaggcguguacaaggaagggacauuucacaccauguggcacgugacgcguggcgcugugcugaugcaccgaggaaagcgcaucgagccguccugggcggacgugaagaaggaccugaucuccuacgguggcggguggaaacucgaaggcgaguggaaggagggugaggagguccagguauuagcgcuugagcccggcaagaacccccgggccguucagacaaagcccggccucuucaagaccaauaccggcacgaucggcgccgucagucuggacuuuuccccggggaccuccggcagccccaucguugaccgcaaggguaagguggucggauuguacggcaaugggguggugaccaggucgggcgcguacgucagcgcuauugcacagaccgaaaaguccaucgaggacaaccccgagauugaggacgacauauucagaaagaagaggcuuacgaucauggaccuacacccgggggcuggcaagaccaagcgguaccugccagccaucguacgggaggccaucaagcgcgggcuucggacccucauacuagcccccacccgcguggucgccgcagagauggaggaggcccugcgcggccucccaauccgguaccaaacucccgccauccgcgccgagcacaccggccgggagauuguggaccuuaugugccaugccaccuucacaaugcgccuuuuaagcccgguucggguccccaacuacaaccucauuaucauggaugaagcccacuucacggaccccgccagcaucgcggcccgcggcuacauauccacgcgcguagagaugggcgaagccgccgggauuuucaugaccgccacgccgccugggagccgcgaccccuucccccagagcaacgcacccaucauggacgaggagcgggagauucccgagagaagcuggaauuccgggcacgagugggugacggacuuuaaggguaagaccgucugguucguacccagcaucaaggccggcaacgacaucgcggccugccugcgcaagaacgggaagaaggugauacagcucucccgcaagacauucgauagcgaguacguaaagacuaggacaaacgacugggacuucguggugacuacggacaucuccgagaugggggcgaacuuuaaggcagagcgggucaucgacccccgccgcuguaugaagcccgugauucuuaccgacggugaggagcgggugauccuugcaggcccgaugcccgucacgcacagcucggccgcucagcgccgggggcgcaucggacggaaucccaaaaacgagaacgaucaguacaucuauaugggcgagccccucgagaacgacgaagacugcgcacacuggaaggaggccaaaaugcuguuagacaacaucaauacaccagaggggaucauccccagcauguuugagcccgagcgggaaaagguugaugccaucgacggggaguaucgacucaggggagaggcccgcaaaaccuucguggaccuuaugcggcgcggagaccugccggucugguuagccuaccgaguggccgcagaggggaucaacuaugccgaucgccgguggugcuucgacggcgugaagaacaaucagauccuugaggagaacgucgagguggagaucuggaccaaggagggagagcgcaagaagcuuaagcccagguggcucgacgcccgcaucuacuccgacccccuggcccuuaaggaguucaaagaguuugcggcgggcagaaaaucucucacacugaaccugaucaccgaaaugggucgccuccccaccuucaugacccagaaggcccgugaugcccuggauaacuuagcgguacugcacacugcagaggcugggggacgcgcuuauaaucacgcacucuccgagcugccggagacccucgagacucugcugcuccugacgcuguuagccacgguaacuggcgggaucuuucuguuccugauguccggaaagggggucggcaagaugacccucggaaugugcugcaucaucaccgccucgauacugcugugguacgcccagauccagccccauuggaucgcagccagcauaauccucgaguucuuccuaauaguucuacucauccccgaacccgaaaagcagcguacaccgcaggacaaccagcugacguacguggugaucgccauccugacagucguggccgcaacaauggcuaacgagaugggcuuccuagagaagaccaagaaggaccugggccugggcuccaucgcaacgcaagagcccgagagcaauauccuggacaucgaccugcgucccgcaagcgcguggacacuguaugccguggccacuaccuuuguuacgcccauguugcgccauaguaucgaaaauuccucugugaacgugagccugaccgcgaucgccaaccaggcuacgguacugaugggcuuagggaagggcuggccgcuguccaaaauggauaucgggguaccacuucuugcaaucggaugcuauagccaggugaaccccaucacgcugacggccgcgcuccuccugcuggucgcccacuacgccaucaucggccccggucuccaagcaaaggcgacccgcgaagcccagaaacgggccgccgccggcauuaugaagaauccgacaguggacggaauuacggucaucgaccuggaucccauaccguacgacccaaaguucgagaagcagcugggccagguaaugcuccuuauucugugcgugacccagguacucaugaugcgcaccaccugggcucuaugcgaggcgcugacgcucgccacggggccaaucucaacguuaugggagggcaacccuggccgcuucuggaacaccaccaucgccgucucuauggcaaacaucuuccgggguaguuaccuggcgggcgcugggcuacuauucagcauuaugaaaaacacaacgaacacccgccggggcacgggcaacaucggggagacacugggcgaaaaguggaaaucccgccucaacgcccugggcaagagcgaguuccagauuuacaagaaguccgguauacaggaaguggaccggacucuagcgaaggaggggauaaagcgcggcgagaccgaccaccacgccgucagccgugguuccgcgaagcuccgcugguucguagaacggaauauggucacccccgagggcaagguggucgaccuuggcugcggccgcggcggguggucuuacuacugcggaggccucaaggacgugcgggagguaaaggggcucaccaagggagggcccggccacgaggagccuauccccauguccaccuacggguggaaccugguccgccugcagagcggaguggacguguucuucacgccacccgagaagugcgacacccuccugugugauauuggggaguccagcccgaacccgacgaucgaagcugggcggacccugcgcguccucagcuuaguggagaacugguuaaacaacgacacucaguucugcaucaaggugcucaacccauacaugccguccgucauugagaagauggagacccugcagcggaaguacggcggggcacuggugcgcaacccacugagccggaacuccacccacgagauguauugggugagcaacgccacggguaauaucgucaguucagugaauaugaucucccgcaugcucaucaaccgguucaccaugaagcacaagaaggcgacauacgagcccgauguagaccugggcucaggcacgcgaaacaucggcaucgaaucagagauccccaaccuagacaucaucggcaaacgcauugagaagauaaagcaggagcacgagaccagcuggcacuacgaccaagaccacccauacaagaccugggcguaccacggguccuaugagacgaagcagaccgggucugcgagcucuauggugaacggugugguccggcuccugaccaagcccugggacgucgugcccauggugacccagauggcuaugaccgacaccacgcccuucggccagcagagagucuucaaggagaagguggacacccggacgcaagagccgaaggaggggacgaagaagcugaugaagaucacggcagaguggcuauggaaggagcugggcaaaaagaagacgccgcggaugugcacgcgggaggaauucacccgaaaaguccgguccaacgcagcgcugggggcgaucuucacggacgagaacaaguggaaauccgcacgcgaggccgucgaggacucucgguucugggaauuggucgacaaggaacgcaaccugcacuuggagggaaagugcgaaacaugcguguacaacaugauggggaaacgggagaagaaacucggggaguucggcaaagcgaaggggucuagagccauaugguacauguggcugggcgcgagguuccuggaguucgaggcccuuggguuucugaacgaggaccacugguucucccgcgagaauucccugagcggaguggagggggagggucuccacaagcuaggcuacauacugcgggacguuaguaagaaggagggcggggccauguacgcggaugauaccgccggaugggacacccgcaucacgcuggaggaccugaagaacgaggagauggucaccaaccacauggaaggcgagcacaaaaagcuggccgaggccaucuuuaagcucaccuaccagaacaagguggugaggguccaacgucccacgcccagggggacggucauggauauaaucucccgccgggaccagaggggauccggccagguugggacuuacggccugaacaccuucaccaacauggaggcccaacugauccggcagauggagggggagggcgucuucaaaagcauucaacggcucacugucaccgaagagauagcggugcaaaacuggcuagcccgcgucggccgagagagguuaucccggauggccauuagcggggaugacugcguggugaagccgcucgacgaccgcuucgccuccgcccuaacugcccugaacgacaugggcaagguucggaaggacauccagcagugggagccuagccgcgguuggaaugacuggacgcaaguccccuucugcucgcaccacuuccacgagcucauaaugaaggacggacgggugcuggucgugccaugucgcaaccaggacgagcugaucggccgggcucgcaucagccagggcgccggcuggucccucaaggaaacggcuuguuugggcaagagcuacgcccagauguggagccuaauguauuuccaucggcgcgaccuccggcucgcugcgaacgccauuuguagcgcagugccgucgcacuggguaccaaccagccgcacgaccugguccauacacgcgaagcaugaguggaugaccacggaagauauguugacuguguggaaccggguguggauccaggagaaccccuggauggaagacaagaccccugucgagagcugggaggagguaccguaccucggcaaacgagaggaccaauggugcgguagccugaucggccugacuucucgcgcgacgugggcgaagaacauccagaccgccaucaaccaggugcgcucgcucauuggaaacgaggaguauaccgacuacaugcccucuaugaaaagauuucggagggaggaggaagaggccggcgucuuaugguaa

SEQ ID NO: 25402 - RNA, 9876 nt, Artificial Sequence
  derived and/or modified CDS sequence (opt11) from DENV-2__EU482784__SS-prME
agcgcggggaugaucauuaugcuaauccccaccgugauggccuuccaucucaccaccagaaacggggagccccacaugaucgucggcauccaggagaaagguaagagccuauuguucaaaaccgaggauggggugaacaugugcacacucauggcgauggaccugggcgagcuuugugaggacaccaucaccuacaaguguccguugcugcggcaaaaugagcccgaggacaucgauuguuggugcaacagcaccuccaccugggugaccuacgggacaugcacaaccaccggcgagcaccgccgggagaagcggagcgucgcucuggucccacauguggggauggggcucgaaacccggaccgaaaccuggaugucuucagaaggggcuuggaagcaugcccagcgcauagagaccuggauccuccgacacccggguuucacuauaauggccgccauccucgccuacaccaucgggaccacccacuuccagcgcguccucaucuucauccugcugacggccguggcuccuuccaugacuaugcggugcaucggcauauccaaccgcgauuuuguagagggcguguccgggggcagcuggguggacauagugcucgagcaugggucuugugucaccaccauggcgaaaaacaagccgacguuggacuucgagcugaucaagaccgaggcuaagcagcccgccacgcuccgaaaguacugcaucgaagccaagcugaccaacacgaccaccgagagccgcugucccacucagggcgagccuucccugaaagaggaacaggacaagcgauuugugugcaagcacagcaugguggaccgugguugggggaacggcugcggccuguucggcaagggugggaucgucaccugugcaauguuuacauguaagaaaaacauggagggcaagaucgugcagccggagaaccuggaguacacgaucgugguaacgccccacuccggggaggagcacgccgugggaaacgauacggggaagcacggcaaggaaaucaaggugacgccgcagagcuccaucacggaagccgagcugacaggcuacggcacggucacuauggagugcagccccaggaccggccucgacuucaacgaaaugguucugcugcaaauggagaacaaggccuggcucgugcaccggcaaugguuccuagaccugccacuccccuggcugccuggggcggauaagcaggaguccaacuggauccagaaggagacucugguaaccuucaagaacccacacgccaaaaaacaagacgugguggugcugggaucccaggagggagcgaugcacacugcucugaccggcgccacggagauacaaaugagcuccggaaacuugcucuucaccgggcaccugaagugccggcugcgcauggacaagcuccaacugaaagggaugagcuacuccauguguaccgggaaguuuaagguggucaaagagaucgcagagacccagcacggcaccauuguuauuagagugcaauacgagggggacggcagccccugcaagauccccuucgagauaauggaccuggagaagcgcuacguccucggccgacugaucaccgugaaccccauagugacggagaaggauagcccggucaacaucgaagccgaaccgcccuucggggacucguacaucaucaucgguguugagccgggccagcuaaagcucaacugguucaagaagggcuccucaauuggucagauguucgagaccaccaugagaggagcgaagcggauggccauccuuggcgauaccgccugggacuucgggagucugggcgggguguuuacgaguauaggcaaggcucuccaccaagucuucggggcgauuuacggcgcggccuucuccggcgucagcuggacgaugaagauccugaucggcgugauuauaaccuggauuggcaugaacagccgaagcaccucccugagcgucucccucguguugguggggaucguaacccuuuaccugggcgugauggugcaggccgacucggguugcguuguuuccuggaaaaacaaggagcucaaaugcggcagcgggaucuucaucaccgacaaugugcacacuuggaccgagcaguacaaguuucagcccgagagccccuccaaacuggcuuccgcaauccagaaggcccaggaggagggcaucugcggcauccgcuccguuacacgguuggagaaccucauguggaaacaaaucacccccgaauugaaccacauccuggccgagaacgaagugaaguuaaccaucaugaccggggacauccgcggcaucaugcaggccgggaagcggucccugcgcccccagcccacggagcucaaauacuccuggaaaaccuggggcaaagcgaaaaugcuaucuaccgaguccuacaaccagaccuuccugaucgacggaccagagacugcggagugccccaacaccaaccgggccuggaauagccuggagguugaagacuacggauuuggcgucuuuaccacgaacauuuggcucaaacuuaaggagaagcaggacguauuuugcgacuccaagcuaauguccgcugccaucaaagacucacgagccguucaugcagacaugggguacuggauagagagcgcccucaacgauacguggaagaucgagaaggccuccuucaucgaggucaagagcugccacuggccgaagucccauacccuguggagcaauggaguucuggagagugagaugaucauccccaagaacuucgccggcccuguuucucagcacaacuaucggccggguuaccacacucagacggccggccccuggcacuugggucgccucgagauggacuucgacuucugcgaggguacaacggucguagugaccgaggacugugguaaccgggggcccucccugcgcaccaccaccgcguccgguaaguuaaucaccgaguggugcugucggagcuguacccugcccccgcuucgguaccgcggggaggacggcugcugguaugggauggagauccgcccccucaaggaaaaggaggaaaaccugguuaacucccucgugaccgccggccacggccagauagacaacuucagccucggcgugcugggcauggcccuguuccucgaggagaugcuucgaacgcgcauugguaccaaacacgccauacuucucgucgcuguuuccuucgugacucugauaaccggcaacaugagcuuccgggaccuggggcgugucauggugauggugggcgccacgaugaccgacgauaucgggaugggcgucaccuaccucgcccugcuggccgccuucaaaguacgccccacguucgcggccggccugcugcuacggaagcugaccagcaaagaauugaugaugaccaccaucgggaucguucugcucucccaauccaccauccccgaaaccguccucgagcugaccgacgcccuagcgcugggcaugauggucuugaagaucgugcguaacauggaaaaguaccaauuagccgucaccaucauggcgauccucugcgugccgaacgccgucauccugcagaacgccuggaaggugagcuguaccauccuggccguagucuccgugagccccuuacuacucacgagcagccagcagaagaccgacuggauuccccuugcucugacuauaaaggggcucaacccaaccgcgaucuuccugacuacacuguccagaaccaacaagaagcgcagcuggccguugaacgaggcuauaauggccguggguaugguguccaucuuggcaagcucgcugcucaaaaaugacauccccaugaccggcccccugguggccggcggucuccucacggugugcuaugugcuaaccgggcggagcgccgaccuggagcucgaacgcgcuaccgacgugaagugggaggaccaggcagagaucagcgggucuucgcccauacuguccaucaccauaagcgaggacggcuccauguccauaaagaacgaggaggaagagcagacgcugaccauucucauccggacuggauugcugguuaucucaggccuauuuccgauuagcauacccaucacugccgcggccugguaucucugggaggucaagaagcagagggcggggguucugugggacgugcccagcccccccccaaugggcaaggccgagcucgaggauggggccuaucgcauuaagcagaagggcaucuuaggguacucucaaaucggcgcgggagucuauaaggaggggacuuuccauaccauguggcaugugacccgcggugccguucugaugcacaaagggaagcggaucgagcccucaugggcagaugucaagaaggaccugaucagcuacggggggggcuggaaacuggagggcgaguggaaggagggggaagagguccaggugcuggcgcucgaacccggcaaaaacccacgcgcgguccagaccaagcccggacuguucaagacgaacaccggcaccaucggagcggugucccucgacuuuucgccgggcacuuccggcagccccaucaucgacaagaagggcaaggucgucggccucuaugggaacgggguggugacccgguccggggccuacgucuccgccauagcacagacugagaaguccaucgaggacaaccccgaaaucgaggaugauauuuucaggaagcggagauugaccaucauggaccugcaccccggggccggcaagacgaagcgcuaucugcccgccaucgugcgcgaggcuaucaagcgggggcuccggaccuugauacuggccccgacacggguggucgcugcggaaauggaggaggcuuugcgaggacugcccauccgcuaccagacucccgcaaucagagcggaacauaccgguagggagaucguggaucuaaugugccacgccaccuucacgaugcggcuccuuagccccgugcgcgugccgaacuauaaccugaucauuauggacgaagcacauuucaccgacccggcuaguaucgccgccagaggauauaucucgacccgaguggaaaugggcgaagcagcggggauauucaugaccgccacgccgcccgguucccgggacccguucccacaguccaaugcccccaucaucgaugaagagcgcgagauccccgagcggaguuggaacuccggccacgagugggucacugacuucaagggcaagacugugugguucguuccgagcaucaaggccggcaacgacaucgcagccugccuccgcaaaaacggaaagaaggugauccagcugucacggaagaccuucgacucugaguacguuaagacucgcacgaacgacugggacuucguggugaccaccgacaucuccgagaugggcgccaacuuuaaggcagagcgggucauugacccgcgccgcuguaugaagccggugauccuuaccgacggggaagagcgggugauccuagccgggcccaugccgguaacccauagcuccgcggcccagcggcggggacggauuggcaggaaccccaagaacgagaacgaccaguacauauacaugggagagccucuggaaaacgacgaagacugcgcccacuggaaggaggcgaagaugcugcucgacaacaucaauacccccgaaggcaucaucccgagcauguuugaacccgagcgugagaagguggacgccaucgacggcgaauaccggcuucgcggcgaggcgcgaaagacauucguggaccugaugcggcggggggaccugcccgucugguuggccuacaagguggcagccgaagggaucaacuacgccgaccgcagauggugcuucgacggaaucaagaauaaccagauccuggaggagaacguagaggucgagauauggacgaaggagggggagcgcaagaagcuaaaaccccggugguuggacgcucgcauuuacagugacccgcuggccuuaaaagaguucaaagaguucgcggccggccggaaauccuuaacccucaaccucaucaccgagaugggccgccugcccacguuuaugacgcagaaaacgcgggacgcucuggacaaccuugcgguacugcauaccgccgaggccgggggacgcgccuacaaccacgcacugagugagcuucccgagaccuuagagacgcugcuucugcugacccuccuggccaccgucaccgggggaaucuuccuguuccucaugucgggccggggaauagguaaaaugacccugggcaugugcugcauuaucacugccuccauccugcucugguaugcccagauucagccgcauuggaucgccgcgucgaucauccucgaguuuuuccugaucgugcuccugauuccagagcccgagaagcagcgcacgccgcaggacaaucaguuaacauacguggucauagccauuuugaccguuguggccgccacuauggcaaacgagaugggcuuccuggagaagaccaagaaggaccuggggcucggcucgauagcaacacaacagccggagucuaacauccuggacaucgaccugcgucccgccagcgcauggacucucuacgccgucgccacgacuuucgugacccccauguuaaggcacuccaucgaaaauucuuccguaaacgucagccugaccgcgauugccaaccaagccacggugcucaugggccuggggaagggauggccccugaguaagauggacauuggagugccgcugcuggcaaucggcuguuacagccaagugaacccgaucacccugacugccgcacuuuugcucuugguagcccacuacgccaucaucgggcccggccugcaggcgaaggcgacccgggaggcucagaagagagccgccgcaggcaucaugaaaaaccccacgguggacgguaucaccguaaucgaccuagacccgauccccuacgaccccaaguucgagaagcagcucgggcaggugaugcugcugauccucugugugacucagguacucaugaugcggaccacgugggcgcugugcgaagcccucacccuggcaaccgggccaaucuccacccugugggagggcaacccggggcgcuucuggaauacgaccaucgcugucagcauggccaauaucuuccgcggcaguuauuuggcgggcgccggguuacuauucagcaucaugaagaacaccaccaacacccggcgcggcaccgggaauaucggcgaaacccugggcgagaaguggaagucccgguuaaacgcccugggcaaaucggaauuccagaucuacaagaaaucaggcauacaggagguggaucgcacccuugccaaagagggaaucaaacggggcgagacggaccaucaugccgucagccgcggguccgcgaagcugcguugguucgucgagcgcaacauggugacuccggaaggcaaggucguggaccugggcugcgggcgcggcggguggagcuacuacuguggggggcucaagaacguccgcgaggucaaaggccucaccaagggcggcccaggccacgaagaaccgaucccgaugagcaccuacggguggaaccugguccgguugcagagcggcgucgacguguuuuucaucccgcccgagaaaugcgauacgcuauugugcgauaucggggagucaagcccuaacccgaccguggaggccgggcgcaccuuacggguguugaaccucgucgagaacugguuaaauaauaacacccaguucugcaucaagguccugaaccccuacaugcccagcguaaucgagaagauggaagcccuucagcgcaaguacggcggagcccugguccggaacccgcuuucccgcaauuccacccacgagauguacuggguguccaacgccagcgggaauaucgugucuagcgucaacaugauuucccguaugcucaucaaccgcuucacgaugaggcacaagaaggcuaccuacgagcccgacguagaccuggggucgggcacccgcaacaucggaaucgaguccgagauccccaauuuagacaucaucggcaagcgcauagagaaaaucaaacaggagcacgagacaagcuggcauuaugaccaggaccaccccuauaagacgugggccuaucauggcagcuacgagaccaagcaaaccgggagcgccuccagcauggugaacggcgucgugcgucugcuuaccaagccgugggacguacucccuacggucacccagauggccaugaccgacaccacgccguuugggcagcagcgcguguuuaaggagaagguagacacccggacucaagaacccaaggagggcaccaagaagcugaugaagaucacggcggaguggcuguggaaggagcucgguaagaagaaaaccccgcgcaugugcacucgagaagaguuuaccagaaagguccggaguaacgccgcccugggagccauauucacggacgagaacaaguggaaaucggcacgcgaggcgguugaggacucccgguuuugggagcuggucgauaaagagcgcaaccuccaucuggagggcaagugcgagaccugcgucuacaauaugaugggcaagcgugagaagaaacuuggggaguucgggaaggcaaagggcagccgcgcuauaugguauauguggcucggcgcccgguuccuggaguucgaggcccugggguuccucaacgaggaccacugguuuucaagagagaacagccuguccggugucgagggggagggacuacacaagcugggguacauacugcgggacgucucaaagaaggaaggcggcgccauguacgcggaugacaccgccgggugggauacccgcaucacgcuggaagaccucaagaaugaagagauggugaccaaccacauggaaggcgagcacaaaaagcuggcggaggcgauauucaagcugaccuaucagaacaaggucguacggguccagcgccccaccccccgggggacugugauggacaucauaagccggcgggaccagcgcggcuccggacagguaggcaccuacggcuugaacaccuucacgaauauggaggcccagcugauccgccagauggaaggggaaggcguguucaagaacauccagcaccugacggugaccgaggaggucgcggugcauaauuggcucgccagaguggggcgggagcggcugucacguauggccaucucuggcgacgacuguguugugaagcccuuggacgaccgguucgcgaacgcgcugaccgcccuuaacgacaugggaaagauccguaaggauauucagcagugggagcccaguaagggguggaaugauuggacccaggugcccuuuugcucccaccacuuccacgagcugauuaugaaagacggccggguccuaguggugcccugcagaaaccaggacgaacuaaucggucgagcccggaucagccagggcgcuggguggucccuccgggagacugcgugccucggcaaaagcuacgcucagauguggucccugauguauuuccaccgccgggaucugcgccucgccgccaacgcaaucugcucggcgguucccucgcacugggugccuacuagccggaccacgugguccauccacgcaaagcacgaguggaugacgacggaagacaugcuaaccguguggaaccgcgucuggauacgggagaaccccuggauggaggacaagaccccggucgagucaugggaggagauccccuaccugggaaagcgcgaagaucaauggugcgggucauuaaucgggcugaccagcagggcgacgugggcgaaaaacauucaagccgcgauuaaccaggugaggagcuugaucgggaacgaggaguauacagacuauaugcccagcaugaagcgcuuccggcgcgaggaagaggaagcugguguucuuugguga

SEQ ID NO: 25403 - RNA, 9876 nt, Artificial Sequence
  derived and/or modified CDS sequence (opt11) from DENV-2__EU482785__SS-prME
acugccggagugauuauaaugcugauucccaccgccauggcguuccaccucaccacccguaacggggagccacacaugauugucgggaggcaggaaaagggcaagagccugcuguucaaaaccgaggacggcguaaacaugugcaccuuaauggccauugaccugggggagcuuugcgaagacaccauaacguauaagugcccccuucuacgccagaacgagcccgaggacaucgacugcuggugcaacagcaccucuaccugggugaccuacgggaccuguaccacuacgggugagcaccggcgcgagaaacgcucuguggcccuugucccacauguggggaugggccucgagacccgcaccgagacuuggaugagcucagaaggggccuggaagcaugcccaacggauugagaccuggauccugcgacacccgggcuucaccauaauggccgccauccuggccuauaccgugggaaccacccacuuccaacgggcccucauauucauucugcuggcggccguggccccgucuaugaccaugcgcugcaucggcaucaguaaccgggacuuuguagagggcguuucggguggcuccuggguggacauugugcucgaacacgggucgugcguaacgaccauggcuaaaaauaagccgacccuggacuucgagcuuauaaagaccgaggcuaagcagcccgcgacacuccggaaguacugcaucgaggcuaaguuaaccaauaccacuaccgagucccgaugcccgacccaaggcgagcccucauuaaacgaagaacaggacaaacguuucgugugcaagcacuccaugguagauagggggugggggaacggcugcgggcuguucggaaaaggggggauaguuacgugcgccauguucacgugcaagaaaaacauggagggcaagaucgugcagcccgaaaaucuggaguauacaaucgugauuacuccccacagcggggaggagcacgcggucggaaaugauacggggaagcacggaaaggagauaaagauuacuccgcagagcccaaucaccgaggccgagcugaccggauacggcaccgugacgauggaaugcucgccccgcaccggccucgacuucaaugagaugguccugcugcagauggaagacaaggcgugguuaguccaccggcaaugguuccuggaccugccccuuccguggcuucccggggccgauacccagggcagcaacuggauccagaaggagacucucgugacguucaagaacccgcaugccaagaaacaggacguggucguccucgggagccaagagggcgccaugcacacggcccugaccggggcaaccgagauacagauguccucuggaaaucuccuguucacuggccaccugaagugccgccugcggauggauaagcuucagcugaaggggaugagcuacuccaugugcacgggaaaguucaagaucgucaaggagaucgcagagacccaacacgggacgauugugauucgcgugcaguacgagggcgacggaucgccuuguaagauuccguucgagaucauggauuuagagaagcggcaugucuugggccgccuuauuacagugaaccccaucgugaccgagaaggauucccccgucaacaucgaggccgagccuccguucggcgacaguuauaucauaaucgggguagagcccggccaacugaaguugaauugguucaagaagggcuccaguaucggccagauguucgagaccaccaugcgcggcgccaagcggauggcgauucugggagacacugcgugggauuucggcagucucggagguguguucaccagcaucgggaaggcucuccaccagguguucggagcuauauacggcgcagcguucaguggcgugagcuggaccaugaaaauacugaucggcgucaucaucaccuggaucgggaugaacuccaggaguacgucccuauccgugucccuugugcucgucggcgugaucacccucuacuugggggcgaugguucaagcggacagcggcugcguugucucguggaagaacaaagagcucaagugcggcagcgguauauucauaaccgacaacgugcacacguggacggagcaauacaaauuccagccagagucccccagcaagcuggccuccgccauacagaaggcgcaugaggagggcauuugcgggauucguucaguaaccaggcucgaaaaccucauguggaagcagaucaccccggagcuaaaccacauacuuagcgagaacgagguuaaacucacgaucaugaccggagacaucaagggcaucaugcaggcagggaagcggagucuucgcccccagcccaccgagcucaaauauagcuggaagacauggggcaaggccaagauguuguccaccgagagccacaaucagaccuuccugauagacgggcccgagaccgccgagugcccaaacaccaaucgggcguggaacucccuggagguugaggacuauggcuucgggguguucaccacgaauauuuggcucaagcugcgggagaaacaggacgucuucugcgauagcaaacugauguccgccgccaucaaagauaaccgggcagugcacgccgacaugggcuacuggaucgagagcgcccucaaugacacguggaaaauggagaaagcgagcuucaucgaggugaagagcugccacuggcccaagucccauacgcuauggucgaauggcguguuagagagcgagaugauaauacccaaaagcuucgccgggccgguaucccaacacaacuacagacccgguuauuacacccaaaccgccgggccuuggcaucucggcaagcucgagauggacuuugauuucugcgaggggacaacagugguggugaccgaggacugcggcaauaggggccccagcuuacgaacgacgaccgccagcggaaagcucauaaccgaguggugcugcaggucuugcaccuuaccaccccugcgauaccggggcgaggacgggugcugguacgguauggagauccgcccccucaaagaaaaggaggaaaaccugguuaacagccuggucacggcggggcacggccaaauagacaacuucucucucggagugcuggguauggcccuauuccuagaagagaugcugcgcacccgcguaggcaccaagcacgccaucuuacucguuaccgugucuuucgugacgcugauuaccgguaacauguccuuccgggacuuaggccguguaauggugauggugggagccgccaugacggacgauauuggcaugggcgucaccuacuuagcccugcuagccgccuuuaaggugcgccccaccuucgccgccgggcuuuugcugcggaagcuaaccagcaaggagcugaugauggcuaccaucggcaucgcccuguuaucccagagcaccaucccggagacuauccuggagcuaacugacgcccucgcauuggguaugaugguuuuaaaaaucguccgcaauauggaaaaguaucaguuggccgucacgaucauggccaucuccugugugcccaacgccgucauccugcagaaugccuggaaggugagcugcaccauccuugccgcgguuagcguuucgccccuccuccugaccucgagccagcaaaaggccgacuggauccccuuagcccugacuauuaaaggcuuaaacccgaccgccauauuccucaccacgcugucgcggacaucgaagaaacgcucguggcccuugaacgaggcuauaauggcggucggcauggucaguauccucgccucaagccugcugaaaaacgacauccccaugaccgggccccucguugcuggcgggcugcuaacugugugcuacguacucacgggccggagugccgaccuggaauuggagcgcgccaccgacgugaagugggaagaccaggcugagaucuccggguccuccccuaucuugagcaucaccauugccgaggacggcuccaugagcaucaaaaacgaggaggaggaacagacccugacgauccugauccggacaggacuccucgucaucucggggcuguuucccgucucaauccccaucaccgccgccgccugguaucucugggaggugaagaagcaacgcgcgggcguccugugggacguacccuccccgccgccgguggagaaggccgaguuagaggacggggccuaccggaucaagcaaaaaggcauccucggauacucgcagaucggcgccgguguguauaaggaggggaccuuccauacuauguggcaugugacgcgcggcgccguacugaugcacagagggaagcguaucgagccgucgugggcggacguaaagaaggacuuaauuucuuacggcggaggguggaagcucgaaggagaauggaaagagggggaggagguccagguucuugcccuggagccuggcaagaacccccgggcugugcagaccaagcccggccuauuuaagaccaacaccggcacgauaggggccgucucccuggacuucagccccggcaccagcggcagccccaucguggaccguaaggggaagguugucggccuguaugggaacggcgucgucacccggucuggcgcguauguuagcgcaauugcccagacagagaaguccauugaggacaacccggagaucgaggacgacaucuucaggaaaaagcggcuaacaaucauggaccugcacccuggggcaggcaagaccaagcgcuaccugccggccauuguccgggaggcgaucaagcgcggcuuacggacgcucauccuggcgcccacccgcgugguugccgcugagauggaggaggcccuucgcggccucccaaucagguaccagacgccggcgauccgcgccgagcacacuggucgggagaucguagaccugaugugccaugcaacguucacgaugcgccugcucagcccggugcggguccccaacuacaaucuaauaauaauggacgaggcccacuucacggauccggccagcaucgcggcccgcggcuacaucagcacccggguggagaugggugaagccgccgggaucuucaugaccgccacgccacccggcagccgcgaccccuuuccccagaguaacgcccccaucauggaugaggagagggagauaccggagcgcucauggaacuccgggcacgaaugggugacagacuucaagggcaagaccguuugguucgugccaaguaucaaggcagggaacgauauugccgccugccugcggaagaacgggaagaaggugauccagcucucccgcaagacuuucgacagcgaguaugucaagacccguacgaaugacugggauuucguggugacgacggacaucuccgagaugggggcgaauuucaaggcggagcgcgucaucgacccccggcguugcaugaagcccguaauccuaacagacggggaggaacgggugauccuggccgggccgaugcccgucacgcacagcucggccgcccagcgccgggggcguaucggcaggaaccccaaaaacgagaacgaccaguacaucuacaugggggagccccucgagaacgacgaggacugcgcgcauuggaaggaggcgaagaugcugcuggauaacaucaauaccccugaggggaucauccccagcauguucgagcccgaacgugagaagguggacgccauagacggcgaguaucguuugcgcggggaagcuaggaaaaccuucguggaucugaugcggcgcggcgaccugcccgucugguuagccuaccggguggccgcagaagguauaaacuaugcugaccgcagauggugcuucgacgggguaaagaacaaccagauucuggaggaaaacgucgagguggagaucuggaccaaagagggugagcgcaagaagcugaagccccgauggcuggacgcccgcaucuauuccgacccccuagcucugaaggaauucaaggaguucgccgcagggcgcaagagccucacgcugaaccuaauuaccgagaugggccgucuccccaccuucaugacgcaaaaggcccgggacgcccuggauaaccuggcgguuuuacacaccgcugaggccgggggccgggccuacaaccaugcccuguccgagcugccagagacgcucgagacccuucugcugcugacccuacucgcgacggugacggggggcaucuuccuguuccugaugagcggcaagggggugggcaagaugaccuuagguaugugcuguauuaucacagccuccauacuucugugguaugcccaaauacaaccccauuggaucgccgccuccauaauccuugaguuuuucuuaaucguccuacucauccccgagcccgagaagcagcggaccccacaggacaaucaauuaacguacgucgugauugcgauacugacagucguggccgccaccauggcuaacgaaaugggguuucucgagaagacaaagaaggaccuuggguuaggcuccaucgccacgcaggaacccgagucuaacauccucgacaucgauuuacgacccgcgucugccuggacccuguacgccguagccaccaccuucgucacacccaugcuccggcacuccauagagaacucuaguguaaacguaagucugaccgcgaucgccaaccaggccacaguacucaugggccuugguaagggcuggccgcugucuaagauggacaucggcgugccgcuccucgccaucggcugcuauagccaggugaaccccaucacccugaccgccgcgcugcuccugcucguagcccauuaugccauaauagggcccggcuugcaagccaaagccacccgcgaagcgcagaagcgggcagccgccggcaucaugaagaacccaaccguggacggggugacggucauugaucuggaccccauacccuacgaccccaaguucgagaaacaguuaggccaggugauguuacugauucugugcgucacgcaggugcuaaugaugcgcacgacgugggcccuaugcgaggcgcugaccuuggcaacggggccuauuuccacacugugggagggcaacccaggaagguucuggaauaccaccauagccgugaguauggccaacaucuuccggggcaguuaccuggcgggcgcgggacuccuguucagcaucaugaaaaacacgaccaacacacgccgaggcaccggaaacaucggggagacguugggggagaaguggaagucacgcuugaacgcccugggaaagagcgaguuccagaucuacaagaaauccggcauccaggagguggauagaacccuggccaaggaggggaucaagcguggagagacugaucaccacgccgucagccggggauccgcgaagcuccgcugguucguggagcguaacauggugacccccgaagggaaggucguggaccugggcugcggacgcggcggauggagcuacuacugcggcggucugaaggacgugcgggaggucaagggccucacgaagggcggacccggccaugaggagccuauccccauguccaccuacgguuggaaccuggugagacugcagagcggaguggaugucuucuuuacuccgcccgagaaaugcgacacccuccucugcgauaucggugaguccagcccgaaccccacgaucgaagccggccguacguugcgcgugcucagccugguagagaacuggcugaacaacgacacccaguucugcaucaaagugcugaaucccuacaugccgucggugauugagaagauggaaacccugcagcguaaguacggcggggccuuggugcgcaaccccuuaucacggaacuccacccacgagauguacugggucagcaacgccacgggaaacaucgugaguagcgugaacaugauaucacguaugcugaucaaucgguucaccaugaagcauaagaaggccaccuacgagcccgacguagaccucggcagugggacacgcaacaucgggaucgaaucggaaaucccuaaucuggauaucaucggcaagaggaucgaaaaaaucaagcaggagcacgagacgucguggcacuacgaccaggaccacccguacaagaccugggcguaucacggcagcuacgaaaccaagcagacugguagcgcguccucuauggugaacggcguuguccggcuccugacgaagccgugggacguggugcccauggucacccaaauggccaugacagacaccacgcccuucgggcagcagaggguauucaaagaaaagguggacacgcggacgcaggagccgaaagaaggcacuaagaagcugaugaagaucacggccgaguggcuguggaaggagcugggcaagaaaaagacgccacgaauguguacccgggaagaguuuacccgcaagguccggucaaacgcggcgcugggcgccaucuucacggaugagaacaaguggaaguccgcccgcgaggcaguggaggacuccagauucugggaguugguggauaaggagcgcaaccugcaccuugaaggcaagugugagacaugcgucuacaacaugauggggaagagagagaagaagcucggcgaguucgggaaagcuaaaggaagccgggccauaugguacauguggcugggcgcccguuuccuagaguuugaggcccuaggguuccugaacgaggaucacugguucucccgcgagaacaguuuaucuggcguggagggggagggccuucauaagcugggguacauccuucgggaugucuccaaaaaggagggcggcgccauguaugcggaugacaccgccgggugggacacccgcauaacgcucgaggaccugaaaaacgaggagaugguuacgaaucacauggagggagaacacaagaagcuugcagaggccauauucaagcuaacguaccagaacaaggugguucgggugcagcgccccacaccgcggggaacgguuauggacauuauuagccgccgggaccaaagaggaagcgggcaagucggcaccuacggacugaacaccuuuaccaacauggaggcgcagcugauccgucagauggagggggagggcguguucaagagcauccaacggcucacggugacagaggagauugccgugcagaacuggcuggcucgcguggggcgggagagacugagucgcauggcuauaagcggcgacgacugcguggucaagccccucgacgaccgauuugccuccgcccugaccgcgcuuaacgacaugggcaaggugcggaaggauauccagcagugggaaccgagccgcggguggaacgacuggacccagguccccuuuugcucccaccacuuccacgagcucaucaugaaggacggccggguccugguggugccuugccggaaccaggacgagcuuauuggacgggcacguaucucccagggcgcaggguggucccuaaaagagacggccugucuugguaaguccuacgcccagauguggucccugauguacuuccaucggcgcgaccucaggcuggccgccaacgccauuugcuccgcggucccgucgcacuggguccccacgagccggaccaccugguccauccacgcgaagcacgaauggaugacgacggaagacaugcugaccguguggaaccgaguguggauccaagaaaaccccuggauggaggauaagaccccaguggagagcugggaggaggugcccuacuuaggcaagagagaggaccaguggugcgggagccucauaggccugacaucccgagcgacaugggccaagaacauccaaacagccaucaaccagguccgcucccugaucgggaaugaggaauacaccgacuauaugcccuccaugaagcgguuucggagagaggaagaggaagcgggagugcugugguga

SEQ ID NO: 25404 - RNA, 9876 nt, Artificial Sequence
  derived and/or modified CDS sequence (opt11) from DENV-2__EU482786__SS-prME
agcgccggcaugauuaucaugcugauccccaccgugauggccuuccaccucaccacccggaacggggaaccucacaugaucguuggaauccaggagaaaggaaagagccugcuguuuaaaaccgaggacggcgugaacaugugcacccucauggcaauggaccugggggagcugugcgaagacaccaucaccuacaagugcccgcuccugcggcagaacgagcccgaggauaucgauugcuggugcaacagcaccucaaccugggugaccuacgggaccugcacgaccaccggcgagcaccggcgggagaagcgcucagucgcacuggugccccacguggggaugggccucgagacccggaccgagacguggauguccagcgagggcgccuggaagcacgcccaacguaucgagacuuggauucugcggcaccccggcuuuacgaucauggccgcgauccuggccuacaccaucggaaccacucacuuccagcgcguccucaucuucauucugcugacggccguagcccccuccaugaccaugcggugcaucggcauaucaaaccgcgacuuuguugagggcgucuccgggggcucauggguggacaucguucucgagcacggguccugcgucacgaccauggcaaagaacaagccuacgcuggacuuugagcugaucaagacagaggccaagcagccggccacccuccggaaguauugcauugaggccaaauuaaccaacacuaccaccgagagccgcugcccuacccagggugagccaucccugaaggaggagcaggacaagcgguucgugugcaagcauagcaugguggaccgcggcugggggaacggcugcgggcuguucggcaaaggcgguaucgucacgugcgcuauguuuacgugcaagaagaacauggagggcaagaucgugcagccggaaaaccuggaguacaccaucguggucacaccucauuccggagaggagcacgcggucggcaacgacacggggaagcacggcaaagagaucaaggugaccccgcagucauccauuaccgaggcugagcugaccggguacggcaccgucacuauggagugcagcccccggaccggucucgauuucaacgaaauggugcuacugcagauggaaaacaaggccuggcucgugcaccgacaaugguuccuagaccugccccuccccuggcugccgggggccgacaaacaagaguccaauuggauccagaaggagaccuuggugaccuucaagaacccccacgcaaagaagcaggaugugguuguguugggaagccaggagggugcgaugcacacggcacuuaccggcgccaccgaaauccagaugucaagcgggaaccuccuguucacaggccaccugaagugcaggcugcgcauggacaaguugcagcuaaagggcaugagcuacuccaugugcacgggaaaguucaagguggucaaggagaucgccgagacccaacacggcaccaucgucaucagggugcaguacgaaggggacggcagccccugcaagauccccuuugaaaucauggaccuggagaagcgguauguacucggccggcugaucaccgugaauccaaucgugacggggaaggacagccccgucaacauugaggccgagccgccauucggcgacagcuacaucaucaucgggguggagccgggccagcugaagcucaacugguucaagaagggguccucgaucggccagauguucgagaccaccaugcgcggcgcgaaacgcauggccauccugggagacaccgcgugggauuuuggcucccucggcgguguguucacgagcaucggcaaggcgcugcaccaggucuucggggccauauacggcgcggcguucuccggagugagcuggacaaugaagaucuugaucggugugaucaucaccuggaucgggaugaacucccggucaacuagucugagcgucagucuggugcuuguggguaucgucacgcuguaccuaggugugaugguacaggcugacagcggcugcgucguguccuggaagaacaaggagcuaaagugcggcagcggcaucuuuaucaccgauaacgugcacaccuggaccgagcaguacaaguuucagcccgagagccccuccaagcuggccagcgcaauccagaaggcccaagaggaggggaucugcgggauccgcuccguuacucggcucgaaaaccugauguggaagcagaucaccccugaauugaaccacauccuggccgagaacgaggugaagcucacaauaaugaccggggacaucaaggggaucaugcaggccgguaagcgcagccuacggccgcagccuacggagcugaaguauucuuggaagaccuggggcaaagccaagaugcuuagcaccgaguccuacaaucagacguucuugaucgacgggccugagacggcggagugcccgaauaccaaucgcgccuggaacagccuggagguagaggacuacggcuucgggguuuuuaccaccaacaucuggcucaagcucaaagagaaacaggacgccuucugcgacucuaagcugaugucagccgccauuaaggacaaccgggcggugcacgcugauaugggcuacuggaucgagagugcgcucaacgacacguggaagaucgagaaggccagcuuuauugaggugaagaacugccacuggcccaagucccacacccuguggagcaacggcguccucgaguccgagaugaucauccccaagaaccucgccgggccggugagccaacacaacuaccgcccgggauaccauacccagaucgcggggccguggcaccugggcaaguuagagauggauuucgacuucugcgaugggacgaccguuaucgucacugaggacugcggcaaccggggccccucccuccgcacaacuacugcgagcgggaagcugaucacugaguggugcugccggagcugcacccuccccccgcuccgcuaccggggagaggacgggugcugguacggcauggagauucgcccguugaaggagaaggaagagaaccuggugaacucccuugugaccgccggacacggccaggucgauaacuucagccugggcguguuggggauggccuuauuccuggaggagaugcuccggacccgcgucggaacgaagcacgcgauccuccuggucgccgucuccuucgugacccugaucaccggcaacaugagcuucaaggaccuuggccgggucgucgugauggucggggccaccauggccgacgacaucggcaugggcguuacguaccuggcccuguuagcggccuucaaggugcgcccaaccuucgcagccgggcugcugcuccgcaagcugacgucgaaggagcugaugaugaccacgaucggcaucguacuacugagccaguccacgauccccgagaccgugcuggagcugaccgaugcccuggcucuggggaugaugguucuaaagaucguccgcaacauggagaaguaccagcuugcagugacuauuauggccauucugugcguuccgaacgcgguggugcuccaaaaugccuggaagguaagcugcaccaucuuagcaguggucuccgucucgccccugcuccugaccuccagccagcaaaagacagacuggauaccgcuggcccucacgaucaagggccugaaccccaccgccaucuuccuuacaaccuuguccaggacgaacaagaagcggagcuggccgcugaaugaagccauuauggcgguggggaugguguccauccuggccagcucacuccugaagaacgacauccccaugacgggcccccugguugccggcgggcucuugaccguguguuacgugcugaccggccgcagcgccgacuuagagcuagagcgggccacggacgucaagugggaggaccaggcggagaucuccgggagcagcccgauccuguccaucaccaucagcgaggauggcuccaugagcaucaagaacgaggaggaagagcagacucucaccauccugauccgcacgggccuacugguaaucuccggacuguucccaauaagcauaccaaucaccgccgcggccugguaccugugggaggugaagaaacagcgggccggcguccucugggacgugcccagcccaccccccauggguaaggcggaguuagaggacggcgcauaccgcaucaagcagaagggcaucuuaggcuauagccagauuggcgccggcguguacaaggaaggcaccuuucacaccauguggcauguaacccgcggggcggugcucaugcacaagggcaagcgaaucgaacccaguugggcagacgucaagaaggaccugaucucauacggaggcggcuggaagcuggagggggaguggaaggagggcgaggagguccaggugcucgcgcuggagcccgggaagaacccccgagccgugcaaacgaagcccggccuguucaagaccaacaccgggacuaucggcgcagucucccucgacuucagccccgggacauccgggagccccaucaucgacaagaagggcaagguugugggccuguacggcaacggcguugugacccgcucgggggccuaugugucggccaucgcgcagaccgagaaguccaucgaggacaaccccgaaaucgaggaugacauauuucggaagaggcggcugacuaucauggaccugcaucccggcgccggaaagacgaagcgcuaccuccccgccaucguccgggaggccauuaagcgcggccugcggacccugauacucgcgccgacccgcgugguggccgccgagauggaagaagcccugcgagggcugcccauccgcuaucagacccccgcaauaaaggcggagcacacaggccgggagaucguggaccucaugugccacgccaccuucaccaugcgccugcuguccccagugcggguuccgaacuacaaccucaucaucauggacgaagcccacuucaccgaccccgccuccaucgccgcucggggcuauaucaguacacgugucgaaaugggugaggccgccggcaucuucaugacugccaccccgcccggaagccgggacccuuucccccagucaaacgccccuaucaucgacgaggagcgcgaaauccccgagcgaagcuggaacuccggccacgagugggugaccgacuuuaaggggaagacggugugguucgucccgagcaucaaggcgggcaacgacauagccgccugcuugcgcaaaaacggcaagaaggugauccaacugagccggaagacguucgacagcgaguacguuaagacgcgcaccaaugacugggacuucgucgugacgaccgacaucuccgagaugggggcuaacuucaaggcggagcgggugaucgacccccgccggugcaugaagccggucauccucacggacggcgaggagcgcgugauacuggccgggcccaugccggugacccacucguccgccgcccagcggcgcggccggauagggcgcaaccccaagaacgagaacgaccaguacaucuacaugggcgaaccccuggagaacgacggcgauugcgcccauuggaaagaggcuaagaugcuccuggacaacaucaacacgcccgagggcaucaucccgagcauguucgaacccgaacgggaaaaggucgacgccaucgacggcgaguaccgccugcgcggggaagcccgcaagaccuucguggaccucaugcgucggggcgaccugcccgucuggcuggcuuacaaggucgcugcggaagggaucaacuacgccgaccgccgguggugcuuugacggcaucaagaacaaccagauuuuagaggaaaacgucgaggucgaaaucuggaccaaggaaggcgagagaaaaaagcugaagccgcgauggcuggacgcccgcaucuacagcgacccccucgcccucaaagaguucaaggaauucgccgcgggacggaaaucccugacccucaaccugaucacagagaugggccgcuuacccacuuucaugacccagaagacgcgggacgcccucgacaacuuagcgguguugcacacggccgaggccggagggcgcgccuacaaccacgcccucuccgagcugcccgagacucuggagacccuccugcugcucacccugcuggccacggugaccggagggaucuuccucuuccugaugagcggacgggggaucggaaagaugacccuggggaugugcugcaucaucaccgccuccauacuccugugguaugcgcagauacagccgcauuggaucgccgccagcauaauccuggaguucuuccucaucguccuguugaucccugagccggagaagcaacguacgccccaggacaaccagcucacuuacguggugaucgcaauccuuaccgucguagcugcgacaauggccaacgagaugggcuuccuggagaaaacuaaaaaagaccucggccugggauccaucgccacucagcagccggagagcaauauacuggacaucgaccuacggcccgcaagugccuggaccuuguacgcuguggcgaccaccuuugucacgcccaugcuucggcacagcaucgaaaauagcagugugaacgugagcuuaaccgccaucgccaaccaagccaccguccuuaugggcuuagggaagggcuggccccucuccaagauggacauaggcguuccgcuucuggcgauagggugcuacagccaggugaaccccauaaccuugacggccgcccugcugcuccuggucgcccacuaugcgauaaucggcccagggcugcaggccaaagcuaccagggaggcucagaagcgcgcagcggccgggaucaugaagaacccaaccguggacgggaucaccgugaucgaccuugacccgauccccuacgaucccaaguucgagaagcaacugggucaggucaugcugcucauccugugcgugacccagguccugaugaugcggacuacuugggcacucugcgaggcccugacccuggccacugggcccaucuccacccucugggagggcaaccccggucgcuucuggaacaccacgaucgcgguaaguauggccaacauauucagaggguccuaccuggccggugccggacuccuguucucuaucaugaagaacacgacgaacacccgccggggcacuggcaauaucggagagacguugggcgagaaguggaagucccgccugaacgcacucgguaagagcgaguuccaaaucuacaagaaguccggcauccaggaggucgaccgcacccuggcuaaggaagggaucaagcggggagagaccgaccaccacgccgugagccgcggcuccgccaagcugcgcugguucguugagcgcaacauggugacgcccgagggcaagguggucgaccucggcugcggucgcggcggauggagcuauuacugcggcggcuuaaagaacgugagggaggugaaggggcugacgaagggagggccaggacacgaggagcccauccccaugagcaccuacggguggaaccugguacggcugcagagcggcguagauguguucuuuaucccgcccgagaagugcgauacccugcucugcgacaucggagagucaagccccaacccgacggucgaagccgggcgcacgcugagagugcuuaaccucguggagaacuggcugaacaacaacacccaguucugcaucaagguccugaacccuuauaugcccuccgugaucgagaagauggaggcgcugcagcggaaguauggcggggcgcucgugcggaacccgcugagccgaaacucaacccacgagauguacuggguuuccaacgcgagcggcaauaucguguccagcgugaacaugaucagucggauguuaaucaaccgcuucaccaugcggcacaagaaggccacauaugagccagacgucgaucucgggagcggcacccgcaauaucggcaucgaguccgagauccccaaccucgacauaaucgggaagcggauagagaagauuaagcaggagcacgagaccuccuggcacuacgaucaggaccaccccuacaaaaccugggccuaccacggauccuacgagacaaagcagacggggucagcgaguagcauggucaacggcguaguccgccucuugaccaagccgugggacgugcugcccaccgucacccaaauggccaugacggacacgacccccuucggccagcagcgggucuucaaggagaagguggacacccgcacgcaagagccaaaggaggggaccaagaagcugaugaagaucacugccaaguggcucuggaaggagcuggggaagaagaagacaccgaggaugugcacgcgggaggaguucacucgcaaggugcgguccaacgccgcccucggggcgaucuucaccgaugagaacaaguggaaguccgcccgcgaagcugucgaggacucccgcuucugggagcucguggauaaggagcgcaaccugcaccuggagggcaagugcgaaacuugcguauacaacaugauggggaagcgggagaagaaguugggcgaguucggcaaggccaagggaagccgcgccaucugguacauguggcugggcgcgcgguuccuggaguuugaagcccucggguucuugaacgaagaccacugguucucccgcgagaacagccugucuggcgucgagggggagggccugcacaagcugggcuacaucuuaagagaugugagcaaaaaggagggcggggccauguacgccgacgacacggcggggugggauacccguaucacgcucgaggaccucaagaacgaggagauggucacaaaccacauggaaggcgagcacaagaaacuggccgaggccaucuucaagcucacguaccagaacaaggugguucggguccagcgccccacgccccgggggacggugauggauaucaucagucgccgggaccagcgcggcuccggccagguggggacuuacggccugaacacauucaccaauauggaggcccagcucauacggcagauggagggggagggcgucuucaagaacauccagcaccucaccgugacggaggagguggcgguccaaaauuggcuggcgcgcgucggccgggagcgccucagccgcauggccaucuccggcgacgacuguguggucaagccccuugacgaccgguucgccaacgcccugacggcacugaacgacaugggcaagauccgaaaggauauccaacagugggagccgagcaaaggguggaacgacuggacccaggugcccuucugcucgcaucacuuccacgagcucauuaugaaagacggccgggugcuuguggugcccugccgcaaccaggacgagcugaucgggcgggcgcgcauaagccaaggcgccggcuggucguugcgggagaccgccugccugggcaaaagcuacgcccagauguggucccuuauguacuuucaccgccgggaccugcgcuuggccgcgaacgcgauuugcagcgcggugcccucccacugggucccgaccagccggacgacgugguccauccacgccaaacacgaguggaugaccaccgaagacaugcugaccguguggaaccgcguguggauucgggaaaacccauggauggaggacaagacgcccguagagagcugggaggagauccccuaccucggcaaacgcgaggaccagugguguggaucucugaucggucugacaagccgcgccaccugggcaaaaaacauccaggccgccaucaaccaagugcgcucccucauagggaacgaggaguacaccgacuauaugcccagcaugaagcgcuuccgccgggaggaggaggaggcaggcguguugugguga

SEQ ID NO: 25405 - RNA, 9876 nt, Artificial Sequence
  derived and/or modified CDS sequence (opt11) from DENV-2__EU482787__SS-prME
accgcgggcgugaucaucaugcugaucccaacagccauggcguuccaccucaccacccgcaacggugagccgcauaugaucguaggccggcaggagaagggcaagaguuuacuauucaagaccgaggacggugugaacaugugcacacucauggcuauugaccucggggagcugugcgaagacacgauaaccuacaagugcccucuccugcgccagaacgagcccgaagacaucgacugcugguguaauagcaccagcacuugggugaccuacgguacauguaccaccacaggggagcaccggcgcgagaagagaucggucgccuuagugccccacguggggaugggccucgagacaaggacggagacauggaugucuuccgagggggccuggaagcacgcccagaggauugagacuuggauccugcgccacccggguuucaccauaauggccgccauccucgcguacaccgucgggaccacccacuuccagcgggcacucauuuucauccugcuagcugcaguagcccccagcaugaccaugcggugcaucgguaucaguaaccgggacuucgucgagggcguuagcgggggcuccuggguagacaucguguuggagcacgggagcugcgucaccaccauggccaagaacaaacccacccuggauuucgagcuaaucaaaacugaggccaagcagccagcgacgcugcgcaaauacugcaucgaggccaagcugacgaauacgaccaccgaguccagaugcccgacccagggagaacccagcuuaaacgaggagcaggauaaacgcuuuguuugcaaacacuccaugguggaccgggggugggggaacgggugcgggcuguucggcaagggcgggaucgucacgugcgcuauguucacgugcaagaagaacauggagggcaagaucgugcagccggaaaacuuggaguacaccaucgugaucacgccccacagcggugaagagcacgccguuggaaacgacacggggaaacacgggaaagagaucaagaucacgccccagucccccaucaccgaggccgagcuuacaggguacggcaccgugacuauggaguguuccccccgaacuggccucgacuucaacgagauggugcugcugcagauggaggacaaggcgugguugguucaccggcagugguuccuggaucugccccuccccuggcugccgggggccgacacacaggguuccaacuggauccagaaggagacccuggugacguuuaaaaacccacacgccaagaagcaagacgugguuguacucgguagccaagagggcgcuaugcacacagcccuuaccggcgcgacggagauccagauguccagcggcaaccucuuauucacgggccaccugaagugccgccugcggauggacaagcugcaacuuaaggggaugucguacuccaugugcaccgguaaguucaagauagucaaggagaucgccgagacccagcacgguaccaucguaauccgcgugcaauaugagggcgauggcucucccuguaagaucccguucgagaucauggauuuggagaagcggcacguccucgggagacugaucacggugaacccaaucgugaccgagaaggacucccccgugaacaucgaggcagagcccccguucggggacagcuacaucaucaucgggguagagcccggccagcugaagcucaacugguucaagaaaggguccucaauuggccagauguucgagaccaccaugcgcggagcgaagcggauggcaauccuaggggacacagcuugggacuucggcagucucggggggguuuucaccagcauugggaaagccuuacaccaggucuuuggggcgaucuacggugccgcguucuccggugugagcuggaccaugaagauucuaaucggcgucaucauuaccuggaucgguaugaauucccgcagcacguccuuaagcgucagucuggugcucgugggagucaucacccuguacuugggagccauggugcaagcagacagcggcugcgucgucuccuggaagaacaaagaacucaagugcggcucggggauuuucaucacggacaacgugcacacuuggacggagcaguauaaguuccagccggaaucccccagcaagcuugcuagcgccauccagaaggcgcacgaggaggguaucugcgggauccgcagugugaccaggcuugagaaccucauguggaagcagaucaccccagagcugaaccacauacugagcgagaacgaaguuaagcuaacaaucaugacgggggacaucaaagggaucaugcaagccggcaaacggagucugcgcccacagcccaccgaauuaaaguacagcuggaaaaccuggggcaaggcuaagaugcuguccaccgagagccacaaccagacguuccugauugaugggccggagacagccgagugcccgaauaccaaccgggccuggaacucccuggaggucgaggacuacggcuucgggguguucaccacgaacaucugguugaaguugagggagaagcaggacguuuucugcgacagcaagcugauguccgcggccaucaaggacaaccgggccgugcacgccgacaugggcuacuggaucgagagcgcguugaacgacaccuggaagauggagaaggcgucguucaucgaggucaagaguugccacuggccgaagucccauacucuguggagcaacggcgugcuggaguccgaaaugaucauccccaaaagcuucgccgggccggugagccaacacaacuaccgccccgguuacuacacccagaccgccgguccguggcaccucgggaagcuggaaauggauuucgacuucugcgaagggacgaccguggucgugaccgaggauugcggcaaccggggccccagcuugcgcaccacgacugcgucagggaaguuaaucaccgaguggugcugccgguccugcacccugccuccccuucgauacagaggcgaagacgggugcugguacggcauggagaucagaccacucaaggagaaggaggagaaccucguuaacagccuagucacggccgggcacggacagaucgacaacuucucccucggugugcuggggauggcccuguuucuggaggagaugcugcggacccgcguggggaccaaacacgccauccugcucguuaccguaucuuucgugacgcugaucacggggaacauguccuuuagggaccugggcagaguuauggugauggugggggccgccaugaccgacgacauuggcaugggcgugaccuaccuagcgcuacuggcagccuuuaaagugcgcccaacguucgcugccgggcuccugcuacggaagcucaccucgaaggaacugaugauggcgaccaucggcaucgcccugcucucccaaagcaccaucccggagacgauccuggagcugaccgaugcucucgcccuggggaugaugguccuaaagauuguccgcaacauggagaaguaccaacucgccgugacuaucauggcgaucuccugcgugcccaacgccguuauucugcagaacgccuggaagguuagcuguaccauuuuagcugcgguguccguuuccccacuccuccugacuuccagccagcagaaggccgacuggaucccccuugcccugaccaucaaaggucugaacccuacugccauuuuccugaccacguuaucccggaccagcaagaagcgcuccuggccccugaacgaggccaucauggcugucggcaugguuagcauccucgcaaguagccugcuuaaaaacgacauaccgaugaccgggccccucguggccggcggucugcugacagugugcuacguccucacgggccggagcgcugaccuggagcuggagcgcgccaccgacgugaagugggaggaccaggcggagaucuccggguccucgccuaucuuaucgaucaccauugccgaggacgguaguaugagcaucaagaacgaggaggaggagcagacccuaacgauccugauacggaccggccuccuggugaucuccgggcuguuccccgucaguauccccaucaccgcagccgccugguaccuuugggaggugaagaagcagcgugcgggggugcucugggacguccccagcccgccccccgugggaaaggccgaguuggaggacggagccuaccguaucaaacagaaagguauccucgguuacagccaaaucggcgcugggguguacaaggaggguaccuuccacaccauguggcaugucacgcgaggugccgugcugaugcaccggggcaagaggaucgagccguccugggcggacgugaagaaggaucugauaagcuaugguggagguuggaaacucgagggggaauggaaggaaggggaagaaguccagguccuggcccucgagcccggcaagaacccccgcgcgguucagaccaagcccggucucuucaaaaccucaaccggcacgaucggggccgucucgcuugacuucuccccaggcacgucggguuccccaaucguggaccgcaagggcaagguuguaggauuauacggcaaugguguggugacuaggagcggggcguacgucuccgccaucgcccaaaccgagaaaaguaucgaagacaaccccgaaauugaggacgacaucuuccgcaagaaaagacugacgaucauggaccuacaucccggcgccgguaagaccaagcgauaccuaccggccaucgugcgggaggcgauaaaaaggggccugcggacguuaaucuuagcaccgacccgcgugguugccgcggagauggaagaggcccugcgcggucucccuauucgguaccagacacccgcgaucagagccgagcauaccggucgggaaaucguggaccugaugugucacgccaccuucacgaugcgccugcucagcccugugcggguccccaacuauaaccugauuaucauggacgaggcacauuucacggaucccgccuccaucgcggcgcgcggauauaucagcacucggguggagaugggggaggccgccggcaucuuuaugacugcgaccccucccggaucccgcgaccccuucccccagagcaacgcccccaucauggacgaggagcgagagauccccgagcgcucguggaacagcggccaugagugggugacugauuucaaggggaaaaccgucugguucgugcccuccaucaaggcagguaacgacauugccgccugccugcggaagaauggcaagaaagucauccaacucagcagaaagaccuucgacuccgaguacgucaagaccagaacgaacgacugggauuuuguugucaccacugacaucagcgagaugggggcgaacuucaaggcggagcgugucaucgauccgcggcgcugcaugaagcccguaauacugaccgauggcgaggaacgcgugaucuuggcggggccgaugcccgucacgcacuccucggccgcucagcgcaggggacggaucgggaggaaccccaagaacgagaacgaucaguauaucuacaugggugagccauuggagaacgacgaagacugcgcgcacuggaaggaagccaagaugcugcuggacaauaucaacaccccagaggggaucauccccuccauguuugaacccgaacgggaaaagguggacgcaaucgacggggaguaucgccuacgcggcgaggcccgcaagacguucguggacuugaugcggagaggggaccugccggugugguuagccuaccggguggcggcugagggcauuaacuacgccgacagacgguggugcuucgacggggugaagaacaaccagauccuggaggagaacgucgaaguggagaucuggaccaaggaaggcgagcgaaagaagcugaagccccgguggcucgaugcccgcaucuacagcgacccccuggcccugaaggaguuuaaggaguucgcggcggggcgcaagucccucacguuaaaccugauuacggaaauggggcgccucccuaccuucaugacccagaaggcucgggacgcccuggacaaccuagcggugcuccacacggccgaggccggcgggcgugccuacaaccacgcucugagcgagcugccggagacccucgagacccugcuucuccugacccuacucgcgacgguuaccggcggaauauuucuguuccuuaugagugggaagggcgugggaaagaugacgcuuggcaugugcugcaucaucacugccucaauccugcucugguacgcgcaaauacagccucacuggaucgccgccagcauuauccuagaauuuuuccugaucguccuacucauccccgagcccgagaagcagcggaccccgcaggacaaucagcugacguacguugugaucgcgauccuuacggucguggccgcaaccauggccaacgagaugggguuucucgagaagaccaaaaaggaccugggccuggguagcaucgccacgcaggagcccgagagcaauauccuggacaucgaccuacgccccgcguccgccuggacccuguacgccguggcaaccacuuucgucacgccgauguugcggcacagcaucgagaacuccagcgugaacguuucccuuaccgccaucgccaaccaggcaaccguccugaugggacucggaaaggguuggccccugucgaagauggacaucggugugccccugcucgccauuggguguuauagccaggugaaccccaucacccugacggcggcgcuccuccugcuggucgcccacuacgccaucaucgggcccggccuccaggcaaaggccacucgagaggcucagaagcgggccgcugccgggauaaugaagaauccgaccguggacggagugaccgucaucgauuuagaucccauccccuacgaccccaaguuugaaaaacagcucggccaggugaugcugcugauucugugcguaacgcaggucuuaaugaugcgcacgacaugggcccugugcgaggcgcugacccucgccacgggcccgaucagcacacugugggaggggaaucccggcagguuuuggaacaccaccauugccgucucaauggcaaacaucuucagaggcagcuaccuggcgggggccggacuccuguucuccaucaugaagaacacgaccaacaccagacgggggacaggcaacauuggcgagacgcucggggagaaauggaaaucccgacucaacgccuuggggaagucagaguuccagaucuacaagaaguccgggauccaggagguggaccggacccuggccaaggagggcaucaaacgcggggagaccgaccaccacgcagucuccagaggcagcgcgaaguuacgcugguucguggagcggaacauggugacgcccgagggcaaagucguggaccuggggugcggcagggggggcugguccuacuacugcggggggcuaaaggauguucgugaggucaagggacucacaaagggcggcccugggcaugaggagccaauacccaugagcaccuacggcuggaaccuggugcgccugcaguccggaguggaugucuucuucaccccgcccgaaaagugcgacacccuccugugcgacauaggcgagucaagcccgaaccccacgauugaagcuggccguacgcugcgcgugcugucccugguggagaacuggcugaacaacgacacccaguucugcaucaaggugcucaaccccuacaugccaagcguaaucgagaaaauggagacccugcagcggaaauacgggggcgcacucgugcgcaacccgcugucacggaacagcacccaugaaauguauugggucuccaacgcgacgggaaacaucgugagcuccgugaacaugauuagucgcaugcucaucaauagguucacaaugaagcacaaaaaggccaccuacgagcccgaugucgaccugggcuccgggacgcgcaacaucggcaucgaaagcgagaucccaaaccucgacaucaucgggaagcgcaucgaaaagaucaagcaggagcacgagaccuccuggcacuacgaucaggaccaccccuacaagaccugggccuaccaugggagcuacgagaccaagcagaccggcucagccagcuccauggugaacgggguggugcgauuacugacgaaacccugggacguggugcccauggucacccagauggccaugaccgacaccacgccauucggccagcagcgcguguucaaagagaagguggacacccguacccaagagccaaaagagggcacgaagaagcugaugaagaucacggccgaguggcucuggaaggaguugggaaagaagaagacgccccgcaugugcacccgggaggaguucacccgcaaaguccggucgaaugccgcacugggcgccauuuuuacugacgaaaauaaguggaaguccgcgagggaggccguagaggacuccagguucugggagcucguggacaaggagcgcaacuugcaccuggaggggaagugcgaaaccugcgucuauaacaugaugggcaagcgggagaagaagcucggggaauucggcaaagcgaagggcucccgcgccaucugguauauguggcugggggcccgguuucuugaguucgaggcccuaggauuucugaaugaggaucacugguucagccgcgagaacagccugucggguguagagggagaggggcuacacaagcuuggcuacauccugagagacgucagcaaaaaggaggguggagccauguacgcggacgacaccgccggcugggacacgcgcaucacccucgaggaccugaagaacgaagaaauggugaccaaccacauggagggggagcacaagaagcuugccgaggcaaucuucaagcucaccuaccagaauaaagucgugcgggugcagagacccacaccccggggaacgguaauggacaucauuucccgcagagaccagcgcgggagcggccaagucggcacguacgggcugaacaccuucaccaacauggaggcccaguuaauccgccagauggagggcgaggggguguuuaaguccauccaacggcucacggugaccgaggagaucgcgguccagaacuggcuggcucgcguuggccgggagcgccugagccggauggcaaucagcggcgacgauugcgugguaaagccgcucgacgaccgcuuugccagcgcccugaccgcgcugaaugacauggggaagguacggaaggacauccagcagugggaaccaucccgcggcuggaacgauuggacccaggugccuuucugcucucaucacuuccacgagcucauaaugaaggacgggcggguccugguggugccgugccgcaaccaagacgagcugaucggccgggcccgcaucucccagggggccggcuggucgcucaaggagacggcuugccuggguaaguccuacgcucagauguggagccucauguacuuccaccggcgcgaucucagacuggcggcuaacgccauuugcuccgcuguuccgagccauugggugccaaccucccgcacgacuuggagcauucacgcaaagcaugaguggaugacuacggaggacaugcucaccguguggaaccgggucuggauccaggagaacccguggauggaggacaagaccccaguggagagcugggaagaagugccguaccuagggaagcgcgaggaccaauggugcggaucgcugaucgggcuaaccucucgcgccacgugggcaaagaauauccagaccgcaaucaaccagguacgaucuuugaucggaaacgaggaauacaccgacuacaugcccagcaugaagcgcuuccggcgcgaagaagaggaggccggggugcuaugguaa

SEQ ID NO: 25406 - RNA, 9876 nt, Artificial Sequence
  derived and/or modified CDS sequence (opt11) from DENV-2__EU482788__SS-prME
accgccggcgugauaaucaugcugauccccaccgccauggcguuccaccucaccacccggaauggcgagccccacaugauugucggccgccaggaaaagggcaagagccugcuguuuaagaccgaggacggcgucaacaugugcacccucauggcaaucgaucugggggagcugugcgaggacacuaucaccuacaagugcccgcucuuacgccagaacgagcccgaggacaucgacugcuggugcaacagcaccagcaccuggguuaccuacggaaccugcaccaccacuggcgagcaucggcgggagaagagaucggucgcccugguuccccacgugggaaugggcuuggagacgcgcaccgagaccuggaugagcuccgagggagcguggaagcacgcccagcggaucgaaaccuggauccuccgccacccgggcuucacaauaauggcggccauccuggccuacaccgucgggaccacccacuuccaacgggcccucauuuuuauccuccucgcagccguggcccccagcaugacgaugcgcugcauugguauuuccaaccgggacuucguggagggugucagcgggggauccugggucgauaucgugcuggagcacgggucuugcgucaccaccauggcaaagaacaaacccacucuggacuucgagcugaucaaaaccgaagccaaacaacccgcgacacucaggaaguacugcauagaagcaaagcugacuaauacgaccaccgaguccaggugcccuacccaaggcgagccaucgcugaaugaggagcaggacaagagauucguuugcaagcauuccaugguggaccggggcugggggaacggcugcggacucuucggaaagggcgggaucgucacgugcgcaauguucacguguaagaaaaacauggagggcaaaauugugcagcccgagaaccuggaguacacgaucgugaucacaccacacagcggggaggagcacgccgucggcaacgacacugguaagcacggcaaagagaucaagaucaccccgcagagccccauuacggaggccgagcugacggguuacggaacggugacgauggagugcagcccccgcacgggacuugacuuuaacgaaauggugcuguuacagauggaggacaaggcauggcuuguucaccggcagugguuucuggaccugccccucccguggcugcccggggccgacacccaaggauccaacuggauccagaaggagacccugguuacauucaagaauccccacgccaagaagcaagacgucgucgugcucgggagccaagagggcgccaugcacaccgcgcucaccggggcgacugagauacagauguccagcggcaaccuccucuucacgggacaccugaaaugucgccugcggauggacaagcuccagcucaaggggaugagcuacuccaugugcaccgggaaguuuaagaucgucaaggagaucgccgagacgcagcacgggacaauugugauucgcgugcaguacgagggggacggcagccccugcaagaucccguucgagauuauggaccuggagaagcggcacguccucgggcgccugauuacggucaaucccaucgugaccgagaaggacuccccggucaacaucgaggccgagcccccuuucggcgacagcuauaucaucauagggguggagcccggccagcugaaguugaacugguuuaagaaaggguccagcaucgggcaaauguucgaaacgacgaugcgcggcgccaagcggauggcaauccugggggacacggcgugggacuucgggucccucggcgggguguucaccagcaucggaaaggcucugcaccaggucuucggggccaucuacggcgccgcguucuccggggugucuuggaccaugaagauccugaucggcgugaucaucaccuggaucgggaugaacucccgcagcacgucacugagcgucucccuggugcucgugggcgucaucacccuguaccugggagcaauggugcaggccgauucaggcugcguugucuccuggaagaacaaagagcucaagugcggcagcgggauuuuuaucaccgacaacgugcacacauggacggagcaguauaaauuucagcccgagucccccagcaaacuugcgagcgccauucagaaggcgcaugaggagggcaucugcgggauccggagcgugacccgccuggagaaccugauguggaagcagaucaccccggagcucaaccacauccucagcgagaacgagguuaaacugaccaucaugacgggcgacaucaaggguaucaugcaggccggaaagcguagucugcgcccccagccaaccgaguuaaaauacagcuggaagacauggggaaaggcuaagaugcucuccaccgagagccacaaccagacguucuuaaucgacgggccggagaccgcugaaugcccaaauaccaaucgagcguggaacucccuggagguggaagacuacggcuucgggguguuuaccacgaacauuuggcugaagcugcgcgagaagcaggacguuuucugcgauucgaaacugauguccgcggcgaucaaggacaaccgggccgugcaugccgacaugggcuauuggaucgaaagcgcacugaacgacacguggaagauggagaaagcgaguuucaucgagguuaagagcugccacuggcccaagucccacacccuguggucgaacggcgugcuggaguccgagaugaucauacccaagucuuucgccgggccugugucccagcacaacuaucgccccggcuacuacacccagaccgcggggcccuggcaccucgguaagcuggagauggauuucgacuucugcgaggggacuaccgugguggugaccgaggauugcgggaaccggggacccagccugcgcaccacgaccgcaagcgggaagcucaucacugagugguguugcaggucuugcacccuaccgccccugcgcuacagaggcgaagacggaugcugguaugggauggagaucagaccucugaaggaaaaggaagaaaaccugguaaauagccuggucaccgcggggcacggccagaucgauaacuucuccuugggcguucucgggauggcgcuguuccucgaggagaugcugcggacccgcgucggcaccaagcacgccauccugcuagucaccgugucguucgugacucuuauaaccgggaacaugucuuuucgcgacuuaggccgcgucauggugauggugggggcugcuaugaccgacgacaucggcaugggcgucacguaccucgcacuacuggccgccuucaaggugcgaccgacguucgccgcgggacuccugcugaggaagcucacaaguaaagagcugaugauggcgaccaucggcaucgcccugcucucacagagcaccauaccggagaccauccuggagcugaccgacgcccuagcccuggggaugauggugcugaagaucguccguaacauggaaaaguaccagcucgccgucaccaucauggccaucuccugcgugcccaacgccgucaucuuacagaacgccuggaagguaagcugcaccauccuggccgcgguguccgucagcccccuucugcugacuuccagccaacagaaggcugauuggaucccccucgcccugacaauuaagggccugaacccgaccgcaaucuuccuuacgacgcugucccggacgagcaagaagcgcuccuggccccugaacgaggccauuauggcggugggcauggucucgauucuagccucuucacugcuaaagaacgacauccccaugacugggccuuuaguugccggagggcuguugaccguaugcuacguccucaccggacgaucugccgaccuggaacucgagcgcgccacagacgugaaaugggaggaccaggcggaaaucuccgggaguuccccgauccuuagcaucaccauagcagaggaugguuccaugagcaucaaaaacgaagaggaggagcagacacugacgauccugauccggacgggccuccuagugaucuccgggcuguuucccgucaguaucccgaucaccgccgccgcgugguaucucugggaagucaaaaagcagagagcggguguucugugggauguccccuccccaccacccguggggaaggcagagcuggaggacggcgcuuaucggaucaagcaaaaggggauacucggguacucgcaaauaggagccggggucuacaaggaaggcaccuuccacaccauguggcacgucacgcgcggcgccgugcugaugcauaggggcaaacgcauagagccguccugggcggacgugaaaaaggaccugaucagcuacgggggcggcuggaagcuggaaggggaguggaaggagggcgaagagguccagguccuggcccuggagcccggcaagaacccacgggccguucaaacgaagcccggccucuucaagaccaacaccggcacaauaggcgcggucagucuggacuucagccccggcaccuccgggucuccaaucguggacagaaaggggaaggugguaggccuguacggcaacggcguugugacucggaguggggcguaugucagcgccaucgcccagaccgagaaguccaucgaggacaaccccgagaucgaggacgacaucuucaggaagaaacgguugaccaucauggaccuucaucccggagccgggaagacuaagcguuaccugccggccaucguucgagaggcgaucaagaggggcuugcggacccucauccuggcccccacccgcguugucgcagcugagauggaagaagcgcuucgcgguuugcccauccgguaccagacgcccgcgauacgcgccgagcacaccggccgggagaucguggacuugaugugccacgccaccuucacaaugcgacuccucucgccggugcgggugccaaauuacaaccucauaauaauggacgaggcccacuucacggaccccgccagcaucgcggcucgcggcuacaucaguacccgaguagaaaugggcgaggccgccggaauauucaugaccgcuacuccgccugggagccgagacccguucccccagucuaacgcaccgaucauggacgaggagcgcgagauccccgagagaagcuggaacuccggccacgagugggugacggacuucaaggggaaaaccgucugguucgugcccagcaucaaggccggcaacgacauugcggcuugccuccgcaaaaauggcaagaaagugauccaguuaagccgcaagacuuuugacuccgaguacgucaagacccggacgaacgacugggacuucguugugaccacugacaucuccgagaugggggcgaacuucaaggccgagcgcgucaucgacccccggaggugcaugaagcccgucauccugacagacggcgaggagcgugugauauuggcgggaccgaugcccgucacgcauagcucggccgcccagcgccgggggcgcaucgggcgcaacccuaagaacgagaacgaccaguacaucuacaugggcgaaccccucgagaaugaugaggacugcgcgcacuggaaggaggccaaaaugcugcucgacaacauaaacacacccgagggcaucaucccaagcauguuugagcccgaacgggagaaaguggacgccaucgacggggaguaccgccuacggggugaggcaaggaagacauucguugaucugaugagacgcggugaucugccagucugguuggccuaccgggucgcugcugagggcaucaacuacgccgacagaagguggugcuucgacggcgugaagaauaaccagauccuggaagagaacguagagguagaaaucuggaccaaggagggcgagcgcaagaagcugaaaccccgguggcucgacgcucgcaucuacuccgauccccuggcgcugaaggaguucaaggaguuugccgccggccgcaagagcuuaacgcuaaaucugaucaccgagauggggcgccuccccaccuucaugacgcagaaggcccggaacgcacuggacaaucuggcggugcuccacacggccgaggcgggcgggcgcgccuacaaccacgcgcuguccgagcugccggaaacgcucgagacuuuacuacuccugacucugcucgcgacggucaccggcggcaucuuccuguuccuaaugagcgggaagggcgugggaaaaaugacgcuugguaugugcugcaucaucaccgccuccauccuucugugguaugcccagauccaaccccacuggaucgccgccagcaucauccuugaguucuuccugauugucuugcucauccccgagccugagaagcagaggacaccccaggauaaccagcugacuuacguugugaucgcgauuuuaaccgucguggcugccaccauggccaacgagaugggauuccucgagaagaccaagaaagaucugggccuagguucuaucgcuacacaggagccggagagcaacauucucgacaucgaccugcgccccgcgagcgccuggacccuguacgcgguggcuacgaccuucgucacgcccaugcucaggcacaguauagaaaacagcagugugaacgugagucugaccgccaucgccaaccaggccaccgucuuaaugggucucggaaagggguggccgcuauccaagauggacaucgguguuccccugcucgccauugggugcuacagccaggugaaccccauuaccuugacggccgcgcugcuccugcuggucgcgcacuacgccauaaucggccccggacuccaggccaaggccacgcgcgaggcucagaagcgggccgcggccgggauaaugaagaacccaacuguggacggaaucaccgugaucgacuuggaccccaucccauacgacccgaaguucgaaaagcaguuggggcaggucaugcuucugaucuuaugcgugacccaaguguugaugaugcgcaccaccugggcccucugugaagcgcuuacccucgccacgggcccgaucuccacgcugugggaggggaacccuggccgcuuuuggaacaccaccaucgccgucagcauggcgaacaucuuccgcggcuccuaucuggcgggggccggcuuguuauucagcauuaugaagaacacgaccaauacccgccgggguacugguaacaucggcgagacccuaggggaaaaguggaagucccgccucaacgcccugggcaagagugaguuccagauuuacaagaaguccggcauacaggaagucgaccggacucuggcaaaggagggcaucaagcgcggggagacagaccaccaugccgugucucgcggcucggcgaaacuucgcugguucgucgagcggaacauggugacucccgaggguaagguggucgaccugggaugcgggcgcggagguuggucauacuauugcgggggccugaaagacgugagggaagucaagggguuaaccaagggcggccccggacacgaggaaccgauacccauguccacauacggcuggaaccugguccgacugcagagugguguggacguguucuuuacgccucccgagaagugcgauacccuccugugcgauauaggcgagucgucaccaaacccaacaaucgaggccggcaggacccuacguguccucagccucguggaaaacuggcugaacaaugacacccaguuuuguaucaaggugcucaaccccuacaugccaaguguaaucgaaaagauggagacccugcagcggaaguacgggggcgcccuggugagaaacccccugagccggaacuccacccacgagauguauugggugagcaacgcaacggggaacauugucuccuccgucaacaugaucucccgcaugcuaaucaaccgguucaccaugaaacacaagaaagccaccuacgagccugauguugaccucggaucggggacucggaacaucggcaucgaauccgagauccccaaccuggacauaaucggcaagcgcaucgagaagauuaagcaagagcacgagaccagcuggcacuacgaccaggaccacccguacaagacaugggcguaccauggguccuacgagaccaagcaaacgggcagcgccuccaguauggucaacgguguggugagacuccugacgaagcccugggacgucgugcccaugguaacgcagauggcaaugaccgacaccacucccuuugggcagcaacgcgucuucaaggaaaaaguggacacccggacccaagagccgaaggagggcacuaagaaacugaugaagaucacggcagaauggcuguggaaagagcuggggaagaagaaaacgccccggaugugcacccgugaagaguuuacccgcaaggugagaaguaacgccgcuuuaggcgccauuuucacggaugaaaauaaguggaagucagcccgcgaggccguggaggacagucgcuucugggagcucguggacaaggagcgcaaucuacaucuggaagggaagugcgagaccugcguguacaauaugaugggaaagcgggagaagaagcucggggaguuuggaaaggcgaagggcagccgcgcaaucugguauauguggcugggggcgcgcuuccuggaguucgaggcgcuuggcuuccugaacgaggaccacugguucucccgcgagaacagccugaguggggucgagggcgaagggcuccacaaacugggcuacauccugcgggauguguccaagaaggaaggcggggccauguaugcggacgacacagccggcugggacacccgcaucacgcucgaggacuugaagaacgaggagauggucacuaaccacauggaaggggagcauaagaagcuggcugaagccauuuucaagcucaccuaccaaaacaagguagugcggguccagcgccccacgccacggggcacggugauggacaucaucucacgccgggaccagcgcggguccggccaggugggcaccuacgggcugaacaccuuuaccaacauggaggcccagcugauucgccagauggagggcgagggaguauucaagagcauccagcgguugaccgugacagaggagaucgccgugcagaacuggcuggccagagucggucgggagcgccugagucggauggccaucagcggcgacgacugcguggugaaaccguuagaugaccguuucgccucagcgcugaccgcacugaacgauauggggaaggucagaaaggacauccagcaaugggagcccucacgcggcuggaacgacuggacccaggugcccuucugcucccaucacuuccacgagcucauaaugaaggacgggcggguucugguagugccuugccgcaaucaggacgagcugaucggccgggcccguaucagccagggugcuggcuggucacucaaggaaacggcuugcuugggcaaaagcuacgcccaaauguggucccugauguauuuucaccgucgcgacuugcggcuggcggcuaaugcuaucugcagcgcagucccgucgcacugggucccuacgucacgaacuaccugguccauacacgccaagcacgaguggaugaccacggaggauaugcugacuguguggaaccggguuuggauccaggagaacccauggauggaggacaagacacccgucgagagcugggaggagguuccuuacuugggaaagcgcgaggaccaguggugcgguagccugauugggcugacuucaagagccacgugggccaaaaacauccagaccgccaucaaccaggugcgcagccugaucggcaacgaggaguacaccgauuacaugccguccaugaaacgcuuccggcgcgaggaagaggaggccgggguccugugguga

SEQ ID NO: 25407 - RNA, 9876 nt, Artificial Sequence
  derived and/or modified CDS sequence (opt11) from DENV-2__EU482697__SS-prME
agcgccgggaugaucaucaugcugaucccaaccgugauggccuuucaucucaccacucggaacggggagccccacaugaucgucgggauacaagagaagggcaagagccugcuguuuaagaccgaggauggggugaacaugugcacccucauggcgauggaccugggggagcugugcgaggacacgaucaccuacaaaugcccgcuccugcgccagaacgaacccgaggauaucgacugcuggugcaauagcaccuccaccugggugaccuacgggacuugcaccacuacuggcgagcaccgccgggagaagcggagcgucgcucuggucccccauguugggaugggucucgagacccggaccgagaccuggaugucaucggagggcgccuggaagcacgcccagcgcaucgagacauggauccugcggcauccggguuuuacgaucauggcugcuauccuggccuacaccaucgggaccacccacuuccagagaguccucaucuucauccugcugacggccguggccccauccaugaccaugcggugcaucggcaucagcaaccgcgacuucguggagggcguuuccgggggcucguggguggacaucgugcuggaacacgggucuugcgucaccacaauggcgaagaacaagccgacgcuggacuucgagcugaucaaaaccgaggccaaacaacccgccacccuccggaaguacuguauagaggcgaagcugaccaacaccaccacagaaagccgcugcccuacacagggugagcccaguuugaaggaggagcaggacaaaagguuuguaugcaagcacagcaugguggaccguggcugggggaacggcugcggccuuuucggcaaaggagggaucgucacgugcgccauguuuaccugcaaaaagaacauggaaggcaagauugugcagccugagaaccucgaauacaccauuguggugacgccccauuccggcgaggagcacgcggugggaaacgacacggggaagcacggccaggagaucaaggugacgccgcagagcagcauaaccgaagccgagcugaccggguauggcaccgucacgauggagugcucaccccggaccggcuuagauuucaacgagaugguucugcugcagauggagaauaaggcguggcucguccaccgccagugguuccuggaccugcccuugcccuggcuucccggggcggacaagcaagagucgaauuggauucagaaagagacccugguaaccuucaagaacccccacgccaaaaagcaggacguugucgugcucggcagccaggagggggcgaugcacacggcauuaacuggggccaccgagauccagaugucaucggggaauuugcuauucaccggacaccugaaaugucggcugcgcauggacaagcuacaauuaaagggcaugagcuacuccaugugcacagggaaguucaaggucgucaaggagauugccgagacccagcacgguacaauaguaauccggguucaguaugagggugacgguagcccgugcaagauccccuucgagaucauggaccucgagaaacguuacguccucgggcggcugaucacagugaacccgaucgugacggagaaggacucccccgucaauauagaggccgagccucccuucggggacagcuacauaaucaucggcguggagccggggcagcucaagcucaauugguucaagaaaggcucaagcaucgggcagauguucgagaccaccaugcgcggggcgaagaggauggccauccugggcgacacggccugggacuucgggucccugggcggaguguucacuagcaucggcaaagccuuacaccaggucuucggggcgaucuacggcgcggccuucuccggggugagcuggaccaugaagauccugaucggggugaucaucaccuggauaggcaugaacucccggagcaccuccuugagcgugucgcuggugcucguggggaucguuacucuguaccuggguguaauggugcaggccgacucugggugcgucguguccuggaagaacaaggagcucaagugcggcucgggcaucuucaucacugacaacgugcacaccuggacggaacaguacaaguuccagcccgagagcccauccaaacuggccagcgcgauccaaaaggcccaggaggagggcaucugcggaauccgcucggucacucggcuggagaaccucauguggaagcagaucacacccgagcugaaccacauacuggcggagaacgagguaaaacucaccaucaugacuggggacaucaagggcaucaugcaggccgggaagcggucucugcggccgcagccuacagagcugaaguacuccuggaagaccuggggcaaggccaagaugcucagcacagaguccuacaaccagaccuuccucaucgacggucccgagacggcggaaugcccgaacaccaaucgagccuggaacucccuggagguggaggacuacggcuucggagucuucaccaccaacaucuggcugaagcugaaggagaagcaggacgccuucugcgacuccaagcugaugagcgccgccauuaaagacaaccgggcgguccacgccgacaugggguacuggaucgagagugcccucaacgauacauggaaaauugagaaagccucauucauagaagugaaaaacugccauuggccgaagucccauacccucuggucuaacggaguccuggagucugaaaugauaauccccaaaaaccucgcgggcccaguuagccaacacaacuaucgcccgggguaccacacccagaucgcggggcccuggcaccuggguaagcuggagauggacuucgacuucugcgacgggaccaccgucaucgucacggaggauugcggcaaccgcggccccucacuucgaaccaccaccgccagcgggaaguugaucacggaguggugcugccggagcugcacauuaccaccgcuccgcuaucgcggggaggacggcugcugguacggcauggaaauccgccccuugaaggagaaggaggagaaccugguaaauucacucgugaccgccggacauggccaggucgauaacuucagccucggcguguuagguauggcucucuuucuagaggagaugcugcggacccgcguugggacgaagcacgcgauacuccugguugcuguaucauucgugacccucaucaccggcaacauguccuucaaagacuuagggcggguaguggugauggucggcgccaccaugaccgacgacaucggaaugggcgugaccuaucucgcccugcucgccgcauuuaaggugaggccaaccuucgcugccggacugcugcuucggaagcuaaccuccaaggagcugaugaugacgaccaucggcauugucuuguuaagccagucuaccauccccgagaccgugcuugagcucaccgaugcucuggcacugggaaugauggugcucaagaucguccgaaacauggagaaauaccagcuugcugugaccaucauggccauccugugcgucccgaacgccgugauccuccaaaacgcauggaaggugagcugcaccauccuggccgucguguccgugucaccgcugcucuuaaccuccagccagcagaagacagacuggaucccccuggcgcuaacaaucaaggggcuuaaucccaccgccauuuuccuaaccacgcucucucgcaccaacaagaagcguagcuggccgcugaaugaggccaucauggccgucggcauggugucuauucuggcuuccuccuuacugaaaaacgauauccccaugacaggcccccucguggccgggggacuccuaaccgugugcuacgugcugacggggcguagcgccgaucucgagcuggaacgugcuaccgacgugaagugggaggaccaggcagagaucuccggaagcucgccaauuuuguccaucaccaucagcgaggacgggaguaugucaauuaagaacgaggaagaggagcagacacucacgauccugauccgcaccgggcugcucgucaucuccggccuguuccccauaagcaucccaaucaccgcagcagccugguaccugugggaggucaagaagcaacgggccggcguucucugggacguccccagcccgccacccauggggaaggccgaacuugaggacggcgcguaccgcaucaagcagaaaggcauccugggcuauagccagaucggggccgggguguaccgggaggggaccuuccacaccauguggcacguaacccgcggcgccguacugaugcacaaggggaagcggaucgagccuucgugggccgacgugaaaaaggaccuuaucucguacggcggugguuggaagcuagagggugaauggaaggagggggaagaggugcagguccucgcccuggagcccggcaagaacccccgugcggugcagaccaagcccgggcuguucaagaccaacaccggcacgaucggagccgucuccuuggacuucagcccuggcacauccgggagcccuaucaucgacaagaaggggaaggucguagggcuguacgguaacgggguggucacgcgcuccggggcauacgugagcgcgaucgcacagaccgagaaguccauagaggacaaccccgagaucgaggacgacauauuucgcaagcggaggcugacgaucauggaucugcacccuggggcgggcaagaccaagagauaccuccccgccaucguucgcgaggccaucaagcgggggcugcgaacccugauccucgccccgacacgggucguggccgccgagauggaggaggcccugcgcggccugccgauccgguaccaaacucccgccauccgggccgagcacaccgggcgagagaucguugaucucaugugccacgcgaccuucaccaugagacugcucagccccguucgagugccgaacuacaacuugauaaucauggaugaagcgcacuucacggacccggccagcaucgccgccaggggcuacauaucuacacgcguggagaugggggaggcggcugggaucuucaugaccgccacgccacccgguucccgggacccguuuccccaguccaaugcacccaucaucgacgaggagcgagagauccccgagcggagcuggaacuccggucacgagugggucacggacuucaaggggaagaccgugugguucgugccgagcaucaaagccgggaacgacauugcggccugccugcgcaaaaacgguaaaaagguaauccagcugucccguaagaccuucgauagcgaguacgugaaaacccgcacgaacgacugggacuucguggucaccacagacaucuccgagaugggcgccaauuucaaggccgaacgggugaucgacccccgccggugcaugaagccagugaucuuaaccgacggcgaggagagaguuauccuugcgggccccaugccggugacgcauagcuccgccgcccagcggcgcgggcgcaucggccguaacccuaagaacgagaacgaccaguauaucuacaugggggaaccccuggagaaugacgaggacugcgcccacuggaaggaggcuaagaugcuccuggauaauauaaacaccccugagggcaucaucccguccauguucgagcccgagcgggaaaaggucgacgccaucgacggcgaguaccgccuucgcggagaggcgcggaagaccuucgucgaccucaugcggcggggagaccugcccguguggcuggccuacaagguggccgccgaggggaucaauuaugcggaccgccgguggugcuucgauggcaucaagaacaaucagauccuagaggagaacgucgagguggagauuuggacgaaggagggggagcguaaaaagcugaaaccgcgguggcuggaugcccgcaucuacuccgacccccuggcccugaaggaguucaaggaauuugcugccggccggaagucccugacgcucaaccugauaaccgagauggggcgccugcccaccuucaugacccaaaagacgcgggacgcacucgacaaccuggcuguccuccacaccgcggaggccgggggccgcgccuacaaccacgcccuguccgaacugcccgagacucuggagacucuccuucuucucacgcuguuggcaacgguuaccgggggcaucuuccucuuccugaugucaggccgggggaucggcaagaugacccuggguaugugcugcaucaucaccgccucaauccuucugugguacgcacagauccagccgcacuggaucgcggcuucuaucauccuggaguucuuucuaaucgugcugcugaucccggaacccgagaagcagagaacgccgcaggauaaucagcucacuuacgucguaaucgccauacuuaccguggucgcugccaccauggcgaaugagaugggcuuucuagaaaagacgaagaaggaucucgguuuaggaagcaucgccacucagcagccagaaucaaacauccuggacaucgaucuccgucccgccuccgccuggacccuguacgccguagcgaccacguucgucacccccaugcugaggcacucgaucgaaaacagcucugucaacgugagccucaccgcuauugcaaaccaggcaaccgugcugaugggccuggguaaggguuggccccucucaaagauggauauaggggucccgcuacuggccaucggcugcuacagccagguaaaucccaucacacuuacggcggccuugcugcuacugguggcccauuacgccaucauagggcccggucugcaggcgaaggccacgcgggaagcccagaagcgcgccgccgcgggcauaaugaagaaccccaccgucgacggcauuaccgugaucgaccucgauccgaucccguaugaccccaaauuugagaagcaguuaggccaggugaugcugcucauucugugcgucacccaggugcugaugaugcguaccaccugggcccuuugcgaggcccugacccuggccaccggcccuauuuccacccucugggagggcaacccggggcgcuucuggaacaccacaauagccgugagcauggcgaacauauuccggggcuccuaucucgccggcgccgggcuccucuucagcaucaugaaaaacacuacgaacacccgccgcggcacgggaaacaugggcgagacccugggcgaaaaguggaagucacggcugaacgccuugggcaagagcgaguuccagaucuacaaaaagaguggaauccaagaggucgaccggacccucgccaaagaggggaucaagcggggcgagacugaccaccacgcggugagccggggguccgccaagcugcggugguucguggagcgcaacauggucacacccgagggcaaagugguggaccucgguugcgggcggggcggguggaguuauuacugcggcgggcugaagaauguccgcgaagugaaggguuuaaccaagggcgggcccggucacgaggaacccaucccgaugucgaccuacggguggaaucucgugcgauugcagagcggcgucgacguauucuuuauuccacccgagaagugugacacccuguugugcgacauaggggaguccagcccaaacccgacaguggaagcaggaaggacccugcggguccugaaucucguggagaauuggcucaacaauaauacccaguucugcaucaagguucuaaaccccuacaugcccuccgugaucgaaaagauggaggccuuacagcgcaaguacggcggggcccucgugcggaacccccugucucgcaacaguacgcacgagauguacugggucuccaacgccucgggaaacaucgucuccagcgucaacaugaucagucguauguuaaucaaccguuucaccaugcgacacaagaaagccacguaugagccggacgucgaccucggcuccggcacccgcaauaucgggaccgaguccgagaucccuaaccuggacauuaucggcaagcggaucgagaagaucaagcaagaacacgagaccagcuggcauuacgaccaggaccacccuuacaagaccugggcauaccauggcuccuaugagacuaaacagacaggcagcgccucaagcauggucaacggcguggugagacucuugacaaagccgugggacguucugcccaugguuacccaaauggcgaugacagacaccacccccuucggccagcaacggguguuuaaggagaaggucgauacgcggacccaggagcccaaggagggcaccaagaagcugaugaagaucaccgcugaguggcucuggaaggagcugggcaagaagaagacgccucgaaugugcaccagagaggaguucaccaggaagguacgguccaacgcugcccugggggcuaucuucaccgacgagaacaaauggaagucggcgagagaggccguggaggacucccgcuucugggaacucgucgacaaagagcgcaacuuccaccuggagggcaagugugagacuuguguguacaauaugaugggaaagcgggagaagaagcugggcgaguucggcaaggccaagggcucccgcgccauaugguacauguggcuaggcgcccgguuccuggaguuugaggcguuaggguucuuaaaugaggaccacugguuuucacgagagaauagccugaguggcgucgagggggagggccugcacaaacuuggcuauauacugagggacgucagcaagaaggaaggcggugccauguacgccgacgacaccgccgggugggauaccaggaucacacuugaggaccucaagaacgaagagauggugacgaaccauauggagggcgagcacaagaaacuggccgaggcgaucuucaagcugaccuaccaaaacaaggucgugagggugcagcgccccacgccucgagggaccgucauggacauuaucagccgccgggaucaacggggcuccggccagguugggacguacggacucaacaccuucacaaacauggaggcccaacugauccggcagauggagggggaggguguguucaaaaacauccagcaccuuacggucacggaggagguagccgugaagaacuggcucgcccgcgucgggcgcgagcgacuaagcagaauggcgauauccggggacgacugcgucgugaagccccuggaugaccgguucgcuaacgcccucaccgcccugaacgauaugggcaaaaucagaaaggacauccagcagugggagccgagcaaagguuggaacgacuggacucagguccccuuuugcucccaccacuuccacgagcucaucaugaaagacggccgugugcucguggucccgugcaggaaucaggacgagcugauagggcgggcccguauuucgcagggcgcggggugguccuugagggagaccgccugccucggcaagagcuacgcccagauguggucccuuauguacuuccaccgccgggaccugcgacuggccgcuaaugcgaucugcagcgccgugccaucucauuggguacccacgagccggacaacuuggaguauacaugccaaacacgaguggaugaccaccgaggacaugcugacggucuggaaucgcguguggauucgggagaaccccuggauggaggacaaaacccccguggagagcugggaggagauccccuaccucggaaagcgcgaagaccaguggugcgguagucucaucggccugaccagccgggcuaccugggccaaaaacauccaggcggccaucaaucagguccgaaguuugauagguaacgaggaguacacggacuacaugccgagcaugaaacgguuccgccgcgaggaagaagaagccggcguguuaugguaa

SEQ ID NO: 25408 - RNA, 9876 nt, Artificial Sequence
  derived and/or modified CDS sequence (opt11) from DENV-2__EU482699__SS-prME
ucugccggcaugaucaucaugcugauccccaccguaauggccuuccaccucaccacucggaauggggagccacacaugauagucggcauccaggagaaagguaaaucccugcuguucaaaaccgaggacggcgugaacauguguacccucauggcgauggaucugggggagcugugugaggacacuaucaccuacaaaugcccccuccuccggcaaaacgagccagaggacauugacuguugguguaacagcaccagcacgugggugaccuacgggaccugcaccacgaccggcgagcaccgacgagagaagcggucagucgccuugguuccgcacgugggaaugggccucgagacccggaccgaaaccuggauguccagcgagggcgccuggaaacacgcccagcggaucgaaaccuggauacugcggcacccgggcuucacgaucauggcggcgauccuggccuacacgaucgggacuacucacuuccagcgcguccucauuuucauccugcucacggccguugccccguccaugaccaugcggugcauuggcaucucgaaucgcgacuucguggagggcgucuccgggggcaguuggguggacauugugcucgagcacggguccugcgugaccaccauggcgaagaacaagcccacgcuggacuucgagcugaucaagacggaggcuaagcagccggccacgcuccggaaauacuguaucgaggccaagcugacuaauacgacgaccgagucucgcugccccacccagggcgagccaucguugaaggaggagcaggacaaacgguucgugugcaagcacagcaugguggaccgcggaugggggaacggaugcggccuguucgggaagggcgggauagucacgugcgccauguucacgugcaagaaaaacauggagggcaagaucguccagccugagaaccuggaauacaccaucgugguaacgccccacuccggggaggagcacgcugugggcaacgacacggggaagcacgguaaggagauaaaggugacgccucagucuuccaucaccgaggcagagcugaccggguacggcacggucacgauggaaugcagcccccggaccggacucgauuucaaugaaauggugcuguuacagauggaaaacaaagccugguuggugcaucgccaaugguuucucgaccugccccuccccuggcugccgggagccgacaaacaagagucaaacuggauccagaaggagacccuggucaccuuuaagaacccccacgccaagaaacaggacgugguggugcucggcucucaagagggggcuaugcacacggcgcugaccggggccaccgagauccagaugagcuccggaaaccugcuguucaccggccaccugaagugccgccugaggauggacaagcuccaacugaagggcaugaguuacuccaugugcacggggaaguucaaggucgucaaagagaucgccgagacccagcauggcaccaucgugauacgggugcaauacgagggggacggcagccccugcaaaauaccuuucgaaaucauggaccuggagaagcgcuacguucuuggccggcugaucacugugaauccgauugugacggagaaggacucucccgucaacauagaagccgagccgcccuucggggacuccuacaucauuauuggcguggagccgggucagcugaaacucaacugguucaagaagggaaguagcaucggccaaauguuugagaccaccaugcgcggggcuaagagaauggccauacugggcgacaccgccugggacuuugggucccugggcgggguguucacgucuaucggcaaggcccuccaccaggucuucggggcuauuuacggcgcggccuucuccggagugagcuggaccaugaagaucuuaaucggggugauaaucacguggaucggcaugaacaguaggucuaccucacucagcguaucccuggugcucguggggauagucacucuauaccugggcgugaugguccaggccgacagcgggugcgucguguccuggaagaacaaggaguugaagugcggcucuggcauuuuuauuaccgacaacgugcauaccuggacggagcaguacaaauuccagcccgagagcccaagcaagcuggccagcgcgauccagaaggcccaggaggaagggauaugcggcauucgcucagucacgcggcuggagaaccucauguggaagcagaucacgcccgagcugaaccacauacucgccgagaacgaggugaagcucacaauaaugaccggggacaucaaagggaucaugcaagcggggaagcgcagccugcggccgcagcccacggaguugaaguacaguuggaagaccuggggaaaggccaagaugcucucuaccgagagccacaaccagacauuccugaucgacggcccggaaacggcggaguguccgaacaccaaccgcgcguggaacucuuuagagguggaggacuacggguucggggucuucacgaccaacaucugguugcggcuuaaggagaagcaggaugcguucugcgauuccaagcucaugagcgccgcaauaaaggauaaccgcgccguucacgccgacaugggguacuggaucgaaucggccuugaacgacacguggaaaaucgaaaaggccucauuuaucgaggugaagaacugccacuggcccaagucccacacgcuguggucaaacggcguccuggagagcgagaugaucaucccuaagaaucucgccggccccgugagccagcacaacuaccggccgggguaccacacacagaucgcgggccccuggcaccucgggaaguuagagauggauuucgacuucugcgacggcaccaccgugauugucacggaggacugcgggaaccguggacccagucuccgcaccaccaccgccucugggaaguugauaacggagugguguugcagaucgugcacgcuacccccgcugcgguaccgcggggaggacggcugcugguacgggauggagauacgaccccugaaggaaaaggaggaaaauuuagugaacucgcucgugaccgccgggcacggacagguggacaacuucagccuggguauccugggcauggcauuauuccuggaggagaugcugcgcaccagaguggggacaaagcacgcaauacuccuggcugccguuuccuucgucacccugaucacaggcaacaugagcuucaaggaucuuggaagggucauggugauggugggcgcaaccauggccgacgauaucggaaugggcgugacguaccuggcguugcucgcagccuucaaaguccggcccaccuucgcagccggccuucuucuccgccgccugaccucaaaggagcugaugaugaccacgauugggaucguacuauuaucgcaguccaccauaccggaaaccgugcuggagcuuaccgacgcauuggcguuaggcaugaugguccuuaagaucguccggaaaauggagaaguaucaguuggcugugacgauaauggcuauccugugcgucccgaacgcgguuauucugcagaacgcguggaagguaaguugcaccauacuggccgucgugagcgugagcccacugcucuugaccaguagccaacagaagaccgauuggauuccccuggccuuaacgaucaaaggacugaaccccaccgccaucuuccugacaacccuaagccgcacgaacaaaaagcggagcuggccgcugaacgaagcgaucauggccgucggcauggugagcauccuggccagcucccuucugaaaaacgacauucccaugaccggcccccugguggccggcggguuguuaaccgucugcuacgugcugacggggaggagcgccgaccucgagcuggagcgugcgacggacgugaagugggaggaucaagcagagaucagcgggucgucaccaauccuguccaucaccaucucagaggacggauccaugagcaucaagaacgaggaggaggaacagaccuuaaccauccugauccggaccggccugcucgucaucucaggucuguucccgauaucaauccccauuaccgcugccgccugguaccugugggaggugaagaagcagagagcggggguguuaugggacguccccaguccgccacccgugggcaaagccgagcuggaggacggugccuacagaauuaagcagaagggcauccugggguacagccagauuggcgccggcguuuacaaggaaggcaccuuccacaccauguggcacgucaccagaggggccguccucaugcauaaggggaagcgcaucgaacccagcugggcggacgugaagaaggaccugaucucauacggcgggggcuggaagcuggagggcgaguggaaggagggggaggagguucagguucucgcccuggagcccggcaaaaacccccgggcgguccagacgaagccagggcuauuuaagaccaacacgggcacgauaggggcggucucucuagauuucagcccaggcacgaguggcagccccaucauagacaagaaagggaagguggugggacuguacgggaacggcgucgucacccgcucgggcgccuacgugucggcgaucgcccagaccgagaaguccaucgaggacaaccccgagaucgaggacgacauuuuccggaaacggcgacuaacuauaauggaccuccacccuggggccgggaagacgaagcgguacuugcccgcaaucgucagggaggcgaucaagcgcggccuccguacccugauccucgccccgacccgcguaguggcagccgaaauggaagaggcacugcgggggcugcccauccgcuaccagacucccgcgauccgcgccgagcacacggggcgggagaucgucgacuuaaugugccacgcuaccuucaccaugcggcugcucucacccgugcgggugcccaacuacaaccucauaaucauggacgaggcccauuucaccgacccggccuccaucgcggcccgcggcuacaucucuacgcgggucgagaugggcgaggccgccgggaucuucaugaccgccacgccgcccggaagccgcgacccguucccccagaguaaugcucccaucauugacgaggagcgugagauucccgagcgcagcuggaacuccggacaugagugggugaccgacuucaaggggaagacggugugguuugucccgagcaucaaagccgggaacgauauagccgcuugccugcggaagaauggcaagaaggugauccagcugucacgcaagaccuucgauagcgaguaugugaagacccggaccaacgacugggacuucgucgugacgaccgacauuuccgaaaugggcgcgaacuucaaggcagagcgcgugaucgaccccaggcgcugcaugaagccggucauacucacggacggggaggagcgggugaucuuggccggaccgaugccggucacccacagcuccgccgcccagcgcagagggcgcaucggccgaaaucccaaaaacgagaacgaucaguacaucuacaugggggagccccuggagaaugacgaggacugugcgcacuggaaggaggccaagauguugcuggacaacaucaacacgcccgagggcauuauaccgagcauguucgagccagagcgcgagaaggucgacgccaucgacggcgaguaccgccugcgcggggaagcgcgcaagaccuuuguagaccucaugcggcgcggugaccuucccgugugguuagccuacaaggucgccgccgagggaauaaacuacgccgaucggaggugguguuucgacggaaucaagaauaaucagauccucgaggaaaacguggagguggagaucuggaccaagggcggagagaagaagaaacugaagccacguuggcucgacgcccgcaucuacucugacccauuagccuuaaaggaguucaaggaguucgcggcugggcggaagucccuaacccucaaucugauaacggagauggggcgucugcccaccuucaugacccagaagacccgggaugcccucgacaaccuggccguccuacacacggcggaggccggcggccgcgccuacaaccacgcccuauccgaguuacccgaaacgcuggagacccuccuguugcucacucuguuagccacggugacaggggguaucuuccucuuccugaugucgggucggggcaucgggaagaugacucugggcauguguuguaucaucacagcguccauccuccugugguacgcccagauccagccgcacuggaucgcggccagcaucauccuggaguuuuuccucaucguccugcugauacccgaaccagagaaacaacguacaccccaggacaaccagcucacuuacguggugaucgccauucugaccgugguggccgcuaccauggccaacgagaugggauuccuggagaagaccaagaaagaccucggccuaggaucaaucgccacgcagcagccggaaagcaacauccuggacaucgaccuacggccggcauccgcguggacacuauaugcuguggccaccaccuucgucacgccgaugcugaggcacagcaucgaaaacagcuccgugaacgugucauugaccgccaucgccaaucaggcuaccguccuaauggggcugggcaagggcuggcccuuguccaagauggacauaggcguuccgcugcuggcaaucgggugcuacagccagguaaaccccaucacauugacggcagcccugcugcuccuggucgcgcacuacgcaaucaucggccccggccugcaggccaaagcaacacgggaggcccagaagcgagcggccgccgggaucaugaagaaccccacuguggacggcaucacugugaucgaccucgacccgaucccuuacgacccaaaguuugagaagcagcugggccaagucaugcuucugauccugugcguuacacaggugcugaugaugcggacgacuugggcacucugugaggcccugacucuggcgacgggacccaucuccacucucugggaagggaacccaggccguuucuggaacaccaccaucgcagucucaauggccaacaucuuccgaggcuccuaccuggccggggccggccucuuauucagcauuaugaagaacaccaccaauacccgucgugguaccgggaauaugggcgagacgcugggggagaaguggaaaucccgacugaacgcucucggcaagagcgaguuccagaucuacaagaaguccgggauccaagagguugaucgcacauuagccaaggaggggaucaagcgcggggagaccgaccaccacgcugugagccgcggcucagccaagcugcggugguucguagagagaaauaugguaacuccugaaggcaagguggucgaccuggggugcggacgcggcgguuggaguuacuauugugggggccugaagaacguacgcgaggugaaaggccugacgaaaggagggcccgggcacgaggagcccaucccgauguccacauacggauggaaccucgucaggcugcagagcgggguggacguguucuuuaucccgcccgaaaagugcgacacccugcugugcgacaucggcgaguccagccccaacccaaccgucgaggcgggacguacccugagagugcugaaccuugucgagaacuggcugaacaacaacacucaguucugcauaaaagucuuaaaccccuacaugcccuccgugauagagaaaauggaagcccugcagcgcaaguauggaggcgcgcucgugcggaacccccugucacgcaacagcacccaugagauguacugggucucaaacgccagcggaaacauuguguccagcguaaauaugaucucccggaugcugaucaaccgcuucacgaugcgacacaagaaggccaccuacgagcccgacguugaccucgggagugggacgcguaacaucggcaucgaaucugagaucccaaaccuagacaucaucggcaagcggauagagaagauuaagcaggaacaugagacaagcuggcacuaugaccaggaucaccccuacaagacuugggcauaucauggguccuacgagaccaagcagacaggcagcgcaucuagcauggugaacggggugguccgucugcugaccaagccgugggacgugcugcccaccguuacccaaauggcuaugaccgauaccacacccuucggccagcagcgcgucuuuaaagagaagguggacacucggacucaggaacccaaggaggguaccaagaagcugaugaagaucaccgccgaguggcucuggaaggagcuggggaagaagaagacaccccguaugugcacgcgggaggaguucacccgcaaggugcggucuaaugccgcucugggugccaucuucaccgacgagaacaaauggaagucagcgcgugaggccguugaagauucccgguucugggagcucguugacaaggaacggaaucugcaucuggaggggaaaugcgagacaugcguguauaacaugaugggcaagcgggagaagaaguuaggggaguucgggaaagccaagggaagccgcgcgaucugguauaugugguuaggggcacgguuccuggaguucgaggcacucggcuuccugaacgaggaccacugguucagucgggagaacagccuguccggggucgagggcgaagggcuccacaagcugggcuacauccuucgggacgugagcaagaaggagggaggggccauguacgcggacgacacggccgguugggacacacgcaucacccucgaggaccucaaaaaugaggagauggucacgaaccacauggagggugagcacaaaaagcuggccgaggcuaucuucaaacucaccuaccagaacaaggucguacggguccagcgacccacgccucggggcaccgugauggacaucaucagccgccgagaccagcgugggucuggacagguaggcacauaugggcuuaacacguucaccaacauggaggcacaacugauccgccagauggagggcgagggugucuucaaaaacauucagcaccucaccgugaccgaggagguggcaguccagaauuggcuggcccgcgugggccgcgagagguuaagccgcauggcgaucagcggcgacgacugcguggucaaaccacucgacgaccgcuuugccaacgccuuaacggcgcugaacgauaugggaaagauccgcaaggacauccaacagugggagccgagcaagggcuggaacgacuggacacaggugcccuucugcagccaucacuuccacgagcucauuaugaaggauggucgggugcucguagucccgugucgcaaccaggacgagcugaucggacgcgcccgcauuagccagggagccggcugguccuugcgcgagaccgccugccuggguaaaaguuacgcccaaauguggucccucauguacuuccaccgccgggaucuccgauuggcugcgaacgccaucugcagugcggugcccucccacugggucccgaccagccggacgaccugguccauccaugccaaacaugaguggaugacaacagaggacaugcugacuguguggaaccgcguguggauucgggagaaccccuggauggaagacaagaccccugucgagagcugggaggagauccccuaccucgggaagagggaggaccagugguguggcucccuaauuggccugacgagccgggcaaccugggccaaaaauauccaggcugccauuaaccaagugaggucccuaaucggcaacgaggaguacaccgacuacaugccgagcaugaagcgguuccgccgggaggaggaggaggcgggcgugcuuugguga

SEQ ID NO: 25409 - RNA, 9876 nt, Artificial Sequence
  derived and/or modified CDS sequence (opt11) from DENV-2__EU482701__SS-prME
agcgccgggaugaucaucauguugauuccgacggugauggcauuccaccuuaccacccggaauggggagccacacaugaucguuggaauccaagagaagggcaagagccugcuuuucaagaccgaagacggagugaauauguguacccucauggcuauggaccugggggaacugugcgaagacaccauaaccuacaagugcccccuccugaagcagaacgaacccgaggacaucgacugcuggugcaacucaaccuccaccugggugaccuacgggaccuguaccacuaccggcgaacaccgacgcgagaagcggaguguggcccuggugccgcacgugggcaugggccuagagacccgcaccgaaacauggaugucuagcgagggggccuggaagcacgcccagcggauagagacguggauccugcgccacccgggcuuuacgaucauggccgccauucuagcguacaccaucgggacuacccacuuccagcgggugcucauuuucauccuauuaacggccguggcccccuccaugaccaugcgcugcaucggcaucuccaaccgugacuucguagagggggucuccggggguagcuggguggacaucgugcuggagcacgggucuugcgucaccaccauggcgaagaauaagcccacccuugacuucgagcugaucaagaccgaagccaagcagccggcaacgcuccgcaaguacugcaucgaggccaaguuaacuaacacgacuaccgagagccggugccccacccaaggcgagcccucccugaaggaggagcaggauaagcgguuuguguguaagcacaguaugguugaccggggcuggggaaacgggugcggccuguucggcaaaggcgggaucgucacgugugccauguuuaccugcaagaagaauauggaaggcaagauaguacagcccgagaaucuggaguacaccaucguggucacgccccacuccggggaggaacacgcaguagggaacgacacggggaagcacggcaaagagaucaagguuaccccgcagagcuccauaaccgaggccgaguuaacgggguacggcaccgucacgauggagugcagcccacgcacgggacuugauuucaaugagaugguacugcuucagauggagaauaaggccuggcucgugcaccggcagugguuccuggaccucccccucccuuggcuucccggugcggacaagcaggaguccaacuggauccaaaaagagacccuugucaccuucaagaacccgcacgcaaaaaagcaggacguagucgugcuagggucgcaggagggugccaugcacgccgcccuuacgggcgccaccgagauccagaugagcucugggaaccuccucuucaccgggcaucugaagugccgccugcguauggacaagcuccagcugaagggcaugucuuauuccaugugcacggggaaauucaaggugguaaaggaaauugcggagacccagcacggcaccaucgugauucgcguccaguaugagggggacggcagccccugcaagauacccuucgagauaauggaccuagagaaacgguauguccucggccgccuuauaacugugaacccgaucguuacagagaaggacuccccagucaauaucgaggccgaaccgcccuucggugacagcuacaucaucauuggcguggagccggggcagcugaaacuaaacugguucaagaagggcuccagcauagggcaaauguucgagacgacgaugcggggagccaaacgaauggccauccugggcgacaccgccugggauuuugggagucugggcggcguuuucaccagcauuggcaaggcccugcaucaggucuucggggccaucuauggcgcagccuucagcggcguuagcuggacuaugaagauccugaucgggguuaucaucaccuggauuggcaugaacaguagaagcaccagucugagcgucucccugguccuaguugggauuguuacccuguaucugggcgugaugguccaggccgacagcgggugugucguguccuggaagaacaaagagcucaagugcggcaguggcaucuucaucacggacaacgugcacaccuggacugagcaguacaaguuccagcccgagucucccuccaagcuggcgagcgccauccagaaggcucaagaagaggggaucugcggcauucgguccguaacucgccuggaaaacuuaauguggaagcagaucacgccggaacugaaccauauacuugccgagaacgaagugaagcuaacuaucaugaccggagauauaaaggggaucaugcaggccgggaaacggucacugcgcccgcagcccaccgagcugaaauacuccuggaaaacuuggggcaaggcgaagaugcucagcaccgagucccacaaccaaacuuuuuuaauugacggccccgaaaccgccgaaugcccgaacacgaaucgcgccuggaacucacuggagguggaggauuacggauuuggcgucuucaccacuaauaucugguuacgccucaaggagaaacaggacgcauucugcgacucaaagcugaugagcgcugcagugaaggauaaccgggccguucacgcagacaugggguacuggaucgaguccgcccucaacgacacuuggaagauagagaaggccucuuucaucgagguuaagaacugccacuggccgaaaucccacacgcuguggagcaauggcgugcuggaguccgagaugguaauacccaagaaccucgcgggccccgucagccagcacaauuacaggccggguuaccauacgcagauugcaggccccuggcaccuuggaaagcuugagauggacuucgacuucugcgacggcaccaccguaaucgugaccgaggacuguggcaaccgaggcccaucauugcgaacuaccaccgccagcggcaaacugauaaccgaaugguguugccguagcugcacgcugcccccgcucagguaccgcggggaggacggcugcugguacgggauggagauccggccccugaaggagaaagaggagaacuuagucaacagucuagugaccgccgggcacggccagguggacaauuucagccuaggcauucugggcauggcgcucuuccuggaggagaugcugcgaacccgcguagguacgaagcacgccauccuacugguggccguuuccuucgucacgcugaucaccggcaacaugagcuucaaggaccuugggcgggugguggucauggugggagccaccauggccgaugacauaggaaugggaguaaccuaccuggcgcugcucgccgccuucaaaguccgucccacguucgcggccggucugcugcuccgaaagcuuaccucaaaggaguuaaugaugacuaccauuggggugguguuacuaucgcagucaacgauccccgacaccguccuagagcucacagacgcuuuagcccuaggcaugauggugcucaagaucguccgcaauauggagaaguaccagcuggccgugacuaucauggcaauccugugugugccaaacgccguuaucuuacagaacgcuuggaagguuagcuguacgauccucgcggucguuuccgugaguccgcugcuacugacgagcagccagcagaagacggacuggaucccccuugcgcucaccaucaaggggcucaaccccacggccaucuuccugacaacccucucccgaaccaacaagaagcggagcuggccgcugaacgaggccauuauggccgugggcauggucuccaucuuggcgagcucccuccugaaaaacgacauaccuaugacgggcccccugguggccgggggccuucugaccguguguuacguacugaccggucggagcgccgaucucgagcuggagcgggcgaccgaugugaagugggaggaccaggccgaaaucuccgggagcucgcccauauuguccaucacgauaagcgaagauggguccaugagcauaaagaacgaagaagaagagcagacccucacaauccuaauacggacggggcuguuagugaucuccggucuguuuccgaucaguauccccauaacagccgcagccugguaccugugggaggucaagaagcaaagggcaggggugcuuugggacgugcccagcccgccgccgaugggcaaggccgaacuggaggacggggccuaccggaucaagcagaagggcauccugggguacagccaaauaggcgccggcguguacaaggaggggacuuuccacaccauguggcacgugaccagaggugccgugcucaugcacaaggggaaaaggaucgagcccuccugggcggacgucaagaaggaccuuauaaguuauggcgggggauggaaguuagagggcgaguggaaagagggggaagaaguccaggugcuugcccuggagcccgggaagaacccccgugccgugcagacaaagcccggucuguucaagacgaacacgggcacuaucggugcagugucccucgacuucucacccggaacauccgggagccccaucaucgacaagaaggggaaaguggucgggcuguacgggaauggcgucgucacgcgcuccggagccuacgucuccgcgauugcccagaccgagaaguccaucgaggacaacccagagaucgaggacgacaucuuccgcaagcgccggcugacuaucauggaccugcaucccggagcuggcaagaccaagcgcuaccuccccgccaucgugcgagaggcgauaaaacgcgggcugaggacccugauccuggccccgacccgcguaguagcagccgagauggaggaggcucuaagaggccugccaauccgcuaccagacacccgcgauucgggcugagcacacggggcgcgagaucguggaccucaugugccaugccacguucaccaugcgacuguuaagccccguaagagucccgaacuauaaccuuaucaucauggacgaggcccacuucaccgaucccgccucaaucgcggcuagaggcuacaucagcacccggguggagaugggcgaagcagccgggaucuucaugacggcuacaccgcccgguagccgcgacccguucccccaaagcaacgcgcccaucaucgaugaggagcgggagauaccggagcgcucuuggaacucagggcacgaguggguuaccgacuucaaggguaagaccgugugguucgucccaagcaucaaagcugggaacgacauagccgcaugccuacggaaaaacgggaagaagguaauccagcugagccgcaagacuuucgacagugaguacguuaagacgcggaccaacgacugggacuucgucgugaccacggacauauccgagaugggggcgaauuucaaagccgagcgugucaucgacccccgacgaugcaugaaacccgugauccucaccgauggggaagagcgggugauacuggcaggccccaugccgguuacacauuccuccgcagcccagcgccgggggagaauaggcaggaaccccaagaacgagaacgaccaguacaucuacaugggcgagccccuggaaaaugacgaggacugcgcgcacuggaaggaggccaagauguuacuggacaacauuaacacucccgaagguaucaucccgucuauguucgagccagagcgcgagaagguagacgcaaucgauggcgaguacaggcugagaggggaggcccgcaagacuuucguggaccucaugaggcguggcgaccuccccgucuggcuggccuacaagguggcggccgaaggcaucaacuaugccgaccgacgcuggugcuuugacggcaucaagaacaaccagauccucgaggagaaugucgagguggaaaucuggaccaaggaaggggagaggaaaaaguuaaagccccgauggcucgacgcccguaucuacagugacccacuugcuuuaaaggaauucaaggaguucgcggccggacgcaagagucugacccucaaccuaaucaccgagaugggucgauuaccaacguuuaugacucaaaagacgcgcgacgcgcucgacaaucuggcagugcuacauaccgccgaagcagggggccgggccuacaaucacgcccucuccgagcugcccgagacgcuggaaacucuccugcugcucacccugcuggcgacggucaccggcggcaucuuccucuuccugaugucagggagagggaucggaaagaugacgcuagggaugugcugcaucauaaccgcauccauccuucuuugguacgcccaaauccagccgcauuggaucgccgcuucaaucauacuggaauucuuccucauaguacuguuaauacccgagcccgagaagcagcggacgccccaggacaaccagcucaccuauguggucaucgcuauccugacugugguggcugcuacgauggccaacgagaugggcuuccuagagaaaaccaagaaagaccucgggcuggggucgaucgcgacacagcagccggaguccaacauccucgauauugacuugcgcccggcuuccgcauggacccuguacgccgucgccaccaccuucgugacccccaugcugcggcauucuaucgagaacagcuccguaaaugucagccucacggcgaucgccaaccaggcgaccguacugaugggccuagggaagggcuggccccuauccaagauggacaucggugugccacuccuugccaucggcugcuacucccaagugaacccgaucacgcucaccgccgccuuauugcuccugguggcgcauuacgccaucauagggcccggccugcaggccaaggcuacgcgcgaggcccagaagcgggcggcugccggcaucaugaagaaccccacaguagacgggauuaccgucauagaccucgacccgauccccuacgaccccaaguucgaaaaacagcuaggccaggugauguuacucaucuuaugcgugacccaggugcugaugaugcgcacuaccugggcccucugcgaagcccuaacccuggcgaccgggccuauauccacacucugggagggcaacccaggacgauuuuggaacacaaccaucgccgucagcauggccaacaucuuccgcggaaguuaucuggcaggcgccggacuccucuucagcauaaugaagaacaccacgaacacccggcgggggaccgggaacaugggugagacccugggugagaaguggaaaucccgacugaacgcucuggguaagucugaguuccagauauauaagaaguccggcauucaggaaguggaucggacgcuggcaaaggagggcaucaaacgcggcgagacagaccaccacgcagucagccggggcuccgccaaacuccgcugguucguggagaggaauaugguaaccccugagggcaagguaguggaccucgggugugggcgcgggggguggagcuacuacugcggcgggcucaaaaauguacgagaggucaagggccugacuaagggcgggccuggccacgaggagccgaucccgaugaguacauacggguggaaccucguccggcugcagagcggaguggacgucuucuucauuccgccggagaagugcgacacccugcuaugugacaucggggagucuucucccaacccuaccguggaggcgggccggacccuccgcgugcugaaccucgucgagaacuggcugaacaacaauacucaguucugcaucaaggugcugaaucccuacaugcccuccgugauagagaagauggaggcucugcagcggaaguacggcggggccuuaguuagaaacccgcugagcagaaacagcacucacgagauguacugggugaguaacgccagcggcaacaucguaucuagcgugaauaugaucagucgcaugcugaucaauagguucacgaugcgccacaaaaaggccacauacgaacccgacguggaccucgggagcgggacccggaacauugggaucgaguccgagauccccaaccucgacaucaucggcaagaggaucgagaagaucaaacaggagcacgagacgagcuggcauuacgaccaggaccaucccuacaaaaccugggcguaccacggcuccuacgagaccaagcaaaccgguagugcuuccagcauggugaacggcgucguccgguuacucacgaagccgugggacgugcugcccacggucacccagauggcaaugacugacacgacgccauucgggcagcagcgagucuucaaggaaaagguggauacucgcacccaggagcccaaggagggcacgaaaaaguugaugaagaucacugcggaguggcucuggaaggagcuaggcaagaagaaaaccccaagaaugugcacccgugaggaguuuacgcggaagguacgcucgaacgcggcgcuaggggcgaucuuuacagacgagaacaaguggaaguccgcgcgcgaggccgucgaggacucccgcuucugggagcucgucgacaaagagcggaaccugcaccuggagggcaagugcgagaccugcgucuauaacaugaugggaaagcgcgaaaagaagcucggcgaguucgggaaggcgaaggguucccgggcgauaugguacauguggcuuggggcgcgcuuccuggaguucgaggcccuuggguuucuuaacgaggaucacugguuuucucgggaaaauagccugucgggcgucgagggcgagggccuacacaagcuuggcuacauccugcgcgacguuucgaagaaggagggcggugccauguacgcagacgacacggccgggugggacacacgaaucaccuuggaggaccugaagaacgaggagauggugacgaaccacauggagggcgagcacaagaagcuggccgaggccauauucaagcucaccuaucagaacaaagugguccgagugcagcggcccacgccccgcgggaccgugauggauaucaucagccggcgggaucagcgaggcuccggucaagucggcacguacggccugaauaccuucacgaacauggaggcgcagcugaucaggcagauggagggggagggcguguucaagaacauccagcaccucaccgugaccgaggaggucgcggugcagaacuggcuggcgcgggugggccgcgagcgcuuaagccggauggccaucuccggagacgacugcgucgugaagccguuggacgacagguucgccaacgcgcugacagcguuaaacgacaugggcaagauccguaaggauauccagcagugggaaccgagcaagggauggaacgacuggacgcaagucccuuucuguucacaucauuuucacgagcucauaaugaaggacggccgcguccuuguggugccuugccguaaccaggacgagcugaucgggcgggcccggaucagccaaggcgccggguggucgcuucgcgaaaccgccugucugggcaagucguacgcccaaauguggagccugauguacuuccaccgucgcgaccuccgccuggcggcaaacgccaucugcucggcggucccaucccacugggugccgacaagccguaccacgugguccauccacgccaagcacgaauggaugaccaccgaggacaugcugaccguguggaaccggguuuggauucgcgagaaccccuggauggaggacaagacacccguggagaguugggaggagauccccuaccucggcaagcgggaggaucaguggugcggguccuuaaucggccuaacgucgcgcgccaccugggccaagaacauacaggcagccauuaaccaggugcgaagccugauagggaaugaggaguacacggauuacaugccgagcaugaaaagguucagacgcgaggaggaggaggcugggguacucugguga

SEQ ID NO: 25410 - RNA, 9876 nt, Artificial Sequence
  derived and/or modified CDS sequence (opt11) from DENV-2__EU482703__SS-prME
ucggccggaaugauaaucaugcugaucccaaccgugauggccuuccaccugaccacccggaacggcgaaccucacaugauaguggguauucaggaaaagggcaagagccuucuauucaagacggaggauggcguuaacaugugcacgcucauggcgauggaucuuggggaacugugcgaggacacaaucaccuacaaaugcccgcugcuccgucagaacgagcccgaggacaucgacugcuggugcaacagcaccagcacgugggugacguacgggaccugcacaacuacgggcgagcacaggagggagaagaggagcguagcccucgugccccacgugggcaugggccuggaaacgcgcaccgaaaccuggaugagcagcgagggggccuggaagcacgcgcagcggaucgagaccuggauccugcgacacccgggcuuuacgaucauggcggcuauccuggcauacaccaucgggaccacucacuuccagcgcguccucaucuucauccuuuuaacggccguagcaccuagcaugaccaugcggugcaucggcaucucuaaccgcgacuucguggagggugucuccggcggcagcuggguggacaucguguuagagcaugggucaugcguuacaacaauggcaaagaacaagcccacguuggacuuugaacugauaaagacggaggccaagcaacccgccaccuugagaaaguacugcaucgaggccaaacuuacgaauaccaccacugaaucgcgcugucccacccaaggugaaccuucccugaaggaggagcaggacaagcgguucgugugcaaacacagcaugguggaccgcggcugggggaacgggugcggccuguucggcaaaggcgggaucgucacgugcgccauguucacgugcaagaagaacauggaggggaagauuguccagcccgagaaccuggaauacacuauuguggucacgccccacuccggggaggagcacgcuguaggcaacgacacugggaagcacggcaaggagaucaaggugaccccacaguccucuaucaccgaggccgagcugaccggauacgguacggucacgauggagugcucgccgcgcaccgggcuugacuucaacgagauggugcugcuucagauggagaacaaggccuggcucgugcaucgccagugguuccuagauuugccgcuccccuggcucccgggggccgacaagcaggaaaguaacuggauacagaaggagaccuuaguaacguuuaaaaauccccacgccaagaagcaagacguggucgugcucggcagccaggagggagcuaugcacacggcuuugaccggcgcaaccgagauccagaugaguucggggaaccucuuauucacuggccaccugaagugcagacugaggauggacaagcuccagcugaaagguaugucuuacucgaugugcacggggaaguucaagguugucaaagagaucgccgagacccagcacggaaccaucguuauccggguccaguacgagggggacggcagcccauguaaaauccccuucgagaucauggacuuggagaagcgcuacguacugggucgguugaucaccgucaacccgauugugacggaaaaggacucucccguaaacaucgaggccgagccgcccuuuggcgauaguuauaucaucauuggagucgagccgggucagcucaaacucaacugguucaagaaaggcuccucaauagggcagauguucgaaacaaccaugcgcggcgcuaagcgcauggcgauacugggcgauaccgcaugggacuuugggucgcugggcggaguguucacgucuaucggcaaagcccuccaccagguauucggagcuaucuacggcgcugccuucucaggcgugagcuggaccaugaagaucuugaucggggugaucaucaccuggaucggcaugaacucgcggaguaccucccugagcgucucccuggugcuuguuggcaucguuacguuguaccuaggcguuauggugcaggcugacucugggugcgucguguccuggaagaacaaagagcucaagugcgggucgggcauauucaucaccgacaacgugcacaccuggaccgagcaguacaaguuccagcccgaaagcccguccaaacuggccagcgccauccagaaggcccaagaggaagggauauguggaauacgguccgugacgcgcuuggagaaccucauguggaaacagaucacgcccgaauugaaccacauucuggccgagaacgaagugaaacuuacuauaaugacuggugacaucaagggcauuaugcaggcagguaaacgcagccuacggccccaacccacggagcugaaguacuccuggaagaccuggggcaaggccaagaugcucuccaccgagucuuacaaucagaccuucuuaaucgacggcccggagacggcggaguguccgaacacaaaccgcgccuggaacagccuggagguggaggacuacggauuuggugucuucaccaccaauaucuggcugaaguuaaaggaaaagcaggacgccuucugcgacaguaaguuaaugagcgccgccaucaaagacaaccgggcagugcacgccgacaugggguauuggaucgaguccgcucucaacgacacguggaagaucgagaaggcgagcuucaucgaggugaagaacugucacuggccgaagucgcacaccuugugguccaacgguguccuggaguccgagaugaucauccccaaaaaccucgccgggcccgugagccaacacaacuaccgcccgggguaccacacccaaauagcggggcccuggcaccugggaaagcuggagauggacuucgacuucugcgacgggacgaccgugauagucaccgaggacugcgggaaccggggucccucacuacgcacuaccaccgccucggggaaauuaauuaccgaguggugcugccggagcuguacccugccaccccuacgcuaccgcggggaagacggcugcugguacgggauggagauccggccccugaaagagaaggaggagaaucuggugaacucucucguaaccgccggacacgggcagguugacaacuucagcuuaggcgugcugggcauggcccucuuccuugaggagaugcuccggacccgggugggcacgaaacacgcgauccucuuagucgcagugaguuucguaacccugauuacaggcaauaugucauucaaggauuuaggucgggucgucgugauggucggggccacuauggccgacgacaucgggaugggcgugacuuaucuggccuuauuggcggccuucaaggugcgccccacuuuugcugccggccugcugcuccggaagcugacguccaaagaacugaugaugaccacgaucgggaucguccuccugagccagucaaccaucccagaaaccgugcuggaacucaccgacgcccuggcacuuggaaugaugguucucaagaucguccgcaacauggaaaaguaucaacuggccgugacgaucauggccauucucugcgucccuaaugccgugauauuacagaacgccuggaaagucgggugcaccauccuggcggucgugagcgugagcccacuccuccucaccagcucccagcagaagaccgacuggauaccgcuagcccucacgauaaagggccugaacccaaccgccauuuuccucaccacacucucccguacgaacaagaagcgguccuggccgcucaaugaggccaucauggcggucggcauggugagcauccuggccaguagcuuauugaagaacgacauucccaugaccgguccccuuguugccggagggcuucugaccgucugcuauguccugacgggccgcuccgcggaucucgagcuggagcgggccacggacgugaaaugggaagaccaagcggaaaucagcggauccagcccaauccugagcaucaccaucucugaggacggcagcaugaguaucaagaacgaggaggaggaacagacgcucaccauccugauccgcaccggccugcucgucauuagcggucuguucccgaucuccauccccaucaccgccgcugccugguaccugugggaggugaagaagcagagggccggugugcuuugggacguccccuccccgccaccaaugggcaaggcggagcuggaagauggcgcauacagaaucaagcagaaggggauccugggcuacucccagauaggcgcgggaguguacaaggagggcacuuuucacacgauguggcacguuacccgcggggccguccuuaugcacaaaggaaaaagaaucgagcccagcugggcugacguuaagaaggaccugaucuccuacgggggaggcuggaaacuggagggggaguggaaggagggugaggagguacagguccucgcucucgagccugggaaaaacccccgggccguccagacaaaacccggccuauuuaaaacaaacaccggcaccaucggggccgugagccucgacuucuccccgggcacgagugggucccccauuaucgacaaaaagggaaaagucguaggacuguacggcaacggcgucgucacccgcaguggcgccuacguguccgcgaucgcgcagacagaaaagaguaucgaggauaaccccgagaucgaggacgacaucuuccggaagcggaggcuuacuaucauggacuuacaccccggagccgguaagacgaagcguuaucuacccgccaucgugcgggaggccauuaagagaggacugagaacccugauccuugcgccgacccgcguaguggccgccgaaauggaggaggcacugcgugggcugcccauccgcuaucagacgcccgccauccgggcggagcacacgggccgcgaaaucgucgaccucaugugccacgccaccuuuaccaugcgccugcugaguccugugcgggucccuaacuacaauuugaucaucauggacgaggcucacuucaccgacccagccagcaucgccgcacggggauacaucuccacgagagucgagaugggggaagcagccggcauauucaugaccgcgacgccgcccggaagccgcgacccguucccccagucaaaugccccgaucauugacgaggaaagagagauccccgagcgcuccuggaacagcggccaugaguggguuacugacuucaagggaaaaacggugugguucgugccgagcaucaaggccggcaacgacaucgccgccugccugcguaagaauggcaagaagguaauccagcugagccgcaaaaccuuugacuccgaauacgucaagacccggacuaacgauugggauuucguagucaccaccgacaucucugagaugggggccaacuucaaggccgaacgcgugaucgacccccggcgcugcaugaagccuguuauccucaccgacggagaggaacgggucauccuggcagggccaaugccggugacucacuccagcgccgcgcagcgccgcggcagaaucgggcgaaaccccaagaacgaaaacgaccaguacauauacaugggggaaccccuggagaacgacgaagauugcgcccacuggaaagaggcgaagaugcuguuagauaauaucaacacgcccgagggcaucaucccuuccauguuugagcccgagcgcgagaagguggacgccaucgacggggaguaccgccugcgcggcgaggcgaggaaaacguucgucgauuuaaugcggcgcggggaccuacccguguggcuggcuuacaaaguggccgcggaggguauuaacuacgccgaccggcgcuggugcuucgauggcaucaaaaacaaccagauccucgaggagaacgucgagguggaaauuuggaccaaggagggcgagaggaagaaguuaaagccgcgcuggcuggaugcccggaucuacagugaucccuuagcgcugaaggaguucaaagaguucgcggcaggccggaaaucccugacucuuaaccugaucacggagaugggucggcugcccaccuucaugacccagaagacucgcgacgcccucgauaaccuagccguccugcauacggcugaggcgggcgggcgagccuacaaucacgcacucucagagcugcccgagacacuggagacccuucugcugcucacccugcuggccacggugaccggcggcaucuuccuguuccugaugucaggacguggcaucgggaagaugacccugggcaugugcugcauuaucaccgccagcauuuuacugugguacgcgcagauccagccgcacuggaucgccgccucgauuauacuggaguucuuccucauuguucugcucauuccagagcccgagaagcagcggacgccccaagacaaccagcuaacguacguagugaucgccauccugaccgugguugccgcgaccauggccaacgaaaugggguuccuugaaaagaccaagaaggaucucggccugggcagcauagccacgcagcagccggaguccaacauacuggacaucgaccuccgccccgcgucugccuggacgcuguaugccguggccacaaccuucgugacaccuaugcugcggcauuccaucgaaaauucuagcgucaacgucuccuuaaccgcgaucgccaaccaggccaccgugcugaugggguuaggcaagggguggccucucagcaaaauggacaucggcguuccacugcuggcaaucgggugcuacagccaagugaaccccaucacccucacugccgccuugcugcuccuggucgcccacuacgcgaucaucggacccggcuuacaggcuaaggccacucgcgaagcccagaaacgggcugcggccggcaucaugaaaaaccccaccgucgauggaauaaccgugauagaccucgauccgauccccuacgacccgaaguucgagaagcaguuaggccaggugaugcuucucauccugugugucacucagguucugaugaugcgcacuaccugggcacucugcgaagcccucacccuggccacgggucccaucucaacccucugggaggggaauccaggccgguucuggaacaccaccauagcgguuuccauggccaauaucuuccgcggcagcuacuuagcgggggccggccuccucuucuccauaaugaagaauacgaccaacacccggcgcgggacagggaauaugggagagacgcugggggagaaguggaagucccgccugaacgcccucggcaaauccgaguuccagaucuacaaacggucugggauccaggaagucgaccgcacccuggcgaaagagggcaucaagcguggggagacugaccaccaugcaguaucccgcggcagcgccaaacuucgaugguucgucgagcgcaauauggucaccccggaaggcaaggugguggacuuaggauguggcaggggaggcugguccuacuauugcgggggccugaagaacguccgcgaagucaagggccugacgaaaggcgggcccggccacgaggagcccauuccgaugagcaccuacgguuggaacuuggugcggcuucagagugggguggauguguucuucaucccucccgagaagugcgauaccuugcucugcgacaucggcgagagcagcccuaacccgaccguggaggccggccguacacuucguguccugaacuugguggagaacugguugaacaauaauacccaguucugcauuaaggugcuuaaccccuauaugccuagcgucauugagaagauggaggcgcugcagagaaaguacggaggggcucuagugcggaacccguugucuagaaauucuacucacgagauguacugggugagcaaugccuccgggaacauuguuagcuccgucaauaugaucucucgcaugcugauaaaccgcuucaccaugcgucauaaaaaggccaccuaugagccugacguagaccuuggcagcgggacgcgcaacauaggaaucgagucagagauacccaaccucgacaucaucggcaagcggaucgagaagaucaagcaggagcacgagaccuccuggcacuacgaccaggaccaccccuacaagaccugggccuaccacgguagcuacgaaaccaaacaaacgggcuccgcgagcaguauggucaacggggucguacgccugcuuaccaagccgugggacgugcugcccacggugacgcagauggccaugacggacacaacccccuucggccagcaacgaguguucaaggagaaggucgacacccggacucaggagccuaaggagggcaccaagaagcugaugaagaucaccgcugaguggcucuggaaggagcucggcaagaaaaagacaccccgcaugugcacuagagaagaguucacgaagaaagugcgcagcaacgccgcucugggugcgaucuucaccgacgagaacaaguggaaguccgcucgagaggccguggaggacagccgcuucugggagcucguggacaaagagcgaaaccuccaucuggaagguaagugcgagaccugcguguauaacaugauggggaagcgcgagaagaaacucggggaguuuggaaaggcaaagggaucacgcgcuauaugguacauguggcugggagcacgcuuccuggaguucgaggcccucggcuuccugaacgaggaccacugguucagccgggagaacagucuaucuggcguggagggcgaggggcuucauaagcugggcuacauccugcgagacguguccaagaaggagggcggggccauguacgccgacgauacggcgggcugggacacccgcauuacccucgaggaccucaaaaacgaggaaauggugacaaaccacaugaagggggagcacaagaaacuugccgaggccaucuucaagcucacguaccagaacaaggucgugaggguccagcggccgacgccccggggcacugucauggacauaaucagcaggcgcgaccagcgagggagcggccaggucggcaccuacggguuaaacacguucaccaacauggaggcccagcugauccgacagauggaaggcgaaggcguguucaagaacauccaacaccucaccgucaccgaggaaguggccgugcagaacuggcuagcacgagucggccgcgagcgccugaguaggauggcaaucagcggagacgauuguguggugaagccgcuagacgaccgauucgccaacgcccugacggcccucaacgacaugggaaagauccggaaggacauccagcagugggaaccaagcaaaggauggaaugacuggacucagguccccuuuugcagucaccacuuccacgaacucauaaugaaggacggaagaguauugguggucccaugccggaaucaagaugagcucauaggucgcgcgaggaucucccagggggccggcuggagccuccgcgagaccgcgugccugggcaaguccuacgcucagauguggagcuuaauguauuuccaccggcgugacuugcggcuggccgcgaacgccaucugcucugccgugccuagccacugggugccgaccucccgcaccacuuggagcauccaugccaagcacgaguggaugaccaccgaggauauguugaccgucuggaaccgggucuggauaagagagaaccccuggauggaggacaagacgcccguagaguccugggaagaaaucccguaccucgggaagcgugaggaucaguggugcggcagccugaucgggcucacuucccgcgccaccugggcgaagaacauccaggccgccaucaaucagguuagaagccucaucggcaaugaggaguauaccgacuacaugccguccaugaaaagauucagacgcgaggaagaggaggccgggguacugugguag

SEQ ID NO: 25411 - RNA, 9876 nt, Artificial Sequence
  derived and/or modified CDS sequence (opt11) from DENV-2__EU482705__SS-prME
agcgccgggaugauaaucauguuaauccccacugugauggccuuccaccuaaccacccggaauggggagccccacaugauugucgggauccaagagaagggcaagucucugcuguucaagaccgaggauggagugaacaugugcacccuuauggcgauggaccucggugagcuuugcgaggacaccaucaccuacaagugcccauuguuacgccagaaugagcccgaggauaucgacugcuggugcaacucaaccagcaccuggguaacguacgggacuuguaccacaaccggcgagcaccgccgggagaagcgaagcguggccuuagugccucacguggggaugggccuggagacccggaccgagaccuggaugagcagcgagggggccuggaaacacgcccaacgcaucgagacuuggauccugcggcacccgggcuucaccaucauggccgcgauccuugccuauaccaucgguaccacacauuuccagcgggugcucaucuucauacuacugacggcgguugcccccucaaugaccaugcggugcauuggcauaagcaaccgcgacuuuguagagggcgucuccgggggcagcuggguagacaucgugcucgagcauggcuccugcgucaccaccauggcgaagaauaagccuacccuggauuucgagcucaucaagacugaggcaaagcaacccgcaacacuccggaaauacuguaucgaggccaagcugaccaacacuaccaccgagagucgcugucccacacagggcgagccaucccugaaggaggagcaagacaagagauuugugugcaagcauuccaugguagaucguggcugggguaacggcuguggccuguucgguaagggugggauugucacgugcgcaauguucacgugcaagaagaacauggaaggcaaaauagugcaacccgagaaccuggaguauacaauugucgugacgccccauuccggggaggagcaugcgguaggaaacgacacggggaagcacggcaaagaaaucaagguaaccccgcaaagcuccaucacggaggccgagcugaccgguuauggaaccgucacgauggaauguagcccccggacgggccucgauuucaacgaaauggugcugcugcagauggagaacaaggccuggcucguucaucgccagugguuccucgaccugcccuugcccugguugccgggggccgacaaacaggaguccaacuggauccagaaggagacccuggucaccuuuaaaaacccccaugccaagaagcaagacguugucgugcucggcagucaggagggcgcuaugcacacagcccugacaggcgcuaccgagauccagauguccuccggcaaccuccuguucaccggccaucugaagugucggcugcgcauggacaaacuccaguugaagggcaugaguuacuccaugugcacggggaaguuuaagguugugaaggagaucgccgagacgcagcaugggaccaucgugauccggguccaguacgagggggacggcagcccguguaagauaccuuucgagauuauggaccuggagaaacgauauguccucggccgacugaucacggucaacccaaucgugacugaaaaggacagccccguaaacaucgaggccgagccgcccuucggggacagcuacauuaucaucgggguggagccggggcaguuaaagcucaacugguucaagaagggcaguagcaucggacaaauguucgaaacaacaaugcgaggcgcgaagcguauggccauacugggcgauaccgccugggacuucgguucccugggugggguauucacgagcauaggcaaggcccuccaucaagucuucggggccaucuacggcgcggcguucuccggggugagcuggaccaugaagauccugaucggugugaucaucacuuggaucggaaugaacuccaggaguacgucccugagcgucucccugguacucguggggaucgucacauuguaucugggcgugauggugcaggcugacuccggaugcgucguguccuggaagaauaaggagcucaaaugcggcucgggaaucuuuaucaccgacaauguucacaccuggaccgagcaguacaaguuccagcccgagucacccuccaaacuggccagugcgauucagaaggcccaagaagaggggaucugcgguauccgcuccgucacccggcuugagaaccucauguggaaacagauaacccccgaacucaaccacauucucgcggagaacgaggugaagcucaccauaaugaccggcgacauuaagggcauuaugcaggcuggcaagcgcagcuuacggccucaaccuacggaacuuaaguacuccuggaagacuuggggcaaggccaagaugcucagcaccgaguccuacaaccagaccuucuuaauagacgggcccgaaacgaccgaguguccgaacaccaaccgcgcauggaacagccuggagguggaagacuacggguucggagucuucacgacuaacauuugguuaaaacugaaggagaaacaggaugccuucugcgacaguaaacuaaugucugccgccauuaaggacaaccgggccgugcacgcggacaugggguauuggaucgagagugcacucaacgauaccuggaagauagagaaggcuaguuucauagaggugaagaauugccacuggcccaagucccacacucuguggagcaacgggguccuggaguccgaaaugauuaucccgaagaacuuagcgggcccagucucacagcacaacuaucgcccgggguaccacacccaaauagccgggcccuggcaccugggcaagcuugagauggacuucgauuucugcgacgggaccaccgugaucgucacugaggacugugggaaucgggggccaagccuucgcaccaccacagccagcggcaagcugaucacggagugguguugccguagcugcaccuuacccccgcugcgcuaccgcggagaggacggcugcugguacgggauggagauccguccgcuuaaggagaaggaggagaaccuggugaacucguuagucaccgcaggccacgggcagguggacaacuucagccugggggugcugggaauggcucucuucuuggaggaaaugcuucggacgcgggugggcaccaagcacgccauacucuuagucgccguguccuucguuacccugaucacgggcaauaugagcuucaaggaucucgggcgagucguagugauggucggugccacuauggcugacaacauagggauggggguuaccuaccuggccuuacuugccgcguucaaagugcgcccuaccuucgccgccggccuguuacuucggcgucugaccuccaaggagcugaugaugacgaccaucgggauuguucuccuaagccaguccaccaucccagagacggugcuggaguugacggaugcacuggcucuggggaugaugguacuuaaaaucguucgcaacauggagaaguaccagcucgcggugaccauaauggccauccugugcguuccaaacgcggugauccuccaaaacgcuuggaaggucucgugcacuauucuagcaguggugucggugaguccucugcuccuuaccaguucucaacagaaaacggauuggaucccccuggcguuaacaaucaaggggcugaaccccaccgccaucuuccugaccacgcucagucgaaccaacaagaaacgcagcuggccguuaaacgaggccaucauggcagugggcaugguauccauauuagcgucuucccuucucaagaacgacauaccgaugaccgguccccugguggcaggggggcuacugaccgucugcuaugugcucacgggucggagcgccgaccuugagcucgagcgcgccaccgaugugaagugggaagaccaggccgagaucucagguagcagccccauacuguccaucacaauuagcgaggacggguccaugucuauuaaaaacgaagaggaggagcaaacccucacgauccugauccggacggggcugcucguuaucuccggccuguucccgaucagcauucccaucaccgcagccgccugguaccucugggaggugaaaaaacagcgggccgggguucucugggacgugcccagcccgccacccaugggcaaggccgagcucgaggacggggcauaccggaucaaacagaagggcauacugggguacucgcagaucggcgccgggguguauaaggaggggaccuuccacaccauguggcacguaacccgcggcgccguccucaugcacaaagggaagcggaucgagcccagcugggcugacgucaagaaggaccugaucagcuacggcgggggcuggaaacuggagggcgaauggaaggagggagaggagguccaaguccucgcccuggagcccggcaagaacccccgcgcggugcagacuaagccugggcuguucaagaccaacacaggaacgauaggugccgugucuuuagauuucagccccggcaccuccggcagccccauaauagacaagaaggggaagguggugggccuguacgggaacgguguggucacccgguccggugccuacgugagcgcuaucgcccagaccgaaaagagcaucgaggacaacccugagaucgaggacgacaucuuccgcaagcggcgacuuacaauaauggaccugcauccaggggcgggcaagaccaaaagguaccugcccgcaaucgugcgagaggccauuaagcgcggguuacgcacccugauccucgccccuacucgggucguggcugccgagauggaggaggcccugcgcggccugcccauccgguaccaaacgccagcuauccgcgcagagcauaccggacgcgagaucguagaccucaugugccacgcgaccuucacaaugcggcuucugagccccgugcgcguuccgaacuauaaccuaauaaucauggaugaggcccauuucacggaccccgccuccauagccgcccggggcuacauauccacaagaguggagaugggcgaggcugccgggaucuuuaugaccgccaccccgcccggcagccgggauccguucccccaguccaaugcccccaucaucgacgaggagcgggagauacccgaacggagcuggaacuccggucacgagugggucacggacuucaagggcaaaaccguuugguucguccccaguaucaaagccgguaacgacauagcggcaugccuacgcaagaacggcaagaaggugauccagcuaucccggaagacuuucgacagcgaguacgugaagacgcgcacgaacgacugggacuuuguggucaccaccgauaucuccgagaugggcgccaauuucaaagcugaacgggugaucgacccccgacguugcaugaagcccgugaucuugacugauggggaggaaagagucauccuugccggccccaugccggugacucacagcuccgcagcacaacggcgcggucggaucggcagaaaccccaagaacgagaacgaccaguacaucuacaugggagagccgcuggagaaugacgaggacugugcccacuggaaggaggccaagaugcucuuggauaacaucaacacccccgagggaaucauuccgagcauguuugagcccgaacgugagaaaguagaugcgauagauggcgaguaccgccugaggggggaggcacggaagaccuuugucgaccucaugcgacgcggagauuuacccguguggcuggcguacaagguagcugcggaggggaucaacuaugcggaccgcagaugguguuucgacggaauaaaaaacaaccagauacucgaggaaaacgucgagguggagaucuggacgaaggagggggaacgcaagaagcugaagccgagaugguuagaugcccgcaucuacuccgacccccucgcccucaaggaauucaaggaauucgcggccggccggaagucgcugacgcuaaaccugaucaccgagaugggucggcugccuacguucaugacccagaagacgcgggacgcguuggauaaccuugcaguccuacacaccgcagaggccggggggcgcgcauauaaccacgcccucuccgagcuuccggagaccuuagagaccuugcugcuccucacguugcuggcgaccgucaccggcggcaucuuccucuucuuaaugagcggccgggggauaggcaagaugacgcuggggauguguugcaucaucacugcuuccauucuccucugguacgcucagauccagccgcacuggaucgcugcauccaucauccuggaauucuuccucaucgugcugcucauacccgagcccgagaaacagcgcacaccacaggauaaccagcucaccuacguaguaaucgcgauccugacuguggucgccgcaaccauggcgaacgaaaugggcuuccuggagaagacgaagaaggaccuugggcugggcuccaucgcuacccagcagccggagagcaacaucuuggacaucgacuugcggcccgccagcgccuggacccuuuaugcgguagcgaccacguuugucacccccaugcugcgccacagcauagagaauagcuccgucaacgugucacuuaccgccaucgccaaucaggccaccguucugaugggccuggggaagggauggccccucucgaagauggacaucgggguuccgcugcuggcuaucggcugcuauucgcaggugaauccgaucacucucaccgccgccuuguugcuccugguagcccacuacgccauuaucgggcccggccugcaagcgaaggccacccgcgaagcacagaagcgcgccgcggcgggcaucaugaaaaauccuaccgucgacgguaucaccgugaucgaucuagacccgauacccuaugaccccaaauuugagaagcagcugggucaggugaugcuccucauccugugcgucacacaggugcugaugaugcggaccacgugggcucuuugcgaggcacugacacuggccaccgggcccaucucuacccucugggaaggcaauccggggcgcuucuggaauacaacuaucgcuguguccauggcgaauaucuuucggggaagcuaucuggccggcgccgggcuccucuucagcaucaugaagaacaccacuaacacccgccgcggcacugggaacauuggcgagaccuuaggcgagaaauggaagucccggcugaacgcccugggaaagucggaguuccagauauacaagaaauccggcauccaggagguagaucgcacccucgcaaaagaagggauaaagcggggugagaccgaccaccacgcagugagucgcgggucggccaaacugcgaugguuuguggagcgcaacauggucacgcccgagggcaaggucguggaccucggaugcggccggggcgguuggagcuacuacugcggcgggcugaagaacguacgcgaggugaaggggcugacuaagggcgggccgggacacgaggagcccaucccgaugucgaccuacggguggaauuugguaaggcuucaaagcggcguagacguguucuucaucccgcccgagaagugcgacacccugcucugcgauauuggggaguccagcccuaacccgacggucgaggccggccgcaccuuacggguauuaaaucuuguggagaacuggcugaauaacaacacgcaguucugcaucaagguucugaaccccuacaugcccucagucaucgagaaaauggaggcgcugcagcgcaaguacggcggcgcguuagugaggaauccucugagcagaaacagcacgcacgagauguacuggguauccaacgccagcgguaacaucgucuccagcgugaacaugaucuccagaaugcugaucaaccgcuuuaccaugcggcauaagaaagcgacguacgagcccgacgucgauuugggcucgggcacucgcaacaucgggauugaauccgagauaccgaaccuggacaucaucggcaagcggaucgagaagaucaagcaggagcacgagaccucauggcacuacgaucaggaccaccccuacaagacuugggccuaccauggguccuacgagacgaagcagacugggagcgccuccuccauggucaauggaguggugcggcugcucaccaaaccaugggacguucuccccaccgucacucagauggccaugaccgauaccacccccuucgggcagcagcgcgucuucaaagaaaaggucgacacacgaacacaagagccuaaggagggcaccaaaaaguuaaugaagaucaccgccgaguggcuauggaaagagcuggguaagaaaaagacuccgcgcaugugcacgcgcgaagaguuuaccaggaagguacguuccaacgcugccuugggggccaucuucaccgaugagaauaaguggaaguccgcgcgcgaggccguagaggacucccgguucugggagcuugucgacaaggagcgcaaccugcaucuggagggcaaaugcgagacuugcguguacaacaugauggguaaacgggagaagaaacucggagaguucggaaaggcuaagggcucucgcgcgaucugguauauguggcuaggcgcacgguucuuagaguucgaggcgcuuggguuccugaacgaggaccacugguuuucucgugagaacucgcuauccggcguagagggugagggccuacacaaacuuggauacauccugcgggacgugagcaagaaggagggcggagcgauguaugcagacgacaccgccggaugggauacucgcauaacccucgaggaccugaagaacgaagaaaugguaacgaaccacauggaaggcgagcauaagcgguuggcggaggcaaucuucaagcucaccuaccagaacaaggucgugcgcguccagcggcccacgccucgggguaccgucauggacaucaucagccgccgcgaucaacggggcuccggccaaguggggacguacggccugaauaccuucaccaacauggaggcacagcugauccgccagauggagggggagggaguguucaagaacauccagcaccucacagucacggaagagguggcgguccagaacuggcuggcaagaguagggcgcgagcgccugagccgcauggcgaucucaggcgacgacugcguggugaagccccucgacgacagguuugccaacgccuugacugcccugaacgacaugggaaagauaagaaaggacauacagcagugggagccgucaaagggauggaacgacuggacccagguccccuucugcucccaccacuuccacgaacucaucaugaaagauggccgagugcuggucguacccugccggaaccaggaugagcugaucggccgcgcaagaaucagccagggcgccggguggucacucagggagacggccugccugggcaagucuuacgcccagauguggucccugauguacuuccaccggcgagaccuccgucuggccgccaacgccauaugcagcgccgugcccagucauuggguaccgacaagccgcaccaccugguccauucaugccaaacacgaguggaugaccacggaggacauguuaaccguguggaaccggguguggauccgcgagaaccccuggauggaagacaagaccccuguugaaagcugggaggagauccccuaccucgggaagcgagaggaccaguggugcggguccuuaaucggccugacuucccgugccacaugggccaagaacauccaggcagccaucaaccagguccggucccucauaggaaaugaggaguacacggauuauaugccuagcaugaagcgcuuuagacgggaagaggaggaggcaggcguacugugguag

SEQ ID NO: 25412 - RNA, 9876 nt, Artificial Sequence
  derived and/or modified CDS sequence (opt11) from DENV-2__EU482463__SS-prME
agcgccggaaugaucaucaugcugaucccgaccgugauggccuuccaccucacuacccggaauggggaaccccauaugaucguuagcauacaagaaaagggaaaaagccuucuguucaagacggaagacggggugaauaugugcacccucauggcgauggaccuaggagagcuaugcgaggacacuaucaccuacaaaugcccccuccugcggcagaacgagcccgaggacaucgacugcuggugcaacagcaccaguaccugggugaccuaugggaccugcaccacgaccggcgagcacaggcgcgagaaacgcuccguggcgcuggugccccacgugggcauggggcucgagacgcggaccgagaccuggaugucauccgaaggcgccuggaagcacgcucagcggaucgaaacguggauccuucggcacccgggguucacgaucauggccgcgauccuggccuacaccaucggcaccacccacuuccagcgcguccucaucuucauucugcugacggccguagcgcccagcaugacuaugcggugcauugggaucuccaaccgcgacuucgucgagggcgucagcggcgguuccuggguggacauagugcucgagcacggcucaugcgucaccaccauggcgaagaacaagcccacgcucgacuucgagcugaucaaaacagaggccaagcagccggccacccuccgaaaguacuguauagaggccaagcugacuaacacgaccaccgagucccgcugcccuacccagggggagcccagccugaaggaggagcaggacaagcgguucgugugcaaacacuccaugguggaccgcggcuggggcaacgggugcggccuauucgggaagggugggauugucacgugcgccauguucacgugcaagaagaauauggagggcaagaucgugcagcccgagaaucuggaguacaccaucguggucacgccccacagcggugaggagcacgcgguuggcaacgacacgggcaaacacgggaaagagaucaaggucaccccgcaauccagcaucacagaggccgaacugaccggcuacgggaccguaacgauggaguguucgccccggacuggccucgacuuuaacgagauggugcuuuugcagauggaaaacaaggccuggcuugugcaucgccagugguuccuagacuugcccuuaccauggcugcccggagcggacaagcaggaauccaauuggauccaaaaggagacccuagucaccuucaagaacccacacgccaagaagcaggacguagucguucucggcucccaggaaggagcgaugcacaccgcccugaccggggcgaccgagauccaaaugucaagcggcaaucugcuguucaccgggcaccugaagugccggcuucgcauggacaagcuccagcugaagggcaugagcuacagcaugugcacggguaaguucaagguggucaaggaaaucgccgagacccagcacggaaccaucgugaucagggugcaguaugagggggacgggucccccugcaaaauccccuucgagaucauggaccuggagaagcgcuacgugcucggccggcugauaaccgugaacccgauugugacggaaaaggacagccccgucaacaucgaggccgagccacccuucggcgauucguacauaaucaucgggguagagccaggccagcugaagcucaacugguuuaagaaggggucauccaucggucagauguucgagaccaccaugcgcggugcgaagcgcauggccauccugggcgacaccgccugggacuucggcagccucggcgguguguuuacguccaucgggaaggcccuccaccaggucuucggggcuaucuacggugcggcauucagcggcguuuccuggaccaugaagauccugaucggcgugaucaucaccuggaucgggaugaacagccgguccaccagccuguccgucucccuagugcucgugggaaucgucacgcuauaccugggggucauggugcaggccgacuccggcugcgucguaaguuggaagaacaaggagcugaagugcgggucgggcaucuucaucaccgacaacgugcacaccuggaccgagcaguacaaauuucagcccgagucccccagcaagcuggccuccgcgauccagaaggcccaggaggaaggcaucugcgggaucagauccgucacgaggcuggagaaccucauguggaagcagaucacccccgaacugaaccacauccuagccgagaacgaggugaagcucaccaucaugaccggggacauccgcgggauaaugcaggcgggcaagcgcuccuugcgcccucagccgaccgagcugaaguacuccuggaaaaccugggggaaagccaagaugcucuccacggagagcuauaaccagaccuuccuaaucgacggccccgagacggccgaguguccgaacacaaacagggccuggaacucacuggaggucgaggacuacggguucggggucuucaccaccaacaucuggcucaagcugaaagagaagcaagacgccuucugugacagcaagcugauguccgcagccaucaaggacaaccgggcggugcacgccgacaugggcuacuggaucgagucagcccucaacgacacguggaagaucgagaaggccuccuucaucgaggugaagaacugccacuggcccaagagccacacccugugguccaacgggguccuggaaagcgagaugaucaucccuaagaaccucgccggcccggucucccagcauaacuaccggccaggcuaccauacacagaucgccgggcccuggcaucugggcaagcuggagauggacuucgacuucugcgacgggaccaccgugaucgucacggaggacugcggcaaccgcgggcccucgcucagaaccacuaccgcuagcgguaagcugaucacagaguggugcugccgauccugcacuuuacccccucuccgguaucgcggcgaggacggauguugguacgggauggagauccggccucugaaagagaaggaggagaaccuggugaacucucucgucaccgccgggcacggccaggucgacaacuucucccuggggguacuuggcauggcccucuuucuugaggagaugcugcgcacccgggugggcacgaagcacgcgaucuuacugguagccgugagcuucgugacccugaucacugggaacauguccuuuaaggaccucggccgcgucguggugauggucggagccacuauggccgacgauaucggcaugggagugacguaucucgcccugcucgcugccuucaaagugcggcccacauucgcugcagggcugcugcuccgaaagcuaacgagcaaggagcugaugaugaccacgaucggcaucguccuccugucccagagcaccaucccagagacgguucuggagcucaccgacgcuuuggcgcuggguaugauggugcuuaagauugucaggaacauggagaaguaccagcuggccgugacgaucauggcuauccugugugucccuaacgccgugauacuccagaaugccuggaaggugagcugcaccauccucgcggucgugagcgugagcccucugcuccugaccagcucccagcaaaagaccgacuggaucccccuggcccugacgaucaaggggcugaaccccaccgccauauuccugacaacccucucacggacaaacaagaagagguccuggccgcugaacgaggccaucauggcggucggaaugguaagcauccuugccuccucgcuccugaagaacgacaucccaaugaccggcccccugguggccggcgggcuccugacuguuuguuacgugcugacuggccgguccgccgaccucgagcuggagcgugcaacugacguaaagugggaggaccaggcggagauaagcgggagcucccccauucugagcauaaccaucuccgaagacggcagcaugucaaucaagaacgaagaggaagaacagacccucaccauccugauccggacaggccuacucgucaucagcgggcuguucccgaucucuauccccaucacugccgccgcuugguaccugugggaggugaagaagcagcgagccggcgugcucugggacguccccuccccgccgcccaugggaaaagcggagcuggaggacggcgccuaccgaaucaaacagaaggggauccugggcuacucccagaucggggccggcguguacaaggagggcaccuuccacaccauguggcaugugacccgcggggccguccuuaugcacaagggcaagcgaauugaacccagcugggccgacgucaagaaagaccugaucaguuacgggggcggguggaaacuggagggcgaguggaaggagggcgaggaggugcagguccucgcgcuggagcccgggaagaacccccgcgccgugcagacgaagcccggccuguucaaaaccaauaccgggaccaucggugccguguccuuggacuucucccccgggacgagcgguuccccaaucaucgacaagaaagggaaggucguggggcuguacggcaacgggguggucacaagaagcggcgccuacgugucagccaucgcucagacugagaaguccaucgaagauaacccugagaucgaggaugacaucuuucgaaagaggcgguugaccaucauggaccuucaccccggcgccggcaagacgaagagauaucuccccgccaucgugcgggaggccaucaagcggggccugcgcaccuuaauccuugcgccuacccguguuguggccgccgagauggaggaagcccugagagggcugcccauccgguaccagacgcccgccauccgcgccgagcacacuggacgcgagauugucgaccucaugugccacgccaccuucacaaugcgacuacugagccccguccgcguacccaacuauaaccucaucaucauggacgaggcccacuucaccgaccccgccagcaucgccgcgagaggguacaucucgacgcgcguggagaugggcgaggccgccggaaucuucaugaccgcgaccccucccgggucccgggacccguuuccccagagcaacgcccccaucauagacgaggagcgcgagauacccgagcggucuuggaacaguggccacgagugggucaccgauuucaaggggaagacggugugguucgugccguccaucaaggcggguaacgacaucgccgccugccugcgcaagaauggcaagaaaguaauccagcugucacgaaaaacauuugacuccgaguauguaaagacccgcaccaacgacugggacuucgugguaacgacagacaucagcgagaugggcgccaacuucaaggcggagagagugaucgacccccgccggugcaugaagcccguuaucuugaccgacggugaggaacgcgucauacuggccgggcccaugcccgugacucacuccucagccgcccagcggaggggccggaucgggcgcaaucccaagaaugaaaacgaccaguacaucuacaugggugaaccccuggagaacgacgaggacugcgcccacuggaaggaggcuaagaugcuccuggacaacauaaacacgcccgaggggaucauuccuuccauguucgaaccugagcgcgagaagguggacgccaucgacggcgaguacagacugcgcggcgaggccagaaagaccuucgucgaccucaugcgccgcggagaccugccuguguggcuggccuacaaggucgccgcggagggcaucaacuacgccgaccgccgguggugcuucgacggaauaaagaacaaucagauucucgaggaaaaugucgagguggagaucuggaccaaggagggcgagcgcaagaagcuaaagccgcgguggcuggacgcccgcaucuacagcgacccgcucgcccugaaggaguucaaagaguucgcagcgggacggaagucccugacccuaaaccugaucacugagaugggccgccugcccaccuucaugacccagaagacccgggacgcccucgauaaccuagcugucuugcacacggcggaagcagggggucgcgccuacaaccaugcacucagcgagcugcccgagacccuggagacccuccugcugcugacucugcuggccacgguuacaggcgggauauuccuguuccugauguccggcagaggcaucggcaagaugacccuuggcaugugcugcaucauuaccgccagcauccuccugugguacgcucagauccagccgcacuggaucgccgccucuaucauacuagaguucuuccucaucguucugcugauucccgaacccgaaaagcagcgcacaccccaggacaaccaguuaacguacguugugaucgccauccugaccguagucgccgcgacaauggcaaacgagaugggguuucuagagaagaccaagaaagacuugggccuagggucuauagcgacgcagcaaccggaauccaacauccuggacaucgaccuccgaccggccagcgccuggacauuauacgcgguggccaccaccuuugugacgcccaugcugagacacagcaucgagaacaguucggucaacgugagccucaccgccaucgccaaccaggcaaccgugcugaugggacuggggaagggguggccucucagcaagauggacaucggugugccgcugcuggccaucggguguuacucccaggugaacccuaucacucucacggccgcgcuauugcugcugguggcucacuacgcgaucaucggccccgggcugcaggccaaggccacccgggaggcgcagaagcgggcugcggccggcauaaugaagaacccaaccguugacgguaucaccgugaucgaccuagacccgaucccuuacgaccccaaguucgagaagcagcuuggccaggugaugcugcuaauccucugcguuacacagguacugaugaugaggaccaccugggcccucugugaggcauugacccucgcaacgggccccaucagcacccucugggaggggaacccgggccgcuucuggaauacuaccaucgccguguccauggccaacaucuuccgcgguucguaccuggccggcgccggccuccuguucuccauaaugaagaauaccacgaacacucgccgugggacaggcaacaucggcgagacgcuaggcgagaaauggaagagucggcugaacgcgcucggcaaguccgaguuccagaucuacaagaaguccggaauccaagaggucgaccgcacccuugcaaaggagggcaucaagcgcggggagaccgaccaccacgcggugucccgaggcagcgccaagcugagaugguucguggagcgcaauaugguuacccccgagggcaaagucguagaucucgggugcggccgcggcggguggagcuacuacugcggcgggcucaagaacguacgcgaggugaaggggcugacgaaaggcgggcccgggcacgaggagccgaucccgaugagcaccuacggcuggaaccucguucggcugcaguccggggucgacguguucuuuaucccgcccgagaagugcgacacgcucuuaugcgacauuggugagagcucgcccaacccuacgguggaggccgggcgcacgcugagagugcugaaccucguugagaauugguuaaacaacaacacgcaguucugcaucaaggugcugaaucccuacaugccgagcgucaucgagaaaauggaggcgcuacagcgcaaguacgggggcgcgcuggugcggaacccgcugucucgcaacagcacccacgagauguacugggugagcaacgccuccgggaacauagucagcuccgucaacaugaucucgcggaugcucaucaaccgcuucaccaugagacacaaaaaggccacguacgagcccgacguggacuugggcucggggacgcgcaacauuggcaucgagagcgagaagcccaauuuggacaucaucgguaagcguaucgaaaagaucaagcaggagcacgagacauccuggcacuaugaccaggaccacccuuacaagaccugggccuaccacggcagcuaugagacuaagcagacggguuccgcaagcucgauggucaauggggugguacgccuccucaccaagccgugggacguucugcccaccgugacccagauggccaugacggacaccacccccuucggccagcagcgcguguucaaagagaaggucgacacccggacgcaggaacccaaggaggggaccaagaagcugaugaaaauuaccgccgaguggcucuggaaggaguugggcaagaagaagaccccgcguauguguacccgggaggaguucacucgcaaggugcggagcaacgccgcccugggcgcuaucuucacggacgaaaacaaguggaaguccgcccgcgaggccguggaggacagccguuuuugggaguugguugacaaggagcgcaaccugcaccuggaggggaagugcgagacaugcguguauaacaugaugggaaagcgggagaagaagcucggggaguucggcaaagcuaagggcagccgggcuaucugguacauguggcugggcgcgcgguuccuggaguucgaggcccucggcuuccuuaacgaggaccacugguucagccgcgagaacucccuaagcggagucgagggcgaggggcuccacaagcugggcuacauucugcgggacgugagcaagaaggagggcggcgcgauguacgccgacgacacggcgggcugggacaccagaaucacccucgaggaccugaagaaugaggagauggugaccaaccacauggagggugaacacaagaaguuagccgaggccaucuucaagcucacauaccagaacaaggucgugcgggugcagcgccccacgccacggggcaccguuauggacauuaucucccgccgggaccagcgcgggagcggccagguggggaccuacggccugaacacguucaccaacauggaggcccagcugauccggcagauggagggcgaggggguguuuaagaauauccagcaccucaccgucacagaagagguggccgugcacaacuggcuggcccgcgucggccgcgagcggcugagucguauggccaucucaggagacgauuguguggugaagccccuagacgaccgguucgccaacgcauuaacggcucugaacgacaugggaaaaauccgcaaagacauccagcagugggaaccgucuaagggcuggaacgacuggacccagguccccuucugcucucaccauuuccacgaguugaucaugaaagacgggcgggugcugguggucccaugccgaaaccaggacgagcuuaucggccgggcucgcaucucccaaggugccggcuggucccuccgugagaccgccugccuggggaaguccuacgcccaaauguggagccucauguauuuccaccgccgugaccuccgccuggcugcgaacgcaaucugcuccgcagugcccucccacugggugccgaccagccgaacgaccugguccauccacgccaaacaugaguggaugaccaccgaggacaugcugacugucuggaaccgcguguggauccgggagaaccccuggauggaagacaagacucccguggagaguugggaggagaucccuuaccuaggcaagcgcgaggaccaguggugcggcagccucaucgggcugaccuccagggccaccugggcgaagaauauucaggccgccauaaaccagguucgcagccucaucggcaacgaggaauacaccgacuauaugccgagcaugaagcgguuucgccgggaggaggaggaagcagggguccugugguga

SEQ ID NO: 25413 - RNA, 9876 nt, Artificial Sequence
  derived and/or modified CDS sequence (opt11) from DENV-2__EU482464__SS-prME
ucugccggcaugaucaucaugcugauucccaccgugauggcguuccaccucaccacccgcaacggggagccucacaugaucguuggaauccaagagaagggcaaaagccugcuguuuaagacggaggacggugugaacaugugcacccucauggcgauggaccugggggaguugugugaagacaccaucaccuacaagugcccccuccugcggcagaacgaacccgaggacauagacugcuggugcaacagcaccuccaccugggugacuuacgggacuugcaccacgaccggcgagcaccgccgggagaagcgcagcgucgcccugguaccccacguggggaugggccucgaaacccggaccgagaccuggauguccuccgagggggccuggaagcacgcccagcgcauagagacauggauccugcggcacccgggcuucacgaucauggccgcgauccuggccuacaccaucgggaccacccacuuccagagaguccuuaucuucauccugcuaacggccguggccccuuccaugaccaugcggugcaucggcaucucuaaccgcgacuucguugaaggcgucuccgggggcucuuggguggacauugugcucgagcacggguccugugucaccacgauggcaaagaauaagcccacucuggacuucgagcugaucaagaccgaagccaagcagcccgccacccuccggaaguacugcaucgaggccaaacugaccaacacgaccaccgagucaagaugccccacacagggggagcccucccuuaaggaggagcaggacaagcgguucgugugcaagcacaguaugguggaccguggcugggggaacggcugcggccuguucggcaagggagggaucgucacgugcgccauguucacgugcaagaagaacauggaaggcaagaucgugcaacccgagaaccuggaguacaccaucguggucacgccccacuccggagaggagcacgcggugggcaacgacacgggcaaacacggcaaggagaucaaggugaccccccaaagcuccaucaccgaggccgagcucaccggguacggcaccgucacgauggaaugcucgccccggacgggccucgauuucaacgagauggugcugcugcagauggaaaacaaagccugguuagugcaccgacagugguuccuggacuuaccccuccccuggcugccgggcgccgacaagcaggaguccaacuggauccagaaggagacccuggucaccuucaagaacccccacgcuaagaagcaggacguagucgugcucggcucucaggaaggggcuaugcacacugcccugaccggcgccaccgagauccaaaugucguccgggaaccuccuguucaccggccaccucaaaugccggcugcgcauggauaagcuccagcugaagggaaugagcuacuccaugugcacggggaaguucaagguggucaaggagaucgccgagacccagcacggcacaaucgugauucgggugcaguacgagggggacggcagccccugcaagauccccuucgagauuauggaccuggagaagcgcuacguccucggccggcugaucacagugaacccgauagugaccgagaaggacucccccgucaacauagaagcugagccgcccuucggggacagcuacauaaucaucggaguggagccggggcagcugaagcuuaacugguucaagaagggguccagcaucgggcagauguucgagaccaccaugcgcggcgcgaaacgcauggccauccugggcgauaccgccugggauuucgggucccuggguggcguguucacgagcaucggcaaggcccuucaccaggucuucggagccaucuacggcgcggccuucuccggcgugagcuggaccaugaagauccugaucggugugaucaucaccuggauuggcaugaacagccggagcaccucccugagugucucccuggugcucguggggaucgucacgcuguaccugggcgugauggugcaggccgacagcggguguguaguguccuggaagaacaaggagcuaaagugcggcucggggaucuucaucaccgacaacgugcacacauggaccgagcaguacaaguuccagcccgagagccccuccaagcuggccagcgcgauccaaaaggcccaggaggagggcaucuguggcauccgcuccgucacgcgccuggagaaucucauguggaagcagaucacccccgagcugaaccacauccuggcugagaaugagguuaagcuaaccaucaugaccggagacaucaaaggcauuaugcaggccgggaagcgcagccugcgcccgcaacccacggagcucaaguauuccuggaagaccuggggcaaggccaagaugcucagcaccgaguccuacaaucaaacguuccugaucgacggucccgagacgacugagugcccgaacacuaauagggcguggaauucccuggagguggaggacuauggauucggugucuucacaacgaauaucuggcucaagcugaaggagaagcaggacgcguucugcgacuccaagcugaugagcgccgcuauuaaagacaaccgggccgugcacgcggacaugggguacuggaucgaguccgcccucaacgacaccuggaagaucgagaaggcgagcuucaucgaggucaaaaacugccacuggcccaagagccacacccuguggagcaacggcgugcuugaguccgagaugaucauccccaagaaccuagccggccccgugagccagcacaacuaccgcccgggguaccacacccagaucgccggccccuggcacuuggggaagcuggagauggacuucgacuucugcgacggcaccacggugaucguuaccgaggacugcgggaaccgcggccccuccuuacggaccaccacagcgagcggcaagcugaucaccgaguggugcugccggagcugcaccuuacccccguugcgcuaccgcggggaggacggcuguugguacgggauggagauccgcccccugaaggagaaggaggagaacuuagugaacucccucguaaccgcaggccacgggcaggucgacaacuucagccugggcguccugggaauggcacucuuccuggaggagaugcugcgcacgcgcguggguaccaagcacgccauccuccuggucgcgguguccuucgugacccugaucacaggcaacaugagcuucaaggaccucgggcgggucgugguaauggucgguacgaccauggccgacgacaucgggaugggcgugaccuaccuggcccugcucgccgccuucaaggugcgccccaccuucgcggccggccugcuccuccggaagcugacguccaaggagcugaugaugaccaccaucgggaucgucuuacugagccaguccaccauccccgagacggugcuggagcucaccgacgcccuggcgcugggcaugauggugcucaagauaguccgcaacauggagaaguaucagcuggccgugaccauaauggcgauccugugcgucccaaacgccgugauacuccagaacgccuggaagguuagcugcacuauccuggccguuguguccgugagcccccugcuccugaccuccucucagcagaagaccgacuggaucccccuggcccucaccauuaagggccugaaccccacugcgaucuuucugacuacauuguccaggaccaacaagaagcggagcuggccgcugaaugaggcaaucauggccguaggcaugguguccauccuggccaguucccuccugaagaacgacauccccaugaccggcccucugguggccggagggcuccucacggucugcuacgugcugaccgggagaagcgccgaucucgagcuggagcgggcaaccgacgugaaaugggaggaccaggccgagaucuccggaaguagcccgauacuguccaucaccaucagcgaggacggguccaugagcaucaagaaugaggaggaggagcagacgcucaccauccugauaaggaccggccuguuggucaucuccgggcuguucccaaucagcauccccauaaccgccgcggccugguaucugugggaggugaagaagcagcgggccgggguguuaugggacguacccagcccgccgcccaugggcaaagccgagcuggaggacggagcauaucgcaucaagcagaagggcauccugggguacagccagauuggcgcgggcguguacaaggaggguaccuuccacaccauguggcacguuacccggggcgccguccugaugcacaaggggaagcgcaucgagcccuccugggccgacgugaagaaggaccugauaagcuacggcgggggcuggaagcuggaaggcgaguggaaagagggggaggaggugcagguccucgcucuggagcccggcaagaacccccgggccgugcaaaccaagcccgggcuguucaaaaccaacacgggaacgaucggagcggugucccucgacuucagccccggcaccuccggcagcccgaucaucgacaagaaggggaaggucgugggccuguacgggaacggcguggucacccgcuccggcgccuacgucagcgccaucgcccagacggagaaguccaucgaggacaaccccgagauugaggacgauaucuuccggaagcgccggcugacuaucauggaccugcaccccggggccggcaagaccaagcgcuaccucccugccauaguacgggaggccaucaagcgcggccugcggacacugauacucgccccgacgcgcgucguggcugcggagauggaggaggcccugcggggucugcccauccgcuaccaaacccccgcuauccgggcagagcauaccggccgcgaaaucguggaccucaugugccacgcgaccuucacgaugcguuugcugucgcccguccgggugcccaacuacaaccucaucaucauggacgaggcgcauuucaccgaccccgccuccaucgcugcucgcggcuacaucagcacccggguggaaaugggcgaggcugccggaaucuucaugaccgccacaccgcccggcagccgcgacccguucccacaguccaaugccccuaucaucgacgaggagcgggagauacccgagcgcagcuggaacuccgggcacgagugggucaccgacuuuaagggcaagaccgugugguucgugccgagcaucaaagccgggaacgacaucgcagcuugucugcggaagaacgguaagaagguuauccagcugucccguaagacauucgacagcgaguacgugaagacgcgaaccaacgacugggacuucguggucaccaccgacaucuccgaaaugggcgccaacuucaaggcagagcgcgugauugacccccggaggugcaugaagccugucaucuugacggacggggaggagcgggucauccuggccggcccuaugccggugacccacagcucggcggcccagcgccgaggucgcaucggccggaaccccaagaaugagaacgaccaguacaucuacaugggggagccgcuggagaacgacgaagauugcgcccacuggaaagaggccaagaugcuccuggacaacaucaacacccccgagggcaucaucccgagcauguucgagccugagcgcgaaaagguggacgccaucgacggcgaauaccgccugcggggugaggcgcgcaagaccuucgucgacuuaaugcggcgcggcgaccugcccguguggcuggccuacaagguggcagccgaggggaucaauuacgccgaccggcgcuggugcuucgacggcaucaaaaacaaccagauucucgaggagaacgucgagguggagaucuggacgaaagagggggagcggaagaagcugaagccgcgcuggcuggacgcccggaucuacuccgacccccucgcucugaaggaguucaaagaguucgcugccggccgcaagucgcugacccucaaccugaucaccgagaugggccggcugcccaccuucaugacgcaaaagacccgcgacgcccucgacaaccuggcgguccuacacaccgcagaggccgggggcagggcguacaaccacgcgcucuccgagcuucccgagacccuggagacgcucuuacuacucacccugcuggccaccgugaccgggggcauuuucuuauuccugaugagcggccgggggaucgggaaaaugacccuggggauguguugcaucaucacggccaguauccuccugugguacgcccaaauccagccgcacuggauagccgcgagcaucaucuuggaguucuuccucaucgugcuccugauccccgagcccgagaagcagcgcacgccacaggacaaccaacuaaccuacgucgugauugcuauccugaccgugguugccgccacaauggccaacgagaugggcuuccuggagaagaccaagaaggaccuugggcuuggauccaucgcuacccagcaaccggagagcaacauccuggacaucgacuuacgcccagccuccgccuggacccuguacgccguggccacgacauucgugacccccaugcugcggcacagcauugagaacagcucggucaaugugagccucaccgcgauagccaaccaggcuaccgugcugaugggccuggggaagggcuggccccucuccaagauggacaucggagucccgcugcuggccaucggaugcuacagccaagugaaccccauuacccucaccgccgcgcugcugcuccugguggcccacuacgccaucauugggcccggccugcaggccaaggcgacgcgcgaagcccagaagcgugccgccgccggcaucaugaagaaccccacggucgaugguaucacggugaucgaccucgacccgauccccuacgaccccaaguucgagaagcaacugggccaggugaugcugcucauccugugcgucacccaggugcugaugaugcgcaccacgugggcgcucugcgaggcccuaacccuagccaccgggcccaucucgacucucugggagggcaacccugggcgguucuggaacacgacuaucgcagugagcauggccaacaucuuccgcggcuccuaccuugcgggcgcaggguuacucuucagcaucaugaaaaacaccacuaacacccggcgcggcaccgggaacaucggcgaaacccugggcgagaaguggaagucccgccuuaaugcccucgggaaguccgaguuccagaucuacaagaaauccggcauacaggaggucgaccggacacuggcuaaagaggggaucaagcguggcgaaacggaccaccaugccgugagccgggggucagccaagcugcgcugguucguagagcggaacauggucaccccugagggcaaggugguggaccucggcugcgggagaggcggguggagcuacuacugcggcggucuaaagaacguacgggaggucaagggccugaccaagggcgggcccggucacgaagagccuauccccaugucaaccuacggguggaaccucgugcgccuacaaucaggcgucgacguguucuucaucccccccgagaagugcgacacgcugcucugcgacaucggggaguccucccccaacccgacuguagaggcgggccggacccugcgcguccugaaccucguggagaacuggcugaacaacaacacccaguucugcaucaagguucugaaucccuacaugcccuccgucaucgagaaaauggaggccuugcagcgaaaguacggcggcgcccuaguacgaaacccgcugagccggaacagcacccacgagauguacuggguguccaacgcgagcggcaauauuguauccagcgugaacaugaucucgcgcaugcugaucaaccgguuuacgaugcgccacaaaaaggccaccuacgaacccgacguggaucucgggaguggcacccggaacaucgggauugaguccgagauacccaaccuggacaucaucgggaagcgcaucgagaagaucaagcaggagcacgagacgagcuggcacuacgaccaggaccaccccuacaagacgugggcauaccacggauccuacgagaccaagcagacugggucggccuccagcaugguaaacggcguugugcggcuucucaccaagcccugggacguccugcccacggugacccagauggcaaugacagacaccacgccauucgggcagcagcgcguuuucaaggagaaggucgacacucgcacccaggaacccaaggagggcaccaagaagcugaugaagauaaccgccgagugguuauggaaggagcugggcaagaagaaaaccccgcggaugugcaccagggaagaguucacucggaaggugcgcuccaacgccgcgcugggggccaucuucacagacgagaauaaguggaagucugcccgggaggcggucgaggacagccgcuucugggaguuggucgacaaggaacggaaucugcaccuggagggcaagugcgagaccugcguguacaacaugauggggaagcgagagaaaaaguugggcgaguucgggaaggccaagggcagccgagccaucugguacaugugguuaggcgcccgguuccuggaguucgaggcucucggauuccugaacgaggaccacugguucucccgggagaacagccugucgggcgucgagggggagggccuucacaagcugggguacauccugcgcgacgugagcaagaaggagggcggcgcuauguacgcggacgacacagccgggugggacacgcgaaucacgcucgaggaccugaagaacgaggagauggugaccaaucacauggagggcgagcacaagaagcuagccgaggcgaucuucaagcugacauaccagaacaaggucguuagggugcagcggcccacgccccgggggacgguuauggacaucaucagccggcgcgaccagcggggcuccggccagguggggaccuacggccugaacaccuucaccaacauggaggcccaacugauccgccagauggaaggugagggcguguucaagaacauccagcaccucacggucaccgaggaggucgcugugcagaauuggcuggcccgggucggacgggagcgccuaucgcggauggcaaucuccggcgacgacugcguggugaagccccucgacgaccgcuucgcgaaugcccuggccgcucugaacgacaugggcaagauccggaaggacauccagcagugggagccgagcaagggcuggaacgacuggacccaggucccuuucugcucccaccacuuccacgagcucaucaugaaggacggccgcgugcuggugguccccugccggaaccaggacgagcucaucggccgcgcccggaucagccagggcgcgggguggucccuccgcgagaccgccuguuugggcaagagcuacgcccagauguggucccugauguacuuucaccggagagaccuccggcuggccgcgaacgcaaucugcagcgccguccccucccacugggugccgacgagccgcacuaccugguccauccacgccaagcacgaguggaugaccaccgaggauaugcugacgguuuggaaccggguguggauccgcgagaaccccuggauggaagacaagacccccguggagucgugggaggagauccccuaccucggcaagagggaggaccaguggugcgggucccugaucggccugaccagccgcgccaccugggccaagaacauccaagcggccaucaaccagguccggagccucaucgggaacgaggaguacacggacuauaugccuagcaugaagcgcuuccgucgagaggaggaggaggccggaguacugugguga

SEQ ID NO: 25414 - RNA, 9876 nt, Artificial Sequence
  derived and/or modified CDS sequence (opt11) from DENV-2__EU482465__SS-prME
ucagcgggcaugaucauuaugcugauccccaccgucauggcauuccaccucaccacccgcaauggcgagccucacaugaucgugggcauccaggagaagggaaagucucuacuguucaaaaccgaggacggggugaacaugugcacccuuauggcgauggaucugggggagcugugcgaggauaccaucaccuacaaguguccucuccugcggcagaaugaacccgaggacauagauugcuggugcaauagcaccagcaccugggugaccuaugggaccugcacaaccaccggugagcaccgaagggagaaacguagcgucgcccuggucccucacguggggaugggccucgagacccgaacggaaaccuggauguccagcgagggugccuggaagcaugcccagcgcauagaaaccuggauccugagacacccgggcuucacgauaauggcugcgauccuugccuacaccaucgggacuacccacuuccagcgcguccucaucuuuauccuucugacggcgguggcucccuccaugaccaugagaugcaucggcaucuccaaccgcgacuuuguggaaggcgucuccgggggcagcuggguggauaucguucuugaacacggguccugcgucaccaccauggcgaagaacaagcccacccuggauuucgagcugaucaagaccgaggccaagcagccggcaacccuccggaaguacugcauugaggcgaagcugaccaacacgaccaccgagagccgcugcccgacccagggcgagccuucgcugaaagaggagcaggacaaacgguucauauguaagcacaguaugguugaccgcggcugggggaacggaugcggccuguucggcaagggagggaucguaaccugugccauguuuaccugcaagaagaacauggagggcaagaucgugcagcccgagaaccuggaguacaccauaguggugacgccccacuccggagaggaacacgcggucggcaacgacacgggaaagcacggcaaggagaucaagguaaccccgcagagcuccaucaccgaggcggagcugaccggauacggcaccgugacgauggagugcagcccgcggaccgggcucgacuuuaacgagaugguauuacugcagauggagaacaaggccuggcucgugcaccgucagugguucuuggaccucccccuacccuggcugccgggggcagacaaacaggaguccaacuggauccagaaagaaaccuuagugacguucaagaacccccacgccaagaagcaagacgucgugguccucggcagccaagaaggggcgaugcacacggcccugaccggcgccacggagauccagaugaguuccgggaaccuucuguucaccgggcaccugaagugccggcugcggauggacaaacuccagcuuaagggaaugaguuacuccaugugcacggggaaguucaagguggugaaggagaucgcugagacccaacauggcaccaucgucauccgugugcaauacgagggggacggaucgcccugcaagauaccauucgagaucauggaccuggagaagcgcuacguccucggccggcugaucacgguuaauccaaucguuaccgagaaggauucccccgugaauaucgaggcggagccgccguucggggacagcuacaucaucaucggcgucgagccugggcagcuaaaguugaacugguucaaaaagggcuccagcaucgggcagauguucgagaccacgaugcgcggcgcgaagcgcauggccauucugggugacaccgccugggacuucgggucccugggcgggguguuuaccucuaucgggaaagcccuacaccaaguguucggggcuauauacggcgcggccuucucuggcgucagcuggacgaugaagauccugaucggggugauaaucaccuggaucgguaugaauagucguagcacgagucugagcguauccuuaguucucguggggaucgugacccuguaccuugggguaauggugcaggcagacagcggaugcguggucuccuggaagaacaaggagcucaaaugcggcuccggcaucuucaucaccgacaacgugcacaccuggacagagcaguacaaguuccagcccgagucgcccuccaaacucgcuagcgccauccagaaggcgcaggaggaggggaucugcggaauaagguccgugacgcggcuggaaaaccucauguggaagcaaauaacccccgaacugaaccauauccuagcggagaacgaggucaagcucacgaucaugaccggggacaucaagggcaucaugcaggcggggaaacgcagccuccgaccgcagcccacggagcugaaguacuccuggaagaccuggggcaaagccaagaugcucagcaccgaguccuacaaccagaccuuccugaucgacggcccggagacggcagagugcccgaacacuaaccgagccuggaauucacuggagguggaagacuacggcuuuggcguuuucaccaccaauaucuggcucaagcuaaaggagaagcaggacgccuucugcgauucgaaguugaugagcgccgccaucaaagacaaccgggcgguccacgccgacaugggguacuggauagaguccgcucucaacgacacguggaagauagagaaggcuucguuuaucgaaguaaagaauugccacuggccaaagucccacacccuguggagcaacggcgugcuugaguccgagaugaucauccccaagaaucuggccggaccugucagccagcacaacuaccgccccggguaccacacccaaauagcgggccccuggcaccuggggaagcuggagauggauuucgacuucugcgacggcaccaccgucaucgucacggaggacuguggaaaccggggcccuucgcuccgcaccacgaccgccucaggcaaguuaaucacggaguggugcugccgaucuugcacccugcccccguuacgcuaccgcggggaggacggcugcugguacgggauggaaauucgacccuugaaggaaaaggaggagaaccuggucaauucccucgucaccgcaggucacggccaggucgacaauuucagccucgggguccuuggcauggcucucuuccuugaggagaugcugaggacacgaguugggacaaagcacgcgauucucuugguggccgucuccuucgugaccuuaaucaccggcaauaugucuuuuaaggaucucggucggguggucgugauggugggcgcuacaauggccgacgacaucgggaugggcgucacguaccuugcccuacucgcugccuucaagguaaggcccacauuugccgcgggcuuacugcuccggaagcugacgagcaaggagcugaugaugacaacgaucgggaucguguuacugagccaguccaccauccccgaaaccguacuggagcucaccgacgcucuggcgcugggcaugauggugcucaagaucgugcgcaacauggagaaguaccaguuagccgucacaaucauggcuauccugugcgugccgaaugccguuauucuccagaacgccuggaaagugucaugcaccauccuggcggucgucuccgugucuccccugcuccugaccuccagccagcagaaaaccgauuggauaccgcuggcccucacgaucaagggucugaaccccaccgccauuuuccugaccacccucucccgcacgaacaagaaacgaagcuggccgcugaaugaggccaucauggcaguggguauggucucgaucuuggcuagcucccuccugaagaaugacauccccaugaccggcccacuuguggcggguggccuccugacaguaugcuacguccugaccgggcgcucagccgaccucgaacuggagcgagccacggacgugaagugggaggaccaggcggaaaucuccgguagcagccccauucuguccauaaccaucagcgaggacggaaguaugagcaucaaaaacgaggaggaggagcaaacccuuaccauccucaucaggacuggccugcucgucaucuccggccuguucccuaucagcauuccaauaaccgccgcugccugguaccugugggaagucaaaaaacagcgggccggcgugcucugggaugugccuaguccgccgcccauggggaaggcggagcuggaagauggugccuaccgcaucaagcagaagggcauccugggguacucucagaucggcgccggcgucuacaaagaagggaccuuucacacgauguggcacgucacucggggcgccgugcucaugcacaaggggaaaaggaucgaacccuccugggccgacgucaagaaggaucuuaucuccuacggagggggcuggaagcuagagggcgaguggaaggaaggggaggagguccaggugcucgcguuagaacccggcaaaaauccccgggccguccagacgaagccagggcuguucaagacaaacaccggaaccaucggggcagugucccucgacuucagccccggcacgucgggcagcccuauuaucgacaagaaggggaagguagucggacuguacgggaacgggguggugacccgauccggcgccuacgucagcgcuauugcgcagaccgagaagucuaccgaggacaaccccgagaucgaggaugacaucuuccgaaagcgcaggcucacgaucauggaccugcaccccggggccggcaagacaaagcgauaucuccccgcuaucgugagagaggccaucaaacgcggucugcggacccugauacucgcgccgacgcgcguggucgcagcggaaauggaggaagccuugcggggccugcccauccgcuaccagacgcccgccauucgggcggagcacaccggcagagagaucguggacuuaaugugccacgccaccuucacaaugcgccugcuaagccccguacgcgucccuaacuauaacuuaaucaucauggaugaagcccacuucacggaccccgcauccaucgccgcgcgcggcuacaucagcaccagggucgagaugggcgaggccgccggcauauucaugacugccacuccgcccgguagccgcgauccguucccgcaguccaacgcccccaucauagaugaggaacgggagauccccgaacgcucauggaacaguggucaugaaugggugacugauuucaaaggcaagaccgucugguucgucccgagcauaaaggcggggaacgacaucgccgccugcuugcggaagaacgguaagaaggucauacagcugucucgcaagacuuucgacagcgaguaugucaaaacccggacgaaugacugggauuucguggugaccacggacaucuccgagaugggcgccaauuucaaggcagagagaguaaucgacccccggcgaugcaugaagcccgucauucucaccgacggggaagagcgggugauccuggcgggucccaugccggucacgcacaguuccgccgcgcaacgccgggggcggauaggccggaacccgaagaaugaaaacgaccaguacaucuacaugggggagccccuggaaaaugacgaggacugugcccacuggaaggaggcgaagaugcuccuggacaacaucaacacccccgaggguaucaucccgagcauguucgagcccgagcgcgagaaggucgacgccaucgauggcgaguaccgccugagaggggaggcccgcaagacuuucguugaucucaugcggcgcggagaccuucccgucuggcuagcguacaagguggcagcggaggggaucaauuacgccgaccggcgcuggugcuucgacggcaucaaaaacaaucagauucuagaagagaacguggaggucgagaucuggacgaaggaaggggagcggaagaagcugaagccgagguggcucgacgcucggauauacucggauccccucgcauuaaaggaguucaaggaauucgccgcgggcaggaagagccucacauugaaucuaaucaccgagaugggcagacugccuaccuucaugacccagaaaacgcgcgacgcauuagacaaccuugccguuuugcacaccgccgaggccggugggcgcgccuacaaccacgcccucuccgaacucccagaaaccuuagagacccuacugcugcucacguugcuggccaccgucaccgggggcauauuccucuuccuuaugaguggccgagggauaggcaagaugacccuggggaugugcugcaucacuacggccaguaucuuacugugguacgcacagauucagccgcacuggaucgcagccagcaucauccuggaauucuuccugauuguacugcugauucccgagcccgagaagcagcgcaccccacaggacaaccaacucaccuacguggucaucgccauacuuaccguaguggccgcgacgauggccaacgagaugggcuuccuggaaaagaccaagaaggaccucgggcugggcuccaucgccacccaacagccagagagcaacauacuagauaucgaccuccgccccgccucugcguggacgcuguacgcaguggccacgaccuucgugacgcccaugcuacgccacuccaucgagaacucguccgugaacgucagcuugaccgccauugccaaucaggccacggugcuuaugggccuggggaagggcuggccacucagcaagauggacauaggggugccgcuguuggcgaucggcugcuacagccagguuaaccccauuaccuugaccgcggcgcuguuacuccugguggcccauuacgcgauuauugggccgggccuccaagccaaggcuacgagagaggcccagaagcgggccgcagcgggcauuaugaagaaccccacggucgacggcauaaccgucaucgaccucgauccgauccccuacgaccccaaguucgaaaaacaacuaggccaggugaugcugcucauuuuauguguuacucaggucuugaugaugcgcaccacgugggcccucugcgaagcccugacccuggcuaccgggccuaucaguacccucugggagggcaacccgggacgguucuggaauacgaccaucgcggugagcauggcgaauaucuuucgcggcuccuaccuugcuggugccggucuccucuucucaaucaugaagaacaccaccaauacgcggcgcggaacgggcaacaugggcgagacccugggcgagaaguggaagucccgccugaacgcccuugggaaguccgaguuccagaucuacaagcgguccggcauccaagaggucgaccgcacccuggcgaaggaggggaucaagcggggcgaaacggaccaccacgccgucucccgcggaagcgccaagcuucggugguuugucgagagaaacauggugacccccgagggcaaagucguagaucucggcugcgggcggggcgguuggucguacuauugcggggggcugaagaaugugagagaggucaagggauugaccaaggguggccccggccacgaggagccaauaccuauguccaccuacggauggaaccucgugcgccugcaaucuggaguggacgucuucuuuauccccccggagaagugcgacacacugcucugcgacaucggggagagcucucccaacccgaccguggaggcuggucgcacgcugcgggugcugaacuuggucgaaaacuggcugaacaacaauacccaguucugcaucaaggugcugaaccccuacaugcccucagugauagagaaaauggaggcgcugcagcgcaaguauggcggugcucucguccggaacccgcugagccgcaacucgacccacgagauguauugggucuccaacgccucggguaauaucguuaguagcgucaacaugaucucacggaugcugauuaaccgcuucacgaugagacacaagaaggccaccuacgaaccggacguggaccucgguagcggcacccgcaauauagggauugaguccgagauacccaaccuggacauaauaggcaagcguauagagaagauaaagcaggagcaugagaccagcuggcacuacgaccaggaccaccccuacaaaacgugggccuaccacggguccuacgagaccaaacagaccgggagcgcgucuagcaugguuaacggcgucgugcgccugcucacaaagccgugggacgugcuucccacggucacucagauggccaugacagacaccacgcccuucggccagcaacgcguuuucaaagagaagguagauacgcggacccaggagcccaaggaggguaccaagaaacugaugaaaaucacggccgagugguuauggaaggagcuuggcaagaagaaaaccccgcgcaugugcacccgggaggaguucacccgcaagguccgguccaacgccgcccugggggcgaucuucacggacgagaacaaguggaaguccgcccgcgaggcuguggaggacucccgguucugggaacucguggacaaggagcguaaccugcaccucgagggcaagugcgaaaccugcgucuacaacaugauggggaagagggagaagaagcucggggaguucgggaaggcgaagggcagccgugccaucugguacauguggcugggcgcucgguuccuugaguucgaggcccucggauuucucaaugaggaccacugguucucccgcgagaacucccugucgggcguggagggggagggccuccacaagcugggguacauccugcgggacgucagcaagaaggaaggcggugcuauguaugccgacgacaccgcggggugggacacacgcauuacgcucgaagaccugaaaaacgaggagaugguaaccaaucacauggaaggcgaacauaagaagcuggcggaagcgaucuuuaaacucaccuaccagaacaagguuguccgggugcagcgccccacgccccgggggacgguuauggacaucaucagccgccgggaccagcgcggcaguggacagguuggcaccuauggccugaacaccuuuaccaacauggaggcccagcucauccgacagauggagggggagggcguguucaagaauauccagcaccuaacggugacagaggaagucgcugugcagaauuggcucgcgcgaguggggcgcgagcggcugagccgcauggccaucaguggcgacgacugcgucgugaaaccccucgacgaccgauucgccaacgcccugaccgcacugaacgacaugggaaagaucagaaaagacauucaacaaugggagcccagcaagggguggaacgacuggacccaggugccuuucuguucccaucacuuccacgagcucaucaugaaggacggacgggugcuggucgugcccugucgcaaccaagacgagcugaucgggcgggcccgcaucagccagggcgccggguggucauuacgagagaccgccuguuuaggcaagagcuacgcacagauguggucacugauguacuuucaccgccgggaccuccgccuggccgcgaacgccaucuguagcgcuguccccucccauugggugccgaccucccggaccaccugguccauccacgccaagcacgaguggaugacuacggaggacaugcugaccgucuggaacagggucuggauccgggaaaacccuuggauggaggacaagacgcccguggaaagcugggaagagaucccauacuugggcaaacgcgaggaccaguggugcgggucccugaucggacugaccagccgggccacgugggcaaagaacauccaggccgccauuaaccaggugcgcucccuaaucgggaaugaggaguacaccgacuacaugccgagcaugaagcgguuccgacgggaggaggaggaggccggcguccugugguga

SEQ ID NO: 25415 - RNA, 9876 nt, Artificial Sequence
  derived and/or modified CDS sequence (opt11) from DENV-2__EU482466__SS-prME
ucggcggggaugaucaucaugcugauacccaccgugauggcguuccacuuaaccacccgcaacggggaaccccacaugaucgugggcauucaagaaaagggcaagagccuguuauucaagaccgaggacggggugaacaugugcacccugauggcgauggaccugggggaacuaugcgaggacacuaucaccuacaagugcccccuccugcggcaaaacgaacccgaggacaucgacugcugguguaacagcaccagcaccugggucaccuacgggaccugcaccacaaccggcgagcaucggcgggagaagcgcagcgucgcacuggugccccaugucgggaugggccucgagacccggaccgagacguggaugaguagugagggggcguggaagcacgcccagcgcaucgagaccuggauccuucgucaucccggcuuuaccaucauggccgcaauccuggccuacaccaucgggaccacacauuuccagcgcguccucaucuucauccuacucacggccguggccccgucgaugaccaugcggugcauuggcaucagcaaccgggacuucguggagggggucuccggagggagcuggguugacaucguacucgagcauggcuccugcguuacgaccauggccaagaacaagccuacguuagacuucgagcugaucaagaccgaggcuaagcagccggccaccuuacguaaguacugcaucgaggcgaaacuuaccaacacgaccacagaaaguaggugcccgacccagggugagcccucccugaaggaggagcaagauaagcgguucgugugcaagcacagcaugguggaccgcggcugggggaauggcugcggccuguucgggaaaggagggaucguaacgugcgccauguucacaugcaagaagaauauggagggcaagauugugcagcccgagaaccuggaguauacuauaguagucacgccgcacagcggggaggagcaugcgguugggaaugacacugggaagcacgggcaggagauuaaggugacaccgcagagcuccaucacagaggcugaacucaccggguacggaaccgugacgauggaaugcucacccagaaccggacucgacuucaacgagaugguguugcugcagauggaaaacaaggccuggcucgugcaccgccagugguuccuggauuugccccucccuuggcugccgggggcagacaagcaagaguccaacuggauccaaaaggagacccuugucaccuuuaagaacccccaugccaagaagcaagacgucgucgugcucgggucucaggagggggcgaugcacaccgcacuaaccggugcaaccgagauccagaugagcucggggaaccuccuauucaccggacaccucaagugccgacuacgcauggacaagcuccagcuuaagggcaugaguuacuccauguguacggggaaguucaaggucguaaaggagaucgccgagacccagcacggcaccaucgucauacgggugcaguacgagggggacggcagccccuguaaaaucccguucgaaaucauggacuuggagaagcgauacguuuuaggacggcugaucaccgugaacccgaucgugacggagaaggacagccccgucaauaucgaggcggagccacccuucggggacagcuacauuaucaucggcgucgagccaggacagcugaaguuaaacugguuuaagaagggcuccagcaucgggcagauguucgagacaaccaugcgcggggcgaaacgaauggccauccugggggacaccgcuugggauuucggguccuuaggcgggguauucacgagcauaggaaaagcccuucaucagguguucggggcaaucuauggcgcugcuuucuccggcgugagcuggacaaugaagauccugaucggggugaucaucaccuggauuggcaugaacucccggucaaccucacugucagucucccugguguuaguggggaucgucacgcuguaccugggcgucauggugcaggccgacagcgggugcgucguguccuggaagaacaaggagcucaagugcggcucugguaucuucaucaccgacaacgugcacacauggaccgagcaauacaaguuccaaccggagagccccucuaaguuagccucagccauccagaaggcccaggaggagggaaucuguggcauccgcuccguuacgcggcuggagaaccucauguggaaacagaucacccccgaacugaaccacaucuuagcugagaacgaggugaaacucacaaucaugacgggggauaucaaaggcaucaugcaggccgggaagcgcagccugcgcccgcagcccaccgagcugaaguacucauggaaaaccuggggaaaggcgaagaugcucaguaccgagucguacaaccagaccuuucugauugaugggcccgagaccgcggagugcccgaacaccaaucgggcguggaacagccuggagguugaagacuacggguuuggcguuuucacgacuaacauuuggcucaagcugaaggaaaagcaggaugcauuuugcgauucuaaacugaugucggccgccaucaaggauaaccgagcggugcaugccgacaugggguacuggaucgagucggcgcucaacgauacguggaagaucgagaaggccagcuucaucgaggugaagaauugccacuggccuaaaucucacacccuuuggagcaacggugugcucgagucggagaugaucauuccaaagaaccucgccggccccgugagccagcacaacuaucgcccaggauaccacacucagauugcgggccccuggcaccuggggaagcuggaaauggacuucgacuucugcgacggcaccaccgugauugucacggaggacuguggaaaccgaggcccuucccuucgcacgaccacagccagcgguaagcugaucacggaauggugcugccggagcuguacccugccaccguugcgcuaucgcggggaagauggcuguugguacgggauggagauuagaccccugaaggagaaggaggagaaccuaguuaacucccucgugaccgccggccacgggcaggucgacaacuucucacugggcguguugggcauggcccucuuccuggaagaaaugcuucgcacccgcguggggacgaagcacgcgauacuccuggucgccguguccuucgugacacugauaacuggcaauaugagcuuuaaagaccucggucgggucguagugauggucggggccaccauggccgacgacaucggcaugggggugacuuaucuagcccugcucgcugccuuuaagguucgacccacuuucgcugccggccuacugcuccggaagcugaccuccaaggaacugaugaugaccacgaucgguaucguacuccugagccaauccaccauccccgagaccgugcucgagcuuaccgaugcccuggcgcugggcaugauggugcuuaaaaucguccgcaacauggagaaguaccagcuggcuguuacgaucauggccauccuaugcgucccgaacgcugugauccugcagaaugccuggaagguaagcugcaccauccuggcggucguguccgugagcccccuguuacugaccuccucgcagcagaagaccgacuggaucccccuagcccucacgaucaagggccugaaucccaccgccaucuuccugacuacccucucgcgcacgaacaaaaagcggagcuggccgcucaacgaagccaucauggcggugggcauggugucuauccuagccagcucccuccugaagaacgacaucccuaugaccggcccccugguggcaggagggcuccucaccgucugcuauguguugaccgggcgcagugccgaccucgaguuagaaagggccacggacgugaagugggaagaccaggcggagaucucagggagcagcccuauccugagcaucaccaucucugaggacggcuccaugucgauuaagaacgaggaagaggagcagacccucaccauccugauccgcacuggcuugcucgucaucucaggccuguucccgaucagcaucccuaucacggcugcagccugguaccuuugggagguaaagaagcagcgcgccggggugcucugggauguccccagcccccuucccaugggcaaggcggagcuggaggauggugccuacaggauuaagcagaaaggcauccucgguuacucacagaucggagccggcguguacaaggaggggaccuuccacaccauguggcaugugacccggggcgccguccugaugcauaaggggaagcgaaucgagcccuccugggccgaugugaagaaagaccuaaucagcuacggcggggguuggaagcucgagggcgaguggaaggagggagaggagguucagguacuggcgcuggagccaggcaagaacccgcgggccgugcagaccaagcccggccucuucaagaccaacaccggcaccaucggagcagugucccuggacuucagccccggcacguccggcagcccuaucaucgauaagaaggggaagguugugggccuguacgggaacggcguggucacccgcuccggagccuacgugucagccaucgcgcagacagagaaguccauugaggacaacccggagauagaggacgacaucuuccggaagcgccggcugaccaucauggaccuacaccccggggccggcaagacgaagcgcuaccugccugccaucgugcgugaggccaucaagcgcggucugcggacccuuauacuggcgcccacccgcgucguggccgccgagauggaggaggcccugcguggccucccgauccgcuaccagacgccagccauccgggcugagcacacggggcgcgaaaucguggaccucaugugccacgccaccuucaccaugcgccuguugagccccguccgugugcccaacuauaaccugaucaucauggacgaggcccacuucaccgauccggcauccauugcggcgagaggguacaucuccacgcguguggagaugggcgaggcugcugggauuuucaugacagccacgccgccgggcagccgcgaccccuucccccagucuaaugccccgaucaucgacgaggagcgggaaauccccgaacgcagcuggaacuccggacacgagugggucacagacuucaaaggcaagacagugugguucguccccagcaucaaggcggggaacgacaucgccgccugccugcggaagaaugguaaaaaggucauccagcugucccgcaagaccuucgauagcgaguacgugaaaacucggaccaacgauugggacuucguagucacgaccgacaucucggagaugggcgccaacuucaaagcggagagggugaucgacccgcggcgaugcaugaaacccguuauccuuaccgacggugaggagcgggugauacuugcaggccccaugcccgugacccacagcuccgccgcgcagcgccgggggcgcauaggacggaauccuaagaacgaaaaugaccaguacauuuacaugggggaaccucucgagaacgacgaggauugcgcccacuggaaggaggcgaaaaugcuauuggauaacaucaacacgcccgagggcaucauccccagcauguucgagccggagcgcgagaagguggacgccaucgacggagaguaucggcuccgcggugaggccaggaagaccuucgucgaccucaugcggcgcggcgaucuacccguuuggcuagccuacaaaguggcugcugaggggaucaacuacgccgacaggcgcugguguuucgauggcaucaagaauaaccagauucuggaggaaaacgucgagguggagaucuggacuaaggaaggugagcgcaagaaguuaaagccgagguggcucgaugccaggaucuacuccgauccgcuggcguuaaaagaguucaaggaguucgccgcgggcagaaagagccucacgcugaaccugaucacugagaugggcaggcuccccaccuucaugacccagaagacucgcgaugcccuggauaaccuggcagugcuccacacggcagaggccggcgggcgagccuacaaccaugcccuguccgagcugcccgagaccuuagaaacuuugcugcuccugacccugcucgcgacgguaaccgguggcaucuuccuguuucugaugucuggucgcgggauuggcaaaaugacccucgggaugugcuguaucaucaccgccuccauccuacugugguacgcgcaaauacagccucacuggaucgccgccucaaucauucucgaguucuuucuaauaguguuguuaaucccagagcccgagaaacagcggacgccccaagauaaccaguugacguacguggugaucgccauccucacuguggucgccgcgaccauggcuaacgagauggguuuccuagagaagaccaaaaaggaccuggggcugggguccaucgccacgcagcagcccgagagcaacauccucgacaucgaccugcgcccugccuccgccuggacccuguaugcaguggcaacuacauucgugacgcccaugcuucggcacagcaucgaaaacagcuccguaaauguaagccugacggcuaucgccaaccaggccaccgucuuaaugggcuuaggcaagggcuggccccugucaaagauggacauuggggucccucugcucgcgaucggaugcuauucucaagugaacccgaucacccuuaccgccgcccugcuccugcugguggcccacuacgcgaucauaggacccgggcuccaggcuaaggcgacccgcgaggcccagaaacgggccgcggccggcaucaugaagaacccgacggucgaugggaucaccgugauagaccuggaccccaucccguacgaucccaaguucgagaaacagcugggccaggugaugcuccugauccugugugucacccaggugcuuaugaugaggaccaccugggcccugugugaggcccucacccucgcgacggggcccaucuccacccugugggagggaaaccccgggcgauucuggaacaccaccaucgcgguuagcauggccaacauauuccgcggauccuaccucgccggcgccgggcuccuguucagcauaaugaagaacaccaccaacacgcgucgcggcaccgggaacaugggggagacgcugggcgagaaguggaagagucgccuaaacgcccuggggaaguccgaguuccagaucuacaagaagucuggcauccaggagguagaccggacucuggcgaaagaggggaucaagcgcggcgagaccgaucaccacgccgugucacgcggguccgccaaacucaggugguucguggagcggaacauggucaccccggagggaaaggugguugaucuuggcugcgggcgcggcggguggagcuacuacugcggcggguuaaagaacguacgggaggugaaggggcucacgaaaggagggccgggccacgaggagccaauacccauguccaccuacgguuggaaccuggugcgccugcagagcggugucgacguguucuuuaucccgcccgagaagugcgacacccuccugugcgacaucggggagucuagccccaacccuaccguggaggccggccggacgcugagaguucugaaccuuguggagaauuggcugaauaacaacacgcaguucugcauuaagguacugaacccguacaugcccuccgucaucgagaagauggaagcacuccagcgaaaguacggcggggcccugguccgcaauccccugagccggaacagcacccacgaaauguacugggugucaaacgcuagcgggaacaucgucuccagcgugaacaugaucucccgcaugcucaucaaucgguucaccaugcgccacaaaaaggcaaccuacgagccggacguggaccugggcagcgguacgcgcaacaucggaaucgaguccgagacucccaaccuagacaucauuggaaagcgcauagagaagaucaagcaggagcacgaaaccagcuggcacuacgaccaggaccaccccuacaagacaugggccuaucacggcuccuaugagacuaagcagacgggcagcgcgagcaguauggucaacggcguugugcggcugcuuaccaagcccugggacguccugccgaccgucacgcaaauggccaugaccgauacuacccccuucgggcagcagcgcguguucaaggaaaagguugauacucgcacccaggagcccaaagaggguaccaagaagcugaugaagaucaccgccgaguggcuguggaaggaguuggguaagaagaaaacgcccagaaugugcacccgcgaggaguucacucggaaggugcgcucaaacgccgcccucggagcuaucuuuaccgacgagaacaaguggaaaagugcgagggaggccguggaagacucccgcuucugggagcuggucgacaaagagcggaaccuccaucucgagggcaaaugcgagacgugcguuuacaacaugauggggaaacgagagaaaaagcugggcgaguucgggaaggcgaaggggagcagagcgauuugguacauguggcugggugcacgcuucuuagaguucgaagccuuggguuuccugaaugaggaccacugguucucccgggagaacucccucucaggcgucgagggagaaggccugcacaaacuaggguacauccuccgcgacgugagcaaaaaggaaggcggcgccauguacgccgaugacaccgcggggugggacaccagaaucacccuggaggaccugaaaaaugaggagauggugacgaaccacauggagggcgagcacaagaagcucgccgaggccaucuucaagcugacuuaucaaaacaaggucguucgcguccagcggcccacgccccgggggaccgucauggacauaaucagccggcgcgaccagcggggcuccggucaaguuggaacguacgggcugaacaccuuuacgaacauggaagcccagcucaucagacaaauggagggggagggcguuuucaagaauauccaacaccugacggucacggaggagguagccgugcagaacuggcuagcgcgggucgggcgcgaacgcuuaagccgaauggccaucuccggggacgacugcguugugaagccccuggacgaucgcuucgccaacgcccugaccgcccucaacgacaugggaaagaucagaaaggacauacagcagugggaacccaguaagggauggaacgacuggacccaggucccguucugcagucaccacuuccacgagcugauuaugaaggacggccgcguacuggugguccccugcagaaaccaggacgagcucaucgggcgcgcaagaaucagccagggcgccggguggucccugcgcgagaccgcaugucugggcaaaagcuacgcccagauguggucccucauguacuuucaccggcgcgaccugagauuagcggccaacgccaucuguagcgccgugcccucccacugggucccaacgucacggaccaccugguccauccacgccaagcacgaguggaugaccaccgaagacaugcucacggucuggaacaggguguggaucagggagaacccguggauggaggauaagacccccguagaauccugggaagagaucccauaccugggaaagcgagaggaucaguggugcgggucccugaucggccuaaccagccgagccaccugggcgaagaacauacaagccgccaucaaccagguccggagucugaucgggaaugaggaguacacggacuacaugcccagcaugaagcgcuuccggcgcgaggaggaggaggccggcguccugugguga

SEQ ID NO: 25416 - RNA, 9876 nt, Artificial Sequence
  derived and/or modified CDS sequence (opt11) from DENV-2__EU482467__SS-prME
ucugccggcaugaucauaauguugaucccaaccguaauggcuuuccauuuaaccacccggaacggggagccccacaugaucgucggcauacaggaaaaagggaagucccugcuguucaagaccgaggacggaguaaacaugugcacccuuauggcgauggaccugggggaacugugcgaggacaccaucaccuacaagugcccccuccugaggcagaacgagccagaggacaucgacuguuggugcaacuccacgagcaccugggugaccuacgggaccugcaccaccaccggggagcaccgccgggaaaagcggagcguggcccuggugccucacguggggaugggccucgagacccgcaccgagaccuggauguccagcgaaggagccuggaagcacgcccagcgcaucgagaccuggaucuuacggcacccgggcuucaccaucauggccgcgauccuggccuacaccaucgggacgacacacuuccaacgcguccucauuuuuauacugcugacugcgguggcaccuucuaugaccaugcgaugcaucggcaucagcaaccgcgacuuuguagagggcgugucagggggaagcuggguggacaucguguuagagcacgggaguugcgucaccaccauggcgaagaacaagcccacguuggacuucgagcuuaucaagaccgaggcuaagcaacccgccacccuacggaaguacugcaucgaggcuaagcuaaccaacacgacuacggagucgagaugcccgacccagggggaacccucccugaaggaggagcaggauaaacgguucgugugcaagcacagcaugguggaucgcggcugggggaauggaugcggccuguuuggcaagggcgguaucgucacgugcgccauguucacgugcaagaagaauauggagggcaagaucgugcaacccgaaaaccuagaguacacaaucguuguuacgccacacucgggagaggagcaugcggugggcaacgacacggguaagcacggcaaggaaaucaagguaaccccgcagagcuccauuacugaggccgagcugaccggguacgggaccgucacgauggagugcaguccccggaccgggcucgacuucaacgaaauggugcugcugcaaauggagaacaaggccuggcucgugcaccgccaaugguuccuggaccucccccucccuuggcugccuggggccgacaagcaagaguccaauuggauccagaaggagacucuugucaccuucaagaacccccacgcaaagaagcaagacgucguuguacucggcagccaggagggggcuaugcacacugcccugacgggagccaccgaaauacagaugucauccgggaaucuccuauucaccggccaccuuaaaugccggcugcguauggauaagcuccagcucaagggcaugagcuauuccaugugcacgggcaaguucaaggugguuaaggagaucgccgagacccagcacggcaccaucgugauccgggugcaguacgagggggacggcagucccugcaagauacccuucgagaucauggaccuggagaaacgcuacguccugggccggcugauaaccgugaacccgauuguuacggagaaggacuccccagucaacaucgaggcugagccgcccuuuggggauagcuauaucauuaucgggguggagcccggccaacugaagcucaacugguucaagaagggcagcuccaucgggcaaauguucgagaccacaaugaggggugcgaagcgcauggccauccugggcgacaccgccugggacuucggcucucugggcggaguauucacaagcaucggcaaggcccugcaccagguauucggggcuauuuacggcgcugcguuuuccggggucagcuggaccaugaaaaucuugaucgggguuaucaucacauggaucggcaugaauucccggagcacuucgcugagcgucucccuaguucucgugggaaucguuacgcuguaucugggcgugauggugcaggccgacagcgggugugugguguccuggaagaauaaggagcucaaguguggcagcggcaucuucaucacagacaacgugcacacauggacugaacaguacaaguuucagcccgagagccccucuaagcuugcuagcgccauccagaaggcgcaggaagaagguaucugugguauccgaucuguaacgcgacuggagaaccucauguggaaacagauaacucccgaacuuaaccacauccuugcagaaaacgagguaaagcucaccaucaugaccggagauaucaaaggcaucaugcaggccgggaagcgcagccugcggccgcagccaacggagcugaaauacagcuggaagacuuggggaaaggcuaagaugcucagcacagaguccuauaaccaaaccuuccugaucgacggccccgaaacggcagaaugcccgaacacgaaccgggcauggaacagccuggagguggaagacuacggguuuggcguuuucaccaccaacaucuggcucaaguuaaaagagaagcaggacgccuucugugauuccaagcugaugagcgccgcaauuaaggacaaccgggcggugcaugccgacaugggguauuggaucgagucggcacuaaaugacacguggaaaauugagaaagccuccuuuauagaggugaaaaauugucacuggcccaaaucccacacacuuuggaguaauggcguccuggagagugagaugaucaucccaaagaaccuagccggccccgugagccagcacaauuaccgcccaggguaccacacccagauagcaggcccauggcaccugggcaaguuagagauggacuucgacuucugcgacggcacuaccgucauaguuacggaggauugcggaaaccgaggccccucccuccgcaccacuacggccagcggcaagcugaucacggaguggugcugccggagcugcacccugcccccgcuccgcuaccgcggggaagacggcugcugguacgggauggagauccgcccccugaaggagaaggaagagaaucuggugaacagucuggugaccgccggacacggacaggucgacaacuucucgcugggcguccuuggcauggcgcucuucuuagaggagauguugcggacccgcguugggacuaagcacgcgaucuugcugguugcuguguccuuugugacacugaucaccggcaacaugagcuucaaggaucucgggagggucguggugauggucggugccaccauggccgacgacauugguaugggcguuacguaucuggcccuguuggcggccuucaaggugcgccccacauucgccgcuggucuauuacuccggaaguugacuuccaaggaacugaugaugaccacuauagggauaguccuccugucccagagcacaauacccgaaaccgugcuggagcucaccgacgcgcuugcgcugggcaugaugguucuuaagaucguccgaaacauggagaaguaccagcuagccgugaccauuauggcuauccugugcgucccgaaugccgucauucugcagaacgccuggaagguaagcugcaccauccuggcugucgucagcgugagucccuuacuccugacaaguucccagcagaagaccgauuggaucccguuggcccucacgaucaaggggcugaacccuaccgcaaucuuucugaccacccucucucgcaccaacaagaagcgcaguuggccacuuaaugaggccauaauggcagucggcaugguuuccauccuugccucuucguugcucaagaacgauauccccaugaccgguccccucguugcaggaggccuccugaccguuugcuacgugcugaccgggagaucagcugaccucgagcuugagcgggccacggacguuaagugggaggaucaggcugagaucuccggcagcagccccauucuuuccaucacuaucagugaggacggguccaugucuauuaagaacgaggaggaggagcagacucuaacgauccugauccgcaccggccugcucguaaucuccggccuguuuccuaucagcauuccuaucacagccgccgccugguaccugugggaggucaaaaagcagcgggccggggugcuaugggacguccccucgccgccgcccaugggcaaggcggagcuggaagacggagccuaccgcaucaaacaaaagggcauccugggguacagccagaucggagccggcguguacaaggaggggaccuuccacacuauguggcacgugacccguggggcuguauugaugcauaaagggaagcguaucgaacccuccugggccgacguaaaaaaagaccugaucagcuauggaggggguuggaagcuagagggugaguggaaggagggggaagaggugcagguccuggcgcuggagcccggcaaaaacccccgggcugugcagacgaagccggguuuguucaagaccaauaccggaaccaucggugccgugagucucgacuucagccccggcacguccgguagcccuauaaucgacaagaagggaaaagucgugggccuauacgggaacgggguggucacccgcaguggcgccuacgugagcgccaucgcucaaaccgagaagagcaucgaggacaacccagagaucgaagacgacaucuuccggaaacgccggcugacaaucauggauuugcacccgggggccggcaagacgaagcgcuaccuacccgccauaguucgugaggccaucaagcggggccuucggacgcugauccucgccccgacgcgagucguugcugcggaaauggaggaagccuugcggggccugcccauacgcuaccagacacccgcuauccgggcggagcacacgggucgagagaucguagaucucaugugccacgcgaccuucaccaugcgccugcugaguccuguacgggugccgaacuacaaccuuaucaucauggacgaagcccauuucaccgaccccgcuagcauagcagcgcgcggcuauaucagcacccggguggagaugggcgaggcagcagggaucuucaugaccgcgacgccgcccggcagccgcgacccguucccccagaguaacgcuccuauuaucgacgaggagcgggagaucccagagcgaaguuggaacagcgggcacgagugggucaccgacuucaagggaaaaaccguaugguucguccccagcaucaaagcggggaaugacauagcagccugccuccggaagaacgguaagaagguaauccaguugucccgcaaaaccuucgacagcgaguacauuaagaccaggacgaaugacugggauuucguggugacgacugacaucuccgagaugggcgcgaacuucaaggcggaacgcguaaucgacccccguagauguaugaagcccgugauccucaccgauggcgaagaacgggugauuuuggccgguccaaugccggucacccacagcucggccgcucagagacgggggcgcaucggcaggaauccaaagaacgagaacgaucaguacaucuacaugggggagccguuagagaacgacgaggacugcgcgcacuggaaggaggcgaagaugcuccuagacaacaucaacacgccugaaggaauuauaccgagcauguuugagcccgagcgugagaagguggacgcgauugauggggaguaccggcugcggggggaagcccggaagaccuuuguggaccucaugcggcgcggcgaccucccaguguggcuggccuacaagguggccgcggaggggaucaauuacgcagaccgccgauggugcuucgacgguaucaagaacaaucagauccucgaggagaacguggaggucgagaucuggaccaaggaaggggaaaggaagaagcugaagccgcgauggcuggacgcccgaaucuacuccgauccccucgcgcugaaagaguucaaagaguucgcagcagggcgcaagucucugacccucaaccucaucaccgagaugggccggcugcccaccuuuaugacccagaagacccgcgacgcccucgauaaccuggcaguccugcauacggccgaggccggcgggcgcgcuuacaaccacgcgcucucggaacugcccgagacccuggagacuuugcuguugcuuaccuuacuggccacggucaccggggggaucuuccucuuccugauguccggccgagggaucgguaagaugacacuggggauguguugcaucaucaccgccuccaucuugcugugguacgcgcagauccagccgcacuggauugccgcgucgauuauacuggaguucuucuuaaucgugcugcugauccccgagcccgagaagcagcggaccccccaggacaaccagcucacauacguggucaucgcgauccugaccgugguggccgcgaccauggccaacgagaugggcuuccuagagaagaccaagaaggaucucggguuaggcucgaucgcaacgcagcagccggaaagcaacauccucgacaucgaccuccgccccgccuccgcguggacccuauacgcgguugccaccaccuucguuacgccuaugcugcggcacagcaucgagaauagcucagucaacgucagccucaccgccaucgcgaaccaggccaccguguuaaugggacugggaaagggcuggccacucuccaaaauggauauaggagugccgcuacuugcuauuggcugcuauucccaagucaaccccaucacccucacggcagcccugcucuugcugguggcccacuacgcgaucaucgggccaggccugcaggccaaggccacuagagaggcccaaaaacgggccgcggccggcaucaugaagaaccccacgguagacgggaucacggucaucgauuuagauccgauccccuacgaccccaaguuugagaagcagcugggccaggugaugcugcucauauugugcgugacgcagguccugaugaugcgcaccaccugggcgcucugcgaggcccucacccuggccacggggcccaucucgacccuaugggagggcaauccggggcgcuucuggaacacaacgauagcggucucgauggccaacaucuuccgcggcucguaccuggccggggcugggcuccuuuucaguaucaugaagaacacgaccaacacgcgcagagguaccgguaacaugggcgagacgcuuggcgaaaaguggaagucccgccugaacgccuuaggcaaaagcgaguuucaaaucuacaagaagagcggcauccaagagguggaccggacccuagcuaaagaggguaucaagaggggggagaccgaccaucacgccguaagcagaggguccgccaagcugagaugguucgucgagcgcaacauggugacaccggaggguaagguuguagaccuuggcugcggucgcggcggguggucuuacuauugcggcgggcugaagaaugugcgggaggucaaagggcugacgaaaggcgggcccggucacgaggagcccauuccaauguccaccuauggguggaacuugguacgcuuacaaaguggaguggacgucuuuuucaucccgcccgaaaagugcgacacgcugcucugcgauauaggggagucgucucccaacccgaccguggaagccgggaggacgcugcggguacugaaccuugucgaaaacuggcucaacaacaacacccaguucuguaucaagguacugaauccauauaugcccuccgucaucgagaagauggaggcgcugcagcgcaaguacggcggugccuuaguccgcaacccgcugagccggaauagcacccaugagauguacuggguguccaacgccagcgggaacaucgugucguccguaaacaugaucaguagaauguuaaucaaucgguucacgaugcggcacaagaaggcaaccuacgagcccgacguggacuugggcagcggcacgcggaacauugggaucgagucugagauaccgaaccucgacaucauaggcaagcguauagagaaaaucaagcaggagcacgagacgagcuggcacuaugaccaggaccaccccuauaaaacaugggccuaucacggcuccuaugagaccaagcagacgggaagcgcgucuagcaugguaaacggaguagugcggcuucucaccaaaccgugggacgugcuuccaacugucacucagauggcuaugacagacaccacccccuuugggcagcaaaggguguuuaaggagaagguggacacucgcacgcaggagcccaaggaggguacuaagaagcugaugaagauuaccgccgaguggcuguggaaggagcugggcaagaaaaagacaccuaggaugugcacgcgcgaggaguucacccggaagguccgauccaacgccgccuuaggggcgaucuuuaccgacgagaacaaguggaagagcgcccgggaagccguugaggacucccgguucugggagcucguggauaaggagcguaaccugcaccuggagggcaaaugcgaaacgugcguauacaacaugaugggaaagagagagaagaagcucggcgaguucgggaaggccaaggggagccgggccauaugguacauguggcucggcgcccgcuuccuggaguucgaggcgcucggguuucugaacgaggaccacugguucaguagggagaacagccuguccggcguggagggggagggacuccacaaauugggguauauccugcgcgacgucucuaagaaggagggaggcgccauguacgccgacgauacggcgggcugggacacccggauuacccuggaggaccugaagaacgaggagauggugaccaaccacauggaaggcgagcaccgcaagcuggccgaggcuaucuucaaacucacguaccagaacaaggugguccgggugcaacgacccacgccacgggguaccgugauggacaucaucagcaggcgggaccaacgcggcuccgggcaagucgguaccuauggccugaacacguucaccaacauggaggcgcagcuaauuagacagauggagggugaaggcguauucaagaauauucaucaccucacggugaccgaggagguggccgugcaaaacuggcucgcgcgcguugggcgcgagagacuuagccgcauggcgaucuccggugaugacugcgucguaaagccacucgaugaccgguucgccaacgcguugacugcccugaaugauaugggcaagauucgcaaggacauccaacagugggagccgucgaagggguggaacgacuggacccaggugccuuucuguucacaccacuuccacgagcucauaaugaaggacggccgggucuugguagugcccugucgcaaucaggaugaguuaaucgggcgggcgcgcauuagccagggugccggguggucccuccgagaaaccgccugccuggguaaaucuuacgcccagauguggucucugauguacuuccaccgcagagaccucagacuggcagcgaacgccaucuguagcgcugucccgagccacugggugccgaccagccggacgaccuggagcauucacgccaagcacgaguggaugaccaccgaggacauguugaccguguggaaccgcgucuggauucgugagaaccccuggauggaagacaagacgcccguggaaucaugggaagagauccccuaccucggcaagcgugaggaucaguggugcgggagucucaucggccuaaccucacgagcaaccugggccaaaaacauccaggccgccaucaaucaaguccgcucccucaucggaaaugaggaguauacagacuacaugccgagcaugaagcguuuccgccgcgaggaggaggaggccgguguccucugguga

SEQ ID NO: 25417 - RNA, 9876 nt, Artificial Sequence
  derived and/or modified CDS sequence (opt11) from DENV-2__EU482468__SS-prME
agcgcggggaugauuaucauguugauccccacagugauggcauuucaccuuaccacacggaacggugaaccccacaugaucgucgguauccaggagaaagggaaaucccugcuguuuaagaccgaggacggcgucaauauguguaccuuaauggcaauggacuuaggggagcugugcgaggauaccaucaccuauaaaugcccacugcuacggcagaacgagcccgaggacaucgauugcuggugcaacagcaccucgaccuggguaaccuacgggacgugcacuacgaccggcgagcaccgccgggagaaacggucuguugcccuugugccucacgucgggaugggccucgagacgcggacugagacauggauguccagcgagggagccuggaagcacgcccaacgcauugagaccuggauaaugaggcacccgggcuuuacaaucauggcagcgauacuggccuacacuaucgggacgacccacuuccaaagaguucuuauuuucauccuccucaccgccguggcucccuccaugacuaugcggugcauuggcauuagcaaccgugacuucgucgagggcgucuccgggggcagcuggguggauauugugcuggagcacgggaguugcgucaccaccauggcgaagaauaagccuacucucgacuucgagcugaucaagaccgaggccaagcaaccugccacacuacggaaguauugcauugaggcuaagcucaccaacacgacuaccgagucuagaugucccacccagggcgagccgucccugaaggaagaacaagacaagcgguucgugugcaagcauagcaugguggaccgcggaugggggaauggcugcggacucuucggcaaaggagggaucgucacaugugccauguuuacuuguaagaagaacauggagggcaagaucgugcagcccgagaaccuugaguacaccauaguggucacuccucacaguggggaggaacacgcggugggaaacgacacggggaagcacggcaaggagauaaaggugacaccgcagagcuccaucacugaggccgagcugaccggguauggcaccgucacgauggagugcagcccacggaccggucuggacuucaacgagauggugcuccugcaaauggagaacaaggcguggcuggugcaccgccaaugguuccucgaccugccguugccgugguugccgggggccgauaaacaggagaguaauuggauccaaaaggagacccuggugacauucaaaaacccccaugccaaaaagcaggacguggucgugcugggaagccaagagggggcuaugcacacggcucuuaccggcgcgaccgagauccagaugagcuccgggaaccugcuguucacuggccacuugaaauguagauuacgcauggacaagcuacagcucaagggcaugagcuacuccaugugcacggggaaguucaaaguagucaaagagauagcugaaacgcagcauggaaccaucguaauccgagugcaguacgagggagacggcucgcccuguaagauccccuucgaaaucauggaccuagagaaacgcuacgugcugggccggcucauuacaguuaacccaaucgugacggagaaagacuccccagucaacaucgaagcggaaccuccauucggugacagcuacaucauaaucgguguggagccugggcagcugaagcugaauugguucaagaagggauccagcaucgggcagauguucgagacaaccaugcgaggcgccaagcgaauggccauccucggcgacaccgccugggauuuuggguccuuagguggggucuuuaccagcaucggcaaggcccuacaccaggucuuuggggccauauacggagcggcguucuccggcgugucauggaccaugaagauacucaucggagugaucauaaccuggaucggcaugaacucgcggagcaccucacugagcgucaguuugguacugguagggaucgucacccuuuaucugggcgugauggugcaggccgacagcgggugugucguguccuggaagaacaaggaacugaagugugguagcggcaucuucaucaccgacaacguucacaccuggaccgaacaguacaaguuccaaccggagagccccuccaaacucgccagcgcgauccaaaaggcacaagaagagggcaucugcggaauccgcuccgucacucggcuggagaaccugauguggaagcagauuacgcccgaguuaaaccacaucuuagccgagaacgaggugaagcugaccaucaugacgggggacauccgcgggaucaugcaagccgggaagcggagccuccgaccgcagcccacggaauuaaaguacuccuggaagacaugggguaaggccaagaugcugagcaccgaguccuacaaucaaacguucuuaaucgacggcccggaaacggccgagugcccgaacaccaauagagcauggaacagccuggagguggaggacuacggguucggcgucuucacaaccaacauuuggcugaaguuaaaagagaagcaagacgcuuucugcgacuccaagcugaugagcgcagccaucaaggacaaucgggcgguucaugcagauaugggguacuggauggagucagcgcugaacgacacuuggaagaucgaaaaggcuucauucauagaagugaaaaacugccacuggcccaagucccacacacucuggaguaauggcguccuggaauccgagaugaucauccccaagaacuuagcugggccagucagccagcacaacuaccggccgggguaccauacccagaucgcgggccccuggcaccucgggaagcucgaaauggauuucgauuucugugauggaaccaccguuaucgucacggaggauugcgggaaucgugggccgucccugcggaccacgaccgccagcgguaagcugaucacggagugguguuguagaagcugcacgcugcccccgcuacgguaccguggggaggacggcugcugguacgguauggagauccggccccucaaagaaaaggaggagaaccuggugaacucccugguaaccgcgggccacgggcaggucgauaauuucagccucggcgugcucggaauggcccuguuccucgaagagaugcugcgcacacguguggggacuaaacacgccauccugcucgucgcugugagcuuugugacccugaucaccggcaacaugucguucaaggaccuggggagagucguggugauggucggcgccacuauggcugacgacaucgggaugggcgugacguaccuggcccugcuggccgcuuuuaaggugcggcccaccuucgcggcaggccuucugcugcgcaagcucaccucgaaggaacugaugaugaccacuaucgguauuguccuccuaucccagucaacgauacccgagaccguacuggaguuaaccgacgcucucgcgcugggcaugauggugcugaaaaucguccggaacauggagaaguaccaauuggccgucacgaucauggccauacugugcgucccgaacgcugugaucuuacagaacgccuggaaggugagcuguaccauacucgcggucguauccgugucuccccugcuacucacguccagccagcagaagacagauuggauaccauuggccuugacuaucaagggguuaaaccccaccgcgauuuuccucaccacgcugucacggacaaacaagaagcgcagcuggccgcucaacgaggccaucauggcggucggcaugguuuccauuuuagcgagcucccuccuaaagaaugacauccccaugaccggcccccucguggccgggggacugcucaccguguguuacgugcuaacaggaaggagcgcugacuuagagcucgagcgggcaacggacgucaaaugggaggaccaggcagagaucuccgguuccagccccauccuguccauuaccaucuccgaggacgggucuaugagcaucaagaacgaggaggaggagcagacccugaccaucuugauccggacgggccugcuggugaucaguggccuauucccgaucucuauuccuaucaccgccgcagcaugguaccugugggaagugaagaagcagcgcgcuggggugcugugggacguucccagucccccgcccaugggcaaggccgaacuugaggacggagccuaccggaucaagcagaaggguauccuugguuacagccagaucggcgccggcgucuauaaggaggggaccuuucacaccauguggcacgucacaagaggggcaguccugaugcacaaaggcaagcggaucgagccgaguugggccgaugugaagaaagaccuaaucagcuacggagggggcuggaagcucgaaggcgaauggaaggagggugaggagguacaggugcuggcguuagagcccgguaaaaauccccgagccgugcagacgaagcccgggcuguucaagacaaacacaggcacaaucggcgccgugagucuugauuucagccccggcacguccggcagccccaucauagacaagaagggcaaggucguuggccucuacgggaauggagucgucacccgguccggcgccuacguuagcgccauugcccaaacugaaaaguccaucgaggacaaccccgagaucgaggaugauaucuuccgcaagcgucgccugacgaucauggaccugcaccccggggccggcaaaaccaagcgguauuuacccgcgauuguccgcgaagccaucaagcgagggcuccgcacccugauccuugcuccgacccggguaguggccgccgagauggaggaagcccugcgcggccugccaauucgguaccaaaccccggccaucagggcggagcacaccgggcgagagaucguugaccugaugugccacgccaccuucaccaugcgucuccugagccccguacgcgugccgaacuacaaccuuaucaucauggacgaagcacacuucaccgaccccgccucuauagccgcgagaggcuacauaagcacgcgcguggagaugggcgaggccgccgggaucuucaugaccgcgacgccgccaggcucccgggacccuuucccccaauccaacgcccccaucauugacgaggaaagagagauccccgaacggagcuggaacuccgggcacgaaugggugacagacuucaagggcaagacugugugguuugugccgagcaucaaggccgggaaugacauugcugccugccuccggaagaacgguaaaaaggucauccagcucagucggaagaccuucgauucagaauacgugaagacacgcaccaacgacugggacuucguggucacuaccgacaucucugagaugggcgccaacuucaaggccgagcgggucaucgacccccgucggugcaugaagcccgugaucuuaacggacggagaagaacgcgucauccuagccggcccuaugccagugacccauagcucggccgcucagcggcgcggccggaucggccgcaacccaaagaacgagaacgaccaguacaucuacaugggggagccccuugagaacgacgaggacugcgcucauuggaaggaggcgaaaaugcugcuagacaacaucaacacgcccgagggcaucauacccucaauguuugagcccgaacgggagaagguggacgcgaucgacggcgaguaccgccugcgcggugaggccaggaagaccuuuguggaucuaaugcgccggggagaccucccaguguggcuggcuuauaagguagccgcggaggguaucaacuacgcugaccgccgguggugcuucgacggcaucaagaacaaccaaaucuuagaggaaaaugucgaaguggagaucuggaccaaggagggugaacgcaagaaacucaagccgcgguggcuggacgcucgcaucuacuccgacccccuggcgcucaaggaguucaaagaguucgccgcgggccggaagucccugacccuuaaccuuauuacggagaugggcagacugcccaccuucaugacgcagaagacgagagacgcccuggacaaccucgcggucuugcacacggccgaggccggcggcagagccuauaaccaugcccuuuccgagcucccggaaacccuggagacccugcuccuacugacccuccuggccacggugacuggaggcaucuuucucuuccucaugagcggcagggggaucgguaagaugacgcuggggauguguugcaucaucaccgccagcacccugcucugguacgcccagauccagccgcauuggauugcggccagcaucauccuggaguucuucuugaucgugcucuuaaucccugagccagagaagcagcggacuccccaggacaaccagcugacauacgucgugaucgccauucucaccguaguugcugcgaccauggccaaugagaugggcuuccuggagaaaacgaagaaggaccuggggcucggcuccaucgccacccagcaaccugagagcaacauccuggacaucgaccugcggcccgccucugccuggacccucuacgcgguugcuacuacguucgugacccccaugcugcgccacagcaucgagaacagcucugucaauguuagccugaccgccaucgccaaccaggccacgguccucaugggccuagggaagggcuggccacuguccaaaauggacaucggggugccgcuccuggcgaucggaugcuacagccaggugaaucccaucacacucacggccgcccuccugcugcuagucgcccauuacgccaucauugggccgggucuccaggcuaaggccaccagggaggcccagaagcgcgccgccgccggcaucaugaagaacccaaccgucgacgggaucaccgugauagacuuggacccgauccccuacgaccccaaguuugagaagcagcucggccaggugauguugcugauccucugcgucacacaggugcugaugaugagaacuaccugggcacugugcgaggcccucacgcuggcgaccgggccuaucuccacccugugggaaggaaacccggggcgcuucuggaacacaacgauugcggugagcauggcuaacaucuuccguggcuccuaccuugcuggcgccggccugcuguucucaaucaugaagaauacgaccaacaccagaaggggaaccgggaacaucggcgaaacccucggcgagaaguggaagucccgguugaaugcucugggcaagagugaguuccaaaucuacaagaaaucgggcauacaggaaguagaccgaacccuugcuaaggagggcauaaagcggggagagacagaccaccacgcuguaucucgagguuccgcgaagcugagaugguucguggaacggaauauggucacgccugaaggcaaggugguugaccucgggugcgggcggggcggguggucauauuacugcggagggcuaaagaacguuagggaggugaaaggccugaccaagggcgggccgggccacgaggaacccaucccgauguccacauacggguggaaccucguccggcuccagagcggcgucgacguguuuuucauacccccggagaagugcgacacccugcugugcgacaucggggaguccagccccaacccaacgguagaggccggucgcaccuugcgggugcuuaaccugguggagaacuggcucaacaauaauacccaguucugcaucaaaguacucaacccauauaugcccuccgugauagagaagauggaggcgcuacagcgcaaguauggcggagcccuggugcgcaacccgcucagccgcaacagcacucacgagauguacuggguauccaaugccagcggcaacauagucucaagcgugaacaugauuucccggaugcugauaaaucgcuucaccaugcggcacaagaaggccacuuaugagcccgacguggaccugggcagcggaacuaggaauaucgggauugaauccgagauccccaaccucgacauuaucggaaagcggauugagaaaaucaaacaggagcacgagacaagcuggcacuacgaccaagaccaccccuauaagaccugggcauaccacggcaguuacgagacaaagcaaacgggaucggcguccucuauggucaacggaguggugaggcugcugaccaagccgugggacguccuccccaccgugacgcagauggcaaugacugacaccacacccuucgggcagcagagaguguuuaaggagaaggucgacacgcggacacaggagccgaaggaagguacuaagaaguugaugaagaucacggccgaguggcuuuggaaggaauuagggaagaagaaaacgccucgcaugugcacacgugaggaguucacccgcaaggugcgguccaaugccgcacugggcgcuaucuucacugacgagaacaaguggaagucagcccgugaggccguggaggacucccgguucugggagcuggucgacaaggaacgaaaccuccaucuugagggcaagugcgagacguguguguacaacaugauggggaagcgagagaagaagcugggcgaguuugggaaggccaaggguucacgggccaucugguacauguggcucggggcgcgguuccuggaguucgaagcacugggguuccucaaugaggaccacugguucucgcgggagaauagcuuauccggcgucgaaggugagggccugcacaaacugggcuacauccugagagacguuucuaagaaggaaggaggggccauguacgccgacgacaccgcugggugggacacccgcaucaccuuggaggaucuuaaaaaugaggagauggugacgaaccacauggaaggagagcacaagaaauuagccgaagccauauucaagcuaaccuaccagaacaaggucgugcgggugcaacgccccacaccccgggggacugucauggacaucaucucgcgccgggaccagcgcggguccggucagguggguacguacggccucaacacauuuacuaauauggaggcccaacugauccggcagauggaaggggaggguguuuucaagaacauacagcaccugaccgucacggaggaaguggcggugcacaacuggcucgcgcgcgucggacgugagcggcugagccgcauggccauauccggcgacgacugcguggugaagccccuggacgaucguuuugccaacgcccucaccgcuuugaaugacaugggcaagauccgcaaggacauccagcagugggagccgucaaagggguggaacgauuggacccagguccccuuuuguucucaucacuuccacgaacugauuaugaaggacggccgggugcucgugguccccugccgcaaccaggaugaguuaaucggacgggcccgcauuagccagggcgccggcuggagccugcgggagaccgccugcuugggcaagucguacgcgcaaaugugguccuugauguacuuccaucgacgggacuugcgccucgccgcaaacgccaucugcagcgccgugcccucgcacugggugccgacguccagaacgaccugguccauacaugcaaagcacgaguggaugacgacagaggacaugcuuacaguuuggaaucgcguguggauccgggagaaccccuggauggaggacaaaaccccaguggagagcugggaggagauccccuaccucggcaagcgcgaggaccaauggugcgguucccucaucggccugaccucccgggccaccugggcuaagaacauccaggccgccaucaaucagguccgcucccucauagggaacgaggaauacacggacuauaugccuagcaugaaacguuuccgccgcgaggaggaggaggccggugugcucugguga

SEQ ID NO: 25418 - RNA, 9876 nt, Artificial Sequence
  derived and/or modified CDS sequence (opt11) from DENV-2__EU482469__SS-prME
ucggcggggaugaucaucauguuaauccccaccgugauggcguuccaccucacuacccggaacggcgagccucauaugaucgucggcauccaggagaagggaaagagccugcuguucaagaccgaggacggcgugaacauguguacccucauggcgauggaccugggggagcugugcgaagauacuauuaccuauaagugcccccuccugcggcagaaugagcccgaggacauugacuguuggugcaauagcaccagcaccugggugaccuacgggaccugcaccaccaccggagaacacaggcgggagaagcgcagcguagcccuggugccgcauguuggaaugggcuuagagacccggaccgaaaccuggauguccagcgaaggggcauggaagcacgcacagcgcauagagaccuggauccugcggcacccgggcuucacgaucauggccgcuaucuuggcccacaccaucgggacuacccauuuccagagggucuuaaucuucauccuauugacggccguggcccccuccaugaccaugagguguaucggcaucagcaaccgcgacuucguggaaggcgucuccggaggcagcuggguggacaucguccucgagcacgguucgugugugaccaccauggccaaaaauaagccaacgcuggacuucgagcugauuaagacggaagccaagcagccagccacccucagaaaauacugcaucgaggccaagcugacgaacacgaccaccgagagucgaugucccacccagggcgaacccuccuuaaaagaggaacaggacaagagauucguuuguaagcacagcaugguggaccguggcugggggaauggcugcggccucuucggcaagggcgggauugucacgugcgccauguuuacguguaagaaaaacauggagggcaagauuguacaacccgaaaaccuggaguacaccaucguggucacgccccacuccggugaggagcacgcagugggcaacgacacggggaagcacggcauggaaauuaaggugacaccccagagcuccauuacugaggccgagcugacgggguacggcacugucaccauggagugcagcccacggaccggccucgacuucaaugaaauggugcuacugcagauggagaacaaagcguggcuugugcaccggcagugguuccucgaucugccccuacccugguuaccgggggcagacaagcaagaauccaacuggauccagaaggagacccugguaacuuucaagaacccccacgccaagaagcaggacguggugguucucgguagccaggagggggcaaugcauacugcccugaccggcgccaccgagauccaaaugagcuccgggaaccuccuguuuaccggucaccugaagugucgucuacgaauggauaagcugcaacugaagggcaugucguacuccaugugcacagggaaguucaaagugguaaaggagaucgcugagacucagcacggcaccauagucauccgggugcaguaugaaggggacggaagcccaugcaagaucccauucgagaucauggaccuggagaagcgcuacgucuugggccgacugauaacggugaacccgaucgugaccgaaaaagacuccccugucaacauagaggccgagccgccuuuuggggacagcuacaucaucaucggcguggagcccggucagcucaagcugaacugguuuaagaaaggaagcucaaucgggcagauguucgagaccacaaugcgcggcgccaagagaauggccauccuuggcgacaccgccugggacuuugggucccucggcgguguuuucacgucgaucggcaaggcccuucaccaggucuucggcgcgauuuacggcgcggccuucucuggcguaagcuggaccaugaagauccugaucgggguaaucaucacuuggaucggcaugaacucccggagcaccucgcugucagucucgcuggugcucguagggauugucacgcuguaccugggggugauggugcaggcggacucuggaugcgucguaagcuggaagaauaaggagcucaagugcggcucgggcaucuucauaacagacaacguccacaccuggaccgaacaguacaaauuccagcccgagagccccuccaagcuagcauccgcuauccagaaggcccaggaggaggggaucugcggcauccgcuccgucacacgguuggaaaacuuaauguggaagcaaaucacccccgagcugaaucacauccuggccgagaacgaagugaagcucaccaucaugacaggggacauacgcggcaucaugcaagccggaaagcggucucugcgaccgcaacccacggagcugaaauacaguuggaagaccuggggcaaggcgaagaugcuuagcaccgaguccuauaaucagacguuccugauagacggcccugagaccgcggaaugcccaaacaccaaccgggccuggaacucucuggagguagaggauuacgguuucggggucuucaccacgaacauauggcucaagcugaaagagaagcaggacgccuuuugcgacuccaagcugaugagcgcagccaucaaggacaaccgcgcggugcaugccgauaugggguacuggaucgaauccgcccucaacgacacguggaagauagagaaggccagcuucauugagguaaagaacugccacuggcccaagucucauacccuguggagcaacggcguauuagaauccgagaugauaauuccgaagaaccuagccgggcccguuucacagcauaacuaccgaccaggguaccauacccaaaucgccggccccuggcaccugggcaagcuggagauggacuucgauuucugcgacggcaccaccgugaucguaacggaggacugugggaaccgcggccccucccucaggaccaccacggccagugggaagcugauaacugaguggugcugcagaucuugcacccugcccccucuccgcuaccguggggaggauggcugcugguacgggauggagauccggccucugaaggagaaggaggagaaucuuguaaauucccucgugaccgccggccacgggcaggucgacaacuucagcuugggagugcugggcauggcccucuuccuggaggagaugcuccgcacccggguggggacaaagcacgcgauccuccugguugccguauccuucguuaccuuaauaaccggcaauaugagcuucaaggacuuagggagagucgucgugaugguuggcgccacuauggccgacgacaucggaaugggcguuacguaccuggccuuacuugccgccuuuaaaguucggccgacuuucgccgccggacuccuguugcguaagcugaccuccaaggagcugaugaugacuacaaucggcaucguccuccugagucagagcaccauccccgagaccgugcuggaguugaccgacgcccuugcgcugggcaugaugguacucaagauuguccggaacauggaaaaguaucagcuggccgugacgauaauggccauccugugugucccgaacgccgucaucuugcaaaacgcuuggaaggugagcugcaccauccuggcgguggugucaguguccccucugcuucugaccuccucgcaacagaagaccgacuggaucccucucgcucuuaccaucaaggggcuaaaccccaccgccaucuuucugaccacauugagucggacgaacaaaaagcgcagcuggccucugaacgaagcgaucauggcggucgggaugguguccauccucgccagcucccucuugaagaacgacauacccaugacaggaccccugguggccgggggacuucugaccgucugcuacgugcucaccggccggagcgccgaucucgagcuggagcgcgccacggacgugaaaugggaagaucaagcggagaucuccgggagcagccccauacugagcaucaccaucagcgaagacggauccaugagcauaaagaacgaggaggaggaacaaacccuaaccauccugauccggacgggucuucuugucauaucuggccuguuuccgaucagcauacccaucaccgccgcggcgugguaucugugggaggugaagaagcaacgcgccggcgugcucugggauguccccagcccgccgccuaugggcaaagcggagcucgaggauggcgccuaccguaucaagcagaaggguauccugggguauagucagaucggcgccggcguuuacaaggaggggaccuuucacaccauguggcaugugacccguggcgcaguccucaugcacaaggggaaacguaucgaacccaguugggccgauguaaagaaggaucugauuagcuacggcgggggcuggaaacuggagggugaguggaaggagggagaagaggugcaaguacucgcgcuggagcccggaaagaauccccgcgccgugcagacgaagccagggcuauucaagacuaauacaggcaccauaggagcuguuucccucgauuucagucccggcacauccgguagucccaucaucgacaaaaaggggaaagucgucggccuuuacggaaacggcgugguaacucggucuggcgcauacguuagcgccaucgcgcagaccgagaagaacauagaggauaaccccgagaucgaggacgauaucuuccgcaagcgaagacugaccaucauggaccuucaucccggggccggcaaaacgaagcgguaccuccccgccaucgugcgcgaggccauaaagcgaggccugcggacucugauccucgcgcccacccgggucguggccgccgagauggaggaggcccuacgcggccuccccauccgguaccagacccccgccauccgcgcggagcacacggggagagagaucguggaucucaugugccacgccaccuuuaccaugcggcugcugucccccguucgcguuccgaauuacaaccucaucaucauggaugaagcccacuucacggaucccgccagcaucgccgcuaggggauauaucuccacacgcguggaaaugggcgaggccgccggcaucuucaugaccgccacgccgcccgguagccgcgacccauucccccagucgaacgcccccauaaucgacgaggaacgggagaucccagagcgguccuggaacagcgggcacgagugggucacugacuucaagggaaagacggugugguucgugccuucgaucaaggcgggaaacgacauugcagccugccugcgaaagaacggcaagaaggucauacagcugagccgcaagaccuuugacuccgaguaugugaagacaaggaccaacgacugggacuucguggucaccacugacaucuccgaaaugggcgccaacuucaaggcggagcgggugauagacccccgccggugcaugaagccgguaauucucaccgacggggaagaacgcgugaucuuagccggccccaugccagucacccauucaucagcugcgcagcggagaggucggaucggccgcaaucccaagaacgagaaugaccaguacaucuacaugggcgaacccuuggaaaaugacgaagauugcgcucacuggaaagaagcgaagauguuacuggauaauaucaacacucccgagggaaucaucccguccauguuugaaccagagcgugaaaagguggacgccaucgacggcgaguaccgccugcgcggagaggcccguaagaccuuuguagaucucaugcgccgcggcgaccuccccgucuggcuggcuuauaaaguggcugccgaggguaucaacuacgccgaccgccgguggugcuuugacgggaucaagaacaaccagauacucgaagagaacguagagguggaaauauggaccaaggagggggagaggaagaaacugaagccgcgguggcuggacgcccgcaucuacucugacccccuagcccugaaggaguuuaaggaguucgccgcgggccgaaagaguuuaacccucaaccuaauuacagaaaugggcaggcugcccaccuucaugacucagaaaacaagagacgcacucgacaaccuggcaguccugcacacggcggaagccggcggccgcgccuacaaccacgcccuaagcgagcugccagagacccuggagacccuccugcugcucacccugcuggcaacggugaccgggggcaucuuucuguuccugauguccggcagggggaucggcaagaugacccuggggauguguugcaucaucacugccaguauucuucugugguaugcgcagauccagccgcacuggauugccgccuccaucauacucgaguucuuucucaucgugcuacugaucccggagcccgaaaagcagcgcacgccccaggacaaccaguugacguacgucguuauagcaauccugaccgucgucgccgcuaccauggcuaacgagaugggauuccuagagaaaaccaagaaggaccuggggcucgggagcaucgccacgcagcaaccggaauccaacauccuggacaucgaccuacggccggccuccgcuuggacccuguacgcgguagccacaacauucgugacgcccaugcugcgccauuccauugagaacagcagcgugaauguaucgcucaccgccauugcgaaccaagccaccguguugaugggucugggcaagggauggccccuaaguaaaauggauaucggggucccgcuguuagcgaucgggugcuauucccaggucaacccgaucacccucaccgccgcccugcuacugcugguagcccacuaugcgaucaucgggcccggucuccaggccaaggccacacgggaggcccagaagcgcgccgcugccggcauaaugaagaaccccacagucgacggcaucacaguaaucgauuuagacccgauaccguacgaccccaaguucgagaagcagcuaggccaaguaaugcugcucauccuuugugugacccaggugcugaugaugagaaccacaugggcccuaugcgaggcacugacucuggccacggggccuaucucgacccucugggagggcaacccggggcgcuucuggaauacgaccaucgcgguguccauggcaaacauauuccgggggagcuaccuggccggggccggucuccuuuucuccauaaugaagaacacaaccaacacccgccgcggcaccggaaacacgggcgagaccuugggugagaaguggaagucccggcugaacgcccucgguaaauccgaguuccagaucuacaagaaguccggcauccaggagguggacaggacccuggcgaaagaggggaucaagaggggcgagaccgaccaccacgccgugucccgcgggagcgccaagcugcggugguucguggagagaaacauggucacgcccgagggcaaggugguggaccucgggugcgggcggggcgggugguccuacuacuguggcgguuuaaagaacguucgcgaagugaagggccugacgaagggagggcccggccacgaggagccuauuccgaugagcaccuauggguggaaccucguccgguugcagucgggcgucgacguguucuucaucccgccagagaagugcgacacccugcucugugacaucggggagaguucccccaacccgaccguggaggccggcaggacccugcgggugcugaaucucguugagaacuggcucaacaauaacacccaguucugcaucaagguucucaaccccuacaugcccagcgucaucgagaagauggaggcucugcagcgcaaguacggcggagcccucguccggaacccguugucccgcaacagcacucaugagauguacugggucagcaacgcaaguggcaacauagucucguccguaaacaugaucagcagaaugcugaucaacagauucacgaugcgccauaaaaaggcgacguacgagccagacguggaccucgggucuggcacccgcaacaucggcaucgagagcgagauucccaaucuggacaucaucggcaagcggaucgagaagaucaagcaggagcacgagacguccuggcacuacgaccaggaccaucccuacaagacaugggcauaccacggguccuacgagacgaaacagaccggguccgccagcucuauggucaacgggguaguacgccugcucacgaagccgugggacguccugcccacugugacgcaaauggccaugaccgacaccacccccuucgggcagcaacgcguauuuaaggagaagguugacacgcguacacaggagcccaaggaggggaccaagaagcugaugaagaucaccgccgaauggcucuggaaagagcuggggaagaagaagacaccgcgcaugugcaccagagaggaguucaccaagaaggugcgcagcaacgcagccuuaggagcgaucuucacagaugagaacaaauggaagagugcaagagaggccguggaagacuccagguucugggaacucguugacaaggaaaggaaccugcaccuggaggggaagugcgagacgugcguguacaacaugauggggaagcgagagaagaaguuaggcgaguuuggaaaagcgaaggggucccgggccaucugguauauguggcugggagcucgauuccuggaauuugaggcgcucggguuccugaacgaggaccacugguucagccgggagaacucccugucuggcgucgagggggagggccuccacaagcugggguauauccuccgggacguuagcaagaaggagggcggugccauguacgccgaugacacggcggggugggacacccggaucacucucgaggaccucaagaaugaagaaauggugacaaaccacauggaaggcgaacauaagaagcuggccgaggcgauuuucaaguugaccuaccagaacaagguggugcgagugcagcggcccacgccccguggcacugucauggacauuaucagccggcgagaccagcguggcagcggacaaguaggaacguacggcuuaaacacauuuaccaacauggaggcccagcugaucaggcagauggagggcgaaggcguguucaagaacauccagcaccucaccgucacagaggaaguggccguucauaacuggcuugcacgagucggacgcgagcgccugucgcggauggcgaucagcggcgaugacugcguaguuaagccccucgaugaccgcuucgccaacgcccugaccgccuugaacgacaugggcaagauccggaaagacauccaacagugggagccguccaagggauggaaugacuggacccaggugcccuucugcucacaccauuuccacgaguugaucaugaaggauggccgcauccugguagugccgugccgaaaccaagacgagcuuauaggucgcgcgcggauaagucagggugccggguggagccuccgugagaccgccugccugggcaaguccuacgcacagauguggagccugauguacuuccaccguagagaccucagauuagccgcaaacgccaucuguuccgcgguccccucucacugggugccuacgucucgcacaacuuggucaauccaugccaagcacgaguggaugaccaccgaggauaugcugacgguguggaacagggucuggauacgcgagaacccuuggauggaggacaagacgccgguggaguccugggaggagauacccuaccuuggcaagcgggaagaccaguggugcgguagccugaucggccugaccucccgggccacgugggcgaagaacauccaggcugccaucaaccaggugcggagcuugauagggaacgaggaguauacggacuauaugccgucgaugaaaagauuuaggcgcgaggaggaggaggcggguguccugugguga

SEQ ID NO: 25419 - RNA, 9876 nt, Artificial Sequence
  derived and/or modified CDS sequence (opt11) from DENV-2__EU482470__SS-prME
agugccgggaugaucaucaugcugauccccaccgugauggccuuccacuuaaccacccgcaauggggaaccccauaugauaguugggauccaagaaaagggcaagucacugcuguucaagacagaggauggcgucaacauguguacccucauggcgauggaccugggggaacugugcgaggacaccaucaccuauaaaugcccccuccuacggcagaacgaaccugaagacaucgauugcuggugcaacagcacguccaccugggugacauacgggaccugcaccaccacgggugagcaccgccgggagaaacgcagcguggcccuggugccccacguagggaugggccucgaaacccggacggagaccuggaugucgagcgagggggccuggaagcacgcccagagaaucgaaacauggauccugaggcauccgggcuucacgaucauggccgcgauacuagccuauacuaucgggaccacccacuuccagagaguucucauauucauccuucugacggcuguugccccuucuaugaccaugcggugcaucggcaucagcaaccgcgauuuuguggagggugucuccgggggcaguuggguggacaucguacuugagcacggcuccugcgucaccacuauggcuaagaacaaacccacgcuggacuucgagcugauuaagaccgaggccaagcagcccgcaacucuccguaaguauugcauugaggccaagcugacgaacacgacuaccgagucgcgcugcccaacucaaggcgagcccucccugaaggaagaacaggacaagcgguucguaugcaagcacagcaugguggaccgcggcugggguaacggaugcggcuuauucggcaaggguggcauaguaacgugcgccauguucacaugcaagaagaacauggagggaaagaucguccagcccgagaaccuggaguacaccaucguggucacgccgcauagcggggaggaacacgcgguugguaacgacacgggcaagcauggaaaggagaucaaggugaccccgcagucuucaauaaccgaggcggagcuaacaggcuacggcacuguuacgauggagugcucgccccgcaccggauuagacuucaacgagauggugcugcugcagauggagaauaaggccugguuagugcaccgccagugguucuuagaucugccccucccguggcugccgggggcagacaagcaggagucuaacuggauccagaaggagacccuggucaccuucaagaacccccacgccaaaaagcaagacguggucguguuaggcagccaggagggggcgaugcauacggcccugacaggcgccaccgagauucagaugucgucugggaauuugcuguucaccggccaccugaagugccggcugcgcauggacaagcuccagcugaagggcaugagcuacucaaugugcacggggaaguucaaagugguaaaggagaucgccgagacccagcacggcaccauagugauccgggugcaguacgagggggacgguagcccaugcaagauccccuucgagaucauggaccuggagaagcgcuauguccucgggcggcugaucacagucaacccgauagugacggagaaggacucccccgucaacaucgaagccgaaccgcccuucggcgacagcuauaucauaaucggcgucgagccaggucagcuaaagcucaacugguucaagaagggcuccagcauaggccagauguuugagaccacgaugcgcggggcgaagcgcauggccauccugggcgauaccgcuugggacuuugggucccugggcgggguguucaccagcauaggcaaggcccuccaccaggucuucggggccaucuauggcgcggccuucuccggcguuucuuggaccaugaagauccugaucggcguaaucauuacuuggaucgguaugaacucccggagcaccucccugagcgucuccuuagugcucguggggauuguaacguuguaucuuggggugaugguccaggccgacagugggugcguaguguccuggaagaacaaagaguuaaagugcggaucuggaaucuucaucaccgauaacguucacaccuggaccgagcaguauaaguuccagccggagagcccguccaaguuggccagcgccauacagaaggcccaggaggagggcaucugcggcauacgcuccgucacgcggcuggagaaucucauguggaagcagaucacccccgaguugaaccauauccuggccgaaaacgaggucaagcucaccauuaugaccggggauaucaagggcaucaugcaggccgggaagcgcucacuacggccacagcccacggaacugaaguacuccuggaaaaccuggggcaaggccaaaaugcucagcacggaguccuauaaccaaacauucuuaaucgacggacccgagaccgcggagugccccaacaccaaucgcgccuggaauagcuuggaggucgaggacuacggauucggcguuuucacaaccaauauuuggcugaaacugaaggaaaagcaggacgccuuuugcgacucuaagcugaugucggccgcaaucaaggacaaccgggccguccacgcagacaugggguauuggaucgagagcgcccucaaugacacguggaagauagagaaggccagcuucauagaggucaagaacugccacuggccuaagucccacacccuguggagcaacgguguacuggaguccgagaugaucauacccaagaaccucgcgggccccgugagucagcacaacuaucguccgggguaccacacgcagauagcgggccccuggcaccugggcaagcuggagauggacuucgauuuuugcgacggaacaacaguaaucgucacggaggacugcgggaaccggggccccagucuccgcacaacgaccgccagcggcaaacuuaucacggaguggugcugccguagcugcacgcuucccccgcuccgcuacagaggggaggacggcugcugguacgggauggagauccgcccgcugaaggagaaggaggagaaccucguuaacucacuggugacugccggucacggucaagucgacaauuucagccugggcgugcugggcauggccuuauuccuggaagagaugcugcggacccgcguggggacgaaacaugcgauccuucuugucgcuguuuccuucguaacccugaucaccggcaauaugagcuucaaggaucucggccgcgucguugugauggucggcgccaccauggccgacgacaucggcaugggcgugacuuaccuggccuuacucgcggccuucaagguacggcccacguuugcagccggccugcuucuccgaaaacuuacuucuaaggagcuuaugaugaccaccaucgggaucgucuuacucagucaaucuaccauccccgagaccguucuggagcucacagacgcgcuggcgcugggcaugaugguccucaagaucguacgcaacauggagaaauaccagcuggccgugacgauaaugaccauccucugcgugccgaacgccgugauccuccagaacgccuggaaggugagcugcaccauacuggccgucguguccguaagcccccugcuccugaccagcagccgccagaaaacggacuggaucccccuggcgcucacaauuaaggggcugaaucccacugccauuuuccuaacaacgcucucccgcacaaauaagaagcgcucguggccccugaacgaggccaucauggccgugggcaugguuaguauccuggcgagcucccuucugaagaacgacauacccaugaccggcccccugguggccgggggacuccugaccgucugcuacgugcugacgggccggagcgcggaccuugagcuggagcgcgcgaccgacgugaaaugggaggaccaggccgagaucaguggcagcagccccauacugucaauaaccaucagugaagacggguccauguccaucaagaacgaggaagaggaacaaacccuaacgauuuugauccgcaccggacugcucgugaucuccggacuguucccaauaucgauccccaucacggcggcugccugguacuugugggaggugaaaaagcaacgugcuggggugcucugggacguccccagcccgccgccgaugggcaaggccgagcuggaagacggggccuaccggaucaaacagaagggcauccuaggcuacagccaaaucggggccggcguguacaaggaggggacuuuucacaccauguggcacgucacgcgcggcgccguccucaugcacaaggguaagcgaaucgagcccucaugggcggacguuaagaaggaccugaucagcuacggcgggggcuggaagcuggagggagaguggaaagagggcgaggaggugcaggucuuggcacuggaacccggcaaaaacccaagggcggugcagaccaagccggggcuguucaagaccaacaccggaacuaucggggcugugucccucgacuucagcccggggaccuccgggucucccauuaucgauaagaagggcaaggucguggggcuguacgguaacggcgugguuacccgguccggcgccuaugucagcgccaucgcccaaaccgagaaaucaauagaggauaaccccgaaaucgaggacgacauuuuucggaagcgacgccucacgaucauggaccugcacccgggggcgggcaagaccaagcgguaccuacccgccaucguucgugaggcuaucaaacgcgggcugcgaacucugauccuagccccgacccgggucguggccgccgagauggaagaggcccugcgcggucugcccaucagguaccagacgccggccauuagagcggagcacaccgggcgcgagaucguggaccucaugugucacgcgaccuuuacuaugcgccugcugagcccaguccgcgugcccaacuacaacuuaaucaucauggaugaggcgcacuuuacggaccccgccuccauagccgccagaggcuacaucagcacgcgcguggagaugggcgaagcggcagggaucuucaugaccgccacgccgcccggcagccgggacccguuuccccagucaaacgccccgaucaucgacgaggagagggagauucccgagcguagcuggaacuccgggcacgagugggucacggacuuuaagggaaaaaccgugugguuugugccgucaaucaaggcagggaacgacaucgcugcgugucugcguaaaaacgguaagaaggucauccagcugucccgcaagaccuucgacucugaguacgucaagacccgcacuaacgauugggacuucgugguaaccaccgacaucuccgagaugggcgccaacuucaaggccgagcgggugauugauccccgcagaugcaugaagcccgugauucucaccgacggcgaggagcgcgugauccucgcuggcccuaugccggugacucacaguuccgccgcccagaggcgcgggcggauuggccgcaacccuaagaacgagaaugaccaguacaucuacaugggagagccacuugagaaugacgaggacugcgcucacuggaaggaggccaagaugcuucuugauaacaucaacacccccgagggaauaaucccgucaauguucgagcccgagcgggagaagguggaugcgauagacggcgaauaucgacugcgcggggaggcccggaagaccuucgucgaccucaugcgccguggcgaucugccaguguggcuggccuauaagguggccgccgaggggaucaauuacgcggaccgccgguggugcuucgacggcauaaagaacaaucagaucuuagaggagaaugucgagguugagaucuggaccaaagagggcgagcgcaagaaguugaagccgcggugguuagacgcccgcauauacucggacccucucgccuugaaggaguucaaggaguucgccgcgggccggaaguccuugacgcuaaacuuaaucacagagaugggucggcuaccaaccuucaugacgcaaaagacgcgggacgcacucgacaaccuagccguccugcacaccgcugaggcagggggccgugcguacaaccacgcucucuccgagcuucccgagacccuggagacacuccugcugcucacgcugcuggcaacagugaccgguggcauauuccucuuccuaaugagcggccgggggaucggcaagaugaccuugggaaugugcugcaucauaaccgccucuauucuccugugguacgcgcaaauccagccccacuggaucgcggccagcaucauucuggaguucuuccucaucguucugcugauccccgagcccgagaagcagcgcacuccccaggacaaccagcucaccuacgugguuaucgccauccugaccguggucgcggccaccauggcgaacgagaugggcuuucuggagaagacgaagaaggaccucgggcugggcuccaucgccacccagcagccggagagcaacauccuggacaucgaucuccggcccgccuccgccuggacccuguacgccguggcgacuacguucgugaccccaaugcugcgccacucaauagaaaauagcagcgucaaugugagccucaccgccauagccaaccaggccaccgugcuuaugggccuggggaagggcuggccgcugucaaagauggacauaggggucccgcugcuggccaucggcugcuacagucaggugaacccgaucacgcucacagcggcauugcugcuccugguggcccacuacgcuaucaucgggcccgggcugcaagcgaaggccacccgggaggcccagaagcgggccgccgccggcauaaugaaaaaucccacgguugacgggauuacggugaucgaucucgacccgaucccguaugaccccaaguucgagaagcagcuaggacaggugaugcuucucauccugugcgucacgcagguacugaugaugcggacaacaugggcccucugcgaagcccugacucuagccaccgguccuaucuccaccuuaugggaggggaacccggggcgcuucuggaacacuacgaucgccguuagcauggcgaacaucuuccggggcuccuaccuagccggcgccgggcuccucuucucuauaaugaagaacacaaccaacacccgccgcggcacagggaacaugggggagacccugggcgagaaguggaaaucccggcugaacgcacucggcaaaagcgaguuccagaucuacaaaaagaguggcauccaggaggucgaccgcacacuggccaaggaagggaucaagcggggcgaaacggaucaucacgcugugagccgcggguccgcuaagcugcgaugguuuguggaacgcaacauggucacgccggaaggcaaggugguagaucucggcugcgggcggggcggguggagcuauuauugcggcgggcugaagaauguccgagagguaaagggucugacuaagggcggucccgggcacgaggagcccaucccgauguccaccuacggguggaaccucgugcgacugcaaagcggggucgauguguucuucauaccacccgagaagugcgacacucugcucugcgacauuggggaguccagccccaacccgacgguggaggccggccgcacucuccggguccugaaccucguagagaauugguuaaacaacaacacucaguucuguauuaaagugcugaaccccuacaugcccuccgucaucgagaagauggaggcccugcagcggaaguacggcggggcgcuggugcgaaacccgcugucgcgcaacagcacccacgaaauguacuggguaucaaacgccagcggcaacaucgucuccagcgugaacaugauuagccggaugcugaucaaccgguucaccaugcgucacaagaaggcaaccuacgaacccgauguggacuuggggagcggcacucggaacaucgggaucgaguccgagauuccuaacuuggacaucaucggcaagcggauugagaagauaaagcaagagcacgagaccucauggcacuacgaccaagaccacccauacaagaccugggccuaccacggauccuacgagacgaaacagaccggcagcgccuccagcaugguuaacgguguggugcgucugcucaccaagccgugggacguccugcccaccgugacgcagauggcgaugaccgauaccacccccuucgggcagcaacgcguguucaaggagaaggucgacacgcgcacccaggagcccaaggagggcacgaagaaacugaugaagauuacagccgaguggcucuggaaagaguuaggcaagaagaagaccccgcgcaugugcacccgggaggaguuuaccagaaaagugcgguccaaugcagcccugggggcaauuuucaccgaugagaacaaguggaagagugcgcgcgaggccguggaggauuccggcuuuugggagcuugucgacaaagagcggaaucugcaccuggaggggaagugugagacgugcguuuacaacaugaugggcaagagggaaaagaagcucggggaguucggcaaggcuaagggcagccgggcaaucugguauauguggcucggggcccgcuuccuggaguuugaagcacucggauuccugaaugaggaccacugguuuuccagggagaacagcuuguccggggucgagggcgaggggcuucacaagcugggcuacauccuuagggacgugagcaagaaagagggcggcgccauguacgccgaugacaccgccggcugggacacccggaucacucucgaggaccucaagaaugaggaaaugguuacgaaccacauggagggggagcacaagaagcuggcggaggcaaucuucaaacucaccuaccagaacaagguaguacgcgugcagagaccaacgccccggggcaccgugauggacaucauaagccgccgcgaccaaagggguagcggacaggugggcacuuacgggcuuaacacguucaccaacauggaagcccaauugauccgccagauggagggcgaaggaguguucaagaacauccagcaucucaccgugacggaggagguggcaguccaaaauuggcuggcccggguggguagggagcgcuuaagccggauggccaucuccggcgacgauuguguggugaagccgcuugacgaccgcuuugccaacgcuuugaccgcccuaaacgacauggggaagauccggaaggacauccagcagugggagccgucuaagggcuggaaugacuggacacaggugccuuucugcucccaccacuuccaugagcuaauaaugaaggacgggcgcgugcuggugguccccugccggaaccaagaugagcugaucggccgcgcccggaucagccagggagcuggcuggucccuccgcgagaccgccugccugggcaagagcuacgcacagauguggucccuaauguacuuccaccggcgcgaucuccggcuggccgccaacgcaaucugcagcgcgguccccucccacuggguaccgacgagccgcaccaccugguccauccacgccaagcacgaauggaugaccaccgaggacaugcuuaccgucuggaaccguguguggauccgggagaaccccuggauggaggauaagaccccgguggagagcugggaggagauccccuaccucgguaagcgggaggaucaguggugcgguucacugaucgggcugaccagccgcgccacgugggccaaaaacauccaagcggccaucaaccaggugcggagccucaucggcaacgaggaauacaccgacuacaugccaucaaugaagcgcuuucggagggaggaagaggaggcggggguccugugguga

SEQ ID NO: 25420 - RNA, 9876 nt, Artificial Sequence
  derived and/or modified CDS sequence (opt11) from DENV-2__EU482471__SS-prME
agcgccgguaugaucaucaugcugauucccaccguaauggccuuccaccucacuacccgcaauggcgagccucacaugaucguagggauucaggaaaaggggaaaagccugcuguucaagaccgaggacggggugaauaugugcacccucauggccauggaccugggugagcugugcgaggacaccauaaccuauaagugcccgcuccugcggcagaaugagccugaggacaucgacugcugguguaauagcacgagcaccugggucacauacggaaccugcaccaccaccggcgagcaccgccgggagaagaggagcguggcccuuguaccccacguggggauggggcucgagacccggacagagaccuggaugucgagcgagggggccuggaagcacgcccagcgcauagagaccuggauccugcgccaccccggcuucaccaucauggccgcgaucuuggccuacaccauagggacuacgcacuuccaacgcguccugaucuuuauucuucugacggcaguggcccccucgaugaccaugcgguguaucggcauuuccaaccgugacuuugucgagggcgucuccgggggcagcugggucgauauaguucucgagcacgguucgugcgucaccaccauggcuaagaacaaacccacccuggacuuugagcugauuaaaacagaagccaaacaacccgccacacuccgcaaguacugcauagaggcgaaguugaccaacacaaccaccgagagccgcugccccacccagggcgagccaucccugaaagaggagcaagauaagcgguucguuugcaagcacagcauggucgaccgcggcugggggaacggcugcggguuguuuggcaagggcgggaucgucaccugugccauguucacgugcaagaagaacauggaaggcaagauagugcagcccgagaaccuggaguacaccaucgugguaacgccccacucaggggaggagcacucggugggcaacgauaccgggaagcacggcauggagaucaagguaaccccucaguccucuaucacagaggcggagcugacgggguacggcaccgucacgauggaauguagcccacggaccggucuagacuucaacgaaauggugcugcuccagauggagaacaaggcguggcuugugcaccgccaaugguuucuggaccugccucucccguggcugccgggugcagacaagcaggaaagcaacuggauucagaaggaaacccuggucaccuuuaagaauccccacgccaagaaacaggacguggucguguuaggcagccaagagggggccaugcacacggcgcugacaggcgcaacagagauccagauguccucugggaaccuccuguuuacgggccaucugaaaugccgcuugcgcauggacaagcuacaacugaagggcauguccuacagcaugugcacggguaaguucaaaguggucaaggaaaucgccgagacccagcacgggaccaucgucauacgggugcaguacgagggggacggguccccuuguaagaucccguuugagaucauggaccuugagaagcgcuacguccucggcaggcuuauaaccgugaacccuaucgugacugaaaaggacaguccggugaauauugaggcagagccaccguucggggacuccuacaucauuaucggcguagaaccggggcagcugaaacucaacugguuuaagaaggggagcuccauagggcaaauguucgagaccaccaugaggggugccaagcgcauggcgauauugggcgauacugccugggacuucgggucacuaggagggguuuucacuuccaucggcaaggcccuccaccaagucuucggggccaucuauggcgccgcguucuccggcgugagcuggaccaugaagauccugaucggcgugaucaucaccuggaucggcaugaacucacggaguaccucccuguccgucucucuuguguuaguggggaucgucacccuguaucuuggugugaugguucaggcugacuccgggugugucguaagcuggaagaauaaggagcucaaguguggcagcggcaucuuuaucaccgacaacgugcauaccuggaccgagcaguacaaguuccagcccgaguccccaagcaagcuggcauccgccauacagaaggcgcaagaggaggggaucugcggcaucagaucaguuacgcgucuugagaaccucauguggaagcaaaucacccccgaacugaaccacauccuggcggaaaacgaagugaagcucacgaucaugacuggggacauaagaggcaucaugcaggccggcaagcggucccugcgcccgcagccaacggaacugaaguacagcuggaaaaccuggggcaaggccaagaugcucuccaccgaaagcuacaaccagaccuuccugaucgacggccccgagacggccgagugcccuaacaccaacagggcguggaacuccuuagagguggaggacuacggguucggcgucuucaccacgaacaucuggcucaagcugaaggagaagcaggaugcguucugcgacagcaaacugauguccgccgccaucaaagacaaucgcgccgugcacgcggacaugggguauuggauugagagcgcccucaacgauacguggaagauagagaaggccucauucaucgagguaaagaacugccacuggcccaagucccacacgcugugguccaacgguguucuugaaucggaaaugauaauccccaagaaccucgccggcccggugagccagcacaauuaccggccgggauaccacacccagaucgcuggccccuggcaccuggggaagcuggagauggacuucgacuucugcgacggaaccacugugaucgucacggaggauugcgggaacagagggcccagccucaggaccaccaccgcgagcggcaaacuuaucacagaauggugcugucgcuccugcacccugccaccccuccguuaccgcggcgaggacggcugcugguacggcauggagauacggcccuugaaggagaaggaggaaaaucuggugaacagcuuagucaccgccggccaugggcaagucgacaauuucucccuggggguauugggcauggcccuauuccuggaggaaaugcugcgaaccagggucgggaccaagcacgccauccuccuuguagcgguuagcuucgugaccuuaauaacgggaaacaugucuuucaaggaccuugggcgcgucguggugaugguaggcgcaaccauggccgacgauaucggcaugggugugacguaccuggcccugcuugcugcguucaaggugagacccacauucgcggcaggccuucuguuacgcaagcugaccucgaaggagcugaugaugacaacgaucgggaucguccuccugucccaaucaaccaucccggagaccgugcuggagcucaccgaugcccuggcccugggcaugauggugcugaaaaucguccgcaacauggaaaaauaccaacuggcugugacgaucauggccauucugugcgucccuaacgccgugauacugcagaacgccuggaagguuuccugcacgauacuagccguagugagugugagccccuugcuacugaccucgucccagcagaagaccgacuggaucccacuggcucucacaaucaagggucugaacccgaccgccaucuuccugaccacccuguccagaacgaacaagaaacgcuccuggccucugaaugaggccaucauggccgucgggauggugaguauccuggcgucaagccuguuaaagaacgacauccccaugaccggcccccuggucgccgggggccuccugaccgugugcuacgugcugacggguagaagugccgacuuagagcuggaacgcgcaaccaacgucaagugggaggaucaggcagagaucucgggcuccucccccauccugagcaucaccauuuccgaggaugggagcaugagcauuaagaacgaggaggaggagcaaacgcucacuauucuuauuagaacgggccugcuugugaucagcgggcuguuucccauaucuauacccaucaccgcggcggccugguaccucugggaggugaagaagcagagggccggagugcucugggauguucccagcccgccacccaugggcaaggccgagcuggaagacggugcguaccgcauuaaacagaaagguauccugggguacagccaaaucggcgccgguguguauaaagaggggacauuccacacaauguggcacgugaccaggggcgccguccucaugcacaaagggaagcggaucgagcccuccugggccgacgugaagaaagaucuaaucuccuauggcgggggcuggaagcuggaaggggaguggaaagaaggcgaggagguccaggugcucgcccuggagccuggcaagaaccccagagcggugcagaccaagcccgguuuauucaaaaccaacaccgggacaauaggcgcagugagcuuggacuucagccccggcaccagcggcucgcccauaauagacaagaaggggaaagucguuggccuguaugggaaugggguggucacccgaagcggcgcuuacguguccgcgaucgcgcagacggagaaauccaucgaggacaacccagaaaucgaggacgacaucuuucgcaagcggcgcuugaccaucauggaccugcaucccggcgcgggcaagacgaaacgguaccucccggccauugugcgcgaagccaucaagcgagggcuccgcacacugauccucgccccgacccgaguuguagcagccgagauggaggaggcccugcgugguuugccgauccgauaccagacccccgccauccgcgcggaacacacggggcgcgagauagucgaccugaugugucacgccacauucacuaugcggcugcucucccccguccgaguuccgaauuacaaccucaucaucauggacgaggcacacuucaccgaccccgcgucgaucgcggcccgggguuacaucagcacgagaguggagaugggggaagcggccgggauauucaugaccgcaacuccgcccggaucccgggacccguucccccagucaaacgcccccaucaucgacgaggaacgcgagauaccagagcgaagcuggaacucugggcacgagugggucacggacuucaagggcaagacagugugguucgugccguccaucaaggccgggaacgacauagccgcgugcuugcgcaaaaacggcaagaaaguaauccagcugagccgaaagaccuuugauuccgaguacgugaaaacccgcacaaacgacugggauuuugugguuacgaccgacaucuccgaaaugggcgccaacuucaaggccgagcggguuaucgaccccaggcgguguaugaagccugugauuuuaaccgauggggaggagcgcgucauccuggcgggcccgaugccggugacccacaguucagccgcccagagacgcggcagaauagggcgcaaccccaagaaugaaaaugaucaauacaucuauaugggcgagccucuggaaaacgaugaggauugcgcgcacuggaaggaagccaagaugcuccuggauaacauaaacacgccugaggggauaaucccguccauguuugagcccgagcgggagaagguggacgcgauugacggggaguacagauuacgcggcgaggcccggaaaaccuucgucgaccuaaugagaaggggcgaccugcccguguggcuagcguacaagguggccgccgaagggaucaacuacgcagaccggcgguggugcuucgauggcauuaagaacaaccagauccucgaagagaauguugagguggaaaucuggaccaaggagggagagcgcaaaaagcuaaagccgcgguggcuggacgcccgcaucuauuccgacccccucgcccugaaggaguuuaaagaguucgccgccggacgaaagaguuugacauuaaaccucaucacggagaugggccgucugccaacuuucaugacccagaaaacccgggacgcgcucgauaaucuugccguccugcacacggccgaggccggagggcgcgcguacaaccacgcccucagcgagcugcccgaaacucuggagaccuuauuacugcucacucuguuggccacggugaccgggggcaucuuuuuauuucugauguccggccgggggaucgggaagaugacccuggggaugugcugcaucaucaccgcaucaauccucuuaugguacgcccagauucagccgcacuggauugcagcauccaucauccuagaauuuuuccucauagugcugcugauucccgaaccugaaaagcagcgcaccccucaggacaaccaguugacguacgucgugauugccauacugacugugguagcugccaccauggcgaacgagaugggcuuucuugagaaaaccaaaaaggaucucgggcugggcucaaucgccacucagcaacccgaguccaacauccuugauaucgaccuccggcccgccagcgcguggacucuauaugccguggcaaccaccuucgugacgcccaugcugcgccacagcaucgaaaacuccuccgugaacgugucccugaccgccauugccaaccaggccaccguacugaugggccuagggaagggcuggccucucuccaagauggacaucgggguuccgcucuuagcuaucggcugcuacucccaaguuaaccccauaaccuuaacggcugccuuacugcucuuggucgcccacuacgcaaucaucgggcccggcuuacaagcgaaggccacacgggaagcccagaagagggcugccgcgggcauuaugaagaaucccacagucgacgggaucaccguuaucgaccuagacccgauacccuacgaucccaaguucgagaaacagcugggccaggugaugcuucugauccucugcgucacccaaguccugaugaugagaaccaccugggcucucugcgaggcgcucacauuggccacgggcccuaucucgacccucugggagggcaacccggggcgcuucuggaauacaaccauugccgugucuauggcuaacauuuuccggggaagcuaucucgccggcgccgggcuacucuucuccauaaugaagaacacgaccaacacucgccggggcaccgggaacauuggcgagacgcugggagagaaguggaaguccaggcuuaacgcccucggaaaguccgaguuccaaaucuacaagaaaagcggaauccaggagguagaucguacgcuggcuaaggaagggaucaaacggggcgagacagaccaucacgcggugagcagagguagcgccaaacuucgaugguucguggagcgcaacauggugacccccgagggcaaggugguggaccucggaugcggccguggaggguggucguacuacugcggagggcugaagaauguccgugaggugaaaggccuuacuaaaggagggcccggucacgaggagcccaucccgaugagcacauacggguggaaccuggugcggcuucaguccggagucgacguguucuucaucccgcccgaaaaaugcgacacccugcucugcgacauaggugagagcucucccaacccgacgguggaagccggccgcaccuugcggguccucaacuugguggaaaacuggcugaacaacaacacccaguuuuguaucaaagugcugaaccccuacaugcccagcgucauagagaagauggaggcccuucagagaaaauauggcggggcgcugguccggaacccgcucucaagaaacaguacccacgagauguacugggucagcaacgccuccggaaacauagucagcuccgugaacaugauaagccggauguugaucaaccgcuuuaccaugcggcacaagaaagccaccuacgaaccggacguggacuugggguccggcacgcguaacaucgggaucgagagcgagauacccaaccuugacaucauagggaagcgcaucgagaaaaucaagcaggaacacgagaccucuuggcacuaugaccaggaucaucccuacaagaccugggccuaccauggcagcuacgagaccaaacaaacgggauccgcgagcucaaugguaaacggaguggugcggcugcucaccaagccgugggacguccugcccacggugacccagauggcgaugacggauacuacccccuucgggcagcagcgcguguucaaggaaaaggucgacacccggacccaggagcccaaggaggggaccaagaagcugaugaagaucacugccgaauggcuuuggaaggaacugggcaagaagaagaccccgcgcaugugcacgcgugaggaguucacacgcaagguccgaucaaacgccgcccugggggccaucuucaccgacgagaauaaguggaaguccgcccgcgaggcaguggaggauagcagguucugggaacucgucgauaaggaaaggaacuugcaccuggaggguaagugcgaaaccugcguguauaauaugaugggaaagcgugagaagaagcuaggcgaguucgggaaagccaaaggcucccgcgccaucugguauauguggcugggcgcccgguuucuagaguucgaggcgcuuggguucuugaacgaagaccacugguuuucgcgcgaaaauucccugaguggcguggaaggugagggccuccacaaacuaggcuacaucuugcgggacguaagcaagaaggagggcggcgccauguaugccgacgacacagcagggugggacaccaggauuacccucgaggaccugaaaaacgaggagaugguaaccaaccacauggagggugagcacaagaagcuggcugaggccaucuucaaacuuaccuaccaaaacaagguggugagaguccagaggcccacaccacgggggaccgucauggauaucaucucccgucgagaccagcgcggaaguggccagguaggcaccuacggccugaacacguucaccaacauggaagcccaacugauucgccagauggagggggagggcgucuucaagaacauucagcaccuuacagucacugaggaaguggcagugcacaacuggcuggcucgagucgggcgcgagcggcuaucccgcauggcgaucucuggcgacgacugcguggugaaaccacucgaugaccguuucgccaacgcccuaacggccuugaacgacaugggcaagauccgcaaggacauucagcagugggagccgagcaagggguggaacgacuggacucaaguacccuucugcucccaccacuuccacgagcuuaucaugaaagacggccggauucuuguggugcccugccgcaaccaggacgagcucauagggcgggcccgcaucucgcagggcgcaggguggucgcuccgggaaaccgcgugccuggggaaguccuacgcccaaauguggagccucauguacuuccaucgccgagaccuccgccuagcugccaacgcgaucugcuccgccguuccgagccacugggugccgacaucucgaacgaccuggagcauccacgccaagcacgaguggaugaccaccgaggacaugcucacuguguggaaccgcguauggauccgggagaaccccuggauggaggauaagacgcccguugaguccugggaagagauccccuaccuaggcaagcgugaggaccaguggugcggaagccugauaggucucaccuccagggccacaugggccaagaauauacaggcggccaucaaccagguacguucguugaucggcaacgaagaauacacggacuacaugccauccaugaagcgguuccgccgcgaggaagaggaggccggcguccuaugguaa

SEQ ID NO: 25421 - RNA, 9876 nt, Artificial Sequence
  derived and/or modified CDS sequence (opt11) from DENV-2__EU482472__SS-prME
agcgcggggaugaucaucaugcugauacccaccguuauggccuuccaccugaccacuaggaacggggagccccacaugaucgucggcauucaggagaaagguaaaagucugcuguucaagaccgaggacggagugaacaugugcacccucauggccauggaccuaggggaguuaugugaggacaccaucaccuacaagugcccccuacugcggcaaaacgaacccgaggacauugacugcuggugcaacaguaccuccaccugggugaccuacgguacaugcaccacaacgggugagcaccgucgggagaagaggagcgucgcgcucgugccucacguggggaugggccucgagacgcggaccgaaaccuggauguccagcgagggagccuggaagcacgcucagcgcauagagaccuggauccugcggcacccaggcuucacuauaauggccgcuauccuggccuauaccaucggaaccacacacuuccagcgaguccuaaucuucauucuauuaacggccguggcccccuccaugaccaugcggugcaucggaauuuccaacagggacuucguggagggagucuccgggggcagcuggguugacauagugcucgagcauggguccugcguaaccaccauggcgaagaacaagcccacgcuugauuucgaguugaucaagaccgaggcaaagcagccagccacccuccggaaguacugcaucgaggccaagcugacuaacacgaccacggaaagccgcuguccgacccaaggcgagccuucauuaaaagaggaacaggacaagcgguucguguguaagcauaguaugguugaccguggaugggggaacgguuguggcuuauucggaaagggcgggaucgucacgugcgcgauguucacaugcaagaagaacauggaaggcaaaaucgugcagcccgaaaaccucgaguacaccaucguggugacuccccacuccggugaggagcacgcugugggcaacgacacagguaagcacggaaaggagaucaaggugaccccacaguccuccauaaccgaggccgagcugaccgguuaugguaccgucacaauggaaugcagcccccguaccggccucgacuucaacgaaauggugcugcugcaaauggaaaacaaggccuggcucgugcaccgccagugguuccuggaccuuccccuaccuuggcugccgggagcugacaagcaggaguccaacuggauccagaaggagaccuugguaacuuucaagaacccccacgccaagaaacaggacguggucguguuggggagccaggagggggcgaugcacacagcccugacuggggccacggagauacagaugagcuccgggaaccugcuguucaccggccaccugaagugccggcugcgcauggacaaguuacagcugaagggcaugagcuacagcaugugcacggggaaguucaagguggucaaggagaucgcagagacccagcacggcaccaucgucauccgggugcaauacgagggagauggcagccccugcaagaucccuuucgagauaauggaucuggagaagcgcuacguacucggacggcuuaucaccgugaacccuaucgugacggagaaggacucccccgucaacaucgaggccgagccgcccuucggggacagcuauaucaucaucggcguggagccggggcaacugaaacucaacugguucaagaaggguaguagcaucggacagauguucgagaccaccaugcgcggagcgaagcguauggccauucugggcgacacggccugggacuucgggucucugggcggggucuucacaucgaucgggaaggcccuccaucaggucuucggagccaucuacggcgcggcauucuccggggugagcuggacaaugaagauccuaauuggggugauaaucaccuggaucggcaugaacucucggagcaccucccuaagcgucucacugguguugguggggaucgucacccuguacuuaggcgugaugguucaggccgacucugggugcguugugucauggaagaacaaggagcucaagugcggcagcggaauuuuuauuaccgacaacgugcacaccuggaccgagcaguacaaauuccagcccgagagcccuuccaaacuggccagugcgauccagaaggcccaggaggagggaaucugcggcauuagguccgucacgagacuggagaaccucauguggaaacagaucacccccgagcugaaucacauccuggccgagaacgaggugaaacucaccaucaugaccggggacauccgcggcaucaugcaggccgggaagcggagccugcgcccgcagcccacggaacugaaguacagcuggaaaaccugggguaaggccaagaugcucaguaccgaguccuauaaccaaaccuuccugauugacgguccggagacggcggaaugucccaacaccaaccgggccuggaauuccuuagaaguggaggacuacggguucggcgucuucaccaccaacauauggcucaaauugaaggagaagcaggacgccuucugcgacuccaagcuaaugagugccgcgaucaaagacaaccgcgcggugcacgccgacaugggguacuggauggaguccgcccucaacgacacauggaaaaucgagaaggccucguucauugaggugaagaacugccauuggcccaagucccacacccuguggagcaacggcguacuggaguccgagaugaucauaccgaagaaccucgccggacccgugucccagcacaacuaucggccgggguaccauacccagaucgccggccccuggcaucuggggaaauuagagauggacuucgacuucugcgacgguaccaccgugaucguuacugaggacugugggaaccgcggcccaucccucagaacgaccacggcaagcggcaagcuaaucaccgagugguguugccgcagcugcacccugcccccguuacgguaccgcggggaagacggcuguugguacgggauggagauccggccccugaaggaaaaggaggaaaaccuggucaacagucucgucaccgcuggccaugggcaggucgacaauuuuagccugggcgugcucggcauggcauuauuccuggaggagaugcugcgcacacgugugggcacgaagcacgcuauccuacuggucgccguauccuucguaacccugauaaccggcaacaugagcuucaaggaucucgggagaguaguagugauggucggcgcgacuauggcugacgacauagguaugggcgugacuuaccuggcucuucucgcggcauucaagguucggcccaccuuugccgccggccugcugcuccgcaagcuaaccagcaaggagcugaugaugaccacgaucgggauaguauuacugucucaguccaccauccccgagacagugcuggaguugacugacgcucuggcgcugggcaugauggugcuaaagaucguccgcaacauggaaaaauaucaauuggccgugacuaucauggccauccuuugcgucccuaacgccgugauccuccagaacgccuggaagguaagcugcaccauccuagcggucguguccgugagcccacugcuccugaccuccucacagcagaagaccgacuggaucccccuggcgcuaacuauuaagggucugaacccuacagcuauuuuccugaccaccuugucacggacgaacaagaagagauccuggccguuaaacgaagccaucauggcggucggcaugguguccauacuagccagcucccuccugaagaaugauauccccaugacgggcccccugguggcggguggccuccuaaccgucugcuacgugcugacagggcguagcgccgaccuagaacuggaacgcgccacggacgugaagugggaagaccaggcggagaucuccggcagcagccccauccuuuccaucaccauuagcgaagacggcuccaugagcaucaagaacgaggaggaggagcagaccuugacgaucuugauccggacgggcuuacucgucaucuccggcuuguucccgauuagcauccccaucaccgcugccgccugguaccugugggaggugaagaaacagagggccggggucuugugggauguccccucuccaccgcccaugggcaaagcggaauuagaggacggggccuaccggaucaagcagaagggcauacugggguacucccagaucggcgcaggaguauauaaagaggggaccuuccacaccauguggcacguuacucgcggcgcuguucucaugcacaaaggcaagcggauugagcccucgugggccgacgugaaaaaggaccuaaucagcuacggagggggcuggaaacuggaaggagaguggaaggagggggaggaggugcagguccucgcgcuggagcccggcaaaaacccacgcgccguucagacgaagccaggucuguucaagaccaacaccggcaucauuggugccgugucccucgacuuuucgcccggcaccuccgggagcccuaucaucgauaagaaagggaagguugugggccuguacgggaacggagucgucacacgguccggcgccuacgugagugccaucgcucagaccgagaaaaguauugaggacaaucccgagaucgaggacgacauauuccgcaaacggcgccugacuaucauggaccugcaccccggggccggcaagacaaaaagauaccuccccgcgaucguccgcgaggccaucaagcgggggcugaggacccugauauuggcgccgacucggguuguggcagcggaaauggaggaggcacugcgcggccugcccauccgguaccagaccccugcuauuagggcagagcacacggggagggagauaguggauuugaugugccacgcgaccuucaccaugcggcugcugagccccgucagagugccgaacuacaaccuaauuaucauggacgaggcccacuucaccgaccccgccuccaucgccgcgcggggauacauaaguacucgcguggagaugggcgaggccgccgggauauucaugacggccacgccgccgggcagccgggacccguuuccgcaguccaacgcacccaucauugacgaggagcgcgagauucccgagaggagcuggaacucagggcaugaguggguaaccgacuucaaaggcaagacugugugguucguaccuucaaucaaggcugggaacgauaucgccgcgugucugcgcaagaacggcaagaaggucauccagcugucccggaaaacguucgacagcgaguacgugaagacacggaccaacgauugggacuucguggucaccacggacaucucggagaugggcgccaacuucaaggcggagcgggugauagacccgaggcggugcaugaaacccgugauccucacagacggggaggagagggucauccucgccggcccgaugccggucacccacagcucggccgcccagcggcgcgggcggaucggucgcaacccuaagaaugaaaacgaucaguacaucuacaugggugagccccuggagaaugacgaggacugcgcucacuggaaggaggcgaagauguugcuggacaacauuaauaccccggagggcauaaucccgagcauguucgagcccgagcgggagaaaguugacgccaucgacggcgaguaucgcuuacgcggggaggcccguaagacguuugucgaccucaugcgucggggagaucucccuguguggcuagccuacaagguagccgcggaggggauuaacuacgcggaccgcagaugguguuucgacggcaucaagaacaaccaaauucucgaggagaacguagaaguggagauauggacuaaggagggggagcgcaagaagcugaagccuagauggcuggacgcacgcaucuacucggauccgcucgcccugaaggaguucaaggaguuugccgcuggccgcaagucccugacccucaaucuuauaacagagaugggccgccugccaacguuuaugacgcagaagacccgggacgcccucgacaaucuggccguguugcacaccgccgaagccggcgggcgcgccuacaaucacgccuuauccgaacugccagagacgcuggaaacccuccugcugcuuacgcugcuggcaacugugaccggcgggaucuuccucuuccugaugagcgggcggggaaucgggaagaugacccuggggaugugcugcaucauaaccgcaucgauccuccugugguacgcgcagauucaaccgcacuggaucgccgccagcaucauccuggaguucuuccucauaguacuucugauccccgagccggagaaacagcgcacgccccaagacaaccagcucaccuacgucgugaucgccauccugacugugguagcugcuaccauggccaacgagaugggcuuccucgagaaaaccaagaaggauuuggggcugggguccaucgccacccagcagccggaaaguaacauccuggauaucgaccuucggcccgccuccgcguggacccuguaugcuguggccacaacauucguuacucccaugcugcggcacagcaucgagaacagcucuguuaacgugucgcucacagccauugcuaaccaggccaccgugcucauggguuuagguaagggcuggccccucuccaagauggacauaggcgucccguugcuggcgaucggcugcuacagccaggucaaucccaucacacucaccgccgcccugcuacuccugguugcccauuaugcgaucaucgggccaggccugcaggccaaggcgacaagggaggcccagaagagagccgcagccgggaucaugaagaaccccaccguggacgggaucacugugaucgaccuugacccgaucccauacgacccgaaauucgaaaagcagcugggccaggugaugcugcucauccugugcgucacccagguguugaugaugcggaccaccugggcccucugcgaggcccugacccuggccaccgggcccauauccacgcucugggagggcaacccgggucgcuucuggaacaccacuaucgcugugagcauggccaacaucuuccggggcuccuaccuggccggcgccggcuuacuuuucucuauaaugaaaaacacgacgaauaccagacgcgggacggguaacaucggcgagacgcugggagaaaaguggaagucccggcugaaugcccucggcaaaucugaguuccaaaucuacaagaaguccggcauccaggaggucgacaggacgcuggcgaaggaggggaucaagcguggugagacugaccaccaugccgugagucgggggagcgcaaagcugagaugguuuguggagcgcaacauggucacccccgagggcaaaguuguggacuugggcugcggccggggcggguggagcuacuauugcggugggcuuaagaauguccgcgaggugaagggacugaccaagggcgggcccggccacgaggaacccaucccgauguccaccuacggauggaaccucgugcgguugcagagcggagucgacguguuuuucaucccgcccgaaaagugcgacacccugcucugcgauaucggggaauccucacccaauccuacgguagaggccggccggacccugcgaguucuaaaucucguugagaacugguugaacaacaacacccaguucugcauuaagguccugaaucccuauaugcccuccgucauagagaagauggaagcgcugcagcguaaguaugguggagcguuggugagaaauccgcugucgcgcaauagcacccaugagauguacugggugaguaaugccagugggaacaucgucuccagcgugaacaugaucucgaggaugcugauuaaccgcuucacgaugcggcacaagaaggccaccuacgaacccgacguggaccucgggagcggaacccgcaacaucgggaucgaguccgaaaucccaaaccuggauaucaucggcaaacggaucgagaagaucaagcaggagcacgagacuucguggcacuaugaccaggaucacccauacaagaccugggccuaucacggcuccuacgagaccaagcaaaccggcucagccucgagcauggugaacggcguggugcgccuacuaaccaagccgugggacguucugcccaccgugacccaaauggccaugaccgacaccacccccuucgggcaacagcguguguuuaaggagaagguggacacccggacccaggagcccaaggagggcaccaagaaguuaaugaaaaucaccgccgaguggcucuggaaggaacuggggaagaagaagacuccacgcaugugcacucgggaggaguuuacgagaaagguccguuccaaugcugcccuaggggcgaucuucaccgaugagaacaaguggaaguccgccagagaggccguggaggacagccgguucugggagcucgucgauaaggaacgcaaccuccaccuggagggcaagugugagaccugcguuuacaacaugauggggaagagagagaagaagcuuggcgaguucgggaaagcaaaaggcagccgcgccaucugguacauguggcugggcgcgcgguuucuggaguucgaggcccucggauuccugaacgaggaucauugguucuccagggaaaacagucuguccggcgucgagggagagggccuccacaaacucggguauauccuccgcgacguuucuaagaaggaggguggggcgauguaugccgacgacacugcggggugggacacgcgcaucacccucgaggacuugaagaacgaggagaugguuaccaaucacauggagggcgagcacaaaaagcuggccgaggccaucuucaagcucaccuaccaaaacaagguaguccggguccagagacccacaccccggggaacagucauggacaucaucagccgccgggaccagcgcggcuccggccaagucggcaccuauggccugaacaccuucacgaacauggaggcccaacugauccgacagauggagggggagggugucuuuaagaacauccaacaccucaccgucacagaggaggucgccguccacaauuggcuggcgcgcguuggccgcgagcgguuaagccgcauggccaucuccggcgacgacugcguggugaaaccccucgacgaccgauucgccaacgcgcugaccgcccugaacgacauggguaagauccgcaaggacauacagcagugggagccgaguaagggguggaacgacuggacccaaguccccuucugcucccaccacuuccacgagcucaucaugaaggacggucggguacuggugguaccaugccgcaaccaagaugagcugaucgggcgggcccgcaucagccagggagcggggugguccuuacgagagaccgccugccugggcaagagcuacgcgcagauguggucccugauguauuuccaccgcagggaccuccgcuuggcggcgaaugcaauuugcucagccgugccaucccauugggugccaaccagccguacaaccugguccauccaugccaagcacgaguggaugacuaccgaagacauguuaaccgucuggaaucgaguguggauccgggagaaccccuggauggaggauaagaccccugucgagagcugggaggagauccccuaccucggcaagcgcgaggaucaguggugcgggucccugauuggguugacgagccgggccaccugggcgaaaaacauccaagcggcaauaaaucaaguccgaucgcucaucgggaacgaggaguacacggacuacaugccgagcaugaagcgguucaggcgugaggaggaggaagcgggcguucugugguaa

SEQ ID NO: 25422 - RNA, 9876 nt, Artificial Sequence
  derived and/or modified CDS sequence (opt11) from DENV-2__EU482473__SS-prME
agcgcggguaugauaaucaugcucauccccaccgugauggcguuucaccucaccacacggaauggggagccccacaugaucgucggcauccaggaaaaggggaagucccucuuguucaaaaccgaggacggcgucaacauguguacgcucauggcgauggacuuaggcgaacucugcgaggacacuauuaccuacaagugcccccuccugcgccaaaacgagccugaggacauugacugcuggugcaauagcaccagcacgugggugacguacggcaccuguaccaccacaggagagcaccgccgggagaagagaucagucgcccucgucccacacgucgggaugggacucgaaacccggaccgagacuuggauguccucggagggggccuggaagcacgcccaacgcauugagaccuggauuuuacggcacccgggcuucacgauaauggcggcgaucuuagccuacacuaucgggaccacccacuuccagcgcguccucaucuucauacuuuugacggcuguggccccaucaaugacuaugcgaugcaucggcauuagcaaccgcgacuucguggaaggcgucuccgggggcucauggguagacaucguguuagagcacgggaguugcguaaccaccauggcgaagaauaagcccacccuagacuucgaguuaauuaagacggaggcgaagcagcccgccacucucaggaaguauugcaucgaggccaagcugaccaacacuaccaccgagagccgcugccccacccagggggaaccgucccuaaaggaggagcaggauaagcgguucgucugcaagcacagcaugguugaccgcggcugggggaacggauguggcuuguucggcaagggagguaucguuaccugugccauguucacgugcaagaaaaauauggagggcaaaauuguccaacccgagaaccuggaguauaccauugugguaacgccccacuccggggaggagcacgcugugggcaacgauacaggcaagcacggccaagaaaucaagguaaccccgcagagcuccaucaccgaggcagagcugaccggguacggcaccgucaccauggagugcucgccccggacgggccuagacuucaacgagaugguguuauugcagauggagaacaaagcguggcucguacaccgccagugguuccuggacuugccccuccccuggcugccgggggcggacaagcaggaguccaacuggauccagaaggaaacucuugucacuuucaagaacccccaugcgaagaagcaggauguggucgugcuuggcagccaggagggggcgaugcacacggcccugaccggagcaaccgagauccagaugagcuccggaaauuuacucuucacgggccaccugaaguguagacucagaauggacaagcuucagcugaaagggaugagcuacaguaugugcacggggaaguucaaggucgugaaagagaucgccgagacccagcacggcaccauugugauccgggugcaguaugagggugauggaagcccuugcaagauucccuucgagaucauggaccuggagaaacgcuacguccucggccggcugaucaccgugaaccccaucgugacggagaaggacucccccgucaacauagaggccgagccccccuuuggagacucuuacaucaucaucggaguggagccuggccagcugaagcuaaacugguucaagaaaggcagcucgaucgggcagauguucgagaccaccaugcgcggcgccaaacgcauggcgauccugggcgacaccgccugggauuucgggucgcugggggggguguucacgaguauuggcaaagcacuccaucaggucuucggggccaucuacggcgccgccuucuccggcgucagcuggaccaugaagauccugauaggggugaucaucaccuggaucggcaugaacucgcggucuaccucccugagcguaagcuuggugcucguggggaucguaacguuauaccucggcgugaugguacaggccgacucugguugcguuguguccuggaagaauaaagagcucaaaugugggagcgggauuuuuauuacagacaacguccacaccuggacagagcaguacaaguuccagcccgaaagccccuccaagcuggccagcgcgauccagaaggcccaggaggaaggcaucugcgggauccgcuccgucacgcggcuggagaaccucauguggaagcagaucacgccagagcucaaccacauccuggccgagaacgaaguuaagcucaccaucaugaccggggacauuaagggaauaaugcaggccggaaagcgcagucucaggccgcagccgacggagcucaaguacuccuggaaaacguggggcaaggccaagaugcugagcaccgaauccuacaaccagaccuuccugaucgacggucccgagacggcagaguguccgaacaccaaccgagccuggaacagccuggagguagaggacuacggguucggcgucuuuaccaccaauaucuggcugaagcugaaggagaaacaggacgccuuuugcgauuccaaacugauguccgccgccaucaaggacaaucgggcgguacaugccgacaugggguacuggauugaguccgcgcucaacgacacguggaaaaucgagaaggcaagcuuuauagaggucaagaacugccacuggcccaagucccauacccuguggagcaacggcguccuggagagcgagaugauaauucccaagaaccucgccggacccgugagccagcacaauuaccgcccgggguaucacacucaaaucgcgggacccuggcauuuggggaaguuggagauggacuucgacuucugugacggaaccaccgugauugucacggaggacugcgggaaucggggccccucccuccggaccaccaccgccagcggcaagcugauuacagaguggugcugucgcucguguacccugcccccgcuccguuaccggggugaggacggcuguugguacgguauggagauccgcccacugaaggaaaaagaggaaaaccucgugaacucacucgugaccgcuggucacggucagguagacaacuucagccugggagugcucggcauggcccucuuccuggaagagaugcugcggacucgcguuggcaccaagcacgcgauucuccuggucgcggugaguuucgugaccuuaaucaccggcaacaugagcuucaaagaucucggcagaguuguggugauggucggcgcuaccauggcggacgacauuggaaugggcgugacguaccuggccuugcucgcggcauucaaagugagacccacuuucgcugccggccugcugcugcggaagcuaaccuccaaggagcugaugaugacuacgaucgggaucgugcuccugagccaguccaccauccccgagacuguacuggaacucaccgacgcacuggcccugggcaugauggugcuuaagaucguacguaacauggaaaaguaccagcuagcagugacgaucauggccauccucugcgucccgaacgcggucauccugcagaacgccuggaaggugucuugcaccauccuggcggugguguccguguccccccugcuccugacguccagccaacagaaaaccgauuggauaccccuggcccucacgaucaaggggcugaaccccaccgccaucuuccugacaacccucucccguacgaauaagaagagaagcuggccgcuuaacgaagccaucauggcggucggaaugguguccauccucgccucuucccuccugaagaacgacauuccuaugacuggcccacugguagcggguggcuugcugaccgucugcuacgugcugacggggcgcagcgcugaucuugagcuggagcgggccacggauguuaagugggaggaucaggcggaaaucuccgguagcagccccauccugucaauaaccaucucugaggacggcucuaugaguaucaaaaacgaagaggaggagcaaaccuugaccauucugauccgcacaggucuucucgucauuucuggccuguucccgauuucuauucccaucaccgccgccgccugguaccucugggaggucaagaagcagcgggcaggggugcucugggacguucccucgcccccgcccaugggcaaggcagaguuggaagacggggccuaccgcaucaagcagaagggcauccuaggguacucgcagaucggcgcuggcguguacaaagagggcaccuuccacaccauguggcacguuacccggggcgccguccucaugcacaagggcaaacgcaucgaaccuuccugggcggacgugaagaaagaccugaucagcuacggaggaggcuggaaacuggagggugaguggaaggagggggaagaggugcagguccucgcacuggagcccgguaagaacccccgggcagugcagacaaagccagggcuguucaagaccaauacuggcaccauaggggccgugucucucgacuucagccccggcacuuccggcagccccauaaucgaucguaaggggaaggucgugggacuguacgggaacggcguggucacaaggucuggcgccuacgugucggcaaucgcgcagacugagaagucuaucgaggacaaucccgaaauagaggacgacauuuuccgcaagcgacgccugaccaucauggaccugcaccccggggccgguaagacgaaacgauaccuucccgcaauaguccgugaggcgaucaagcggggccugcgcacacugauccucgcgcccacccgcgugguggcugcagagauggaagaggcccugcgcggccugccaauccgguaccagacccccgccauccgcgcagagcauaccgggcgcgagaucguugaccuuaugugucacgccaccuuuaccaugaggcuguuaagccccguccgcgugccgaacuauaauuuaauaauaauggaugaagcccacuucaccgaucccgccuccaucgccgcgcggggcuauaucucaacccgcguggaaaugggggaggccgccggaauauucaugacugcgacuccgccuggaagccgggacccguuuccccaauccaacgcccccaucaucgacgaggagcgcgagauucccgagcggucuuggaauuccgggcacgagugggucacggacuuuaaggggaagacagucugguucgugcccagcauaaaggcggggaacgacauugccgcuugcuugcgcaagaacggaaagaaagucauucaguugucacggaagaccuucgacagcgaguacgugaagacccgaaccaaugacugggacuuugugguaacgacggauaucuccgagaugggugcaaacuucaaagcggagcgggugauagacccccgucggugcaugaagccuguaauccucaccgacggggaggagcgcguuauuuuggccggacccaugcccgucacucacagcagcgccgcccagcggcgcgggcggaucggccgcaaucccaaaaacgaaaacgaccaguacauauacaugggggagccguuagagaacgacgaggacugcgcccauuggaaggaggcuaagaugcuccuggacaacaucaacacgcccgaggggaucaucccgagcauguuugagcccgagcgugaaaaaguagacgccaucgacggggaguacagauuacguggcgaggcccggaagaccuuugucgaucuuaugcgccguggggaucugcccguguggcuugccuacaaaguugcugcggaggguauaaauuacgcggaucgccgguggugcuucgacggaaucaagaacaaccagauccuugaggagaacgucgagguugaaaucuggacuaaggagggggagaggaaaaagcugaaaccccgauggcuggacgcccgaaucuacuccgacccccucgcccugaaagaauucaaggaguucgccgcgggccggaaguccuuaacucuaaacuuaaucacggaaaugggucgccuacccaccuucaugacccagaagacccgugacgcucucgacaaccucgccguccugcacacggccgaagcaggcggaagagcuuacaaccacgcccucuccgagcugcccgagacccuagagacccuccugcugcucacccuccuggcuacggugacggguggcauuuuucucuuccugaugaguggccguggcauaggcaagaugacccuggggaugugcugcaucaucacugccuccauccuccugugguacgcgcagauccagccgcacuggauagccgcaagcaucauccuggaauuuuuccucaucgugcuacucauccccgagccagagaagcaacguacgccccaggacaaucaguugacuuacguggugauugcaauccugaccgugguagccgcgacgauggcgaacgagaugggcuuucucgagaaaaccaagaaagaccucggucuaggcuccaucgccacgcaacaacccgagagcaacauccuggacaucgaccuccggcccgccagugcuuggacccucuacgcaguagccaccaccuucguaacgcccaugcuucgccacagcaucgagaacucuuccgucaacgugagccucacugccaucgccaaccaagcaacugugcuaaugggcuuagggaagggauggccgcucaguaagauggacauuggggucccgcugcuagcgaucggaugcuacagccaagugaaccccaucacuuugacugcagcgcuuuugcuccugguggcucacuacgcaaucauuggccccgggcugcaggccaaagccacgcgggaggcccaaaagcgcgccgcagcaggcaucaugaagaacccaacagucgacgggauaaccgugaucgauuuggacccgaucccauacgaccccaaauucgaaaaacagcugggccaggugaugcuacucauccugugcgucacucagguauugaugaugcggaccaccugggcccucugcgaggcccugacccuggccacggggccaauuuccacuuuaugggaaggcaacccgggucgcuucuggaauaccacuaucgcgguuagcauggccaacauuuuccguggaaguuaccuggccggcgccggccugcucuucagcaucaugaagaacacgacaaacacccgccguggcacugggaacaugggcgagacgcugggcgaaaaguggaagucccgacugaacgcucucgguaagagcgaguuccagauauacaagaaauccggcauccaggaggucgauagaacccucgcgaaagagggaauuaagcggggggagaccgaccaccacgccgugucacguggguccgccaagcugcggugguucguggagcgcaacauggucaccccagaaggcaaggugguugaccuuggcugcgggcggggaggguggagcuacuacuguggcgggcuaaagaacguacgcgaggugaagggccugacuaagggcgggcccggacacgaagagcccauaccuauguccacuuauggguggaaccucgugaggcugcaaagcggggucgacguguucuuuaucccgcccgagaagugcgacacccuacucugcgacauuggggaguccucacccaacccaacaguagaggcgggacggacacuccggguccuuaaccucguggagaauuggcugaacaacaacacccaguuuuguaucaagguccucaauccuuacaugcccagcgucauagaaaagauggaggcgcugcaacgcaaguacggcggggcacucgugcggaacccguugagccgcaacagcacccacgaaauguacuggguguccaaugccagcgggaacaucguguccagcgugaacaugauaucuaggaugcugauuaaccgauucacuaugaggcacaagaaggcuaccuacgagccggacguugaccucgggagcgggacgagaaacaucgggaucgaguccgagacccccaaccuggacaucauagggaaacggaucgagaagaucaaacaggagcacgagaccagcuggcacuacgaccaagaccaccccuacaagacgugggccuaucacggcuccuacgagacuaagcaaaccgggagcgcgagcucaauggucaacggcguggugcggcuguugacuaagccuugggacguccugcccaccguuacgcaaauggccaugaccgacacaacacccuuuggucagcagcgcguuuucaaggagaagguagauacucggacucaggagcccaaagagggcacgaagaaacuaaugaagaucaccgcugaguggcucuggaaggagcugggcaagaagaagacgccucgcaugugcacccgagaggaguucacgcguaaggugcggagcaacgcugcccugggagcgauuuucaccgaugagaacaaguggaaauccgcccgggaggccguagaggacucccgcuucugggagcucgucgacaaggagcggaaccugcaccuugagggaaagugcgagacaugcguguauaacaugauggguaagcgggagaagaaacucggcgaguucgggaaggcgaagggcagcagggcaauaugguacauguggcugggcgcccgguuccuggaguucgaagcccucggguuucugaacgaggaccacugguucucccgagaaaacucgcuguccggggucgagggagagggccuccacaagcuuggguauauucugcgagacgugagcaagaaggagggcggcgcuauguacgcggaugacaccgcggggugggacaccagaaucacccuagaagaccugaagaacgaggagaugguuacaaaccacauggagggugagcauaagaaguuggcagaggcaaucuucaagcucaccuaccagaacaaggucgugcgggugcagcgccccacgccccguggaaccgucauggauaucaucucucgccgagaccagcgcggcuccggacaggugggaacguacggucugaauaccuucacaaacauggaggcccaacugauccggcagauggagggagaaggcguauucaagaacauccagcaccucaccgucacggaggagguggcuguccagaauuggcucgcaagaguggggcgggaacggcuuagccgcauggccaucucgggggacgauugcguggugaagccccucgacgaucgguucgccaacgcccugacugcgcugaacgauaugggcaagauucguaaggacauccagcagugggaaccgucgaaaggguggaaugauuggacccagguccccuuuugcucccaccacuuccacgaauugaucaugaaggacggacgcgugcuggugguacccuguagaaaccaggacgagcugaucgggcgugcgaggaucagccagggugccgggugguccuuacgggaaaccgccugccugggcaagucguacgcccagauguggucacugauguacuuucaccgcagagaccuccgccuggccgcuaacgccaucugcagcgcugugcccagucauugggugccaacgagcagaaccaccuggucgauccacgcaaagcacgaguggaugaccacugaggacaugcugacggucuggaaccgcguguggauucgggagaaccccuggauggaggacaaaacccccguggagagcugggaagaaauucccuacuuaggcaagagggaggaccaguggugcggguccuuaaucggccugacaagccgugcuaccugggccaaaaauauccaggucgccaucaaccaagugcguucccucauagggaacgaggaguacacggacuacaugccgagcaugaaacgcuuccggcgcgaggaggaggaagcaggcgucuuaugguga

SEQ ID NO: 25423 - RNA, 9876 nt, Artificial Sequence
  derived and/or modified CDS sequence (opt11) from DENV-2__EU482474__SS-prME
agcgcggggaugaucaucaugcuuaucccgaccgugauggccuuccaccuaaccacccgcaacggggagccccacaugaucguggggauacaggagaagggaaagucccugcucuuuaaaaccgaagacggggugaacaugugcacacucauggccauggacuuaggggagcugugcgaggacaccauuaccuacaaguguccccuccuucggcaaaacgagcccgaggacaucgacugcugguguaacagcacaagcacaugggucacauacgggaccugcaccaccaccggcgagcaccgacgggagaagcgcagcgucgcccuggugccccacgugggcaugggccucgagacccgaacagagaccuggaugagcuccgaaggggcuuggaagcacgcccagcgcaucgagaccuggauucugcgucacccgggcuucacgauuauggcggcgauccuggccuacacuauagggacaacccacuuucagcgcgucuugaucuucauccugcugacugccguagcucccuccaugacaaugcggugcaucggcaucagcaaccgcgacuuuguggagggcguauccgggggaaguuggguggacauaguguuggagcaugggucaugcguuaccaccauggcgaagaacaaacccacacuggacuucgaguuaaucaagaccgaggccaagcagccugcgacccuucggaaguauugcaucgaggcgaagcuaaccaacacgaccacagaaagccgcugccccacccagggcgagcccucccugaaggaggagcaggacaagcgguuugucuguaaacacagcaugguggaccgcggcugggggaacggcugcggccuauucggcaagggcgggaucguaaccugugccauguucacgugcaagaagaauauggaggggaagaucguacagcccgaaaaccuagaguacaccaucguggucacgccccacucgggggaagagcacgcgguagggaacgacacugggaagcacggcaaagagaucaaggugaccccacaaagcuccaucaccgaggccgagcucaccggguacggcaccgugacgauggagugcaguccacggaccggccuagacuucaaugagaugguccugcugcaaauggagaacaaagccugguuggugcaccgccagugguuccuggaucugccccucccguggcugccgggggcugacaagcaggaguccaacuggauacagaaggagacacuggucacauucaagaacccacacgccaaaaagcaggacguugucgugcucggcagccaggagggggcuaugcacacggcccucacgggcgcuaccgagauccagaugagcuccgggaaccuucuguucaccggccaucuaaagugccggcugcgcauggacaaacuccagcugaaggggaugagcuacucaaugugcacgggaaaauucaagguggucaaggagaucgccgagacccagcacggcacaauugugauccgggugcaguacgaaggcgauggcucucccugcaagaucccguucgagaucauggaccuggagaagcgcuacguccucgggcgacuaaucaccgugaacccgaucguuacagagaaggacucccccaucaacauugaagccgagccucccuucggggacagcuauaucauaaucggcgucgagccggggcagcugaagcucaauugguucaagaaggggagcucuaucggccagauguucgagaccaccaugcgcggcgcaaagaggauggccauucugggagacaccgcuugggauuucgggucccugggcggaguguucaccagcaucggcaaggccuugcaccagguguucggggccaucuacggggcggcauucuccggcgucagcuggacaaugaagaucuuaaucggagugauuaucacauggaucggcaugaauucccggagcaccucccugagcgugucucuggucuuagucgggaucguaacgcuuuacuuaggcgucauggugcaggcagacagcgggugcgucguaucauggaagaauaaggaacucaagugcggcucgggcaucuucauuacggacaacguccacaccuggaccgagcaguacaaauuccagcccgaaucccccuccaaguuggcaucagcgauccaaaaggcucaagaggaagggaucugcggcauccgcuccguuacgcggcuggaaaaucucauguggaagcagaucacccccgagcugaaccauauccuagccgagaacgaggucaagcucaccaucaugacaggggauauaaaagggaucaugcaggcgggaaagcgcagccugcggccgcagcccacggagcugaaguauuccuggaagaccugggggaaggccaagaugcucagcacggaaucccacaaucagaccuuucugauugacggccccgagacggcggaguguccgaacaccaaccgcgccuggaacucacucgagguggaggacuauggguucggcguguucaccaccaacaucuggcuccgacugaaggaaaagcaggacgccuucugcgacuccaagcugaugucagcagccauuaaggacaaccgggcgguacacgccgacaugggguacuggaucgaguccgcccucaacgacacguggaagauugagaaggccuccuucaucgaggugaaaaacugccacuggcccaagucccacacucuguggagcaaugggguacuugagucagaaaugaucauccccaagaaucucgccggccccgucagccagcacaacuaucggccuggguaccacacccaaaucgcgggccccuggcaccuagggaaguuagagauggacuucgacuucugcgacggcaccaccgugaucguaacggaggacugugggaaccgcggacccucacuccggacuacgaccgcgucagggaaacugaucacggaguggugcugucgcagcugcaccuugcccccguugcgguaucguggggaggauggcugcugguacgggauggagauccggccgcuuaaggagaaggaggagaacuuagucaacucucucgugaccgccggccacggacaaguggacaacuucagccugggcguccugggcauggcccuuuuccuggaggaaaugcuucgcacccggguggggacgaagcacgcaauccuccugguugccgucuccuucgugacauuaaucacuggcaacaugagcuuuaaggaccucgggcgcguggucguaauggucggggccaccauggccgacgacaucgggaugggcgucacguaccuggcgcugcucgcggccuucaaaguacguccaaccuucgccgccggucuguuacuacggaagcugaccuccaaggagcugaugaugaccacgaucggaaucguucugcugagccaguccaccaucccggaaaccgucuuggaacucacggacgcccuugcgcugggcaugaugguccuaaagauugugcgcaacauggagaaguaccagcuugccgucaccaucauggccauccugugugugcccaacgccgucauccuucaaaacgcguggaaggugagcugcaccauccuggcgguggucuccgugagcccccugcuccugaccuccagccagcagaagaccgacuggaucccccuagcccuaacgaucaaggggcugaauccgacagccaucuuccugaccacccucucccggacgaauaagaagcgcagcuggccucugaacgaggcgaucauggcggugggcaugguuucgauccuggccagcagucuccugaagaacgacauccccaugaccggcccccugguggcugggggccuccuuaccguguguuacgucuuaaccgggcggucggcggacuuagagcuggagcgcgccacugacgugaagugggaggaccaagcggagaucuccggcagcucucccauccuguccauaaccauuagcgaggacgggagcaugagcaucaaaaacgaggaggaggaacagacccucacaauccugauccggacggggcuucucguuaucuccggccuguucccgaucagcauccccaucaccgccgccgccugguaccugugggaggucaagaagcagcgcgcuggggugcucugggaugugcccagcccuccgccuaugggaaaggcggagcuggaggacggggccuaccggaucaagcaaaagggcauucugggguacagccagaucggcgcuggcgucuacaaggaggggaccuuccacaccauguggcacgugacccgcggcgccgugcucaugcauaaggggaagaggaucgagcccuccugggcggaugucaagaaggaucuaaucuccuacggcgggggcuggaagcuggagggcgaguggaaagagggggaggagguccagguguuggcgcuugagcccggcaagaacccccgcgccguacaaacgaagcccgguuuauucaaaacaaauaccggaaccaucggagccguuucacuggacuucucccccggcacgucaggcagccccaucauagacaaaaagggcaagguggucggccuguacgggaacggcguggucacgcggucgggcgccuacgucagcgccaucgcacagaccgagaagaguaucgaggauaauccugagaucgaggacgacaucuucaggaagcggcgccugacaaucauggaccugcaccccggggccggaaagacuaagcgguaucuccccgccauugugcgcgaggcgaucaagcgggggcugcgcacccugauccucgcgccgacccgaguggucgccgccgaaauggaggaggcccugaggggacugcccauccgguaccagacccccgcgauucgcgcggagcacacggggcgugagauuguagaccucaugugccacgccaccuuuaccaugcggcucuuaagccccgugcgcgucccgaacuacaaccucaucauaauggaugaggcccauuuuaccgaccccgccuccaucgccgcgaggggcuacaucagcacgaggguggagaugggcgaggccgccgggaucuucaugacggcuacuccgcccggcucucgggacccuuucccccaaucgaacgccccaauuaucgaugaggaaagagagaucccugagaggagcuggaacuccgggcacgagugggugaccgacuucaagggcaagacggucugguucgugccgagcaucaaggcagggaacgauaucgccgcgugccuacgcaagaacggcaaaaaggugauccagcuuucacggaagacuuucgacagcgaguacgucaaaacacgcacaaacgacugggacuucguggugacgacagacaucuccgaaaugggcgcuaauuucaaggccgagcgggucaucgacccccggcggugcaugaagccagugauacucaccgacggcgaggagcgcgugauccuagccggaccaaugccggugacacacucguccgcugcccaacggcgcggccggaucggccgcaaccccaagaacgagaacgaucaguauaucuauaugggggagccgcuggagaacgacgaggacugcgcccacuggaaggaggccaaaaugcuccuggacaauauaaacacacccgaaggcaucauaccgucaauguucgagcccgagcgggagaagguggacgccguagacggcgaauaccgguuacgaggggaggcccggaagaccuucguagaccucaugcgccguggugaucugccaguauggcuugccuacaagguggcugcggaagggauuaacuaugccgaccgccgguggugcuucgacggaaucaagaauaaccagauccucgaagaaaacgucgagguggagaucuggaccaaggagggggagcgaaagaagcugaagccucgguggcuggaugcccgcauauauuccgacccgcucgcccugaaggaguucaaggaguucgccgcaggacggaaaucucuaacccucaaccucaucacggagaugggccgucugcccaccuucaugacucagaagacccgagacgcgcucgacaaccuagccguccugcacacugcagaggccggcgggcgcgcguacaaccacgcccuguccgagcuaccggagaccuuagaaacgcuccuucugcucacacugcuggccacgguaaccgggggcauauuccucuuccugaugucuggucgagggauuggcaaaaugacucugggaaugugcuguaucguuaccgcguccauccugcugugguaugcgcagauccagccucacuggauugccgcuagcaucauacuggaguucuuccucaucguccuccugauccccgagcccgagaagcagcgcacaccccaggauaaccaacuaacuuacguggugaucgccauccugacggucguugcggcuaccauggccaacgagaugggcuuuuuggagaagaccaagaaggaccucgggcugggcagcauugccacucagcaaccggagagcaacauccuggacaucgaccucaggccggccuccgccuggacgcuguaugcgguggcuaccaccuuugucacgcccaugcuccgccacagcaucgagaacagcuccguaaacguuagccucacggcaauagcuaaccaggcaacagucuuaaugggccuagggaagggcuggccccucuccaagauggacauuggggugccgcugcuggcgaucggcugcuauucccaagucaaccccaucacgcucacugccgcucugcugcuucuggucgcucacuacgcgaucaucgggcccggccugcaggcuaaggcuacccgggaagcucagaagcgcgccgcggccggcaucaugaagaacccaaccguugaugggaucaccgucauugaccucgacccgauccccuacgaucccaaguucgagaagcagcuaggccagguuauguuacucauccugugcgugacccaggugcugaugaugcggaccacgugggcccucugcgaggcucugacccuggccaccgggccgaucuccacccucugggagggcaacccugggcgcuuuuggaacaccaccaucgcggucagcauggccaacaucuuucguggcuccuaccuggccggagccggccuccucuucagcauaaugaaaaauacgaccaauacucgacgcggaaccgggaacaugggcgagacccuuggcgagaaguggaagucccggcugaacgcgcucggaaagagcgaguuccagaucuacaagaaguccggcauccaggagguggaccggacccuugcgaaggaggggauaaagcggggcgagacagaccaccacgcugugagcaggggguccgccaaguuacggugguucgucgagcgcaacauggugacacccgaagguaagguagucgaccuuggcugcgggcgcggggggugguccuacuacugcggcgggcugaaaaacgugcgcgaggucaagggccugaccaaggguggaccaggacacgaggagcccaucccgauguccaccuauggguggaacuuaguccggcugcagagcggcgucgacguguuuuucauaccaccagagaagugcgacacacugcucugugacaucggagaguccagccccaacccgacagucgaagccggccgcacgcuucgggugcugaaccucguggagaacuggcugaacaacaacacccaguuuugcaucaagguccuaaaccccuauaugcccuccgugauagagaagauggaggcacugcagcgcaaguacggcggggcucucgugcggaacccgcugagcagaaauagcacccacgagauguacugggucuccaacgccagcggcaacauuguguccagugugaacaugauaucccggaugcugauuaaccgcuucacuaugcgacacaagaaggccaccuacgaacccgacgucgacuuagguucaggcacgcgcaacaucgggaucgaguccgagauucccaaccuggacaucaucgggaagagaaucgagaagaucaagcaggagcacgaaaccagcuggcacuacgaccaggaccaccccuacaagaccugggccuaccacggcaguuacgagacaaagcagacggggagcgcguccuccauggugaacggugugguccgcuugcucaccaagccgugggacgugcugcccaccgucacgcagauggcuaugacggacacgacccccuucgggcagcaacgaguuuucaaggagaagguggacacgcggacgcaggaacccaaagagggcaccaagaagcuuaugaagaucaccgccgaguggcucuggaaggaacugggcaagaagaagaccccuagaaugugcacccgggaggaguucacccgaaagguucguuccaacgccgcccugggggccauauucaccgacgagaacaaguggaaguccgcccgcgaggccgucgaagacuccagauucugggaauuaguggacaaggagcgcaaccuucauuuagagggcaagugcgagaccugcguguacaacaugaugggaaagcgggagaagaaauuaggcgaguucgggaaggccaagggaagccgcgccaucugguauauguggcugggcgcucgguuccuggaauucgaggcccucggguuccuaaacgaagaccacugguuuucccgcgagaacagccuguccggcgucgagggggagggccuacacaagcugggguacauccugagagacgugagcaagaaggagggcggagccauguacgccgacgacacggcggggugggauaccagaaucacccuggaagaccugaaaaacgaggagauggucacaaaccacauggagggcgaacacaaaaagcuggcggaggccaucuuuaagcucacuuaucagaacaaggugguaaggguccagagacccacgccgcgggggaccguaauggacaucaucucgcgcagggaccagagaggauccggccagguggguacuuacggccugaacacuuucaccaacauggaggcccagcugauccggcagauggaaggcgagggcgucuucaagaacauucagcaccuaaccguuaccgaggagguugccguucagaacuggcuggcgagggugggccgcgagcggcucucucgcauggccaucuccggcgacgacugcguagucaagccccuagacgaucgguucgcuaaugcgcugaccgcccucaacgacauggggaagauucguaaagacauccagcagugggagccgagcaagggguggaacgacuggacccaggugcccuucugcucccaccacuuccacgaacuuaucaugaaggacggccgggugcuggucgugcccugccggaaccaggacgagcugaucggccgggcgcgcauaagccagggcgccggguggucccuccgcgagacugccugccugggcaagagcuacgcgcagauguggucccugauguacuuucaccgccgggaccucaggcuggccgcgaacgcgaucugcucggccgugcccucccacugggucccgaccagccggacgaccuggucuauccacgccaagcacgaguggaugaccaccgaggauaugcugacgguguggaaucgaguguggauccgggagaauccuuggauggaggacaagacucccgucgaaucuugggaagagauccccuaccucggcaagcgggaggaccaguggugugguucccugaucggccugaccagccgggcuaccugggcgaagaacauccaggccgccauuaaucaggugaggucccucaucgggaacgaggaguacaccgacuauaugccuagcaugaaaagguuucgacgcgaggaagaggaagccggcguacugugguga

SEQ ID NO: 25424 - RNA, 9876 nt, Artificial Sequence
  derived and/or modified CDS sequence (opt11) from DENV-2__EU482475__SS-prME
agcgccggaaugaucaucaugcucauacccaccgucauggcguuccaccucacaacccggaauggggagccccacaugaucgucggcauccaggagaagggcaagagccugcuuuucaagacagaggacggcgugaauaugugcaccuugauggcgauggaucugggggagcugugcgaggacacuaucaccuacaagugcccacuccugcggcagaacgagcccgaggacauagacugcuggugcaauagcaccuccacgugggugacauacgggaccugcaccacuaccggcgagcaucgccgggaaaagcgcagcgucgcccuugugccccauguggggaugggguuagagacgcggaccgagaccuggauguccagcgagggggccuggaagcacgcucagaggaucgagaccuggauccugcggcacccuggcuuuacgaucauggccgcgauucuagccuacaccaucggcaccacccacuuccagcgcguacucaucuucauccuucugacggccgucgcccccuccaugaccaugcggugcaucggcaucagcaaccgggacuuuguggagggcgucuccggagguucguggguagacauagugcucgagcauggguccugcguuaccaccauggcaaagaacaaaccgacgcuggacuuugagcugaucaagaccgaagccaagcagcccgccacccuccgcaaguacugcauagaggcgaagcuaacgaacacgaccacugagucacgcugccccacacagggcgaacccucccugaaagaggagcaggacaaacgguucguuugcaagcacucuaugguggaccgcggcugggguaacggcugcggccuguucggcaaaggcgggauaguaacgugcgccauguucacaugcaagaagaauauggagggcaaaauagugcagcccgaaaaucuggaguauaccaucguggucacgccgcacuccggggaggaacacgcggugggcaacgauacggggaaacauggcaaggagaucaagguuacuccccagagcucgaucaccgaagccgagcugaccggguacggcacugucaccauggagugcagcccccggaccggccucgacuucaacgagauggugcuguugcagauggagaacaaggccuggcucgugcaucgccagugguuccuggaccuucccuugcccuggcuuccgggggccgacaagcaggagaguaauuggauccagaaagagaccuuagugacguucaagaacccgcaugccaaaaaacaggacguggucguccucggcagccaggagggagccaugcacacggcccugacgggugcuaccgaaauccaaaugagcuccggaaaccuccuguucacuggccaccugaaaugccggcuacgcauggacaaacuccaauuaaagggcaugucuuacuccauguguacggggaaguuuaagguggucaaagagaucgcagaaacccagcacggcaccaucgugaucagagugcaauacgagggcgacggcucacccugcaaaauccccuuugagauaauggaucuggagaagcgguacguccucggccgguuaauuaccgugaacccgaucgugacggaaaaggacuccccggugaacaucgaagcagagccucccuucggggacagcuacaucaucaucgguguggagccggggcaauuaaagcuaaacugguucaagaaaggcuccucaauagggcagauguucgagaccacgaugcgcggcgcgaagcgcauggccauccuaggcgauaccgccugggacuucgggucccugggcgggguguuuacgagcaucggcaaggcccuccaucaggucuuuggugcuauuuacggcgcggccuucuccggcguaagcuggaccaugaagauucugaucgggguaaucauuaccuggauuggcaugaacucccgaagcaccucccugagcgucucccuggugcucgugggaaucgucacgcuguaccugggcgugaugguucaggcugacagcggcugcguggugucguggaagaacaaggaacuaaagugcggcagcggaauuuucauuaccgacaaugugcacaccuggaccgagcaguacaaguuucagcccgagagcccguccaagcuggcaagcgcgauucagaaggcucaagaggaggggauuuguggaauccgcagcgucacgcggcuggagaaccucauguggaagcagaucacccccgagcugaaucacauacuggccgagaacgaggugaagcucaccaucaugaccggcgauaucaagggcauuaugcaggcggggaaaaggagccugcggccgcagcccacggagcuaaaguacagcuggaagacguggggcaaggccaagaugcuuuccaccgaguccuacaaccagaccuuccugaucgacgggcccgagacggcggaaugcccuaacaccaaccgagccuggaacagccuggagguggaggacuacggauucggcguuuucaccaccaacaucuggcucaaacugaaggagaagcaagacgcguucugcgauuccaagcuuaugagugccgccaucaaggacaaccgggcggugcacgccgacaugggguacuggaucgagucugcccucaacgacacguggaagaucgagaaggccagcuuuaucgaggugaagaacugccauuggcccaagucccacacccuguggaguaacggcguccuggagucugaaaugaucauccccaagaaccuugccggcccugugagccagcauaauuaucgcccgggguaccacacgcaaaucgcgggccccuggcaccuggggaagcuagagauggacuucgauuucugcgacggcaccaccgucaucguaacggaggacugcgguaaccggggacccucccucagaaccaccaccgccuccgggaagcugauaacggaguggugcugccgaagcugcacccugcccccgcuccgcuaucgcggugaggacggcugcugguacgguauggagauccgcccucugaaagagaaggaggagaaccuagugaacagccucgugaccgccggccacgggcaggucgacaacuuuagccucggggugcucgggauggcccucuuccuggaagaaaugcugcggacccgcguggggacaaagcacgcgauccuccucgucgccguguccuucgugacguuaaucaccggcaacaugaguuucaaggaucucgggcgggucgugguuauggucggugcuaccauggccgacgacauagggaugggagucacguaccuugcccugcucgcggccuucaaaguuagacccacauucgcagcuggccugcugcuccggaagcugaccuccaaggaguuaaugaugacuacgaucgggaucguccuccugagccaguccaccauccccgaaacggugcuagagcucaccgaugcccucgcgcucggcaugaugguucucaagauagugcguaacauggagaaguaccagcucgccgugacgaucauggccauucuuugcguaccgaacgccgugauccuccaaaacgccuggaaaguaagcugcacaauuuuagccgucgugucugugagcccccugcuccugaccuccagccaacagaagaccgacuggaucccccuggcguugacgaucaaggggcucaaccccaccgccaucuuccugacgacccucuccagaacgaacaaaaagcgcagcuggccacugaacgaggccauaauggcgguaggcauggucucaauccuggcaagcucgcuccugaagaacgacauacccaugaccggcccccugguggccggcggccuacugaccguuugcuacgugcugaccgggcgcagcgccgaucucgagcuagagcgggccacagacgugaagugggaggaccaggcggaaaucucuggcagcucgcccauacuguccaucaccaucagcgaggacggguccaugagcauaaagaacgaggaggaagagcagacccucaccauccugauccgcacgggccugcucguaaucaguggacuguucccgauuagcauuccaauaaccgcagcagcgugguaccugugggaggugaagaaacagcgggcaggugugcucugggacguccccagcccaccgcccaugggcaaggcagagcucgaggauggugcguaccguaucaagcagaaaggcauccugggguauagccagaucggggccggcguguacaaggaggggaccuuccauaccauguggcacgugacccggggcgccguccugaugcacaaaggaaagcgcaucgagcccuccugggccgacgucaaaaaggaccugaucaguuacggcgguggcuggaagcuggaaggggaguggaaagagggggaagagguccaagucuuggcccuggagcccggcaagaauccccgggccgugcagacgaagcccgggcuguucaaaacaaacacaggcaccaucggggccguguccuuagacuucagcccuggcacuucaggcagcccuaucaucgacaagaaggggaaggucgugggccuguacgggaacggcguggucacccgcucaggcgccuacgugagcgccaucgcgcagaccgaaaaguccauugaggacaaccccgagauagaggacgacaucuuucggaagagaagacugaccaucauggaccuucaccccggggcuggcaagaccaagcgcuaccucccagcaauagugcgggaggccaucaaacgcgggcugcggacccuaauucucgcgccgacccguguuguagccgccgagauggaggaggcccugcgggguuuaccuauccgcuaccagacucccgccauccgggcggagcacacggggcgcgagaucguggaccucaugugccacgccaccuucaccaugcgccuguuguccccaguccgggugccgaacuacaaccuuaucaucauggacgaggcccacuucaccgacccggccuccauagccgcucgaggcuacaucaguacgcggguggagaugggggaagcggcagggauauucaugaccgccaccccgcccggcagccgcgacccuuucccucagucaaaugcccccaucaucgacgaggagcgggagaucccggaacgcagcuggaacuccgggcacgagugggucacugauuucaaagggaagacugugugguucguuccgucuaucaaggcggggaacgacauugccgcaugccugcggaaaaacggcaagaaagucauccagcugagucgcaagacguuugacagugaguacgugaagacucggaccaacgauugggacuucguggucacgacggacauuuccgaaaugggcgccaacuucaaggcagagcgcguaaucgauccccggcgcuguaugaagccggucaucuuaaccgacggggaggaacgggucauacuggccggucccaugccugucacccacucuucugcugcccaacgccgggggcgcaucggccggaacccaaagaacgagaacgaccaauauaucuacaugggggagccccuagagaacgacgaagacugcgcccacuggaaggaggcgaagaugcugcuggauaacauaaacacgccagagggcauuaucccgagcauguucgagccggagcgcgaaaagguagacgccauagauggggaguaccgccugcgcggggaagcucggaaaacauucgucgaccugaugcggcgaggagaucugcccguguggcucgcauacaagguugccgcggaaggaaucaacuacguagacaggagauggugcuucgacggcaucaagaacaaccagauucucgaggagaacguagaagucgaaauauggacaaaggagggggaacggaagaagcugaagccgcgcuggcuggacgcccgaaucuacuccgacccgcucgcccugaaggaauuuaaagaguucgccgccggccguaaaagccucacccucaaccugaucacggagaugggccggcugcccaccuucaugacgcagaaaacccgcgacgcgcuagacaaccuggcugugcugcacacggccgaggccggcggacgggcguacaaucacgcguuaucggagcugcccgagacccucgaaacacuccuccugcucacacugcuggcgacuguaaccggugggaucuuccucuuccugaugagcggccgcgguauuggcaaaaugacccugggaauguguugcauuauuaccgccagcauccuucuuugguacgcccagauccagccgcacuggaucgcggccagcaucauccuugaguuuuuccugaucguccugcugauccccgaacccgagaaacaacggacgccacaggacaaccagcucacauacguggucauagccauccugaccgucguagccgccaccauggcgaacgaaauggguuucuuggaaaagacaaagaaggaccucggucuggggagcaucgccacccagcagccggagucaaacauucuggacaucgaccuccgcccggccucagccuggacacuguaugcggucgcgaccaccuucgucacgcccaugcugaggcacagcaucgagaacagcuccguuaacgugucacucacugccauugccaaccaggccaccgugcugaugggccuggguaagggguggcccuuauccaagauggacaucggggugccucugcuggcaauaggcugcuacucacaggugaaccccaucacccucacagcggcgcugcugcuccuggucgcacacuacgccaucauagggcccggcuugcaagcgaaagccacccgggaggcccagaagcgggcagccgcgggaaucaugaagaaccccaccguggaugggaucaccgugaucgaccucgacccgauccccuacgauccuaaguucgagaagcagcugggccaggucauguugcucauccugugugugacccaagugcugaugaugcgcacaaccugggcccuaugcgaggcccugacacuggcaacggggccaauuuccacucucugggagggcaacccggggcgguucuggaacaccaccauugcagucaguauggccaacaucuuccgcggguccuaccuggccggggccgggcuccuguucucgaucaugaagaacaccaccaacacacggcgcggcaccgggaacaugggcgaaacgcugggcgagaaguggaagucccgcuuaaacgcucucgggaagagugaguuccagaucuacaagcgguccggcauccaggagguggaccgaacgcuggcaaaggagggaaucaaacggggcgagaccgaucaucacgcggugucacgcggguccgccaagcucaggugguucgucgagcgcaauauggugaccccugaggggaaggucgucgaccucggcugcgggagaggggguuggagcuacuauugcggagggcuuaaaaacgugcgcgaaguaaagggcuuaacgaaaggcgggccgggccaugaagagccgauaccgaugucaaccuauggauggaaccucguccggcugcaaagcggcguggauguuuucuucaucccgcccgagaagugcgacacccugcucugcgacauaggggaguccucgcccaauccgacagucgaggccggacguacguugcgggucuugaaccucgucgagaacugguuaaacaacaacacgcaguucugcaucaagguccugaaucccuacaugccuucggugauagagaaaauggaggcccuacagcgcaaguacggaggggcgcucguccggaacccucugucucguaacucgacucacgagauguauugggucuccaacgccagcggcaacaucgugaguagugugaacaugaucucgcggaugcucaucaaccgguuuaccaugcggcacaagaaggccaccuacgagcccgacgucgaccuugggagcggcacuagaaacaucggaaucgaauccgagauccccaaccuugacaucaucggaaagcggaucgaaaagaucaagcaggagcacgagacgagcuggcacuacgaccaagaccaccccuacaagaccugggccuaccacggaagcuacgagacgaagcagacggguucggccagcaguauggugaacggcgugguccggcuguugacaaagccgugggacguucuuccaaccgucacccagauggcgaugacggacacuacccccuucgggcagcagcgcgucuucaaagagaagguagacacaagaacgcaggagcccaaggagggaaccaagaagcugaugaagaucaccgccgaauggcucuggaaggagcugggcaagaagaagaccccgcgcauguguacccgggaggaguucacucgcaaagugcgguccaacgccgcccuuggcgcaauuuuuacagacgagaauaaguggaaguccgcgcgugaggcgguagaggacucccgguucugggaguugguugauaaggaacgcaaccugcaccuggaggggaagugugagacgugcguauacaauaugaugggaaagcgggagaaaaaacucggagaauucgggaaggcuaagggcagccgcgcaaucugguauauguggcugggcgcccgcuuucuggaguuugaggcucucggcuuccuuaacgaggaccacugguucagucgcgaaaacagccuguccggcguugagggggaaggccuccacaaacugggguacauucugagagacgugagcaagaaggaaggcggcgccauguacgcagacgacacggccgggugggauacccggaucacccucgaagaccugaagaacgaggagauggucaccaaccauaugaagggcgaacacaagaagcuggcggaggcgaucuucaagcucacguaccagaacaagguggugcggguccaacgcccuacgccccgggggaccgugauggacaucaucucacgccgggaccagcgcggcuccggccagguggggacguacggccugaacacguucaccaauauggaggcacagcuuauccgacagauggagggggagggcgucuucaaaaacauccagcaccugaccgugaccgaggagguggccguccagaacuggcuggcccgugugggacgcgagcggcugucucgcauggcgaucuccggcgacgauugcgucgugaagccccucgacgaccgauucgccaacgcccugacggcccugaacgacaugggcaagauccgcaaagacauccagcagugggagccuagcaagggauggaacgauuggacccaggugcccuucugcucccaccauuuccacgaacucauuaugaaggauggccgggugcuugucgugccgugucgcaaucaagaugaauugaucgggcgggcccgcaucagccagggagccggguggagucuccgggagacugcuugccugggaaagaguuacgcucagauguggucccugauguacuuccaccgccgggacuuacgccuggccgccaaugcuaucugcagcgccgugcccagucacugggucccaaccagccggaccacaugguccauccacgcuaaacaugaguggaugaccaccgaggacaugcugaccguguggaaccgcguguggauccgggagaaccccuggauggaggacaagacgccugucgagucaugggaggagauaccuuaccucggcaagcgcgaggaccaauggugugggucccugaucggcuuaaccucccgggccacgugggccaagaacauccaggcggcuaucaaccaagugcgcucccucauagggaacgaggaguacaccgacuacaugccgagcaugaagagguuucgccgugaggaggaggaggccggcguguuaugguga

SEQ ID NO: 25425 - RNA, 9876 nt, Artificial Sequence
  derived and/or modified CDS sequence (opt11) from DENV-2__EU482541__SS-prME
agugcggggaugauuauaaugcuaauaccaaccgucauggcuuuccaucuaacaacucgcaauggggaaccccacaugaucguggggauccaggagaaaggcaagucgcugcuguucaagaccgaagacggcgugaacauguguacccucauggcgauggaccugggggagcucugcgaagauaccaucaccuacaaaugcccgcucuugcggcagaacgagccagaggacaucgacugcugguguaauagcaccuccaccuggguuacuuacgggacgugcaccacuaccggugaacaccgccgagaaaagcguucggucgcccucgucccccauguggggaugggccucgagacucggaccgaaacauggauguccagcgagggggccuggaagcacgcgcagcguaucgagaccuggauccugcgucauccgggguucaccaucauggccgcuaucuuagccuacaccaucgggaccacgcacuuccagcgcguccuaaucuucauccugcugacggcgguggccccuuccaugaccaugcguugcaucggcaucuccaaucgcgacuuuguagaaggcgucuccggcgggucuuggguugacauugucuuggagcacgggucgugcguaacaacaauggccaaaaauaagccgacgcuggauuucgagcugaucaaaacugaggcgaaacagcccgccaccuuaagaaaguacugcaucgaagcaaagcugacaaacacuacgacagagagccgcugccccacucagggggagcccucucugaaggaggaacaggacaaaagauucgugugcaagcauucuaugguagaccgcggcuggggaaacgguugcggguuauuuggcaaagggggaaucgucacuugcgccauguuuacuugcaagaagaacauggagggcaagaucgugcagccugaaaaccuggaguacacaauaguggucacgccgcacuccggggaagaacacgcagugggcaacgauacgggcaagcacggcauggagaucaagguaacaccgcagaguucuaucaccgaggccgaguugacuggguacggcaccguaacgauggagugcucgccccguaccggucucgacuucaacgagauggugcuccuacaaauggagaacaaagccuggcucgugcaccggcagugguuucuagaccuuccccugccuuggcucccgggggcugacaagcaggaauccaacuggauccagaaggagacauuggucacguuuaaaaacccgcacgcaaagaagcaggaugugguaguauuaggcucucaggagggugcgaugcacacugcccugacgggcgcaaccgagauucaaaugagcuccgggaaccucuuguucaccggacaccugaaaugccggcugaggauggacaagcugcaacugaaagguaugagcuacuccauguguaccgggaaguuuaaaguggugaaagagaucgccgagacucagcacggcaccauugugauccggguccaguacgagggagacggcagcccuugcaagaucccguucgagauuauggaccuggagaagagauacgugcucggccgccugauuaccgugaauccgaucgugaccgaaaaagacucgccagugaacauagaggccgagccgccauucggggauagcuacaucauaaucggaguugaaccaggacagcuuaagcugaauugguucaagaagggcuccucuauagggcagauguucgagacaacaaugcgcggcgcgaaacgcauggccauccugggcgacaccgcuugggacuucgggucccugggcgggguauucaccagcaucggcaaagcccuacaccagguuuuuggggcuauauacggcgcggccuucucuggggugagcuggaccaugaaaauacuuaucggggugaucaucaccuggaucgguaugaacucccggucaaccuccuugagcgugagucuggugcucguugggaucguaacgcuuuaccugggcgugauggugcaggcagacagugggugcgucguuaguuggaaaaauaaagaauuaaaguguggcagcggcaucuucauaacagacaaugugcacacuuggaccgaacaauacaaauuucagcccgagagccccuccaaacucgcuagcgcaauccagaaggcucaggaggaggggauaugcggcauccgcuccgucacgcggcucgaaaaucucauguggaagcagauaacgcccgaacugaaccacauccuggccgagaacgaggugaaacucaccaucaugacgggggacauacguggcauuaugcaggccgguaagcggagccuucgcccucaacccgcagagcugaaguauagcuggaaaacauggggcaaagcgaagaugcucagcaccgaaucuuacaaucagaccuuccugaucgacggccccgaaacugccgaaugcccgaacaccaaccgggcauggaacucucuugagguggaggauuacggguucggcgucuucaccacgaauaucuggcucaagcugaaagaaaagcaagaugcuuucugcgauagcaagcugaugucagcugccauuaaggacaaucgcgcgguccacgcagacaugggguacuggauagaguccgcgcuaaaugacaccuggaagaucgaaaaggccagcuuuaucgaaguuaagaacugucacuggccuaaaucucacacguuauggagcaacgguguacuagaguccgaaaugaucaucccaaagaacuuagcggggcccgugagccagcacaacuaccggccgggguaccacacccagauagccgguccauggcacuugggaaagcuggaaauggacuucgauuucugugauggcacaaccgucaucgugaccgaggacugcgguaaccgcgggccuucucuccggacgacgaccgccagcggcaagcuaauaacggaguggugcugccguagcugcacauugcccccacuccgcuaccguggggaggauggcugcugguacggcauggagauccgaccccugaaggagaaagaggagaaccuggugaacucccuugugacagccggccauggacaaguggacaacuuuucccugggcguacuuggcauggcccuauuucuugaggagaugcugcgcacgcgggucggaacuaagcacgcaauucuccuggucgcggugaguuucgugacacucauaaccggcaacaugagcuucaaggaccucggucgcgucguaguuaugguaggcgccaccauggcggacgacaucgggaugggggucaccuaucuggcgcugcucgccgccuucaaggugagacccaccuucgcggcuggccuuuuacuccgcaaacugaccuccaaggaacuuaugaugaccaccaucgggaucguucuccugagccagucaacgauccccgagacggugcuggagcucaccgacgcgcuagccuuaggcaugauggugcucaaaauuguccguaacauggaaaaguaucaacuagccgucaccauaauggcuauuuuaugugucccgaacgccgugauacugcaaaacgcuuggaaagugucaugcacgauccuggccguaguguccgugagcccccugcugcuuacgaguucucaacagaaaacagacuggauuccccucgccuuaaccauuaaagggcugaaccccacggccauuuuccugacuacccucagucggacuaauaagaagcgaucuuggccacugaacgaagcgauaauggccgucggcauggucaguauucuggccuccucccuccuuaagaacgauauccccaugacuggcccuuugguggcagggggucugcuaaccguguguuaugugcugaccgggcggagugccgaccucgaguuagagcgcgcaaccgacgucaaaugggaggaucaggccgaaauuuccggaagcagcccaauacuguccaucacuaucagcgaggacggguccaugucaaucaagaaugaagaggaggagcagacucucacuauccuaauccgcacaggccugcucgucauuucuggucuguucccgaucagcauccccaucaccgccgccgccugguaccugugggaggugaagaaacagcgcgcgggggugcucugggacguccccagcccgccacccauggguaaagcggagcuagaggacggggccuaccggaucaaacagaaaggaauccuggguuacagccagauuggcgccgggguguauaaggaggggaccuuccacacaauguggcacguaacgcgcggcgccguccuuaugcacaaggggaaaaggaucgagccauccugggcggaugugaagaaagaccugauuagcuauggcgggggauggaaacuggaaggugaguggaaggagggggaggaagugcagguacuugcccuugaaccaggcaagaacccaagggccguacaaaccaagcccgggcucuuuaagacaaacaccgggacgauaggggcaguaucccucgacuucagcccaggcacaagcggcagccccaucauagauaagaaggggaaggucguaggcuuauacgguaacggcguggucacucgguccggugccuacgugucugccaucgcccagacagaaaagaguauagaggacaaccccgagaucgaggacgauaucuuccgcaagcgacgccugacaaucauggaccuacaccccggcgcugggaaaaccaagcgauaucuucccgccauaguacgcgaagcgaucaagaggggguuacgcacucuuauucucgccccgacccgggucguugcugcugagauggaagaggcacuccgcgggcugccuauacgauaccagacccccgcgauccgagccgagcauaccggucgcgagauuguggaccuaaugugccacgccacguucaccaugcggcuucugagcccgguucgcgugcccaacuauaacuuaauaaucauggacgaggcgcacuucaccgaccccgccuccaucgcggcacggggguacauuagcacccggguggagaugggcgaagccgccgggaucuucaugacggccaccccgcccggcagcagagauccguucccacagucaaaugcgccuaucaucgacgaggaacgcgagauacccgagcggucauggaacucagggcacgagugggucacugacuucaagggcaaaaccgugugguucgugccaagcaucaaggccgggaaugacauugcugcaugcuuaagaaagaacggcaagaaaguuauucagcugucccggaagacguucgacagcgaauaugugaagacacggaccaacgacugggacuucguuguuacuaccgacauaagugaaaugggcgcgaacuuuaaagccgagaggguaaucgauccgcgacggugcaugaaacccguuauccuuaccgacggcgaggaacgcgucauccuagccggcccaaugccgguuacccauucgagcgcugcgcaaagacgaggccggauaggccggaauccgaagaacgaaaacgaccaguacaucuacaugggugagcccuuggagaacgacgaagacugcgcgcacuggaaggaggccaagaugcuacuggacaacauaaacacccccgaaggcaucaucccaucaauguucgagcccgaacgggagaagguggacgcaaucgacggcgaauaccgccugagaggagaggcucgcaaaacguucguagaucuaaugcgcagaggagaccuccccguguggcuggccuauaagguggcugccgagggaauuaacuacgcagaccgccgguggugcuucgacgguauaaagaauaaccaaaucuuagaagagaacguagaggucgaaauuuggaccaaagagggagaacgcaagaaacucaagccccguuggcuggacgccagaaucuauuccgacccgcuagcccugaaggaguucaaggaguucgcggccggacggaagucccugacccuaaaccugauuacugaaaugggccguuuaccaacguucaugacccagaagacccgggacgcccuggacaaccuggccguguuacacaccgcggaggcugggggccgcgcguacaaccacgcccucagcgagcugccggagacccuggagacacuccugcugcucacacugcuggccacuguuacagggggcauauuccuauucuuaaugagcgggcgugggaucggaaagaugacccuggggaugugcuguaucaucacggcaagcauccucuuaugguacgcccagauccagccacacuggauugccgccagcaucauccuagaguuuuuccucaucgugcuacuuauaccagaacccgagaagcagcgcacgccccaggacaaccagcucaccuacgucgugaucgccauccugaccguaguagcggccacaauggcuaaugagaugggcuucuuggagaaaaccaaaaaggaucuuggccuggguuccauugcuacccagcagcccgaaagcaacauccuggacaucgaccuccggccggcaagugcguggacgcuguaugcuguagcaaccaccuucgucacccccaugcuucgccauaguauagagaacucuuccgucaacgucagccucacagcaauugccaaccaagcgaccgugcuaaugggguuggguaagggcuggccacuaaguaagauggauauaggggucccacuccuggcgaucggcugcuauucucaggucaauccuaucacccugaccgccgcacugcuucuccucguggcgcacuaugcaauuaucgggccgggacuccaagcuaaggccacgcgggaggcgcagaagcgcgcagcugcuggcaucaugaaaaaucccaccguggaugggaucaccgugaucgaucucgacccgaucccguaugaucccaaauuugagaagcagcugggccaggucaugcuguuaauacugugcgucacccaaguccuaaugaugcggacaacuugggcccuaugugaggcgcugacccuggcgaccgggccuaucaguacccucugggaggggaaccccggccgcuucuggaacaccaccauagcgguaucgauggccaacaucuuccggggcuccuaccuggcuggcgccgggcuauuauuuucgauuaugaaaaacacgacuaacaccaggaggggcaccgggaacaucggcgagacccugggagagaaguggaaaagcagacuaaacgcccucggcaagagugaguuucaaauuuacaagaaguccggcauccaagaagucgaucgcacgcuugccaaggaggggaucaagcggggcgaaacugaccaccacgccgucuccagggggucggcuaagcuccguugguuugucgagagaaauaugguaacucccgagggcaaggucguggaucuagggugugggcgggguggcuggagcuauuacugcggcggucucaagaacguccgcgaggugaagggauuaaccaagggugggcccggccacgaggagccgauaccgauguccacguacggcuggaaccucgugcggcuucagagcgggguugauguguucuucaucccgcccgagaagugugacacccugcuuugugauaucggggaauccucucccaacccgaccguggaggcugggcgcacccugcggguccugaaccucguggagaauuggcuaaacaacaacacgcaguucugcaucaagguucugaaucccuauaugccgucagucaucgagaagauggaagcccuccaacgcaaauacggcggggcucucgugcggaauccguugagucgaaauagcacgcaugagauguauuggguguccaacgcuagcggcaauaucgucaguucggugaauaugaucucccguaugcugauuaaccgauucacaaugcggcacaagaaagcuaccuacgaacccgauguggaccucgguucaggcacgaggaacauuggcauugagagcgagauccccaacuuggacauuaucggcaaacguauagagaagaucaagcaagagcacgagacaagcuggcacuacgaccaagaccaccccuauaaaaccugggcuuaucacggcucguaugaaaccaagcaaacaggguccgccucuaguauggugaacgggguggugaggcugcucacgaaaccgugggacguacuuccaacagugacacaaauggccaugacagacacuaccccauucgggcagcagcgcguguuuaaggagaaggucgacacccgcacacaggagccaaaggaaggaacgaagaaauuaaugaagauaacggccgaguggcucuggaaggagcucggcaagaagaaaacaccucgcaugugcaccagagaggaguucacgcgcaaaguacgguccaaugccgcgcuuggggcuaucuucacugacgagaacaaguggaagucggcccgggaggccguggaggauucccgcuucugggagcucgucgacaaagaacgcaaccuacaccucgagggcaagugugaaaccugcguguacaacaugaugggcaaaagagagaagaaacucggugaguucggcaaagccaagggcucacgugcgaucugguacauguggcugggagcccgcuuccuggaguucgaggcccucggguuucugaacgaagaccacugguuuagcagagagaacagccuaucaggcgucgagggagaaggcuuacacaagcuaggguauauucugcgggacgugucuaagaaagaaggaggggccauguacgcugacgauacagccgggugggacacgcguaucacacucgaagaucuaaagaaugaggagaugguuaccaaccacauggaaggcgagcacaaaaagcuagcggaggccauuuuuaaguuaacuuaucagaacaaaguggugcgggugcaacgcccaacgccaagggggacuguuauggacaucaucucucgccgggaucagcgcgguuccggccaggucggaacguacggcuuaaacaccuucacgaacauggaggcccaauuaauucggcagauggagggggaagggguguuuaaaaacauucaacgccuaaccgucaccgaggaggucgcgguucacaacuggcuggcccgagucgggagggagcgccugagccggauggcgaucuccggagaugacugugucgugaaaccccucgacgaccguuuugccaacgcccugaccgcacugaacgacaugggcaagauucgcaaggacauccagcagugggagccuagcaagggguggaacgacuggacgcaggucccguucuguucgcaccacuuccacgagcucaucaugaaagacggacggauucugguagucccgugcagaaaccaagaugaacugaucgggcgagcaaggaucucacagggcgccggcuggucccuccgcgaaacagcuugucuggguaagucauacgcccagauguggagccugauguacuuccaucggagggaccuuaggcuagcggccaacgccaucugcuccgcagugcccucccauugggucccgaccagccgcacgacgugguccauccaugcuaagcacgaguggaugaccaccgaagauauguuaaccgucuggaaccguguauggauucgcgaaaauccguggauggaagauaaaacgcccguggagagcugggaagagauuccuuaccucggcaaacgggaagaucaauggugcgggucccucaucggacugacgucccgcgcgacaugggccaagaacauccaggccgccaucaaccaggugcggagucuuaucggaaacgaagaguacaccgauuacaugccgagcaugaaacgcuuucgacgggaggaggaagaggcgggaguccuaugguag

SEQ ID NO: 25426 - RNA, 9876 nt, Artificial Sequence
  derived and/or modified CDS sequence (opt11) from DENV-2__EU482542__SS-prME
uccgcggggaugaucaucaugcugauuccuaccgucauggcauuccaucuaaccacucggaacggggaaccccacaugaucgucgggauucaggaaaaggggaaguccuuacucuuuaagaccgaagaugggguuaacaugugcacccucauggcuauggacuugggggagcugugugaggacacgauuaccuacaaguguccuuugcugcggcaaaacgagccugaagacaucgauugcuggugcaauagcaccagcaccugggugaccuaugggacaugcaccaccaccggggagcaccgccgggagaagcgcagcguugcucuggugccccaugugggaaugggccucgaaacgcggaccgagacauggauguccagcgagggugcauggaagcaugcgcagcgaaucgagaccuggauacugcggcauccgggguucacuauaauggcagcaauccuggcauacaccaucggcaccacccacuuucagcgcguccucaucuuuauccuucugacggccguggcacccuccaugacuaugcguuguaucggcaucucaaaccgcgacuucguggagggcgucuccgggggcagcuggguggauaucgugcuggagcacgggaguuguguuaccacgauggcuaagaacaagcccacucuggacuucgagcugaucaagacugaggccaagcagcccgcuacccuccgaaaauacugcauugaggccaaguugacuaauacgaccaccgagagccgcugucccacccaaggcgagcccagucugaaggaggaacaggacaaacgguucgucuguaagcacagcaugguggaccgcggcugggggaauggcugcggacuguucggcaagggagggaucgugacgugcgccauguucacgugcaagaaaaauauggaaggcaagaucgugcagcccgagaaccuugaguacaccauagugguuacgccccacuccggggaggagcacgccguagggaaugacacggggaagcacggccaggaaaucaaggugacgccgcaauccuccauuaccgaggcggagcugaccggguauggcaccgucacgauggaaugcagcccccggaccggccuagacuucaacgaaauggugcuccugcagauggagaacaaagccuggcucguacaucggcagugguuucuggaccugccucuccccuggcugccgggggcggauaagcaggagucuaacuggauucagaaggagacccugguuaccuucaagaacccccacgccaagaagcaggacguaguaguacucggcagccaagagggggccaugcauacagcgcugaccggcgcaaccgaaauacagaugucguccgggaaccucuuauuuacgggacacuugaagugccggcuacgcauggacaagcuccagcugaagggcaugucguacuccaugugcacgggaaaguucaagguggucaaggaaaucgcugagacccaacacggcaccaucguaauucggguccaauaugagggcgacggcuccccauguaaaguuccauuugagauaauggaccuggagaagcgguacguacucggccggcuaaucacuguaaauccaauagucacggagaaggacucccccgugaauauagaggcagagccgcccuuuggggauagcuacauaaucauuggcguggagccggggcaacuuaagcucaacugguucaagaagggauccagcaucgggcagauguuugagaccacuaugcgcggcgcgaagcggauggccauccugggcgacacggcuugggacuucgggucccugggcggugucuucacgaguauuggaaaagcccuccaccaaguauucggggcuaucuauggggcggccuucuccggcgugagcuggaccaugaaaaucuugaucggggucauaauuacauggauaggcaugaacagucgcucgaccucccugagcgugagucuaguacucgucgguaucgugacccuguaccugggcgucaugguccaggcugacagugggugcguggugaguuggaaaaacaaggagcucaaaugcggaucggggaucuucauaaccgauaacguccauaccuggaccgagcaauacaaauuccagccugagucucccucgaaacuugccuccgcgauccaaaaggcgcaggaagaagggacgugcggcauccguuccgugacaagacuggagaaccucauguggaagcagaucacccccgagcugaaccacauacuggccgagaacgaggugaagcucacgauaaugacgggggacaucaaggggaucaugcaggccgggaagcguagccugcggccgcagcccaccgaacugaaguacuccuggaagaccuggggcaaggccaagauguuaucgacugaguccuacaaccaaacguuccucaucgauggcccagaaaccgcggagugcccaaauacgaaccgagcguggaauagccuggaagucgaggacuacggguucggaguguucaccacgaacaucuggcuuaagcugaaggagaagcaggaugccuuuugcgacagcaaacugaugagcgccgcaaucaaggacaaucgggcggugcacgccgacaugggauauuggaucgaaucugcccucaacgauaccuggaagauagaaaaggcgagcuucaucgaggucaagaacugccacuggcccaagucccauacuuuauggagcaacggcgugcuggagagcgaaaugaucauccccaagaaucuagccggccccguuagccaacauaacuaccgccccggguaucacacccagaucgcgggccccuggcaccuuggcaagcuggaaauggacuucgauuucugcgacggcaccacggucaucguuacagaggacugcggaaaucgaggacccucccuacgaaccaccaccgccucgggcaaacucaucaccgaguggugcugccggucgugcacgcugccgccgcuccgauaccgcggggaggacggcugcugguacgggauggagauccgcccucugaaggagaaggaggagaaccuagugaacucccucgucaccgcugggcacggccaagucgacaacuucagccucggcgugcugggcauggcucucuuccuggaggaaaugcucaagacacgggucgggacaaaacacgcgauccuacucguggccguuuccuucgugacacugaucacggggaacaugagcuucaaggaucucgggcgugucguagucauggucggggccacgauggccgaugacaucgggaugggcgugacauaccuggccuuacucgcggccuuuaagguccgaccuacguuugccgccggucuccugcuccgcaagcugaccuccaaagaacugaugaugacaacuauugggaucgugcuacugagccaguccaccauccccgagaccgugcuggagcugaccgacgcccuggcgcucggcaugauggugcuaaagaucgugcggaacauggaaaaguaccaacuggccgucaccauuauggccauccuuugcgugccgaacgccgugauucuccagaaugcauggaaggugagcuguacgauccuggccgucguaagcguuagcccccugcuccugaccuccagccagcagaaaacggauuggauaccccuggcgcugaccaucaagggguugaaucccaccgccaucuuccugaccacgcuuucccgcaccaauaagaagagaagcuggccgcugaacgaggccaucauggcgguuggcaugguguccauccuagccagcucgcuacugaagaacgauauucccaugaccggccccuuagucgcaggcgggcuccugaccguuugcuacguucugacggggcggagcgcagaccucgagcuggagagggccaccgacgucaagugggaagaccaagcggagauauccgggagcucgccuaucuuguccaucaccauaagcgaggacggcuccauguccaucaagaacgaggaagaggaacagaccuugacgauccugauccggaccggccugcucgugaucuccgggcuguucccgaucagcauccccauuaccgccgccgccugguaccugugggaggugaagaagcagcgagccggaguccuaugggaugugcccagcccgccgccuaugggcaaggcggaauuggaagacggggccuaccggauuaaacaaaaggggauccugggguacagccagaucggcgccggcguguacaaagaagggaccuuccauaccauguggcacgucacgcggggagccguguuaaugcacaagggaaagcggaucgagcccuccugggccgacgugaagaaagaucuaaucagcuacgguggggguuggaaguuagagggcgaguggaaggagggagaggagguacaagucuuagcucucgagccuggcaaaaacccgcgugcagugcagacgaagcccgggcuguuuaagaccaacaccggcacgauaggagccgucucccucgacuucagccccgggaccuccgggagccccauuaucgacaaaaaggggaagguggugggccuguacgggaacggcguagugacccgguccggcgccuacguaagugcuaucgcgcagaccgagaaaagcaucgaagacaauccagagaucgaggacgacauauucagaaagcgccgacugacaauaauggaccugcacccgggggcaggcaagaccaaacgguaucuccccgccaucguucgugaggccaucaagagaggacugcggacccucaucuuagcacccacuaggguuguggccgccgagauggaggaagcucugcgaggcuugcccauccgauaccagacgcccgccauccgcgcggagcacaccgggcgugagaucgucgaccucaugugccacgcaacguucaccaugcgccugcugagcccaguucgagugccgaacuacaaucucaucauaauggacgaggcgcacuucacggacccggcuucgaucgccgcgcggggauacaucaguacccgagucgagaugggcgaggcagccgggaucuucaugacggccaccccgcccgguucgcgggacccauucccacaguccaacgcuccgaucaucgacgaggaacgggagauuccagagcgcagcuggaacuccgggcacgagugggugacugacuuuaagggcaaaaccgucugguucguaccgagcaucaaggcggggaacgacauagccgcuugucugcgcaaaaacggcaagaaaguaauucaauuaucccggaaaaccuuugacagcgaguaugugaaaacucggacgaacgacugggauuucgucguaacuaccgacaucuccgagaugggcgcgaacuuuaaggcugagcgggugaucgacccccgacguugcaugaaacccgucauacucaccgacggggaggagcgcgugauccuggccggccccaugccgguaacgcacagcuccgcugcucagcgacgcgggcguaucggccgcaaucccaagaaugagaaugaucaauacaucuacaugggggaaccccuggagaacgacgaggacugcgcccacuggaaggaggcuaagaugcuccuugacaacaucaauacccccgagggcaucauccccagcauguucgagccugagcgggagaaagucgacgcgaucgauggagaguaccgcuuacgcggcgaggcucgcaagaccuuuguagaccugaugcgccggggcgaccugcccguguggcuggccuacaaggucgcugcagaggggauuaacuacgccgaucgucgcuggugcuuugacggcaucaagaacaaccaaauccucgaggagaauguggagguugagaucuggaccaaggagggggagagaaagaaacuuaaaccucgguggcuggacgcacgcaucuacucugauccccucgcccugaaggaauuuaaggaguucgcggcgggcagaaagucgcuuacacucaaucugaucaccgaaaugggccgcuugcccaccuuuaugacgcagaagacgcgggaugcccuagacaaucuggccguccugcauaccgccgaggcuggcgggcgcgccuauaaucaugcacucuccgagcuucccgagacucuggaaacccuccuacuacucacgcuacuggccacugugaccggcggaaucuucuuguuccugaugagcggaaaaggcaucggcaagaugacccuggguaugugcugcaucauuaccgccuccauccuccugugguacgcgcagauccagccucacuggaucgccgccuccaucaucuuggaguucuuucucauaguccugcuaauccccgagccggagaagcagcgaacgccccaggacaaccagcugaccuauguggugaucgccauccugacggucguggccgcgaccauggcaaacgagaugggcuucuuggagaagacgaagaaggacuuggggcugggcucgauugccacccagcagccggagagcaacauccuagacauagaccuccgccccgcuuccgcuuggacccucuacgccguggccacaaccuuugucacuccuauguuacggcacagcaucgaaaacucaagugugaacgugucacuuacagccaucgccaaccaggcuaccguccugaugggcuuggggaagggcuggccccucagcaaaauggacaucggggugccgcugcuggcgauuggcugcuacucucaggucaaccccaucacgcuaacagccgcgcugcugcuccuggucgcccauuacgcgaucauugggcccggauuacaagcaaaggccacacgcgaggcccagaagcgggccgcagccggcaucaugaaaaaccccaccgucgacgggaucacggugaucgaccucgacccgauccccuacgaccccaaguucgagaagcagcugggucaagucaugcugcugauccugugugugacccaggugcugaugaugcgcaccacaugggcccucugcgaggccuugacucuggccacagggcccauuucgacccuaugggagggcaacccggggcgguucuggaacaccacgaucgcuguaagcauggccaacauauuccgcggcuccuacuuagccggcgccggacuacuuuucagcauaaugaaaaauaccacaaauacacggcgcggcacggggaacaugggcgagacccugggcgagaaguggaagaguagacugaacgcccucggcaagucagaguuccagaucuauaagaagucggggauucaggaaguggaccggacacuggcaaaggagggaaucaaacgcggcgagacggaccaccacgccgugagccgggguuccgccaagcugcgcugguuugucgagcggaacauggucacgcccgagggaaagguggucgacuuaggcugugggcgcggcggauggagcuacuacugcggcggucugaagaacgugcgggagguaaaaggccugacaaagggcgggcccggccacgaggagcccaucccgauguccacauacggguggaaucucguccgucugcaaucuggcgucgacguguucuuuauaccgccggagaagugcgacaccuuauugugcgacauaggggaguccagccccaacccgacgguagaggccggccguacccugcgcgugcugaauuuaguggagaacuggcugaacaacaacacacaguucugcaucaaaguccuuaacccuuacaugcccuccgugaucgagaagauggaggcgcugcaacguaaguaugggggugcccucgugcgcaacccgcuaagccggaacagcacucaugagauguauuggguguccaacgccagcgguaacaucguauccagcgugaauaugaucagucguauguugaucaaucgguucacgaugcgccacaagaaggcaacguaugagcccgacgucgaucucgggagcggcacgcguaauauuggcauugagucggagauacccaaccuggacauaauuggcaagcgcaucgagaagauaaagcaagaacacgagaccagcuggcauuacgaucaagaccaccccuacaagaccugggccuaccauggcucguacgagacgaagcagaccggaagcgcguccagcauggugaaugguguaguccggcugcucaccaagccgugggacguucugcccacugucacacagauggccaugacagacaccacccccuucgggcaacagcgcgucuucaaggagaagguggacacgcggacgcaggagccaaaagagggcaccaagaagcugaugaaaauuaccgccgaguggcucuggaaggaguugggcaagaagaagacuccgcgcauguguacacgcgaggaguucacgaggaaggugcgauccaaugccgcgcugggggcgauuuucaccgaugaaaacaaguggaaguccgccagagaggccgucgaagacucccguuucugggaacucguugacaaggagcggaaccugcaccucgaggggaagugcgagacgugcgucuacaacaugaugggaaagagagagaagaagcucggagaguucgggaaggccaagggcucccgagccaucugguacauguggcugggcgcgcgcuuccucgaguucgaggcgcucgguuuccugaaugaggaccacugguucagccgggaaaacagccuguccgggguggaaggggagggccuccauaagcugggguacauccugagagacgugagcaagaaggaaggcggcgccauguacgcggacgauaccgcggggugggacacccggauaacccuggaggaccucaagaaugaggaaauggucacgaaccauauggagggcgagcacaaaaagcucgcagaggccaucuucaagcucaccuaccagaauaaggugguacgaguccagaggcccacgccuagggggacggugauggacaucaucagccggagggaucagcgggguuccggccagguggggacguacggccugaacaccuucacgaauauggaggcccagcuaauccggcagauggaaggggaaggcgucuucaaaaacauacagcaccucaccguuacggaggaaguggccguccaaaacugguuagcgcggguggggagagagagauuaagccgcauggccaucuccggagaugauugcgugguaaagccacucgacgaccgcuucgccaacgcccuaaccgcccugaaugacaugggcaagauccggaaggauauccagcagugggagccuagcaaaggauggaacgacuggacacaggugcccuucuguucucaccauuuccacgagcucaucaugaaagacggccgaauccugguggucccuugccggaaucaggacgagcugaucggucgcgcgcggaucagccagggagccgguuggucucuacgcgagaccgccugccuggggaaaaguuacgcccagauguggucccuuauguacuuccacagacgcgaccuccggcuggccgcgaacgcgauuugcagcgccguaccgucccacugggugccgacgucucgcacaacaugguccauacacgccaagcaugaguggaugaccacugaggacaugcugacggucuggaaccggguguggauccgcgagaaccccuggauggaggacaagacccccguagagucuugggaggagauccccuacuuggggaaacgggaggaccaguggugcgguucccugaucggccuuaccagccgcgcgacgugggcgaagaauauucaggccgccauuaaccagguucgaucccucaucgggaacgaggaauacacggacuacaugccaagcaugaagcgcuuccgacgcgaggaggaggaagccggugugcugugguga

SEQ ID NO: 25427 - RNA, 9876 nt, Artificial Sequence
  derived and/or modified CDS sequence (opt11) from DENV-2__JX966380__SS-prME
acugcgggaaugaucaucaugcuaaucccaacagugauggccuuccaccugacaacgcgcaauggagaaccgcacaugauagucagcaggcaggaaaaaggaaaaagccuguuguucaaaacaaaagacgguacaaacaugugcacucucauggcgauggacuugggcgaacucugcgaagacaccauuacauacaaaugcccauuccuaaaacagaacgaacccgaagacauugacugcuggugcaacaguaccuccaccuggguuacauacggcacgugcacaacaaccggugaacaccgacgcgaaaaacgaucaguggcgcucguuccacacguaggcauggggcuggaaacccgcacggaaacguggaugagcuccgaaggcgcuuggaaacacgcccaacgaauagaaaccuggauacuucgccacccaggcuuuacuauaauggccgcaauacuggcuuacaccaucggaacgacccauuuccaacggguucuuauauuuauauuauuaaccgccaucgccccgucgaugaccaugcggugcauuggcaucagcaaccgcgauuucgucgaggggguaucgggcggaucaugggucgacauaguccucgagcauggaaguugcgugacgacgauggcgaaaaacaaaccgacucucgacuucgaauuaaucaaaacagaagcuaaacaacccgcgaccuuacgaaaauauugcauagaggcgaaacugaccaacacaaccacugacucccgaugcccuacgcaaggcgaacccacacuaaacgaggaacaagacaaacgauuuguaugcaaacacucgauggucgacaggggcuggggaaauggcuguggacuguuuggcaaaggcggaauaguuaccugcgcuauguucaccuguaagaaaaauauggaaggcaagaucguucaaccggagaaucuugaauacacaguggucaucacuccccacucgggagaagaacacgcaguggggaacgacacaggcaagcacgggaaagaagugaagaucacaccacagagcucgaucaccgaagccgaacucacuggauacggcacagucacuauggaaugcaguccacggacagggcuagauuuuaaugagauggugcugcugcaaaugaaagauaaagcguggcucguccaccgccaaugguuccucgaccuaccccuaccauggcugccaggggcagauacucaaggaucaaauuggauucagaaagaaacucuagucacauuuaaaaauccacaugcaaagaagcaagacguagugguauuggguucucaggaaggcgcuaugcacacagcacugacgggugcuacggaaauccaaaugagcucaggaaaccuacucuucacgggccauuugaagugccgcuugcguauggacaagcuccagcugaaaggaaugucguacucaaugugcaccggaaaguucaaaaucgugaaagaaaucgcagaaacgcagcacggaacaauaguaauaagagugcaguaugaaggagacggcucgccgugcaaaauacccuucgagaucauggaccuugaaaagagacacguacucgggcgucuaauaaccguaaauccgaucgugaccgagaaggacagccccgucaauauugaagcugaaccacccuucggagacaguuacauuauaaucgguguggagccgggucagcuaaaguuggacugguucaaaaagggaagcaguaucgggcaaauguucgagacaacaaugcgaggagccaaaagaauggcaauacuaggagacacggcgugggauuucggaagucuagguggcguguuuacuuccaucgggaaagcccuccaucagguguuuggagcuauauauggagccgcauuuagcggaguuucauggacgaugaagauccucaucggagucauaaucacguggauugggaugaacagccguagcaccagccucagcguaucgcuggugcuggucgggaucguaacacucuaucucggcguaaugguucaagcagacagcgggugugucgugucauggaagaacaaagaacucaaguguggcucuggcauuuucgucaccgacaacguccacacauggaccgagcaguacaaauuccaaccagaaagcccgagcaagcuagcauccgcaauccaaaaggcacaugaggaggggaucuguggaauacgaaguguaacacgccucgagaacuuaauguggaagcagauaaccagcgaguugaaccauauccuaucagaaaaugaagugaagcucacaaucaugaccggagacauuaagggcauaaugcagguagguaaacguagccuacgaccacagccgacagaacuacguuacucuuggaagacaugggggaaggccaagacuuuauccacagaguugcauaaucaaacguuccuaauagacggcccggagaccgccgaauguccaaacacaaacagagccuggaauagccuugaaguagaagauuacggauucggaguauucacaacaaauaucuggcuccgccuccgggagaaacaagacguguucugcgacagcaaacugaugagcgcggccauaaaggacaaucgagcaguccacgcagacaugggguacuggauagaaagcgcgcucaaugacacauggaaaaucgaaaaggcauccuuuaucgaagugaaguccugccacuggccaaaaucacacacuuuguggucaaacgguguccuagagucagaaauggugauacccaagaauuucgcuggcccggucucccaacacaauaaccggccagguuaucacacgcagacagccggacccuggcaccuaggcaaacucgaaauggacuucgacuucugcgaagggacaacgguuguaguuaccgaggacugcggcaaccggggaccauccuuacguaccacaaccgccuccgguaaacugaucacagaguggugcuguagaucgugcacgcuaccgccacucagguaucgcggcgaagaugggugcugguacgggauggagauccggccccucaaagaaaaggaggagaauuugguaucgagccuaguaacggcaggccacggacagauagacaacuuuucucuggguauacucggcauggcccucuuucucgaggagaugcuccggacuagggugggcaccaaacacgcaauccugcucguggccguaucauucgugacccuaaucacgggcaacauguccuuucgagaccugggacgagucaugguaauggucggcgccaccaugacggacgacaucgggaugggaguuacauaccucgcccuauuagcagccuuuaagguaaggccgacguucaccgcaggacuacuauuacggaaauugacaagcaaggaauuaaugaugacaaccauaggcauaguccugcugagccaaucaagcauacccgaaacgauacucgaacuaacagacgcgcuagcacuagggaugaugguacucaagaugguccguaauauggagaaauaccagcucgcaguuacaaucauggcaauucuaugcguuccuaaugccguaauacuacagaacgcuuggaaagugagcugcacgauccucgcgguaguaucgguaaguccccugcugcuuacaagcucacaacagaaggcggacuggaucccccucgcccugacgauaaaaggacugaaccccacagccauuuuccugacgacgcuuucucgcacaagcaagaaacggucauggcccuuaaacgaggccaucauggcggugggcaugguaucgauacuagcguccucacucuuaaagaaugacauaccaaugaccggcccgcucguagcagggggacuccucaccguauguuacguucugaccggccgcucugccgaucuagagcucgaaagagcaacggacgucaaaugggacgaccaagccgagaucuccggaagcucaccgauccucagcauaaccauaagcgaagaugguucgaugagcaucaaaaaugaagaggaggaacagacgcucacuauccuaauccggaccggccuccuaguuaucucgggccucuuccccgucucgauaccaauaaccgccgccgcaugguaucucugggaagucaagaaacaacgugcaggcguacugugggacgugccaucaccaccaccggucggcaaagcggagcuagaagauggggccuaccgcaucaagcaaaaaggaauacuaggguacucacagauuggggccggcgucuacaaggaaggaacauuucacaccauguggcacguaaccaggggcgcuguccuuaugcacaaagggaagagaaucgaaccaagcugggcugacguuaagaaagaccucauauccuacggcgguggauggaagcuagagggagaauggaaggagggcgaggaaguacaagugcuggcgcuagagccaggcaaaaacccgcgagcgguucaaacgaaacccggacuauuucggaccaacacaggaacaauuggugcgguuaguuuggacuucagcccgggcacgagugggucaccuauugucgacaagaaagggaaaguggucgggcuauacgggaauggcguugucaccagaucaggugccuauguaucggcaauagcucaaacagagaaaucaauagaggacaauccagaaaucgaagacgacaucuuccgaaaacgacgccugacuaucauggaccugcauccaggagcaggaaaaacaaaaagauaccuaccagcgauugugagagaggcgauaaagcgaggcuuacgaacccucauccuagccccuacccgcgucguugcagcugaaauggaggaagcccugcggggacucccaauccgcuaucagacgcccgcaaucagagcagaacacacggggcgagaaauuguagaucucaugugccacgcgacguucacaaugcgacuccucagcccuauucgaguacccaacuacaacuugaucaucauggaugaagcgcacuuuaccgaccccgccagcauugcggcacgaggauacauaucuacacgaguagaaaugggagaagcggcagggauuuuuaugaccgccaccccucccggaagccgagaccccuucccccagagcaacgcaccgaucauggacgaagagagggagauucccgagcgcagcuggaacuccggccacgaaugggucaccgacuuuaaaggcaagacggugugguucguaccuucgauaaagaccgguaacgacauagcagcaugccugaggaaaaacggaaaaagagucauacagcuuagccgaaaaacauucgacuccgaguacguaaaaacgagaaccaacgacugggacuucguugugaccacagauaucuccgagaugggggcgaacuucaaggcggaacgcguaauugacccaagacguugcaugaaacccguuauacuaacagacggagaagaacgcguaauccuagccggucccaugcccguaacgcacagcucggccgcgcaaaggagaggcagaaucgguaggaacccccguaacgaaaacgaccaauauaucuacaugggugaaccccucgaaaacgacgaggacugcgcccacuggaaggaagcuaaaauguuguuggacaacauaaauaccccagaagguaucauuccgaguauguuugaaccagagcgcgaaaaaguggaugccauagacggagaauacagacuaagaggggaagcaaggaagacguucguagaccuaaugagacgaggggaccugccaguguggcuugcguacaaaguugcugccgaaggcauaaauuacgccgaccgacgaugguguuuugacggaacaagaaacaaccaaauacuggaagaaaacgucgaagucgaaauauggacaaaggagggagagcgaaagaaauuaaaaccaagauggcucgacgcccggauauauagugacccacuagccuugaaagaguuuaaagaguucgcagcggggcgaaaaucgcuaacgcugaaccuuauuaccgaaaugggaaggcuacccacauucaugacgcagaaagcacgggaugcguuagacaacuuggcaguacuccauacggccgaagcuggaggcaaggccuacaaccaugcccuguccgaacuacccgagacccuugaaacacuacuccuguuaacacuccuggccacggucacugguggaauuuuccuuuuucuaaugagcgguaggggcauaggcaagaugacgcuuggaaugugcugcaucauaacagccagcauccuccuaugguacgcccagauacaaccucacuggauugcggcuagcaucauucucgaguucuuucucauaguccuccucauccccgagccggaaaagcaacgcacgccacaagauaaccaguuaacauacgucaucaucgcgauacucaccguuguagcggcaaccauggcgaacgaaaugggcuuccuggagaaaacaaagaaagaucucggacucggcaacaucgccacccaacaacccgagagcaacauccuggauauagaccuucgaccagcauccgcuuggacuuuguacgcaguggcgaccaccuucauaaccccgauguugcggcauucaauagaaaacucaucgguuaacguaucguuaaccgcaaucgcaaaucaggccacaguacucaugggucucggaaaaggcuggccgcugagcaaaauggacauaggggucccccuccuggcuaucgguugcuauucgcaagugaaccccaucaccuuaacggcagcacuccuacuccuaguagcacacuacgcaauaauuggaccgggacuccaggccaaagccacccgugaagcgcagaaaagagcagccgcagguaucaugaaaaacccgaccgucgacgguauaaccgugauugacuuagacccgaucccuuacgauccaaaguucgaaaaacaacucggccaagucaugcuauuaguccucugugugacacaaguauuaaugaugcgcacaacgugggcccugugcgaggccuuaacgcuagcaaccgggccggucuccacacucugggagggcaacccgggacguuucuggaacaccacaaucgccgugaguauggcuaauaucuuccgaggaucauaccuagcgggagccggacuccuauucaguaucaugaaaaacacaaccucgacgcgacggggcacaggaaauauaggagagacauuaggagaaaaguggaagucaagacuaaaugcacucgggaaaagcgaguuccaaauauacaagaaaucuggcauacaagaggucgaucgcacccuagccaaagaaggaauaaaacgaggggaaacagaucaccacgccgucucccgggggagcgcgaaacuccggugguucguagagcgaaaucuaguaacgccggaagggaaaguagucgaccugggcugcggaagaggggguuggagcuauuacugugguggacucaaaaacguaagggaagucaaagggcucaccaagggaggcccgggacacgaagaaccaauaccuaugucaacguauggauggaaccuggucaggcuucaaucgggcguagaugucuucuucgugcccccagaaaaaugugacacucugcuuugcgauauuggugagaguaguccgaaccccaccguagaagcuggacggacccuacgcguccugaaccuagucgaaaauuggcucaacaacaacacgcaauucugcguaaagguccucaacccuuauaugccaagcgucauagaacggauggagacccuccaaagaaaauacggcggcgcgcugguacggaauccucucuccagaaauaguacgcaugaaauguacugggucuccaacgcaaguggcaacaucgucucuuccguaaacaugaucucucgcauguuaauaaacagauucaccaugcgccacaagaaagcgacguaugaaccagacguagaccucggcucagggaccagaaacauaggaaucgaauccgaaaccccgaaccucgacauuaucggcaaaagaaucgaaaagauaaaacaagaacacgaaacuagcuggcacuacgaccaggaucacccuuacaagacgugggcguaccauggaucauaugaaaccaaacagacgggcucagccucaagcaugguuaacggcgucguccgccuacuuacgaagccaugggacguagugccaauggugacacaaauggccaugacggauaccacaccguucggucaacagagaguauuuaaagagaaggucgacaccagaacucaggagcccaaggagggcaccaagaaacuaaugaaaaucacggcugaguggcuguggaaagaauuagggaagaagaaaaccccuagaaugugcacccgggaagaauuuacaaagaaggugcgaagcaacgcggcacuuggggcuaucuucacugacgaaaacaaauggaaaagcgcgcgggaagcaguagaagauaguagauucugggagcuaguggauaaagagcgcaaccuacaucuggagggaaaaugugaaaccugcgucuacaacaugaugggcaagcgagagaagaaacugggugaguucgggaaggccaaggggagccgagccauaugguauauguggcuaggggcaagauuccucgaguucgaggcccucggauucuuaaacgaggaucauugguucagcagggaaaauucgcuuuccggaguagaaggagaaggacuacacaaguuaggcuauauacuacgggaggucagcaagaaagaagggggcgcgauguacgcggacgacacugcgggaugggacacgcgaauaacaauugaagaccucaaaaacgaagaaaugauaacuaaucacauggcaggcgaacacaaaaaguuggcagaagccauauuuaagcucacauaccaaaacaagguagugcgggugcaacgcccgacaccaaggggcacagugauggauaucauuucgagaagggaucaacgagggagcgggcaggucgggaccuacggucugaacacauuuacaaacauggaagcgcaacucauacgucaaauggagggagagggaauauucaaaaauauacaacaccugacggcuucggaagagaucgcaguacaagauuggcuagucagaguaggcagagaaaggcucucacgcauggcgaucagcggcgacgacugcgucgucaaaccccuggacgacagguucgcacgcgcgcucaccgcccucaacgacauggggaaaguucgaaaagauauccagcagugggaaccgucgagagguuggaacgacuggacucagguccccuuuugcucgcaccacuuucaugaacuaauaaugaaagacgguaggaccuuggugguacccugccgcaaucaagacgaguuaaucggccgcgccagaauaucacagggggcgggaugguccuuaagagagacagccugccuaggaaaaaguuacgcgcagauguggagcuuaauguacuuccacaggcgugaccuacggcucgcagcuaacgcgauaugcucugcgguaccaagccacugggugccaacuucccggacaacguggucgauacacgcuucacacgaguggaugacaacagaagacaugcucaccgucuggaacaaaguguggauacuggagaaccccuggauggaagacaaaacaccgguagaaagcugggaggagaucccuuaccuggggaagcgugaagaccagugguguggaucgcuaauuggccucaccucgagggcaacaugggccaaaaauauccagacagcaauaaaccaaguucgaucgcugauagggaacgaggaauauaccgacuacaugccaucuaugaagcgguucagacgcgaggaagaggaggcaggagugcucugguaa

SEQ ID NO: 25428 - RNA, 9876 nt, Artificial Sequence
  derived and/or modified CDS sequence (opt11) from DENV-2__JX966379__SS-prME
acagcugguaugaucaucaugcuuauccccaccguuauggcguuccaccuaacaaccagaaacggcgaaccgcacaugauaguaagcaggcaggagaagggcaagagccugcuguucaagaccaaggaugguaccaacaugugcacccucauggcgauggaucuuggcgagcugugcgaggacacgaucacguacaaaugcccuuucuuaaagcagaacgagcccgaggacaucgacugcuggugcaauagcaccuccacuugggugaccuaugguaccugcaccacaaccggcgagcaccggcggggcaagcggagcguagcccuggucccgcacguagggaugggccuggagacccggacagagacguggauguccuccgagggggccuggaagcacgcccagcgcaucgagaccuggauucuccggcaccccggcuucaccaucauggccgcgauccuggcguacaccauagguaccacacacuuccagcgggugcugaucuucauacuacugacggccaucgcccccaguaugaccaugcggugcauaggcaucuccaaccgcgauuucguggaagguguuuccggcggcucauggguggacaucguccuggagcacgggucuugcgugacgaccauggcgaaaaacaaaccuacacucgacuucgagcugaucaagacggaggccaagcagcccgccucccugcguaaguacuguaucgaggcuaagcucacuaacaccaccaccgacagucgcugcccgacgcaaggcgaacccacccugaacgaggagcaagacaagagauucguguguaagcacagcauggucgaccgcggcuggggaaacgggugcggacuguucggaaagggcgggaucgugaccugugccauguucacgugcaagaagaacauggagggcaagauuguacagcccgagaaccucgaguacacggucguuaucaccccccacuccggagaggaacacgcggucgggaacgauacagggaagcauggcaaggagguuaagaucaccccucagagcuccaucaccgaggccgagcugaccggguacggcaccgugacuauggaauguucaccccguaccggccuggacuucaacgagaugguucuccugcaaauggaggacaaggccuggcugguccaccgccagugguuccucgaccugccccugccguggcucccaggggccgacacgcaaggcuccaacuggauccagaaggagacacugguaacauucaagaacccccacgccaaaaagcaggacgucguagugcuagggagccaggagggcgcuaugcacaccgcccucacgggggccaccgagauccaaaugagcucgggcaacuugcuguucacgggccaccucaagugccgccugcgcauggacaagcugcagcucaagggaaugaguuacuccaugugcaccggcaaguucaagaucguuaaggagauugcagaaacgcagcacgggaccauagugauccgggugcaguacgagggcgauggcagccccugcaagaucccauucgagaucauggaccuggagaagcgccacguccuggggagacucaucacggugaacccgaucgugaccgagaaggacucucccguaaauaucgaggccgagccacccuucggcgacagcuacaucauaauagggguggagccgggacagcugaagcuggacugguucaagaaagggaguagcauuggccagauguucgagacgacgaugcggggagcgaagcgcauggccauacucggggacaccgccugggacuucggcucucucggugggguguuuaccagcaucgggaaggcccugcaccaggucuucggugccaucuacggcgcagccuucuccggggugagcuggacgaugaagauacucaucggcgucaucaucaccuggaucgggaugaauucccggagcaccucccugucgguaucccuggugcucgugggcaucgucacccucuaccugggugugaugguacaggccgauagcggcugcgucguguccuggaagaacaaggaguuaaaaugcggcuccgggauuuucgugacggacaacguccauaccuggaccgagcaguauaaguuucagccggagucacccuccaaacucgcuucagcgauccagaaagcccacgaggagggcaucugugggauccgcuccgugacccggcuggagaaucugauguggaaacagaucacgcccgagcucaaucacauccugucagagaacgaggugaagcugaccaucaugacaggcgauaucaaggggauaaugcaagucggcaagcgcucccuccggccgcagccgaccgagcugcgcuacagcuggaagacgugggguaaggccaagauguuguccacugaguugcacaaccagaccuuccuuaucgacgggcccgagaccgcugagugcccgaacaccaaccgugccuggaauagcuuggagguggaggacuacgguuucgggguauucaccaccaacaucuggcuccgacuucgggagaagcaggacgucuucugcgacuccaaacucaugagcgcggcaaucaaggacaaccgcgccgugcacgccgacaugggcuacuggaucgaauccgcucugaacgacaccuggaaaaucgaaaaagcgagcuucaucgaaguaaaguccugccacuggccuaagucucacacgcugugguccaacggcguauuagagagcgagaugguuauccccaagaacuacgcggggcccgucucccagcacaacaaccggccgggauaccacacccaaacggcggggcccuggcaccuuggcaagcuggagauggacuucgacuucugcgaggggaccaccguuguggugacggaggaaugcggaaaccgcggacccagcuuacggaccaccaccgcaagcgggaaacugaucacugaguggugcugccgcuccugcacccugcccccgcugcgguacaggggcgaggacggguguugguacggcauggaaauccggccucucaaggaaaaggaggagaaccuggucaguucacuggugacagccgggcacggccagaucgacaacuucagccucgggaucuuagggauggcgcucuuucucgaagagaugcugcgcuccagaguggguaccaagcacgccauccugcucgucgcagugucguuugugacgcugaucaccggaaacauguccuuuagggacuugggcagagucauggugauggugggggccaccaugaccgacgacaucgguaugggcguuaccuacuuagcccugcuggccgccuacaaggugcggcccaccuucgccgccgggcucuugcugcggaagcucaccucuaaggagcugaugaugaccacaaucgguauugugcugcucagccagagcaguaucccugagacaauccuggagcugacagacgcgcuggcuuuagggaugaugguccugaagauggugcggaauauggagaaguaccagcuugccgugaccaucauggcgauccucuguguacccaacgccgugauccuccagaaugcguggaaagucagcugcacuacccucgccguagugagcgucagcccgcugcugcuuaccucgucgcagcagaaggccgacuggauccccuuagcccucacgaucaagggcuugaacccgacggccaucuuccugaccacccugucgcgcacuagcaagaagcggucauggccacucaaugaggccaucauggccgugggcauggugagcauccuggcaagcucgcuucugaagaacgacauaccgaugacagggccgcucgucgccgguggacugcugaccgugugcuacguguugaccggccgcagugcugaccuggagcucgaacgggccaccgacguaaagugggacgaucaagcggagaucuccgguagcucccccauccugucuauaacuauauccgaggacggcagcauguccaucaagaacgaggaggaagagcagacccugaccauccugauccgcacaggauuacuaguuauaagcgggcuuuucccugucuccacccccaucacggccgccgcgugguaccugugggaagucaagaagcaacgagccggagugcugugggacguacccucuccaccgccagucgggaaggccgagcucgaggacggcgcguaccgcaucaagcagaaaggaauccugggcuauagucaaaucggcgccgggguguacaaggaagguaccuuccacaccauguggcacgugacucgcggggccguccugaugcauaagggcaagcgcaucgagcccuccugggccgacguaaagaaggaccucaucucguacgggggcggauggaagcuggagggggaguggaaggagggcgaggaagugcagguccuggcccucgagcccgggaagaacccccgggccguccagacgaaaccgggccuauuccgcacuaacacuggaaccauuggcgcggugagccucgacuucucgcccggcacgagcgggucuccuaucgucgacaagaagggcaaggugguaggacucuacgguaacggaguggugacccggagcggggcguacguuagcgcgauugcccagacugagaagucaauugaggacaaccccgagaucgaggacgauauauuccguaagcggcgccugacgauaauggaucugcacccuggcgccgggaagacgaagcgguaccugccggcaaucgucagagaagcgaucaaacggggacuccgaacccugauccuggccccgacgcgggugguggcugcugagauggaggaagcgcuccggggguuacccauccgcuaccagacccccgccauccgggcggagcauacgggccgcgagaucgucgaccuaaugugccacgcuaccuucacaaugcgguugcugagccccauacgcgugccgaauuauaaucugauaauuauggaugaagcccauuucacagaccccgcguccaucgcugccagaggcuacaucuccacgcgcguggagaugggggaggccgcugguaucuucaugaccgcgacgccgcccggaucccgugacccguucccgcagagcaacgcacccaucauggacgaggagcgggagaucccugagcgcuccuggaacagcggucacgaaugggucacugacuucaagggaaaaacgguuugguucgugccguccauuaaggccgggaacgacaucgcgacuugucucagaaagaacgggaagcguguuauccaacugagucgcaagaccuucgauuccgaguacguaaagacccggacgaacgauugggacuucguagucaccacugacauaagcgagaugggggcuaacuucaaggcugagagaguaaucgacccccggcgcugcaugaagccugugauucugaccgacggcgaagagcgggucauuuuggccggacccaugccgguaacacacuccuccgccgcccagcggcgcggccggauaggccgcaauccccggaacgaaaacgaccaauauaucuauaugggagagccccuggagaaugacgaagauugugcgcauuggaaggaggccaagaugcuguuggacaacaucaacacuccggagggcaucaucccgucgauguucgagccugagcgcgagaagguugaugcaaucgacggggaguaccggcuacgcggggaggcgcggaaaaccuucgucgaccuuaugcgcaggggggaccuccccguguggcuggccuauaaaguggcgagcgagggcaucaacuacgccgaccgccgguggugcuucgacgggacccgcaacaaccagauccuggaggagaacgucgaaguggagaucuggacgaaggagggcgagcggaagaagcucaagccccgcuggcuggacgcucggaucuacuccgacccuuuggcccucaaggaauuuaaggaguucgccgcgggccgcaagucauugacucuuaaccucaucacagagaugggccggcuccccaccuucaugacacaaaaagcccgagacgcgcuggacaaccucgccguucugcacaccgccgaggcgggugggaaggccuacaaccaugcccuguccgagcucccggagacccuggaaacucugcuccugcuaacccuccuggccaccgugacagggggaaucuucuuguuucucaugagcgggagaggcauagggaagaugaccuuagguaugugcugcauaaucacagcgucuauccucuuaugguacgcucaaauucagccccauuggaucgccgccuccaucauccuggaguuuuuccucaucgugcuccuaaucccagagcccgagaagcagcgcacaccgcaagauaaccaguugaccuaugucaucaucgcgauucucacagugguggcugcaaccauggccaacgagaugggguuccuggagaagacgaagaaggaucuuggcuuaggccacaucgccacgcagcagccggagucuaacauccuggauauugaucugcggcccgccucugcguggacccuauaugcugucgcgaccaccuucaucacccccaugcugcggcauucgaucgaaaacuccucagugaacgugucccugaccgccaucgccaaccaggcgaccguccuaaugggucugggcaagggguggccccugagcaagauggauaucggugugccucuguuagccaucggaugcuacagccaggugaaccccaucacgcugaccgccgcacuccuucugcucguugcucauuacgcgaucaucggucccggguuacaggccaaggccacccgcgaggcgcagaagcgggcggccgccgggaucaugaagaaccccaccguggauggaauuacggugaucgacuuagauccgauccccuacgaccccaaauuugagaagcagcucgggcaggucaugcuccucguguuaugcgucacccaagugcuuaugaugcggacgaccugggcccugugcgaggcccucacgcuggcgaccggccccguaagcacccugugggagggaaacccggggcgguucuggaacaccacgaucgccguguccauggccaacaucuuuaggggcagcuacuuagccggggccggccuucuguuuucaauaaugaagaacacuacaagcacccggagagggacgggcaauaucggcgagaccuuaggggaaaaguggaagucccggcugaacgcacugggcaagagugaguuccagauauacaagaaguccgggauccaggagguggaccgcacgcuggcuaaggagggcauuaaacgcggcgagaccgaccaccacgccgugagccgcgguagcgcuaagcugcggugguucguggaaaggaaccuggucacgcccgaaggcaagguaguggaccucgggugcggccgcggggguuggucauacuacugcgggggucuaaagaacguccgcgaggugaagggcuugaccaagggcggaccugggcacgaggaacccaucccuaugucgaccuacggcuggaacuuagugcggcugcaaucaggggucgacguauucuucgugccccccgagaagugugacacccugcucugcgacaucggcgagucuucccccaauccgaccgucgaggccggccgcacgcugcgggugcugaaucucguggagaacuggcugaacgacaacacucaguucugcgugaaggugcuaaaccccuacaugcccuccgugaucgaacgcauggagacccugcaacggaaguacgggggugcgcucgucaggaauccgcugagucgcaauagcacccacgagauguacuggguguccaacgccagcggaaacguggucucaagcgugaacaugaucucccggaugcuuaucaaccgcuuuacgaugcggcacaagaaggccacuuacgagcccgauguggaccucggcagcgggacccgcaacaucggcauugaguccgaaacacccaaccucgacauuaucgggaagcggauugagaagauuaagcaggagcaugaggccagcuggcacuacgaucaagaccaccccuacaagacgugggcguaucacgguuccuacgaaaccaagcagacuggcagcgccuccucgauggugaacgggguagugaggcugcucaccaagccaugggaugucgugcccauggugacccagauggccaugacagacaccacucccuucgggcagcaacgggucuucaaggagaagguggauacgcgcacccaggagccaaaggagggcaccaagaagcugaugaagaucaccgcagaguggcuuuggaaggaacucgggaaaaagaaaaccccgcggaugugcacucgugaagaguucaccaagaaaguccgguccaacgccgcucugggcgccaucuucaccgacgagaauaaguggaaaagcgcccgggaggccguggaggauaaccgguucugggagcugguggacaaagagaggaaccuucacuuagaagggaagugugagacgugcgucuauaacaugaugggaaagcgggagaagaagcuaggggaguucggcaaggcccgcggcagccgggcgaucugguacauguggcugggggccagauuccuggaguucgaggcauugggguuccucaaugaagaccacugguuuucccgggagaacucucugucuggggucgagggcgaggggcugcacaagcucggcuacauacugcgcgaaguaagcaagaaggagggcggggcuauguaugccgacgacaccgccggcugggacacccggaucaccaucgaggaccugaagaacgaagagaugaucacgaaccacauggccggcgagcacaagaaacucgccgaggccaucuucaagcugaccuaccagaacaaagucguaagaguccagcgccccacaccacggggcacugucauggacauuaucucccgucgggaccagcgcgggaguggccaagugguuacauacggucugaacacuuucaccaacauggaagcgcagcucauacggcagauggagggagagggcaucuuuaaguccauccagcaccuuaccgcuucugaggagaucgccguccaggacuggcuagcccgcguugggcgcgagcgccucucccggauggccauuagcggugacgauugcguggucaagcccuuagaugaccgcuuugcgagggcccugacggcccugaacgacaugggaaaggugcgcaaggacauacagcaaugggagccgucccggggguggaacgacuggacccaggugcccuucugcagccaccacuuccacgagcugaucaugaaggacggacgaacccuggucguacccugcagaaaccaggaugaacucaucggccgcgcccggaucucccagggagccggcuggagccugcgcgagacugccugccugggcaaguccuacgcccaaauguggagccuaauguacuuccacaggcgcgaccuucgccuggccgccaacgcgauauguagcgcggugcccagccacugggucccgaccucccgaaccacaugguccauccacgccucgcacgaguggaugaccacugaggacaugcucacgguuuggaaccgcguguggauccuggagaaccccuggauggaggauaagacccccgucgaguccugggaggagauuccuuacuuaggcaagcgggaggaccaguggugcggcucccucaucggccugaccucacgcgccacgugggccaagaacauccagaccgcgauaaaccaggugcguagccuuaucgggaacgaggaguacacugacuacaugccguccaugaaacgcuuucggcgcgaagaggaggaggcgggcgugcucugguaa

SEQ ID NO: 25429 - RNA, 9876 nt, Artificial Sequence
  derived and/or modified CDS sequence (opt11) from DENV-2__KP012546__SS-prME
accgccggcaucauaauuaugaugauccccacugugauggccuuccaccugaccacccggaauggggagccccacaugauugucagccggcaagagaagggcaaaagccuccuguuuaagaccgagaacggugugaacaugugcacccugauggcgauggaccuaggcgagcugugcgaggauaccaucaccuacaacugcccccuucuccggcagaacgagcccgaggauaucgacugcuggugcaacagcaccagcaccugggugaccuacgggaccugcaccgccaccggcgagcaccggcgggaaaagcggucgguagcccuggugccccacguugguaugggguuagagacgaggacggagaccuggauguccuccgaaggcgccuggaagcacgcccagcggaucgagaccuggguccuccgccaccccggguucacgaucauggcggccauccuagccuacaccauaggcaccacauacuuccaacgggugcugauauucauccuccucacggccguggcgcccucuaugaccaugcgcugcaucgggaucagcaaccgggacuucguggagggcguguccggcgggucuuggguggacaucguccuggagcacggcuccugcgugacgacuauggcaaagaacaagcccacgcucgacuucgagcugaucaagaccgaggcuaagcaccccgccaccuuacguaaauauugcaucgaagcaaagcucacaaauacaaccacagcgagccggugcccgacccagggcgagcccucccugaacgaggaacaggacaagcgcuucgugugcaaacacucuaugguagaccggggcugggguaacggcugcggccuguuugggaagggcgggauugugacgugcgccauguucacuuguaagaagaacauggagggcaagaucgugcagcccgagaaucuagaguacacuauuguaaucaccccccauagcggugaagagaacgccguggggaacgacacggguaagcacgggaaggagauaaaggugaccccgcaaucauccaucacagaggccgaauuaaccggcuacgggacggucacgauggagugcagccccagaaccggccuggauuucaacgagaugguccuccugcagauggagaacaaagccuggcuggugcaccggcagugguuccucgaccugccccugcccuggcuccccggcgcggacacccagggguccaacuggauccagaaggagacccuggucacguucaaaaacccacacgccaagaagcaggacguagucgugcugggcucgcaggagggagccaugcacaccgcccucacuggcgccaccgagauccagaugagcuccgggaaccugcuauucacaggccaccucaagugcaggcugcggauggacaagcuccagcucaagggcaugaguuauucgaugugcaccgggaaauuuaagguggucaaggagaucgcggagacccaacacgggaccaucguaauucgagugcaguacgagggggacggcuccccauguaaaauccccuucgagaucauggaccuggagaagcggcacguccuuggccgccucaucacagugaauccgaucgugaccgaaaaggacucccccgucaacaucgaggccgaaccgcccuucggggacagcuauauuaucaucgguguagagccugggcaacugaagcuguccugguucaagaagggaucguccaucgggcagauguucgagacgaccaugcgcggggccaagagaauggccauccucggugacacggccugggacuucgggagccugggcggaguuuucacgucuaucggcaaggcgcugcaccaggucuucggugccaucuacggagccgcauuuagcggcguguccuggacuaugaagaucuuaaucgggguggucaucacauggaucggaaugaacucacgcaguacgucucuguccgugucccuggugcuggucggggucgugacccucuaccugggagucauggugcaggcugauuccgggugcgugguaagcuggaagaacaaggagcugaagugcggcagcggcauuuucauaaccgacaacgugcauacguggacggagcaguauaaauuccagcccgaguccccgagcaagcuggcuuccgcuauacagaaagcccacgaggaggggauuugcggcauacggagcgugacccgccuggagaacuuaauguggaagcagauuaccccugaguugaaccacauccuuuccgagaacgagguaaagcugaccauaaugacaggggacaucaaagggaucaugcaggcggggaagcggagccuccgcccccagccaacggagcugaaguacuccuggaagacuugggguaaagcgaagaugcuaagcaccgagcuccacaaccacacguucuugaucgauggccccgagaccgccgaaugcccgaacaccaaccgggccuggaacucccuggaaguggaggacuacggguucggcguguucaccacgaauaucuggcuuaagcugaaggagcgucaggacguauucugcgacagcaagcugaugucugccgccaucaaggacaaccgggcggugcaugccgacaugggguacuggaucgagagcgcccucaacgauaccuggaagaucgaaaaagcuucguucaucgaagucaagagcugccacuggcccaagucccacacccuguggagcaacggcgugcuggaauccgagaugaucauucccaagaacuuugccggccccgugagucaacauaacuaucgcccgggguaucacacccaaacugcugggcccuggcaccucgggcgguuggaaauggacuucgacuucugcgaggggaccaccguggucgugaccgaggacugcgggaaccggggccccagccugcggaccacgaccgcgucaggcaaacucaucaccgaguggugcugccgcucuugcacucugcccccguugcgguaucgcggugaggacggcugcugguacgggauggagauccggccacucaaggagaaggaggagaaccuggugaacucccuggucaccgccggccacggucaaaucgacaacuucucacucggcguucugggcauggccuuauuucuugaggagaugcugcgcacccgugucggaacaaagcacgcgauccugcucgucgccgucuccuucgugacccuuaucacgggcaacauguccuuucgcgaccuggggcgcgucauggugauggugggcgccgccaugacggacgacaucgggaugggcguaacauaccucgcccugcuggcggccuucaaagugcggcccaccuucgccgccggccuccugcugcgcaagcucacgucgaaggagcugaugaugaccacaaucgggaucgugcugcucucucaguccaccaugcccgagacgauccuggagcugaccgaugcccuugcucuuggcaugaugguucuuaagaucguucggaauauggagaaguaucagcucgccgucaccaucauggccauccugugugugccgaacgccgugauacuucagaacgccuggaaggucagcugcaccacgcucgccgugguguccgucagcccccugcuacuaaccuccagccagcaaaaggccgacuggauuccccuagcccugacuaucaaggggcucaaccccaccgccaucuuccuaacuacacuguccagaaccagcaaaaagcgguccuggccgcucaacgaggcgaucauggccgugggcauggucagcauccuggccucaucccugcuuaagaacgacauuccgaugacaggcccccuggucgccgggggccuacuaacggugugcuacgugcugaccggucggagcgccgaccuggagcuugagcgggcggcugacguccgcugggaggaacaggccgagaucuccggcaguucccccauccugagcaucaccauauccgaggacgggagcaugucuaucaagaacgaagaggaggagcaaacccugacgauccucauccggacuggucuccuggucauaagcggccucuuucccguguccauacccauaacggcggcugcgugguaccuuugggaggucaagaagcagcgcgccgggguccugugggacgugcccagcccuccacccgucggcaaggcugagcucgaggauggggccuaccggauaaagcagaagggcauccuuggguauucccagaucggagccggcguguacaaggaggggaccuuucacaccauguggcacgugacgcgcggcgcgguccuaaugcacaaggggaagcggauagagcccagcugggccgacguaaagaaggaccucaucuccuauggcgggggguggaagcuggagggcgaguggaaggaaggggaggaggugcagguccuggcucucgaacccgggaaaaacccccgcgccgugcaaaccaagcccggacuuuuuaaaaccaacacuggcacgaucggcgcugucucacuggacuucucccccggcaccaguggcucccccaucgucgacaagaaggggaagguggugggccucuacggaaacggugucgugaccaggagcggcaccuacguguccgcuaucgcccaaacggagaaguccaucgaggacaaccccgagaucgaggaugauaucuuucgcaagaagcggcuuaccaucauggaccuucacccgggggccggcaagaccaagcgauacuuacccgccaucgucagggaggcaauuaagcgcggacugaggacacugauccucgccccgacgcgcgugguugccgccgaaauggaggaggcccuccguggccugcccauccguuaccagacccccgcuauacgcgccgagcacaccgggcgggagaucgucgaccugaugugccacgcaacuuucacgaugcgccuccuguccccuauccggguccccaacuacaaccugaucaucauggacgaagcccauuucaccgaccccgcgucuaucgcggcccgcggauauaucaguacccggguggaaaugggcgaggccgccgggaucuucaugacagccacgccgcccggcucccgcgacccguuuccgcagagcaacgcgccgaucauggaugaggagcgggagauccccgagcguuccuggaacagcgggcacgagugggucaccgacuucaagggcaaaaccgugugguucgugccauccaucaaggccgggaacgauaucgccgccugucuccggaagaauggcaaaaaggucauccagcuuucgcgcaagaccuucgacagugaguacaucaagacgcggaccaacgacugggacuucgucgugaccacagauaucagcgagaugggcgcgaacuucaaggccgagcgggucaucgacccccggcgcugcaugaagccugugauccuaacggauggagaggaacgcgugauccucgccgggcccaugccggucacccacuccuccgccgcccaacgccggggucgcgugggccgcaaccccaaaaacgagaaugaccaguacauauacaugggagagccccuggaaaacgacgaagacugcgcgcauuggaaggaagcuaagauguugcucgacaauaucuccacucccgagggcaucaucccgucgauguucgagcccgagcgggagaaggucgacgcgaucgacggcgaguaccgccugcgcggggaagcccgcaaaacguucgucgacuuaaugcggcgaggcgaccuccccguguggcuugcauauagggucgcggccgaagggaucaacuacgccgauagacggugguguuucgacggcgugaaaaacaaccagauacucgaagagaauguggaggucgagaucuggacgaaggagggggagcgcaagaaacugaagccgcgguggcuggacgcccgcaucuacuccgacccccuggcccucaaggaguuuaaggaguucgcagcgggccgcaagagccugacccugaaccucaucacugagaugggccgccuacccaccuucaugacgcagaaggcgcggaacgcccuggacaaccucgcgguguuacacacugccgaggccggaggacgcgccuacaaccacgcccuuuccgaacucccggagacguuagagacuuuacuccugcuaacgcuccuggcagccgugaccggggggaucuuucuuuuccucaugagcggaaaggggauuggcaaaaugacccucggcaugugcugcauuauaaccgcguccauccugcucugguacgcccagauccagccgcacuggaucgccgcgagcaucauccuggaguucuuucugaucguccuccugaucccagagcccgagaagcagaggacgccccaggauaaccaguugacguacguggugaucgccauccucaccgucguggccgccaccauggcgaacgagaugggcuuccuggagaagacuaagaaggacuucgggcugggcucaaccacgacucagcaaccggaauccaacauccucgacaucgaccugcgcccggcgucggcguggacccuuuacgccguggccacgaccuucaucacgccgaugcuccggcacuccaucgagaacagcuccgucaauguuagccugaccgccaucgcgaaccaggccacgguccugaugggccucgggaagggcuggccccuguccaagauggacaucggagugccgcugcucgccaucggcuguuacagccaggugaaccccaucacccugaccgccgcgcugcugcugcugguggcccacuacgccauaaucgggcccggucuccaggccaaagcaacccgcgaagcgcaaaagcgggccgcugcuggcaucaugaagaaccccacagucgacgggaucaccgugaucgaucuggacccgauccccuacgaccccaaguucgagaagcagcuggggcaggugaugcuucugguccugugcguuacccagguccuuaugaugcguaccacgugggcccugugcgaggcccugaccuuagccaccgggcccaucuccacccucugggagggcaacccggggcgcuucuggaacacgaccaucgccgucagcauggccaacaucuuccggggcagcuaucuggccggcgcugggcucuuauucagcaucaugaagaacaccgcgaacacgcgccgaggaacggguaacaccggggagacccugggcgagaaguggaagaaccgccucaacgcccuggggaaguccgaauuccagauuuacaaaaagucaggcauccaagagguugaccggacccuggccaaggaggguaucaagcgcggcgagacggaccaccaugcgguaucccgggggagcgccaagcuccgcugguucgucgagcggaaccucgucacccccgagggcaaggugguagaucuggggugcgggcgcggcgggugguccuacuacugcggagggcucaaaaacgugaaagagguuaagggucuuaccaagggcggacccggccacgaggagcccauaccgaugucaaccuauggguggaaccugguccgguugcaguccggcguggacgucuucuucacuccccccgaaaagugcgauacguugcuuugcgacaucggggagucaucgccgaaccccaccguugaggccggucgcacgcuccgcgugcugaaccugguggagaacuggcucaacaacaacacccaguucugcaucaagguccugaaucccuacaugcccuccguaaucgagaagauggaggcccugcagcgcaaauauggcggggcccuggugcggaauccgcucucgcgcaacuccacgcacgagauguacugggucagcaaugcaucggggaacaucgugagcuccgugaauaugauaucacgaaugcugaucaaccgcuucaccaugcggcacaagaaggcgacauaugagcccgacgucgaccuggggucaggaacucgcaacaucggcaucgagagcgagacgcccaaccuagauaucaucggaaagcgcaucgagaagaucaaacaggagcacgagaccuccuggcacuacgaucaggaucaccccuacaagaccugggcguaccacggcucuuacgagaccaagcagacggggucugccagcuccauggugaacggcgugguccggcugcugaccaagccgugggacgugauccccauggugacccaaauggccaugaccgauacgacccccuucgggcaacagcgcgucuucaaggaaaaggucgacacccggacccaggaacccaaggagggcacgaagaagcucaugaagaucacugcggaguggcuauggaaggagcuugguaagaaaaagacccccagaauguguaccagagaggaguucacgcgcaagguccggagcaacgccgcccucggggccauauucaccgaugagaacaaauggaagucagcccgcgaggcgguggaggacagcggcuucugggagcugguggacaaagagcggaaccuucauuuggaagggaagugcgagacguguguguacaacaugauggguaaaagagagaagaaacugggggaguucggcaaggccaaaggcucacgggcuaucugguacauguggcugggagcccgcuuucucgaguucgaggcucugggcuuucugaacgaggaucauugguucucgcgggagaauucccucucugggguggagggcgagggacugcacaagcucggcuacauuuugcgcgacguaagcaagaaggaaggcggcgccauguacgccgaugacacugccgggugggacacgcgaaucaccuuagaggacuugaaaaacgaggagauggucaccaaccacauggagggcgagcacaaaaagcucgcggaggcaauauucaagcugaccuaccagaacaaagucgugcgcguacagcggcccacaccccgcggcacugugauggacaucaucucccggcgcgaccagcgggggagcggccagguggucaccuacggccugaacacauucacgaacauggaggcgcagcucauacgucagauggagggggagggcguguucaaguccauccaacagcugaccgugaccgaggagaucgccgucaagaauuggcugguccgcguggggcgagagcgacucagccggauggcuauuuccggcgacgacugcgucgugaagccccuggacgaucgcuucgccagugcgcugaccgcccucaacgacaugggcaaaguucggaaagacauucagcagugggagccgucccgcggguggaaugacuggacacagguccccuucugcagccaccacuuccaugagcuaaucaugaaggacggccgggugcuggugguuccuugccgaaaccaggacgagcucaucgggcgcgcucgcaucucccagggcgccggguggucacugcgggaaacugccugccugggcaaguccuaugcgcagauguggaaccucauguauuuccaccgucgggaccugcgccuggccgccaaugccaucugcagcgccgugcccucccacugggugccuaccucacggacaacauggucaauccaugcgacgcacgaguggaugacgaccgaggacaugcucaccgucuggaaccgcguguggauccaagagaaccccuggauggaggacaagacgcccgucgagagcugggaggagauccccuaccugggcaagcgggaggaccaguggugugggagccugaucggccucaccuccagggccacgugggccaaaaacauccagaccgccaucaaucagguccggucgcuaaucgggaacgaggaguacacggacuacaugccguccaugaagcgauuccgccgggaagaggaggaggcgggagugcuuugguga

SEQ ID NO: 25430 - RNA, 9876 nt, Artificial Sequence
  derived and/or modified CDS sequence (opt11) from DENV-2__KP723478__SS-prME
acggccgggaucaucaucaugaugauccccaccgugauggccuuccaccuaacuacccggaacggggagccccacaugaucgugagucggcaagaaaaaggcaaaagccuccuguucaagacggagaacggugugaacaugugcacccugauggcaauggaccuuggggagcugugugaagacacgaucaccuacaacugcccucugcuccgccagaacgagcccgaggauaucgacugcuggugcaacagcaccagcaccuggguaaccuacgggacaugcaccgccaccggcgagcaccggcgcgaaaagagaagcguagcccuggucccucacguggggauggggcuggagacucggacggagacuuggauguccagcgagggagccuggaagcacgcccagcggauagagacauggguccuccgccaccccggguucaccaucauggcggccauccuggcauacaccauaggcacaaccuacuuccagaggguucugauauucauccuccugacagcgguggcgcccuccaugacaaugcgcugcauagggaucagcaaccgggacuucgucgagggcguguccggugggagcuggguggacaucguccuggagcacggcaguugugugacgaccauggcuaagaacaagccgacgcucgacuucgagcugaucaaaaccgaagcuaagcaccccgcuaccuuacgcaaguacugcaucgaggccaagcuaacuaacacgacgaccgcgagccguugcccgacucagggagagcccucccugaacgaggagcaggacaagagauucguaugcaaacauucgaugguggaccggggcuggggcaacgggugcggccuguuugggaagggugggaucgugacgugcgccauguuuaccugcaagaaaaacauggaaggcaagaucgugcagccagagaaccucgaguacaccaucgucauaacaccccacuccggcgaggaaaaugcuguggggaacgauacgggcaagcaugggaaagagaucaaggugaccccgcaguccuccaucacugaagccgagcugacugguuacgguaccguaaccauggaaugcagccccaggaccggccuggauuucaaugagauggugcuccuacaaauggagaacaaggccuggcuagugcaccggcaaugguuccucgaccugccccugcccuggcucccgggcgcagacacccagggguccaacuggauccaaaaggagacccucgucacguuuaagaacccccacgccaagaaacaggauguggucgugcucggcagccaagagggggccaugcacaccgcccucacuggcgccacggaaauccagaugagcuccgggaaccugcuauucacgggccaccucaagugccgccugcggauggacaaacugcagcuuaagggcauguccuacagcaugugcaccgggaaguucaagguugucaaggagaucgcggagacccagcacggcaccauugugauccgggugcaguaugagggggacggcaguccaugcaagauuccauucgagaucauggauuuggaaaagcggcauguccugggccgccucaucacggugaacccuaucgugaccgagaaggacuccccggucaacauagaggccgagccgcccuucggggacucuuacaucaucauaggggucgagccggggcagcugaagcugaguugguucaaaaaggggagcuccauagggcagauguuugagacgaccaugcgaggcgccaaacggauggccauccucggcgauacggcaugggacuuugggagccugggcggcguauucaccuccaucggcaaggcgcugcaccaggucuucggggcuauauacggcgccgccuucagugguguauccuggaccaugaagauacucaucgggguggucauaaccuggauuggaaugaacagccgcucuacuagccuaucugugagccuggugcuggucggaguugugacacuguaccuggguguuauggugcaagcggacagcggguguguggucagcuggaagaacaaagagcucaagugcggaagcggcaucuuuaucaccgauaacgugcacaccuggacagagcaguacaaauuccagcccgaauccccaagcaaacuagcauccgccauccagaaagcccaugaagaggggaucugcgggauccggagcguuacccgccucgagaaccugauguggaagcagauuacccccgaguuaaaccacauacuguccgagaacgaggucaaacugaccauuaugacgggggacaucaagggcaucaugcaggcggggaagcggagccuccgcccucagcccacggaacuaaaguacuccuggaagacauggggcaaggcgaagaugcuuagcacugagcuccacaaccacacguucuugaucgacgguccagagaccgccgagugcccgaauaccaaucgggccuggaacucucuggagguggaggacuacggguucggcguuuucaccacgaacaucuggcucaagcugaaggaacgucaagacguguucugcgacagcaagcugauguccgccgccaucaaagacaaccgagcggugcacgccgacaugggcuacuggauagaguccgccuuaaaugauaccuggaaaauagagaaggccuccuuuauagaggucaagagcugccacuggcccaaaucccacacacuguggagcaacggcgugcuggaauccgagaugaucauccccaagaacuucgccggccccaugagccagcacaacuaccguccgggcuaccacacccagaccgcugggccauggcaccucggcagacuggagauggacuucgacuuuugugagggcaccaccgugguggugaccgaggacugugggaaccgcggcccgucgcuucggaccacaaccgcauccggcaagcucaucaccgaguggugcugcaggaguugcacgcugcccccgcuacgguaucggggugaggacggaugcugguacgggauggagauccguccgcucaaggagaaggaggagaaucuggugaacucuuuagugacggcgggccacggccagauagacaauuucagccucggcguccuaggcauggcccuguuccucgaggaaaugcugcgcaccaggguggggaccaagcacgccauccugcucguggccgugucauucgugacucuaauaacgggcaauaugagcuucagagaucugggacgcgugaugguuaugguaggcgccgccaugaccgacgauaucgggaugggcgugaccuaccucgcccugcuggcagcauucaaaguccggcccacguucgccgcgggccuccuacugcguaagcuaacguccaaggaacugaugaugacgaccaucggaaucguacugcucagccaguccacaaugcccgagaccauucuggagcugaccgacgccuuggcguugggcaugaugguucugaagauuguccggaauauggagaaguaucaacucgcagugaccauuauggccauacuuugcgugccgaacgccguuauccuacagaaugccuggaaggugagcugcaccacgcuggccgucgucucggucagcccccugcugcucaccuccagccagcagaaggccgauuggaucccccuggcccuuaccauuaaggggcucaacccuaccgccaucuuccuuacgacccugucaagaaccagcaagaagcgcucauggccgcugaacgaggccauaauggcggucgguaugguuagcauccuggccucaucccuacucaaaaacgacauuccgaugaccggccccuugguugccgggggauugcucacggucugcuacguguuaaccggucgcagcgccgaccuugagcucgagcgcgcggcugacgugcgcugggaagaacaggccgaaauuuccggcucguccccgauacugagcaucacuaucuccgaggacggguccauguccaucaagaaugaggaggaggagcagacauuaacgauccucauucgcaccggucugcuugugaucucaggccucuuucccguguccaccccgaucacagcggcggcgugguacuugugggagguuaagaagcagcgcgcaggggucuuaugggacgugcccuccccgccacccguaggaaaggccgaguuggaggauggggccuauagaauuaagcagaagggcauccucggguacucacaaaucggcgccggcgucuauaaggaggggaccuuccacacgauguggcacgugacacgcggcgcgguacugaugcacaaggggaagcggaucgagccaagcugggccgacgugaagaaagaucucaucuccuacggagggggcuggaagcuggagggcgaauggaaggagggggaagagguccaagugcucgcacucgagcccggcaagaacccccgggccguacagaccaagccaggucuguucaagacgaacacuggcaccaucggggccgugagccuggacuucuccccugggaccagcggcucaccgaucguggacaagaaggggaaggucguuggccuuuacgggaacggcguggucacgcggagcggaacguauguguccgcgaucgcccagacggaaaagucuaucgaggacaaucccgagaucgaggacgacauauuccgcaagaagcggcugaccauuauggaccugcaccccggggccgguaagacgaagcgguaccugcccgccaucgugcgggaggcgauuaagcguggucuccggacguuaauccuggccccgaccagggucguggccgccgagauggaagaggcccugcggggacuucccauccgguaccagacucccgcgauccgcgccgagcacacagggcgggagaucguggaccugaugugucacgccacguuuaccaugcgccuccugagcccuauccgggucccgaacuacaaccucaucaucauggacgaggcgcacuucacagaucccgccuccaucgcggcccgcggguacaucagcacccggguggagaugggggaggccgccgguaucuucaugacugcaacgccgcccggcucccgcgaucccuucccccagagcaaugcgcccaucauggaugaggagcgggagauccccgagcgcucguggaauagcgggcacgagugggugacggacuuuaagggcaagacugucugguucgugccguccauaaaggcugggaacgacauagccgccugccucaggaaaaauggcaagaaagugauacagcugagccgcaagacuuucgacuccgaguacaucaagacccggaccaacgauugggacuucgucgugacgacggacaucagcgagaugggcgcgaauuucaaggcugaaagagucauagauccucgccgcugcaugaaacccgucauccugaccgacggagaggagcgcguaauccucgccggccccaugccggugacccacagcucggccgcccagcgucggggucgcguaggacgcaaccccaagaacgagaaugaccaguacauauacaugggggagccucuggagaacgaugaagacugcgcgcacuggaaggaggccaaaaugcugcucgacaacaucucuaccccagagggcaucaucccgagcauguucgagccggagcgggagaagguagacgccaucgacggcgaauaccgccugcgcggggaggcccgcaagacguucguggaccugaugcggcgcggugaccuccccgucuggcuggccuaccgcgucgcugccgaggggaucaacuacgcugaccgccgcuggugcuucgauggcgucaagaacaaccaaauacuagaggagaacguugagguagagauuuggaccaaggagggggagcgcaagaagcucaagccgcgcuggcuggacgcccggaucuacuccgacccccuggcccucaaggaguucaaggaguucgcggccggccgcaaaagucugacacuaaaccucaucaccgagaugggucgccugccaacguuuaugacccagaaggccagaaacgcccuggacaaccucgccguccugcauaccgcggaagccggagggcgcgccuacaaccacgccuuguccgaacucccugaaaccuuggagacuuuauugcuguugacccuacuggcggccgugaccgggggcauuuuucuguuccuuaugagcggcaaggggauuggaaagaugacgcuggggaugugcugcaucaucacugccuccauccuucuuugguaugcccagauccagccgcacuggauugccgcaagcaucauccuggaguucuuucugaucguacuccugauccccgagcccgagaagcagagaacgccccaggacaaccagcugaccuacguugugaucgcgauacucaccgugguggccgcgaccauggcuaacgagauggguuuccucgagaagacuaagaaagacuucggucugggcaguaccacgacucagcaaccggaguccaauauccuggacaucgaucugcgacccgcuagcgccuggacacuguacgccguugccacaaccuucaucacccccaugcuccggcacucgaucgagaacagcuccgugaacgucagccucacggcgaucgcgaaucaagccaccgugcugaugggcuuagggaaggguuggccccuguccaagauggauaucggggugccccuacucgccaucggaugcuacucccaggucaaccccaucacuuuaaccgccgcgcugcuccugcugguggcccacuacgccaucaucgggcccggacuccaggccaaagcgacacgcgaggcgcagaagcgcgccgccgccggaaucaugaagaaccccaccguagacgggaucacugucaucgaccuggacccgauacccuacgaccccaaauucgagaagcagcugggccaggugaugcuucuggugcugugcgucacacagguccucaugaugcgcaccacuugggccuugugcgaggcccuuacccucgcgaccggucccaucuccacgcugugggagggcaaccccgggcgcuucuggaacaccaccauugcagugaguauggccaacaucuuccggggcagcuaucuggccggagcgggacuccuguucagcauaaugaagaacaccgcuaacacgagacggggcaccgggaacaccggggagacccugggcgagaaguggaagaaccgccucaacgcccuggguaaguccgaguuccagaucuacaagaaauccggcauccaagaggucgaucggacccuggccaaggaggguaucaagcgcggcgaaacugaccaccacgcgguuucccgggggagcgccaagcuacgcugguucguggagcguaaccucgucaccccugagggcaaagugguggaccugggcugcgggcgaggcgggugguccuacuacugcggagggcucaaaaaugucaaggaggugaagggccuuaccaagggugggccuggucacgaggagcccaucccuaugagcacguauggguggaaccuggugcgucuccagucuggcgucgacguguucuucacgccgcccgagaagugcgacacacugcugugcgacaucggcgagagcagccccaacccgaccguggaggccggcagaacccuccguguccugaaccugguggagaacuggcucaauaacaacacucaguucugcaucaaggugcugaaccccuacaugcccuccgucaucgagaagauggaggcccugcagcgcaaguacgguggggccuuggugaggaacccgcucucucguaauuccacucaugagauguacugggugagcaacgcguccggcaacaucguaagcuccgugaacaugaucucgcggaugcuuaucaaccgcuucaccaugcggcacaaaaaggccacauacgagcccgacgucgaccugggguccgguacccgcaacaucgggaucgagagcgagacccccaaccucgauaucaucgguaaacguaucgagaagaucaagcaggagcacgagacguccuggcacuacgaucaggaccaccccuacaagaccugggccuaccacggcagcuaugagacgaaacagaccgggagcgccagcucuauggucaacggaguggugcggcuccugaccaagccuugggacgucauucccauggugacacagauggccaugacggacaccacccccuucgggcaacagcgcguguucaaagagaaagucgacacaagaacgcaggagcccaaagaaggcacaaagaagcucaugaagauuacugcggagugguuauggaaggagcucggcaaaaagaaaacgccgcgcaugugcacgcgggaggaguucacccgcaaggugagaagcaacgccgcucucggggccaucuucacggacgaaaacaaguggaagucagcccgcgaggcggucgaggacagcggcuucugggagcuaguggacaaggagcggaaccugcaccuugaggggaagugcgagacaugcguguacaacaugaugggcaagcgcgagaagaagcugggagaguucggaaaagccaagggcucccgggcgauuugguacauguggcucggggcgcgcuuccucgaguucgaggcgcuggguuuccugaacgaggaccauugguucagccgggaaaacucucuauccggagucgagggcgaaggacuucacaagcugggcuacauucuccgcgacgugagcaagaaggaggguggggccauguaugccgacgacacggccggcugggauaccaggaucacccuggaggaccuuaagaacgaggagauggugacgaaucacauggagggugagcacaagaaacucgccgaggcgauauuuaagcugacguaccagaacaaggucgugcgcguacaacggcccacaccacggggaaccgucauggacaucaucuccaggcgcgaucagcgggggucuggccaggugguuaccuacggccugaauacguucaccaacauggaagcccagcucauucggcaaauggagggggagggcgucuuuaaauccauccagcagcugaccgugacagaggagaucgccgucaaaaacuggcugguccgcguugggcgagagcgucucagccggauggccaucuccggcgacgacugcgucgucaagccacuggaugaccgcuucgccagcgcacugaccgcgcucaacgacaugggcaagguccggaaggauauucaacagugggaaccgagccgcggguggaaugacuggacccaggugcccuucugcagccaccacuuccacgaacucaucaugaaagacggucggguccugguaguucccugucgcaaucaggacgagcucaucgggcgggcccgcaucucccagggcgcuggguggagccugcgggagaccgcaugcuuaggcaaguccuacgcgcaaauguggaaccucauguacuuccaccgccgggaccugcgccucgccgccaacgccaucugcagcgccguccccucccauugggucccgacgagccggaccacgugguccauucacgcgacucacgaguggaugaccaccgaggacaugcucacgguguggaauagagucuggauccaggagaacccuuggauggaggacaagacccccguagaaagcugggaggagauccccuaccuaggaaagcgggaggaccaguggugcgggagcuuaaucggccuuaccucccgcgccaccugggccaaaaacauucaaacugccaucaaucagguacggucauugaucgggaaugaggaguacaccgacuacaugccguccaugaagagauuccgccgggaggaggaggaggcggggguccugugguga

SEQ ID NO: 25431 - RNA, 9876 nt, Artificial Sequence
  derived and/or modified CDS sequence (opt11) from DENV-2__KP723479__SS-prME
acagccgggauaaucauaaugaugauaccaacugugauggccuuccaccuaacaaccagaaacggagaaccccauaugauaguaaguagacaagaaaagggaaagagccuacuguucaaaacagaaaacggcgugaacaugugcacguuaauggcaauggaccuaggggagcugugugaagauacgaucacuuacaacugcccucuauugcgacaaaacgaacccgaggacaucgacuguugguguaacagcacaucgaccuggguuacguacggaaccuguacagcaaccggcgaacaccgccgcgaaaaaaggucggucgcgcucgugccgcacgugggaaugggucuugaaacaagaacagagacguggaugagcuccgagggggcauggaaacacgcacaacguauugaaacauggguccuacgacaccccggauuuacaaucauggcggcaauauuggcuuauaccaucgggacaacguauuuccagcgggugcucauauucauacuacuaacggcgguggcaccuagcaugacaaugagaugcauagguauaagcaacagggacuucgucgagggcguuucgggaggaagcuggguggauauaguauuggagcauggaagcugcgucaccacgauggcaaaaaacaaacccacacucgauuucgaacugauaaagacagaagcgaaacacccugcuacgcuccgaaaauauuguaucgaagccaaauuaaccaauacgaccaccgccucaagaugccccacgcagggcgaaccaagccucaacgaggagcaggauaagcgcuucgugugcaagcacucgaugguagaccggggguggggaaacggaugcgggcuguucggaaaagguggaauugugacgugugcuauguuuaccugcaaaaaaaauauggaagguaaaaucguccaacccgagaaccuagaguauacgaucgugaucacaccacacuccggggaggagaacgcuguagggaacgauacaggaaaacauggcaaagagauaaaggugaccccacaaagcagcauaacagaagccgaacuaaccggguacggaacgguaacaauggagugcuccccccgaaccggacuggacuucaacgagaugguacuccuccagauggagaacaaagccuggcucguucacaggcaaugguuccucgaccucccucuaccguggcuuccgggcgccgacacccaaggaucaaacuggauacagaaggaaacgcugguaaccuuuaaaaacccacacgcaaagaaacaagacgugguaguuuugggaagucaggagggggcgaugcacacggcccuaacgggcgcaacagagauacagaugagcucgggcaaccuccuuuucacgggacaccuaaaaugccggcuaaggauggacaaacuccagcuaaagggaauguccuauuccaugugcaccgggaaauuuaaggucguaaaagagaucgccgaaacgcaacacgguaccauuguaauaaggguccaauacgagggcgacggaagucccuguaagauaccguucgaaaucauggaccucgaaaaaagacacguccuaggaaggcucaucacgguuaacccaaucguaacagagaaagacucaccuguuaacaucgaagccgaaccgccuuucggagacagcuacaucaucaucggagucgaaccgggccagcuuaagcugagcugguucaaaaaaggaaguucgaucggacagauguucgagaccaccaugcggggagcaaagcgaauggcgauccucggagauaccgccugggacuucgggagccuaggaggaguguucacuucgauugggaaagcacuacaccaaguauuuggggcaaucuauggugcggccuuuucaggcguaagcuggacgaugaagauccugauugggguagugaucacauggauaggaaugaacucccguagcaccagccuaagcgugucacucguauuggucggcguggucacacuguaucucggagugaugguucaagccgacagcggcugcguggucucauggaaaaauaaggaacugaaaugcgggucuggcauauucaucacugauaacguacacaccuggacagaacaauacaaguuucagccagaguccccaaguaaacuggcaagcgcaauucagaaagcucacgaagaaggaauuuguggaauacgcagcgugaccaggcucgaaaaccuaauguggaaacagaucaccccagagcuuaaccacauacucagcgagaacgaggucaaauuaacgauaaugaccggagacauaaagggaaucaugcaggcaggcaaacgaagccuacgcccacaaccgacagagcuaaaguauagcuggaaagcaugggguaaagcaaagaugcuguccacagagcuccauaaccacaccuucuugaucgacggaccagaaacagcggaaugucccaacaccaaccgagcguggaacaguuuagaaguggaagacuacgguuucggcgucuucacgacgaauauauggcuaaagaugaaggagcgccaagacguguucugcgacucaaagcucauguccgcagcgaucaaagacuccagagcgguccacgcagauaugggcuacuggauagaaagugcgcugaaugacacguggaaaauagagaaagcaaguuucauugaagugaaaaguugccacuggcccaagucacacacccuauggagcaacgggguacucgaaucugaaaugauaaucccuaagaacuucgccgguccgguaucccaacacaauuaccggcccggauaccauacccaaacagcggguccauggcaccuaggccgccucgagauggacuucgacuuuugcgaagguaccacagugguaguaaccgaagacugugggaaccgcgggccaagcuugcgcaccacgaccgcauccggcaaacuaauaacagaguggugcugucgcucauguacccuacccccgcuaagauacagaggcgaggauggaugcugguacggaauggaaauccgcccccuuaaagaaaaagaggaaaaccuaguaaacucccucgucacugccggacacggacaaauugacaacuucucccuaggaguccuuggaauggcucucuuccuggaggaaaugcuccgcacuagagucgguacgaagcaugcgauacuacuggucgcuguuucguucgucacacugaucacagggaacaugucguucagagaccugggucguguuauggugauggucggcgccacaaugacugacgauaucgguaugggggugacauaucuggccuuacuugcggcauucaaaguccguccgacauuugccgccgggcucuugcuacgcaaauuaacaucaaaagaacucaugaugacgaccauaggaauuguacuacugucccaggcaaccauacccgaaacgauacuggaguugacagaugccuuggccuuggggaugauggugcuaaaaauugucagaaauauggaaaaauaccagcucgcaguuacgauuauggcaauucugugcguacccaaugcgguaauucugcaaaacgccuggaaggucagcugcacuaccuuggccguuguaagcgucagcccccucuugcucaccucuucacagcagaaagcagacuggauuccacuagcccuaacgaucaaggguuuaaacccaacggcuaucuuucuaacuacacuuucgaggacuaauaagaagcgcagcuggccauugaacgaggcaaucauggcaguagggaugguaucaauacuugcgagcagucuguugaaaaaugacauuccgaugacaggcccacuagucgcaggaggacuccucacggucugcuacguacucacagguagaagcgcagaccuagaacuggaaagagccgcggacgugaggugggaggagcaagcggagaucagcggaagcucaccaauccuaucaauaacaauaagcgaagacggcagcaugucgaucaaaaacgaagaagaggagcaaacacugacgauccucauuaggaccggacucuuagucgugucaggacucuuuccuguuagcacucccaucacagccgccgcaugguaucugugggaagugaagaaacagagagcgggcgugcuuugggacgucccgaguccgcccccggucgggaaggccgagcuugaagacggcgcguacaggaucaagcagaaagggauccuaggauacucccagauaggagccggggucuauaaggaagggacguuccacacgauguggcacgucacccgcggagcuguacuuaugcacaaagguaaacgcauagaaccaucaugggccgacgucaaaaaagaucuuaucagcuacggaggaggauggaaacuggaaggcgaguggaaagagggugaagaaguacagguccucgcguuagagcccgggaagaauccacgagcaguccagacgaaaccgggccuguucaaaacuaacacuggcaccauaggggcgguuagcuuagauuuuagccccggcacgucaggauccccaaucguggauaagaaagggaaggucguuggccuauacggaaacggcguaguaacacgcucggggaccuacguuagcgcuauagcccagacagaaaaaucaauugaagacaacccagagaucgaggacgacaucuuccguaagaaacgucuaaccaucauggacuuacacccgggggcgggaaaaacaaagcgcuaccuuccugcaaucguccgcgaggcgaucaaacgcggacugaggacgcuaauccuugcgccaacccgggugguagcggccgaaauggaggaggcccuacggggguugccuauuagguaccaaacccccgcgauacgggcugaacacacuggucgggaaauaguggacuugaugugucaugcaaccuucaccaugcgacuuuuaagcccaauucgggucccgaacuacaaccugauuauaauggacgaggcgcacuucaccgauccggcgagcauagcggcgcgaggauauaucucgacacguguagagaugggugaagcagcagguaucuucaugacggccacaccgcccggaagucgugacccauuuccacaaaguaacgcuccgauaauggaugaggaacgcgagaucccagagaggucguggaacagcggccaugagugggucaccgacuuuaaggggaaaaccguaugguucguaccuagcauaaaagcagggaacgacauagcagcaugccuacgcaagaacggaaaaaaggugauucaacugagccggaagacauucgauucggaauacauuaagacccgaacgaacgacugggacuuuguuguuaccacugacauuuccgaaaugggagcaaacuuuaaagcggaacgagucauagauccccggcgcugcaugaaaccgguaauacuaacagacggagaagagagaguaaucuuggcggggccaaugccgguaacgcauagcucagcagcccagaggaggggcagggugggacggaauccaaaaaacgaaaacgaccaauacaucuacaugggagaaccacuggaaaacgacgaggacugcgcccacuggaaagaagcgaaaaugcuucucgacaauaucaacacaccagaagggaucauaccgucaauguucgaaccggaacgggagaaagucgacgcaaucgacggugaguaccggcuacgaggcgaagcccgaaaaacauuuguugacuuaaugcgucgcggggaccuucccguauggcuggcguacagaguagccgcagagggaauaaacuaugccgaucgccgguggugcuucgaugguguaaagaacaaucagauauuggaagagaacgucgagguggagaucuggacgaaggagggcgagcguaaaaagcuuaaaccgagauggcuggacgcgcgaauauacucggacccuuuggcguuaaaagaguucaaagaauucgcggcggggcggaaaucccugacacugaaccuaaucacagaaauggggcgauuaccaacauucaugacgcagaaagcaaggaacgcccuggacaaccuagcaguacuucacacggcagaagccgggggaagagcguacaaccaugcauuaagcgaacugccagagacccuagagacccuucuccuccucacuuuacuggcaacggugaccggaggcaucuuccuauuucucaugagcggcaaagggauagggaaaaugacguuaggaaugugcugcauaaucacggcaucgauucugcucugguaugcgcagauccaaccccacuggauagcugcaagcaucauccucgaauuuuuccugaucgugcuccugauaccggaaccugaaaaacagcgcaccccccaggauaaucaacucacauacguagugauugccauacucacagucgucgcggcgacuauggccaacgaaaugggauuccuagagaagacgaaaaaagauuuuggccucggcucgaucaccacccaacaaccugaaaacaauauauuggauaucgaccuacgaccugcgucagccuggacacuguacgccguagccacaacauucauaacaccuaugcugagacacucaauagaaaauucgucugucaauguuagccucaccgcgauugccaaucaagcaaccgucuuaauggggcugggcaaaggcuggccucuauccaaaauggacaucggagugccacugcucgcaaucggcuguuacucacaggucaaccccauaacauuaacggcagccuuacucuuauugguagcacacuaugccaucaucgggccaggacugcaggcaaaggcaacaagggaagcgcaaaagcgagcggccgccggcauaaugaagaacccaacgguagacgguaucaccguaaucgaucucgaccccauccccuacgacccaaaauuugagaaacaacucggucaagugauguuacuaguccugugcguaacucagguccuaaugaugagaacaacgugggcccuuugcgaagcacucacacuagcgaccggaccaaucagcaccuuaugggaaggaaacccgggucgauuuuggaauacgaccauagccgugagcauggcgaauauauuucgcggaaguuauuuggcgggggcuggacuacuauucucgaucaugaaaaacacagccaacaccagacgggguaccggaaacacaggcgaaacacugggagagaaguggaagaaccgacuaaacgcccuggggaaaagcgaauuccaaaucuacaaaaagucgggcauccaagaagucgaccgcacgcucgccaaggagggcauaaaaagaggugagaccgaccaccaugcuguaagccguggaagcgcgaaguugcggugguucguugagcggaaccuagugaccccggagggaaaaguggucgacuuagguugcggaagagggggauggaguuacuacugcggaggucucaaaaaugucaaagagguaaaggggcuaaccaaagggggcccagggcacgaggaaccaauaccgaugucgacauauggauggaaccugguacgccuccagagcggcguggacguauucuuuacucccccggaaaagugugacacuuugcugugugacauuggggaaagcaguccuaauccaacggucgaagcagggagaacccuccguguucuuaaucuggucgaaaacuggcugaacaauaacacucaguuuugcaucaaaguucugaacccauacaugcccucugucauagagaagauggaagcccugcaacgaaaauacggaggggcgcucgugcggaacccgcugagcagaaauagcacucaugagauguacugggucagcaacgcuucgggcaacauuguaucauccgucaacaugauauccagaaugcugauuaaccgguucacaaugcggcacaaaaaagccacguaugagccagacguggacuuagggagcgggacaagaaacaucggcaucgaguccgagacaccaaaucuggauauaaucggcaaacguauugagaagauaaaacaagaacaugaaaccucauggcacuacgaucaggaccaccccuacaaaaccugggcuuaccauggcagcuacgaaacuaaacaaacugguagugcauccucgauggugaauggagucgucagacuguugacgaagccaugggacguaaucccuaugguaacucagauggccaugacggacaccacaccauucggacagcaaagaguauucaaagaaaaaguggauacgcggacccaagaacccaaagaaggcacaaagaaauugaugaagauaaccgcagaguggcuauggaaagagcuaggcaaaaaaaagacgccuagaaugugcacacgcgaggaauucacucgcaaagugaggagcaaugcggcgcucggagccaucuucacggaugaaaacaaauggaaaucagccagagaggcggucgaagauuccggauuuugggagcucguagacaaagagcgaaaucugcacuuagaaggcaagugcgaaaccugcgucuacaacaugaugggaaaacgggaaaaaaaacugggugaguucggaaaggccaaagggucaagggccaucugguacauguggcucggcgcaagauuccucgaguuugaggcacugggcuucuugaacgaagaccauugguuuucgcgggagaauucacuauccggcgucgaaggagagggccugcacaaacugggauauauucuacgugaugucaguaaaaaagaagggggagcgauguacgccgacgacacagcgggcugggacaccaggaucacgcuugaggauuuaaagaacgaggaaauggucaccaaccacauggaaggagaacauaaaaaacuagcugaagccauauuuaaacucacguaccaaaauaaaguaguccgggugcagcgcccgacgccgagggggacaguaauggacauuaucucccgacgggaccagcgcggcucgggccaagugguaacauacggacugaauacguucacaaacauggaagcacaacucauacgacagauggagggcgaaggcguauucaaaaguauccaacagcuuaccgucacagaagaaauagcgguuaagaacuggcuagugaggguaggccgagaacggcuuucuagaauggcgaucagcggagacgacugcguggucaaaccgcucgacgacagguucgccagcgcgcucacugcucuaaacgacaugggcaaaguacgaaaggauauacaacaaugggagccaucacggggguggaacgacuggacccagguccccuucuguucacaccauuuccacgagcuuauaaugaaagacggucgagugcuuguagugccuugcagaaaccaagacgaauugauaggacgugccaggauaucucagggcgcgggcuggucccugagagaaacggcaugccucggcaagucguacgcucagauguggucacugauguacuuccaccggcgggacuuacgacucgcagccaaugcgauuugcucagcggucccaagccacugggugccaacgucccguaccacuuggucgauccaugccacacacgaauggaugaccacagaggauaugcucacgguauggaacagagucuggauccaggagaacccauggauggaagacaaaaccccaguagaaagcugggaggagauucccuaccuuggcaagcgggaagaccaauggugcggaagccucaucggccuaacaagccgggcgacaugggcaaaaaacauacaaaccgcaauaaaccaggucagaucccugauuggaaacgaagaauauacggacuauaugccaucgaugaagcgauuccgccgggaggaagaagaagccggaguccucugguga

SEQ ID NO: 25432 - RNA, 9876 nt, Artificial Sequence
  derived and/or modified CDS sequence (opt11) from DENV-2__KT187554__SS-prME
accgccgggaucauaaucaugaugauccccaccgugauggccuuccaccugacgacccggaacggggaaccccauaugauagucagccggcaggagaagggcaagagccugcuuuucaagaccgagaacggugugaacaugugcacccuaauggcgauggaucucggcgagcuuugcgaggacaccaucaccuacaacugcccccugcuccggcagaacgagccagaggauaucgacugcuggugcaacagcaccagcaccugggugaccuacgggacaugcaccgcgaccggcgagcaccggagggaaaagagaagcgucgcucuggugccccacguuggaauggggcuagagacucgcaccgagacguggauguccagcgagggcgccuggaagcacgcccagcgcaucgagaccuggguccuccgccacccggguuucacgaucauggccgccauccuggccuacaccaucggcaccaccuauuuucagcgggugcugaucuucauccugcugacggcgguggcgcccucgaugacuaugcgcugcaucgggaucagcaaccgagauuucguggagggcgugaguggcgggagcuggguggacaucguccucgagcaugguaguugcgucaccaccauggccaagaacaagccaacgcucgacuucgaacucaucaagacagaggcaaagcaccccgccacccuuaggaaguauugcauugaggccaagcucaccaauacgaccacggcaagccgguguccaacccagggggagccgucacugaacgaggagcaggacaagcgcuucgugugcaaacacuccauggucgaccgcgguuggggcaacgggugcggccuguucgggaagggggggauuguuacgugcgccauguucacguguaagaagaauauggaaggcaagaucguacagcccgaaaaccuugaguacacuaucgucaucacgccccacaguggcgaagaaaacgcggugggcaacgacacagguaagcacggcaaagagaucaaggugaccccgcagucguccauaaccgaggccgaacugaccgguuauggaaccgucacgauggagugcagcccgcggaccggccuggacuuuaaugagaugguguuacugcagauggagaacaaagcguggcucgugcacaggcagugguuccucgacuugccacugccuugguugccgggcgcugauacccaagggaguaauuggauccagaaagaaacccucguuacguucaagaacccucacgccaaaaagcaggaugucgucguucucggcagccaggagggcgcaaugcacacugcccucaccggggccacugagauccagaugagcagugggaaccugcuguucacgggccaccucaagugccgccugcggauggacaagcugcagcuuaagggcaugagcuacagcaugugcaccgguaaauuuaagguggucaaagagaucgcggaaacccagcacggcacuauagugauccgcgugcaguacgagggcgacggcagcccuuguaagauacccuucgaaaucauggaccuggaaaagaggcacguccugggacgccucaucacggugaacccgauagugaccgaaaaggacucccccgucaacaucgaagccgagccgcccuucggggacuccuacaucaucaucgggguggagccgggccagcugaaacuguccugguuuaagaagggcagcuccaucgggcaaauguucgagacaaccaugcggggagcaaagcguauggccauccucggcgacacggccugggauuucgggagccugggcgggguguucaccuccauaggaaaggcgcugcaucaggucuucggggcaauauacggcgccgccuucagcggcgugucuuggaccaugaaaauucucaucgggguagucaucaccuggaucggcaugaauagccgauccacgucgcuguccguuagccuggugcuggucggcguggugacucucuaucugggcgucauggugcaggcggacagcgggugcguggucucguggaagaacaaggagcugaagugcggcagcggcaucuucaucaccgacaacgugcacacguggacggagcaauacaaguuccagcccgagucgcccagcaagcucgccuccgccauccagaaggcccacgaggaggggaucugcgggauccggucaguaacccggcuggagaaccucauguggaagcagaucaccccggaacucaaccacauccuguccgagaacgaggugaagcugaccauuaugaccggggacauuaagggcaucaugcaggccggaaagcggagcuugcgcccgcagcccacagaacugaaguacuccuggaaaacuuggggaaaggcgaagaugcucagcaccgaacuccacaaccacacguuccugaucgauggccccgaaacggccgagugcccuaacaccaaccgggccuggaacucgcucgagguggaggacuacggguuuggcguguucacaacgaacaucugguuaaagcucaaggaacggcaagaugucuucugcgacucgaagcugauguccgcugccauuaaggacaaccgggcgguacacgccgacaugggguacuggauagagucagcccucaacgacacguggaaaauugagaaagccaguuucauagaggucaagaguugccacuggcccaaaucccauacucuguggagcaacggcgugcuggagagcgagaugaucauccccaagaacuucgccggccccguuagccagcauaacuaccguccgggguaccacacccagaccgcaggcccauggcacuugggucggcuggagauggacuucgacuuuugugagggaacuaccgugguugugaccgaagacugcggcaacagaggccccucccugcggaccacgaccgcguccggcaaacucaucacagaguggugcugcaggagcugcacacugcccccucugcgguaccgcggggaggacggcugcugguauggaauggagauaagaccccucaaagagaaggaggagaaccuaguuaacagucucgucacggcgggccacgggcagaucgacaacuucagccucggcgugcugggcauggccuuguuccucgaggagaugcuccgcacgagaguagggaccaagcacgcaauucugcuugucgccgucucauucgugacccugaucacgggcaacaugagcuuccgggaccuggggcgugucaugguaauggugggcgccgccaugaccgaugacaucgggaugggcgucacguaccucgcacugcucgcggccuuuaagguacgacccacuuucgccgccggccuccuguugcgcaagcucacauccaaagagcugaugaugaccaccaucggcaucguacugcucucgcagucuacgaugcccgagacuaucuuagagcugacagacgcccucgcgcugggcaugaugguccugaaaaucgugcggaacauggagaaguaccaguuggccguuacaaucauggcuauccugugcgugccgaacgcggugauccuacagaacgcauggaagguaucaugcacuacgcucgcgguugugagcgucagcccccuguuccugacauccagccaacagaaagccgacuggaucccccucgcccugaccaucaaagggcuaaaccccaccgccauuuuccucaccacccugucccgcaccagcaagaagcggaguuggccguuaaacgaggcgauaauggccgugggcauggugagcauccucgccucaucguuacugaagaacgacauucccaugaccggcccccucguagccgggggcuugcucacagucugcuacguucuuaccgggaggagugccgaccuggagcuggagcgggcggcggacguccgcugggaggagcaagcugagaucuccgguucgagccccauccucagcaucacaauuuccgaggaugggagcaugaguauaaagaacgaagaggaggagcagacccugacgauccugauccgaaccggcuuguuagugaucagcggccuauuuccgguguccauccccaucaccgcugcagcgugguaccucugggagguaaagaagcagcgcgccgggguguuaugggacgugcccucgccaccgcccgucggcaaggcugagcuggaggacggcgcguaccgcaucaagcagaagggcauccucggguacagccagaucggcgcggggguguauaaggaagggacguuccacaccauguggcacgucacgcgcggcgcgguccugaugcauaaggggaaacggaucgagccgagcugggccgacgucaagaaagaccugaucuccuauggcgggggcuggaaacucgaaggggaguggaaggaaggggaagaggugcagguacuggcccuagagcccggcaagaauccccgcgcggugcaaacgaagcccgggcuguucaaaaccaauacuggcacuaucggggcggugagccuagacuucucccccggaacgagcgggucgcccaucgucgacaagaaggguaaaguggugggcuuauacgguaacggugucgugacccggagcgggaccuacgugucugcgauagcccagacggaaaaauccaucgaggauaaucccgagaucgaagacgacauauuccgcaagaagcggcucaccaucauggaccugcacccgggggcaggcaagaccaagcgcuaccugcccgccaucguacgggaggcgauuaagcggggauuacgcacccucauccuggccccgacucgcgugguggccgccgagauggaagaggcucugcgugggcuccccauccgguaccagacccccgcgauacgcgccgagcacacagggcgggagaucguugacuugaugugccacgccaccuucacgaugcggcuccucagccccauacggguaccgaacuacaaccugauuaucauggacgaagcccauuucacggaucccgcuuccaucgcggcccgcggcuacaucagcacucguguagagaugggcgaggccgcggggaucuucaugaccgccacgccccccgggagucgcgauccguuuccccagagcaacgcgccaaucauggacgaggagcgggagauccccgagcgcuccuggaacagcgggcacgaguggguuaccgacuuuaagggcaagaccgugugguucgucccguccaucaaggccgggaacgacauagccgcuugcuugcgaaagaacggcaagaagguuauccaacugagccgcaagacguucgacuccgaguacaucaagacgcggacaaacgacugggacuucguggugaccaccgacaucagcgagaugggcgcgaacuucaaggcugagcgcguaaucgacccccgucgcugcaugaagcccgucauccuuacggacggggaggagcgggucauccuggcuggccccaugccgguuacccauuccagugcagcccagcgccgaggccgcgugggacgcaauccuaagaacgagaacgaucaauacaucuacaugggggagccccucgaaaacgacgaagacugcgcgcacuggaaagaggccaagaugcugcuggacaacaucaguacccccgagggcauaauaccgagcauguuugaacccgagcgggagaagguagaugccaucgacggcgaauaccgccuccgcggggaggcccgcaagaccuucgucgaucugaugcggcgcggcgaccugccgguguggcucgccuaucggguagcggccgaggggauaaacuacgcggaucgccgguggugcuucgacggcgugaagaauaaccaaauccuggaggaaaacguggaggucgagaucuggacgaaggagggggaacgcaagaagcuuaagccgcgguggcucgacgccagaauauauuccgacccccuggcccugaaggaguucaaagaguucgcggccggccgcaaaagccuaacccugaaucugaucaccgagaugggccgccuccccaccuuuaugacgcagaaggcccgcaacgcucuggacaaccuggcugugcuccacaccgcugaagccggaggccgagccuacaaccaugcacuguccgagcugccggagacacucgagacccugcugcuccugacgcuucucgcggccgugacagguggcauauuccuguuccugaugagcggcaaggggaucgguaagaugacccucgggauguguugcaucaucacggccuccauuuugcugugguacgcucagauccagccgcacuggaucgcugcgagcaucauccuugaguucuuccugaucguccuguugauacccgagcccgagaaacagaggacgccucaggacaaccagcugacguacgucgugauagccauucugaccgucguagccgcaaccauggccaaugagaugggguuccucgaaaagacuaagaaggauuucggccugggcuccacgaccacccagcagccggaguccaacauccuggacaucgaccuaaggcccgcaagcgccuggacccuguacgccguagccacgaccuucaucaccccgaugcugcggcacuccaucgagaacagcuccgucaacgugucccucacggcuaucgcgaaucaagccacgguacugauggggcuggggaagggcuggccccuuuccaagauggacaucggcguaccgcugcuggcgaucgguugcuacucgcaagugaaccccauaacucucacugccgcguuguuacuacugguggcccauuacgccaucaucgggcccggacuucaggccaaggccacgcgggaggcucagaagcgggccgccgccgguaucaugaagaaccccacggucgacggaaucaccgugauagaccucgacccgauccccuacgaccccaaauucgaaaagcagcugggccaggugaugcugcucguccugugugugacccagguacugaugaugcgcaccacgugggcccucugcgaggcgcugacccuggccaccgggcccaucaguacgcuaugggaaggaaacccggggcguuucuggaacaccacuauugccguguccauggccaacauuuuccggggaaguuaccuggccggugcgggucucuuguucucaaucaugaagaacaccgccaauacccgccggggcacggggaacaccggcgagacgcugggcgagaaguggaagaaccgccugaaugcacucgggaagucagaguuccagauauacaagaagucgggcauccaggagguugaccggacacuagccaaggagggcaucaagcgcggagagacggaccaccacgcugugucgcgggggagcgccaagcugcgaugguuugucgagcggaaccucgugacucccgaagggaaggugguagaucugggcugcggaaggggcgggugguccuacuacugcggugggcuaaagaacguuaaggaggugaagggccucaccaagggcgggccuggucacgaggaacccauuccgaugagcacuuacggguggaaccugguccgacuccagagcgggguggauguguucuucacuccgcccgagaagugcgauacgcuccugugcgacauaggggagaguagucccaauccgaccgucgaggcgggccgaacccugaggguauugaacuuaguggagaacuggcuaaacaacaacacgcaauucugcaucaagguccucaaccccuacaugcccuccgugaucgagaagauggaagcgcugcaacgcaaguaugggggggcacugguccggaacccucugagccgcaacucaacgcacgagauguacugggucagcaacgcuuccggcaacaucgugucuuccgugaacaugauaagccggaugcucaucaaccgcuucaccaugcgccacaagaaggccacuuacgagccugaugucgaccugggcagcggcaccaggaacaucgggauagaaagcgagacccccaacuuggauaucaucggcaaacgcaucgagaagaucaaacaggagcacgaaaccuccuggcacuacgaccaggaccaucccuacaagaccugggcguaccacggcagcuacgaaaccaagcagacagguucugccagcaguaugguuaacggcgugguccggcuccuuaccaaaccgugggaugugaucccuauggugacccagauggccaugacagacacgacccccuuugggcagcagcgcgucuucaaggagaagguggacacgcggacccaagagcccaaggagggcacgaagaaacugaugaagaucaccgcggaguggcucuggaaggaguuagggaagaagaagacgccgcgcaugugcacccgggaggaguucacccgcaaaguccggagcaaugccgcccugggggcaaucuucacugacgagaacaaguggaaguccgcacgcgaggcgguggaggacagcggcuucugggagcugguggacaaggagcguaaccugcaucuggaggggaagugcgagaccugcguuuacaacaugaugggcaagcgugagaagaagcuaggggaguucggcaaagccaaaggcagccgggccaucugguauauguggcugggagcccgcuuccucgaguucgaggcgcugggcuuccuaaacgaggaccacugguucucucgggagaauagccucucgggggucgaaggcgaggggcuucacaaacucgguuacauccugagagacgucucgaagcgggagggcggagcaauguacgcugacgauaccgccggaugggacacccggaucacgcucgaggaccucaagaacgaagagauggucaccaaccacauggagggugaacacaagaagcuggccgaggcgaucuucaagcucaccuaccaaaacaaggugguccgcguccagaggcccacgcccagaggcacugugauggacauuaucucccgcagggaccagcgcggaagcggccagguagucaccuaugggcuuaacaccuuuacaaacauggaggcgcaguuaauccgccaaauggagggggagggcguuuucaaaucuauccagcaacuuacagugaccgaagagaucgcgguaaagaacugguuggugcggguggggcgcgagcggcugagccgcauggccauuucaggagacgacugcgucgugaagccccucgacgacagguuugccucugcguugaccgcgcugaaugacaugggcaaggugcgcaaggacauucagcagugggagcccucccgggguuggaacgacuggacgcagguccccuucugcagccaccacuuccacgagcucauuaugaaagacggccgaguccuggucgucccaugcagaaaccaggacgagcugaucgggcgcgcccggaucucacagggcgccggguggagccugcgagagacugcaugcuuaggcaaaucuuacgcgcagauguggaaccugauguacuuucaccgucgcgaccucaggcuggcagcaaacgcgaucugcucagccgucccgucccacugggucccgaccagccggaccacguggaguauucaugcgacgcacgaguggaugacuaccgaggauaugcugacugucuggaaccggguauggauccaggagaaccccuggauggaggacaagacgccuguagagagcugggaagagauuccuuaccucggcaagcgcgaggaccaguggugcggaagccugaucggccugaccucaagagccacuugggccaagaacauccagacggccaucaaccagguccgcagccucaucggcaacgaggaguacacugauuauaugccguccaugaaacgcuuccggcgcgaagaggaggaggcagguguucugugguga

SEQ ID NO: 25433 - RNA, 9876 nt, Artificial Sequence
  derived and/or modified CDS sequence (opt11) from DENV-2__KT187557__SS-prME
acggccgggauuauaauuaugaugauucccaccgugauggcuuuccaccugacuacccguaacggcgaaccucacaugaucgucucgcgacaagagaaggggaaaucguugcuuuucaagacggagaacggagugaacaugugcaccuuaauggcgauggaccuaggcgagcugugcgaggacaccaucacguacaauuguccacugcuccggcagaacgaacccgaggacauugauugcuggugcaauagcacuagcaccuggguaacuuacgggacaugcaccgccacaggagagcaucggcgcgagaagcggucugucgcccuggugccucauguaggcauggggcuggagacgcgcaccgagacguggauguccucagagggcgcguggaagcacgcucagcgaaucgagaccugggugcuccgccaccccggguuuacgaucauggcggcgauacuggcguauaccauagggaccaccuacuuccagagggugcucauauucauccuacuuacggcaguagcacccuccaugaccaugcguugcauaggaaucagcaaucgggauuucgucgagggcguuucuggcggaucguggguggauaucguccuugagcacggauccugcgugaccaccauggccaagaauaagcccaccuuggacuucgagcugauuaagaccgaagccaaacacccagcgacccugcgcaaguauuguauagaggcuaaacucaccaacaccaccaccgccucgcggugcccaacgcagggggagcccucccucaacgaggaacaagacaaacgcuucgugugcaagcacagcauggucgaccggggcugggguaacgggugcggccuguucgggaaaggcgggaucgugacgugugccauguucacgugcaaaaagaacauggaaggcaaaaucgugcagccagagaaccucgaguacaccaucgucauuacaccccacaguggugaggagaacgccguaggcaacgacacgggaaaacaugguaaagagaucaaggugaccccacagagcuccauaaccgaggccgaacugacaggguacggcacagucacgauggaguguucgccgcgcaccggccuggacuuuaacgagauggugcuccuccagauggagaauaaggccugguugguucacaggcagugguuuuuggaccugccccugcccuggcuucccggcgcggacacacaagggucuaacuggauacagaaggaaacccuggucacauucaagaacccgcaugccaagaaacaggaugucgucguucuuggcagccaagagggggccaugcacaccgcacucacuggggcuaccgaaauccaaaugucuagcgggaaccugcuuuucacuggccaccucaagugccgccugcggauggacaagcugcaauugaagggcaugagcuacuccaugugcacugggaaguuuaagguggucaaggagaucgcggagacccagcacggcaccaucgugauccgaguacaauacgaaggggaugguagcccguguaagaucccauuugagauaauggaccuggaaaagcgccacguccugggucgccugaucacggucaauccgaucguuaccgaaaaggacuccccugugaacaucgaggcagagccuccauucggggauucguacauuauaauaggcguggagccggggcaguugaagcuguccugguucaagaaaggcagcuccaucggccagauguucgaaacaaccaugcgcggcgcaaagaggauggcgauccucggcgacacggcgugggacuucgggucccugggcgggguguucacauccauagggaaggcucuacaccaggucuuuggggcuaucuauggcgccgccuucagcggugugucguggaccaugaagauccucauaggcguggucaucaccuggauuggaaugaacagccgcuccacuagcuuauccgugucgcuggugcuggucggaguugugacccuuuaccuuggcguaauggugcaagccgauucagggugcguggucaguuggaaaaauaaggagcucaaaugcgggagcggaauauucaucaccgacaacgugcacaccuggacagagcaguacaaguuccaaccagagucacccagcaaacuagccuccgccauacagaaggcccacgaagaggguauaugcggcauccguucggugacccgcuuagaaaaccugauguggaagcagaucaccccggagcucaaccacaucuuauccgagaaugagguuaagcugaccauaaugacuggugauauuaaggggaucaugcaggccgggaagaggagcuugagaccgcagcccaccgagcugaaguacuccuggaagaccuggggcaaggcgaagaugcugagcacagagcuccacaaucauacuuucuugaucgauggccccgagacggccgagugcccgaacaccaaccgggccuggaacucccuagagguagaggacuacggguucggcguguucacaacgaacaucuggcugaaguugaaggagcgccaagacgucuucugcgacagcaaguugaugagugcggccauaaaggacaaccgagcgguucacgcagauauggguuacuggauagagucagcccucaaugacaccuggaagauugaaaaggccuccuucaucgaagugaaaagcugccacuggccaaagagucacacucucuggagcaacggggugcuggaaucagagaugaucauacccaagaacuucgccggcccgaugagccaacauaacuaccgcccaggguaccacacccagaccgcuggccccuggcaccuugggcgacuagagauggauuucgauuucugcgagggcacgaccguuguggucaccgaggacuguggcaaccgcggccccagccuacgcaccacgaccgccucgggcaagcucaucacagaaugguguugccgcaguugcacccugcccccgcugcguuacagaggggaggacggcugcugguaugggauggagauucggccccucaaggaaaaggaggaaaaccuggugaacuccuugguuacggcaggccacggccagaucgacaacuucagccucggcgugcugggcauggcccuguuccucgaagaaaugcugcguacacgggucgggaccaagcacgcgauucugcucguggccgucuccuuuguuacccucauaacgggcaacaugucauuccgagacuuggggcgcgucauggucaugguuggugccgcuaugaccgacgacauagggaugggcgucaccuacuuggcguuauuggcggccuucaagguccggcccaccuucgcggccggccugcuucuccgcaagcucacguccaaggagcugaugaugaccacaaucgggaucgugcugcucagucagagcaccaugcccgagacgauccuggagcugaccgacgccuuggcacuuggcaugaugguccugaagaucguccggaauauggagaaguaccagcucgccgugaccaucauggccauuuuaugcgucccgaacgccgugauccugcagaacgccuggaaagugagcugcacuacgcucgcggucguauccgugagcccccuccucuugaccuccagccagcagaaagccgacuggaucccccuggccuugaccauuaaggggcugaacccuaccgcuaucuuccucacgacguuaagucgcacgagcaaaaagagguccuggccgcucaaugaggcgaucauggccgucggcauggugaguauacuggccuccucacugcuaaagaacgacauccccaugaccgggccucugguggccgggggccugcugacggucuguuaugugcuaaccggccgcucagccgaccuagagcucgagcgggcggccgacgugcgcugggaggaacaggcggagaucuccggcagcucaccgauccugucuaucaccauuuccgaagacgggagcaugucuaucaaaaaugaagaggaggagcagacacugaccauucucauccguaccgggcuucuggucaucucuggccuguuuccggugucuaucccaaucacggccgcugcgugguaccugugggaggugaagaaacagagggcggggguacuaugggacgugccaucaccgccgcccgugggcaaggccgaacuagaggacggggccuaccguaucaagcagaagggcauccugggguacucccagaucggcgccggcguauacaaggaggggaccuuccacaccauguggcacguaacacgcggggcggugcucaugcacaagggaaagcguauagagcccagcugggcggacguaaagaaagaucucaucuccuacggcggcggguggaagcuggagggcgaguggaaagagggggaggagguccagguccuugcccucgagccagggaagaacccccgcgccguccagaccaagcccgggcuguucaagacaaacacuggcacgaucggggccgucagccuggacuucucaccaggcacuucgggcucccccaucguggacaagaaagggaaggucgucggccucuaugguaauggcguugucacacguucaggcacauacguguccgcgaucgcccagacugagaaguccaucgaggacaaccccgagauagaagaugacaucuuuaggaagaaacggcucacuauuauggaccuccaccccggggccggcaagaccaagcgcuaccugcccgcgaucgugagggaagcaaucaagcgcggacuccggacccugauccuggccccgacacgagucguggcagccgagauggaggaggcccuccgcggccuuccgauuagguaccagacgccugcgauccgcgccgagcauaccgggcgggagaucguggaccugaugugccacgcgacguucacuaugcgacugcugagcccgauacgggucccaaacuacaacuugauuauuauggaugaggcgcacuucaccgaccccgcauccaucgcggcccgcggauauaucaguacccgggucgagaugggcgaagccgccgggaucuuuaugaccgcuacacccccgggcagccgcgauccguucccccagagcaaugcgcccaucauggacgaggagcgcgagauucccgagcgaucauggaacagcgggcacgaguggguaacagacuucaaggggaaaaccgucugguucgugccgucaaucaaggccgggaacgauaucgccgccugucuccgcaaaaacggcaagaaggugauccagcugagucgcaaaaccuuugacagcgaguacaucaaaacacggaccaaugauugggacuucgucgugacuaccgacaucuccgaaaugggcgcgaauuuuaaagccgagcgcgugaucgacccccgacgcugcaugaaacccgucauauuaacggacggggaagaacgggugauccuagccggacccaugccggugacccacuccagugcugcccagcgccgggggcgcguagggcgcaaccccaagaacgagaacgaccaguacaucuacaugggggagccccuggaaaacgacgaggacugugcgcacuggaaagaggccaagaugcugcucgacaacaucuccacgccagagggcaucaucccaagcauguucgagcccgagagggaaaaaguggacgcaauugacggcgaguacagacugcggggagaggcccgcaagaccuuuguggaucuuaugcgccgcggcgaucucccagucuggcuagccuaccgcguggcagcugaggggaucaacuacgccgauagacgguggugcuuugacggggugaagaauaaccaaauccuggaggagaaugucgagguggaaauuuggacgaaggagggggaaagaaagaaauuaaagccucgguggcuggacgcccgcaucuauagcgacccacuggcccucaaagaguucaaggaguucgcggccggccgcaagagccugacccugaaccuaauuaccgaaaugggccgcuuacccaccuucaugacgcagaaggcucggaaugcgcuggauaaucuugcugugcugcacacggccgaggcagggggacgcgccuacaaccacgcccugagcgagcuccccgagacccuggagacccugcuccuucugacgcuccuggcagccgucaccggaggcaucuuccucuucuuaaugucuggcaaggggauuggcaaaaugacccugggcaugugcugcaucaucaccgccucgauccuacugugguacgcucagauccaaccucacuggaucgccgccuccaucauccuggaguucuuccuuaucgugcuuuugauccccgagcccgagaagcagcggacgccgcaggauaaucaacuaacguacgucgugauugccauauugaccguggucgccgccaccauggcgaaugagaugggcuuccuagagaagacgaagaaggacuucggacugggcagcacgacuacccagcagccggaauccaacauacucgauauagacuugcgccccgcgagcgcauggacccuguaugcaguggcgaccaccuucaucacucccaugcuccggcacuccauugaaaauagcucggucaacgucagcuuaaccgcuauagcgaaccaagccacgguccucaugggucucgggaaaggcuggccgcuguccaagauggacauaggggugccgcugcucgcaaucggcugcuacagccaagucaaccccauuacgcugacagccgcguuacuccuccugguagcucacuacgccaucauugggccaggacuucaagccaaggcaacccgcgaagcgcagaagcgggccgccgccggcaucaugaaaaaccccacgguugacgggauuacaguuaucgaucuagacccgauccccuaugaccccaaguucgagaagcagcucggccaggugaugcuccuggugcuguguguaacccagguucucaugaugcgcacuacgugggcgcugugcgaggcgcuaacgcucgccacgggccccaucucgaccuugugggagggcaacccggggcgauucuggaacacgaccauagccgugagcauggccaacaucuuccggggaucuuaccuggccggagcggggcucuuauuuagcauaaugaagaauacagccaauacacgccgcggcacuggcaauaccggcgagacauugggagagaaauggaagaaccgccugaacgcccuggggaaguccgaguuucaaaucuauaaaaagagcgggauucaggagguggaccggacucuggcgaaggaggggaucaagcgaggugagacggaucaccacgcggugucccgggggagcgccaaguugcgcugguuuguggaacgcaaccugguaacccccgagggcaaggugguggaccucggcugcgggcgcggagggugguccuacuacugcggcgggcucaagaaugucaaggaggugaaaggcuuaaccaagggcggccccggccacgaagaaccgaucccgauguccacuuacggguggaaccuugugcgguugcaauccggaguugacguauucuucacaccuccggaaaagugcgacacccugcugugcgacaucggggaguccucacccaauccgacaguggaggccgggcgcacgcuccgcguccuaaaucugguggaaaacugguuaaacaacaacacccaauucugcauaaaagugcugaaccccuacaugccuagcgucaucgaaaagauggaggcgcuacagcgcaaauacggcggggcacucgucaggaacccccucagccgcaacucgacacacgagauguacuggguuucuaacgcgucuggaaauauagucuccuccgugaauaugauuaguagaaugcucaucaaucgcuuuacgaugcggcauaagaaggcgaccuacgagcccgacguggaccugggaucuggaacccgcaauauugggauagagagcgaaacgccgaaccucgacaucaucggcaaacgcaucgagaaaauuaagcaggagcacgagacauccuggcacuaugaucaagaccauccuuacaagacaugggcauaucacggcagcuaugagaccaagcagacagggucagcuagcuccaugguuaacggcguggugcggcugcugaccaagcccugggacgucauucccaugguaacucagauggcgaugaccgacacgacacccuucggucagcagcgcguuuucaaggagaagguagauacccggacacaagaacccaaggaaggaacgaagaagcucaugaagauaacggccgagugguuguggaaggagcucggcaagaaaaagacaccgagaaugugcacccgggaggaguucacgcgcaaggugcgcagcaacgccgcucucggggcaauauucaccgacgagaacaaguggaaguccgcccgggaggcggucgaagacagcggcuucugggagcugguggacaaggagaggaaccuacaccucgaggggaagugcgaaacuugcguauacaacaugaugggaaagcgcgagaaaaagcugggggaguucggaaaggcaaaggguucacgggcaauaugguacauguggcugggggcccgcuuccucgaguucgaggcacugggcuuccugaacgaagaccacugguuuucucgagagaacucccucagcggggucgagggcgaaggguuacacaaauugggcuacaucuuacgggauguuagcaaaaaggaaggaggggcgauguacgcagaugauaccgccggcugggacacacggaucaccuuggaggaucugaagaacgaggagauggugaccaaccacauggagggugagcauaagaaguuagcggaggcaauuuucaagcugaccuaucagaauaagguugugcgcguucagcggccaacgccgaggggcaccgucauggacaucaucucccggcgcgaccaacgggguagcggccaagucgugaccuauggacugaacacauucacaaacauggaggcgcaguugauacgccagauggagggggagggcgucuucaagucgauccagcagcugaccgugaccgaggaaaucgccgugaagaacuggcugguccgcguggggagagagcgccucagccguauggcaaucuccggggacgacuguguggugaaaccccuggaugaccgguucgccagcgcgcuuaccgcgcucaacgauaugggcaaggugcggaaggacauacagcagugggagccgucccgaggguggaacgacuggacccaggugcccuuuuguucacaucacuuccaugagcuaaucaugaaggacggacgggucuuaguggugccuugcaggaaccaggacgagcugaucgggcgagcccguaucucgcagggagccggguggagccugcgagagaccgcaugucugggcaaguccuacgcgcagauguggaacuugauguauuuucaccgccgggaccugagacuagccgccaacgcaaucugcagcgccguacccucccauugggugccgacgagccgaaccacguggaguauacacgcuacccaugaguggaugaccaccgaagacaugcuaacaguguggaauagggucuggauccaggagaauccuuggauggaagacaagacgcccguagagagcugggaggagauuccguaccugggcaagcgugaggaucaguggugcgggagcuuaauaggucucacaagccgcgccacgugggcaaagaacauucagacggcuaucaaccaggugcggucgcugauagguaacgaagaauacacugacuauaugccuuccaugaagagguuucgcagagaggaggaagaggcgggcguccugugguga

SEQ ID NO: 25434 - RNA, 9876 nt, Artificial Sequence
  derived and/or modified CDS sequence (opt11) from DENV-2__JQ045670__SS-prME
ucagccggcaugaucaucaugcugauacccaccgugauggccuuccaccucaccacacgcaauggugagccccauaugaucgucggcauccaggagaagggcaagagccugcuguuuaagaccgaggacggcgucaacaugugcacccucauggcgauggaccugggggagcugugcgaggacaccaucaccuacaaguguccccuccugcggcagaacgagcccgaggacaucgacuguugguguaacucuaccuccaccugggugacauacgggaccugcacuacuaccggagagcaccgccgggagaagcgcucuguugcccuuguaccccacguugggaugggccucgagaccaggaccgaaaccuggauguccucagagggagccuggaagcaugcccagcgcauugagaccuggauucugagacauccgggcuucaccaucauggccgcgaucuuggccuacaccaucgggaccacgcacuuucagcggguccucauuuucauccuguugacggccguggcccccuccaugacgaugcguugcauuggcauaagcaaccgcgauuucguggagggcgucuccgggggcagcuggguggacaucguguuggagcacggguccugcgucacuaccauggccaagaacaagcccacgcuggauuuugaacugaucaaaaccgaggccaagcagcccgcgaccuuacgaaaguacugcaucgaggccaagcugaccaacacgacgaccgagagccgcugccccacccagggcgagcccucccugaaggaggagcaggauaagcgguucgugugcaagcacagcaugguggaccggggcugggggaacgggugcggucuguucggcaagggagggauugucacgugcgccauguucacgugcaagaagaauauggaggguaagaucgugcaacccgagaaccuagaguacaccaucgucgucacgccccacuccggggaggaacacgccgugggcaacgacacggggaagcacggcaaggaaaucaaggugacgccgcagagcuccaucaccgaggccgagcugaccggguacggcaccgucacgauggagugcagcccccguaccggucucgauuucaacgagauggugcugcugcagauggagaacaaggccuggcucguccaucgccagugguuccuagaccugccccucccguggcugcccggagccgacaagcaggagagcaacuggauccagaaagagacucuagucaccuucaagaacccccacgccaagaagcaggacguggucgugcucggcagccaggagggggcgaugcacacggcccugaccggcgccaccgagauacagaugagcuccgggaaccuccucuuuaccggccaccugaagugccggcugaggauggacaagcuccagcugaagggcaugagcuacuccaugugcacggggaaguucaaggugguuaaggagaucgccgagacccaacacggcaccaucgugaucaggguucaguacgagggggacggcucacccugcaaaauccccuucgagaucauggauuuggagaagagauacguccucggccggcugaucaccgugaacccgauugugacggagaaggauucgcccgucaacaucgaggccgagccgccguucggggacagcuacauaauuaucggcguggagccggggcagcugaagcucaacugguucaagaagggcuccagcaucgggcagauguucgagaccacaaugcgcggagcgaagcgcauggccauccugggcgacaccgcaugggacuucgggucccugggagggguguucacgagcaucgguaaggcucuucaccaggucuucggcgccaucuacggcgcggcguuuuccggcgugagcuggacgaugaaaauccugaucggcguaaucaucaccuggaucggcaugaacucgcggagcaccucccugagcgucucucuggugcuuguugggaucgucacgcuguaccugggcgugauggugcaggccgauagcgggugcgucguguccuggaagaacaaggagcucaagugcgggagcggcaucuucaucacggacaacgugcacacauggacagagcaguacaaguuccagcccgagucgcccucuaagcuggcaagcgcgauacagaaggcccaggaggaagggaucugcggcauccgcaguguuacgagacuggaaaaucucauguggaagcagauuacccccgagcugaaccacauccuggcugagaacgaagugaagcucaccaucaugaccggggauaucaagggaaucaugcaggccgggaagcgcagccugcggccgcagcccacggagcugaaguauuccuggaagaccugggguaaggccaagaugcucagcaccgaguccuacaaccagaccuuccugaucgacggccccgagacagcggagugcccgaauaccaaucgcgccuggaauagccuagagguggaggacuacggguuuggcgucuucaccaccaacaucuggcucaagcuaaaggaaaagcaagacgccuucugugacuccaagcugaugagcgccgccaucaaggacaaccgggcggugcacgcggacaugggguacuggaucgagagcgcgcucaacgacaccuggaagauugagaaggccucauucaucgaggugaagaacugccacuggcccaagucccacacgcuuuggagcaacggcguccuggaguccgagaugaucauccccaagaaccucgccgguccagugagccagcacaacuaccgcccgggguaccacacccagaucgcgggccccuggcaccuggggaagcuggagauggacuucgacuucugcgacggcaccaccgugaucgucacggaggacugcgguaaccggggccccucccuccgcaccaccaccgccagcggcaagcugaucacggaguggugcugccguagcugcaccuugccaccgcuccgauacagaggggaggacggcugcugguacgguauggaaauccgcccccugaaggaaaaggaggagaaccugguaaacucccuuguaaccgccggacacgggcaggucgacaacuucagucugggcgugcugggcauggcccucuuccuggaggagaugcugcgaacccgcguagggacgaaacacgcgauccuccugguggccgugaguuucguaacccugaucaccgggaacaugagcuucaaggaccuugggcgggucguggucauggucggcgcggccauggcugacgacauagguaugggcgugaccuaccuggcguuacucgcggcuuucaaggugcgccccacguucgccgcgggccugcugcuccggaagcuuacuuccaaggaguugaugaugaccaccaucgggaucguacuacugagccaguccacgauccccgagacggugcuugagcucaccgacgcgcuggcccugggcaugauggugcucaagauaguccgcaacauggagaaguaccagcucgccgucaccauaauggccauccugugcgucccgaacgccgugauccuccagaacgcuuggaaggugagcugcacgauccuggccgucguguccgugagcccccuacuccugaccuccagccagcagaagaccgacuggaucccguuggcccucaccauuaaggggcugaaccccacggccaucuuccugaccacccucucccgcacaaacaagaaacggagcuggccguuaaacgaggccauaauggccgucggcauggugucuauccuggccagcucccuccugaagaacgacauccccaugacuggcccccugguggccgggggccugcugaccgucugcuacguucugaccgggcgcucugccgaucucgagcuggagcgagcgacggacguuaagugggaagaccaggcagagaucuccggcuccagccccauccuguccauuacgauaucggaggauggguccaugaguaucaagaacgaggaggaggagcagacccucaccauccugauccgcaccggccugcuagucaucuccggucuguucccaaucucgauccccaucacggccgccgccugguaccugugggaggugaagaagcagcgggcgggggugcucugggacguacccagcccgccgcccaugggaaaagccgagcuggaagacggggcuuaccgcauaaaacagaagggcauacugggguacagccagaucggcgccggaguguauaaggaggggaccuuccacaccauguggcacgugaccagaggcgccguccucaugcacaaggggaagcgcaucgaacccuccugggcggacgugaagaaggaccugaucagcuacggcgggggcuggaaguuagagggcgaguggaaagagggggaggaggugcagguccucgcccuugagcccggcaagaacccccgggccgugcagaccaagcccgggcuguucaagacgaauaccggcaccaucggggccgugucccucgacuucagccccggcaccuccggcagccccauuauugacaagaaggggaaggucgugggccuguacggaaacggcguggugacccgcagcggcgcauacgugagcgcgaucgcgcagaccgagaaguccauugaggacaaccccgaaaucgaggacgacaucuuccggaagcgccggcuaaccaucauggacuuacaccccggagcgggcaaaaccaagcgcuaccuccccgccaucgugcgggaggcgaucaagcggggguugcggacgcugauucucgcgccgacccgcgucguggcggccgagauggaggaggcgcuacguggacuccccauccgcuaccagacccccgcgauccgggccgagcacaccggucgugagaucguugauuugaugugccaugccacguucacuaugcgccugcugucacccguucggguaccgaacuauaaccucaucauaauggacgaggcacacuucaccgacccagccuccaucgcggcccguggcuacaucagcacccggguugagaugggcgaggccgccgggaucuucaugacugccacuccgcccggcagcagggacccguucccccagucaaacgcgcccaucauggacgaggagcgggagauccccgaacgcagcuggaacuccggacaugagugggucaccgacuucaagggcaagaccgugugguuugugccgagcaucaaggccgggaacgacaucgccgccugccugcggaagaacggcaagaaggucauccaacugucccgcaagacguucgacagcgaauacgugaagacccgaaccaaugacugggacuucguggucacuacggacaucuccgagaugggcgcgaacuucaaggccgagagggucaucgacccccggcgcugcaugaagcccgugauccuuaccgacggggaggaacgggucaucuuagccggccccaugcccgugacccauagcuccgccgcccagcgccggggccgcaucggccggaaccccaagaacgagaacgaccaguacaucuacaugggggagccccuggagaacgacgaggacugcgcgcacuggaaggaggccaagaugcuccuggacaacaucaacaccccggaggguaucaucccgagcauguucgagcccgaacgcgagaagguggacgccaucgacggugaguaccggcugcgcggggaggcccgcaagacguucgucgaccucaugcggcgcggcgacuuacccgugugguuggccuauaagguggcggccgaggggaucaacuacgcagaccggcgauggugcuucgacggcauaaagaacaaccaaauccuugaagagaacgucgaaguggagaucuggaccaaggagggggagcggaagaagcugaagccgcgcuggcuggacgcucggaucuacucagacccccucgccuugaaggaguucaaggaguuugcggccggccgcaagagccugacccucaaccugaucaccgaaaugggccggcugcccacguucaugacccagaagacccgcgacgcccuagacaaccuggccguccugcacaccgcggaggccgggggccgggcuuacaaccacgcccucagcgagcugcccgagacguuagagacccuccuguugcucacccugcuggccaccgugacuggcggcauauuccucuuccugaugagcgggcgcggaaucggcaagaugacccuggguaugugcugcauaaucaccgcgucgauccuccugugguacgcccagauccaaccucacuggaucgccgccagcauuaucuuggaguucuuucucauaguucugcugauccccgaacccgagaagcagcgcacaccccaggacaaucaacugaccuacgucgugaucgccaucuuaacuguggucgccgccaccauggccaacgagaugggcuuccuggagaagaccaagaaggacuucggccucgguuccaucgccacccagcagccggaaagcaacauccuggacaucgaccugcgccccgccuccgcguggacgcucuacgccguggccaccaccuucgugacccccaugcugcggcacagcaucgagaacagcuccgucaacgugagccugacggccaucgccaaccaggcgacagugcucaugggccuggggaaaggcuggccccuguccaagauggacaucggaguuccucuacuggccauuggcugcuacagccaggugaaccccauaacccugacggccgcccuccuucugcugguggcccauuacgcgaucaucggucccggccugcaggccaaggccacccgcgaggcgcagaagcgggcggccgccggcaucaugaagaaccccaccgucgacgggaucacggugaucgaccuggacccgauccccuacgaccccaaguucgagaaacaguuagggcaggugaugcugcugauccuuugcgucacacaggugcugaugaugcgcacgacuugggcccugugcgaggcccucacucuggcgaccggccccaucucaacgcugugggagggaaacccggggcgguuuuggaacaccaccaucgccgucagcauggccaacaucuuccggggcuccuaccucgccggcgccgggcugcuguucucuauaaugaagaacacaacaaacacccggcgcgguaccgggaacauaggcgagacccucggcgagaaguggaagucccgccugaacgcgcuggggaaguccgaguuccagaccuacaagaagucugggauccaggaagucgaccggaccuuggccaaagaaggaauaaagcgcggcgagaccgaccaccacgccgucagccgggggagcgccaagcugcgcugguucguagagcggaaccugguuacccccgagggcaagguggucgaucucggcugcgggcguggcggguggagcuacuacugcggcgggcugaagaacguccgggaggugaagggucugacgaaaggcgggccuggccacgaggagcccaucccuauguccaccuacggguggaaccucgugcgacugcagagcggcgucgacgucuuuuucaucccucccgagaaaugcgacacccugcucugcgacaucggggaguccagccccaacccgaccguugaggcgggccggacguuacgcguccugaaccucguugagaacuggcucaacaacaacacccaguucugcaucaaggugcugaaccccuacaugcccuccgucaucgagaagauggaggcccugcagcggaaguacggcggggcccucgugcguaacgacuugagccgaaacuccacccacgaaauguacugggugucaaacgcguccggcaacaucguauccagcgugaacaugaucucccguaugcugaucaaccgauucaccaugcgacacaagaaggcuaccuaugagccagauguggaccucgggaguggcacgcggaacaucgggaucgaguccgagauccccaaccuggacauaauaggcaagcgcaucgagaagaucaagcaggagcacgagaccagcuggcauuacgaccaagaccacccuuauaagacuugggcguaccacggcuccuacgagaccaaacagacggguagcgccuccagcauggucaacggcguggugagacugcucaccaagcccugggacguccugccgacagugacccaaauggcuaugacggacaccacccccuucgggcagcagcgcguguucaaggagaaggucgacacucgcacgcaggagcccaaggagggcaccaagaagcugaugaaaaucaccgccgagugguuguggaaggaauugggcaagaagaagacgccacggaugugcacucgugaggaguucacccggaaagugcgcuccaacgccgcgcugggggccauuuucaccgacgagaacaaguggaagagugcccgggaggccguggaggacagucgcuucugggagcucgucgacaaggagcggaaccugcaccuggagggcaagugugagaccuguguguacaacaugauggggaagcgggaaaaaaagcucggggaauucgggaaggccaaaggcagucgggcgauuugguacauguggcugggugcccgcuuccuggaguucgaggcccucggguucuuaaacgaggaccacugguucucacgggagaacagccuguccggcgucgagggggaaggacuccacaagcugggauacauccuacgcgacgugagcaagaaggagggaggcgccauguacgcggacgacacggccgggugggacacccggaucacccucgaggaccugaagaacgaagagauggugacuaaccacauggagggcgagcauaagaagcuggccgaagccauauucaagcucacguaccagaacaaagucgugcgcgugcagcggccgacgccacgagggaccguaauggacaucaucagccgccgcgaccagcggggcuccggccagguggggaccuacggccugaacacguucaccaacauggaggcccaacugauccgucagauggagggggagggcguguucaagaacauccaacaccucacggucaccgaggagguggcggugcagaacuggcuggcccgggucgggcgcgagcgccugagcagaauggccaucucaggugacgacugcguggucaaaccccucgacgaccgcuucgccaacgcacugacugcgcugaacgacaugggcaagauccggaaggacauccagcagugggaaccuagcaaggguuggaacgacuggacccaggucccguucugcucucaccacuuucacgagcuaaucaugaaggacggucgaguguuagugguccccugccggaaccaggacgaguugaucgggcgcgcccgaaucagccagggugccgguuggucccuucgagagacagccugucugggcaagagcuacgcccagauguggucacugauguacuuccaccggcgcgauuuacggcuggcggcgaaugccaucugcagcgccgugcccagucacugggucccuaccagccgcacgaccuggucuauccacgccaagcacgaguggaugaccaccgaggauaugcugaccgucuggaaccggguguggauccgcgagaacccguggauggaggacaagacgccaguggaaucaugggaggagauacccuaccucggcaagcgggaggaccaguggugcgggucccugaucggccugaccagcagggccaccugggccaagaacauccaggccgccaucaaccagguccggucccucaucgggaacgaggaguacaccgauuacaugcccagcaugaagcguuuccgucgcgaggaggaggaggcgggcgugcugugguga

SEQ ID NO: 25435 - RNA, 9876 nt, Artificial Sequence
  derived and/or modified CDS sequence (opt11) from DENV-2__JQ045686__SS-prME
ucagcagggaugauuaucaugcugauccccacaguuauggccuuucaccucaccacucgcaacggugagccccacaugauugucggaauucaggagaagggaaagagccugcuuuucaagacagaggauggcguaaacauguguacacucauggcgauggaccugggggaacugugcgaagacaccaucaccuauaagugcccccuccuacggcaaaaugaacccgaggacauugacugcuggugcaacagcacuuccaccugggugaccuacgggacaugcaccaccaccggugaacaccgccgggaaaagagaagcgucgcccuugucccccacguagggaugggccucgaaacccggaccgagacguggaugaguagugagggggcuuggaaacacgcccagcgcaucgagacuuggauacugcggcacccuggcuucacgauaauggccgucauccuggcguauacgaucgggaccacccacuuccagcgcgugcucaucuuuauacuucugaccgcgguggcaccgucgaugaccaugcggugcaucggaaucaguaaccgggacuucgucgaagguguguccgguggcagcuggguggacaucguccucgaacacggguccugcgucacaacgauggccaaaaauaaaccuacguuggacuucgagcugaucaagaccgaggcaaagcagcccgcuacucugaggaaguauuguaucgaggccaagcuuaccaacacgaccaccgagagccgaugcccaacucagggugaaccgucucugaaggaggagcaggacaagcguuucguauguaagcauagcauggucgacaggggaugggggaacggcuguggccuauucggcaaaggcgggauugugacgugcgccauguucaccugcaaaaagaacauggaggggaagaucgugcaaccagagaaccuggaguacacuauagucgugacuccccacuccggggaagaacacgccgugggcaacgacacgggcaagcauggccaggaaaucaaagugacaccgcagagcuccaucaccgaggcggagcugacuggguacggaaccgugacaauggagugcaguccccggaccggccucgacuucaaugagaugguguuacugcaaauggagaacaaggcauggcucguccacagacagugguuucuagaccuaccuuuacccuggcugccuggagcagacaagcaagagucuaacuggauccagaaggagacacuggugaccuuuaagaacccacaugccaagaagcaggacgucguugugcucggaucucaggagggggcgaugcacacggcgcugacaggcgcgaccgagauucagaugucuagugggaaccuccuauucacuggccaccuaaagugccgucuccgcauggacaaguugcagcugaagggaaugagcuacuccaugugcacggggaaguucaaggucgugaaggagaucgcggaaacucagcacggcaccaucguaauccggguacaguacgagggggauggcagcccuugcaagauuccauucgagaucauggaucuggaaaagcgcuacgugcugggcaggcugauaaccguaaauccgauagugacugagaaggauagcccagucaacaucgaagcagagccgcccuuuggagauucuuauauuaucaucggcgucgagccgggacagcugaagcugaacugguucaagaagggcucuagcauagggcagauguucgaaaccacgaugagaggcgcuaagcguauggcgauccuaggggauaccgccugggacuucgggucucugggcggagucuuuacgagcaucggaaaggccuuacaucagguauucggggcaaucuacggcgcggcguucuccggagugagcuggaccaugaagauucugaucggggucaucaucaccuggauuggcaugaacucccggaguaccuccuuaagcgugucccucgugcucguggggauugugacucuguaccugggcgugaugguacaggccgacagugggugcguggugucguggaagaacaaggagcuaaaaugcggcucaggcauauucaucaccgacaacguacacacauggaccgaacaguacaaguuccagcccgagagccccuccaagcuggcuagcgccauccagaaggcacaggaggaggggaucugcggaauccgcucugugacgcgacuggaaaaccucauguggaaacagaucacucccgagcuaaaucauauccuggccgaaaacgaagugaagcuuacuaucauaaccggggauaucaaagguaucaugcaggcagguaaacguagccugcggccacagccgacagaauuaaaauacuccuggaagaccuggggaaaggccaagaugcuuucgaccgaguccuacaaccaaaccuuucuaaucgacggcccugaaacggccgaaugcccgaacaccaacagggcguggaacagcuuggaggucgaggacuacggguucggaguuuucaccacuaacauaugguuaaaguugaaagagaagcaagacgcuuuuugcgacagcaaacugauguccgcagccaucaaggacaaucgcgccgugcacgcggacaugggauacuggaucgaaagugcuuuaaacgauacguggaagauugagaaggccagcuucaucgaaguuaagaacugccacuggcccaagucacacacccuguggagcaacggagugcuggagucugagaugaucauccccaagaaccuugcaggcccugugagccagcacaacuacagaccagguuaucacacgcagaucgccggccccuggcaccuagggaagcuggagauggauuucaauuucugcgacggaacaacugucaucgugacggaggauugcggcaaucggggcccuucucuccgcaccaccaccgcaagcggcaagcugaucacggagugguguugucggucguguacccugcccccgcugcgcuacagaggggaggacggaugcugguacgguauggagauucgcccccugaaagagaaagaggagaaccucguaaacagcuuagucaccgccggucacggccaggucgacaacuucucauugggcguucugggcauggcgcuguuccuggaggaaaugcugcgaacccgcgucgggacaaagcacgccauccuccugguggcgguguccuuugucacccuaaucaccggaaacauguccuucaaggaccucgggcggguuguggucauggugggcgccacaaugacugacgacaucgggaugggcgugaccuaucucgcgcuccuugccgccuucaaggugcgcccgaccuucgcggcuggccuucuccuccggaagcugaccucuaaggagcugaugaugacgaccauuggaaucguauugcuaucgcaauccacuauuccagagacgguuuuggagcuuacggaugcucuugccuuggggaugaugguccucaagaucgugcgcaacauggagaaguaccaacuggcugucaccaucauggcgauuuugugcguaccgaacgcggucauucuucagaacgccuggaaggucaguuguaccauacuagcagugguuagugucagcccccugcucuuaacuagcagccaacagaaaacagauuggaucccgcuggcccucaccauuaaagggcugaaccccaccgcuauuuuucucaccacacucucacgaaccaauaaaaagcggagcuggccgcugaacgaggccauaauggcgguggguaugguguccauccuggccucgucucuccuuaagaacgacauccccaugacaggcccccuggucgcaggcggguugcugaccguguguuacguucugacggggagguccgccgaccucgagcuugagcgggccaccgacgugaagugggaggaccaagccgagaucuccgggucaucgcccaucuuauccaucaccauuagcgaggacggauccaugucaauuaagaacgaggaggaagagcaaacucucacgauccugauccgcaccggacugcuugugaucuccggacuuuuuccgaucagcauccccaucaccgcagcggccugguaccugugggaggucaaaaagcagcgggccgggguccuaugggaugugcccagcccgccgcccaugggcaaggcugaguuagaggacggggcuuaccgcaucaagcagaaagggauacugggcuacagccaaauuggugcaggcguguacaaggaggggacuuuucacaccauguggcacguaacucggggcgcugugcucaugcacaagggcaagcgcaucgaaccguccugggccgacguaaaaaaggaccugaucagcuacggugggggauggaagcuggaaggcgaauggaaggaaggggaggagguccagguucucgccuuggagccggguaagaacccccgggccgugcagacaaaacccggccuguucaagaccaacaccggaacgaucggggcggucucccucgacuuuagcccuggcaccagcggcucuccuaucaucgacaagaaggggaaaguggugggccuguacggaaauggcgucgugacccgcuccggagccuacgugagcgcaauagcccagacugagaaauccaucgaagauaaucccgagaucgaggacgauaucuuccggaagcgacggcugacaauuauggaccugcaccccggcgcuggaaaaaccaagcguuaucuccccgcuauuguucgggaggccaucaagcgcggccugcguacuuuaauccucgcgcccacccgggugguggccgccgagauggaggaggcccugcggggacugcccauccgauaccagacgccugccauacgcgccgagcauaccgggcgcgaaauuguugaucucaugugccacgcuacuuucaccaugcgccugcuuagcccggugcggguaccgaacuacaaccucaucaucauggacgaggcgcacuucacggacccggccuccaucgccgcccgcggcuauaucaguaccagagucgagaugggcgaggcagcggggaucuucaugacagcuacgccaccgggcucacgcgaucccuucccacaaucuaacgccccaaucaucgacgaggagcgugagaucccggagcguagcuggaacaguggccacgagugggugacggacuucaagggcaagaccgugugguucgugcccagcauuaaggcuggaaacgacauagccgcgugccugcggaagaacggaaagaaggugauccagcuguccagaaagacauucgacagcgaguacguuaagacgcguacaaacgacugggauuucgucgugacaacggacaucucagagaugggcgcuaacuucaaagccgaaagggugaucgacccccgccgcugcaugaagcccgucauacugaccgacggggaggagcgggugauccucgcaggccccaugccggugacgcauagcagcgcggcccaacgccgggggcgcaucggccggaacccaaaaaaugagaacgaccaguacauuuacaugggggaaccccuggaaaacgacgaggacugcgcgcauuggaaagaggcaaaaaugcuacuggauaacaucaacacccccgagggaaucaucccgucaauguucgagccggagcgcgagaagguggacgcuaucgugggcgaguaccggcugaggggggaggcgcguaagacguuugucgacuuaaugcgccgcggcgaccugcccguguggcuggccuauaagguagcggccgaggggauuaacuaugccgaucgccgcuggugcuucgacgguaucaaaaacaaccaaauccucgaggaaaacauggaagucgagauuuggaccaaggagggagagcgcaagaagcucaagccucgcuggcuggacgcgaggauauauuccgacccccuugcccucaaggaguucaaagaguuugccgcgggaaggaagagucugacguugaaucugauaaccgagaugggccggcugcccacuuucaugacccagaagacaagagacgcucucgacaaccucgcgguccugcacaccgccgaggccgguggccgggccuacaaccaugcguuauccgagcugccggagacccuggagacccugcuacuccuaacgcugcuggcgaccgugacagggggcaucuuccucuuccugauguccggcagggguauuggcaagaugacccuggggaugugcugcaucaucaccgcuucuauucugcugugguacgcccaaauccagccucacuggaucgccgcgagcauuauccuggaguucuuccucaucguccugcuaauccccgaacccgagaagcagcgaacgccccaagacaaccagcugaccuacguaguuaucgcuauacugaccgugguggccgccaccauggcaaaugaaauggguuuccuggagaagacgaaaaaggaccucgggcugggcuccaucgcgacccaacagccagaguccaacauccuggacaucgaccuccgccccgccuccgccuggacacuauacgcgguggcuaccacguucgucacccccaugcugcgucacagcauugagaacucuuccgugaacgugagccucacggccaucgccaaucaggccaccgugcugaugggccuggggaagggcuggccccucaguaagauggacaucggagugccccugcuggccauaggcugcuacagccagguaaaccccaucacgcucacagccgcgcuacuacuccuuguagcccacuacgcaauuaucggcccaggucugcaagccaaggcaacccgcgaagcccagaaacgggccgccgccggcauaaugaagaaccccacgguugaugggauaacggucaucgaucucgacccgauuccguaugaccccaaguuugaaaagcagcugggccaggugaugcuguugguucugugcgucacacaaguucuaaugaugaggacgaccugggcgcucugugaagcccugacacuggccacggggcccaucucaacccucugggagggaaacccgggccgguucuggaauacuacgauagcagugagcauggccaacauauuccguggcagcuaccucgcgggugccggacuccucuucagcauaaugaaaaacaccaccaacacucggcgcggaacgggcaauaugggcgaaacgcugggcgaaaaguggaaaaguagacugaacgcacucgggaaguccgaauuucagaucuacaaaaaguccggaauucaggagguggaccggacgcuggcaaaggaagggaucaagcgcggcgagaccgaucaucacgccgucagccggggaucagcgaagcugcgcugguucguugagcggaauaugguaacucccgagggcaagguuguggaccuuggcugcgggcggggaggguggagcuacuacuguggcgggcucaagaacgugagagaggucaagggacugaccaagggcgggccggggcaugaagaacccaucccgauguccacguacggguggaaucucguucgccugcagucagggguggacguguucuucaucccucccgaaaagugcgacaccuuacucugcgacaucggggaauccagccccaauccgacgguugaagcggggaggacccugcgcguacugaaucucguggagaauuggcugaacaacaauacccaguucugcaucaaaguguugaaccccuacaugccgagugugauugagaaaauggaggcuuuacagcggaaguaugguggggcccucguccgcaauccgcugucacggaacucgacccacgagauguauugggucuccaaugcgucuggcaacaucguguccagcgugaauaugaucucccgcaugcugaucaaccgguucacuaugcgacacaagaaggcgacauaugagcccgacguggaccucgggagcgggacucggaacaucgggauugaguccgagauacccaaccuggauaucaucggcaagcgcauagagaagaucaaacaagagcacgagacgucauggcacuacgaccaggaccaccccuacaagaccugggccuaccacggcuccuaugagacgaagcagaccggcagcgccucuagcauggugaauggcgucgugcggcuucucacaaaaccaugggaugugcugcccaccgucacccaaauggccaugaccgauaccacucccuuugggcagcagcgcguguucaaggagaagguggacacgcgcacccaggaacccaaggagggcaccaagaagcugaugaagauuaccgcagaguggcuguggaaagagcuaggcaagaagaagacgccgcggaugugcacccgcgaggaguucaccaggaagguuagguccaaugcagcucuuggggccaucuucaccgacgaaaacaaauggaaguccgcucgggaggcgguggaggacucccgcuucugggaacuaguagacaaggagcggaaccuucacuuagagggcaagugcgagacgugugucuacaacaugauggggaagcgagagaagaaauugggcgaguuuggaaaggccaagggcucuagagccaucugguacauguggcugggcgcgcgcuuucucgaguucgaggcccucggguuuuugaacgaggaucacugguuuagucgagaaaacagucucucugggguagagggugagggccuccauaagcugggguacauccuccgcgacgugucuaagaaggagggcggagcgauguaugccgacgacaccgccgggugggauacucgggugacccucgaggaccugaagaaugaggagauggucacgaaccacauggagggcgaacacaagaagcuggccgaggcgaucuucaaacuuacauaccagaacaagguagugagagugcagcggccaaccccccggggcaccguuauggauaucaucucacggcgagaccaacguggcagcggccaagugggcacguacggccugaacacuuuuaccaacauggaagcccagcugauccgccagauggagggcgaaggcguguucaagaacauccagcauuuaaccgucacagaggaaguggcugucaagaacuggcuggcccgcguagguagggagcgauugagcagaauggcaaucuccggcgacgacugcgugguaaagccacucgacgaucguuucgcgaacgcccugacagcacugaacgacaugggcaagauacggaaagacauacagcagugggagccgucccggggauggaaugauuggacccagguccccuucugcucccaccacuuccacgagcucauuaugaaggacggcagggugcugguuguccccugccgcaaccaggaugaacuuauugggcgggcccgcaucagccaaggcgccggcugguccuugagagaaaccgccugcuuaggaaagagcuacgcgcagauguggucccucauguacuuccaccgccgggaccugcgccuggccgccaaugccaucuguucagcuguucccucccacugggugccgacgagccgaaccacaugguccauucaugccaagcacgaguggaugacgacggaggauauguuaacggucuggaaccguguguggauccgggaaaacccguggauggaagacaagaccccagucgaaagcugggaagagauccccuaccucggcaagagggaggaccaauggugcggaagccugaucggccugaccagccgcgccaccugggccaaaaacauccaagcagcgauuaaccaggugcgcucccucaucgggaacgaagaguauacggacuacaugccuagcaugaagcgguuccgucgcgaggaggaggaggcuggcgugcugugguga

SEQ ID NO: 25436 - RNA, 9876 nt, Artificial Sequence
  derived and/or modified CDS sequence (opt11) from DENV-2__KU094070__SS-prME
accgccggcaugaucauuaugcugauacccaccguaauggccuuccaucucacaacccggaauggggaaccccacaugaucgugagccggcaggagaaaggcaaaucgcugcuguuuaagacugaggacggggucaacaugugcacccuaauggcgauggacuugggcgaguggcuggaggacaagaucaccuacaagugcccccuccugcggcagaaugaacccgaggacauugacugcuggugcaacagcacauccaccugggugacauacgggaccugcaccaccaccggcgagcaucggcgugagaaacggagcgucgcccuggugccccacguaggcauggggcucgagacccguaccgagaccuggauguccagcgagggcgccuggaagcacgcccagcgcauagagaccuggauccugcgccauccgggguucacgaucauggcugcgauccuggccuacaccauaggcaccacccacuuccagagggcccuaaucuuuaucuuauugacggccgucgcgcccuccaugacaaugcgcuguaucgggauaagcaaccgggacuucguggagggcguguccggcgggaguugggucgacaucgucuuggagcacggcuccugcgugacuaccauggccaaaaacaagcccacgcuggauuucgagcugaucaagacugaggccaagcagccggcaacccuucggaaguacugcauugaggccaagcugaccaacaccaccaccgagagccggugcccgacucagggggaacccucacugaaugaggagcaggacaagcgauucguuugcaagcacucgaugguggaccgggggugggguaacggcuguggccucuucgggaaggggaguaucgugacgugcgcgauguucacgugcaagaagaucaugaaagggaaggucgugcagccggagaaucuggaguacacaaucguuauaacgccucacucaggcgaggagcaugcagucggcaacgauacggggaagcacggcaaagagauuaagauaaccccucaguccagcaucacugaagcggagcucaccggauacgggaccgugacgauggagugcagcccccggacugggcucgacuucaacgagaugguccugcugcagauggagaacaaggccuggcucguccaucggcagugguuccuggaucugccacucccuuggcugccgggcgccgacacgcagggcagcaacuggauccagaaagaaacccuggugacguucaagaacccgcacgcgaagaagcaggacguggucgugcucggcagccaggagggcgccaugcacaccgcccugaccggggccaccgagauccagauguccaguggcuaccugcuguuuacggggcauuugaagugccgcuuacggauggauaagcuccagcugaaaggcaugagcuacagcaugugcaccggcaaguucaaggucgucaaggagauagcggagacacagcacgggaccaucgugauccgcguccaauaugagggcgacgguucccccuguaagauaccguuugagauaauggauuuggagaagcggcaugugcucggccgccugaucacggugaaccccaucguuaccgaaaaggacagccccgugaacaucgaggcggagccucccuucggcgacuccuacaucauaauuggggucgagccaggccagcugaagcuaaacugguucaagaaagguagcuccauaggccagauguucgagaccacaaugcgcggggccaagcggauggccauccugggcgacaccgccugggauuuuggaagccuuggcggggucuucaccuccauugggaaggcccuccaccagguguuuggagcuaucuauggggccgcuuucagcggcguguccuggaccaugaagauucugaccggagucaucaucacguggaucgguaugaacagccgcuccaccucccuguccgugucgcucgugcucgucggcgccgugacccuuuaccuggggguaaugguccaagcggacuccggcugcguggugagcuggaagaacaaggagcucaagugcgggagcggcaucuucaucacggacaacguccacacguggaccgagcaguauaaguuccagccugagucccccuccaagcuggccucggccauccagaaggcccacgaggagggcaucugcggcauccggucuguaacccgccuggagaacuuaauguggaagcagaucacccccgagcuaaaccacaucuuauccgagaacgaggugaagcucacgauuaugaccggcgacaucaagggcaucaugcaggccgggaagcggucccugcgcccgcagcccacugagcugaaguacuccuggaagaccugggggaaggcgaagaugcucagcacagagucgcacaaccagaccuuccuaaucgacgggcccgagaccgccgaaugccccaacaccaaucgggccuggaacagucuagaggucgaggacuacggcuucgggguguuuacaaccaacauauggcucaagcugcgcgaggagcaggacguguuuugcgacuccaagcugaugagcgccgccauuaaagacaaccgggccguccacgccgacaugggcuacuggaucgaguccgcgcucaacgacaccuggaagaucgagaaagccuccuucaucgaggugaagucuugucacuggcccaagagccacacccuguggaguaacggggugcuggagagcgagaugaucauccccaagaacuuugccggccccgugagccagcacaacuaucgcccgggcuaccacacccagacggccggccccuggcaccucggcaaguuagagauggacuuugacuucugcgaggggaccaccguaguugucaccgaggacuguggcaaccgggggcccucuuugcgcacgaccaccgccagcggaaagcucauaaccgaguggugcugccgguccuguacgcuaccacccuuacgcuaucgaggcgaggacgggugcugguacggcauggagauccgcccccucaaggagaaggaagaaaaccucgugaacucguuggugaccgccgggcacggccagaucgacaauuucucccuugggguccugggcauggcccuguuccuggaggagaugcuccggaccagggugggcacgaaacacgcgaucuugcuaguggccgucagcuuugugacgcuaauuaccgggaacauguccuuccgggaucugggccgcgugauggucauggucggugccaccaugaccgacgacaucgguauggggguuacguaccuagcccuguuagcugcguucaaaguccgccccaccuuugccgccggacuccugcugcggaagcucaccucaaaggaguuaaugaugaccacuaucggcaucgugcugcuuucccaaagcaccauccccgaaaccaucuuggaguugaccgaugcccucgcccuggggaugauggugcugaagaugguccgaaagauggagaaauaccaacucgcggugacgaucauggccauucugugcgugccgaacgccgugauccugcagaaugccuggaagguguccuguacaauccucgccgucguaagugugagcccacuuuuccugaccuccucccagcaaaaggcggacuggaucccccucgcgcugaccaucaagggccugaaccccacggccaucuuccucaccacucugagucggacgaacaaaaagcgcuccuggccgcugaacgaggccaucauggccgucgggauggugagcauacuugccuccagccugcugaagaacgacauccccaugacgggcccccucguggccggcggauugcugaccgucugcuacguacucaccgggcggagugccgaccuggagcuggagagggccgcagacgugaagugggaggaucaggccgagaucuccgggagcucccccauauuaaguauaaccauuucugaggacggcagcaugucuauaaagaaugaggaggaggagcagacgcugaccauccuaauccggaccgggcuccuggucauuagcggccuguucccgguguccauucccaucaccgcagccgccugguaccucugggaggugaagaagcaacgcgcgggcguccugugggacgugccuaguccgccgcccguugggaaggcugagcuugaggacggcgcauaccguaucaaacagaaagggauccucggcuacucccagaucggggccggcgucuacaaggagggcacuuuccacacgauguggcacgugaccagaggggccgugcugaugcacaagggcaagcggaucgaacccagcugggcagacgucaagaaagaccugaucucuuacgggggcggguggaagcuggagggcgaguggaaggaaggagaggaaguccaggugcuugcccuggagcccgggaagaacccucgcgcgguccagaccaagcccggguuguucaagacaaacgcagggacgaucggcgccguuagccuugacuucucccccgggaccucuggcucccccaucauugacaagaaagggaagguggucggccuguacggcaacggaguggugacgcguuccggggcguacguaucugcuaucgcccagaccgagaaguccaucgaagacaacccugagaucgaggacgacaucuuccgcaagcggaaguuaacgaucauggaccugcauccuggcgccgguaaaaccaagcgcuaccugcccgcgauagugcgggaggccaucaagcgcggcuuaagaacacuuauccuggccccgaccagagugguagccgccgagauggaggaggcgcugcgggggcucccaauucgcuaccagaccccagccauccgcgccgagcacaccggccgugagaucguggaccugaugugccacgccaccuucaccaugcgccugcucucuccagugcgggugccaaacuacaaucugaucaucauggacgaggcccauuuuacggaccccgcuuccaucgccgcccgcggguauaucagcacacgaguggagaugggcgaggccgcaggaaucuucaugaccgcgacgccgcccgggucccgcgacccuuucccccaguccaacgcucccaucauggacgaggagcgggagauccccgagcgcucauggagcuccggccacgagugggucaccgacuucaaggggaagaccgucugguucgugccaucgaucaaagccggaaacgauaucgccgcgugccugcggaagaacgggaagaaggugauacaacucucccgcaagaccuucgacagcgaauaugucaagacacggaccaacgacugggacuucguggugaccaccgacaucuccgagaugggcgccaacuucaaggcggagcgcgucaucgaucccagacgcugcaugaagcccgugauccugaccgacggcgaggaacgggugacgcuggccggccccaugccggucacccacagcucggccgcgcagcgccgggggcgcaucggcaggaaucccaagaacgaaaacgaccaguacaucuacaugggcgagccccucgaaaacgacgaagacugcgcccacuggaaggaggcgaagaugcugcuggacaacauuaacacccccgaggggaucaucccgagcauguucgagcccgagcgcgagaagguggacgccaucgacggcgaguaccgccuccguggggaagcccgaaaaacauucguggaucugaugcggcgaggggaccugcccgucuggcucgcguaccggguggccgcggaaggaaucaacuaugccgaccgucguugguguuucgaugggauuaagaacaaucagauccuggaggagaacguggaggucgagaucuggaccaaggagggcgaacgcaagaagcugaagccucgguggcucgacgcacgcaucuacuccgacccccuggcucugaaggaguucaaggaauuugccgccggacgcaaaagccucacccugaaccugauaaccgaaaugggccgccuccccaccuucaugacgcagaaagcccgggacgcguuagacaaccuagccgugcuccacacggcugaggccggcgggcgagccuacaaucacgcguuauccgaguuacccgagacccucgagacccugcugcuucugacgcugcucgcuaccgucaccggugggaucuuccuguuccugaugagcggccggggaaucgggaagaugacccucggcaugugcugcaucaucacggcguccauucugcucugguacgcacagauccaaccucacuggaucgcugcaagcaucauccucgaguucuuccugaucgugcuacucauccccgagcccgagaaacagcgcacuccccaggacaaccagcuuacauauguggucaucgccauacugaccgugguggccgccaccauggccaacgaaaugggguuccucgagaagacgaagaaggacuugggccuggggagcaucaccacccaacagccggaguccaacauucucgacaucgaccugcggccugcgagcgccuggacuuuauacgccguugccacgaccuucgugacccccaugcuccggcacuccaucgagaacagcuccgugaaugucagccugacugccaucgcgaaucaggccacggugcugaugggcuuaggcaagggauggccccuguccaagauggacaucggaguaccacugcucgccaucggaugcuacagccaggucaauccgauuacccugaccgcagcauuauuccucuuaguggcccacuacgccaucaucggccccggacugcaagccaaagcgacccgugaggcucagaaacgcgccgccgcugguaucaugaagaacccaacggucgauggcaucaccguuauugaccucgauccgauccccuacgacccgaaguucgaaaagcaguugggccaagugaugcugcucguacugugcgucacccaggugcugaugaugcggaccacgugggcccucugcgaggcguuaacccuugcgacgggccccaucucgacccucugggaggggaaccccggccgcuuuuggaacaccaccaucgccguuagcauggccaacaucuuccgcgggucguaccuggccggcgcaggccuccuguucagcaucaugaagaacaccaccaacacgcggcgcgggaccggcaacaucggggagacccugggcgagaaguggaagucaaggcugaacgcccucggcaagagcgaguuccagaucuacaagaaguccgguauccaggagguagaccgcacccuggccaaggagggcauuaaacgcggggagacggaucaccacgccgugagucgcggcucugcgaagcugcggugguuuguugagcgcaaccucgucacuccugaggggaaggugguggauuugggcugcggccgcggaggguggagcuacuacugcggcgggcugaagaacguccgcgaggugaaggggcucaccaagggagggcccgggcaugaggagcccaucccgauguccaccuacggcuggaaccuggugcgacuucagagcggggucgacguuuucuucacgccgccagaaaagugcgacacccucuuaugcgacauuggcgagagcaguccaaacccgaccguggaagccgggaggacccugcggguccucaaccugguggagaacugguugaacaacaacacccaguucugcaucaaggugcucaacccguauaugcccagcguaaucgagaagauggaggcccugcaacggaaguauggcggugcccugguaaggaauccgcugucccgcaacagcacccacgagauguacugggugucgaaugcgagcgggaacaucgucuccagcgugaacaugaucucccggaugcucaucaaccgcuuuaccaugcgacacaagaaggcgaccuacgagcccgauguggacuuaggaagcgguacucgcaacaucgggaucgaguccgaaaucccaaaccuggacaucaucgggaagcgcauagagaagaucaagcaggagcacgagaccagcuggcacuacgaccaggaccaucccuacaagacaugggcguaucacggcuccuacgaaaccaaacagaccggcagcgcuucuagcauggucaacgggguggugcggcuccugacgaagccaugggacgucguacccauggugacccaaauggcaaugaccgacaccacacccuuuggccagcagcgcguauucaaggagaagguggacacacggacccaggagcccaaggaggggaccaagaagcugaugaaaauuacggccgaguggcucuggaaggaguugggcaagaagaagaccccucgcaugugcacgcgggaagaguucacccgcaaggugcggucuaacgcggcacugggggcaaucuuuacggacgagaacaaguggaaguccgcccgcgaagccgucgaggauucaagguucugggagcucguugacaaggagcgcaaccugcaccuggaggggaagugcgagaccugcgucuacaauaugaugggcaagcgggaaaagaaacucggggaguucgggaaggcaaaagggagccgcgccauuugguacauguggcugggcgcccgguuccuggaguucgaggcccucggcuuccugaaugaggaucacugguucagccgcgaaaauucccugucggggguggagggcgaagggcuccacaagcugggcuacauccugcgggacguauccaaaaaggaaggcggugcgauguacgccgacgacaccgcuggcugggacacccgcaucacccucgaggaccugaagaacgaggagaugguaaccaaccacauggagggggagcauaagaaacucgccgaggccaucuucaagcucaccuaccagaacaaggugguucggguccagcgcccaacgccccggggcacggugauggacauaauuagccgccgggaucagcgcgguucuggacaggugggcaccuacggccugaacacguucaccaacauggaggcgcaguuaaucagacaaauggaaggcgagggggucuucaagagcauccagcaccucacggugaccgaagagauugccgugcagaacuggcuggcccgggucggccgcgagcggcugagccgcauggccaucucaggggacgauugugugguuaagccucuugacgaccgguucgccuccgcgcugaccgccuugaacgacauggggaaaguccgcaaggacauccagcagugggagccgagccggggcuggaacgacuggacacaggugcccuucugcucccaucacuuccacgaacucauaaugaaggacgggcgcgugcuagucgugcccugcagaaaccaggacgagcugauaggccgcgcccggaucagccagggggcuggcuggucccuccgcgagacggccugcuugggaaagucguaugcacagauguggagucugauguacuuccaccggcgggaucuccggcuggcggccaacgccaucuguucagccgugccuucccauugggucccgacuucccgcaccacuugguccauccacgcgaagcacgaguggaugaccacggaagacaugcugaccguguggaaccggguguggauccaggagaaccccuggauggaggacaagacacccgucgaguccugggaagagaucccuuacuuaggcaagcgagaggaucaguggugcggcucccugaucgggcugaccucccgggugacguggggcaagaacauccagacugccaucaaccaggugcgaagccucaucggaaacgaagaguacaccgacuacaugccguccaugaaacgcuuccggcgcgaagaggaggaggccggcguccucugguaa

SEQ ID NO: 25437 - RNA, 9876 nt, Artificial Sequence
  derived and/or modified CDS sequence (opt11) from DENV-2__FM210215__SS-prME
agcgcggggaugaucgugaugcuaauccccaccgugauggccuuccacuugaccacccgcaacggggagccccacaugaucgucggcauccaggagaaggggaagucccugcuguucaagaccgaggacggcgugaacaugugcacccucauggcgauggaccugggggagcugugcgaggacacuaucaccuacaagugcccccuccugcggcaaaacgagcccgaggacaucgauugcuggugcaacagcacgaguaccugggucaccuacgggaccugcaccaccaccggcgagcacaggagagagaagcgcagcguggcccuugugccccacgucgggaugggccucgagacccggaccgaaacuuggaugucuagcgagggggccuggaagcacgcccagaggauugagacguggaucuuacggcaccccggcuucaccauaauggccgcgauacuggcauacaccaucgggaccacucacuuccaacgaguccucaucuucauccuccuaacggccguggcccccuccaugacaaugcggugcaucggcaucagcaacagagacuucgucgagggagugucugggggcagcuggguggacauaguacucgagcacggcucuugugugaccaccauggcgaaaaauaagcccacgcuggacuucgagcuaauaaagaccgaagcgaagcagcccgccacccuccggaaguauugcaucgaagccaagcuaacaaauacaaccaccgagagcagaugccccacccagggcgagcccucccugaaggaggagcaagacaagcgguuuguuugcaagcacagcauggucgaccgaggcugggggaauggcugcggccuguucggcaagggcgggaucgugacuugcgccauguucacgugcaagaagaacauggagggcaagaucguucagcccgagaacuuagaguacaccaucguugugacgccgcauucaggggaagagcacgccgugggcaacgacacggggaagcacggcaaggagauaaaggucaccccucagagcuccauuaccgaggccgagcugaccggauacggcacagugacgauggaaugcagcccgagaaccggccuggacuucaacgagauggugcugcugcagauggagaacaaggccuggcucgugcaucgccagugguuucuggaucugccacuccccuggcugccaggugcagauaagcaggagucuaacuggauccagaaggagacucuggugaccuucaagaacccccaugccaagaagcaggacgucguggugcugggcagccaggaaggggcgaugcacacggcccugacgggcgccaccgaaauucagaugagcuccgggaaccucuuguucaccggccaccugaagugccggcugcgcauggacaagcuccagcugaaaggcaugagcuacucgaugugcacgggaaaguucaaggucgugaaggagaucgccgagacacaacacggcaccaucgugauucggguccaguacgagggggacggcagccccugcaagauccccuucgaaaucauggaccuugagaagcgcuacgugcucggccggcugaucaccgugaacccgauugucacggagaaggacucccccgugaacaucgaggccgagccgcccuucggugacuccuacaucaucaucggcguggagccggggcagcugaagcucaauugguucaagaagggcucgagcaucggccagauguuugagaccaccaugcgcggcgcgaagcgcauggccauacucggcgacaccgccugggacuuuggaucccugggcggcgucuucacaagcaucggcaaggcccuccaccagguguucggggccaucuauggcgcggccuucucaggcgucagcuggaccaugaaaauacugaucggggucaucaucaccuggaucggcaugaacuccagaagcaccucccugagcgugucccuggugcugguugggaucgugacguuauaccugggcgucaugguccaggccgauagcggguguguggucagcuggaagaauaaggagcucaagugcggcagcggcaucuucaucaccgacaacguccacacguggaccgaacaauacaaguuccagcccgagucgccauccaaguuagccagcgcuauccagaaggcccaggaggaggggauuugcggcauucgcuccgugacgcgguuggagaaccugauguggaagcagaucaccccagagcugaaccacauccuggcggaaaaugaggugaagcuaacaaucaugacaggggacaucaagggcauuaugcaggccgggaaacgcagccugcggccgcagcccacggaacugaaguacucauggaagaccuggggcaaggccaagaugcucagcaccgaguccuacaaccagaccuucuuaaucgacggcccggagacggcggagugcccgaacaccaaccgcgccuggaacagccuggaggucgaggauuacggguucggcguguucaccaccaacaucuggcugaagcugaaggagaagcaggacgccuucugcgacucaaagcugaugagcgccgccaucaaggacaaccgggcugugcaugccgacaugggcuacuggaucgaguccgcccucaacgacacguggaagaucgaaaaggccagcuucaucgaggucaagaacugccacuggcccaaaucccacacccuguggagcaacggcgugcuugaguccgaaaugaucauccccaagaaccucgccggccccgugucacagcacaacuaccguccgggguaccacacccaaaucgcggggcccuggcaccuggggaagcuggagauggacuucgacuuuugcgacgguaccacugucaucgugacggaggacugcgggaaccggggccccagccuccgcaccaccacggccagcggcaagcuaaucacggaguggugcugccggagcugcacccugcccccgcuccgcuaccgcggggaggacggcugcugguacgggauggagaucaggccccugaaggagaaggaggagaaccuggucaacagccucgucaccgccggccacggccagguggacaacuucagccuaggcguguuaggcauggcccuguuccuggaagagaugcugcggacccgcgucgggacgaagcacgcgauucuccugguggccgugaguuucgucacccugauuaccggcaacauguccuucaaggaccucgggcgggucguagugauggugggcgccaccauggccgacgacaucgggaugggagugacguaucuggcccugcucgcggccuucaagguccgccccaccuucgccgcgggccuucugcuucggaagcugaccuccaaggaguuaaugaugaccacgaucgggaucguguuacugagccagaguaccauccccgagacggugcuggaguuaaccgacgccuuggcgcugggcaugauggucuuaaagaucgugcgcaacauggagaaguaccagcuggccguuacgaucauggccauccugugcgugccuaacgcugugguccuccagaacgccuggaaggugagcugcaccauccuggcuguggucucggugagccccuuacuccugaccaguucgcagcagaagaccgacuggauuccccuggcccucacgaucaagggccugaacccgaccgccaucuuccuaacaacccucucccgcacgaacaagaagcgcagcuggccgcugaacgaggcgaucauggcugugggcauggucuccauccuggccagcagccuccugaagaaugacauacccaugaccggcccccugguggccgggggccuacugaccgugugcuacguccugaccgggcgcuccgccgaccucgagcucgagaaggccacggacguuaagugggaggaccaggcggagaucaguggcagcagccccauccuguccaucaccauaagcgaggauggguccaugaguaucaagaacgaggaagaggaacaaacgcucaccauccugauccggacgggccugcucgugaucucgggccuguucccuaucagcauccccauaaccgccgccgccugguaccugugggaggugaagaagcagcgcgccggggugcucugggacgugcccagcccgccgcccaugggcaaggcggagcuagaggacggggccuaccggauuaagcagaagggcauccugggguacagccaaaucggcgccggcgucuacaaggaggggaccuuucacaccauguggcacguuacccguggcgcggugcucaugcacaaggggaagcgaauugagcccaguugggccgacgucaaaaaggaccugaucagcuacgguggggguuggaaguuagagggugaguggaaggagggcgaggagguccagguacucgcgcuggagcccggcaagaacccccgcgccguccagacgaagcccgggcuguucaagaccaacaccggcaccauaggggccgugagccucgauuucagccccggcacauccggcagccccauaaucgacaagaaggggaagguagucggucuguacggcaacggcguggugacccgguccggggcuuaugugucagccaucgcgcagaccgagaaauccaucgaggauaaccccgagaucgaggacgacauauuccgcaagcggcgcuuaaccaucauggaucuccaccccggggcaggcaagacgaagcgguaccuccccgccaucgugcgcgaagccaucaagcgggggcugcgaacccugauccucgcgccgacccguguagucgccgccgagauggaggaagcccugcgcggccugcccauccgguaccagacucccgcaaucaaggcagagcacacggggcgcgagaucguggaccucaugugucacgccaccuucaccaugcggcugcugagccccgugcgcgucccgaacuacaaccucaucaucauggacgaggcccacuuuaccgaucccgcauccaucgccgcccgcggcuacaucagcacgcggguggagaugggcgaggccgccgggaucuucaugaccgcuacgccgcccggcagcagagacccguucccccagucuaaugcccccaucaucgacgaggagcgggagauccccgagcgcagcuggaacagugggcaugaguggguaacggacuucaaaggcaagacggucugguucgugccgagcaucaaggcgggcaacgacaucgccgccugccugcggaagaacggcaagaaggugauccagcugucccgcaagaccuucgacagcgaguacguaaagacacggaccaacgacugggacuucguggugacgaccgacaucuccgagaugggcgccaacuuuaaggcggagcgcgucaucgacccccggcggugcaugaagcccgugauccucaccgacggggaggagcgggugauccuggccggccccaugccggucacgcacagcuccgccgcccagcgccgggggcgcaucggccggaaccccaagaacgaaaacgaccaauacaucuacaugggggagccgcuggagaacgacgaggacugcgcccacuggaaggaggcgaagaugcuacuggacaacaucaauacgcccgaggggaucaucccuagcauguucgaacccgagcgcgagaagguugacgccaucgacggcgaguaccggcugcgcggggaggcccguaagaccuucguggaccucaugcgccguggcgaccugcccgucuggcuggcauacaagguggccgcggaggggaucaacuaugccgaccggagauggugcuucgacggcaucaagaauaaccagauucucgaggagaacgucgagguggaaaucuggaccaaggagggggagcggaagaaguuaaagccgagauggcuggacgcccggaucuacuccgacccccuagcccugaaagaguucaaggaguucgccgcaggccguaagucccugacccucaaccugaucacugagaugggccggcugccaaccuucaugacucagaagacccgggaugcccucgacaaucuggcaguguugcacacagccgaggccgguggucgggccuacaaccacgccuuauccgagcugcccgagaccuuagagacccuccugcugcucacccucuuggccacggucaccgggggcaucuuccuguuccugaugaguggccgcgggaucggcaagaugacccuaggcaugugcugcaucaucaccgcuuccauacuccugugguacgcgcagauucagccucacuggaucgccgccagcaucauccuggaauucuuccucaucgugcugcugauccccgagcccgagaagcaaaggacgccccaggacaaccagcucacguacguggucaucgccauccugaccgugguggccgcuaccauggccaacgagaugggcuuccuggagaagacgaagaaagaccucgggcugggcuccaucgccacgcagcagccggagagcaacauccuggacaucgaccuccgccccgccuccgccuggacacuguaugcggucgccaccaccuucgugacgcccaugcucaggcacagcaucgagaacagcuccgugaacgucagccugaccgccaucgccaaccaggccaccgugcugaugggccuggggaagggguggccccucagcaagauggacaucggaguuccguugcuggcuaucggcugcuacagccagguaaacccuaucacccucacggccgcccuacugcuacugguggcucacuacgcgaucauaggccccggccugcaggccaaggccacaagagaggcccagaagcgggccgcggccggcaucaugaagaaccccaccguggacgggauuaccgucaucgaccucgacccgaucccauacgaucccaaguucgaaaagcagcugggccagguuaugcugcuuaucuuaugcgugacgcagguccugaugaugcguaccaccugggcccucugcgaggcacugacccuggcaacagggccuaucuccacccucugggagggcaacccgggucgguuuuggaacacaaccaucgcggugagcauggccaacaucuuccgcggcucguaccuggccggcgccgggcuccuguucagcauaaugaagaacacgaccaacacccggcgcggcacagggaauaucggcgagacucugggugagaaguggaaguccagacugaacagccucggcaaguccgaguuccagaucuacaagaaguccggcauccaggaaguggaccgaacccucgccaaggaggggaucaaacgcggcgagaccgaccaccacgcggucucccgggggagcgccaagcuacgcugguucgucgagcgcaacaugguaacccccgagggcaaaguuguggaccucgguugcggccgcggcgggugguccuacuacuguggugggcuaaagagcgugcgggagguaaagggccugacgaaaggcgggccaggccaugaggaacccaucccgaugucgaccuacggguggaaccucguucgccugcagagcggcguggacgucuucuuuaucccgcccgagaagugcgacacccugcucugcgacaucggggaguccagccccaaucccaccguggaggccggccggacguuacgcgugcugaaccucguagagaauuggcugaacaacaauacccaguucuguaucaaggugcugaaccccuacaugccuagcguaaucgagaagauggaggcccugcagagaaaguacggcggggcgcucgugcggaacccgcugucccggaacagcacccacgagauguacuggguguccaacgcaagcggcaacaucgucuccagugucaacaugaucagucgcaugcugaucaaccgguucacaaugcgccauaagaaggccaccuacgagcccgacguggaccucgggagcggaacgcgaaauaucgggaucgaguccgagauccccaaccuugacaucaucggcaagcgcaucgaaaagaucaagcaggagcacgagaccucauggcauuacgaccaggaccaccccuacaagaccugggccuaccacggcucguacgagaccaagcaaacagggagcgccuccagcauggugaacggagucguucggcugcucaccaagccgugggacgugcuccccaccgucacgcagauggccaugacggacacgacccccuucgggcagcagcgcguguucaaggagaagguggacacccggacccaggagccaaaggagggcaccaagaagcugaugaagaucaccgccgaguggcucuggaaggagcugggcaagaagaaaaccccgcgcaugugcacgcgggaggaguucacucgcaagguccgcuccaacgccgccuugggggccaucuucaccgacgagaauaaguggaagucggcgcgggaagccguggaggacucccgcuucugggagcuuguugacaaggaacggaaccugcaucuggagggcaagugcgagaccugcguguacaacaugauggggaagcgcgagaagaagcucggcgaguucgggaaggccaagggcagccgggccauaugguacauguggcugggugcccgauuccucgaguucgaggcgcucggguucuuaaacgaggaccacugguucucccgggagaacagccugaguggcguagaaggggaaggccuccauaagcugggguauauccugcgcgacgucuccaagaaggaaggcggcgccauguacgccgacgauacagcggggugggacacccgaaucacucucgaggauuuaaagaaugaagaaauggugaccaaccacauggaaggcgagcacaagaagcuugcggaggcuauauucaaacucacguaucagaacaaagucguccgcgugcaacggcccacgcccaggggcaccgugauggacauaaucagccggcgugaccagcguggguccgggcagguaggcacauacggccucaacacguucacgaauauggaggcccagcugauccgccagauggagggggaggggguguucaagaacauccagcaccucacgguuaccgaagaggucgccgugcagaacuggcuggcccgggugggccgcgagcggcugagucguauggcgaucucuggcgacgauugcgucgugaagccccucgacgaccgcuucgccaaugcccugacggcccugaacgacaugggcaagauccggaaggacauucagcagugggagccgagcaagggguggaacgacuggacccaggugcccuucugcucccaccacuuucacgagcucaucaugaaggacggccgcguccugguggugcccugccggaaccaggacgagcugaucgggcgcgcccggauaagccaaggcgcgggguggucccucagagaaacagccugccugggaaagagcuacgcccaaauguggagccugauguacuuucaccggcgcgaccuccgguuggccgccaaugcgaucugcagcgccguccccucccacugggugccgacaagccgcacuaccugguccauccacgccaaacacgaguggaugaccaccgaggacaugcugaccguguggaauagggucuggauccgcgagaaccccuggauggaggacaagacgcccguggagagcugggaggagauccccuaccucggcaagcgggaggaccaguggugcggaucccugaucgggcugaccagccgcgccaccugggccaagaacauccaggcggccaucaaccaagugagguccuugauagggaaugaggaauauaccgacuacaugccguccaugaagcgcuuccggcgcgaggaggaggaggccggagugcugugguaa

SEQ ID NO: 25438 - RNA, 9876 nt, Artificial Sequence
  derived and/or modified CDS sequence (opt11) from DENV-2__FM210216__SS-prME
agcgccgggaugaucaucaugcugauccccaccguaauggcuuuccaucucaccacccgcaacggggagccccauaugaucgucggcauccaagagaagggcaagagccugcuguucaagaccgaggacggcguuaacaugugcacccucauggcaauggaccugggcgagcugugugaggacaccauaacauacaagugcccccuccugcgccagaacgagcccgaggacauugauugcuggugcaacagcacuuccacaugggugaccuaugggaccugcaccaccacgggcgagcaccgccgugagaagcgcagcgucgcccuggucccccacguggggaugggccucgagacccggaccgagaccuggauguccagcgaaggggccuggaagcacgcgcagcgcaucgagaccuggauacugcggcacccgggcuucacgauuauggcggcgauccuggccuacaccaucgggaccacccacuuccaacgcguccucaucuucauacugcugacggcuguggcccccuccaugaccaugcgguguaucggcaucagcaaccgcgacuucguagagggcgucucggggggcagcuggguagacaucguuuuagagcacggguccugugucaccacaauggcgaagaacaagcccacgcuggacuucgagcugaucaagaccgaagccaagcagcccgcgacccugcgaaaauacugcaucgaggcgaagcugacuaacacgaccacggagagccgaugcccuacccagggcgagcccucccucaaggaggagcaggacaagcgguucgugugcaagcacuccaugguggaccgcggcugggggaacggcugcggccuguucgguaaaggagggaucgucacuugugccauguuuacgugcaagaagaacauggagggaaagaucgugcaacccgagaaccucgaguacaccauuguggucacgccucacuccggggaggagcacgcggugggcaacgacacagggaagcacggcaaggagauuaaggucaccccgcaauccuccauuaccgaggccgaauugaccggguacggcaccgucacgauggagugcagccccagaaccggacucgauuucaacgaaaugguccugcugcagauggagaacaaggcauggcucgugcaccgucagugguuccuggaucuccccuuacccuggcugccgggggccgacaagcaggaguccaacuggauccagaaagaaacccuggucaccuucaagaacccccacgccaagaagcaagacguggucgugcucggcagccaggaaggagcgaugcacacggcccuaacaggcgcgacggagauccagaugagcuccgggaaucucuuauuuacgggccaccugaaaugucggcugcgcauggauaagcuccagcugaaggggaugagcuacuccaugugcacggggaaguuuaaagugguuaaggagaucgccgagacccagcacggcacuauagugauccgggugcaguaugaaggggauggcagccccugcaaaauccccuucgaaauaauggacuuagagaagagauacguccucggccgucugaucaccguuaacccuaucgugacggagaaagacucccccgucaacaucgaggcggagccgcccuucggggacaguuacaucaucauuggcguggagccgggucaguugaaguuaaacugguucaagaagggguccagcaucggacagauguucgaaacgaccaugaggggcgcgaagcgcauggccauccucggggacaccgcgugggacuucgggucccugggcgggguguucacgagcaucggcaaggcccuccaccaggucuucggugccaucuacggcgcggcauucucugggguuagcuggaccaugaagauccugaucggggugaucaucaccuggaucggcaugaacucccggagcaccucccugagcgucucccugguacucguggggaucgucacguuauaccugggcgugauggugcaggccgacagcgggugcgucguguccuggaagaacaaggagcucaaguguggcagcggcauauucaucaccgacaacgugcacaccuggacugagcaguacaaguuucagcccgagagccccucuaagcuggccagcgcgauccagaaagcccaggaggaggggauuugcgggauccguuccgucacucggcuggaaaaccucauguggaagcagaucacccccgaguugaaccauauccuggccgagaacgaggugaaguugaccaucaugaccggggauauuaagggcaucaugcaggccggaaagcgcagccugcguccccagcccacggagcugaaguacuccuggaaaaccugggguaaggcuaagaugcucagcaccgagagcuacaaccagaccuuccugaucgacggucccgaaacuaccgagugcccgaauaccaaucgugcguggaacagccuggaggucgaggacuacggguuuggcgucuucaccacgaacaucuggcucaagcugaaggagaagcaggacgccuucugcgacuccaagcugaugagcgcugccaucaaggacaaccgggcggugcacgcggacauggguuacuggaucgaaucugcccucaacgauaccuggaagaucgagaaggcgagcuucauugaggucaagaacugccauuggcccaagucccacacccuguggagcaauggcguacuggaguccgagaugauaauccccaagaacuuggccggccccgugagccagcacaacuaccgcccgggguaccacacacaaauugcgggccccuggcaucuggguaagcuggagauggacuucgacuuuugugacgggaccaccgugaucgucaccgaagacuguggcaacagaggccccucgcuccguaccaccacggcgaguggcaagcugaucacagaguggugcuguagaaguugcacccugcccccgcuccgcuaccgcggggaggacggcugcugguaugggauggaaauccgcccccuuaaggagaaggaggaaaaccuggugaacucccucgugaccgccggccacgggcaggucgacaacuucagccuuggcguucugggcauggcgcucuuccuggaggaaaugcuucgaacacgcgucgggaccaagcaugccauccuccugguagcggugucuuucgugacccugaucaccggcaauaugagcuucaaggaccucgggcgggucguggugauggucggcgcuacgauggccgacgacaucgggaugggcgugaccuacuuagcacugcucgccgcguucaaggugcgccccaccuucgcugcaggccugcugcuccggaagcuuacuuccaaggagcucaugaugacgacaauuggcauaguccuauuaagccaguccaccaucccggagaccgugcuggagcucacggacgcgcuggcauuaggaaugaugguccucaaaauuguccgaaacauggaaaaguaccagcuggcggugaccaucauggccauacugugcgucccgaaugcgguuauccuccagaacgccuggaagguuagcugcaccauacuggccgucguguccgugagcccccugcuccugaccucaagccagcagaagacggacuggaucccccuggcgcucaccaucaagggguugaaccccaccgccaucuuccuuaccacgcucucccgcacuaacaagaagcggagcuggccacugaacgaggccaucauggccguugggaugguguccauccuggcgucuucgcuccugaagaacgacauacccaugaccggcccccugguggccgggggccugcuuaccgucugcuacgugcugacggggcgcagcgccgaccucgagcuggagcgggccaccgacgugaagugggaggaccaggccgagaucagugggagcagccccauccugucuaucaccauuagcgaggacggcuccaugaguaucaaaaaugaggaggaggaacagaccuuaacgauccugauccgcaccggccuacucgucaucaguggccuguucccuaucucaauccccauuacagcggcagccugguaccugugggaggugaagaagcagagagccggggugcucugggacguccccagccccccgcccaugggcaaggccgagcuggaggacggggcguauaggauuaagcaaaagggcauccugggguauagccagauaggcgccggaguguacaaggaagggaccuuccacaccauguggcacgugacucggggugccguacuaaugcacaaggggaagcgcaucgaacccuccugggccgacgugaagaaggaccugaucagcuacggcgggggauggaaacucgagggcgaguggaaagagggggaggaggugcagguccucgcccuggagcccggcaagaaucccagagcggugcagacaaaacccggauuauucaagaccaacaccgguacgaucggagccgugucccucgacuucucgcccgguaccuccgguucgcccaucaucgacaagaaggguaaagucgugggccuguacgggaacggcgugguaacucgcuccggggcauacgucagcgcgauagcccagaccgaaaaauccaucgaggacaaccccgagaucgaggacgacaucuuccggaagcgccggcugaccaucauggaccugcaucccggggcaggcaagaccaagcgcuauuuacccgccaucgugcgggaggcgaucaaaagggggcuucguacccucaucuuagccccgacccgcgucguggcugcggagauggaggaagccuuacggggccugccuauccgcuaccagacgcccgccauacgcgccgagcacaccgggcgcgagaucguggaccuuaugugccaugcgaccuucaccaugcgccugcugagccccguacggguaccgaacuacaaucuaauaaucauggacgaggcccacuucacugaccccgccuccaucgcugcccgcggguacauaagcacccggguagagaugggcgaggcggccgggaucuuuaugaccgcaacgccgccaggcagcagagacccguucccccaguccaacgccccaaucaucgacgaagaacgggagauccccgagcgcagcuggaacuccgggcacgagugggucacggacuucaagggcaagaccguuugguucgugccaagcaucaaggcggggaacgacaucgcggccugcuugcggaagaacggcaagaagguuauccagcuaucccgcaagacauucgacagcgaguacgugaagacccggacgaacgacugggacuucguggucacaaccgacauauccgagaugggagccaacuucaaagccgagagggugaucgauccacgucgaugcaugaagccagugauccucacggacggugaggagcggguuauccuggcuggccccaugccugugacgcacaguuccgcugcccagcgccgagggcggaucggccggaaccccaagaacgagaacgaccaguacaucuacaugggggagccccuggaaaacgacgaggacugugcccacuggaaggaggcuaagaugcuccuggacaacauaaacacacccgaaggcauuauccccagcauguucgagcccgagcgggaaaaaguggacgcgaucgauggcgaguaccggcuucguggggaggcacgcaagaccuucgucgaucucaugcggcgcggcgaccugcccguuugguuggccuacaagguggcugccgaggggaucaacuaugcggaccggcgcuggugcuucgacggcaucaagaacaaccagauccucgaggaaaacgucgagguggagaucuggaccaaagagggcgaacggaagaagcugaagccgcgcuggcuggaugcacggaucuacuccgauccccucgcccugaaggaauucaaagaguucgccgccggucgcaagagccugacgcucaaccugaucaccgaaaugggccggcugcccaccuucaugacccagaagacgcgcgacgcgcuagacaaucuggccguccuacacaccgcggaggccgggggccgggcguacaaccacgcacuuuccgagcugcccgagacucuggagacccucuugcuacucacgcugcuggccacagucaccgggggaaucuuucuauuccugaugucuggccgcggcaucggcaagaugaccuuagggaugugcuguauaaucaccgccuccauacuccugugguacgcccaaauccagccgcacuggaucgcggccagcaucaucuuagaguucuuccucaucgugcugcugauccccgagccagagaagcagcggacgccccaggacaaccagcuaaccuacgucgugaucgccauccucaccgugguagcagcuacuauggcgaacgagaugggcuuccuggagaagacgaagaaggaccuaggccugggcaguaucgccacccagcaaccggagagcaacauccuggacaucgaucuuagacccgcguccgccuggacacuguacgccguagcgacuaccuucgucacccccaugcugcggcacagcaucgagaacagcagugucaacgugagccucaccgcgauugccaaccaagccaccguccugaugggauugggcaagggcuggccccucuccaagauggacaucggcguaccguuacuggccaucggcuguuacucucagguuaaccccaucacgcucaccgcggcgcugcuacuccucguagcccacuacgccauuauagggcccggccugcaagcgaaggccaccagggaggcacagaagcgggccgcagcgggcaucaugaagaacccaacggucgacgggauuacggugaucgaccucgaccccauacccuacgaccccaaguucgagaagcagcugggccagguuaugcuacucauccugugugucacccaggugcuaaugaugcgcaccaccugggcccucugugaagcccugacgcuggccacggggccuaucucaaccuuaugggagggcaacccggggcgguucuggaacaccacgauagccgugagcauggcgaacaucuuucgcggcuccuaccuggcuggcgccgggcuccucuuuagcaucaugaagaacaccaccaauacccggcgaggcacggggaacauaggggagacccugggcgagaaguggaagucgcgccugaacgcccuugggaaguccgaguuccagaucuacaaaaaaucaggcauucaagaggucgaccggacccuggccaaggaggggaucaagcgcggcgagaccgaccaccacgcggugucgcggggcuccgcuaaguugcgcugguucguggagcggaacauggucacgccggaaggcaaagugguggaccucggcugcggucgcggcggcuggaguuacuacugcggcgggcugaagaacgugcgggaggugaaaggccugacgaagggcgggccagggcacgaggagccuaucccgaugucuaccuauggguggaaccugguacgccugcagagcggggucgacguguucuucaucccgcccgagaagugcgacacccugcucugcgauaucggggagucaagccccaauccgacgguggaggccggccggacccugcgcguccuaaaccucgucgagaacuggcugaacaauaacacccaauucugcauuaaggugcugaaccccuacaugcccucggucauagagaaaauggaggcgcugcaacggaaguacggcggggcacucguacgcaacccgcugagccggaacuccacgcaugagauguacuggguaaguaaugccuccggcaacaucguaucaucugucaacaugauaucucgcaugcucaucaaccgcuucaccaugcgccacaagaaggccacguacgagccagacguggauuuggggucaggcacccggaauaucgggauugaauccgagauccccaaccuggacaucaucggcaagcgaaucgaaaaaaucaagcaggaacaugagaccagcuggcacuacgaccaggaccaccccuacaaaaccugggccuaccacggcuccuaugagaccaagcagaccgggagcgcuuccagcauggucaacggcguagugaggcugcuuaccaagccgugggacguccugcccaccgugacacagauggcuaugaccgauaccacucccuucggacagcaacgcguguucaaagaaaaagucgacacacggacgcaagagcccaaggagggcacaaagaagcugaugaagauaaccgccgagugguuguggaaggaacuggggaagaagaagacgccaagaaugugcacccgcgaggaguuuacgcggaaggugcgcuccaacgcggcccugggggccaucuucaccgacgagaacaaguggaaguccgcgcgggaggccguggaagacucccgguucugggagcucgucgacaaggagcggaaccugcaccuggagggcaagugcgagacgugcgucuauaacaugauggggaaaagggagaaaaagcucggcgaguucgggaaggcaaagggcagccgggccauaugguacauguggcugggcgccagguuccuggaguucgaggcgcucgguuuccugaacgaggaucacugguucagucgggagaacagccuguccggcgucgagggggagggccuccacaagcugggguacauucugcgcgacgugagcaagaaggaggggggcgccauguacgccgacgauaccgcugggugggacacccggaucaccuuagaggaccugaagaacgaggagauggugacgaaccacauggagggcgagcacaagaagcuagcggaggccaucuucaagcucaccuaccagaacaaggucguacgcgugcagcgaccuacgccccgugggaccgucauggauaucaucagccggcgcgaccagcggggcagcggccaggugggaacguacggccugaacaccuucacaaacauggaggcucagcugauccgucagauggagggggagggcguauuuaagaacauccagcauuugaccgucacggaggagguggcaguucagaacuggcuggcccggguugggcgcgagcgccugagcagaauggcgaucuccggcgaugacugcguggugaagccccucgacgaccgcuucgccaacgcccugaccgcccugaaugacaugggcaaaauccggaaggacauccagcagugggagccgucgaagggguggaaugacuggacccagguccccuucugcucccaccauuuccacgagcuuaucaugaaggacggccgcguucugguaguccccugcagaaaccaggacgaacugaucggacgcgcgcggaucagccagggcgcgggguggucccuccgagaaacugcuugcuugggcaaaucguacgcccagauguggucccugauguacuuccaccggcgcgaucuccggcuggcggcaaacgcaaucugcagcgcuguccccucucacuggguaccgacgagccgcaccacuugguccauccacgccaagcacgaguggaugaccacagaggauaugcugacggucuggaaccggguuuggauccgcgaaaaccccuggauggaggacaagacacccguggagagcugggaggagauaccuuaucucggcaagagggaggaccaauggugcgggagucugauuggccugaccagccgcgccaccugggccaagaacauccaggcggccaucaaucaaguacggucccucaucgggaacgaggaguauacggauuauaugccgagcaugaagcgcuuucggcgcgaggaagaggaagccggcguccugugguga

SEQ ID NO: 25439 - RNA, 9876 nt, Artificial Sequence
  derived and/or modified CDS sequence (opt11) from DENV-2__FM210217__SS-prME
accgccggcgugaucauuaugcugauccccaccgccauggcguuucaccucacuacccggaacggugagccccauaugaucgucggccggcaggagaaaggaaaaucccugcuguucaagaccgaggacggcgugaacaugugcacccucauggccaucgaccugggggagcugugcgaagacacgaucaccuauaaaugcccccuccugcgccaaaacgagccugaggauaucgacuguugguguaacucgacgucuaccugggugaccuaugggaccugcaccaccacaggcgaccaccggcgcgagaagcgguccgucgcccuggugccucacguggggaugggccucgagaccaggaccgagaccuggaugagcuccgaaggggcguggaagcacgcacagagaaucgagaccuggauccugcgccacccgggguucacuaucauggcagccauccuggccuauaccguugggaccacccacuuucagagagcccucauuuucauccuacuggcggccguggcuccgagcaugaccaugcgaugcaucggaaucuccaaccgggacuucguggagggagucagcgggggcagcuggguugacaucgugcuugaacaugggagcugcguaaccacuauggccaagaacaagcccacccuggacuuugagcucaucaagaccgaggcuaagcagcccgcgaccuugcgcaaguacugcaucgaggccaagcugaccaacacgaccaccgagucccggugcccgacgcagggagagcccagccuuaacgaggagcaagacaagcgcuucguaugcaaacauagcaugguugaucgggggugggggaacgguugcgggcuuuucggcaagggcgggaucgucacgugcgccauguuuacgugcaagaaaaacauggaggguaagaucguccaacccgagaaccuggaauacaccaucgugaucacgccccauagcggugaggagcacgcagucggcaacgacacgggaaagcacggcaaggagauuaagaucaccccgcaguccccaaucaccgaggcagagcugaccggauacggcaccgugaccauggagugcagcccccgcaccggccuggacuuuaaugagauggugcuguugcagauggaggacaaggcguggcugguccaccggcagugguuccuggaccugccucucccguggcugccuggggccgacacccaaggcuccaacuggauacagaaggagacucuggugacguucaagaacccccacgccaagaagcaagacguugucguccucggaagccaagagggcgccaugcacaccgcccugaccggggcgacugagauacagauguccagcggcaacuugcuguuuacgggccauuuaaagugccgccugcggauggacaagcuccaacugaaggggaugagcuacagcaugugcaccggcaaguucaaaaucgucaaagagauagccgaaacucagcacggcacaauugugauccgcguccaauaugaaggcgacggcucucccugcaagaucccguucgaaaucauggaucuggagaagagacacgucuuagggcgccugauuacagugaacccuaucgugacggagaaggacuccccggucaacauugaggccgagcccccguucggcgacuccuacaucaucaucgggguagagccggggcagcugaaacucaacugguucaagaagggguccagcaucggucaaauguucgagacuacgaugcgcggcgcaaagcguauggccauccugggggacacggcgugggauuuuggcucccucggaggggucuuuaccucuaucgggaaagcgcuucaccaggucuucggggcuaucuacggcgccgcguucuccggugugagcuggaccaugaagauucugaucggcgugaucaucaccuggaucggaaugaacucccgcagcacgucccugucggucucccuggugcucgugggggucaucacccuguaucuaggggcaauggugcaagcggacagcggcugcguggucagcuggaagaacaaggagcucaagugcggaagcggcaucuucauaaccgacaacgugcacacguggacggaacaguacaaguuccagcccgaguccccaagcaagcuggcauccgccauccagaaagcgcacgaggaggggaucugugggauucgguccgugacgcgccuggagaaucuuauguggaagcagaucaccccggagcugaaccacauacugagcgagaacgaggucaaauuaaccauaaugacaggcgacauaaaggggaucaugcaggccggcaagcggucccuacgcccccagcccacugagcugaaguauagcuggaagacgugggguaaggccaagaugcucagcacugagagccacaaucagacguuccuuaucgacgggccagagaccgcagagugccccaacacaaacagggccuggaacucccuggagguggaagacuacgguuuugggguuuucacaacgaacaucuggcuuaagcuccgugagaagcaggaugucuucugcgacagcaaacugauguccgcggccaucaaggacaaccgugccgugcacgccgacaugggcuacuggauugagagcgcccucaacgacaccuggaagauggagaaggcguccuucauagaggucaagucgugccauuggccaaagucccacacccuguggaguaauggcguccuggagucagagaugaucauccccaagagcuucgccggcccgguuucccagcacaauuaccgcccaggcuacuacacgcagaccgccggucccuggcaccucggcaagcuggagauggacuuugauuucugugaagggacgaccguugucguaaccgaggauugugguaaccggggccccagccugcgcaccacgaccgccucggggaagcucaucacggaauggugcugccgguccuguacccugccuccccugcgcuaucggggcgaggacgggugcugguacggaauggagauccgaccacuaaaggagaaggaggagaaccuagucaacagccuggucacggcgggucacggucagauugacaacuuuucccucggcguacuggggauggcccuguuccucgaagagaugcugcggacaagaguaggcaccaaacacgccauacugcucguggccgugagcuucgugacccuaaucacggggaacaugucauucagggaucugggucgcgucauggugauggugggugccgcuaugaccgacgacaucggcaucggcguaacguaccuugccuugcuggcugccuucaaggugcgccccaccuuugccgcgggcuuacugcuacggaaacucacgagcaaggagcugaugauggccaccaucgggaucgcccugcuuucccagagcaccaucccggagaccauacuggagcugacggacgcccucgcacuggguaugauggugcugaagaucguccgcaacauggagaaauaccagcucgcggugaccaucauggccauaucaugcgugcccaacgccgucauccuccagaacgccuggaaaguuagcugcacuauccuggcgacaguuagcgucagcccccuccugcugaccuccagccaacagaaagccgacuggauaccucucgcccugacuauaaagggccucaacccgaccgccaucuuccucaccacgcugagucggaccagcaagaagcgcuccuggccacugaacgaggccauuauggcggugggcauggucagcauccuugccuccucccuacugaagaacgacauccccaugacggggccccucguggccgguggcuuguugaccguaugcuacguccucacgggccggagcgccgaucuugagcuggagcgcgccaccgauguuaagugggaggaccaggcagagauaaguggaagcaguccgauccucucgauaaccaucgccgaggauggcucuaugagcauuaagaaugaagaggaggagcaaacucugacgauccugauucggacaggccuccuggugaucuccgggcuguuccccgugagcauccccaucaccgccgcagcuugguaccucugggaggugaagaaacagcgcgcgggggugcugugggacguccccucucccccgccgguagggaaggcugagcuggaggacggcgcguaccggauaaagcagaaggggaucuugggcuacagccagaucggcgccggcguuuacaaagagggcacuuuccacaccauguggcacguaacaagaggugccguccugaugcaccggggcaagcgcaucgagccgagcugggcagauguaaagaaggaccugauuagcuacgggggaggcuggaaguuagagggggaguggaaagagggcgaggagguucaggugcucgccuuggagccagggaagaacccccgggccgugcagaccaaaccaggccucuuuaagaccaacaccgggacgaucggugccguuucccuggacuucagcccggggaccucagggagccccaucguggaccgcaagggcaagguggucggucuguacggcaacgguguggugacccggucgggcgcguacguaucugccaucgcccagaccgaaaagucgaucgaggacaaccccgagauagaggacgauaucuuccgcaagaaacggcucacgauuauggaccugcaccccggcgcagggaaaaccaagcgguaccuccccgccaucgugcgggaagcgaucaagcgcgggcugcggacccucauccuggcccccacacgcguggucgccgccgagauggaggaggcucuccgcggguugcccauacguuaccagacgccggcgauccgagcggagcauacaggccgggagaucguggaccugaugugccacgccaccuucaccaugcgccugcucagccccguccgggucccgaacuacaaccugaucaucauggaugaagcccacuucacggaucccgccagcauugcggcccgcggcuacaucuccacccgcguggagaugggugaggccgccggcaucuucaugaccgccacacccccugggagcaaagaucccuucccgcaguccaacgcccccaucauggaugaggagcgcgagauccccgagcgcagcuggaacucuggccacgaaugggugacggacuucaaggggaagaccgucugguucgugccgagcaucaaggcaggaaacgacaucgccgccugccuaaggaagaacggcaagaaggucauccagcucucccggaaaaccuucgacagcgaguacgucaagacccgcacaaacgacugggacuucguggugaccaccgauaucuccgagaugggggcgaacuucaaggcggagcgggugaucgacccccggcggugcaugaaacccgugaucuugacagacggcgaggagcgcgugauucuggccgggccgaugccagucacgcacagcuccgcagcccaaaggcgcggcaggauagggcgcaaccccaagaacgaaaacgaccaguacauuuacaugggcgagccucucgaaaacgacgaagauugcgcgcacuggaaggaggccaaaauguugcuggacaacaucaacaccccggagggcaucaucccgagcauguucgagcccgaacgcgagaagguagacgcuauugauggggaauaccggcuccgcggugaggccagaaaaaccuucguagauuuaaugcgccgcggggaucuuccggucuggcuugccuaccgcguggccgccgagggcauuaacuacgccgaccggcgcuggugcuucgauggggugaagaacaaccagauccuugaagagaauguugagguggagaucuggaccaaagaaggugagcggaaaaagcugaagccccgcuggcucgacgccagaaucuacuccgauccccuggcgcuaaaggaguucaaggaguuugcugccggcaggaagucacugacguugaaccugaucaccgagauggggcggcuccccaccuucaugacccaaaaggccagagaugcccuagacaaccuggcaguccuccacacggccgaggccggugggcgggcguacaaccacgcccugagugagcuacccgagaccuuagagacccugcuguugcugacccuccucgcuacggucaccggaggaauuuuccucuuccugaugagcgguaagggcguggggaaaaugacgcucgggaugugcugcaucaucaccgccagcauccugcuguggcacgcccagauccagccccacuggaucgcagccagcaucauccucgaguucuuucucauugucuuacucaucccggagccugagaagcagcgcaccccgcaagacaaccaguugacguacguggugaucgcgauccuaaccguaguggccgccaccauggccaacgagaugggguuccuggagaagaccaagaaggaccucggccuggguuccaucgcgacccaggagcccgagagcaacauuuuagacaucgaucuucgcccagcgucugccuggaccuuguacgcuguggccacgaccuucgugacgccgaugcuccgccacuccaucgaaaauucuuccguuaacguuucccugaccgcgaucgccaaccaggccaccguccugauggggcucggcaagggguggcccuuaucaaaaauggacauuggcgugccccugcuggccaucgggugcuacagccagguuaaccccaucaccuugacggccgcgcuacuccuacuggucgcccauuacgccaucaucggccccggccuccaggccaaggccacacgggaggcacaaaaacgcgcugccgccgggaucaugaagaacccgaccguugacgggaucaccgugauugaccucgaucccauccccuacgaccccaaguucgagaaacagcucgggcaagucaugcuccugauccugugcgugacccaggugcuaaugaugcggaccaccugggcacugugcgaggcgcugacccucgccacgggcccgaucagcacccugugggagggaaaccccgggcgcuucuggaacaccacuaucgcagucagcauggcgaacaucuuucgcgggucguaccuggcgggggccggccuccuguuuagcaucaugaaaaacacaaccaacacccggagggggacaggaaacauuggcgagacuuugggugaaaaguggaagucccggcucaacgcacugggcaagagcgaguuccaaaucuacaagaaguccgggauucaggagguggaucggacccuggccaaggaaggcaucaaaaggggugagacggaccaccaugcaguaagccgcggcucggcgaagcuccggugguucgucgagagaaacauggucaccccugagggcaaagugguugacuuagggugcggaagaggaggcuggagcuacuauugcggcggccugaaaaacgugagggaggucaagggccuuacgaaaggcggccccggccacgaggaaccgauccccaugucuacguacggcuggaaccugguccggcuacaguccgggguagauguuuucuucacgccgccagaaaagugugacacccuccugugcgacaucggagaguccagcccgaaucccacuaucgaagcuggccgaacccugcggguucugagccugguggaaaacugguugaacaacgauacucaguucugcaucaaggugcugaaccccuauaugccguccguaaucgagaaaauggagacccugcaacgaaaguacgguggggccuuaguaaggaacccgcuaagccgcaacuccacccacgaaauguacugggugagcaaugccacgggcaacauagucuccagcgucaacaugaucucacgaaugcucaucaaccgcuucaccaugaagcauaagaaggcuaccuacgagcccgacguagaccuggguucgggcacccggaacauaggcaucgagucagagauacccaaccuggacaucauaggcaagcgcauagagaaaaucaagcaggaacacgagaccagcuggcacuacgaccaggaccacccguauaaaacuugggcguaccacgggagcuacgagaccaagcagacuggcucggccucgucgaugguaaacggagugguacgccuccugacgaagcccugggacgucguacccauggugacccagauggccaugaccgauaccacccccuucgggcagcagcgugucuucaaggagaagguggacacccgcacccaggagcccaaggagggcaccaagaagcugaugaagauaacggccgaguggcucuggaaagaauuggggaagaagaagacgccccggauguguaccagggaggaguucacccggaaggugcgcuccaacgcggcucugggcgcgaucuucacggacgagaacaaguggaaaagcgcacgggaggccgucgaggacucccguuucugggagcucguagacaaggagcggaaucuacaucuggaggggaagugcgagacaugcguguacaacaugaugggcaagcgcgagaaaaagcuaggugaguucggcaaggcgaaaggcagccgggccauaugguacauguggcuuggggcccgcuuccuggaguucgaggcgcucggauuccugaacgaggaccacugguucagccgagagaacagccuaagcggagucgagggcgagggcuuacacaagcugggcuacauccugcgagacguguccaagaaggagggcggagccauguacgcggacgauaccgccggcugggauacgcggaucacguuagaggaccuuaagaacgaggagauggucaccaaccacauggagggggagcauaagaagcuggccgaggccaucuucaagcucacauaccaaaacaaggugguucgcguccaacggcccacgccccgggggacggugauggauaucauuagccgccgcgaucagcggggguccggccaaguuggcaccuacgggcugaacaccuucaccaacauggaggcccagcugauccgccagauggagggcgaggggaucuucaagagcauacagcaccucacggcuaccgaggaaaucgcaguccagaauuggcuggcucgcguaggccgggagcgccucucccgcauggccaucagcggugacgacugcgugguuaagccucuagaugaccgcuucgccuccgcucuaaccgcccucaaugauaugggcaaggugcgaaaggacauccaacagugggaacccagccgcggcuggaacgauuggacccagguucccuucugcucccaccacuuccacgaguuaaucaugaaggacgggcgggugcuggucgugcccugccgcaaccaggacgagcugaucggccgugcccgcaucucgcagggggccggcuggucccucaaggagacggccugcuuaggaaagagcuacgcacagauguggucccugauguauuuccaccggcgugaccuccggcuggccgcuaacgccauuugcagcgcggucccgucccauugggugcccaccagccgcaccacaugguccauccaugcaaagcacgaguggaugaccaccgaggauaugcugaccguuuggaacaggguauggauccaggagaaccccuggauggaggacaagacgcccguugagaguugggaggaggugccguaccucgggaagcgcgaggaccaguggugcgggagucuuaucggucugacuucccgagccacgugggcaaagaacauccagaccgccaucaaccagguccggucgcucaucggcaacgaggaguacaccgacuacaugccgucaaugaagcgguuccgccgcgaggaggaggaggcgggggugcuuugguag

SEQ ID NO: 25440 - RNA, 9876 nt, Artificial Sequence
  derived and/or modified CDS sequence (opt11) from DENV-2__JX286524__SS-prME
acggcgggcgugaucguuaugcugaucccuaccgccauggcguuccaucucaccacacgcaacggggaaccccacaugaucgugggccggcaagagaaggggaagucucugcuguuuaagaccgaggacggcgugaauauguguacucuuauggcgaucgaccugggggaacugugcgaggacaccaucacauauaagugcccauuacuaaggcagaaugagcccgaggacaucgauugcuggugcaacuccacguccaccugggugaccuacgggaccuguacgaccacaggcgagcaccggcgugaaaaacgauccguggcccugguaccacacgucgguaugggccucgagacccgcaccgagaccuggaugagcagcgagggggccuggaaacacgugcaacgaauagagaccuggauccugcgccacccuggcuucaccaucauggccgccauccuggccuacaccaucggcaccacacacuuccagcgggcccuaaucuucauccugcucaccgccguugcgccuagcaugaccaugcguugcaucggcauuucaaaccgggacuucguagagggcgugagcggaggauccuggguggacaucgucuuagaacacggaagcugcgugaccacgauggccaaaaacaagcccacccucgacuucgaguugaucaaaacggaggcgaaacaacccgccacucuccgcaaguacugcaucgaagccaagcuuacgaauacuaccaccgagucccggugcccgacgcagggcgagccaagccucaacgaagagcaggacaagcgcuucaucuguaagcacuccaugguggauaggggcugggguaaugguugcggucuguucggcaaaggcggcaucgugacuugcgcaauguucacaugcaagaagaauauggaggggaagaucguucagcccgaaaaccuagaguauaccauugugaucacgccccacucgggugaggagcacgccgucggcaaugauaccgggaagcacggcaaagagauaaagauuacgccucaguccagcaccaccgaggcagagcugacgggguacggcaccgugaccauggagugcagcccccggaccggccuagacuucaacgagaugguccugcugcaaauggaggauaaagccuggcucguccaccgucagugguuccuggaccugccacugccauggcugccgggggccgacacgcagggcagcaacuggauccagaaggagacccuggugaccuucaagaacccccaugcgaagaagcaagaugugguagugcucgguucccaggagggggcaaugcacacugcccucacgggagccaccgagauucaaaugagcagcgggaaccuccuuuucaccggccaccugaaguguagacugcggauggauaaauugcagcugaaggggauguccuacagcauguguacgggcaaguucaagaucgucaaggagaucgcggagacgcagcacgggaccaucgugauccgcgugcaauacgagggcgacggcucccccuguaaaauccccuucgagaucaccgaccuggagaagcggcauguccucgggcggcugaucaccguuaacccaaucgugacggagaaggacagcccagucaacauagaggcggagccgccuuucggcgacuccuacaucauugugggcguggagccgggccagcugaagcucaacugguucaagaaggggagcuccauuggucaaauguuugagaccaccaugcguggugccaagcgcauggccauacugggggacaccgccugggacuucggaagcuuggguggcguuuucacgucuaucgggaaggcccuccaccagguguucggggcaaucuacggcgcagcuuucagcggagucuccuggaccaugaagauccugaucggcgucaucauuaccuggaucgggaugaacagcaggucuaccagcuuguccgugagccuggugcucguaggaguggugacgcuguauuuaggagccaugguacaggccgacuccggaugcauugugagcuggaagaacaaggaacucaagugcgguagugggaucuucaucaccgacaacguacacacguggaccgaacaguauaaguuccagcccgaaagcccuuccaaguuggccagcgccauccagaaggcccacgaggaggggaucugcgggauccggagcgucacacgguuagagaacuuaauguggaaacagaucacccccgagcuuaaccacauacucucggagaacgaggugaagcucaccaucaugaccggcgacaucaaggggaucaugcaggccggcaagcggagccugcgcccgcagcccacggaguugaaguacuccuggaagacguggggaaaagcuaaaaugcucagcaccgagucccauaaccagaccuuccuaaucgacggacccgagacggccgagugcccuaacaccaaccgggcguggaacagccuggagguggaagacuacggguucggagucuuuaccacgaauauuuggcucaagcugcgcgagaagcaggacguguucugcgacagcaagcugaugagcgcagccaucaaggacaaccgggcggugcacgccgacaugggcuacuggaucgaauccgcccucaacgacaccuggaagauggagaaggccagcuucauagaggucaaguccugccauuggcccaagucacacacguuaugguccaacggcgugcuggagagcgagaugaucauccccaaauccuucgccgggcccgugagccaacacaacuaccgcccugguuaccacacccagaccgcggggcccuggcacuugggcaaauuggagauggauuucgauuuuugcgaggggacaacggucgucgugaccgaggacuguggcaacaggggacccagcuugcgcacgacaacggcuuccgggaagcucaucaccgaguggugcugucggucauguacccuucccccgcucagguacaggggcgaggaugguugcugguacggcauggaaauccgcccgcucaaggagaaggaggagaacuuggucaacagccuggugaccgcaggacacggccagaucgacaacuuuagcuugggcgugcuggggauggcucuguucuuggaagaaauguugcggacgagagucggcaccaagcacgcgauccugcucguggcccugucguucgugacgcugaucacaggcaauaugagcuuucgggaccucggccgcguaauggugaugguaggggccacgaugaccgacgacauaggcauggggguaaccuaccuagcccugcucgcagcguucaagguucgaccuacauucgcagccgggcuguuauugcgaaagcugacgucuaaggagcugaugauggcuacgaucggcaucgccuugcugucgcaguccacgcugcccgagaccauucuugagcugacggaugcgcuggcccucgggaugauggcccuaaagaucgugaggaacauggagaaguaccagcuggccguaaccauuauggccaucuccuguguaccgaacgcagugaucuuacagaacgcauggaaggucuccugcacuauacuggccgcugucagcgugagcccccugcuccugacgagcucccagcagaaggcugacuggaucccccuggcgcuuacgaucaagggccugaaccccaccgccauuuuccugaccacccucagccggacguccaagaagcgcucuuggccauugaaugaggcgaucauggccguggguaugguguccauuuuggcgagcucguuacugaaaaacgacauccccaugaccgggccccuggucgccggcgggcuccucaccgucugcuacguucugaccggacgguccgccgaccucgagcuggagcgcgccgccgacgucaagugggaagaccaggcggagaucagcggguccagcccuauccuuuccauaacuaucuccgaggacggcuccaugagcaucaagaacgaggaggaggagcaaacccucaccauccugauccggaccggccugcucgugaucuccggggucuucccggucagcauccccaucaccgcugcugccugguauuuaugggaggucaagaagcagcgcgccggcgugcugugggacgucccaucaccgccgccaguggggaaggcggagcuugaggauggcgccuauagaauaaaacagcgggggauccucggcuacagccaaaucggcgccggaguguacaaagaaggcacguuccauaccauguggcaugucacccgaggggccgugcugaugcaucgcggcaagcguaucgagcccuccugggccgacgugaaaaaggaucucaucagcuacgggggcggcuggaaguuggagggggaguggaaagagggcgaagaaguucaggugcuggcccucgaacccgggaagaacccccgcgccguccagaccaagcccggcaucuucaaaacaaacaccgggacuauuggagccgugagccuggacuuuagccccgguaccagugggaguccuaucguagaccggaagggcaaggugguggggcuguauggcaacggcgugguuacgcgcucaggggccuacgucucagcgaucgcgcagacugagaaguccauugaggauaacccugagaucgaggacgacauuuuucggaaaaagcgccucaccaucauggaccuccaucccggcgccggaaagaccaagcgguaccugcccgccaucguacgcgaagccaucaagcggggacugaggacgcuaauccuagcgccgacccgugugguugccgccgagauggaggaagcccugcgcgggcugcccauccgcuaccagacccccgcuauccgggcggaacauaccggucgcgagauuguggaccugaugugccacgcuacuuucaccaugcggcugcucucccccguucgcgucccgaacuacaaccugaucaucauggacgaggcccacuucaccgaccccgcgagcaucgcggcgcggggcuacauuucaacccgcguugagaugggagaggccgcaggcaucuucaugacggccacgccgccgggaagucgugacccguucccccaguccaacgcgcccaucauggaugaggagcgcgaaauccccgaacguagcuggaacuccggccacgagugggugaccgacuucaaagggaagaccguuugguucguacccagcaucaaggccggcaaugauaucgccgccugucuucgcaagaauggcaaaaaggugauccagcucucccggaaaacuuuugauuccgaguacgucaagacgcgcgcgaacgacugggacuucgugguaaccaccgacaucucggagaugggggcaaacuucaaggccgagcgggucaucgacccccgccggugcaugaaacccgugauucugacggauggcgaggagcgcgugauccuugccgggcccaugccggucacccacagcuccgccgcucaacggcgcggccgaaucgggcggaaccccaaaaacgagaacgaccaguacaucuauaugggcgaaccccucgagaacgacgaggacugcgcacauuggaaggaggcaaagaugcuuuuagauaacaucaacaccccugagggaaucaucccguccauguuugagcccgagagagaaaagguggacgcgaucgacggggaguaccggcuccguggcgaagcccggaagaccuucguggaucugaugaggcgcggggaccugccugucuggcucgccuacaaaguagcggccgaaggcaucaacuacgccgaccgaaaguggugcuucgacgggaucaagaacaaccagauccuggaggaaaacguagaggucgagauauggacgaaggagggcgagcgcaagaagcugaagccgcgcuggcucgacgcccggaucuacuccgacccccuugcgcuaaaggaauucaaagaguucgcagcgggacggaagucgcucacccugaaucugaucaccgagauggggcggcuccccacauuuaugacccagaaagcccgcaacgcccuggacaaccucgcaguacuccacaccgcugaggugggcggcaaagccuacacccacgccuuguccgagcugcccgagacccucgagacacugcuacuacugacccuccuggcugcggucaccggcggaaucuuccuguucuugaugucagggaagggaaucgggaagaugacccucggcaugugcugcaucaucacagcguccaucuuauuaugguacgcacagauccagccgcacuggaucgccgccagcaucauccuagaguucuuucugaucgugcuacucauccccgagccagagaagcaacgaacgccccaggacaaccaacuaacuuacgucgugaucgcgaucuugaccguagucgccgccaccauggccaacgagaugggguuccucgaaaagacgaagaaggaucugggcuucggcagcaucaccacgcaagaguccgagagcaacauccuagauaucgaccugcgaccggcuuccgcguggacccuguaugccguggcaaccaccuucgugacccccaugcugagacacagcaucgagaacagcagugucaacguuagccucaccgcaauagcgaaccaagccacggugcugaugggucuggguaagggguggcccuuaagcaagauggacaucggaguccccuuauuggccaucgggugcuacucccaggugaaccccaucacucuuacugccgcgcugcugcucuuaguggcucacuacgccaucaucgggcccgggcuucaagcgaaggccacccgagaggcccagaagcgggcggccgccgggaucaugaagaaccccacggucgacggcaucaccgugauugaucucgagccaaucccguacgaccccaaauuugaaaagcaacuggggcaggucaugcuguuaauacugugcgucacccaggugcugaugaugcgcaccacgugggcccucugcgaggcccuuacccuggcgacuggucccaucucaacccucugggaggggaaucccggucgguucuggaauacuacuaucgccguguccauggccaacaucuuccgcggcagcuaccuggcuggggcgggccuccuguucuccauuaugaaaaacaccaccaauacgcgccgggggaccgguaacguaggcgagacccugggggagaaguggaagucccgccugaacgcccuugguaaguccgaauuccagaucuacaagaagucugggauccaggagguggaccggacucuggccaaggagggcaucaagcguggagagacggaccaccacgccgugucccggggcucggccaaguuacggugguucguggaacggaacauggucaccccggagggcaagguagucgaucucggguguggccgcgggggaugguccuauuacuguggcggccugaagaacguucgggaggugaagggccugaccaagggugggcccgggcacgaggagcccaucccaaugagcaccuacggcuggaaccucguccgccuccagagcggaguggacguauucuucacuccgccggagaagugcgauacccucuugugcgacaucggcgaguccagucccaaccccaccaucgaggcgggcaggacucugcgcguccugaaccucguggagaacuggcugaacaacaacacccaguucuguauuaaaguguuaaauccguacaugcccuccgucaucgagaagauggagacgcuucagcgaaaguacgggggagcucuggugcgcaacccccugucacggaauuccacccacgagauguauugggugucuaacgccacagggaacaucguauccagugugaacaugaucucccgaaugcugauuaaccgguucaccaugaagcauaaaaaagcaacguacgaacccgacguggaccucgggagcgggacccgcaauauagguaucgagucagagauccccaaucuggacaucauaggaaagagaauugagaaaaucaagcaggagcacgagaccucauggcacuacgaccaggaccaccccuacaagaccugggccuaccacggcuccuaugagacgaagcagaccggcucggccuccucgauggucaacggggugguacgccugcuaaccaagcccugggauguggugccaauggugacgcagauggcaaugacggacacaacacccuucggccaacaacgcgucuucaaggagaagguggauacccgcacgcaagaacccaaggagggaaccaagaagcugaugaagaucaccgcggaguggcuguggaaggagcucgggaaggagaagacgccucggaugugcacgcgggaggaguucacucgcaaggugcggagcaaugccgcccugggcgcgguauucacugacgagaacaaguggaaguccgcccgcgaagccguggaggacggucgguucugggagcugguggaccgagagcggaaucuccaccuugaaggcaagugcgagaccugcgucuacaacaugaugggcaagcgcgagaagaaacugggcgaguucggcaaggccaagggaucccgggcgaucugguauauguggcucggcgcccgcuuccuggaguucgaggcccuggguuuccuuaacgaggaccacugguuuucccggggcaacagccugagcgggguggagggagagggcuugcaccgccucggguacauccugcgggaggucggcaagaaagagggcggcgccauguaugccgaugacacggcuggaugggacacccgcaucacccuggaggaccucaagaacgaggagaugguaaccaaucacaugaagggcgagcacaagaagcuggccgaagccaucuucaagcugacguaccagaacaaggugguccgggugcaaagaccgacgccccgggggaccgugauggacaucaucagcaggaaggaccagaggggguccggccaggucgggaccuacggacuuaacacuuucaccaacauggaggcccagcugauccgccaaauggaaggcgaggguaucuuuaaaagcauccaacacuuaaccgcgaccgaagagaucgcgguucagaacuggcucgcccgcgugggccgggaacgccugagucggauggccauuucuggggacgacugcgucgugaagccgaucgacgaccgcuucgccuccgcacugacggcacucaacgauaugggcaaggugcggaaggauauccagcagugggagcccagccgcgguuggaacgauuggacccaggucccauucuguagucaucacuuccacgagcuggugaugaaggacggccgagugcucguaguccccugccgcaaccaagacgagcucaucggccgggcccgcaucucccagggggccgguuggucacugaaagaaaccgcuugccuuggcaagagcuaugcucagauguggacucucauguacuuccaucggagggaccugcggcuggcggcuaacgccaucugcuccgcaguccccagccacuggguccccaccucccgaaccaccuggagcauccaugcgaaacacgaauggaugaccaccgaggauaugcucgccguguggaaccgaguguggauccaggagaacccguggauggaggacaagacgccagucgaguccugggaggaggugcccuaccuggggaagagggaggaccaguggugcgguagccuuaucggccucaccagccgugccaccugggcaaagaacauccagacagccaucaaucaagugcgaagccugauaggcaacgaaggguacacggacuacaugccgagcaugaagcgguuccgcagggaggaggaggaggcgggcguccugugguga

SEQ ID NO: 25441 - RNA, 9876 nt, Artificial Sequence
  derived and/or modified CDS sequence (opt11) from DENV-2__JX286520__SS-prME
accgcuggcgugauugugaugcugauccccacagccauggcguuccaucucaccacccgcaacggggagccccacaugaucgugggccggcaggagaaggggaaaucccuguuauucaagaccgaggacggcgugaacaugugcacccuuauggcaauugaccugggggagcugugcgaggacaccaucaccuacaagugcccccuccuccggcaaaacgagcccgaggacaucgacugcuggugcaauagcacaagcaccugggucacguacgggaccugcaccaccacaggcgagcaccggcgcgaaaaacgguccguugcccuggugccccaugucggaaugggccuagagacccgcaccgagacauggaugagcagcgagggugccuggaagcacgugcagcgaauugagacguggauccugcggcacccggguuucacuaucauggccgcgauccuggccuacaccaucggcaccacgcacuuccagcgggcacucaucuucauccuucugaccgccguggcgccuagcaugaccaugcgcugcauuggcauuuccaaccgggacuucgucgaaggcgugagcgggggcuccuggguggacaucguccuugagcacgggagcugcguaaccacgauggccaagaacaagcccacccuggacuucgagcugaucaagaccgaggccaagcagcccgccacccuccgcaaguacugcaucgaggccaaacugacgaacaccaccaccgagucccggugcccuacgcagggcgagcccagccugaaugaggagcaggauaagcgcuucauuugcaagcacucgaugguggaccgcggcuggggcaacggcugcggccuguuuggcaagggugggaucguaaccugcgcgauguucacguguaagaagaacauggagggcaagaucgugcagcccgagaacuuagaauacaccaucguaaucacgccccacucgggggaggagcacgccgucggaaaugacaccgggaaacacggaaaggagaucaagaucaccccgcaauccagcaccaccgaggccgagcugacaggcuaugggaucgugaccauggaaugcucuccucggacgggccucgacuuuaacgagauggugcugcuucagauggaggacaaggcauggcucguacaucggcagugguuucucgaucuaccccuccccuggcugccgggggcugacacccaagggagcaacuggauccagaaggagacgcuggugaccuucaaaaacccccacgcgaaaaagcaggacgugguagugcucgggucucaggagggcgcuaugcacacagcucugacaggcgccacggagauccagaugagcaguggcaaccugcuguucacgggccaccugaagugccgccuccgaauggacaagcuccagcugaagggcauguccuacucuauguguaccggcaaguucaagaucguuaaggagaucgccgagacgcaacacgguacuaucgugauccgcgugcaauacgaaggugacggcucccccugcaagauaccauucgagaucaccgaccuggagaagcggcacguacucgggcgccugaucaccgugaauccgaucguaaccgagaaggacagccccgucaauaucgaggcggagccgcccuuuggcgacuccuacauaauaguggguguggagccggggcagcugaagcucaacugguucaagaaagggagcagcaucggccagauguucgaaacgacuaugcgcggcgcuaagcggauggccauacugggggacaccgccugggacuucggcucccucgggggagucuuuaccuccaucgggaaagccuugcaccagguguucggggcuaucuacggcgccgcguucucugggguuuccuggacgaugaagauccugaucggugucaucaucaccuggaucgggaugaacagccgcuccaccucgcugaguguuagucuggugcucgucggcguagugacccuguaccugggggccauggugcaggcggacuccggcugcaucgugagcuggaagaacaaggaacucaaaugcggcuccgggaucuucaucacggauaacgugcacaccuggaccgagcaguacaaauuccaacccgaaagcccgagcaagcuggccagcgccauccagaaggcccacgaggaaggcaucugcgggauccgaagcgucacccggcuugagaaucucauguggaagcagauuacgcccgagcugaaccauauccuguccgagaacgaggugaaacucacaaucaugaccggcgacauaaagggaaucaugcaggccggcaagcggagccugcguccacaacccaccgagcugaaguacuccuggaagaccuggggcaaggcgaagauguugucuaccgagucccacaaccagacauuucugaucgauggacccgagaccgccgagugcccgaacacgaaccgggcguggaacucacuggagguggaggacuacggcuuuggagucuucaccaccaacaucuggcucaagcuacgcgagaagcaggacguauuuugcgacuccaagcugaugucagccgccaucaaggauaaccgggcugugcacgccgacaugggcuauuggauugaguccgcccucaaugacaccuggaagauggagaaggcaagcuucaucgaggucaaguccugccacuggcccaagagccacaccuugugguccaauggcguucuggagagcgagaugaucauccccaagaacuucgccgggccugugucccagcacaauuauagaccgggcuaccacacgcagaccgcgggaccguggcaccucggcaagcuggaaauggacuucgauuucugcgagggcaccaccgucguggugacagaggacugcggcaaccggggacccucccuccgcaccaccacagccagcggaaaacucauaacagaauggugcugcagguccugcacccugccuccgcugcgcuacaggggcgaggaugggugcugguacggcauggagauccgcccccucaaggagaaggaggagaaccuggucaacagccuggugaccgccgggcauggccagaucgacaacuucucccucgguguccuggggauggccuuguuccuagaagagaugcugcggaccagagucggcacgaagcacgcgauacugcuaguugcccugagcuucgugacccuuaucaccggaaacauguccuuccgugaccugggccgcgucauggugauggucggugccaccaugacggacgacaucggcaugggcgucaccuaccuggcccugcucgccgcguuuaaggugcgcccaacguucgccgccggauuacuccuccggaagcugaccagcaaagagcugaugauggccacuaucggcaucgcucuccugucccagagcacccugcccgagaccaucuuggagcugacggacgcgcuggcccucggaaugauggcccugaagaucgugcggaacauggaaaaguaccagcuggccgucacgaucauggccaucucgugugugccgaacgcagucauccuccaaaacgccuggaaggucucaugcaccauccuggccgccguguccgugagcccccuguuacuuaccagcucacagcagaaggcggacuggaucccacuggcccucaccaucaagggccugaaccccacggccaucuuccugaccacccuuucccggaccucgaaaaaaagauccuggccgcucaacgaggccauuauggccguggggauggugagcauccuggcguccagccucuugaagaacgacauccccaugaccgggccucucgucgccgguggguugcugaccgugugcuacgugcugaccggccggagcgccgaccucgagcuggagcgggcagccgaugucaagugggaggaccaagcggagauauccgggucaucccccauccugagcaucacgaucagugaggacggcagcaugaguauaaagaaugaggaggaggagcagacgcucaccaucuugauccggaccggacugcuagugauaagcggggucuuuccggucuccauucccauaaccgccgccgccugguaccugugggagguuaagaaacagcgcgccggcgugcugugggacguccccagcccuccgccuguagggaaggcggaauuagaagacggcgccuaccggaucaagcagcgcgggauacugggauacucccagaucggagccgggguauacaaggaggggaccuuccacacaauguggcacgugacccgcggagccgugcugaugcaccgcggcaaacggaucgagcccagcugggccgacgugaagaaggaccucaucuccuacgggggcggcuggaagcuggagggggaguggaaagagggggaggagguccagguauuggcgcucgagccaggaaagaacccccgcgccguacagaccaagcccggaauuuucaagacgaacacggggacaaucggggcugucagccuggacuucuccccaggcaccagcggguccccuaucguggaccggaaggguaagguugucgggcucuacgggaacggcguggugacccgcagcggggccuacgucuccgcgauugcgcagacggagaagaguaucgaggacaaccccgaaaucgaagacgauaucuuccggaagaaacgccucacgauaauggaucugcaccccggugccgggaagaccaagagauacuuaccugccauagugcgcgaggccaucaagcggggcuugcgcacccucauccuagcgcccacgcgcgugguggccgccgagauggaggaggcccugcgcgggcuccccauccgcuaccagacccccgccauccgagccgagcacaccggccgcgagaucguggaccugaugugccacgccaccuucacgaugcggcugcucagucccgugcgcgugccgaacuauaaccuaaucauaauggacgaggcacacuucaccgaccccgccuccaucgccgcucggggcuacauuucgacccgcgucgagaugggggaggccgccggcaucuuuaugaccgccacgccucccgguucccgggaccccuucccccagagcaacgcgcccauuauggacgaagagcgcgagauccccgagcggucguggaacagcggccacgagugggugaccgacuucaaagggaagacagucugguucgugccauccaucaaggccggcaacgacaucgcggccugucugcgcaagaacggaaaaaaggugauccagcucaguaggaagaccuucgacucagaguacgucaagacccgcgccaacgacugggacuucguggugaccacugacaucagcgagaugggggcgaacuucaaagccgagcgugucauagacccucgccguugcaugaagcccgugaucuugaccgauggggaggaacgcgugauccuggccgggcccaugccggucacgcacuccagcgcggcccagcggcgcggccgcaucgggcggaaccccaaaaacgagaacgaucaguauauuuacaugggcgagcccuuggaaaaugacgaagacugcgcucacuggaaggaggccaagaugcugcuggacaacaucaacacccccgagggcaucaucccguccauguuugaacccgagcgcgagaagguggacgcuaucgacggggaguauagacugcgcggcgaggcccggaagaccuucguggaccugaugcgccgcggggaucugcccgucugguuagccuacaaaguggcugccgagggcaucaacuacgccgaccgcaagugguguuuugacgggaucaagaauaaccagauccuugaggagaacguggaggucgagaucuggaccaaggagggcgaacggaaaaagcugaaaccgcgcuggcucgacgcccggaucuacagcgacccccuggcucucaaggaguucaaggaguucgcugccggccgcaagucccucacgcugaaccuaaucaccgagauggggcggcuuccuaccuuuaugacccaaaaggcccgcaacgcacuggacaaccuagcagugcuucacacggccgaggugggggggaaggccuacacccacgcccugagcgagcugcccgagacgcucgagacccuccugcuccugacgcugcuugcugcggucaccggcggcaucuuccuguuccugauguccgggaagggcaucgggaagaugacgcucgguaugugcugcaucaucaccgcaucgaucuuacugugguacgcccagauucaaccgcauuggaucgccgccuccaucauucucgaguucuuccugaucgugcugcucaucccggagcccgagaaacagcggacgccucaggacaaccaacuuacguacgucgugaucgcaauucugaccgucgucgccgccaccauggccaacgagaugggauuccucgagaagaccaagaaggacuuuggcuucggcagcaucacuacccaggagucggaguccaacauacuggauauugaccugcggccagcuagcgcguggacccucuaugccguggccaccacauucgugacccccaugcugcggcacuccaucgagaauaguuccgucaacgugucccugacagccaucgcgaaccaggccacagugcucauggggcugggcaagggguggccccuguccaagauggacauuggcgucccucuccuggccaucgggugcuacagccaaguaaacccaaucacccugacagcggcccuccugcuacucguggcgcacuacgccauaaucgguccuggccugcaggcuaaagccaccagagaagcacagaaacgggcggcagccgggaucaugaagaacccaaccgucgacggcaucaccguuaucgaccuagaacccaucccuuacgaccccaaguucgagaagcagcucgggcaggucauguugcugauccucugcgucacccagguucugaugaugcgcaccaccugggcccugugcgaggcccucacgcuggcgaccggccccaucuccacucugugggaggggaaccccggccgguucuggaacaccacgaucgccgugagcauggccaacaucuuucgaggcuccuaccucgcgggggcgggacuucucuucagcauuaugaagaacacgaccaacacccgucgugggacgggcaacguaggcgagacccucggggaaaaguggaagucccgccuaaacgcccugggcaagagcgaguuucagauuuacaagaaguccgggauccaggagguugaccggacccucgccaaggaggggaucaagagaggggagacugaccaccaugccgugagccggggcuccgccaaacugcgcugguucguugaacggaacauggugacgccggaagguaaaguggucgaccuggggugcggccgcgggggcuggucguacuacuguggcggccuuaagaaugugcgggaggugaagggcuuaaccaagggcggccccggccacgaggagcccaucccgauguccaccuacggauggaaccugguccgccuccagagcgggguggacguguucuucaccccacccgagaagugcgacacgcugcucugcgacauaggcgagagcucacccaaccccacuaucgaggcgggucggacccuccgcguccugaaucuuguggaaaauuggcucaacaacaacacccaauucugcaucaagguacugaaucccuacaugcccagcguaaucgagaagauggagacccugcagcggaaguacgggggcgcccucguacgcaauccccugucacgaaacucuacgcacgagauguauuggguguccaaugccaccgggaacaucgucucaagugugaacaugaucucgaggaugcugaucaaucgguuuaccaugaagcacaagaaggccaccuaugagccagacguggaccuggguagcgggacgcguaauauuggcaucgagagcgagauccccaaccucgacauaaucgguaagcguaucgagaagauuaagcaggaacaugagacaucguggcacuacgaccaagaccaccccuacaagacaugggccuaucacgggagcuacgagaccaagcaaacaggcucagcguccuccauggugaacggggugguucgccugcugacuaagcccugggacgucgugccgauggugacccagauggccaugacagauacgacccccuucggccagcaaagagucuucaaagagaagguggacacgaggacccaggagccaaaggagggcacgaagaaacucaugaagauuaccgcugaauggcuguggaaggagcuggggaaggagaagacgccgcggaugugcacaagagaggaguucacgcgcaagguccggagcaacgcggcccucggugcugucuuuaccgacgagaacaaguggaaaucagccagggaggccguggaggacggucgguucugggagcugguagaccgcgaaagaaaccugcaccuagagggcaaaugcgagacauguguuuacaacaugauggggaagcgcgagaagaagcugggcgaguuuggcaaggcuaaggggagcagagcgaucugguacauguggcugggugcccgauuccuagaguucgaagcacugggguuccugaaugaggaccauugguucagccggggcaacagccucagcgggguggagggcgagggccugcaucgacugggguauauacucagggagguaggaaagaaggagggaggagccauguacgccgacgacaccgcgggcugggacacccgcaucacccuggaagaccugaagaacgaggagauggugaccaaccauaugaaaggcgagcacaagaagcuugcugaggccauauucaaacugaccuaccagaacaaggugguucgggugcagcgaccgacgccccggggcaccgugauggauaucaucucccgcaaagaccagcgggggagcggccaggucgguaccuacggccugaacaccuucacuaacauggaggcccaacucauccgccagauggagggcgaggggaucuucaaguccauccagcaccugaccgccaccgaggagaucgcggugcagaacuggcuggcccgcgugggccgggagaggcucagccggauggcgaucuccggggacgacugcguuguuaagcccaucgaugaccgcuucgccagcgcccugaccgcgcugaaugacaugggcaaggugagaaaagacauccagcagugggagcccucccgcggguggaacgacuggacgcaggucccguucuguagucaucacuuccaugagcucgucaugaaagacggccggguguuagucgugcccugccggaaccaggacgaacuuaucggacgggcccgcaucucccagggggccggcuggucucucaaagagaccgccugccuggggaaaaguuacgcccagauguggacccugauguacuuccaccggcgcgaccuccggcuggcggccaacgccaucugcagcgccgugcccucucacuggguccccacaagccgcaccacgugguccauccacgcgaagcacgaguggaugaccacugaggauauguuagcgguguggaauaggguguggauccaggagaauccguggauggaggacaagacccccgucgagagcugggaggaggugcccuaccugggcaagagagaggaucaguggugcgggucccugauuggcuuaacgagucgggccacaugggccaagaacauccagaccgccaucaaccaggugcgaagccuuaucggcaacgaaggguacaccgacuacaugcccuccaugaagcgguuccgccgcgaggaggaggaggcgggcguacugugguag

SEQ ID NO: 25442 - RNA, 9876 nt, Artificial Sequence
  derived and/or modified CDS sequence (opt11) from DENV-2__JX286525__SS-prME
accgcgggcgucauagugauguugauaccaacggcgauggcauuucaccuaacgacgcggaacggugaaccacauaugauagucggacggcaggaaaaaggaaaaagccuucuguuuaaaaccgaagacggaguaaacauguguacgcuaauggcgauagaccugggcgaacuaugcgaagauaccauaacuuacaaaugcccauugcuacgacagaaugaaccagaagacaucgacugcuggugcaacagcacgagcacguggguaacguacggaacaugcacaacgacgggggaacacaggcgggaaaaacgaagcguggcacuggucccccacguaggaaugggccucgaaacaaggacggagacguggaugucuucggagggagcguggaaacacguacaaagaaucgaaacauggauauugaggcaccccggcuucacaaucauggcagcuauccucgccuacacgauaggaaccacacauuuccagcgcgcccucauauuuauacuccucacggcagucgcccccaguaugacaaugcgguguauagggauaucgaauagagacuucguagagggugugagcggcggauccugggucgacaucgugcuagaacauggaucuugugugaccacuauggccaaaaauaaacccacccuagacuuugaacuuaucaaaaccgaggcaaaacaaccugcgacacugcgcaaauacugcauagaagcaaagcucacgaauacgacuacugaaucgagaugccccacacaaggcgaaccgaguuugaaugaggagcaggacaagagguuuauauguaagcacagcauggucgaccgcggcuggggaaacggaugcggccuguucgggaaaggcggaauagucacaugugccauguuuacgugcaagaaaaacauggagggaaaaaucguacaaccagaaaaucucgaguacaccauaguaauaacgccgcacaguggugaagaacacgccguaggaaacgacacugguaagcacggcaaagagauuaaaaucacgccccaaagcaguacgacagaggcggaacugacagguuauggaacaguaacaauggagugcuccccacgcacaggacuugauuucaaugaaauggugcuccuucaaauggaagacaaagcauggcucgugcauaggcaaugguuuuuagaccuaccccucccguggcuuccaggagcagauacucaaggcaguaacuggauccagaaggaaacccuggucacauucaaaaacccacaugccaaaaagcaagacgucguuguccuagggucccaagaaggggcgaugcauacggcacuaacgggcgcgacagaaauacaaaugaguucagggaaucugcuauucacuggccaccuuaagugcagauugcgaauggacaagcugcagcuaaaagggaugucauacucaaugugcacagggaaguucaaaauugucaaagagaucgccgagacccagcacggaacaauuguuauaagaguacaguacgagggcgacgggaguccaugcaaaaucccguucgaaaucacugaccucgagaaacgacauguacucggaagacucaucacaguaaacccuaucgucaccgaaaaggauagcccuguaaauauagaagcggaaccaccguuuggugacagcuacauuauagucggcgucgagccuggacaguuaaaacucaacugguucaagaaaggaagcucgauaggucaaauguucgagacuacaaugcggggagccaagcgcauggcaauucuaggcgacacagccugggauuuugggucacucgggggaguguucacuagcauaggcaaagcacuccaccaaguauucggcgcgaucuacggagcagcuuuuucuggaguauccuggaccaugaagauccuuauuggcgugauaaucacauggauaggcaugaacagccgcucaaccucgcuaucugucagccuaguauugguugggguaguaacacucuauuugggagcuaugguacaggcagacucgggauguauaguuagcuggaagaauaaagaacucaaaugcgggagcggaauuuucauaaccgauaacguccacacauggacagaacaauacaaguuccagcccgaaagccccagcaaacucgccagcgcgauacaaaaagcgcacgaggagggaauaugcggcauaagaucggucacgcgcuuggagaaucuaauguggaagcagauuacaccagagcuaaaucauauucuaagcgagaacgaagucaagcuaaccauuaugaccggggacauaaaaggaaucaugcaagccgggaaaagaagucugagaccgcagccaaccgagcuaaaguacucauggaagacguggggcaaagcgaaaaugcuuucaacagagagucacaaccagacguuccuaaucgacggcccggaaacagcggaaugcccuaacacuaauagagccuggaacagccuggaaguggaggacuacggauuuggaguauucacaacaaauauauggcucaagcucagggagaaacaagacgucuucugcgacaguaaacuaaugagcgcggcuaucaaggacaaucgagcaguucacgcugacaugggcuacuggaucgaaagugcccucaacgacaccuggaaaauggaaaaggcaaguuucaucgaaguaaaaucaugccacuggccgaaaagccauacucuguggucgaacgggguacuggagucagaaaugaucauucccaaaucauucgcugguccagugucgcagcacaauuaccgaccaggcuaccacacacagaccgcugggcccuggcaccucgggaaacuagagauggacuucgacuucugcgagggaacaacgguagucgucacugaggacugcggaaacagaggaccaagccugagaaccacaacagcguccggaaaacucauaacggaaugguguuguaggucgugcacuuuacccccacugagguaccggggcgaggacggcugcugguacggcauggagauaagaccucucaaagagaaggaagaaaaccuagucaacucucuaguaacggccggacauggccagaucgauaacuuuagucugggagugcuagggauggcacuauuccuagaagaaaugcuccgaacuagagucggaacaaagcaugcgauccuacucguggcacucucguucguuacgcugauaacaggaaacaugagcuuccgggaccuggguagagucauggucauggugggagcaacgaugaccgaugacaucggcaugggggugacguaccuagcauugcuggccgcauucaaaguacgaccuacauucgcagcgggauuacuauuaagaaagcucaccuccaaagagcucaugauggcgacuaucggcauugcucuccuaucccaaagcacccuaccugagacaauacucgagcuuacagacgcgcucgcccuagguaugauggcauugaagauaguccgcaacauggagaaguaccaguuggcaguaaccaucauggcgauuaguugcgugccuaacgcgguaauacuccaaaacgcuuggaaagugagcugcaccauacuugcagcagucagcgucagcccacuuuuauugaccucgagucagcagaaagcggauuggauaccucuagcgcucaccaucaagggacugaauccgacugcgauauuucucacgacccucucacguacgucgaaaaagcguagcuggccucucaacgaagccaucauggccgugggcaugguaagcauccuggccagcucacugcucaaaaacgacaucccaaugacaggcccccuaguggcagggggacucuugacuguauguuacgugcucaccggaagaucagcggaccucgaguuagagcgugcagcagacgucaagugggaggaccaagcggaaaucucggguucaucacccauacugucaauaaccauaagugaggauggcucgaugucaauuaaaaacgaggaagaggaacaaacgcuuacgauacucauacgcacgggcuugcuaguaauauccggcgucuuuccggugagcauaccgaucaccgcagcagccugguaccucugggaaguaaagaagcaaagggcaggaguucugugggacguaccuucgccgcccccaguuggcaaggcggagcuagaggacggagccuaccguauaaaacagcgaggaauccucggauauagccagauaggugcaggagucuacaaagaaggcacguuccacacgauguggcacgugacgagaggagcaguauugaugcacagagggaagcguauugagccguccugggcugacgugaaaaaggaccucauauccuacgggggcggguggaagcuggagggcgaauggaaggaaggagaagagguacagguacuagcgcuggaacccggcaaaaaccccagagccguccaaacgaagccgggaauuuucaagacaaacacaggcacaauaggagcuguaagccuggacuuuucgccaggaacgaguggaagccccaucguugaccggaaggggaaaguggucggguuauaugggaacggcguaguaacucgaagcggggcguacguaucggcaaucgcacaaacagagaaaucaauagaggacaacccugaaauugaggaugauauuuuccggaagaaaagacugacgauaauggaccugcacccaggagcgggaaaaaccaaacgauaccugccggccauaguacgggaggcgauaaagaggggauuacgcacacugauccuagcgccgacacggguggucgcugcggaaauggaggaggcacuacggggcuuaccgauucgguaccaaacacccgcaauaagggcagaacacacuggccgcgagauuguggaccuaaugugccaugcaacauucacaaugcggcugcuuaguccaaucagaguaccaaauuauaaccuaaucauuauggaugaagcccacuucacggauccagcaucaaucgcggcccgaggcuacauauccacacgaguagagaugggagaagcggcugguauauuuaugacagccacgccaccgggcucaagagacccuuucccacaaagcaacgcgccaaucauggacgaagaaagagagaucccagagaggagcuggaacagcggacaugaauggguuaccgauuucaaagggaaaacugucugguucguacccagcaucaaggcgggcaacgacauagccgccugccugcggaaaaacggcaagaaaguaauccaauuaagcagaaaaacguucgacuccgaauacguuaaaacccgggcaaacgacugggacuucguagugacuacugacauaucagagaugggagcaaacuucaaagccgaaagagucaucgacccgcggcgaugcaugaagcccgugauccugacagauggcgaagaacgggucauacucgcaggccccaugccaguaacccacucgagugcagcacaacggcgaggacgaauaggacgaaaccccaaaaacgaaaacgaccaguacauauauaugggagaaccguuagagaacgacgaggacugcgcucauuggaaagaagcuaagaugcugcucgacaacaucaacacaccagaaggcauaauacccagcauguuugagccagaaagagaaaagguugaugcuauagacggugaauacagacuacgcggagaagcaagaaagacauucguagaccuuaugcgaagaggcgaccugccaguguggcuugcauacaagguugcggcagaagguaucaacuacgcggaccgcaaauggugcuuugacgggaucaaaaacaaccagauccuagaagaaaaugucgaaguagaaauauggaccaaggagggagaacgaaagaaacucaaaccccgguggcuagacgcgagaauuuauuccgacccacuggcgcuaaaagaguucaaagaauuugcagcagguagaaaaucgcuaacgcugaaccugaucacagagaugggaagguuaccaaccuucaugacccagaaagcaagaaaugccuuagacaaccuggcgguacugcacacugcagaagucgguggaaaagcauacacccacgcccugucggagcugccugagacccucgaaaccuugcugcuguuaacuuuguuagcagccgugaccggcgggaucuucuuguuccugaugagcggaaaaggcauaggaaaaaugacccucggcaugugcugcauuauaacggcuagcauacuccucugguaugcucaaauacaaccccacuggauagcggccaguauuauacuagaguucuuucugaucguccuccuuauacccgagcccgaaaaacaaaggaccccucaggacaaccagcuaaccuacguaguuauugcaauccucaccguagucgcagcaaccauggcaaacgagaugggcuuccuagaaaagacgaaaaaggaccucgguuucggcucuauaaccacgcaggagagcgaaucaaauauacucgacaucgaccuccgccccgccagcgcuuggacucuauacgccgucgcaacaaccuucgugacccccauguugcgacauucaauagaaaacagcucuguaaacgucucccugacggccauagccaaucaggccacgguucugaugggucucggaaaaggauggccccucaguaaaauggacaucggagugccccuccucgcaaucggaugcuacucccaggucaacccgaucacgcucacagcagcccuucuccuuuuggucgcccacuaugcgaucaucggccccgggcuccaggcuaaggcaacgagggaagcucagaaaagagcagcggccgguauuaugaagaacccaacagucgacgggaucaccguaauugaucuggagccgaucccguaugaccccaaauucgagaaacaacuggggcaagucaugcuacucauacucugcgugacgcaagucuugaugaugaggacaacaugggcgcuaugcgaggcacucacccuugcgacaggaccgauaucgacacuaugggaaggaaauccgggccgauucuggaacaccacaauagccgugagcauggcgaacaucuucagaggauccuaccucgccggcgcggggcuacuauucucaauaaugaaaaauaccacaaacacucgacgcgguaccggaaacgucggagaaacccucggagagaaauggaaaucgaggcuuaacgcgcuaggcaaaagcgaguuccaaauuuacaagaaauccggcauucaagagguggaccgaacccuagccaaagaaggaaucaaaagaggagaaacggaccaucacgcuguuucgcggggcucugcgaaguugagaugguucguugaaaggaacauggucacaccagagggaaagguuguggaucucggcugcggccggggagguuggaguuacuacugcgggggacuuaaaaauguacgcgagguaaaaggcuuaacaaaagggggcccaggccacgaagaacccauaccaaugagcacuuacggauggaaccuaguacgacuccaaagcggcguugacgucuucuucacaccaccagaaaagugcgauacacuccucugcgacauuggugagucuagcccaaauccaacgaucgaggcaggccgcacacucagagugcuaaaccucguggaaaauuggcuuaacaauaacacacaauucugcauaaaaguacucaacccauacaugccaucgguaauagaaaagauggaaacgcuacagcgaaaguacggaggugcccuaguacggaacccccugagucgcaacaguacccaugagauguacugggucuccaacgcaaccgguaacaucguaagcagcgucaacaugauaucccgaaugcugauaaaccgauuuacaaugaagcacaagaaagccacauacgaaccagacgucgaccuaggauccggaacgaggaacaucggaauagagagugaaauccccaaccuugacauaauaggaaaaagaauagaaaagauaaaacaggaacacgagacuucguggcacuacgaucaggaccacccauacaaaacgugggccuaccacggcucauacgaaacgaagcagacaggaagcgccucuuccauggucaacggaguggugaggcuccucacgaaacccugggacgucguacccaugguaacacagauggcaaugacggauacgacccccuuuggacaacaacgcguauuuaaagagaaaguagacacgaggacccaggagcccaaggaaggcaccaagaaacuaaugaaaauaacagcagaguggcuguggaaagagcuaggaaaagagaaaacaccgagaaugugcacccgggaggaguucacccgaaagguucgaucgaacgcggcacuaggagcggucuuuaccgacgagaauaaguggaaaagcgcaagggaggcgguagaggauggacguuuuugggagcucgucgaccgagaaagaaacuuacaccucgaggggaaaugcgaaacaugcguguauaauaugauggguaaacgcgagaagaaacuaggagaguucggcaaggcuaagggcucccgugcuauaugguauauguggcugggcgcccgauuucuggaguucgaagcacugggauuccuaaaugaagaccauugguucagcagaggcaauagccugagcggagucgagggagaaggccuucaccgacuagguuacaucuuaagggaagucggaaagaaagaaggaggagccauguacgcugacgacacggcgggaugggacaccaggauaacccuugaggaccugaaaaacgaagagaugguaacgaaccacaugaaaggggaacacaagaaacucgcagaagccaucuucaaacuuacuuaucagaauaagguagugcgggugcaacgcccaacuccaagagguaccgugauggacaucauaagcagaaaagaccaaaggggcucuggacagguaggcacauacgggcugaauacuuucaccaacauggaggcccaacuaauacgccaaauggagggggaggguaucuucaaaagcauccagcaucucacggcaacagaggaaaucgcagugcaaaauuggcucgcgcguguuggacgugaacgauugaguaggauggccauuuccggugaugauugcguaguaaaaccaaucgacgaccgcuuugcaagcgcgcuaacagcacugaacgacauggguaagguccgcaaggauauucaacaaugggagccaucacguggauggaacgacuggacccaggucccguucugcagccaucacuuccacgaacucguuaugaaggauggccgcgugcugguagucccaugucguaaccaagacgaacucaucggacgcgcccgcauaucacaaggggccggcuggucgcuaaaagaaaccgcaugccucgggaaguccuacgcgcaaauguggacucucauguacuuucaccggagagaccuacgccucgcggccaacgccaucugcagugcaguaccaagccauugggucccuacaagccgcaccacauggucgauacacgcgaagcacgaguggaugacaacagaagacaugcuagccgucuggaacagaguguggauacaagaaaacccauggauggaagacaagacgcccguugagucaugggaagaaguacccuauuugggcaaaagagaagaccaauggugcggaagucucauagggcuuaccucccgcgcaaccugggccaaaaauauacaaacagcgauaaaccaggugaggagcuuaauagggaacgagggcuacacugacuauaugcccagcaugaagagauucaggagggaagaggaagaagcaggcgugcuaugguga

SEQ ID NO: 25443 - RNA, 9876 nt, Artificial Sequence
  derived and/or modified CDS sequence (opt11) from DENV-2__KM279598__SS-prME
accgcgggcauuaucauaaugaugauccccaccgugauggccuuccaccugaccaccaggaacggggagccacacaugaucgucucccggcaggagaaaggcaagucccuccucuucaaaacagagaacggggugaauaugugcacccucauggcgauggaccucggcgagcugugcgaggacacuaucacguacaacugcccccugcuccgccagaacgagcccgaagacaucgacugcuggugcaacagcaccuccaccugggugaccuacgggaccugcaccgcgaccggcgagcaccggcgcgagaagcgguccgucgcccuggugccccacgugggcauggggcuggaaacgcgcaccgaaacguggauguccagcgagggcgccuggaaacacgcccagcggauugagaccuggauccuccgccaccccggguuuaccaucauggcggccauauuggccuacaccauuggcaccaccuacuuccagcgcguccugaucuucauccuccugacagccgugacacccuccauggccaugcgcugcaucgggaucagcaaccgggacuucguggagggcgucucaggcggaagcuggguggacaucgugcuggagcacggcuccugcgucaccaccauggccaagaacaagcccacgcucgauuucgagcugauuaagacggaggccaagcaccuggccacccuccgcaaguacugcguggaggcgaagcugaccaacacgaccaccgccagccggugcccgacccagggggagcccucccugaacgaggagcaggacaagcgcuucgugugcaagcacuccauggucgaccguggguggggcaacgggugcggccucuucgggaagggugggauugugacgugugcaauguucacgugcaagaagaacauggaaggcaaggugguccagccagagaaccuggaauauacgaucguuaucacgccccauuccggcgaggaaaacgccguggggaacgauacgggcaaacacgggaaggagauaaaggugacgccucagagcuccauuaccgaagccgaacugacgggcuacgggaccgugacgauggagugcagcccaagaaccgguuuagacuuuaacgagaugguucugcugcagauggagaacaaggccuggcucguucauaggcaaugguuccuggaucugccacuccccugguugcccggcgcugacacccaggggagcaacuggauccagaaggagacccuggugacguucaaaaauccgcaugcaaagaagcaggacgucguggugcucggcagccaggagggggccaugcacaccgccuuaaccggcgccaccgagauccagaugagcuccggaaaucuccuguucacgggccaccugaagugucgccugcggauggacaagcuccaguugaagggcaugucauacuccaugugcaccgggaaguucaaggucguuaaggagaucgcggagacccagcauggcacuaucgugauccgugugcaguacgagggggauggcucgcccugcaagaucccguucgagauuauggaccuggaaaagcggcaugucuuaggccgccugaucaccgugaaccccauagugaccgagaaggauuccccggucaacauagaagcggagccgccauucggagacagcuacaucauuaucggcguggagcccgggcagcucaagcucagcugguucaagaagggcuccuccaucgggcagauguucgagaccacuaugaggggcgcaaagcggauggcaauccuaggcgacacggccugggacuucggaucacugggcggggucuucaccuccaucggaaaggcgcuccaccaaguguucggcgccaucuacggcgccgcauucucagguguaucuuggaccaugaagauucugaucggggucgugaucacauggaucggcaugaacagccgcuccacgagccucuccgucucucugguccucguggguguggucacccuguaccuuggcgugauggugcaggcggacuccgggugcgucgugagcuggaaaaacaaggagcucaagugcggcagcggcaucuucauaaccgacaacgugcacaccuggacagaacaauacaaauuccagccggagucccccagcaaacuggccuccgccauccagaaagcgcacgaggaggggauaugcggcauacggagcgugacccgccuggagaaucuaauguggaagcaaaucacccccgagcugaaccacauccugaccgagaaugagguuaaguuaacgaucaugacuggcgacaucaagggcauaaugcaggccgggaagcggacccugcgcccucaaccaaccgagcugaaguacuccuggaaggcguggggcaaagccaagaugcugagcacggagcuacauaaccacaccuuccugaucgacggccccgagaccgccgagugccccaacaccaaccgugccuggaacucacuagagguggaggacuacggguucggcgucuucacgaccaacaucuggcugaagcugaaggagaggcaggacguguucugcgauagcaaguuaauguccgccgcgaucaaagauaaucgggccgugcacgccgacaugggguacuggaucgagucugcccugaacgacacguggaagaucgaaaaggccuccuucaucgaggucaagagcugccacuggccgaagucccacacccuuuggucgaacggcguacucgaguccgaaaugaucauccccaagaacuucgcgggccccgugucgcagcacaauuacagacccggguaccauacacagacugcuggcccguggcaccuggggaggcuggagauggacuucgacuucugcgagggcaccaccgucguugugaccgaggacugcgggaaccgcggccccuccuuacguacgaccacagccagcggcaagcugaucaccgaguggugcugccguaguugcacgcugccuccccuccgguaccgcggggaggacggcugcugguacgguauggagauucggccccugaaggagaaagaggaaaaccuggucaacucccucgugaccgccggccacgggcagauugacaacuucagcuuaggcgugcugggcauggcacucuuccuugaagagauguuacgcacccggguugggacgaagcacgcgauccuccugguugccguguccuucgucacucugauaaccggcaacaugagcuuccgcgacguuggucgcgugauggucauggugggcgccaccaugaccgacgacauuggaaugggcgugaccuaccuggcccugcuggcggcguucaagauacggcccaccuucgccgcgggacuacuccuucgcaagcucaccuccaaggagcuuaugaugaccacgaucgguauagucuugcucucucagucuaccauacccgagucgauccuggagcugaccgacgcacucgcucugggcaugauggugcugaagaucgugcggaacauggagaaguaccaacucgccgugacaauaauggccauccugugcgugcccaacgcaguuauccuucagaacgccuggaagguguccugcacuacccucgcggugguaagcguguccccgcuacugcucaccagcucccagcaaaaggccgacuggauucccuuagccuugaccaucaaggggcucaauccuacggcuaucuuccugaccacuuugucccgcaccucaaagaagcggagcuggccccuuaaugaggcgaucauggccguagggauggucuccauacuggccucaucacuucucaagaacgacaucccaaugacgggcccccuugucgccgggggacugcucacugugugcuacguccugaccgggcguagcgccgaccuggaguuagagcgcgcagccgacgugcgcugggaggagcaggccgagaucagcggcuccuccccaaucuuaagcaucaccaucagcgaggacgggagcauguccaucaaaaacgaggaggaggagcagacguuaaccauccucauccggaccggccuacuagugaucaguggccuuuuccccgucucaauuccgaucacugccgccgcgugguaccugugggaggugaaaaaacagcgcgccggggugcugugggacgucccaagcccgccgcccgugggcaaggccgagcucgaagacggugccuaccggaucaaacaaaagggcauccugggguacagccaaaucggcgccgggguguacaaagaggggaccuuccacacgauguggcacgucacacgcggcgcggugcugaugcauaaggggaagcggaucgagcccuccugggcugacgugaagaaggaccucauuaguuacggcgggggcuggaagcuggagggggaguggaaggagggggaggagguccagguacuggcucucgaacccggaaagaacccccgcgcggugcagaccaaacccggguuguuuaagaccaacacaggcaccaucggggccgugucccuggacuucagccccggaaccuccggaucaccuaucguggauaaaaaagggaaaguugucggccucuacgggaacggcguggugacacggaguggcacguaugucagcgcgaucgcccagaccgagaaguccaucgaggacaacccggagaucgaggacgauauauuccgcaagaagcggcugaccauuauggaccugcacccgggggcggggaagaccaaacgcuaccucccagcaaucgugcgggaagcgaucaaacgcggccuaaggacccucauccuggcccccacccgcguggucgccgcagagauggaggaggcucuccgaggcuuaccaauccgguaccaaaccccggcgauccgcgcugagcauaccggacgggagaucguggauuuaaugugccacgccacguucaccaugcgccuccugagccccauccggguacccaacuacaaccugaucauuauggaugaggcccacuucaccgacccugccucgaucgcggcccgcggcuacaucuccacacggguagaaaugggggaggcagccggcaucuucaugacggccacgccgcccggcagccgcgaucccuuuccgcaaagcaacgcgccgaucauggacgaggagaaggaaauccccgagaggagcuggaacuccgggcacgagugggugaccgauuucaagggcaaaaccgucugguucgugcccucaaucaaggcggggaacgacauugccgccugucuccgcaagaacgguaagaaggugauccagcucucccggaagacguucgacucagaguacauuaaaacccgcaccaacgacugggacuucguugucaccacggacaucuccgagaugggcgcgaacuucaaagccgagcgggugaucgacccgagacggugcaugaagcccgugaucuuaacagauggggaagagcgcgucauccuggcaggucccaugcccgugacccacucguccgcugcccagcggcgcgggcgggugggccgcaacccgaagaacgaaaacgaccaauacaucuacaugggggagccccuggagaacgacgaggacugcgcacauuggaaggaggccaagaugcugcucgacaauaucaacacccccgagggcaucaucccuagcauguucgagccggagcgcgagaaggucgacgccaucgacggcgaguaccggcugcgcggggaggcccggaagacguucguggaccugaugcgccgaggcgaccuccccgucuggcuggccuaccgcguggcggccgaaggaaucaacuacgcagaccgacgcuggugcuuugacggcgugaagaacaaccaaaucuuggaggagaacguugagguugagauuuggaccaaggagggggagcggaagaaguuaaaaccccgcuggcuggacgcgcguaucuacuccgacccgcuggcccucaaggaguucaaagaguucgcggccggccgcaagagccugacccugaaccuuaucacggagauggggcgguugcccacguuuaugacccagaaggccaagaacgcccuggacaaucucgcggugcugcacaccgcagaggccgggggcagggccuauaaucacgcccuauccgagcuccccgagacccuggagacacugcuccugcugacccuccuggcgacgguuacggggggcauauuccuguuucucauguccggcaaggggaucggcaagaugacccugggaaugugcugcaucaucacggccuccauccugcucugguacgcccaaauccagccgcacuggauagccgcuagcaucauuuuagaguucuuccuaaucgugcucuugauuccggaacccgagaagcaacggacgccccaggacaaccaguugaccuacguggucaucgcgauucucaccgugguggccgccaccauggccaacgagauggguuuccuggagaagaccaaaaaggacuucgggcuuggcuccaucaccacccagcagccagagagcaacauccucgauauagaccugcgcccggccagcgccuggacgcuguacgccgucgcgaccacguucaucacccccaugcuccggcacuccaucgagaacagcuccguaaacgucagccugacugcuaucgccaaccaggcgaccguccugaugggccucgggaagggcuggccccuauccaagauggacaucggggugccccugcucgccaucggcugcuacagccaggugaauccgaucacccucaccgccgcucugcuccuguuggucgcgcacuacgccaucaucggacccggccuccaggcuaaggccacgcgcgaggcgcagaagcgggcggccgcugguaucaugaaaaaucccaccgucgacgggaugaccgugaucgacuuggaccccaucccguaugaucccaaguucgagaagcagcugggccaggucaugcuccuggugcugugcguaacucagguccucaugaugcgcacgaccugggcccugugcgaggcgcugacacuagcgacugggcccaucagcacgcugugggagggcaaccccgggcgguucuggaacaccaccaucgccgucagcauggccaacaucuuccguggcuccuaccuggccggggcugggcuccuguucagcauuaugaaaaacaccgcgaacacgcgcaggggcaccggaaacaccggcgagacccuuggcgagaaguggaagaaccgccucaacgcccuggggaaguccgaguuccagaucuauaagaaguccggcauacaggagguggaccggacccuggcgaaagaggggaucaaacgcggugagaccgaccaccacgccgucucucgugggagcgcgaagcuccgcugguucgucgagcggaaccuggugacuccggagggcaaggucguggaccugggcugcgggcgcgggggguggucguauuacugcggcgggcucaagaacguaaaggaggucaagggccugacaaagggcgggcccggccacgaagagcccauacccaugucaacguacggguggaaucuuguccggcuacaguccggcguggaugucuucuucacgccgccggagaagugcgacacccugcugugcgacaucggggagagcucccccaaccccaccguggaggccggccgcacacugcggguucugaaccuggucgaaaauuggcucaacaacaacacgcaguuuugcaucaaggugcugaacccguauaugcccagcgugaucgaaaagauggaggcccugcagcgcaaauacggcggagcccuggugcggaauccccugucccgcaacuccacccacgagauguacuggguuagcaacgccucggguaacaucguaaguuccguaaacaugaucagccggaugcucauuaaccgcuuuaccaugcggcacaaaaaggcgaccuacgaaccggacguggaccuggggagcggcacccgcaacaucgggauagagucagagaccccaaaucucgacaucaucggcaagcggauagagaagaucaagcaggagcacgaaaccuccuggcacuacgaccaggaccaucccuacaagaccugggcauaccacggcagcuaugagacgaagcaaaccggguccgcgagcuccauggucaacggcguggugcgccugcucacaaagcccugggacgugaucccgauggucacucagauggccaugacggacacgacucccuucgggcagcagcgcguguucaaggaaaaggucgacacccggacgcaggagcccaaggagggcaccaagaagcucaugaagaucaccgccgagugguuauggaaggagcugggcaagaagaagacgccccgcaugugcacgagagaggaauuuacccgcaaggugcggagcaacgccgcccucggggccaucuucaccgacgagaacaaguggaaguccgcucgcgaggccguggaggacagcggcuucugggagcuggucgacaaggagcggaacuuacaccucgaggggaagugcgagaccuguguauacaacaugauggguaagcgugagaagaagcugggggaauucgggaaggccaaggguucccgggccaucugguacauguggcugggggcccgcuuccuugaguucgaagcccugggcuuccugaaugaggaccauugguucagccgagaaaacucccucagcgggguggagggugaggggcugcacaagcugggguacaucuuacgcgacgucagcaagaaggaaggcggcgcgauguacgccgacgauacggccggcugggacacccggaucacacuggaagaucugaaaaacgaggaaauggugaccaaccacauggagggggagcauaagaagcucgccgaagccaucuucaagcugacguaccaaaacaaggugguccgcgugcagcggccgacgccgcggggcacaguuauggacaucaucucccggcgcgaccagcgggguuccggccaggucgugaccuacggccugaacaccuucaccaauauggaggcgcagcucauccgucaaauggagggggaggguguguucaaguccauccagcagcugacgguaaaggaggagaucgccgugaaaaacuggcugauccgggugggacgcgagagacucagccggauggccaucuccggggaugacugcgucgugaagccccuggaugaccgguucgcgagcgccuugacagcgcucaacgacaugggcaaagugcgaaaggacauccagcagugggagccgucccgcggauggaacgauuggacgcaggucccguucugcucacaccacuuccacgagcugauuaugaaggacggccgggugcuggugguccccugccgcaaccaggaugagcucaucgguagagccagaaucagccagggcgcaggguggagccugcgagagaccgccugucugggcaaguccuacgcccagauguggucgcucauguacuuccaccggcgugaccugcgacuugcggccaaugcuaucugcuccgccgugccgagccacuggauccccaccucccgcaccaccuggagcauccacgccacgcacgaguggaugaccaccgaggauaugcucacaguguggaaccgcguauggauccaggaaaauccguggauggaggacaagacgcccgucgaguccugggaagagauccccuaccugggcaagagagaggaccaguggugcgggagccucaucggcuugacgagccgcgcgaccugggcaaagaacauccagacugccaucaaccaggugcgaucucugaucgggaacgaggaguauacggacuacaugcccagcaugaaacgcuuccggcgcgaggaagaggaggccggcguccuuugguga

SEQ ID NO: 25444 - RNA, 9876 nt, Artificial Sequence
  derived and/or modified CDS sequence (opt11) from DENV-2__KM279576__SS-prME
acugcgggcaucaucaucaugaugauacccaccgugauggcguuccaccuaaccacccgcaacggagagccccauaugaucguaagucggcaggaaaaggggaagucuuugcuguucaaaacagagaacggcgugaacaugugcacccucauggcuauggaccucggcgaguugugcgaggacacgaucaccuauaauugcccccuccuccggcagaacgagccggaagacaucgacuguugguguaacagcaccuccacuugggugaccuacgggaccugcacugcuaccggcgaacaccgucgcgagaagcggagcgucgcccuggugccccacgugggcauggggcuggagacgcgcacagagaccuggauguccagcgagggcgccuggaagcacgcccaacggauugagaccuggauacuccgccaccccggguucacgaucauggcggccauccuggccuauacaauuggcaccaccuacuuccagcggguccugauauucauccuccugacggccgucacucccuccauggcgaugcgcugcauuggcauuagcaaccgggacuucguugagggcgucuccggcgggaguuggguggacaucgugcuggagcacggcucaugcgucacgaccauggccaagaacaagcccacgcucgacuuugagcugauuaagacggaggccaagcaccuggccacccuccgcaaguacugcguagaggccaagcuaaccaauacgaccacagcgucgcgaugcccuacgcaaggggagcccagucugaacgaggagcaggacaagcgcuuugugugcaagcauuccaugguggaccgcggcuggggcaaugguugcggucucuucgggaagggagggaucgucacuugcgcgauguucacgugcaaaaaaaacauggagggcaaggucguccagcccgagaauuuggaauacaccaucgugauuacgccccacuccggcgaggaaaacgccguugggaacgacacgggcaagcacgggaaggagauuaaggucacgccccagucauccaucacugaagccgaauuaacuggcuacgggaccgugacgauggagugcagcccacgcaccggccucgacuuuaacgagauggugcugcuucaaauggagaacaaggccuggcugguccaccggcagugguuccuggaccugccucugcccuggcuaccaggagcggacacucaaggguccaacuggauccagaaagagacucucgugacguucaagaauccccaugcaaagaagcaggacgucgucgugcucggcagccaggaaggggccaugcacacagcccugaccggcgccaccgagauccagaugagcucagggaaccuccuuuucacgggccaccuaaagugccgccugagaauggacaaguuacaguuaaagggcaugagcuacucuaugugcaccgggaaguucaaggucguaaaggagauagcggagacccagcacggcacgauagucauccgcguccaguacgagggcgacggcagccccugcaagauacccuucgagauaauggaucucgagaagcggcacgugcucgggcgccugaucacggugaaccccaucgucaccgagaaggacagucccgucaacaucgaagccgagccgcccuucggggacagcuacauuaucauuggcguggagccgggacaacuuaagcucagcugguuuaagaaggguagcucuaucggucagauguucgagaccaccaugcgcggcgccaaacggauggcgauccugggugacacagccugggacuuugggagccugggcggggucuucacuuccaucggcaaggcgcuccaucagguguucggggcaauauacggcgccgccuucucuggggugucauggaccaugaagauccugaucggggucguuaucaccuggaucgggaugaacagccgaaguacgagccuguccgugucacugguccucguggggguggucaccuuguaccucggcguaaugguucaagcggacuccgggugcguugucagcuggaagaacaaggagcucaagugcggcucagguaucuucaucaccgacaacgugcauaccuggaccgagcaguacaaguuucagccagaaucucccagcaagcuggccuccgcgauacagaaggcccacgaggaggggauuugcgguauccggagcgucacccgccuggaaaaccucauguggaagcagaucacccccgaauuaaaccauauccugaccgagaacgaagugaagcucacgauuaugaccggagacauuaagggcauaaugcaggccggaaagcggaccuuacguccccagccgaccgagcuaaaguacuccuggaaagcguggggaaaggccaagaugcucagcacggagcugcacaaucacacuuuccugaucgacggucccgaaaccgcugagugcccgaacacuaaccgggccuggaacucccucgagguggaggacuacggguucggaguauucacgaccaacaucuggcuuaagcugaaggagcgccaggacguguucugcgacucgaagcucauguccgcagcgaucaaggacaaccgggcugugcacgcagacaugggguauuggaucgagagcgcccugaacgacaccuggaagauugagaaggccagcuucaucgaggucaaaagcugccauuggccuaagagucacacgcuguggaguaacgggguucucgagucugagaugaucauccccaagaacuucgcgggcccgguaucacagcacaacuaccgccccggguaccacacccaaacggccggaccguggcaccuggggcggcuggagauggauuucgacuucugugagggcaccacugucguugugaccgaggacuguggaaauaggggcccgucccuucggacgaccacggcuucaggcaagcucauuaccgaguggugcugccgcagcuguacgcugccgccccuccgguaucgcggggaggaugguugcugguacgggauggagauccggccgcugaaagagaaggaggagaaccuuguaaauucccuaguaaccgccggccacgggcagaucgauaacuucagccuuggaguauugggaauggcccucuuucuggaggagaugcugcgcacccgggucgggacaaagcacgccauccugcuuguggccguuucguucgucacgcugauaaccggcaacaugagcuuccgugaucucgggcgcgugauggugauggucggcgcaaccaugacggacgauaucggaaugggagugacguaccuagcccugcuggcggccuucaagauccggcccaccuuugccgccggucugcugcuccgcaagcugaccuccaaggagcugaugaugacuacaaucgggaucguacucuuaucccaguccaccauccccgagaguauacuggagcucaccgacgcccuggcgcuggguaugaugguucuuaagauugugcggaacauggagaaguaccagcuggccguaaccaucauggccauccugugcgugccuaacgccgucauacuacagaacgccuggaaggucuccugcacgacacuggcgguugugagcgucuccccgcuacuccuaacaucuucccagcagaaggcugauuggaucccgcuggcguuaacgauaaaagggcugaacccaacggccauauuccugaccacacucagccgcaccuccaaaaaacggagcuggccccugaacgaggcgauuauggccgugggcaugguaagcauauuagccagcucccuccugaagaaugacauuccgaugacaggcccacucguugccggaggccuccugacagugugcuacgugcugaccgggcgcagcgcugaccucgagcuggaacgggcugccgauguccgcugggaggaacaagcagagauaagcggcuccagcccaauacuuuccaucaccaucagcgaggacggguccaugagcaucaagaacgaagaggaggagcaaacguugacgauccugaucaggaccggccugcucguuaucucaggccuguuccccguaagcaucccgauaaccgccgccgcaugguaccugugggaggucaagaagcagcgcgccggggugcucugggacgugcccagcccgccgcccgucgguaaggccgaguuagaggacggggccuaucggauuaaacagaaggggauccugggguacagucagaucggcgccgggguauacaaggaggggacguuucacacgauguggcacgugacccgcggcgcgguucugaugcacaaggggaagcggaucgagcccuccugggccgacgugaagaaggaccugaucucauacggcgggggcuggaagcuggagggcgaguggaaagaaggggaggagguccaggucuuggcguuagagcccggcaagaauccccgcgccgugcagaccaagcccggucucuucaagaccaacacgggcaccaucggagcaguaucccucgacuucagccccggcaccuccggcagccccaucguagacaagaaggggaagguggugggccuguacgggaacggcgucgugacucgguccggcacguacgugagcgcgaucgcacaaacugagaaguccaucgaggacaacccggagaucgaggacgacaucuuccgcaagaagcggcugaccaucauggaccugcaccccggggccggcaagaccaagcgcuaucucccugccaucguucgugaggcgaucaagcgcgggcugcggacgcugauacucgcucccacccgcguggucgccgccgagauggaggaggcgcuacgaggcuuaccgauucgguaccagacucccgcgauccgcgccgagcacaccgggcgggagaucguagaccucaugugccacgccacguucaccaugagacugcugagccccauccgggugccgaacuauaaccucaucaucauggacgaggcucacuucacagauccggccagcauugcugcccggggcuacaucuccacccggguggagaugggcgaggccgccggcaucuucaugacagccacgccgcccggcucgcgcgaccccuucccgcagucgaacgcacccaucauggacgaggagaaggagauccccgagaggagcuggaacuccggucacgagugggugacugacuucaagggcaagacggucugguuugugcccagcaucaaggccgggaacgacauagcagccugcuugcgcaaaaacggcaagaagguuauccagcugucccggaagacauucgacucagaauacaucaagacccgcaccaacgacugggacuucgucgugaccacggacaucucggaaaugggggcgaacuucaaggccgagcgggugaucgacccgcgccguugcaugaagcccgugauccucaccgacggggaggagcgcguuauccuggcgggucccaugcccguaacccauagcuccgccgcccagcgacgcgggagagugggccgcaacccgaagaacgagaacgaccaguauauuuauaugggagagccgcuggagaacgacgaggacugcgcgcacuggaaggaggccaagaugcucuuggacaacaucaacacccccgagggcauuaucccaaguauguuugagccugagcgcgagaagguggacgccaucgacggcgaguaucggcuccgcggggaggcccgaaagacguucgucgaccuuaugcgccggggcgaccugcccguguggcucgccuacagagucgcggccgagggcauuaacuacgccgaccggcggugguguuucgauggcgugaagaacaaucagauccucgaggagaacguggaggucgagaucuggaccaaggaaggggagcggaagaagcugaagccccgcuggcuggacgcccggacuuacuccgacccgcucgcccugaaagaguuuaaggaguucgcggccggccggaagucgcugacacugaaucugaucacggagaugggccgucugcccacauuuaugacccagaaggccaagaacgcccuugacaacuuagcgguccugcacaccgcggaggccggcggacgcgcguacaaccacgcccucuccgagcuucccgagacgcuggagacccuccugcuccucacccuucuagcgacggugaccggcggcaucuuccucuuccugaugagcggcaaggggaucgggaagaugacacuggggaugugcugcaucaucaccgccuccauccuccugugguacgcccagauccaaccccacuggaucgccgccagcaucauccuagaguucuuccucaucguuuugcugaucccggagccagagaagcagcggacgccgcaggacaaccaacucaccuacgugguaaucgcgauccugacggucguggccgccaccauggccaacgagaugggcuuccuggaaaagaccaagaaggacuucgggcucggcuccauaacgacgcaacagccagagagcaacauccuugacaucgacuuacgcccggcgagugccuggacucucuaugccguggccacaaccuucauaacgccaaugcugcggcacuccaucgaaaacagcuccgucaaugugagucugaccgccaucgccaaccaggccaccgugcucaugggccuggggaaaggcuggccccugucaaagauggacaucggggucccccuacuggccauuggcuguuauagccaagucaacccgaucacccuaacggccgcccuucugcugcucguggcucauuaugccaucauagggccgggccugcaggcaaaggcgacucgcgaagcgcaaaaacgggcggccgcuggcaucaugaagaaccccaccgucgaugggaugacggugaucgaccuagaccccaucccuuaugaccccaaauucgagaagcaacuuggccaggucauguugcuaguccuuugcguaacacaggugcugaugaugcgcaccacaugggcucugugcgaggcccucacccuggcgacugggcccauaaguacccugugggaggggaaucccgggcgguuuuggaacacaaccaucgcaguaucaauggcaaacaucuuccgcggcuccuaccucgccggcgccgggcugcuguucagcaucaugaaaaacacggcgaacacacgccgaggcaccgggaacaccggcgagacgcucggagagaaauggaagaaccgccuuaacgcccuggggaagagugaguuucagaucuacaagaagucaggcauccaggagguggaccggaccuuggccaaggaagggaucaaacgcggcgagacugaccaccacgccgugucccgggggagcgcgaaguugcgcugguucgucgaacggaauuugguuaccccagaaggcaaggugguagaccucggcugcgggaggggcggaugguccuacuacugcggcggguuaaagaauguuaaggaagugaagggccugacgaaaggcgggcccggccaugaggagcccauccccaugagcacuuacggguggaaccugguccgccuucaguccggcguagacguguucuucaccccgccagagaagugugacacccugcucugcgacaucggcgaaagcucccccaauccaacagucgaggccggccgcacgcugcgggugcugaaccucguugagaauuggcugaacaauaacacccaguucugcaucaagguccugaacccguauaugcccucgguuauagagaaaauggaggcacugcagcgcaaguacggcggggcccucgugcggaacccccuaucuagaaacuccacccacgagauguauugggugagcaacgccagugggaacauaguaagcagugugaacaugaucagccggaugcuaaucaaccguuucaccaugcggcacaagaaggcaacauacgagccggacgucgaucuuggguccggcacgcgcaacaucgguauugagagcgagacccccaaccuggacauaaucggcaagcgaaucgagaagaucaagcaggagcacgagaccuccuggcacuaugaucaggaccaccccuacaaaacgugggccuaccaugggagcuaugagacaaagcaaaccggguccgccagcaguauggugaacggcguggucaggcugcucacuaaacccugggacgugaucccuauggucacgcaaauggcaaugaccgauaccacuccguucgggcagcagcgugucuucaaggagaagguagacacgcggacccaggagcccaaggagggcaccaagaaacugaugaagauuacggccgaauggcuguggaaggagcucggcaagaagaagacgccccgcaugugcacccgggaagaguucacccgcaagguccggagcaacgcugcgcugggggcgaucuucaccgaugagaacaaguggaaguccgcgcgugaggccgucgaggacagcggcuucugggagcugguagacaaggaacggaaccuccaccuggaggggaagugcgagaccugcgucuacaacaugaugggcaaaagagagaagaagcugggggaauucggcaaggcgaagggcucucgggccauaugguacauguggcucggugcacgcuuccuggaguuugaggccuugggguucuugaaugaggaccacugguucagccgcgagaacagccugucugggguggagggcgaggggcugcauaagcucggcuacauacugcgcgacgugagcaagaaggagggcggagcgauguaugccgaugauaccgccgguugggauacgcggaucacccuggaagaccucaagaaugaagagaugguaacgaaccacauggagggcgagcauaagaagcuggccgaggccaucuucaagcugaccuaccagaauaaaguggugcgcguccaacggccgacgccacgcggcaccgugauggacaucaucucccgccgagaccagcgugggagcggccagguagucacauauggcuugaacacuuucaccaacauggaagcgcagcuaauccgccagauggaaggggagggcguguuuaagucaauacagcagcugaccguuaaggaagagaucgccgucaagaacuggcucauccgggugggacgcgagcgccuaagccggauggccauaucaggggaugacuguguggucaagccccuggacgaccguuuugcgagugcccuaacugcgcugaacgacauggggaagguaagaaaggacauccagcagugggagcccuccagaggguggaaugauuggacacaggugccguucugcagccaccacuuccaugagcuaaucaugaaggacggccggguccucgugguucccugccgcaaccaagacgaacucaucgggcgggcccgcaucucccagggcgccggguggagccugcgggagacagccugucucggcaaauccuacgcucagauguggagccuuauguacuuccaccgccgggaccugcgccucgcggccaacgcuaucuguuccgcggucccuagccacuggauacccacuucccggaccacguggagcauccacgccacccaugaguggaugaccaccgaggacaugcugacgguguggaacagaguguggauccaggagaacccuuggauggaggacaagacccccgucgaguccugggaggagauccccuaccugggcaagcgggaggaccaauggugcgggagccucaucggccuaaccuccagagcgacuugggccaagaauauccagacggccaucaaccaagugcgcagccugaucggaaacgaggaauacacugauuacaugcccucgaugaagcguuuccggagggaggaggaggaggccgguguguugugguag

SEQ ID NO: 25445 - RNA, 9876 nt, Artificial Sequence
  derived and/or modified CDS sequence (opt11) from DENV-2__KC964095__SS-prME
agugcuggcaugaucaucaugcugauccccaccguuauggccuuucaccucaccacccgcaacggggagccccacaugauagugagcauccaggagaaggguaagagucugcuauuuaaaacggaggacggggugaacaugugcacccucauggcaauggaccugggcgaacugugcgaagauaccaucaccuacaagugcccguugcugcggcagaaugagcccgaggacaucgaccgcugguguaacagcaccuccacaugggugaccuaugggaccugcaccaccacaggcgagcacagacgugagaagcggagcgucgcccuggugccccauguugguaugggccucgagacucguacugagaccuggaugucguccgagggagccuggaagcacgcccagagaaucgagaccuggauccugcgccaccccgguuucacgaucauggccgcaauucuugccuacacuauuggaaccacacacuuccagcgggcccucaucuucauccuccugacggccgucgcgccgcccaugaccaugcgcugcauugggaucagcaaccgggacuuuguggagggcguguccggcgggagcugggucgacaucguccuagaacauggcuccugcguuaccaccauggccaagaacaagccuacguuagacuucgagcuaauuaagacugaggcaaaacagccggccacccuccgcaaguacugcauagaggcuaagcugaccaacacgaccaccgaaagccgaugcccgacgcagggcgaacccucccugaaggaggaacaggacaaacgcuucgugugcaaacauagcaucguggaucggggcugggguaacgguuguggauccuucgggaaaggcgggauaguuacgugugcgauguucacgugcaagaagaacauggagggcaagauagugcagcccgagaaccucgaguauacuaucguagucaccccgcacagcggcgaggaacacgccaucgggaacgauacgggcaagcaugggaaagagauuaaggucacgccgcaguccagcgugaccgaggcagagcugaccggcuacgggaccguaacaaucgagugcagcccccgcacuggccuggacuuuaaugagauggucuugcugcagaugggcaacaaggccuggcuggugcauaggcagugguuccucgaccugccccugccauggcucccaggggcggacacccagggcucgaacuggauccagaaagaaacccuggugaccuuuaagaacccccacgcgaagaaacaagacgucgugguccuggggagccaggagggcgccaugcauacggcccucaccggugccaccgagauccagauguccagcggcaaccuccuguucacaggccaccugaaaugcggucugcgcauggacaagcuccaacucaagggaaugucuuauagcauguguacuggcaaauuuaaagugguuaaggagaucgccgaaacucagcacggcaccauugucauccguguucaguacgagggagacgggucccccugcaagaucccguucgagaucauggaccuggaaaagcgcuacguccugggcagacucauaacggucaaucccaucgugaccgaaaaggacucgcccgugaacaucgaggcagaacccccuuucggggacuccuauaucaucaucggcguugaaccagggcaguugaagcugaacugguuuaagaaaggcagcaguaucggccagauguucgagaccaccaugcgcggggccaagcgcauggcgauccucggcgacacggcuugggacuuugggagccuuggcgggguguuuaccucuaucggcaaggccuuacaccaaguguucggcgcgaucuacggggcagccuucagcggugucuccuggaccaugaaaauucugauugguguuaucauaaccuggaucggcaugaacagcagguccacgaguuuauccgugagccugguccugguagguauaguuacacucuaccuaggcgucauggugcaggccgacuccggcugcguggucagcuggaagaacaaggagcugaaaugcgggagcggcaucuucaucaccgauaacgugagaacauggacggagcaguacaaguuccagccugagucccccagcaagcuagcgagugcuauccagaaagcccaggaggaaggaauuuguggaauucgcagcgugacgcgauuagagaaccugauguggaagcagaucacgccggagcucaaucacauccuggccgaaaaugaggucaagcugaccaucaugacgggggauaucaagggcaccaugcaggccggcaagcguucuuuacgaccccagcccaccgaguugaaguacagcuggaagaccugggggaaagcaaagaugcuauccacagagagccacaaccaaaccuucuuaauugacggccccgaaacugcagaaugccccaauaccaaccgggccuggaacucacuggaggucgaggauuauggguucggcauguucacgaccaauauauggcuacagcuuaaggagaagcaagaugcuuucugugacucgaagcugaugucagcugcgauuaaggacaaccgcgcagugcacgccgacaugggauacuggaucgaaagcgcccugaaugacaccuggaaaaucgagaaggcuuccuucaucgaagucaagaacugccauuggcccaagucucacacacucugguccaacgggguauuagagucggagaugaucauccccaagaaccuggcgggcccggugucccagcacaauuaccggcccggguaucacacccaaaucgcgggucccuggcaccagggaaaacccgagauggacuuugacuuuugcgacggaacaaccgucguggugaccgaggacugcggaaaucgcgggccgagccugcggacgacgaccgccagcgggaagcugauuaccgaguggugcuguagaucgugcacccuuccgcccuugcgguaccgcggggaggacgguuguugguacgggauggagauccgcccgcugaaagagaaggaggagaaccuggucaauucucucgugacggcgggccacggccagaucgacaacuuuucguugggggugcugggcauggcccucuucuuagaagagaugcuccgcacccgaguugggaccaagcacgccauccuccugguggccguauccuucgucacccugaucacgggcaacaugucguuuaaggaucucgggcgcgugguggucauggugggugcgacuaugacugacgacaucggcaugggggucaccuaccucgcccugcucgcggccuucaaaguacggcccacguuugccgccggucuacuguugcgcaagcugaccuccaaagagcugaugaugaccaccauugguauugugcuccuuucccaaagcacgauccccgagaccguccuagaacucaccgaugcccuggcccugggcaugauggcccucaagaucguucgagacauggaaaaguaucaguuggccgugaccaucauggccauccugugcguccccaacgccgucauccugcaaaacgcguggaaggugucuugcacgauccuggccguagugagcgugagcccccugcuccugacgagcagccaacagaagaccgauuggaucccccuggcccuaaccaucaagggguuaaaccccacggccaucuucuugacaacccucagccguaccaacaagaagagauccuggccccucaacgaggcuaucauggccgugggaauggugagcauccuggccuccagccuccugaagaacgacauucccaugacuggcccgcugguggccgggggccuacugacgguguguuacgugcuuaccgggcggagcgccgaccuggaacucgagcgagcgacggacgugaauugggaggaccaagcugagauaagcggcuccucccccauccugagcauaacgaucuccgaggacggcagcauguccaucaagaacgaggaggaggagcagacguuaacaauccugaucagaaccgggcuucucgucaucagcggccuguuucccguuuccauccccaucacggcggccgcaugguaccugugggaggugaaaaagcaacgcgcggggguccucugggacgugcccuccccgccgcccaugggcaaggccgagcuggaggacggugccuacaggaucaaacagaaaggcgugcuuggcuacagucagaucggugccggggucuacaaagaggggacguuucacacgauguggcacguuacccgcggggcagugcucaugcacaaggggaagcgcaucgagccgagcugggcggacguaaagaaggaucugauauccuacggcggaggguggaagcuggguggggaguggaaggagggggaggagguccaagugcucgccuuggagcccgggaaaaacccccgcgccguucaaaccaaaccaggccuguuuaagacuaacaccggcaccaucggggccgugagccucgacuucucccccggaaccagcgggucccccaucaucgauaagaagggcaaggucgaggggcuguacgggaacggugucgugacucgaucugggaccuacguauccgccaucgcgcaaaccgagaagucgauagaggacaaccccgagauugaggacgacaucuuucgcaagaaacggcucaccauaauggaccuccacccgggcgccggcaagacgaaacgcuaccugcccgcuauuguccgggaggccaucaagcguggucugcguacguuaaucuuggcuccaacccgcgugguggccgcggagauggaggaggcguuacggggucugcccauccgcuaccaaaccccggcgauccgggcggagcacacugggcgugagaucguggauuuaaugugccacgccaccuucacaaugcgcuugcucuccccuguacggguucccaacuacaaccucaucauaauggaugaggcccacuucacagaccccgcgagcaucgcugcgagaggcuacaucagcacgcggguggagaugggggaagccgccgggaucuucaugacagcuacaccgccgggaucgcgcgacccauucccacagagcaacgccccgaucauagacgaggagcgugagaucccagaacgcuccuggaacagcggccacgaguggguaaccgacuucaaaggcaagacggugugguuuguccccuccaucaaggcgggaaacgacaucgccgccugucugcguaagaacggcaagaaggugauccaguuaagccgcaagaccuucgauuccgaguacguuaaaacccggaccaacgacugggacuucgucgugacgaccgacaucagcgagaugggagcgaacuuuaaggcggagcgcgugaucgauccccggcgcugcaugaagccgguuauccucaccgacggcgaggagcgggugauccuggccggucccaugccugugacgcacuccagcgccgcccagcgccggggucgcaucggccggaacccuaagaaugagaacgaccaguacauuuacaugggggagccacuugagaacgacgaggauugcgcccacuggaaggaggcgaaaaugcuccuggacaacaucaacacacccgagggcaucauucccagcauguucgagccugagcgcgagaagguggacgccaucgacggggaauaccggcugcgcggcgaggcccguaagaccuucguugaccuaaugcggcggggggaucugcccguuuggcuggccuacaaggucgccgcggaaggcauuaacuacgccgacaggagaugguguuuugauggaauuaagaacaaccagauccucgaggagaauguggagguggaaaucuggacgaaggagggggaacgaaaaaaacugaagccccgguggcucgacgcccguaucuacucagauccacuagcucugaaggaguucaaggaauucgccgcgggcaggaagucccugacccucaaccugaucacugagauggggcgucuccccaccuucaugacccagaagacccgcgacgcccuggacaaccuggccguacugcacacggccgaggcggguggccgggccuacaaccaugcucucagcgaacugcccgaaaccuuagaaacgcuccuucugcugacgcuguuagccacggugaccggugggauuuuccucuuccugaugagcggccgcggcaucgguaaaaugacccuuggcaugugcugcaucaucaccgccagcauccuccugugguacgcccagauccagccccacuggauagccgccaguaucauucuggaguucuuccuuaucguguugcugauccccgagccggagaagcagcgcacgccucaggauaaccaguugacguacgugguaaucgccaucuuaaccgucguagccgcgacgauggccaacgagaugggcuuccuggaaaagaccaagaaggaccucggcuuaggcagcauaacuacccagcagccugaauccaacauccucgacauugaccugcccccggccagugccuggacuuuauacgcaguggcgaccacguucguaacccccauguugcgccacucaaucgagaacuccagcgugaacgugucccucaccgccaucgccaaccaggccaccguccugauggggcucggaaagggguggcccuugagcaagauggacaucggcgugccccugcucgccaucgguugcuacucccaggugaacccgaucacuuuaaccgcugcgcugcugcucuuaguugcccauuacgccaucaucggacccggccugcaggcaaaggccaccagagaggcccagaagcgcgccgccgcggggauaaugaagaaccccacuguggacggcaucaccgugauugaucuagauccaaucccguacgaccccaaauucgagaaacagcugggucaggucaugcugcuaguauuaugcgugacccaggucuuaaugaugcggaccacuugggcccucugcgaggcccuaacacuggccacgggccccaucagcacacucugggagggaaacccgggaagguucuggaacaccaccaucgcuguuuccauggcgaacauauuccggggcagcuaccuggccggagccggauuacucuucuccaucaugaagaacaccaccaacacucgccggggcacgggcaacaucggcgagacccugggcgagaaguggaagucccgccuuaacgcucucgguaaguccgaguuucagauauauaaaaaauccgguauccaggagguggaucgcacacuggccaaggaaggcaucaagcgcggcgagacagaucaccacgcggucucccgcgguagcgccaagcugaggugguucguggaacgcaacauggugacgccagaggguaaagucguggaucucgggugcggccgcggcgggugguccuauuauugcggcgggcugaagaacguccgcgaagucaaagggcugaccaaagggggucccgggcacgaggagcccauccccaugucgaccuacggcuggaaccucguccgacuucaguccgguguagacgucuucuucaucccgccugagaaaugcgauaccuuacuuugcgacaucggggaguggagccccaauccaaccguggaggcgggccgcaccuuacgggugcugaaccucguggagaacuggcugaauaacaacacccaauucugcauaaaagugcugaaccccuacaugcccucugucauagaaaagauggagacacuccagcgcaaauacgguggcgcacugguccggaacccacuaagccgcaacagcacccacgaaauguacuggguuuccaacgccuccgguaacaucgugagcucggucaauaugauuucgcgaaugcuaaucaaccgcuucacaaugcgacacaagaaggccacauacgagccugacguggaccucggcuccggcacccgcaauauagggaucgaaucugagacccccaaucuggacaucauaggcaagaggauaggaaaaaucaagcaagaacaugagacaaguuggcacuacgaccaagaccaccccuacaagaccugggcguaccauggcuccuacgagaccaagcagacuggaagcgcuagcagcaugguggacggggucgugcgcuuacucacgaagcccugggacgugauccccaugguaacccagauggccaugaccgacacgacaccauucggccagcaacggguguucaaggagaagguggacacccggacacaagagcccaaagaaggaaccaagaaguuaaugaagauuacugcggaguggcuauggaaggagcugggcaagaaggagacaccacgcaugugcacacgcgaggaguucacccguaagguccgguccaacgccgcccucggggcgaucuucacagacgagaacaaguggaagagugcccgcgaagcgguggaggacuccggcuucugggagcucguggacaaggagcggaacuuacaccuggagggcaagugcgaaaccugcguguacaauaugauggggaagagagaaaagaagcugggcgaguucggaaaggccaaaggcucuagagcuaucugguacauguggcucggggcccgcuuucuugaguucgaggcacugggcuuccucaaugaggaccacugguucucgagggagaacucgcugucgggcguggagggagagggccuccacaaauuaggguacauccugcgcgacguuaguaagaaggaaggcggagcgauguaugccgacgacaccgccggcugggauacccggauaacgcuggaggaccugaagaacgaagagauggugaccaaucacauggagggcgagcacaagaagcuggcggaggcgauauucaaacugaccuaccagaacaagguaguacgcgugcaacggccaccgccaagggggacgguuauggacaucauaucccguagagaccagcgcggauccgggcaggucgucacguacggacucaauacguucacgaacauggaggcucaguuaaucaggcagauggagggcgaagggguguuuaaaaacauccaacaccugacggucacggaggagaucgcagugcagaacuggcuugcccgggugggccgcgagcgguugucucgcauggcuaucuccggggacgauuguguagucaaaccccuggaugaucgcuucgcgagcgcccugaccgcucuuaacgacgugggaaagauucgcaaggauauccaacagugggagcccucccgcggaugggacgauuggacccaaguccccuucugcagucaucacagccacgagcugaucaugaaggacggccgcguguuggugguccccugccguaaccaggacgagcugaucggccgggcccgcaucucgcaaggggcggguuggucccuacgggagaccgccugccuaggcaaaagcuacgcccagauguggucgcuuauguacuuccaccgacgcgaccugcggcucgccgcaaacgcuauuugcagcgccguacccucccacuggguucccaccagcagaacaacuugguccauccacgcuaagcacgaguggaugaccacagaggacaugcugaccgucuggaaccgcguguggauccaagagaaccccuggauggaggacaagacccccguagagagcugggaggaaauccccuacuuggguaaaagggaggggcaauggugcggguccuuaaucggccugaccucucgcgcuacuugggccaagaacauccagaccgcuauuaaucagguccgaucacuuaucgggaacgaagaguacaccgacuacaugccguccaugaagcgcuuccggagggaggaagaggaggcgggggucuuaugguag

SEQ ID NO: 25446 - RNA, 9876 nt, Artificial Sequence
  derived and/or modified CDS sequence (opt11) from DENV-2__KC964094__SS-prME
uccgcaggcaugauuaucaugcugauucccaccgugauggcguuucaucugaccacccgcaauggggagccacacaugaucgucucaauccaggaaaaaggcaagagccugcuguucaagaccgaagacggagucaacaugugcacucucauggcgauggaucugggcgagcugugcgaggacacaaucaccuauaaaugcccccuacugcggcagaacgagccagaggacaucgacuguuggugcaacagcaccagcacgugggucaccuacgggacuugcaccaccaccggcgaacaucgcagagagaaacgcuccguugccuuagugccgcacguaggaauggggcuugagacccggacggagaccuggaugagcucggagggugcguggaagcacgcucagcgcauagagacguggguccugcggcaccccggguucaccaucauggccgcuauccuggcuuacaccaucggcacuaccuacuuucagcgcguucucaucuuuauccugcugacggcaguggcacccucuaugaccaugcgguccaucgggaucagcaaccgcgacuuugucgagggagugucgggcgggagcuggguggacguaguacucgagcacgguuccugcgugaccacuauggcgaaaaacaagcccacgcucgauuucgagcugaccaagaccgaggcgaagcaccccgccaccuugaggaaguacugcaucgaggccaagcugacuaacacaaccaccgccagccgcugcccaacucagggggaacccagucugaacgaggagcaagacaagcgguucguuugcaagcacagcaugguggaucgcggcuggggcaacgggugcggcuuguucgggaagggggggaucguaaccugcgcgauguucacguguaagaagaauauggaggggaaggucgugcagccagaaaaccuggaauauacaauagugauuacaccccacuccggagaagagaaugccguuggaaacgacaccgggaagcauggaaaagagaucaaggugacgccgcagagcuccgugacugaggccgaacugacuggauaugggacggucaccauggagugcucgccccguaccggccucgauuuuaacgagauggugcuucugcagaugaagaacaaagcguggcucguucacaggcagugguucuuagacuuacccuugcccuggcugccgggcgccgacacgcaggggagcaacuggauccagaaagaaacucuggugaccuucaagaacccucacgcgaagaagcaggauguggucgugcucggcucccaggagggggccaugcacacagcucugaccggcgcgacggagauccagaugagcuccggaaaccugcuauuuaccggccaucugaaguguagacugcgaaccgacaagcuccagcuaaaggggaugagcuacuccaugugcaccgggaaauuuaaaguggucaaggagaucgccgaaacacagcacgggaccaucgugauccggguucaauacgagggggacggcagcccgugcaaaaucccguucgaaaucauggacuuggagaaacgccacguucucggccggcugauaacugucaaccccaucgugaccgagaaggacucccccguaaauaucgaagcggagccuccuuucggggacucuuacaucaucaucggcguugagcccgggcagcugaaacucuccugguucaagaaagaguccaguaucggccagauguuugagacgaccaugcggggggccaagcgcauggcgauccuaggggauacagcgugggauuuuggcagccugggcgggguguucacuucgaucgggaaggcucuccaccaggucuucggagcgauauauggggccgcguucuccggcgugucguggacuaugaagaucuuaaucggcgugguuauaaccuggaucgggaugaacucacgauccaccagccuuuccgugucacuggugcucgucggaguggugacgcuguaccugggagucauggugcaggcagacucuggcugcgugguuucguggaaaaacaaggagcucaaaugcgggagcggcaucuuugugaccgacaaugugcacaccuggaccgagcaguacaaguuccagcccgaaucccccagcaagcuugcuuccgccauccaaaaggcccacgaggaggguaucugcgggauccgaucggucacucgacuggagaaccucauguggaagcagauaacacccgagcugaaucauauacuguccgagaacgaggucaaguuaacuauaaugacaggcgacaucaaagggaucaugcaagccggcaagcgcagccugcguccgcaacccaccgagcugaaguacuccuggaaagccugggggaaggcgaagaugcucagcacggagcuucacaaucacacauuccuaaucgacgguccagagacagccgagcgccccaacaccaaccgcgccuggaacucccucgagguggaggacuacggcuucgguguuuucacgaccaauaucuggcuaaagcugaaggaacgccaggauguauucugcgacagcaagcucauguccgcggcgaucaaggacaaccgggcggugcacgccgacauggguuacuggaucgagagugcgcuuaaugacaccuggaagaucgaaaaagccaguuuuaucgaggucaagucaugucacuggccgaaaagccacaccuuguggaguaacgggguccucgaaagcgagaugaucauccccaaaaacuuugccggccccgugucacagcauaauuaccguccgggcuaccacacccagacagcagggcccuggcaccugggccggcuggaaauggacuucgacuucugcgaagggacgacagucguagucacagaggacugcgggaaccgcggucccucccugcggacgaccacagcauccgggaaauugaucaccgagugguguugucgcaguugcacucuucccccacuucgguaccgcggcgaggacgggugcugguacgguauggaaauccggccgcugaaggaaaaggaagagaaccuggucaacucccucguuaccgccgggcacggccagaucgauaacuucucccucggcgugcugggcauggcacucuuccuggaagagaugcugcgcacccgugucggcaccaagcacgcgauccuccucguggcugugucauucgugacgcuaaucacagggaauaugucauuccgggauuugggccgcgugaugguaauggucggcgcuaccaugaccgacgacaucggaaugggggugacauacuuagcucugcuggcggcguucaaggucagacccaccuucgccgccggucuucugcuccgcaagcugacauccaaggagcugaugaugaccacgaucgguaucguguuacugagccagagcaccauccccgaaacaauauuagagcuuaccgaugcucuggccuuagggaugaugguguuaaagaucguccggaauauggagaaguaccaguuagccgugaccauaauggccauccugugcguaccgaacgccguuauacuacagaacgccuggaaggugagcugcacgaccuuagccguggucuccgugagcccccuucuauugaccuccagccagcagaaagcggacuggaucccccuggcgcucacgauuaaaggccucaaccccacggcgauuuuuuuaaccacucucucccgcacaaguaagaagcgguccuggcccuuaaacgaggcaauaauggcgguggggauggugucuauccuggcgaguucuuuacugaagaacgauauucccaugaccggcccacugguggccgggggguuguugaccgugugcuauguccuggccggccgcagcgccgaccucgagcuggaacgggcggccgacgugaggugggaggagcaggccgagaucuccgggagcucacccauucuaagcaucacuaucuccgaggacggcggaaugagcaucaaaaacgaggaggaagagcagacccucacaauacugauccguacaggccuccucgugaucuccggccuauucccggucagcaucccgaucacagccgccgcaugguaccugugggaggugaagaagcagcgagccgggguucucugggacgucccuagcccuccgcccguuggcaaggccgagcuggaggacggggccuauaggaucaagcagaagggcauccugggguauagccagaucggcgccggcguguacaaggaagggaccuuccacacgauguggcacgucacacgcggcgcggugcucaugcacaaggggaagcggauugagccaucuugggccgacgugaagaaagaccucaucucguacggcgggggcuggaaguuagagggggaguggaaggagggcgaggagauccagguccucgcgcuggaacccggcaaaaauccccgcgcuguacagaccaagcccgggcuguucaagaccaacaccggcacaauuggugccgugucccucgacuucagcccagguaccuccggcucgcccauagucgacaagaaggggaaaguggugggguuauacggaaacggggucgugacccgguccggcacauacgugucggcgaucgcacagaccgagaaaucgauugaggacaaccccgagauugaagacgacaccuucagaaagaagcggcugaccauaauggaucugcaccccggggcaggcaagacgaagcgauaccucccggcaaucguccgggaggccaucaagcgcggauugagaacucugauccuugccccuacucgcgugguggccgcagagauggaagaggcccugcgaggacuacccauccgguaccagacccccgcgauucgcgcagagcacacggggcgggagaucguugaccucaugugccaugcaaccuucacaaugcgccugcuguccccaauucggguacccaacuacaaccucaucaucauggacgaagcacacuuuaccgaccccgcgagcaucgcggcacgcggcuacauaucaacgcggguggagaugggcgaggccgccgggaucuuuaugaccgccacgccccccggcagccgcgauccguucccucaguccaacgcgcccauaauggacgaggagcgggagaucccagaacguagcuggaauuccgggcacgagugggucaccgacuucaaggguaaaacuguaugguucgugccgagcauaaaggccgggaacgauaucgcagccugccugcggaagaacggccgcaaggucauccaguugucgcggaaaaccucagacuccgaguacaucaagacccguaccaacgacugggauuucguggugacgaccgauauaucagagaugggcgcgaacuucaaggcagagcgagucaucgacccccgccggugcaugaaacccgucaucuuaaccgacggggaggaacgcgugauccuggccggccccaugccagucacccacuccagcgcagcacagcgcagaggucgcgucggccggaacccuaagaacgaaaacgaucaguacaucuauaugggggaaccccuggagaacgacgaagacugcgcgcacuggaaagaggccaagaugcuccuggacaauauuaauaccccagaaggcaucaucccgagcauguucgagccggagcgcgaaaaagucgacgccaucgacggcgaauaucgccugcgcggggaagcgcggaaaaccuuuguggaccucaugcgccgaggcgaucugcccguuuggcuggcauaucgcgucgcggccgaagggaucaacuacgccgaucguagauggugcuucgacggcguuaagaacaaccagauccucgaggagaacguggaagucgagaucuggacaaaggagggcgagaggaagaagcugaagccgcgcuggcuggacgcccggaucuauagcgacccgcucgcccugaaggaguucaaggaguucgcggccggccgcaagucgcugacccucaacuuaaucacugaaauggguaggcugccuaccuucaugacccagaaggcccgcaacgcccucgauaaccuggcgguguugcacaccgccgaagcagggggccgggccuacaaccaugcacuuagcgagcugcccgagaccuuggagacgcugcucuuauugacccuccuggccaccgugacugggggcauauuucucuuccugaugucaggcaaagguauaggaaagaugacgcuggggaugugcugcaucauaacugccucgauacuccugugguacgcccaaauccagccccacuggaucgccgcaucaauuaucuuagaguucuuucucauuguucuacugauccccgagcccgagaagcaacgaacuccucaggacaaccagcucaccuacguggugauagcgaucuugacgguaguggcggccaccauggccaacgagaugggguuccuggagaagacaaagaaagacuucgggcucggcuccaucgcaacccagcagccugagagcaacauccuagacaucgaucuucggccggcguccgcguggacgcuguacgccguggccacgaccuucauuaccccuaugcuccgccacagcauugagaacuccagcgucaacguuucacugacugcuaucgcgaaucaggccaccgugcuuaugggcuuggggaagggauggccacugagcaagauggacaucgggguaccucuccuggccaucggcugcuacucccaggugaaucccauaacccugaccgcggcgcuccugcugcuggucgcccacuaugcuauaauaggcccuggccuccaggcuaaggcaacgcgugaagcgcagaagcgcgcagccgccggcaucaugaagaaucccacagucgacggaaucacagugaucgaccuggacccaauccccuacgaccccaaguucgaaaagcaacucggccaggugaugcugcuaguacuuugugugacccagguccugaugaugcgcaccaccugggcccugugugaggcguuaacuuuggccaccgggcccaucagcacccuaugggagggcaauccggggcguuucuggaauacuaccaucgccgucuccauggccaauaucuuccgcgggucauacuuagccggcgcugggcugcucuuuuccauuaugaagaacacagccaauacucggcgcggcacagggaacacuggcgaaacccugggcgagaaguggaagaaccggcugaacgccuuaggcaagagcgaguuucaaauauauaagaaguccgguauccaggagguggaccgcacgcuugccaaggagggaaucaaacggggcgagaccgaccaccacgcugugagccggggguccgcgaagcugcggugguucgucgagcgcaaucuggucaccccggagggcaagguugucgauuuaggaugugggaggggaggguggagcuauuacuguggcgggcugaagaacgugaaagagguaaagggccugacaaagggcggacccggccacgaggagcccauccccaugucaacguacggguggaaucucgucaggcuccagagcggggucgacguguucuucaccccgcccgagaagugcgacacccugcuaugcgacauaggcgagagcagucccaacccaacggucgaggcaggccggaccuugcgcgugcugaaucucgucgaaaauuggcucaacaauaacacgcaauucugcaucaagguccugaaccccuauaugccauccgugauugagaagauggaagcucuucagcggaaguacggcggggcccucgugggcaauccucuaucccgcaacagcacccacgagauguauugggcauccaacgcuagcgguaauaucgucuccagcgugaacaugaucucccguauguugauaaaccgcuucaccaugcggcauaaaaaagccaccuaugagccagacguugacuuaggcagcggcacgcggcacaucggcaucgagagcgagacccccaaccuggacaucauaggcaaaagaaucgaaaagauaaagcaggaacacgaaaccucguggcacugcgaccaagaccaccccuacaagacgugggcguaccacggcuccuacgaggcgaagcagacaggcagcgcuaguagcaugguaaacgggguuguuagacugcucaccaagccgugggacgucauccccaugguaacccagauggccaugaccgacacgaccccuuuuggacaacagcgagucuucaaggagaaaguggacacccggacgcaggagcccaaagaggguacuaaaaaacugaugaagaucacugcugagugguuauggaaagagcuugggaagaagaaagcgcccagaaugugcacccgggaagaauucacccgcaaggugcgguccaacgcagcccugggcgccauguucaccgacgagaauaaguggaagucggccagagaggccgucgaggacucgggguucugggagcugguggauaaggagcgcaaccuccaucuggaagggaagugcgagacgugcguguacaacaugauggggaagcgagaaaaaaagcucggcgaguucggcaaagcuaaggggagucgagccaucugguacauguggcucggcgcacgguuucuggaguucgaggcccuugguuuccucaacgaggaccauugguucagucgggaaaacagccugagcggcguugagggggaaggcuugcacaagcucggcuacauccugcgugacguauccaagaaagaaggcggggccauguacgcggacgacaccgccgggugggacacccggaucacguuagaagaccuaaagaacgaagagauggugacuaaccauauggagggcgagcacaaaaagcuggccgaggcaaucuucaaacugacauaccagaacaaggucguaagagugcagaggccgacuccccgcgggacggucauggacauuauaagucgacgcgaccagcggggcuccggacaggucgucacuuacgggcucaacacuuucacgaauauggaggcacagcuuaucagacagauggaaggcgagggggucuucaagagcauucaacaccuuacgguaacggaggagaucgcggugaagaacuggcuaguucgcgucggucgggagcgccugucccggauggccaucagcggcgacgauuguguggucaaaccuuuagaugaccgguucgcguccgcccugacagcccugaacgacaugggcaagguacggaaggacauccaacaaugggagccgagccgcggcuggaacgacuggacacaggugcccuucuguagucaccacuuucaugagcugaucaugaaggaugggcgagucuugguugugcccugcagaaaccaagacgaauuaauuggccgugcgcgcauaucccagggugcaggcuggucguugcgggagacggccugucugggcaagagcuaugcucagauguggucccugauguacuuccaccgccgggaccuucgccucgccgcgaacgcaaucugcagcgccgugcccucccauugggucccgacuagcagaaccacauggagcauccacgcuacucacgaguggaugacaaccgaagacaugcugacaguguggaaccgcgucuggauccaggaaaaccccuggauggaggacaagacgccgguggaauccugggaagaaauccccuaccuuggcaagcgggaagaucaguggugcggcagccucaucgggcugacgucccgcgcgaccugggcaaagaacauacagacugcgaucaaccaggugcggucuuuaaucggcaaugaggaguacaccgacuacaugccuuccaugaagcguuuccgccgggaagaggaggaagccgggguacucugguag

SEQ ID NO: 25447 - RNA, 9876 nt, Artificial Sequence
  derived and/or modified CDS sequence (opt11) from DENV-2__KC964093__SS-prME
accgccggugugaucauuaugaugauccccaccgucguggccuuccaccugacgacccggaacggcgagccccacaugaucgugucaagacaggagaagggcaagucccuccuguucaagaccgagaacggggugaacaugugcacgcugauggcaauggaccucggagaauuaugugaagacaccauaaccuauaacugcccccuacugcgacagaacgagccggaggauaucgacugcugguguaacagcacuuccaccugggugacguacgggaccugcacggccacuggugagcacagacgggagaagcggagcguggcccuggucccccaugugggcauggggcuggagacgcgcaccgagaccuggaugagcuccgagggggccuggaagcacgcacagcggaucgagaccugggugcuccggcaccccggcuucacgaucauggccgccauccuggccuacaccaucggcaccaccuacuuccagcgaguccugaucuuuauacuccuaaccgccguggcacccucgaugaccaugagaugcauagguauuagcaaucgggacuucgucgagggcgucuccggcgggucaugggucgacaucguuuuggaacacggcuccugugucaccacaauggccaagaacaagcccacgcucgacuuugagcugacaaaaacggaagcaaagcaccccgccacccugcgcaaguacugcauugaggccaagcucacgaacaccaccacugccagccggugcccgacgcagggcgagccaucccugaacgaggagcaggacaaacgcuucgugugcaagcacagcaugguggaccggggcuggggcaaugggugcggacuguuugguaagggcgggaucgugaccugcgccauguucacgugcaagaagaacauggagggcaaggucguacagcccgagaaccuugaauacaccaucgucaucaccccacacuccggcgaggaaaacguugucgggaacgacacgggcaaacacggaaaggagaucaaggucaccccgcagagcuccaucaccgaagccgaauugaccggcuacgggacggugaccauggagugcagcccccgcacuggccuggacuuuaacgagauggucuugcugcagauggaggacaaggcuuggcuggugcacaggcaaugguuccuggaccugccuuuacccuggcucccgggcgccgacacacagggguccaacuggauacagaaagagacgcuggugaccuuuaaaaacccccacgccaaaaagcaggacgugguugugcugggcagccaagagggggccaugcacaccgccuugaccggcgcuacggagauccagaugaguuccgggaaccugcuguucaccggccacuugaaaugccgcuugcggauggauaagcugcagcucaaggggaugagcuacucgaugugcaccggaaaguucaaagcggucaaggagaucgcggaaacccagcauggcacgauagugauacgcgugcaauaugagggggauggcaguccgugcaaaauccccuucgagaucauggaccuggaaaagcggcacgucuuaggccggcucaucaccgugaacccgaucgugaccgagaaggacaguccgguaaacaucgaggccgagccgcccuucggggacucuuacaucaucaucgggguggagccggggcagcugaagcuuuccugguucaagaaaggcagcagcauaggucagauguucgaaaccacgaugcguggagccaagcggauggccauacuaggcgauaccgcuugggauuucggaagccugggcggaguguucacuuccauuggcaaagcgcugcaccagguguucggggccaucuacggugccgcuuucagugguguauccuggacgaugaagauccucaucggcgucguaaucacguggaucggaaugaacagccgcuccaccagccuguccgugagccuagugcugguuggugugguuacccucuacuuggguguuauggugcaggcagacuccgggugcguggucucuuggaagaacaaggaacugaagugcggcagcggcaucuucaucaccgacaacgugcacacguggaccgagcaguacaaguuccagcccgagucgccgagcaagcuggccuccgccauccagaaggcccacgaagagggaauaugcggcauccggagcgugacucgucuggagaaccuaauguggaagcagaucacccccgagcucaaccacauccuuagugaaaacgaggucaaacugacaaucaugaccggggauauuaagggcauuaugcaggccgggaagagaagcuugagaccccagccaaccgaacugaaguacuccuggaaggcgugggguaaggccaaaaugcucuccaccgagcuucacaaccauacguuucugaucgacggccccgagacugccgagugcccgaacaccaacagagccuggaacucccuggaaguggaagacuacggguucgguguguucaccacgaacaucuggcuuaaguugaaagagcgccaggacguauuuugcgacagcaagcugauguccgcagcuaucaaggauaaucgggccgugcacgcugacaugggguauuggauagagucagcacuaaaugacaccuggaaaauugagaaggccucauucaucgaggucaagagcugucacuggcccaagucccacacccuguggagcaacggugugcuagaguccgaaaugaucauccccaagaacuucgcgggucccgugucgcagcauaauuaccgcccgggguaccacacccagaccgccggaccauggcaucucgggaagcuugagauggacuucgacuucugcgagggaacuaccgucguaguaaccgaggacugcgggaaccggggacccagccugcggacuacgaccgccuccgguaagcucaucaccgagugguguugccggucgugcacacugcccccgcugagauaccgcggggaggacgguugcugguacgggauggagaucaggccccucaaggagaaggaagagaaccuggugaacucacuggucacggccggccacgggcaaauagacaacuucucccucggagugcuaggcauggcguuguuccuggaggagaugcugcggacccgcguggggaccaagcacgccauccugcucgucgccguguccuuugugacccugaucacggguaacaugaguuccagggaccuggggcgcgucauggugauggugggcgccacaaugacugacgacauugggaugggcgucacuuaccucgcccugcuagcggcguucaaggugaggccgacuuucgccgccggccuccuacugcggaagcucaccuccaaggagcugaugaugaccacaaucgggauuguccugcucucccagagcuccauacccgagacgauccuggagcugaccgaugcacucgcgcugggcaugauggugcugaagaucgugcgcaacauggaaaaguaccaauuggcgguuacgaucauggccauacucugcgugccgaaugccgugauccuucagaaugcguggaaagucagcugcaccacacucgcggugguuuccgucagcccccugcugcugaccaguucccagcagaaagccgauuggaucccgcucgccuugaccaucaagggacucaaccccaccgccaucuuccugacgacccugucccgcaccagcaagaagcgcuccuggccgcucaacgaggcgaucauggccgugggcauggugagcauccuugccucuucccuacucaagaacgacaucccuaugaccgggcccuuggucgccgggggccugcucacggucugcuacgugcuggccgggcggagcgccgaccuggagcucgagcgcgccgccgacguccggugggaagagcaggcugagauuuccggaucuucccccauccucagcaucaccaucuccgaagaugggggcaugagcaucaagaacgaggaggaggagcagacgcugaccauccucauccgcacgggacugcuggucaucagcggccucuucccggugucgaucccaaucaccgccgccgccugguaccugugggaggucaagaagcagcgggccggcgugcucugggacguccccaguccgccgccggucgggaaggccgaacucgaggacggcgcguaccgaaucaagcagaagggaauccugggguacucacagaucggcgcugggguguacaaggagggcaccuuccacaccauguggcaugugacccgcggggccgucuugaugcacaagggcaaaagaaucgagcccuccugggccgacgugaagaaggacuugauaagcuacggaggcggcuggaagcuggagggggaguggaaagagggagaagagauccaagugcuugcccuggaacccgggaagaacccccgggccguccagaccaagcccggccuguucaaaaccaacaccgggaccaucggcgcggugucccuagacuuuagcccagggacuuccgggucccccaucguggacaagaagggcaaggucgugggucucuauggcaauggcgucgucaccagaucaggcacuuacgugagcgcuauagcucaaaccgagaaguccaucgaggacaaucccgagaucgaggacgacaucuuccggaaaaagcgucugacgaucauggaccuucaccccggcgccggaaagaccaaacgguacuuacccgcgaucgugcgcgaggcaauaaagcggggccuccgcacccugauccuggcuccuaccagggucguugccgcugagauggaggaggcucuccgagggcugccgauccgcuaccagacgccugccauucgggcggaacacaccggcagggaaauuguggaccugaugugccacgccaccuucaccaugcggcucuugucccccauccgcgucccaaacuacaaccugaucaucauggaugaggcccacuuuacugaccccgcaagcaucgccgcaagaggcuacauauccacgcgcguggagaugggugaggcugccggcaucuucaugaccgcaacaccccccgguagcagagacccguucccacagagcaacgccccaauuauggacgaggagcgcgagaucccggagcggucguggaacagcggucacgaguggguaacggacuucaaagggaaaaccgucugguucgugccgagcaucaaggcggggaacgacaucgccgcgugccugcgcaagaacgggaagaaggugauccagcugucccgcaaaaccuucgauucugaguacgucaaaaccaggacgaacgacugggacuucguggugacgaccgacaucucugaaaugggggccaacuuuaaagccgagagagucaucgacccccgccgcugcaugaagcccgugauacugacggauggcgaggaacgagucauccucgccggucccaugccggucacgcacagcuccgcagcgcagcggcgcggucggguggggcgcaaccccaagaacgagaacgaccaguauaucuauaugggugagccacuggagaacgacgaggacugugcccacuggaaggaggccaagaugcugcuggacaacauuaacacccccgagggcaucaucccuuccauguucgaacccgagcgcgagcgggucgacgccaucgauggggaguaccgccugcguggcgaggcccgcaagaccuuuguagaccugaugcggcgcggggaccuccccguguggcuggccuaccgggucgccgccgaaggcaucaacuaugcagaccgaagguggugcuucgacgggguuaagaacaaccagauccuagaggagaauguggagguagagauauggaccaaggagggcgagcguaagaagcucaagccgcguuggcuggacgcccguaucuacucagacccccuggcgcucaaggaguucaaggaguucgccgccgggcgcaaaagccugacgcugaacuuaaucaccgagaugggacgccugccaaccuucaugacccagaaggcucggaaugcgcuggacgaccuggccguucugcacacggccgaagccggcggccgagccuauaaccacgcgcuuuccgagcucccugagacucuggagacccuccuacuacugacccuccuugccacggugaccggagguaucuuccuguuccuaaugagcgggaaaggcauugggaagaugacucuaggcaugugcuguauuaucaccgcuagcguacuacucugguaugcccagauacagccacacuggauagcggcgagcaucauccuggaauucuuccugaucgugcuucucaucccugaacccgagaagcaacggacgccccaggacaaccaacugacguacguggcuaucgcuaucuuaaccgucguggccgccaccauggcgaacgagaugggguuccuggagaagaccaagaaggacuucggacugggcuccaucgcaacacagcagccggaaagcaacauccucgaccuugacuugcgccccgccagcgccuggacccucuacgccguggcgaccacuuucaucacccccauguugcggcacuccaucgaaaacagcucggucaaugugagucugacagccaucgccaaccaggccaccgugcucaugggguuaggcaagggguggccucuauccaagauggacaucggcguuccgcuccuugcgauuggcugcuacagccaggugaaccccauuacucucacggcggcccuccuguugcucgucgcucacuacgcgaucauuggccccggccugcaggcaaaggccacccgcgaggcccagaagcgggcugcagcuggaaucaugaagaaccccaccgucgacggcauaaccgugaucgaccuggacccgauacccuacgaccccaaguucgaaaagcaguuagggcaggucaugcugcugguacucugugugacccaggugcuuaugaugagaaccaccugggcacugugcgaagcccuaaccuuagcgacgggaccuaucuccacacugugggaggggaauccaggccgcuucuggaacacuaccaucgccgucagcauggcgaacauuuuccggggcuccuaccucgccggcgugggccuacuguucagcaucaugaagaacacagcuaauacccgcagggggacuggcaauaccggcgagacacucggcgagaaguggaagaaccgccugaacgcccuggggaaguccgaguuccagauauacaagaagucagggauccaggagguugaucggacacuggcuaaagagggaaucaagcgcggggaaaccgaccaccacgccgucucccggggaagcgccaaguuacgcugguucguggagagaaaccuggugacccccgaagggaaggucauggaccucgggugcgggcgcggagggugguccuacuacugugguggacuuaagaacguaaaggagguuaagggccugacgaagggcggccccggucacgaggagcccauccccaugucgaccuacggcuggaaccucguacgccugcaguccgggguagacguguucuucgcgccgccugagaagugcgacacacugcuuugcgacauuggcgagucaucaccgaacccgaccgucgaggccggccgcacgcugcgggugcugaaucucguggagaacuggcugaacaacaacacccaauucugcauuaaggugcugaaccccuacaugcccucugugaucgaaaagauggaggcguugcagcgcaaguaugguggugcucuugugcggaacccgcugagccguaacucaacccacgagauguacuggguuagcaacgccuccgggaauaucgucagcuccgugaauaugaucagccggaugcugaucaaccgcuucacaaugcggcacaagaaggcuaccuacgagcccgaugucgaucucggcuccgggacgaggaacauaggcaucgagagcgagauuccgaaccuggacaucauuggcaagcgcaucgagaagaucaagcaggagcaugagacuucguggcacuacgaccaggaccaccccuacaagaccugggccuaccacgggucuuacgagacaaagcagacgggcuccgcgagcuccauggugaacggcguaguccggcuguuaaccaagccaugggaugugauccccauggucacacagauggccaugaccgacacgaccccauucggccagcagcgcguauucaaggagaagguagauacccggacgcaggagcccaaagagggaacgaagaagcugaugaagauaaccgccgaguggcuguggaaggagcucgggaagaagaagaccccacgcauguguacccgggaggaguuuacgcgcaaaguccguagcaaugcagccuugggcgcgaucuuuaccgacgaaaacaaguggaagucugcccgggaggccguggaggauagcggguucugggagcugguggacaaggagcggaaccuccaccuggaaggcaagugcgagacgugcgucuacaauaugauggggaagcgugagaagaagcucggcgaguuugguaaggccaaggggucacgcgcgaucugguacauguggcucggcgcccgcuuccuugaguucgaggccuuaggguuccucaacgaggaucacugguucucacgagaaaacucccuguccggcguggagggggaaggccugcauaaguuaggcuacauccugcgcgaggugagcaaaaaggagggaggagccauguacgccgaugauacugcggggugggacacacggauaacccuggaggaccuaaagaacgaagaaauggucacgaaccacauggagggggaacacaaaaaacuggccgaggccaucuucaaacugaccuaccagaacaaggugguacgcguccaaaggcccacgccccgcgggacgguaauggauaucaucucacggcgggaucagcgggggucggggcagguggucaccuauggccucaauaccuucacgaacauggaggcucaacugauccgccagauggagggcgaggggguguucaagucaauccagcaccugaccgugaccgaagagaucgccgugaagaacuggcucacccgcgugggucgggaaagacugagccggauggcgaucucgggcgacgacugcguggucaagcccuuagacgauagguuugccuccgcccuuacggcccuaaaugacauggggaaggugagaaaggacauccagcagugggagccgucccgcgguuggaacgacuggacacaagugcccuucugcagccaccacuuccacgaacugauuaugaaagacgggagaguccucgugguucccugccgaaaucaggaugaacuuaucggccgggcgcgcaucucccagggggcgggauggucgcugcgcgagaccgccugccucggcaagucauacgcccagauguggagccugauguacuuccaucgccgggaucugcgccucgccgccaacgcgauuugcuccgccguccccucacacugggugccuaccucccggacgacuuggagcauccacgccacccacgaguggaugaccaccgaagacaugcugacggucuggaaccgcguuuggauucaggagaacccuuggauggaggacaagacccccgucgagagcugggaggagauacccuacuuagggaaaagagaagaucaauggugcggcucguugauugggcugaccagccgugccaccugggcgaagaacauacagacugccaucaaccaggugcggucccugaucggcaacgaggaguacaccgauuacaugccgagcaugaaacgcuuccggcgggaggagggagaggcuggcgucuuaugguga

SEQ ID NO: 25448 - RNA, 9876 nt, Artificial Sequence
  derived and/or modified CDS sequence (opt11) from DENV-2__DQ448231__SS-prME
accgcuggggugaucaucaugcugauaccaacggccauggcuuuccaccuuaccacccggaauggcgagccccacaugaucgucagccggcaggagaagggcaaaagccugcucuucaagaccgaggacggggugaacaugugcacccucauggcuauggaccugggcgaacucugugaggacaccaucaccuacaauugcccccuccugcggcagaaugagccugaggacaucgauugcuggugcaacucaacguccaccugggugaccuaugggaccugcaccgccaccggcgaacaccggcgcgagaagagaagcgucgcccuagugccccacgucggcauggggcuggaaacgagaaccgagaccuggauguccagcgagggcgcuuggaagcacgcccaacggaucgagacguggauccucaggcacccgggauucacgaucauggccgccauucuggccuauacgaucggaacgacuuacuuccagcggguccucaucuucauacuguugacagcgguggcucccuccaugaccaugcgcuguauugggauaagcaaccgggauuucguugaggguguuaguggagggagcuggguggacaucguacucgagcacggcaguugcgucaccaccauggccaaaaacaagcccacgcucgauuucgaguuaaucaagacugaagccaagcagccagccacccucagaaaguacugcaucgaagcgaaacugaccaacacgacuaccgccagccggugccccacccaaggggagcccucucugaacgaggagcaggauaagcgcuucgugugcaaacauuccaugguggaccggggcuggggcaacgggugcggccucuuugggaagggagggauaguaacgugcgccauguucacguguaagaagaacauggagggcaaaaucgugcagcccgagaaccuggaguauacgaucguggucaccccccacuccggcgaggagaacacgguugggaacgacacaggaaaacaugggaaagagauuaaagugaccccucagucaucaaucaccgaggccgaacuaacgggcuacgggacgguaaccauggagugcagcccacgcaccggccucgacuucaaugaaauggugcuauuacagauggagaacaaggccuggcucgugcaccggcagugguuccuagaccuaccauuacccuggcugccaggcgcggacacgcagggguccaacuggauccagaaagagacgcuggugaccuuuaagaacccccacgccaagaagcaggacguuguggugcucgguagccaggagggggccaugcacacagcgcugacgggagccacggagauccaaaugagcucggguaaccuccuguucaccggccaccugaagugucgauuacggauggacaagcuccagcucaagggcaugagcuacuccaugugcacggggaaguucaagguggucaaggagaucgcggagacccagcacggcacgaucgucguacgcguccaguaugagggggacgggagccccugcaagauccccuucgagauaauggaccuggagaagcggcacgugcucggccgccugauaaccgugaacccuauuguaacagaaaaagacucacccguuaacaucgaagcggaaccgccuuuuggggacagcuacaucauuaucgggguggaaccggggcagcuuaagcucuccugguucaagaagggcucauccaucggacagauguucgagaccacgaugcgcggcgcuaagagaauggccauccugggcgacaccgccugggacuuugggucacugggaggggucuucaccuccaucggaaaggcgcuccaucaaguguucggggccauuuacggcgcugccuucagcggcguguccuggaccaugaagauccugaucggggucgugaucacuuggaucggcaugaacucccgcuccaccucacugagugucucccugguccucguagggguagugacccuauacuugggcgugaugguacaggcggacuccgggugcgucguaucuuggaagaacaaagagcugaagugcggcagcggcauuuucaucaccgacaaugugcacaccuggaccgagcaauacaaguuccagcccgaaucccccagcaagcuggccuccgcgauccagaaagcccacgaagagggaauaugcggcauacggucggucacacgccuagaaaaccugauguggaagcagaucacccccgagcugaaccacauccugucggagaaugaggugaaguugacuaucaugacaggggacauaaagggaaucaugcaggccgggaagcggagccugcgcccgcagcccacugaacugaaguacagcuggaagacuuggggcaaggcgaagauccucagcacggagccucacaaccagacguuuuugaucgacggcccggagaccgccgagugccccaacacaaacagagccuggaauucccuggaaguggaggauuacggcuuuggcguuuucacgaccaacaucuggcucaaacugaaggaacgacaagacgucuucugugacagcaagcugaugucugccgccaucaaggacaaccgggcugugcacgccgacaugggguacuggaucgaaagugcccugaacgacacuuggaaaaucgagaaagccuccuucaucgaggucaagaguugucacuggcccaagagccacaccuuauggagcaacggggugcuggaauccgagaugaucauacccaagaacuucgcuggcccaguaagccagcacaacuaccgccccggcuaccauacgcaaaccgcgggcccauggcacuuagggaaguuggaaauggacuucgauuucugcgagggcaccaccgucguagugaccgaggacugcggaaaccggggcccaagcuuacgcacgaccacugccuccggcaagcuuaucaccgaguggugcugccguuccugcacgcugccgcccuuacgcuaccgcggggaggacggcugcugguacgggauggagauccgcccgcuuaaggagaaggaggagaaccuggucaacagucuggugaccgccggccacgggcagauugacaacuucucccuaggggugcuggguauggcguuauucuuagaggaaaugcugcggacccgcgucgggacuaagcaugcagugcugcuuguggcggucuccuucaugacguuaaucaccgguaauaugagcuuccgggaccuggggcgcgugauggugauggucggcgccgccaugacagacgauaucgggaugggcgugaccuaccucgcccugcucgcagcguucaagguacgccccacuuucgccgccggccuccugcuucgcaagcugaccuccaaagaacugaugaugaccaccaucgggaucguccugcucagccaguccacgaucccggaaaccauccuggagcugaccgacgcccuugcgcugggaaugaugauccugaagaucgugcgcaacauggagaaguaucagcuugcagucacuauuauggccaucuuaugcgugcccaacgccgucauccuacagaacgcauggaaagucagcugcacgauccucgcggugguguccguaucuccccugcuucucaccuccagccagcagaaagcggacuggaucccccuagcccucaccauuaaggggcucaacccgaccgcaaucuuccugacgacacugucgcggaccaacaagaagcggagcuggcccuuaaaugaggccaucauggccgugggcaugguguccauccuggcgucgucccugcucaagaacgacauccccaugaccgguccccugguagccgggggccugcucacggugugcuacguccugaccgggcggucggccgaccuggagcucgagcgugccgccgauguccggugggaggaccaagcagaaauaucaggauccagcccgauccuauccauuaccaucagcgaggacggaucgaugagcaucaagaacgaggaggaggagcagacccugacgauccucauccgcaccggccugcuugugaucagcggcuuauucccagugagcauccccaucacugccgccgcgugguaccugugggaggugaagaagcagcgggccggggugcugugggacgugccgucgccgccgccggucgggaaggccgagcucgaggacggggccuauagaaucaaacagaaagggaucuugggguauagccagaucggcgccggcgucuacaaggaagggaccuuccacaccauguggcaugugacccggggugcgguccuaaugcacaaagggaagcguaucgagccguccugggcugacgugagaaaggaccucauaagcuacgguggcggcuggaagcuggagggcgaauggaaggaaggggaagaagugcagguccucgcgcucgagcccgguaagaacccccgcgcgguccagaccaagcccggacuuuucaagacaaacaccggcacgaucggggcagugucccuggacuucucgccuggcacuucagggagccccaucguugacaagaaggguaagguugugggccuuuacgggaacggcgucgugacccgguccgguaccuacguuagcgcgaucgcccaaacugagaagucaaucgaagacaaccccgagaucgaggacgacaucuuccgcaagaagcggcuuaccaucauggaucugcaccccggugcuggcaagaccaaacgcuaccugccggccauuguccgggaggcuaucaagcgcggacuccgcacacugaucuuggcucccacgcgcgucguugccgccgagauggaggaggcccuccgcggccugcccauccgguaucagacccccgcuauccgcgcggagcacaccgggcgggagaucgucgaccugaugugucaugccaccuucacgaugcgccuccugucuccgguccgggugcccaacuacaaccugauuaucauggacgaggcccauuucaccgaccccgccagcaucgcggcccgcggcuauaucucgacccgggucgagaugggugaggcugccgggaucuuuaugaccgccacgcccccgggcagccgggaccccuuuccccagagcaaugcucccauaauggacgaagagcgggagauaccggagagaagcuggaacuccgggcacgagugggugaccgacuucaaaggaaagaccguaugguucguccccuccaucaaggccggaaaugacaucgcugccugccuccgaaagaacgggaagaagguuauccagcugucccgcaagaccuucgacagcgaguacaucaagaccagaaccaacgacugggacuucguggucacuaccgacaucuccgagaugggggcgaauuucaaggccgagcgcgucaucgaccccagacgcuguaugaagcccguuauccugaccgacggcgaggaacgggucauccucgcuggcccgaugcccgucacccacagcuccgccgcccagaggcgggggaggaucggccgcaacccgaagaaugaaaacgaccaguacauauacaugggggagccccuggaaaaugacgaggacugugcgcacuggaaggaggcuaagaugcuucucgauaacaucaacaccccggaggggauaauuccgagcauguucgagcccgagagggagaagguggacgccaucgacggggaguacagacugaggggggaggcgcgcaagacguucgucgacuugaugcgccgcggcgaccucccagucuggcuugcguaccgcgucgcggccgaggggauaaacuaugccgaccgaagauggugcuuugacggcaucaagaacaaccagaucuuggaggaaaauguggaggucgagauauggacgaaggagggggagaggaaaaagcucaagccccgguggcuggacgcccgcaucuauuccgaccccuuagcccucaaagaguucaaggaguucgcagccggacgcaagagccugacccugaaccucauuacagagauggggcgccugcccaccuuuaugacccagaaagcccggaacgcccuggacaaccucgcgguccuacacaccgccgaggccgggggccgcgccuacaaccacgcccugucagaacugccggagacccuggagacccugcuccuccugacgcucuuagcgacugugaccgggggcaucuuccuguuccucaugagcggcaaggggaucggcaagaugacccuggggaugugcugcaucaucaccgcauccauacugcucugguacgcccagauucaaccucacuggaucgcugcuagcaucauccuggaguuuuucuugaucguccuccucauucccgagcccgagaagcagcgcacgccgcaggacaaccaacugacauaugucgugauugcgauccucacggugguagcagccacuauggcuaacgagaugggguuccuggaaaaaacgaagaaggauuucgggcugggauccaucgcaacacagcagcccgagagcaacauucucgacaucgaccugaggcccgcgagcgccuggacacuguacgccguggccaccacguucaucacacccaugcugcggcacucaaucgagaauucuuccgugaacgucucccuaaccgccaucgcgaaccaagcaaccguguuaaugggccucgggaagggcuggccgcuguccaagauggauaucggggugccucuccucgccaucggcuguuacagccaggucaaccccaucacgcugaccgccgcgcugcuccugcuaguugcucacuacgccauuaucgggcccggccuccaggccaaggccacccgcgaggcgcaaaaacgggccgccgcuggcaucaugaagaacccgaccguggaugggaucacggucaucgaccuugaccccauccccuaugaccccaaauucgagaagcaacugggccaggugaugcuccuggugcugugcgugacccaagugcucaugaugcggacgaccugggcccugugcgaggcucugacgcucgccacagggccgauuuccacacugugggaaggcaacccagggagauucuggaacaccacgaucgcagugucgauggccaacaucuuccgcggcucuuaccuagccggcgcgggguugcuguucaguauaaugaagaacacaacgaauacccgaagaggcacggggaacaccggagagacccugggagaaaaguggaagaacagacucaacucccuggggaaguccgaguuccagaucuacaagcgguccgguauccaggagguggacaggacccucgccaaggaggggaucaagcggggugagacugaccaucaugccgucagucgcgggagugccaaacuccggugguucguggagcgcaaccugguaacccccgagggcaaggugguggaccucggcugcgggcggggcggguggaguuacuacuguggcgggcucaagaacgucagggagguuaagggacugaccaagggcgggcccgggcacgaggagccgauacccauguccaccuauggguggaaccuggugcggcuccagagcggcgucgacguuuucuucacgccgcccgagaaaugcgacacccuguuaugugacaucggcgagucaucuccgaaucccacggucgaggcgggccgcaccuuacgggugcugaaccugguggaaaacuggcucaauaacaacacucaguucugcaucaagguguugaaucccuauaugccaagcgucauagagaagauggagacacugcagcggaaguacggcggagcacugguacggaacccccucucccgcaacucaacucacgagauguacugggugaguaacgccagcggaaacaucguauccucagucaacaugaucucccggaugcuuaucaaccgcuucaccaugcgccacaagaaggccaccuacgagccggauguggaccuuggcagcggcacgcggaauaucgggaucgaauccgaaacccccaaccucgacauuaucggcaaacgcaucgagaagaucaaacaggagcacgaaacgagcuggcacuacgaucaggaucacccguacaagaccugggccuaucauggcuccuacgagacgaaacagaccggaagcgcgaguagcaugguaaacggagugguacggcuccuuaccaaaccgugggacgucaucccaauggugacccagauggccaugacggacacaacccccuucgggcagcagcgcguuuucaaggagaaggucgacacucggacgcaggaaccuaaggaggguacuaagaaacucaugaagaucaccgccgaguggcuguggaaggagcuggguaagaagaagaccccccggauguguacgcgggaggaguucacucgcaaggugagguccaacgcugcgcucggggcgaucuucaccgacgagaacaaguggaaguccgcccgggaagcggucgaagacucccgguucugggagcugguggacaaggagcgcaaucugcacuuggaggggaagugugagaccuguguguauaauaugauggggaagcgugagaagaagaucggagaauucgggaaggccaaaggcagccgcgcgauuugguauauguggcucggcgcgcgguuccuagaguucgaggcccucggguuccuaaacgaagaucacugguucagccgcgagaacagcuuaucuggagucgaaggagaaggccuccacaagcugggguacauccugcgggagguguccaagaaggagggcggggcaauguacgccgacgacacggcggggugggacacccgcauaacccuagaggaccucaagaacgaagagauggucaccaaccacauggagggugagcacaaaaagcuggcagaggcuaucuucaaacucacguaccagaauaagguggugcgggugcagcggcccacgccgcgggggaccgucauggacaucaucagccgcagagaccagcggggcucgggccaagucgggacguacggccugaacacuuucaccaacaugggcgcucagcugauucgccagauggaaggcgaggggguguucaaaggaauccagcaccucaccgcaacagaggagguagcggugcaggacuggcuggcccgggugggcagggagcggcugagccguauggccaucucuggagacgacugcgucgugaaaccguuggacgaccgguucgccagcgcucugacagcgcugaacgacaugggcaaaauacguaaggacauccagcagugggaaccaucccguggguggaaugacuggacucagguacccuuuugcagccaccacuuccacgagcuaaucaugaaggacggucgcgucuuaguggugcccugucgcaaccaggacgagcucaucggccgcgccagaauaucgcagggcgccggcuggagccuccgcgagacugccugucuggggaaguccuacgcccagauguggucccugauguacuuucaucggcgcgaccuccguuuggcggccaacgcgaucugcuccgccgucccgucccauuggguucccaccucgcgcaccacauggagcauccacgcaaggcaugaauggaugaccaccgaggacaugcugaccguguggaauagggucuggauccaggagaacccuuggauggaggacaagacacccgucgaguccugggaggaaaucccguaccucggcaaacgagaggaccaguggugcgguagccugaucggcuuaaccucgcgggcgaccugggccaaaaauauccagaccgccaucaaucaggugcgcucacuaauugguuccgaggaauauacggacuacaugccguccaugaaacgauuccggcgggaggaagaagaggcuggcguccucugguga

SEQ ID NO: 25449 - RNA, 9876 nt, Artificial Sequence
  derived and/or modified CDS sequence (opt11) from DENV-2__JX470186__SS-prME
accgcgggcaucaucauaaugaugaucccaaccgugauggcguuccaccucaccacccggaacggggagccacauaugaucguaucucggcaggagaagggcaagagccuacuauucaaaacagagaacggggugaacaugugcacccugauggcgauggaccucggugagcugugcgaagacaccaucaccuacaacugcccccuguuacgccagaacgagcccgaggauaucgacugcuggugcaacagcaccuccaccugggucaccuacggcaccugcaccgccaccggagagcaccggcgcgagaagcggagcguagcccuggugccccacgugggcaugggguuagagacgcgcacugagaccuggauguccagcgagggcgccuggaaacacgcacagcggauagagaccuggguccuccggcacccgggauucaccaucauggcggccauccuggccuacaccauaggcacaaccuacuuccagagagugcugaucuucauccuccugacugccgucgcgcccuccaugaccaugcgcugcaucggaaucagcaaccgggacuuugucgaaggagucuccggcgguagcuggguggauaucguccuggagcacggcaguugcgugaccacgauggcaaaaaacaagcccacgcucgauuuugagcugauaaaaacugaggccaagcaccccgccaccuuacgcaaguacuguaucgaggccaagcucaccaacacgaccacagcgagccguugcccgacccaaggugagcccucccugaaugaggagcaggauaagcgcuucgugugcaagcauagcauggucgacagaggcuggggcaacgggugcggacuguucgggaagggcgggaucguuacgugcgccauguucacgugcaagaagaacauggagggcaagaucguacagcccgagaaucucgaguacacgaucgucaucaccccccacagcggcgaggagaacgccguggggaacgacacgggcaaacacgggaaggagaucaagguuaccccgcagagcuccauuaccgaggccgaauuaaccggcuaugggaccgucacgauggagugcagcccccguaccggccuggacuucaacgaaaugguccuccugcagauggagaacaaggccuggcuggcgcauagacaaugguuucucgaccugccuuuacccuggcucccgggcgccgacacccagggguccaacuggauccagaaggagacacuugugacuuucaaaaacccccacgcuaaaaagcaggacgucguuguccugggcucgcaggagggggccaugcacaccgcccuuaccggcgcgaccgagauucagaugagcuccgggaaccuacuguucacgggccaccucaaaugucgccugcggauggacaagcugcagcugaagggcaugagcuacucaauguguaccgggaaguucaagguggugaaggagaucgccgagacccagcacggcaccaucgugauccgcgugcaguacgagggugacggcagcccuugcaagauccccuucgagaucauggaucuagagaagcggcaugugcugggccgccucaucaccgucaacccgaucgucaccgagaaagacucccccgugaacauagaggccgagccgcccuucggagacagcuacaucaucaucggcguagagccuggccaacucaagcugucgugguucaagaagggcagcuccaucgggcagauguucgagaccaccaugcgcggcgccaagcggauggccauccucggcgauacugcgugggacuucgggagcuuaggcggaguuuucacuucaaucggcaaggcucuccaccagguguucggggccaucuacggagccgcguucagcggcgucuccuggaccaugaagauauuaaucgggguugugaucaccuggaucggcaugaacagccgcucaacgagccuguccgucagucuggugcuggugggggucgugacccuguaccugggcgugaugguccaagccgacuccgggugcguggugagcuggaagaacaaggaacugaagugcggcagcggcaucuucauaacagacaacguccacaccuggacggagcaguacaaguuccagcccgaguccccgagcaagcucgccuccgccauccagaaggcgcacgaggaggggaucuguggaauccgaagcgugacccgccuggaaaaccugauguggaagcagaucacacccgagcuuaaccacauccuguccgagaacgaggugaagcucaccaucaugaccggggacauaaagggcaucaugcaggcggggaagcguagccuccgcccgcagcccaccgagcugaaguacuccuggaaggccuggggaaaggccaagaugcugagcacugaacuccacaaccacacuuuccugaucgauggcccugagacggcagagugccccaacaccaaccgggccuggaacucccuggaggucgaggacuacggguucggcguguucaccacaaacaucugguuaaagaugaaggagcgccaggacguuuucugcgacagcaaauugauguccgcggccaucaaggacuccagagccguccacgccgacaugggguacuggauagaguccgcccugaacgauacauggaagauagagaaggcgucuuuuaucgaggugaagaguugucauuggcccaagucccacaccuuaugguccaacggcguguuggagagcgagaugaucauccccaagaacuucgcgggccccgugagccagcacaacuaucgaccgggcuaccacacccagacggccggucccuggcaccucgggcggcucgagauggacuucgacuucugcgagggaaccacggugguggucacagaggacugcgggaaccgcggccccucccugcggacuacgacugccagcggcaaacuaaucaccgaauggugcugccgcuccugcacccugccgccgcugcgguaucgcggggaggacggcugcugguacggcauggagauccggccccuuaaggagaaagaggagaaccucgucaacagccuggugacugcaggccacggacagauugacaacuucaguuuggggguacucggcauggcccuguuccuggaggagauguuacgcacgcgcguagggaccaagcacgcaauccugcugguggccgugagcuuugugaccuugaucaccggcaacauguccuuccgugaccuggggcgcguuauggucauggugggugccacgaugaccgacgauaucgggaugggcgugacuuaccuggcguuacuggccgccuucaagguccggccgacauucgccgccggccugcuucugcgcaagcugacgagcaaggagcucaugaugacaaccaucggcaucguucugcugucccaggcuaccauccccgagacgauccucgagcuaaccgacgcacuggcccucggcaugaugguccugaagauaguccggaauauggagaaauaucagcuugccguuaccaucauggccauccucugcgugcccaacgcggugauccugcagaacgcauggaaggugagcugcaccacacuggccgucguguccgugagcccccucuugcuaacauccucucaacagaaggccgacuggaucccccucgcgcugaccaucaagggccugaacccuaccgccaucuuccuuacuaccuuaagucgcacuaacaagaagcgcagcuggccguugaaugaggcuaucauggccguugguaugguguccauccucgccagcucccugcugaaaaaugacauccccaugaccgguccacucguugccggcgggcugcugacagucugcuacguucugaccggucgcagcgcugaucuggagcuggagcgugccgcagacguccgcugggaggagcaggccgagaucagcggguccagccccauccuaucuaucaccaucuccgaggacgggaguaugagcaucaagaacgaggaggaggagcaaacccugacgauccugauacggaccggccuccuugucguaucaggacucuucccgguuagcacccccaucaccgcggccgccugguaccucugggaagucaagaagcagcgcgccggggugcugugggacgugcccucuccgcccccagucggcaaggcagagcuggaagacggggcguaccggaucaagcagaagggcauccucggguacagccagaucggcgcaggcgucuacaaggaggguacuuuucauaccauguggcacgugacgcgcggcgccguccugaugcacaaggggaagagaaucgagccauccugggcggacgugaagaaggaccugaucagcuacggcgggggcuggaagcucgagggcgaguggaaggaaggggaggaggugcagguccuggcccuggagccuggcaaaaacccccgagcggugcaaaccaagcccggccucuucaagacgaacacgggcaccaucggggcggugucccuggacuuuagccccgguaccuccggcagccccaucgucgacaagaaggggaagguggugggccuguacgguaacggcgucgugacccgguccggcacguaugugucugccaucgcgcaaaccgagaagucaauagaggacaaccccgagaucgaggacgacaucuuccgcaagaagcggcucaccauuauggacuuacaccccggcgcgggcaagaccaaacgcuaccugccggcgauaguccgagaggccaucaagagagggcugcggacgcucauucuggccccgacccgcgugguggccgcggaaauggaggaggcccugcgcggccuccccauacgguaccaaacccccgccauccgcgccgaacacacaggucgggagaucgucgaccugaugugccaugccacguucaccaugcgccugcucagccccauccgggugccgaauuauaaccuaaucaucauggacgaggcucacuuuaccgaucccgccagcaucgcagcgcgcggcuauaucuccacccggguggagaugggagaagccgcggggaucuucaugacggcaacgccgcccggcagccgcgacccguucccccaguccaaugcccccaucauggacgaggagcgggagaucccagaacgcagcuggaacucggggcacgagugggucaccgacuucaagggcaagaccgugugguucgugccgagcaucaaggccgggaaugacaucgcggccugccugcggaagaauggcaagaaagucauccagcuguccaggaaaacguucgacuccgaguacaucaagacacggacgaacgacugggacuucguggugaccacggacaucuccgagaugggcgccaacuucaaagccgagcgcgucaucgacccccggcgcugcaugaagcccgugaucuugaccgacggggaggagcgcgugauccuggccggccccaugccgguuacgcacagcuccgcagcucagcgaagaggacggguaggccgcaaccccaagaacgagaaugaccaguacauauacaugggugagccccuggagaacgacgaagauugcgcccacuggaaggaggccaagaugcuguuagacaacaucaacacccccgaggggaucauaccgaguauguucgagcccgagcgggagaagguagacgccauagacggugaguaccgccuccgaggggaggcgcgcaagaccuuugucgaucugaugcggcgcggcgaccugcccguguggcucgcauaccgggucgccgccgaagggaucaacuacgcggaccgccgguggugcuucgauggcgugaagaacaaccagauccuggaggagaacguggaggucgagaucuggaccaaggagggggaacgcaaaaagcugaagccaagauggcuugacgcgaggauauacuccgacccccucgcccugaaggaguucaaggaguucgccgcuggccgcaaaagucuaacccugaaccugaucaccgagaugggccggcuccccacguucaugacucagaaggcgcggaacgcccuggacaaucuggccgugcuccacaccgccgaggccgggggccgcgcguacaaccacgcccuguccgagcuucccgagacucucgagacucugcugcuccugacccugcucgccaccgugaccggugguaucuuuuuauuucugaugucaggcaagggaaucggcaaaaugacccucgggaugugcugcaucaucacggccuccaucuuacugugguaugcccagauucagccgcacuggaucgcggccagcaucauacucgaauucuuccugaucguccuccucauccccgagccggagaagcaacggacgccccaggacaaccagcuuaccuacguagugaucgccauccugacaguaguugccgcuacgauggcgaacgagaugggcuuccuugagaagacaaagaaggacuucgggcugggcuccaucaccacccagcaaccagagaacaauauucuggauaucgaucuacgccccgccuccgcauggacgcuguacgccguggccaccaccuuuauaacccccaugcugcgccacuccaucgagaacucuagugucaacgucucauuaacggcgauagcgaaccaagcgaccguguugaugggccugggaaagggcuggccgcuguccaagauggacaucggugucccgcugcuggccaucgguugcuacucccaagugaauccgaucacccucaccgcggcacugcuucuccugguggcucacuacgcuaucaucgggcccggcuuacaggcgaaggcgacgcgcgaagcccagaagcgggcggccgcuggaaucaugaaaaacccuaccgucgacgggaucaccgucaucgaucuagacccgauccccuacgacccuaaguucgagaagcaguugggccaggugaugcugcucguccugugugugacucaagugcucaugaugcgcaccaccugggcgcucugcgaagcccugacgcuggccaccgggcccaucagcacgcucugggaaggaaacccugggcgcuucuggaacacaaccauugccgucagcauggccaacaucuuccggggcagcuaccuggcgggcgccgggcuccucuucuccaucaugaagaacacugccaauacccgccggggcaccgggaauaccggcgagacccugggggagaaguggaagaaucgccucaaugcccucggcaaauccgaguuccagaucuauaagaaguccggcauucaagaaguggaccggacucuggcgaaggaggggaucaagcgcggcgaaaccgaccaccacgcagugucacggggguccgccaaacuacgcugguucguggagcggaauuuagugaccccggaaggcaagguaguggaccuaggcugcgggcgcggcgguuggaguuacuacugcggcgggcugaagaacgugaaagaggugaagggcuuaaccaagggcgggcccggccacgaggagccgaucccgaugucaacguacggguggaaccugguccgacugcagucugggguugacguuuucuucacgccccccgagaagugugacacucuccucugcgacaucggggaguccagccccaaucccacgguggaggccgggcguacccugcggguucuaaaccugguggagaacuggcuaaacaacaacacgcaguucugcaucaagguacuuaaccccuacaugcccuccgugaucgagaagauggaggcccugcagcgcaaguacggcggggcgcuggugcggaacccgcuuagccgcaacagcacccacgagauguacugggucuccaacgccagcggcaacaucguuuccagcgugaacaugauuucccggauguuaaucaaccgcuucaccaugcggcauaagaaggccaccuacgagcccgacgucgaccuggggagcggcacgcgaaacaucgggaucgaguccgagacgcccaaccuggacaucaucggcaaacgcaucgaaaagaucaagcaagagcacgagaccagcuggcauuacgaccaggaccacccguacaaaacuugggccuaccauggguccuacgagacgaagcagaccgguucagccucaagcauggugaacggggugguccgguuacugaccaagccgugggacgucauuccgauggugacccagauggcgaugacggacaccacccccuucgggcagcaacgcgucuucaaggagaagguggacacccgcacgcaggagccuaaggagggcaccaagaaguugaugaaaaucaccgccgaguggcucuggaaggagcugggcaagaagaagaccccccgcaugugcacucgggaggaauuuacucgcaagguccggucgaacgcagcccugggggccaucuucaccgacgagaacaaguggaaguccgcgcgcgaggccgucgaggacuccggcuuuugggaauuaguggacaaagagcggaaucugcaccuggaggggaagugcgaaaccugcgucuacaacaugaugggcaagcgcgagaagaaacucggggaauuugggaaagccaaggguagccgggccaucugguacaugugguuaggggcgcgcuuucuugaguucgaggcccucggcuucuuaaacgaggaucacugguucucccgggagaacagcuuauccggcguggagggggaggggcuccacaagcugggauacauucugcgcgacgugagcaagaaggagggcggggccauguacgccgacgacacggccggcugggacacccgaaucacccucgaggaucugaaaaacgaggaaauggucacuaaccacauggagggggagcauaagaagcuggcugaggccauauucaaacucacguaccaaaacaaaguagugagggugcaaagacccacgccccgcggcaccgucauggacaucauaagcaggcgcgaccaacgggguuccggucaggugguaaccuacggccucaacacauucacaaacauggaggcgcaacugauccgccagauggagggggagggcguguucaaaagcauccaacaguuaaccgugacggaggagaucgccgucaagaauugguuggugcgcguuggucgagagcgccucucccggauggcaaucucgggcgacgacugugucguuaagccccuggaugaccgcuucgcguccgcccugacggcacugaacgacaugggcaaggugcguaaggacauccaacagugggagccgagcagaggcuggaacgacuggacacaggucccguucugcucccaucacuuccacgagcucaucaugaaggauggacgggugcuggugguuccgugccgcaaccaagacgaacugauugggcgggcuagaaucagccagggcgccggguggucccuccgggagaccgcgugccugggcaagagcuacgcccagauguggagccuaauguacuuccaccgaagggaccuucgccuggccgccaacgccaucuguuccgcugugcccucgcacugggugccgaccucgcggacaacuuggaguauccaugcuacccacgaguggaugaccaccgaggacaugcugacggucuggaaccgcguguggauucaggagaaccccuggauggaagacaagacccccguggagucaugggaggagauucccuaccuggguaaacgggaagaucaauggugcgggucccuaaucggacugaccagccgugccaccugggccaagaacauccagacggccaucaaccagguucggucgcucaucgggaacgaggaguacacagacuacaugccguccaugaagcguuuccgccgugaggaggaagaggcuggcgugcuuugguag

SEQ ID NO: 25450 - RNA, 9876 nt, Artificial Sequence
  derived and/or modified CDS sequence (opt11) from DENV-2__KU517846__SS-prME
accgcagguaucaucauaaugaugaucccuaccguaauggccuuccaccugaccacaaggaacggggagccccauaugaucguuagccggcaggagaaaggcaaaagucuccuguuuaagaccgagaacggggugaacaugugcacacugauggcgauggaucucggcgagcugugcgaggacaccaucaccuacaacugccccuuacuccgccagaacgagcccgaggacaucgacugcuggugcaacagcaccuccaccugggugacauacgggaccugcaccgccacuggcgagcacagaagagagaaacggagcgucgcccuggugccacacgugggcauggggcuagagacccgcaccgaaaccuggauguccagugagggcgccuggaagcacgcacagagaaucgaaaccuggguucuccgccaccccggguuuacaaucauggcggccauccuggccuacaccaucggcacuaccuacuuccagcgugugcugaucuucauccuccugaccgcggucgcgcccuccaugaccaugcgcugcaucgggaucagcaaccgggacuucgucgaaggcguuuccggcgggagcuggguggacaucguacuggagcacgguucuugcgugaccaccauggccaaaaauaagccaacguuggauuuugagcugaucaagaccgaggccaagcaucccgcaacccugcgcaaauacugcaucgaggccaagcucaccaacacgaccaccgcgucucgauguccaacacagggggagcccucccugaacgaggagcaggacaagcgcuucgucugcaagcacuccauggucgaucgggguuggggaaauggcugcggccuguucgggaagggcgggauuguaacgugugccauguucacgugcaagaagaacauggagggcaagaucguccagcccgagaaccucgaauacacgaucgugaucacgccccacucuggcgaggagaacgccguggguaacgacacuggcaagcacgggaaggagaucaaggugaccccgcagucauccaucaccgaagccgagcugaccggcuacgggaccgucacuauggagugcucgccccggaccggcuuggauuucaacgagaugguguugcugcagauggagaacaaggcuuggcuggugcaucgucagugguuccucgaccugccccugcccuggcucccgggcgcggacacccaaggguccaacuggauccagaaggaaacccuggucacguuuaaaaacccccaugcaaagaagcaagacguagucguacugggcagccaggagggggccaugcacaccgcccucaccggcgccaccgagauccaaaugaguuccgggaaucuacuguucacgggccacuuaaaaugccggcugcggauggacaagcuccagcucaagggcauguccuacuccaugugcaccgggaaguuuaaagucgucaaggagaucgccgagacccagcacggcacgaucgugauccgcgugcaauaugagggggacggcagccccugcaaaauccccuucgaaaucauggaccuggagaaacggcauguccugggcaggcucauaacggucaacccuaucguaaccgagaaggacagucccguuaacauagaggccgagccgccguuuggggacagcuacaucaucaucggcguugagccggggcagcugaagcuguccugguucaagaaaggcagcuccaucgggcaaauguucgagacaaccaugcgcggcgccaagcgaauggccauccucggcgacacggccugggacuucgggucacugggcgggguuuucaccuccaucggcaaagcgcugcaccaggucuucggggccaucuacggcgccgccuucagcgguguguccuggaccaugaagauccucaucggcgugguuaucaccuggauaggcaugaacagccgcagcacgagcuugucgguaagucuggugcuggucgggaucgugacccucuaucucggggugaugguccaggcggacuccgggugcgugguaagcuggaaaaacaaggaguugaagugcggcagcggcaucuucaucacugacaacguucauaccuggaccgagcaguacaaguuccagcccgagucccccucaaaacucgccuccgcaauccagaaggcccacgaggaagggaucugcgguauccggagcgugaccagacuagagaaccugauguggaagcagaucacccccgagcuuaaccacauacuguccgaaaacgaggugaagcucaccaucaugacgggggacaucaaggggaucaugcaagcgggaaaacguagccucaggccgcagcccaccgaguuaaaguacuccuggaaggcgugggguaaggcuaagauguuaagcaccgagcuccauaaccacacauuccuaaucgacggccccgagacggccgagugcccgaacaccaaccgggccuggaacucucuggaggucgaagacuauggguucggugucuucaccaccaacaucuggcucaagcugaaggagcgccaggacguuuucugugacagcaaacugaugucagccgcgaucaaggauaacagggccguccacgcugacaugggcuauuggaucgagagcgcccucaacgacacguggaagaucgagaaggcuucauucaucgaggucaagucaugucauuggcccaaaucccacacccuguggucgaacggcguucuggaguccgagaugaucauccccaagaacuucgcaggccccgugagccagcacaacuaccgccccggguaccacacccagaccgccggccccuggcacuuggggcggcuggagauggacuucgacuucugcgagggcaccacggugguggucaccgaggacugcgggaaucgaggccccagccugagaaccaccaccgccuccgggaagcugaucacggagugguguugccggagcugcacccuacccccuuuacgguaccgcggggaagacggcugcugguacgggauggagauccggccguugaaggaaaaggaggagaaccugguaaacagccuggugacggccggucauggucaaaucgacaacuucagucucggcguucugggcauggcgcuguuccucgaggagaugcugcgcacccgaguggggaccaagcaugccauccugcucguggccgucuccuucaugacccuuauuacuggcaacaugagcuuuagagaccuagggcgcgucaugguaauggucggcgcuacaaugaccgacgacaucgggaugggggucaccuaccucgcccugcuggcggcauuuaaggugcggcccacuuucgcugccggccuccugcugcggaagcuuaccuccaaggagcugaugaugacgacgaucgggaucguccugcucagccaguccaccauccccgagacgauccuggagcugaccgacgcacuggcgcuaggcaugauggugcugaagaucgugcggaacauggagaaguaccagcucgcggucaccaucauggccauccucugcgugcccaacgcagucauccuccagaacgccuggaaagugucauguacgauccucgcgguggucuccgugagcccccugcugcucaccuccagccagcagaaggcggacuggaucccuuuagcccugaccaucaaggggcucaaccccaccgcuauuuuccugaccacucugucgcgcacgagcaagaagcggaguuggccacugaacgaggccaucauggccgugggaauggugagcauccuagcauccagccugcuaaagaacgacaucccgaugaccggcccccugguggccgggggccugcucaccgucugcuacguccugacggggcgcagcgccgaccuggagcucgagcgggcggcggauguucgaugggaggagcaggccgagaucuccggcagcucccccauccugucaauuaccaucuccgaggacgggagcauguccaucaagaacgaggaggaggagcugacccucaccauucugauccgcacgggacugcucgugaucagcggucuguuuccggucuccauucccaucaccgccgcugcgugguaccucugggaggugaagaagcagcgcgccggggugcucugggacguccccucuccgccucccgugggcaaggccgagcuggaagacggggccuaccggaucaagcaaaaagggauucugggguacucacagaucggcgcaggcguguacaaggaggggaccuuccacacuauguggcacgucacccgcggcgccguccucaugcauaaagggaaacggaucgagcccagcugggcagaugucaaaaaggaccugaucuccuacggcgggggcuggaagcuggagggcgaguggaaagagggggaggagguccaagugcucgcccuugaacccggcaaaaauccccgcgccgugcagacaaagcccgggcuguucaaaaccaacaccggaaccaucggggccgugagccuggacuucuccccagguacgagcggcucccccaucguggacaagaagggcaagguggucggccuguacgggaacggugugguuacccggagcgguaccuaugucuccgcgaucgcucagaccgagaaguccaucgaggacaaccccgagaucgaggacgauaucuuccgcaaaaagaggcugacgauaauggaccuccacccaggggccggcaagaccaagcgcuaucuccccgcaauagugcgggaagcgaucaagcgcggcuugcggacccuaauccucgccccuacccgcgucgucgccgccgagauggaggaggcccugcgaggccugcccauccgguaucagacgccagcgauacgcgccgagcacaccgggcgggagaucguugaccucaugugccacgccaccuuuaccaugcgccuccugagcccuauacgggugcccaacuacaaccucaucaucauggacgaggcacacuucacggaccccgccuccaucgcggcccgcggcuacaucagcacccgggucgaaaugggcgaggccgccgggaucuuuaugaccgccacgccgcccggcucccgagacccguucccccagaguaacgcacccaucauggacgaggagcgggagauccccgaacgcaguuggaacagcggccacgaaugggugacugacuucaagggaaaaaccgugugguucgucccguccaucaaggccgggaacgacaucgccgcaugccugcggaagaacggcaagaagguaauccagcugagccggaagacguucgacucagaauacaucaagacccggacgaacgacugggauuucguggucaccaccgacaucucugagaugggcgcgaacuucaaggccgagcgcgugaucgacccccgucgcugcaugaagcccguaauacucaccgacggggaggagcgggugauccuggccggucccaugccggugacccacaguagcgccgcccagcgccgggggcgcgugggucggaaccccaagaacgaaaaugaccaguacauauacaugggugaaccccuggagaacgacgaggacugcgcgcacuggaaggaggccaagaugcuccucgacaacaucaauacuccggagggcaucaucccuuccauguucgagcccgagcgggaaaaggucgacgccaucgacggugaguacagacugcgcggcgaggcacgcaaaaccuucguggaccucaugcggcgcggcgaccugccuguguggcuggccuaccggguugcggccgaggguauaaacuacgccgaucgccgguggugcuucgauggcgugaaaaacaaccagauacucgaagagaacgucgaaguggagaucuggacuaaggagggggagcgcaagaagcugaaaccgcgguggcuagacgcccgcaucuacucugacccccucgccuugaaggaguucaaagaguucgcggccggccggaagucccugacacucaaucugaucaccgagaugggccgacugccaacguucaugacccagaaggcacggaacgcccucgacaaccuggcggugcugcauacggccgaggccgguggccgcgccuacaaccaugcccucagugaacuccccgagacccuggagacucuccugcugcucacacugcuggcgacugucaccggaggcaucuuccucuuccuaauguccggcaaggggaucgggaagaugacccucgggaugugcuguauuaucaccgccaguauccuccugugguaugcucagauucagccgcacuggaucgccgccuccaucauccucgaguucuuccucaucgugcugcugauccccgagcccgagaagcaacggacgccccaggacaaccaacucacuuacguagucaucgcgauucugaccguaguggccgcuaccauggccaacgagaugggcuuccuggagaagaccaagaaagacuucggcuuaggcagcaucacuacccagcaaccggagagcaacauucuggacaucgaccugcgacccgcaucggcauggacccucuacgcagucgcgaccacguucaucacgcccaugcugcggcacagcauugagaacaguagcguaaacguguccuugacggccauugccaaucaggcgaccguccucaugggccuggggaagggcuggccccugaguaagauggacaucggugugccucucuuagccaucggcugcuauucccaggugaaccccaucacucugacugccgcccuccugcugcucgucgcgcauuacgccaucaucgguccaggccugcaagccaaggccacccgcgaggcccaaaagcgggcggccgccggcaucaugaaaaacccgaccguggacgggauuacggugaucgaccuggacccgaucccauaugaccccaaguucgaaaagcaguugggccagguuaugcuccugguucucugcgugacccagguucugaugaugcgcaccacaugggcucugugcgaggcccucacauuggcgaccgggcccaucagcacgcugugggagggaaacccggggcgcuuuuggaacaccacgaucgccguguccauggccaacaucuuccggggcaguuacuuggcuggcgccggacugcuguucuccaucaugaagaacaccgcgaacacccgccggggcaccgggaacacgggcgaaacacucggggaaaaguggaagaaucgccugaacgcccugggcaagagcgaguuccagaucuacaaaaagucuggcauccaggagguggaccggacccucgccaaagaggggaucaagcgcggcgagaccgaccaccacgccgucagcaggggguccgcgaagcuucgcugguucguggagcggaaccugguaacgcccgagggcaagguaguggaccuaggcugugggcgcggcggguggagcuacuacuguggggggcugaagaacgugaaggaggucaagggccugacaaagggcgggcccggccacgaggagcccaucccgauguccacauacggguggaaccucgugagacugcagagcggcguggacgucuucuucacgccgcccgaaaagugcgacacgcugcucugcgauaucggggaauccagccccaacccgaccguggaagcuggccgcacccugcggguguugaaccucgucgagaacuggcugaacaacaacacacaguucugcauuaaagugcugagccccuauaugcccuccgugauugaaaaaauggaggcccugcagcgcaaguacggcggggcccucguccggaauccgcugagcagaaacuccacccaugagauguauugggugagcaacgccucaggaaacauugugagcuccgucaacaugaucagccggaugcugaucaaccgcuucacgaugcggcacaagaaggcgaccuaugagccggacguggaccucggguccggaacccgcaauaucgggaucgagagcgagacccccaaucuggacaucaucggcaagcgcaucgagaagaucaagcaggagcacgagaccucguggcacuacgaccaggaccaccccuacaagacuugggccuaccacggcagcuacgagacuaagcagaccggguccgccagcuccaugguuaacggcgucgugcggcuccuuacgaagccgugggacgugaucccuauggucacccagauggcaaugaccgacaccacgcccuucgggcagcagcgcguguucaaggaaaagguggacacccggacccaagagcccaaggaaggcaccaaaaagcuaaugaagaucacggccgaguggcuuuggaaggagcucggcaagaagaaaaccccgcgcauguguacccgggaggaguucacccgaaagguucggaguaacgcggcacugggggcaaucuucaccgacgaaaacaaauggaaguccgcccgcgaggccguggaggauagcggguucugggaguuagucgacaaggagcggaaccuccaucuagaagggaagugcgagaccugcguguacaacaugauggggaagagggagaagaagcugggggaguucggcaaggccaagggcagccgugccaucugguacauguggcucggggcccgcuucuuagaguucgaggcccuuggcuucuuaaacgaggaccacugguucucacgcgaaaacagccuguccgggguggagggcgaggggcugcacaagcuuggcuacauccugcgcgacgugagcaagaaggaaggcggggcgauguacgccgaugacacugccggcugggacacccggaucacgcuggaagaccugaagaacgaggagauggugaccaaccacauggagggggagcacaagaaacuagcggaagccaucuuucgccugaccuaccaaaacaaaguuguccgggugcagcgccccacgccccgggguacggucauggacauuaucucgagacgggaccagcgugggagcggccaggucgugacuuacggucucaacaccuucacuaacauggaggcgcagcugauucgccagauggagggggaggggguguucaaguccauacagcaccugacggugacagaggagaucgccgugaagaauugguuagagcggguagggcgcgagcggcugucucgcauggccaucagcggcgacgacugcgucgugaagccccuggacgaccgauuugcuagcgcccucacagcgcugaacgacaugggcaagauccgcaaggacauccagcagugggagccgucccguggauggaaugacuggacccaggugcccuuuugcucacaccacuuccacgagcugaucaugaaggacggccgcguccucguugugcccugccggaaccaagacgagcuaaucgggagagcccggaucucccagggcgccggguggucccugcgugagacggccugccucggcaaguccuacgcccagauguggucucucauguacuuccaccgccgagaccugcgacuggcggccaacgcgaucugcuccgccguacccagccauugggugcccaccagccgcaccaccuggagcauacacgccacccacgaguggaugacgaccgaggacauguugaccguuuggaaccgggucuggauccaggagaaccccuggauggaggacaaaaccccgguggagagcugggaggaaaucccguaccugggcaagcgagaagaccaguggugcgggucccucaucggucugacgagccgggcaaccugggccaagaacauccagacggccauaaaccagguccgcucgcuaauuggcaacgaggaguacacagacuacaugccgagcaugaagcgcuuccggcgcgaggaggaggaggcgggcgugcucugguag

SEQ ID NO: 25451 - RNA, 9876 nt, Artificial Sequence
  derived and/or modified CDS sequence (opt11) from DENV-2__KJ830750__SS-prME
acugccggcgugaucaucaugcugaucccuaccgccauggcguuccacuuaacgacacggaacggggagccccacaugauugugucgaagcaggagaaggggaagagucuauuguuuaagaccgaagacggcguuaacaugugcacccuuauggcaauggaucucggugaacugugugaggauaccaucaccuacaauuguccccucuugaggcagaacgagccggaggauaucgauuguuggugcaacucgaccuccaccuggguaaccuaugggaccugcacagccacuggcgagcacaggcgggagaagcggucugucgccuuggugccccaugugggcaugggguuggagacacggacggagaccuggaugaguucagagggcgccuggaaacacgcgcagcggauugagacuuggaucuugcgacaucccgguuucacgaucauggccgcaauuuuagccuacacuauaggcacgaccuacuuucaacgcguccuuaucuuuauccugcuaacugcgguggcccccuccaugaccaugcggugcauugggaucagcaaccgcgacuucguggaaggcguuuccggugggagcuggguggacaucgugcucgagcauggcuccugcgucacgaccauggccaagaacaagcccacgcuugacuuugagcugaucaaaacggaggccaagcagcccgccacacucagaaaguacugcauagaggcgaagcugaccaacacgaccaccgcaagccgcugcccuacccaaggggaaccgucccugaacgaggagcaggacaagcguuucgugugcaagcacuccaugguugaccgcggauggggcaaugguugcgggcuguucgggaaaggcgggauugucacgugugccauguucacaugcaagaagaacauggaaggcaaaauugugcagcccgagaaccuggaguacacaaucgucgucacgccccacucaggugaggagaacgccgucgggaacgauacggguaagcacggaaaggagauaaaggugaccccgcagucaagcaucaccgaggccgagcugaccggauacgggaccgucacgauggagugcagccccaggaccggucuagacuucaacgagaugguauugcugcaaauggagaacaaagcuuggcucgugcaccgccaaugguucuuggacuuaccccucccauggcugccgggugcugacauccaaggaucuaacuggauccaaaaagaaacgcuggucaccuucaagaauccccaugccaaaaagcaggacguggucguccucggcagucaggagggggccaugcauacagcccucaccggcgcgaccgagauucagaugagcuccggaaaccugcucuucaccggccaccuuaagugccggcugcgcauggacaaguugcaacugaaggguaugucuuacuccaugugcacggggaaguucaaggucguuaaggaaauagccgagacccagcacggcaccauaguggugcggguccaauacgaaggggacggcagccccugcaaaauccccuuugagaucauggaccuggagaagcgccacgugcucggcagacugaucacgguaaacccgaucgucacggggaaggacucccccguaaacauugaggccgagccaccguuuggcgacagcuacaucaucauagggguagagccgggucaguugaagcucaguugguucaagaaaggauccaguaucggccaaauguucgagacaaccaugcgcggcgccaagcgcauggccauuuugggugacacagcgugggacuuuggcucacucggagggguguucacguccauagggaaggcccuccaucagguguuuggggcuaucuauggcgccgccuucagcgggguaaguuggacaaugaaaauccugaucggcgucgugaucacauggauagggaugaacucucgguccacauccuuauccgugagccucguccucgugggcguagugacccuguaccugggggucaugguacaggccgacuccggcugugucgugagcuggaaaaacaaagaacucaaaugcgguucagguauuuucaucaccgacaacguucacacguggacugagcaguacaaguuccagcccgagucgcccuccaagcucgccucugcaauccagaaggcccacgaggaggggaucugugggauucgaagcgucacgcggcuggagaacuugauguggaaacagauuacccccgaguugaaccauauccuguccgagaacgagguuaagcucagcauuaugaccggcgacauaaaggggaucaugcaggcgggaaagcgcucucugcgcccgcagcccaccgagcugaaauauucguggaagacauggggaaaggccaagaugcucuccacagagccgcacaaucaaaccuuucuuaucgacgggcccgaaacugccgaauguccgaacacgaaucgcgccuggaacagccuggaggucgaggacuacggauucggugucuucaccaccaacauuuggcugaaacugaaggagcggcaggacguguccugugacaguaagcugauguccgcagcgauuaaagacaacagagccgugcacgccgacauggguuacuggauugagagcgcccucaacgauaccuggaagaucgagaaggccaguuucaucgaggucaaguccugccacuggcccaaaucacacacguuauggaguaauggcguucuggaaagcgagaugaucauccccaagaacuucgccgggccggugucacagcacaacuaccggcccgguuaccacacccagaccgcggggccuuggcacuuggggaaacucgaaauggacuucgacuuuugcgaggggacaaccgucguaguaaccgaggauugugggaaccgcggccccucacugagaacuaccaccgccuccgggaagcucauaacggaguggugcugcagaucuugcacucugccgccguuacgguaccgcggcgaggacgggugcugguauggcauggagauccggccccucaaggagaaggaggaaaaccuggucaacucacucgugaccgcuggacacggacaaauagauaacuucagccuaggcguccugggaauggccuuguucuuggaggagaugcugcgcacgaggguuggcacuaagcacgccgugcugcucguggccgucuccuucaugacacugaucacagguaauaugagcuuucgcgaccugggccgaguuauggucaugguaggggcugccaugaccgaugacaucggcaugggcgugaccuaccucgcacuucuggccgccuuuaaggugagacccaccuucgccgcugggcuccugcugcgcaaacucacuuccaaggagcugaugaugaccacgauaggcaucguucuacugucgcaauccacgaccccagagagcauucuggagcugaccgacgcgcuugcuuuggggaugaugauccuuaagauuguccggaacauggagaaguaccagcucgccgugacuaucauggcgauccuuugcguacccaacgcugugauucugcagaacgcuuggaagguuuccugcaccauccuagcggccgugucagugucgccccugcugcucaccagcucccagcaaaaggccgacuggauuccccuggcgcugaccauaaaaggccuaaacccuacagcaaucuuucugaccacgcuaaguagaacuaacaagaagcgguccuggccgcuaaacgaggccauaauggcggucggcaugguuagcauacuggcgagcucccuguugaagaacgacauccccaugacggggccccugguggccggaggccugcucaccgucugcuacgugcucacagguaggagcgcggaccuggaguuagagaaggccgcggacgugcggugggaagaccaggccgagaucuccgggucauccccgauauugucgauaacaauuucagaggaugggucgaugucaaucaagaacgaggaagaggagcagacgcugacaauuuuaaucaggaccggccugcugguaaucagcggcuuauuccccguuaguauuccgaucaccgcggccgccugguaccugugggaggugaagaagcagcgggccgggguccuuugggacguucccagcccgccuccagugggcaaggccgagcucgaggacggugcuuacaggaucaagcaaaaggggauccuggguuauucccagaucggggcuggugucuacaaagaagggacguuccacacuauguggcacgugacgcgcggggccgugcugaugcacaaagguaagcgcaucgagccaucgugggccgaugugcggaaagacuuaauauccuaugguggaggauggaagcuggagggagaguggaaggagggcgaggagguccagguacuggcccucgagcccggaaagaacccaagggcgguccagaccaaacccggccuguuuaaaaccaacacagggaccaucggcgcagugucguuggauuucuccccgggcaccucggggucacccaucguugauaaaaaggguaaggucgugggccucuacgggaauggggucguaacacggagcgggacuuacgugagcgccauagcucagaccgaaaagaguaucgaggacaaccccgagaucgaggaugacaucuuccgcaagaagcggcugaccaucauggaucugcauccuggugccgggaagaccaagcgguaccuaccggccaucguacgggaagccaucaagagaggcuuaagaacgcuuauucuggcgcccaccagaguaguggccgcggagauggaagaggcccuuagagggcugccgaucagguaccaaacccccgccauccgcgccgagcacacaggccgggagauuguugaccucaugugccaugcaacguucaccaugcgauugcugagcccgguuagggugccuaacuacaacuuaauaaucauggacgaggcccacuuuacggaccccgccuccauagccgccaggggauauauuucgacacggguggagaugggggaggccgcuggcaucuuuaugacggccacgccgccagggucaagggaucccuucccacaaaguaaugcccccaucauggacgaggagcgagagauccccgagcgcuccuggaacaguggccaugagugggucacagauuuuaaggggaagaccguaugguucguacccuccauaaaggccggcaacgacauagcggcgugcuugcggaagaacggcaaaaaggugauucagcugucgcgcaaaacguucgauagcgaguacaucaagacccggacaaacgauugggauuucgugguaacaacggacaucagcgagaugggcgccaacuucaaggcugagcgcgucaucgacccccggcgcugcaugaagcccgugauccugaccgauggcgaggagcgggugauacucgcggggccgaugcccguaacacacuccucagcugcccagcgacggggccggaucggacggaaccccaagaacgagaacgaucaguauaucuauaugggagagccccuugagaaugacgaggauugcgcgcacuggaaggaggcgaaaauguugcucgacaauauaaacacccccgaaggaaucauccccagcauguucgagcccgagcgcgagaagguugacgccaucgauggggaguaucgccugcggggcgaagcgcgcaagacauucguggaucugaugcggcgcggggaccucccggucuggcuggccuaccggguggcggcagaagggaucaacuacgccgaccgacggugguguuucgacgguaucaagaacaaccagauccuggaggagaacguggaaguagaaaucuggaccaaggagggggagcgcaagaaguuaaagccccgguggcuugacgcacgcaucuacagcgauccccuggcccugaaggaguucaaggaguucgccgccggucggaaguccuuaacacucaaccucauuaccgagaugggacggcugcccacguucaugacccaaaaggcucggaacgcccuggacaaccucgcgguccugcacaccgcggaagcaggcgggcgcgccuacaaccacgcucugucugaacucccggaaacgcuggaaacgcugcucuugcuaacgcuacuggccaccgucacggggggaaucuuccuauucuugauguccgguaaaggcaucgggaagaugacucugggcaugugcuguauuauaaccgccagcauccugcucugguacgcccagauccagccacacuggaucgcggccucuauaauccuggaguuuuuccugaucguacuccugauccccgagcccgagaagcagcggaccccacaggacaaccagcugaccuacguugucaucgccaucuugaccgugguggcggcaacgauggccaaugagaugggguucuuggagaagaccaagaaggacuuuggacuggggucgaucgccauccagcaacccgagagcaacauacucgacauagaccuacgccccgccucggcguggacacuguacgcgguggcgacuacauucaucacccccaugcuccgacacagcaucgaaaacuccagcguaaauguuagucugacugccaucgcgaaccaggccaccgucuugaugggccucggcaagggguggccacugucaaagauggacauaggcgugccccuacucgcgaucgggugcuacucccaggugaaccccaucacacugaccgcggcccugcuccuccuggucgcgcacuacgccauaaucggccccgggcuccaagcgaaggccacccgggaggcacagaagcgcgccgccgcggggauaaugaagaacccuacuguagacggcgugacgguuaucgaccuggaccccauccccuacgacccaaaguucgagaagcaguugggccaaguuaugcuccuggugcugugcguaacccaggugcucaugaugcgaaccacgugggcgcugugcgaggcccugacucucgcgacgggaccuaucagcacucugugggaagggaaucccgggcgguucuggaacaccacgauugcaguguccauggcaaacaucuucagggggagcuaccuggccggagccggccuucucuucuccaucaugaagaacaccacaaacaccaggcgaggcacggguaacacgggagagacgcucggggagaaguggaaaaaucgccucaacagccugggcaagucugaguuucagaucuacaaacguagugggauacaggaggucgaccgcacccuggccaaggaggggaucaaacggggugagacggaccaccaugcggugucgcguggaagcgcaaagcuccggugguucguggaacgcaaucugguaacgccagagggcaaggucguggaucugggcugcgggaggggcgggugguccuacuauuguggcgggcuuaaaaacguacgugaggugaagggguugaccaagggcgggcccgggcacgaggaaccgaucccaaugagcacauacggguggaacuugguccggcuucagucuggagucgacguuuucuucacgccgcccgagaagugcgacacguuacugugcgauauuggcgaaucgucaccgaaccccacggucgaagccggccgcacccuccggguccugaaccugguggagaacugguugaacaacaacacgcaguuuugcaucaagguuuugaauccauacaugccguccgucauagagaagauggagaccuuacagcgcaaguacgggggagcccuggugcggaacccucucagccgcaauuccacacacgagauguacugggugucuaacgccucaggaaauaucguaagcucagugaacaugaucagcagaaugcuuaucaaccgguucaccaugcggcauaagaaggcaaccuacgagccggacguagacuuaggcuccgggacgcgaaacaucggcaucgaguccgaaacgccgaaucucgacauaaucggcaagcgcauagagaagaucaaacaggagcaugaaacauccuggcacuaugaccaggaccacccguauaagacgugggccuaccauggguccuacgagacgaagcagaccgggucugcuagcagcauggucaacggugucguacggcugcugaccaagcccugggacgucauucccauggugacgcaaauggccaugacggacaccacgcccuucggacagcaacgcguguuuaaggagaagguggacacgcggacgcaggagcccaaagaggguaccaagaagcuaaugaagaucaccgccgaguggcuauggaaggagcugggaaagaagaagacgccgcggaugugcacgcgggaagaguuugcaaggaaggugcggucuaaugccgcccucggggcaaucuucaccgaugagaauaaguggaaauccgcacgcgaggcaguagaggacucgcgguucugggaacuaguagacaaagagaggaaccugcacuuggaggggaagugcgagaccugcgucuauaauaugaugggaaaacgggagaaaaagaucggugaguucggcaaggccaagggcucucgcgcuauuugguacauguggcugggggcccgguuccuggaguuugaggcacucggcuuccugaacgaggaccacugguuuucaagagaaaauagucuguccgguguagagggggagggccugcacaagcugggcuacauccuucgugaggugucgaagaaggagggcggugcaauguacgcagaugacaccgccggcugggacacgcgcauaacgcucgaggaccugaagaacgaggagauggugaccaaccacauggagggggaacacaaaaagcuggccgaagccaucuucaagcucaccuaccaaaacaaagucgugcgcguucagcgccccacuccgagaggcaccgugauggacaucaucucucggcgggaccaacgcgguucaggccaagucggcacguacgggcugaacacauuuacgaacaugggcgcccagcuaauccgccaaauggagggcgagggggucuucaaagguauccagcaccucaccgcaaccgaagagguugccguucaagauugguuggcacggguggggcgcgaaagguuaucgcgaauggcaaucagcggagacgacugugucguuaagccccucgacgaccgguucgccagugcccugaccgcacugaacgacauggggaaggugcgcaaagacauccaacagugggagccuucucggggcuggaacgauuggacgcaaguacccuucugcucccaccauuuucacgaacucaucaugaaggauggcaggguauuagugguccccugccggaaccaggacgagcugauuggccgcgcacggauuagccaaggcgcgggcuggagccugcgcgagaccgccugccucggcaagagcuacgcgcaaauguggaguuugauguacuuccaccgcagagauuugcgguuggccgccaaugcgaucugcagcgccgugccgucccacugggugccgaccucacggacgacguggagcauccacgccgggcaugaauggaugaccaccgaggacaugcugacagucuggaaucgcgucuggauccaggaaaaccccuggauggaggauaagacgcccguggaauccugggaggagauuccguaucugggcaagcgcgaggaccaguggugcgggagucuuauaggacugacaucucgagcaaccugggcgcgcaacauccaaacugcuauaaaccagguccgcucauugaucggcucggaggaauacacugacuacaugccgagcaugaaacgguuccgacgugaagaggaagaggccggagugcugugguga

SEQ ID NO: 25452 - RNA, 9876 nt, Artificial Sequence
  derived and/or modified CDS sequence (opt11) from DENV-2__FM210231__SS-prME
agugcgggaaugauaauuaugcucauccccaccgucauggcuuuucaccuaacaacccgcaacggagaaccgcacaugaucgucgguauucaagaaaaagggaaaagccugcuguuuaaaaccgaagacggagucaauauguguacgcuuauggcgauggaucucggcgaauuaugugaagacacgaucacguacaaaugcccccuccugagacaaaacgaaccugaagauauagauuguugguguaacuccacgagcacgugggucacauauggcacuugcacuacaaccggagaacauaggcgcgagaaaaggaguguugcacucgugccccauguaggcaugggccucgaaacaagaacggaaaccuggauguccagcgaaggggcauggaaacacgcucaaaggaucgaaaccuggauuuugaggcacccggguuuuacaaucauggcagcgauucuagcuuacacgaucggcaccacacacuuccaacgcguacugaucuuuauacugcucacggcuguggcccccucgaugacuaugcggugcaucgggauuucuaaccgggacuucgucgaaggagucagcggugggucauggguagacauagugcuggaacacggcucaugcgucaccaccauggccaaaaacaaaccuacgcuggauuucgaauugauaaaaacagaagcaaaacagcccgcgacacugaggaaauauuguauagaagcaaaacuaacaaauacaacaacggaaucacgaugcccaacgcaaggagaaccaaguuuaaaggaagaacaagacaagagguucguguguaaacauagcaugguggacagagggugggguaaugggugcggacucuucggaaagggcgggauuguaacaugcgcgauguuuacgugcaagaaaaauauggaaggcaaaaucguccagccggaaaaccuggaauacaccauuguaguaacaccccacucaggagaggaacaugcagucggaaaugauaccggaaaacacggcaaggaaauaaaggugaccccacaaagcuccauaacggaggcagaguuaacugguuacgggacggucacuauggaguguucgccacgaacggggcuggacuucaacgagaugguccugcuacaaauggaaaacaaggcuuggcuaguacaucgacaaugguuccuagaucuuccacugccuuggcuaccaggcgcugauaaacaagaaaguaacuggauacaaaaagaaacccucgucacguuuaagaacccccaugcuaagaagcaagacgugguaguuuuagggucgcaggagggugcgaugcacaccgcccugacgggggccacagagauacagaugucguccgggaaccuacucuucacuggacaccuuaagugccggcuacgcauggacaagcugcaacuaaaaggcaugucguacucaaugugcacaggcaaauucaaaguuguaaaagaaaucgcggaaacccaacacggaacuauagucauuagagugcaguacgagggugacgggagcccgugcaaaauaccuuucgagauaauggaccuugaaaagagauauguacucggucgccuaaucacaguuaaccccaucguuacggaaaaggauagccccguaaacaucgaggccgagcccccauucggagauaguuacauaauaauuggcguagagcccggacaauuaaagcucaauugguucaaaaagggaagcagcauaggccagauguucgaaacaacaaugagaggagcuaaaagaauggccauacugggcgacacggcuugggacuucggaucgcuaggagggguauucacaaguaucggcaaggcgcuccaucagguauuuggagcaauauacggcgcagcuuucucgggagucagcuggacgaugaagauccuaaucgguguaauuaucaccuggauagggaugaacagccgcucgaccagucucagcguaucccucguccucguaggcaucgucacacuauaccuggggguaauggugcaggcagauucugggugcguaguuucauggaaaaacaaagagcucaaaugcggaagcggaauauucauaaccgacaacguccacacuuggaccgagcaauauaaauuucagccggaaucaccgucuaaacuugccucagcaauccaaaaggcccaagaagagggcaucugcggaauccgcuccgucacuaggcuugaaaaccuaauguggaagcaaaucaccccagagcucaaucacauacuugccgaaaacgaagucaaguugacgaucaugacaggagacaucaagggcauaaugcaagcaggaaaacgaucacuaagaccacagccaacggaacucaaauacaguuggaaaacgugggggaaagcuaagauguuaucuacagaauccuauaaucagacauuccuuauagauggaccagagaccgcggaaugccccaacacgaacagggccuggaacagccuagaaguagaagacuacgguuuuggcguuuucaccacaaacauuugguugaaacugaaagaaaaacaagacgccuuuugcgauuccaagcugauguccgccgcgaucaaagacaaucgggcaguacacgccgauaugggauauuggaucgagagcgcccucaaugacacuuggaaaauagagaaggcuucguuuauagaggugaagaacugccacuggcccaaaagccacacgcuguggucgaacggaguccucgagagcgaaaugauuauacccaaaaacuuagcaggaccggucagccagcauaacuaccggcccggauaccauacccagaucgcagggccauggcaucucggcaaacucgaaauggacuucgacuucugcgacggaacuacaguuauagucacagaagacugcggcaaccgcggucccucgcuucggacuacaacagccaguggaaagcucauaaccgagugguguugucguagcuguacacucccgccccuucgcuaucguggggaagacggcugcugguaugggauggagauacguccucugaaagaaaaagaagaaaaccuugucaacuccuuagugacagcgggucacggacaaguagauaacuucucccucggggucuuaggcauggcccuguuccuagaggagauguuacggacacgcguggggacaaaacacgcgauccuacugguagccguaucauuuguaacccucauaacaggaaacauguccuuuaaagaccuaggacguguggucguaauggucggugcaacuauggcggaugauauaggcaugggcgucacuuaccuggcuuugcuggccgcguucaaaguuagaccaacauuugccgcggggcuacuacuccgaaaacuuaccucaaaagaacuaaugaugacaaccauaggcauagugcuucucagucaguccaccauccccgagacgguauuagaacugacggaugcccuugcacucggcaugaugguccuaaaaauuguccgcaacauggaaaaguaccaacuggcuguaacgaucauggcaauccucugugucccgaacgccguagugcuccaaaacgcauggaaagucaguuguaccaucuuggcggucguguccgucuccccguuacucuuaacaaguagccaacaaaagaccgacuggaucccucuagcacuaaccaucaaaggccuaaacccaacugcgauauucuugacuaccuuaagcagaacgaauaagaaacgaucauggccccugaacgaagcaauaauggcgguagggauggugagcauucuugcaucaucgcuccuaaagaaugacaucccaaugacagggcccuuaguagccggaggauuauuaaccgucugcuacgugcuaaccggcagaucggcagaccuagagcucgaaagggcgacugacguaaaaugggaagaccaagcagaaauuagcggcagcaguccaauccuaucaauaacaaucagcgaggacgggucgaugucgaucaaaaacgaggaagaagaacaaaccuuaacaaucuuaaucagaacggggcuacugguaaucucggguuuauucccaauaagcaucccaauaacagcggcggccugguacuugugggaaguuaagaaacaacgugccggcguacucugggacgucccauccccgccacccaugggaaaagcggagcuggaggacggggcauacagaaucaagcaaaaggggauacugggauauucacaaauuggggcgggcguauacaaggaagggacauuucauaccauguggcacgucacacgcggagccguccuaaugcacaaaggaaagcggauagagccaaguugggccgacgucaagaaggaccuuaucagcuaugggggaggcuggaaacucgagggcgaauggaaggaaggagaagaaguccaaguauuagcccucgagccgggcaaaaauccacgagcuguacaaacaaaacccggccuguucaaaacuaacaccggcacaauaggggccgugagccuugacuucagcccaggcacuagcgguucaccaaucauagauaagaaagguaaaguaguaggccuguauggcaauggcguggugacucgcucgggcgcguauguaagcgcgauugcacaaacggaaaaguccauagaggauaaccccgagauagaagacgacauauucaggaaacgcagacuaaccauaauggaccuccauccaggggcaggaaagacaaaacgauaucucccagcgauaguuagagaggccauaaaacgaggguugaggacacuuauucucgcuccaacgagggucguagcagcagagauggaagaagcacuaaggggccuacccauacgcuaccaaacuccagcgauuaaggccgaacauacaggcagggagaucguagaccugaugugucaugcaaccuucaccaugaggcuucuaagucccguacguguaccaaacuacaacuugaucaucauggacgaagcgcacuucacggacccggcgagcauagcagcgagaggcuacauuagcacaagaguagaaaugggagaagcugcaggaaucuucaugaccgcgacgccaccggggucccgggauccauuuccccaauccaacgcgccaaucaucgacgaagaaagagagauaccagaacgcucauggaacagcggacacgaauggguaacggacuuuaaagguaaaacggucugguucgugccuagcaucaaagccggcaaugauauagccgcguguuugaggaaaaaugggaagaaaguaauacaacuauccagaaagacuuucgacucagaauacgucaaaacccgcacaaaugacugggauuucgucgucaccacagacauuucggaaaugggcgcgaacuucaaggccgaaagaguuauagacccgcgaagaugcaugaaaccuguaauacuaaccgacggcgaagagaggguaauccucgcuggaccgaugccuguaacacacaguagcgcggcacaacgccgaggucgcauaggccggaacccuaaaaacgaaaacgaucaauauauauacaugggagaaccacuggagaacgacgaggacugcgcgcacuggaaagaagccaaaauguuacuagauaauaucaacacccccgagggcauaaucccgaguauguuugagccagaacgagaaaagguagacgccauagacggugaauacaggcucagaggcgaagcccggaagaccuucguagaccucaugcgacgcggggaccuuccaguguggcucgccuacaagguagcagccgagggaauaaacuacgccgacagaagaugguguuucgacggcauaaagaacaaccaaauucuagaagaaaauguagaaguagaaaucuggaccaaggaaggugagagaaagaaacuuaaaccccgauggcucgacgcucgcauuuacucugacccacucgcccucaaggaguucaaagaguucgccgcaggcagaaagucccucacgcugaaccugaucacggagaugggcagacugcccacauucaugacucagaaaacccgggaugcacuagacaaccucgcaguacuccacaccgcagaagccggcgggcgggcauacaaccacgcccuaucagaacuaccagagacacuagagacccugcugcugcugacgcuacucgcaacagugaccggugggauauuccuauuuuugaugucggggcgcgggauaggcaaaaugacgcuggggaugugcugcaucaucaccgccagcauacucuugugguacgcccaaauccagccgcacuggaucgcagccaguaucauucuggaguucuuccuuauugugcuacucauaccggaaccggagaaacaaaggacaccccaggauaaccaacucacauacguggugaucgcgauccucaccguaguagcagcaacuauggccaacgaaaugggauuucuggaaaagacaaagaaagaccuaggccucggaucuaucgucacacaacagccggaaucgaacauucuagacauagaucucagacccgcgagcgccuggacacuuuacgcuguggcgacaacguucgugaccccaaugcugcggcacagcauagaaaacagcuccgugaaugugucauugaccgccauugccaaucaagcgacgguccucauggguuuaggcaagggauggccacuguccaagauggacaucggugugccacuuuuggcaaucggguguuacagucaagucaauccaaucacccucacagcagcccuacuccuucuaguugcucauuacgcaaucaucgggccuggacuucaagcgaaagccacucgcgaagcacagaagagggcggcugccggaauaaugaagaacccgacaguagacgggauaaccguaaucgaucuagacccaauuccauacgacccuaaauucgaaaagcaacucggacaaguaaugcuacugauacuuuguguuacacagguacugaugaugagaaccacaugggcgcuaugcgaggcccuaacccuggccacuggccccaucaguacgcugugggaggguaaucccggaagauuuuggaacaccaccauugcgguuucgauggccaacauauucaggggauccuaccucgccggggccggccuacucuuuaguaucaugaaaaacacgacgaauaccagacgggggaccgguaacaucggggagacccuaggagaaaaguggaaaagccgauuaaaugcacuaggcaagagcgaguuccaaauauacaagaaaucugggauacaagaggucgaccguacacuagcgaaggaagguauuaaacguggagagacggaucaccacgccgucucucgcggcuccgccaaacuucgcugguucgucgagcguaacauggucaccccugaaggcaaggugguugaucuagguugcggaagaggugggugguccuauuacugcggaggcuuaaagaguguccgcgaagucaaggggcuaacaaaaggcggccccggccacgaagaacccaucccaaugucuacguauggauggaaccucguccggcuccagagcggaguagacguuuucuucauaccaccagaaaagugcgacacacuuuugugcgacaucggggaaucguccccaaacccgaccgucgaggcuggccgcacacuucgggucuugaaccugguagagaacugguugaacaauaauacgcaauuuugcauaaagguacuaaacccauauaugcccagcgucaucgagaaaauggaagcguugcaacgaaaguauggcggggcacugguacgcaacccguugagccguaacaguacgcacgagauguacugggugucgaacgcaagcggaaauaucguuagcucagucaauaugauaagccggaugcuuaucaaucgguuuacgaugcgacacaagaaggcaacuuacgaacccgacgucgacuuaggaagcggaacgaggaacaucggcauagaguccgagaucccaaaccucgacauaauaggaaaaaggaucgaaaagauaaaacaggaacacgaaaccucauggcacuacgaccaagaccacccguacaagacgugggccuaccacggaucauaugaaaccaaacagacggguuccgccagcucaaugguaaacggagucguaaggcuacuuaccaagcccugggacgugcucccaacugucacgcaaauggccaugaccgacaccacuccauucggccagcaaaggguauucaaggaaaaaguggacacccgcacccaagaaccaaaggaaggcaccaagaagcuaaugaaaauaaccgccgaguggcuauggaaagaacuaggcaagaagaaaacaccccgaaugugcacacgagaagaguucacucgaaaagugcgcagcaacgcugcucuaggagcaaucuucaccgacgaaaauaaguggaagucggcgcgggaggccgucgaggacucacguuucugggaauuagucgauaaggagcgcaaucuccaccucgaagguaaaugcgaaacaugcguauacaacaugaugggaaagcgcgagaagaaacucggagaguucggaaaggcaaaaggcucucgagcgaucugguacauguggcucggcgcacgcuuccuggaguucgaagcauugggcuuccucaacgaagaccauugguucucacgcgagaacagccuaucaggagucgaaggcgaaggacugcacaaacucggcuacauccugcgcgacgucuccaagaaagaaggcggcgccauguacgccgacgacacagccgggugggacacuaggauuacucuagaagaccuaaagaacgaagagauggucacgaaucacauggaaggcgaacacaaaaagcuggcagaagcuauuuucaaacuuacuuaccaaaacaaaguaguccgggugcaacgacccacuccacgaggaaccgucauggacauaauaagccggcgcgaccaacgcggaagcgggcaaguuggaacauacgggcugaauaccuucacuaacauggaggcucaacuaauccgccagauggagggggaaggaguauucaaaaacauccagcaucuuaccgugaccgaagagguagcaguccaaaauuggcucgccagggucgggagggaaagacuuagcaggauggcgaucucgggugacgacugcguaguuaaacccuuagacgaccgguucgcaaacgcacuaacugcacuuaacgacauggggaagaucaggaaggacauccagcagugggaaccuucgaagggguggaaugacuggacacaagucccauucugcagucaucacuuccacgaacucauaaugaaggacggcagaguccucguagugcccugcagaaaccaggacgagcuuaucgguagagcccgaauaucacaaggcgcgggguggucucugagggagacggcaugccuagggaaaucauaugcgcaaauguggucacuaauguacuuccaucgccgcgaucugcgacuagccgccaacgcuauauguucggcggucccgagucauugggugcccacgucaaggacaaccuggagcauacaugcuaaacacgaguggaugaccaccgaagauaugcugaccguuuggaaccgggucuggauacgugaaaauccauggauggaagacaagacuccaguggaaagcugggaggaaauaccguaccucggcaaacgagaagaccaaugguguggcucacucauaggguuaacgucccgcgcaacuugggccaaaaacauucaggcggcaaucaaccagguaagauccuugaucgggaacgaggaauacaccgacuacaugccaagcaugaagcgauuuaggcgggaagaggaggaagccggcguccucugguga

SEQ ID NO: 25453 - RNA, 9876 nt, Artificial Sequence
  derived and/or modified CDS sequence (opt11) from DENV-2__FM210239__SS-prME
acugccggggugaucauuaugcuaauucccaccgccauggcguuccacuugaccacccgcaauggggaaccacauaugaucguggggagacaggagaagggcaaaaguuuacuauucaagaccgaggacgguguaaacaugugcacccucauggcuaucgaccugggggagcugugugaagacaccauaaccuacaaguguccccuccuucgccagaacgagcccgaggauaucgacugcuggugcaacuccacuagcaccugggugacguacgggaccugcacaaccacgggcgagcaccggcgcgagaaacggagcguugccuugguaccccacguagguaugggccuagagaccagaaccgagacuuggaugaguucggagggggcuuggaagcacgcccaacggaucgaaaccuggauccugcgccaucccggauucaccaucauggcugccauucuggcguacaccgugggaacgacccacuuucagcgggcccuuaucuucauucuuuuagccgccguggccccgagcaugacuaugcgcuguaucgguauuuccaaccgggacuucguggagggcgucagcggggguagcuggguggacaucgugcuagagcacggguccugugugacaaccauggcgaagaacaagcccacccuggacuucgaauuaauuaagacggaggccaaacagccugcgacacuccgcaaguacugcauagaggccaaacugacgaacacgacgacugaaucacggugcccgacccagggcgaaccuucacuaaacgaggagcaggauaagcgcuucgugugcaagcacuccaugguggaccggggcugggggaacgguugugggcuuuuuggcaagggcgggauagucacgugcgcaauguuuacgugcaaaaagaacauggagggcaagauuguccagcccgagaaucuggaguacacgauugugauaacuccccacagcggggaggagcaugccgucggcaacgacacgggcaagcacggcaaggagauuaagaucacuccgcagucccccaucacugaggccgaacugaccgguuacgggaccgugacgauggagugcagccccaggacuggccucgacuuuaaugagauggugcugcugcaaauggaggacaaggcguggcugguccaccgccagugguuccucgacuuacccuugccuuggcugcccggggccgacacccaaggcucgaacuggauucaaaaggagacacuggugacguuuaagaacccccacgccaagaagcaggacguuguagugcucgggagccaggagggggccaugcacaccgcguuaacaggcgcgacagagauccagaugucuagcggcaaccucuuauucacgggccauuuaaagugccgguugcggauggacaagcuccaacuaaaaggaaugagcuacuccaugugcaccggcaaauucaagaucguuaaggagaucgccgagacgcagcacgggacgaucgugauccgggugcaguacgaaggggacggcucccccugcaagauaccauucgagauuauggaccuugagaagcgccacguccucggaagacucauuacgguaaaccccaucguaacagagaaggacagucccgucaacauugaagccgagcccccauucggcgacagcuacauaauaaucgggguugaaccgggucagcugaaauugaauugguucaagaagggguccagcaucggccagauguucgaaaccaccaugcgcggcgcgaagcggauggcaauccugggggacaccgcgugggauuucggaagccucggcgggguguucacuagcaucgggaaagcccuucaccaggucuucggugcaaucuacggcgccgcguucuccggggugagcuggaccaugaagaucuugauaggcguaauuauuacuuggaucgggaugaacucccguagcacuucccugagcgucucccuggucuuggugggagucaucacccucuaccugggggcaauggugcaggccgauucaggauguguggucuccuggaaaaacaaggaguugaagugcggcaguggaaucuucaucaccgacaacguccacaccuggacagagcaguacaaauuucagccggaaucccccagcaaacucgccucggcaauccagaaggcgcacgaagaagguaucugugguauccggucagugacgcgccuggagaaucugauguggaagcaaaucacccccgagcuaaaccacauccugagcgagaaugaagucaaacucaccaucaugacgggagacaucaaagggauuaugcaagccggaaaacggucacuucguccccagccgacugaguuaaaauacaguuggaagacuuggggaaaggccaagaugcugucuaccgagagccacaaccagacguuccugaucgacgggccggagaccgccgagugcccgaacacaaaccgggcguggaacucgcuagagguagaggacuacggauucggggucuuuacgacgaauauauggcucaaacucagggagaagcaagaugucuuuugugacuccaaacugaugucggcugcaaucaaggacaaccgggcagugcacgccgauaugggguacuggaucgaguccgccuuaaacgacaccuggaagauggagaaggcgagcuucaucgaggucaaaagcugucacuggccaaagagucacacccuguggagcaacggcgugcuagaaagcgagaugaucauccccaaauccuuugccggcccggucucccagcauaacuaccgucccggcuacuacacccaaaccgcugguccauggcaccucgggaaauuggaaauggauuucgauuucugcgaggggacaacggucguagugacggaggacugcgguaaccggggccccagucuacgcacaacgacugcaucggggaagcucaucacggaguggugcugucgguccugcacguugccgccgcugcgcuaccgcggcgaggaugggugcugguacggcauggaaauucgcccgcucaaggagaaagaggagaaccugguuaacagccuagucacugcugggcacggucagauagauaacuucucccuuggcgugcugggaauggcccuguuccucgaggaaaugcuaagaacccguguaggcacuaagcacgccauccuccuagucaccgugucuuucgugacauugaucacaggcaacauguccuuucgagaccugggccgggugauggugauggucggggccgccaugaccgacgauaucggcaugggcguuaccuaccucgcccugcuggccgccuucaaggugaggccaacuuuugcagcaggccuauuacuacggaaacuuaccucaaaagaacugaugauggcgaccauagguaucgcccuguuaucccagagcacaauuccggagacgaucuuggagcugacugaugcccucgcccucgggaugauggugcugaagauuguccguaacauggagaaguaucaguuagcagucacaaucauggcaauaaguugugugcccaacgccgucaucuuacagaacgccuggaaggucagcuguaccauucuggccgcgguaagcguuagcccucuccugcugacguccagucaacagaaagccgauuggaucccccucgcccugaccaucaaaggccugaacccgaccgccaucuuccuaacaacgcugucccgcaccagcaagaagcguuccuggccccugaaugaggccaucauggcagugggcauggucagcauucucgcaucuagccugcugaagaacgacaucccgaugaccgggccccuaguagccggcgggcuccugacugugugcuacguccucacgggccggagcgcugaccucgaacuggagagggccaccgacgugaaaugggaagaccaagccgagauaucagggucauccccgauacucucaauaacuaucgccgaagacgguucaaugagcauuaagaacgaagaggaggagcagacccugaccauucugauucggacuggccucuuaguaaucuccgggcuguucccuguaucgauaccgaucacggccgcggccugguaccuuugggaagugaagaaacaacgcgcgggcguacugugggauguccccagcccgcccccaguggggaaagcggagcuagaagacggcgcguacagaaucaagcagaagggcauccuuggcuauagccagaucggugccgggguauacaaggaaggcaccuuccacacgauguggcacguaacucgcggggccgugcugaugcaccggggcaagcgcaucgaaccguccugggcggaugugaagaaggaucugaucucuuacgggggcggguggaaacucgagggggaguggaaagagggcgaggaaguccaggugcuggcacuggagcccgggaagaacccacgugccgugcaaaccaagcccggacucuucaagacgaauaccgggacgaucggggccgucucccuagacuucucgccgggcacauccgggucucccauaguugaccgcaagggcaagguggucgggcuauacgggaauggcguugugaccagauccggcgcuuacguuagcgccaucgcccagaccgaaaagagcauagaggacaaccccgagaucgaggacgauauauuccgcaagaaacggcucacgauaauggaccugcaccccggcgcagggaaaacaaagagauaccugccugccaucguacgggaggccauuaagcguggucugcggacguuaauucuugccccuacuagaguggucgcagccgagauggaagaagcccugcgggggcuccccauccgcuaucagacgccagcgaucagggccgagcauaccggcagagagaucgucgaucugaugugccacgccaccuucaccaugcgguugcucagcccgguaagggugccgaacuacaaccuuauuaucauggacgaggcucacuuuacugaccccgcuucgaucgcugccaggggguacaucuccacccggguggagaugggugaagccgccgggaucuucaugacugcgacgccacccgggagccgcgacccauuuccucagaguaaugcccccauuauggacgaggaaagagagauccccgagcguuccuggaacagcggccacgagugggugacggacuucaaggggaaaaccguaugguucguucccagcaucaaggccggcaacgacaucgcugccugccugcgaaagaacggcaaaaaggugauacagcugucacgaaagaccuucgauagcgaauacgucaagacacgcacgaacgacugggauuucguggugaccaccgacaucucggagaugggggcaaacuucaaggccgagcgcgucaucgacccccgacgcugcaugaagcccgucauacugaccgacggggaggaacggguuauauuagccgggccgaugccgguaacccacagcucugcggcccagcgccggggccgcaucggacguaacccgaagaacgagaacgaccaguacaucuacaugggcgaaccccucgagaacgaugaggacugcgcccacuggaaggaggccaagaugcugcuagacaacauuaacaccccggagggaaucauccccagcauguucgaaccugagcgggagaagguggaugccaucgacggagaguaccgucuccguggcgaggcccgccggaccuuuguggaccucaugcgcaggggcgaucugccggucuggcucgccuaccgcgucgcggcugagggcaucaacuacgcugaccggcgcugguguuucgacggcgugaagaacaaccaaauacuugaggagaauguggagguggagaucuggaccaaggagggcgagcgaaagaaacugaagccccgcugguuggacgcacggaucuacagugacccucuggcccugaaggaguucaaggaguucgcagcuggccgcaagagucuaacacugaaccugauaaccgagaugggccggcugcccaccuucaugacgcaaaaggcaagggacgcccucgacaaccuggcggugcuccacacggcggaggcaggaggacgggccuacaaccacgccuuaucggagcugccggaaaccuuggagacuuuacugcuccucacccuccucgcgacgguuacuggcggcauuuuccuauuccugaugagcgggaagggcgucggaaagaugacguuaggcaugugcugcaucauaaccgccuccauucugcugugguacgcccaaauccagccucauuggaucgccgccaguauuauucucgaguucuuucugaucguccugcucaucccagagcccgaaaaacagagaacaccgcaggacaaccagcuuacuuacgugguaaucgcgauauugacagucguggccgcgaccauggcuaacgagaugggguuccucgagaagaccaagaaggaccugggccugggcagcaucgccacccaggagccggaaagcaacauccuugacaucgaccuucggcccgcgagcgccuggacccuguaugccguggccaccaccuucguaacgccgaugcuccgccacagcaucgagaauagcucugugaacgugagcuuaacagcgaucgccaaucaggccaccguccugaugggacuugggaagggguggcccuugucgaagauggacaucggcguucccuugcuggcuauagguugcuacagccaggugaaccccaucacccugacggccgcgcuucucuugcuuguggcccacuacgccauaaucggcccugggcuccaggccaaggccacucgcgaggcucagaagcgcgccgcugccgggauuaugaagaauccgaccgucgauggaguaacgguuauugaccuggaucccauaccuuacgaccccaaguucgagaagcagcugggccagguaaugcuccuuauccucugcguaacgcagguucucaugaugcguaccaccugggccuugugcgaggcccugacccucgcaacgggcccgaucuccacccugugggaggggaaccccgggcgguucuggaacaccacuaucgcuguaaguauggccaacaucuuccgcggcuccuaccuggcgggugccggccucuuguucagcaucaugaagaauacgacaaauacccggcgcggcacaggcaacauuggcgaaacuuuaggggagaaguggaagucacgguuaaaugcccuggggaaguccgaguuccagaucuacaagaagagugggauacaggaggucgaccgcaccuuagccaaggagggaauuaaacgcggggagacggaccaccaugcggucagccgcggcucugcgaagcucaggugguucguggagcgcaacauggugacccccgagggcaaggucguggaccuggggugcgguaggggaggguggagcuacuacuguggcgggcuaaaagauguucgcgaagugaaaggguugacgaaagggggccccgggcacgaggaaccgauccccaugucgaccuacggauggaaccuggugcgccugcaguccgggguggacgucuucuucacgccaccugagaagugugacacccuccugugcgauaucggugagaguagcccgaaccccacgaucgaggcgggcaggacccugcggguccucagccugguagagaacuggcugaauaaugacacccaguucugcaucaaggucuuaaacccguacaugcccagcgugauugaaaagauggagacacugcagcgcaaguacggaggggccuugguccgcaaccccuuaucccgcaauuccacccacgaaauguauuggguuagcaacgccacggggaauaucguguccagcgugaacaugauuucccggaugcucaucaaccgcuucacaaugaaacacaagaaagccacauacgagcccgacguggacuuaggaagcgggacgcgcaacauaggaaucgagagcgaaauccccaaccuggacaucaucggcaagcggaucgaaaagaucaagcaggagcacgagacaaguuggcauuacgaucaggaccauccguacaagaccugggcguaccacgggagcuacgagacuaagcaaaccggaagcgccuccagcaugguuaauggggugguccgacuccugaccaaacccugggacgucgugcccauggucacucagauggcuaugacggacaccacgcccuucgggcagcaacggguguucaaggagaaggucgacacgcgcacccaggagccgaaggagggaacgaagaagcugaugaagaucacagccgaauggcucuggaaggagcuggggaagaaaaagacgcccaggaugugcacgagagaggaguucacccggaagguccgcucaaaugcggcgcuuggcgccaucuucacugacgaaaauaaguggaaauccgcccgggaagcaguggaggacucccgcuucugggaacucgucgacaaggaacggaaccuucaccuggaggggaagugcgagaccugcgucuacaacaugaugggcaagcgcgagaagaaacucggugaguuuggcaaggcgaagggcagccgggccauaugguacauguggcuaggggcucgcuuccuugaguucgaggcccucggcuuccugaacgaggaccacugguucucucgggaaaauucuuuaagcgggguagagggcgaagggcuccacaagcucggcuacauccugcgugauguuuccaagaaggagggcggggcgauguacgccgacgacaccgcgggaugggauacccguauuacgcucgaagaccugaaaaacgaggagauggugaccaaucacauggagggggagcacaagaagcuggccgaggccaucuucaagcugaccuaccagaacaaggugguccgcguacagcggcccacgccacguggcacgguuauggacauuauaagccggcgcgaccagagaggguccggccaggucggcaccuaugggcugaacaccuucacgaacauggaggcccagcuuauccggcagauggaaggcgaggggguguuuaagucuauacagcgccucacggugaccgaggaaaucgcgguccagaacugguuagcacgggugggcagggagcgcuuaucccgcauggccauuagcggggacgacugcguggucaagccgcucgacgaucgguucgccucggcucugacagcccuaaacgacauggggaaagugcgcaaagacauccagcagugggagcccucacggggcuggaacgacuggacccaggucccguuuuguucccaccacuuccacgagcugaucaugaaggacggccgcguccugguggugcccugccguaaccaagacgagcugaucggccgcgccagaaucagccagggugccggcuggucccucaaagaaaccgccugcuuaggcaagucauacgcccaaauguggucccuuauguauuuucaccgccgggaccugcgucuagcagcgaaugccaucugcagugccgucccgagucacugggugccgacuuccagaaccaccuggagcauccacgcaaaacacgaguggaugaccacggaggacaugcugaccguauggaaccgagucuggauacaggagaaucccuggauggaggacaaaacacccguggagagcugggaggaggucccuuaccucgggaagcgggaagaccaguggugcggcucgcugaucgggcugaccagccgcgcgacaugggcgaagaacauccagaccgccaucaaccaggucagaucccuaauuggaaaugaggaguauaccgacuauaugcccuccaugaagcgauuccgccgggaagaggaagaggccgguguguugugguga

SEQ ID NO: 25454 - RNA, 9876 nt, Artificial Sequence
  derived and/or modified CDS sequence (opt11) from DENV-2__FM210232__SS-prME
accgccggcgugaucaucaugcugaucccuacugcaauggcguuccaccugaccacccgcaacggagagccccauaugaucgucgggcggcaagagaaagguaagagccuguuguucaagacggaggacggcgugaacaugugcacccucauggccaucgaucuuggggagcuuugcgaggacaccaucacguacaagugcccccuccugcgccagaacgagcccgaggauaucgauugcuggugcaacagcacaucuaccugggugaccuacgggaccuguaccaccacuggcgaacaccggcgugagaagcgguccgucgcucuggugccacacgugggcaugggccucgaaacccggacagagacauggaugagcuccgagggggccuggaagcacgcccagcggaucgagaccuggauccuccgccauccggguuucacaauaauggccgccauccuggcauacacuguggguacgacccacuuccaacgggcccucaucuucauccugcuggcagccguggcccccucaaugaccaugcgcugcaucgggauuuccaaccgggacuucguggagggcgucagcgggggcuccuggguggacauagugcucgagcacgggucaugugucaccaccauggccaaaaacaagcccacccuggacuuugagcuuaucaagaccgaggcgaagcagcccgccacccuccgaaaguauugcaucgaggccaaguugaccaacacgacaaccgaguccagaugcccgacgcagggcgagcccucacugaaugaggagcaggacaaacgcuucgugugcaaacauuccaugguugaucgggggugggggaacgguugugggcuguucggcaaaggcgggaucgucacuugugccauguuuacgugcaagaagaacauggagggcaagaucgugcagcccgagaaccuagaguacacaaucgucaucacgccucauagcggagaggagcacgccgucggcaacgauacgggcaagcacggcaaggaaauaaagauaacaccgcagucccccaucacggaagccgagcugacaggguacggcaccguuacuauggagugcagcccccguaccggucucgauuucaacgagauggugcugcugcagauggaggacaaggcguggcucguccacaggcaaugguuccuggaucugccccugccgugguugcccggugccgauacucagggcuccaacuggauccagaaggagacucuggugacguucaagaacccccacgccaagaagcaggacguugucguucucggcagccaggaaggcgccaugcauaccgcacugaccggagcgacagagauccagauguccagcggcaaccucuuauucacgggucaccugaagugccgccugcggauggacaagcuccagcugaaggggaugagcuacagcauguguacgggcaaguucaagaucgucaaggaaaucgccgagacccagcacgggacuaucguuauccgcgugcaguacgaaggcgacggcucccccugcaaaaucccauucgagaucauggaccuggagaagagacacguucucgggcgccugauaacggugaaucccauugugacagagaaggauuccccuguaaacaucgaggccgagcccccguucggcgacucuuauauaaucauugggguggagcccggucagcuuaagcuaaacugguucaagaagggcuccuccaucggccagauguucgaaacuaccaugcggggcgccaagcggauggccaucuuaggggacacggcgugggacuucgggucccugggcgggguguuuaccagcaucgggaaggcccuacaccaaguguuuggagccaucuacggagccgcguucucagggguuucauggaccaugaagauccugaucggcgugaucaucaccuggaucgggaugaacucccgcagcacaucccugagcguuucccuugugcuggugggaguaauaacccuguaucugggggccauggugcaggccgacucuggcuguguggucuccuggaagaacaaggagcucaagugcggcagcgggauuuucaucaccgacaaugugcacacguggacggagcaguacaaguuccaacccgaaucgcccagcaagcuggccagugccauccagaaggcgcaugaagagggcaucuguggaauccgcuccgugacccgccuggagaaccuaauguggaagcagaucaccccagaacucaaccauauccugagugagaacgaggucaagcucaccaucaugacgggcgacaucaagggaaucaugcaggccggcaagcggucccugcguccccagccaaccgagcugaaguacagcuggaagaccuggggaaaagcaaaaauguugaguaccgagucccacaaccagacguuccugauugacgguccggagaccgccgagugccccaauaccaaccgggccuggaacagucuagagguagaggacuacggcuucgggguguuuaccacgaacaucuggcucaagcugcgcgagaagcaagacgucuucugcgauagcaagcugaugucugcggccaucaaggauaaccgggcuguucacgccgacaugggcuacuggaucgaaagcgcccucaaugacaccuggaagauggagaaggcguccuucaucgaggugaagucaugccacuggccgaagucccauacccuguggagcaacggagugcuggaauccgaaaugaucauccccaaaucauucgccgguccugucucacagcacaacuaccgcccgggcuacuacacccaaacugccgggccauggcaccuugggaagcucgagauggacuuugacuucugcgaggggacuacuguggugguuaccgaggccugcgggaaucggggacccucgcugcgcacgacuaccgcgagcgggaaguugaucaccgaguggugcugccgguccugcacccucccgccccugcgcuaccgcggcgaagacggaugcugguacggaauggagauaaggccccucaaggagaaggaggagaacuuggugaacucacugguuacggccgggcacggacagaucgacaacuucaguuugggcgugcuggguauggcgcuguuccucgaggagaugcugcggacccgcguggggaccaagcacgccauccugcuuguaaccgugagcuucgugacccuuaucacuggaaauauguccuuccgggauuugggccgcgucauggugauggugggggccgcgaugaccgacgacaucggcaugggagucaccuaccucgcccuacuggcugccuucaaagugcgccccacuuucgcagcgggucuucuacugcggaaguugaccagcaaggagcugaugauggccaccaucggcauugcccugcucucucagagcaccaucccggaaacaauccuagagcugaccgaugcccucgcccuggggaugaugguccugaagauuguccgcaacauggagaaguaucaacuggcugugaccaucauggccaucuccugcguacccaacgccgucauccugcaaaaugccuggaaggugagcuguacgauccuggcggcaguguccguuagcccccuccugcugacguccagccagcagaaggccgacuggaucccccuggcccugaccaucaagggccuaaacccgaccgcgaucuuucugaccacgcugucccguaccagcaagaaacgcucuuggccacugaacgaggcgaucauggcugugggaauggucagcaucuuggccucuagcuugcugaagaacgacauacccaugacuggaccccucguggccggcggucuguugacaguuugcuacguacucacuggccgguccgccgaccuggagcuggagcgcgcaaccgacgugaagugggaggaccaagccgaaaucuccgggucauccccgauccucucaaucaccaucgccgaagacggcuccaugaguaucaagaacgaggaggaggagcagacgcuaacgauccugauccgcaccggccuccuggugaucuccggucuguuccccgucuccauccccaucacggcugccgcuugguaucuuugggaggugaaaaaacagcgcgccggcguguuaugggaugucccgucgccgccgcccguggggaaggcagaguuggaggacggcgccuaccggaucaaacagaagggcauccucggauacagccagauaggcgccggaguguacaaggagggcaccuuccacaccauguggcacguaacgcgcggggcagugcugaugcaccggggcaagcgcaucgagccguccugggcugacgugaagaaggaccuaauuagcuauggaggcggauggaagcucgagggggaauggaaggagggcgaagagguccagguguuagcgcuggagcccgggaagaaccccagggccgugcagacgaagcccggccuguucaagaccaacaccgggacgaucggcgccgucucccuggauuucaguccgggcaccuccgggagccccaucguagaccgcaagggcaaaguggucggcuuauacggaaacggggugguaacccgguccggagccuacgucucggccauagcccagaccgagaaauccaucgaggacaaucccgagaucgaagacgacauauuccgcaagaagcgcuugacgaucauggaccuacaccccggcgccggcaagacaaaacgcuaccugccugcgauaguuagggaggccauaaagcgcggccuccggacccucauacuggcgcccacccgcguuguggccgccgagauggaggaggcgcugcgcgggcuccccaucagauaccagacgcccgcuauucgcgccgagcacaccggccgggagauaguggacuuaaugugucacgcaaccuucaccaugcgccugcuaagcccggugcggguucccaacuacaaucugaucaucauggacgaggcccacuuuacggaccccgccagcaucgcugcccgcggcuacaucuccacccggguggaaaugggugaggccgcaggcaucuucaugaccgccacgccgcccgguagccgcgaccccuucccccagucuaacgccccaaucauggaugaggaacgcgagauuccugagcguuccuggaauuccggccacgaauggguaacggacuuuaaggguaagaccgucugguucgugccuagcauuaaggccggcaacgacauugccgcgugccugcguaagaacgggaagaaggugauucagcucucccgcaagaccuucgacucugaguacgucaagacgcggacuaacgacugggacuucguggugaccaccgacauuuccgagaugggcgccaauuucaaggccgaacgcguaauugacccgcggcgcuguaugaagccaguuauccugaccgacggcgaagagcgggugauccuggccgguccgaugcccgugacacacagcuccgcagcgcagcgccguggucgcaucgggcgaaaucccaagaacgagaacgaccaguacaucuacaugggagagccccucgaaaacgacgaggacugcgcccacuggaaagaagccaagaugcugcuggacaacaucaacaccccagagggcaucauccccuccauguucgagcccgagcgggagaaaguugaugccauagauggugaauaccgccuucggggggaggcccgcaagacguucguggacuuaaugcgucgcggggaucuaccggucuggcucgccuaccgcguggcggcggaggguaucaauuacgcagaccgccgguggugcuucgaugggguuaagaacaaccagauccuggaggaaaacguagagguggagaucuggaccaaagagggcgaacgcaagaagcugaagccucguuggcucgacgcgcgcaucuacucagacccccuggcccugaaggaguucaaggaauucgccgccggacgcaagucucucacacuaaaccugaucacugagauggggcgccugccgaccuucaugacacaaaaagcccgagacgcgcuggacaaccuggccgugcuccacacggccgaggccgggggucgcgccuacaaccacgcgcuguccgagcugccggagaccuuggagaccuuacugcuccugacacugcuagccacugucacgggcggaauuuuucuguuucugaugagcgggaagggcguggggaagaugacccucggcaugugcuguauuaucaccgcauccauccugcugugguacgcccagauccagccccacuggauugccgcgagcauuauccucgaauuuuuccugaucguccugcucauccccgagccggagaagcagagaaccccgcaggacaaccagcugaccuauguggugaucgcaaucuuaacugucguagcugcgaccauggccaacgaaaugggguuccucgagaagaccaagaaggaccugggcuugggcucaaucgcgacucaagaacccgagagcaacauccuggacaucgaccuacggcccgcaagcgcauggacauuauacgccguggccaccaccuucgucacccccaugcuccggcacuccaucgaaaacagcuccguaaacguaucucugacggccauugccaaccaggccacuguucucaugggguugggcaaaggguggccguuauccaaaauggacaucggcgugccccuguuggccauaggcugcuacucgcaagugaaccccaucacccugacggcggcccugcuccugcuugucgcccacuacgccaucaucggcccgggcuuacaggcgaaagcgacccgugaggcccagaagagagcugccgcugggaucaugaaaaacccgaccguggacggagucacugucaucgaccuggaccccauccccuacgacccgaaguucgagaagcagcuuggccagguaaugcucuugauccugugcgugacgcagguccucaugaugcggaccacgugggcacugugcgaggccuugacccucgccacggguccaaucuccacccugugggaggggaacccaggccgguucuggaacaccacgauugccgugagcauggccaauauuuuccggggcuccuaccuugccggggccggcuuacuguucagcaucaugaagaauacgacgaacacucgccgggggaccggcaauauuggcgagacgcugggggagaaguggaagucccgccucaacgcccuuggcaagagcgaguuccagaucuacaagaaauccgguauccaggaagucgaccggacccuagcgaaggagggcaucaaacguggcgagacugaccaccacgcggugagccggggcucggccaaacuccgcugguucguugaaagaaacauggugacccccgagggcaagguagucgaccucgggugcggccgcggaggcuggagcuacuacugcggggggcugaaagacgugcgcgaggucaagggacucacgaagggcgggccagggcacgaggagccgauccccauguccacguacggguggaaccugguucgcuugcagucuggagucgauguguucuucacuccgcccgagaagugcgacacacuccugugcgacaucggggaguccagcccgaaccccacgauugaggccgggcggacacugcgugugcucagucuaguggagaacuggcugaacaacgacacccaguucugcaucaaggucuuaaaccccuacaugccguccguuauugagaagauggagacacugcagcggaaguacgguggcgccuuagugcgaaacccccugagccggaacucaacccacgagauguacugggucaguaaugccaccgggaacauuguguccagcguaaacaugaucucccgcaugcucaucaacagguucacuaugaagcacaagaaagcgacguacgagcccgacgucgaccuggguagcgggacccgcaacaucggcaucgagagugaaauccccaaccuggacauaauugggaagagaaucgagaagauaaagcaggagcacgagacgagcuggcacuacgaccaggaucacccguacaagaccugggccuaccauggauccuacgagaccaaacaaaccggcuccgccuccagcauggugaauggggugguccggcuccugaccaagcccugggacguggugcccauggucacccagauggccaugaccgacaccacucccuucgggcagcaacgcguguuuaaggaaaagguggacacacgaacccaggagccgaaggaggggacgaagaagcuuaugaagaucaccgcugaguggcucuggaaggagcuugggaaaaagaagacgccgcgaauguguacacgggaggaguucaccaggaagguccgguccaacgcggcccugggcgccaucuucacggacgagaacaaguggaagucagcacgcgaggcuguggaggauucgcgguucugggagcugguggacaaggagcgcaaccugcaccuggaggggaagugugagacaugugucuacaacaugaugggcaagagggagaagaagcugggggaguuuggcaaggccaaaggcagccgcgcgaucugguacauguggcugggggcccgguuccuggaguucgaagcccuaggcuuccugaacgaggaccacugguucucccgugagaacagccugagcgggguggagggcgagggucuccacaagcucggcuacauccugcgggaugucuccaagaaggaaggcggggcaauguaugcggacgacaccgccggcugggacaccaggaucacgcucgaggaccuaaagaacgaggagauggugaccaaucacauggaaggugagcacaaaaagcuggcggaggccaucuuuaagcuaaccuaccagaacaaggugguccggguccagaggccuacgccccggggaaccgugauggacauaaucagcagacgggaccagcgcgggagcggccaggucggcaccuauggcuugaauaccuucacuaacauggaggcgcagcugauucgacagauggaaggcgaagggguguucaagagcauccagcaccugacggugacugaggagaucgcgguccagaacuggcuggcccgagugggccgcgagcggcugucccgcauggccaucagcggugacgacugcgucgucaaaccgcucgacgaccgguucgccuccgcgcucaccgcccugaacgacauggggaaagugagaaaggacauccagcagugggagcccucccggggguggaacgacuggacccaggugcccuuuugcucccaccacuuucacgagcucaucaugaaggacggccgcguucuugugguucccugccggaaccaagaugagcugaucggccgcgcacggaucagccagggggccggcuggucccucaaggagacggcaugccugggcaagucauaugcgcagauguggucccugauguacuuccaccgucgggaccucaggcuggcagcaaacgcgaucugcucagcugucccgucccacugggugcccacaucccggaccaccugguccauccacgccaaacacgaguggaugacuacagaggacaugcugaccguuuggaaccgcguuuggauccaagagaaccccuggauggaggacaagacccccguagagagcugggaggaagugcccuaccucggaaagcgggaggaccaguggugcggcagccugauugggcugacaucccgcgccacgugggccaagaauauucagaccgcgaucaaccagguccggucacucaucggcaacgaggaguacacugacuacaugcccagcaugaagcgcuuccgccgggaggaggaggaagcgggugugcugugguga

SEQ ID NO: 25455 - RNA, 9876 nt, Artificial Sequence
  derived and/or modified CDS sequence (opt11) from DENV-2__FM210233__SS-prME
agcgcggggaugaucaucaugcugaucccgaccgugauggcauuucaucucaccacccgcaauggggagccacauaugaucgucgggauccaggagaaggggaagucguuacucuuuaagacagaagacggcgugaauaugugcacccucauggcgauggaccugggggaacugugcgaagacaccauuacguacaagugccccuugcugcgucagaaugagcccgaggacaucgacugcugguguaacagcaccagcaccugggugaccuacgggaccugcaccacuaccggugagcaccgccgggagaagcgcaguguggcacuugugccccauguggggaugggccucgagacucggaccgagacguggauguccucggagggggcuuggaagcaugcccaacggaucgagacuuggauccugcgacacccgggcuuuaccauuauggcugcgauccuggccuacacuauagggaccacccacuuccagcggguccugaucuucauccuguugacggcaguggcccccuccaugaccaugcgaugcaucggcaucaguaaccgcgacuucguugagggggucuccggagggagcuggguggauaucgugcucgagcacggguccugugucaccaccauggcgaagaacaagccuacacucgauuuugagcugaucaagaccgaagccaagcagcccgcgacacuacggaaguacugcaucgaagccaagcugaccaacacgaccaccgagaguaggugccccacccagggcgagcccucccugaaggaggaacaggacaagcgguucgugugcaagcacucaaugguggaccgcggaugggggaacggcugcggacuguucggcaagggagggauagugacgugugcuauguucacgugcaagaagaacauggagggcaagaucgugcagcccgagaaccuggaguacaccauaguugucacgccccacuccggggaggagcacgcgguggggaacgacacagggaagcacggcaaggagauuaaggugaccccgcagagcuccaucaccgaggccgagcugacgggguacggcacgguuaccauggagugcagccccaggaccggccuggacuucaacgagaugguguugcugcagauggagaacaaagcguggcucgugcaccgccaaugguuccuggaucugccccucccauggcugccaggagcugauaagcaagaguccaacuggauccagaaggagacccuggugacguucaaaaacccccacgccaagaagcaggacgugguggugcucggcagccaggaaggcgcuaugcauacugccuugaccggcgccacugagauccagaugagcucagggaaccuccuauucacgggucaccugaagugucgccuucgcauggacaagcuccagcucaaggggaugagcuacuccauguguacugggaaguucaagguggucaaggagaucgcagagacccagcacggcaccaucgugaucagagugcaguaugagggggacggcagccccugcaaaauccccuucgagaucauggaccuggagaagcgauacguccugggucgguugaucacugugaauccgaucgugacugagaaggacuccccagucaacaucgaggccgagccgcccuuuggggacagcuauauuaucaucggaguugagccggggcaacugaagcucaacugguucaagaagggcuccagcaucggucaaauguuugaaaccaccaugaggggcgcuaaaaggauggcuauccugggcgacaccgccugggacuucgguucccugggcgggguguucacgucaaucggcaaggcgcuccaccaggucuucggggccaucuacggcgcggcuuucagcggggugucuuggaccaugaagauauugaucggggugauuaucaccuggauaggcaugaacucaaggucaacguccuuaagcgucucccucgugcucguggggauagucaccuuauaccuaggcguaauggugcaggccgacagcgggugcgucgugucuuggaagaacaaagagcucaagugugguagcggcaucuuuaucaccgacaacguucacacguggaccgaacaguacaaguuccagccggaaagccccuccaagcucgcgagcgcaauucaaaaggcccaggaggagggcaucugcggcauucgauccgucacucggcuggaaaaccucauguggaagcagaucacccccgagcugaaccacauacuggccgaaaacgaggugaagcucaccaucaugacuggggacauacgcgggaucaugcaggccgggaaacggucccugcggccgcagcccaccgagcugaaguacuccuggaagaccuggggcaaggcuaagaugcucagcacagagucauauaaccagaccuuccugaucgacggacccgaaacggcggagugcccgaacaccaaccgcgcauggaacucacuagagguagaagacuacggguucggcgucuucaccaccaauaucuggcucaaacuaaaggaaaagcaagacgcauucugcgacucaaagcugaugagcgccgcaauuaaagacaaucgcgcggugcacgccgacaugggcuauuggauggaguccgcacucaacgauacguggaaaaucgagaaagccagcuucaucgaagugaagaacugccacuggcccaagucccacacgcuauggagcaauggcguccuggaguccgagaugaucauccccaagaaccucgccggccccgugagccagcacaacuacaggcccggguaccacacccagaucgccggccccuggcaccuggggaaacuggagauggacuuugauuuuugcgacggcacaaccgugaucgucacggaggacugugggaaccgcggccccagccuccggaccacaacagcuagcgguaagcugaucacggaguggugcugucgcucgugcacacuacccccgcuccgguaucgcggggaagacggcugcugguacggcauggaaauccggccccugaaggagaaggaagagaaucugguaaauucccuagugaccgcaggacacgggcaggucgacaacuucagccuuggcgugcuggguauggcccucuuccuggaggagaugcugcgcacuaggguugggacaaagcacgcaauccucuuagucgccguauccuuugucacccugaucaccggcaauaugagcuucaaggaucucgggagaguugucgugauggucggugcuacaauggccgacgacaucgggaugggcgucacauaccucgcccuacucgcggccuucaaaguccggcccaccuucgccgccggcuuacugcuacgaaaguuaaccuccaaggagcugaugaugaccacgauugggaucgucuuacugagccaguccaccauccccgagaccgugcuggagcucacugacgcccuggcgcugggcaugaugguccucaagaucgugcgcaacauggagaaauaucagcuggccgugacaauaauggccauccugugcgugcccaaugccgugauccuccagaacgccuggaagguaagcugcaccauccuggcggucgugucugugagcccccugcuucugaccucaagucagcaaaagaccgacuggaucccccuggcccugacgauaaaggggcucaaucccaccgccaucuuccugaccacccucucccgcaccaauaagaagagaagcuggccgcugaaugaagccaucauggcggucggcaugguguccaucuuggcuagcucucuucuuaagaacgacauccccaugaccggcccgcugguugccggcggacuccugaccgucugcuacgugcugaccgggaggagcgcagaccucgagcuggagcgcgcaaccgaugugaagugggaagaccaagcggagaucaguggcagcagcccaauccuguccaucaccaucagcgaggauggguccaugucuaucaaaaaugaagaggaggaacagacccuuaccauccugauucggacgggccuucucgucaucuccggccuguucccgauaagcauaccgauaacugcagccgccugguacuuaugggaggugaagaagcagcgcgccggugugcucugggauguccccagcccuccgcccauggguaaggccgagcuggaagauggggccuaccgaaucaagcagaagggcauccugggcuacagccagaucggagcuggcguguacaaggaagguaccuuccacaccauguggcacgugacccgcggcgccguucucaugcacaagggcaaacggaucgagcccucaugggcagacgugaaaaaggaccuaaucagcuacggcgggggcuggaaguuggaaggcgaguggaaggagggggaggaaguucagguccucgcgcuggagcccggcaagaacccccgcgcagugcagacgaagcccggucucuucaagaccaacacaggcaccaucggggccgugucacucgacuucagccccggcacguccggcucacccaucauagacaagaaggggaagguugugggccuguacgguaacggggugguuacccgguccggggccuauguaagcgccauugcgcagaccgaaaagagcauagaggacaaccccgagaucgaagacgacaucuuucgcaagcggcgacugacaauuauggaccugcacccaggggccggcaaaacgaagcgguaccuucccgccaucgugcgugaggcaauaaagcgggggcugcguacccugauacucgcgccgacccggguuguagccgccgagauggaagaggcacugcgcggccuccccauccgguaccagacccccgccauucgcgcagagcauacugggcgugaaaucguagaucugaugugucacgccacauucaccaugagacugcuguccccaguccgcgugccgaacuauaaccucaucaucauggacgaggcccacuucacugaccccgccuccauagccgcgcguggauacauuagcaccaggguggagaugggcgaggccgcagguauauucaugaccgcgacgccgcccggcucacgggaucccuucccccaauccaacgccccuaucaucgacgaagagagggagauucccgagcggagcuggaacuccgggcacgagugggucaccgacuucaagggcaagacggugugguucgugccaagcauaaaggcugggaacgacaucgccgcuugccuacgcaagaacggcaagaaggucauacagcugucccggaagacuuucgacagcgaguacgugaagacacgcaccaacgacugggacuucguggugacgacggacaucuccgaaaugggcgccaacuucaaggcggagcgggugaucgacccccgccggugcaugaaacccguuauccucaccgacggggaggagcgcgugauccuggccggucccaugccggugacccauagcuccgccgcccagcggagggggcggauaggacgcaaccccaagaacgagaaugaccaguacauuuacaugggugaaccccuagagaacgacgaggauugcgcucauuggaaggaggcgaagaugcugcuggacaacauaaacacgcccgagggcaucaucccgagcauguucgagcccgagcgggagaaggucgacgccaucgacggcgaauaccgccugcgcggggaagcccgcaagaccuucgucgaucuaaugcgcagaggcgaccuucccgugugguuagccuacaagguagcagcggaggggauuaacuaugccgauagaagguggugcuuugacggcaucaagaacaaucagauacucgaggagaaugucgagguggagaucuggaccaaggagggggaacgcaagaagcugaaaccgcgguggcuggacgcccgcaucuacucagacccgcucgcccugaaagaguucaaggaguucgccgcaggucggaagucccucacccucaaccuaaucaccgagaugggcaggcugcccaccuuuaugacccagaagacccgggacgcucucgacaaccucgcuguccuacacacggccgaggcgggcgggcgcgccuacaaccacgcccucuccgagcucccugagacucuggagaccuuacugcugcucacccuguuggccacgguaaccgggggcaucuuccucuuccuuaugagcggccgggggaucggcaagaugacccuggggaugugcugcauaaucaccgccuccauccuccugugguacgcgcagauccagccgcacuggauagcugccagcauuauucuggaguucuuccucauuguccugcucaucccugagcccgagaagcagcgcacgccccaggacaaccagcucacauaugucgugaucgcaauccucaccguggucgccgccaccauggccaacgagaugggauuccuagagaagacaaagcgggaccucggccugggcucaaucgccacgcagcagccggagucaaacauccucgacaucgaccuccgcccugccuccgccuggacccuguacgcaguggcaacuaccuucgugacgcccaugcuacgucacagcaucgagaacucgagcgucaacgugucccucaccgcuauugcaaaccaagccaccguguugaugggccuaggcaagggcuggccccucuccaagauggacaucgggguuccgcuucuggcgauagguugcuauucucaggugaacccuaucacccucaccgcggccuuacugcuccuggucgcccacuacgcgauaaucggacccggccuucaggccaaggcgacccgcgaagcccaaaagcgggccgcagccgggaucaugaagaaccccacugucgacgggaucaccguaaucgaccucgaccccaucccguacgaccccaaguucgagaagcagcugggacaagugaugcugcucauucugugcgugacccaaguccuaaugaugcgcacaaccugggcccucugcgaggcccugacacuggcuacaggucccaucuccacccucugggaggggaacccggggcgcuucuggaacacgaccaucgcggugucaauggccaauaucuucaggggcuccuaccuggcaggagccgggcuccucuucagcauuaugaaaaacacgaccaacacccgucggggcacagggaacauaggagaaacacugggggaaaaguggaagucgcggcugaacgccuuaggcaagagcgaguuccaaaucuacaagaaguccggcauacaggaggucgaccggacccuggcaaaggagggaaucaaacgcggagagaccgaccaccacgcggugucucggggguccgccaagcugcggugguuuguagaacguaacauggucaccccagaaggcaagguuguggaccugggcugcggacgcggcggguggagcuacuacuguggcggccuaaagaacguccgggagguaaagggccugacgaagggcgggcccggacacgaggagcccauucccauguccaccuacggguggaaucucguccgccugcaaagcggcgucgacguguucuucaucccucccgagaagugcgacacccugcucugcgauaucggggaguccagccccaacccgaccguggaggccggccggacgcugcgcgucuugaacuuggucgagaauuggcucaauaacaacacccaguucugcaucaaagugcugaaccccuacaugccuuccgucauugaaaagauggaggcccuucagcggaaguacggaggggcccucgugcgcaacccgcucagccggaacagcacacacgagauguacuggguuuccaacgccagcggcaacaucgucuccagcguuaauaugaucucgcgcaugcugaucaaccgguucaccaugcgccauaagaaggccaccuacgagcccgauguggauuuaggcagcggcacgcggaacauugggaucgagagugagauucccaaccuggacaucaucggcaaacgcaucgagaaaauaaagcaagaacacgagacuagcuggcauuaugaucaggaccaccccuauaaaaccugggccuaccacggcuccuacgagaccaagcagacgggaagcgcuuccagcauggucaacggcgucgugcgccuguuaacuaagcccugggacguccugcccacaguaacgcaaauggccaugacggacacuacccccuucgggcagcagcgcguguucaaggaaaaggucgacacccggacgcaggagcccaaggagggcaccaagaagcugaugaagaucaccgccgaguggcucuggaaggagcugggcaagaagaagacgccccggaugugcacccgcgaggaguucacccggaaagugcggucgaacgcugcccugggggcgaucuucacggacgagaacaaguggaaguccgcccgggaagcuguggaggacagucgcuucugggagcucgucgauaaggagaggaaccugcaccuggagggcaagugugagaccugcguauauaacaugaugggcaagcgcgagaagaaacugggcgaguucgggaaagccaagggaagccgggccauaugguacauguggcuaggcgcgcgcuuccuggaguuugaagcccucggguuccugaacgaggaccacugguuuucccgagagaauagccuguccggugucgagggugagggccuccacaagcugggguacauauugcgcgacgugagcaagaaggaggguggcgccauguacgccgacgacacugcggguugggacacccguaucacccucgaagaccucaaaaaugaggagauggugaccaaccacauggagggcgagcacaagaaacuggccgaggccauuuucaagcucacguaccaaaacaagguggugcgcguucagcggcccacgccccgagggaccgucauggacaucauuagccggcgcgaccagcggggguccggccaagugggcaccuacggccugaacaccuucaccaauauggaggcccaguugaucaggcagauggagggggagggcguguucaagaauauacagcauuuaaccgucacugaggagguggccgugcauaauuggcuggcucgagucgggagagagaggcugucccggauggcuauauccggugacgauugcgugguuaagccgcucgacgaccgcuucgccaacgcccugacagcccucaaugacauggguaagauccggaaggacauccaacaaugggagccgaguaagggguggaaugacuggacgcaggucccauucugcucccaccacuuccacgagcucauuaugaaggaugggagaguccuggugguccccugucgaaaccaggacgaacugauuggccgcgcgcggauaagccagggcgccggguggucucuacgggagaccgcuugcuuaggcaagucguacgcccagauguggucguugauguauuuucaccgucgcgaccuccgccuggcagcgaacgcaaucugcagcgccgugccgucccacugggugccgacaagccgcacaaccugguccauccacgcuaagcacgaguggaugaccaccgaggauaugcugaccgucuggaaccggguguggauccgagagaaccccuggauggaggacaaaacgcccguggagucuugggaggagauccccuaccucggcaagcgagaggaccaguggugcgggucccugauuggccugacuucacgcgccaccugggcgaagaacauccaggcggccaucaaucagguucggucccucauagggaacgaggaguacacagacuacaugccgagcaugaagcgcuuccgccgagaggaggaagaggccggugugcuuugguag

SEQ ID NO: 25456 - RNA, 9876 nt, Artificial Sequence
  derived and/or modified CDS sequence (opt11) from DENV-2__FM210241__SS-prME
acggccggugucaucaucaugcugauccccaccgcaauggcauuccaccuuaccacucggaacggggagccccauaugaucgugggacggcaggagaaggguaagucccugcuguucaaaaccgaggacggcgugaacaugugcacccucauggccaucgaccuuggcgagcugugcgaagacacgaucaccuauaagugccccuuguugcgccagaacgagcccgaggacauugacugcuggugcaacucgacaagcaccuggguaacuuacgggacauguaccacuaccggcgagcaccggcgcgaaaagcggaguguagcgcugguuccccacguggggaugggccucgagacucgcaccgaaaccuggaugagcagcgagggggcguggaagcacgcccagcgcaucgagacguggauucugaggcaccccggcuuuaccaucauggcugccauacuagccuauacaauagggaccacgcacuuccaacgagcccugaucuuuauccuccuaaccgccguugcccccagcaugacgaugcgcugcaucggcaucagcaaccgggacuucguggagggcguaucugggggcucauggguggauaucgugcucgaacaugggagcugcgugaccacgauggccaaaaacaagcccacucuggauuuugagcuaauuaagaccgaagcgaaacagcccgcuacccuccgcaaguauuguaucgaggcgaagcugacgaacaccaccacagagucacguugcccgacgcagggcgagcccucacugaacgaggagcaagauaaaagguuuguauguaaacacucuauggucgaccggggcugggggaauggcugugggcuguuugggaaaggcgggaucgugaccugcgccauguucacuugcaagaagaacauggagggaaagauaguccagcccgagaaccuggaguacaccaucgugaucacgccccauagcggugaggagcacgcugugggcaacgacacggggaagcacggcaaggagauaaagaucaccccgcaguccagcauuaccgaggccgaguuaaccggguacggcacggucacuauggagugcuccccucgcaccggccuugacuucaacgagaugguacugcugcaaauggaggauaaggccuggcucgugcaccggcagugguuucuugauuugccgcuacccuggcugcccggggcugauacccagggcagcaacuggauacaaaaagaaacgcuggucaccuuuaagaauccccacgccaagaagcaggaugucgugguccucgggucccaggaaggcgccaugcacacagcccuuaccggggccacagagauucaaaugucgucggguaaccuccuauucaccggucaccugaagugccgcuugcggauggacaaacuucagcugaagggcaugucguacucuaugugcaccggcaaguucaaaaucgucaaagaaaucgcggaaacccagcacgggacgaucgucauccgggugcaguaugagggcgacgggucccccugcaagaucccguuugagaucauggaccuggagaagcggcaugugcucgggcgccugaucaccgucaacccuaucgucacggagaaggauagccccguaaacaucgaggccgagccgcccuucggcgacagcuacauuaucaucgggguugagcccggacagcucaaacuuaacugguucaagaaggggagcucuaucgggcagauguuugagacaacgaugcgcggagccaagcgcauggccauccugggggacacggcuugggacuucgguucacucggggguguguucaccucaaucgggaaggcgcuccaccaggucuucggcgcgauauacggagcggccuucagcggaguguccuggaccaugaagauucugaucggcgcgauaaucacguggauugggaugaauagccgguccaccagucuguccguaucucuagugcuaguagguguaauuacccuauaccugggggcgauggugcaggccgacucuggcugcguugugagcuggaagaacaaggaacucaaauguggcucugggauuuucaucaccgauaacguucacacuuggaccgagcaauacaaguuccagccagagagccccucuaagcuggccuccgccauccaaaaggcucacgaggagggcaucugcgggaucaggucugucacccgccuggagaaccucauguggaagcagauaacgcccgaacucaaucacauccuguccgagaacgaggucaaguuaacgaucaugaccggugacauaaaggggaucaugcaggccgguaaacggagcuuacgcccgcagccaacggagcucaaguacagcuggaaaacuuggggcaaagcuaaaaugcugucgacggagucacacaaccagaccuuccuaaucgacgggcccgaaacagccgagugcccaaauacaaaccgggccuggaacucccuggagguggaggacuauggguucgggguguucaccaccaacaucuggcucaaacuucgggagaagcaggacguguucugcgacuccaaacugaugagcgcugcaaucaaagauaaucgggcugugcacgcggauauggguuacuggauagaauccgcccucaacgacaccuggaaaauggaaaaggccagcuucaucgaaguaaagucgugccacuggccaaagagccacacgcugugguccaauggcgucuuggagagcgagaugauuauacccaaguccuuugccgggccggugagccagcacaacuaccgcccgggcuacuacacccaaacagcagggcccuggcaccucggcaagcuggagauggacuucgauuuuugcgaggggaccaccgucgucgugaccgaggacugcgggaaccggggaccgagccuacgcacgaccacagcuuccggaaagcuaauuaccgaguggugcugucgcagcuguacgcuaccgccgcugagauaccgaggcgaggacggaugcugguacggcauggagauccgcccacucaaggagaaggaagaaaaccuuguuaacagucugguaaccgcagggcacggccagaucgacaauuucucgcuuggcgugcuggggauggcccuguuucuagaagagaugcugcggacgcgagucgggacuaaacacgccauccugcucguggccgugucguucgucacccugaucaccgggaacaugucguuucgggaccugggccgagugauggugauggucggggcuaccaugacagacgauaucggcaugggcgucacguaccuggcgcugcuagccgcuuucaaggugcgucccaccuucgccgcugggcuccuccugcggaaguugacuucgaaggagcugaugauggcgaccaucggcaucgcgcuauugucacaguccacuaucccggagaccaucuuagagcugacggacgcccuggcccuggggaugaugguccugaagaucguacgcaacauggagaaauaccagcucgcagugaccaucauggcuauuagcugcguaccgaacgccgugauccuucagaacgccuggaagguguccugcacgauccuggccgcggucagcgugucaccccugcugcugaccucaucccagcagaaggccgacuggauaccauuagcgcuuaccaucaagggcuugaauccuacugccaucuuccucacgacccuaagccgcaccucgaagaagcgcuccuggccgcucaaugaagcaauuauggcagugggcauggucucgauccuagccucaagccuccuaaagaacgacauccccaugaccgggccguugguagccggcgguuuacucacgguguguuacgugcucacugguagauccgccgaucuugaacuggagcgcgcuaccgacgugaagugggaggaccaggcggagaucagugguuccagccccauccucuccauaacaauuagcgaggacggcuccaugagcaucaagaacgaggaggaggagcagacgcugaccauccugauccggaccggccuccucgugaucucugggcuguuuccggugucaauccccaucacggcagcugccugguaucucugggagguaaagaaacaaagagccggcguccugugggacguaccauccccaccaccaguggggaaagcggaacuggaggauggagccuauaggaucaagcagaaggguauccucggcuacucccaaaucggcgccggaguuuacaaggagggcaccuuccacacgauguggcaugugacccgcggggccgugcugaugcaucggggcaagcggaucgagccguccugggcggacguaaagaaagaccugaucucguacggaggaggguggaaguuggagggggaguggaaggagggcgaggagguccaagugcuggcguuggagcccggcaagaacccacgcgcuguccagaccaaaccgggccuauucaagaccaauaccgggacaaucggcgccgucuccuuagacuucagcccaggcaccuccggaucacccaucgucgaccgcaagggcaaggucgugggauuauacgguaacggcguugucacccgguccggggcauacguaagcgcgauagcccagacggagaaguccaucgaggauaaccccgagauugaggacgacauauuucgcaaaaagcggcugacgaucauggaucugcaccccggggccggaaagaccaagcgcuaccugccugccauuguucgggaggccauuaagcgcggccugcggacccucauccucgcaccgacgcguguuguugcugccgagauggaggaagcacugcgcgggcucccuauccgguaccagaccccagccauacgugcugagcacaccggacgggaaauuguggacuuaaugugccacgcuaccuucacaaugcgccuguuaucccccguccgcgugcccaacuauaaccugaucauaauggaugaggcgcacuuuaccgacccagccagcauagcggcgcgcggauacaucuccaccagaguagagaugggugaggccgccgggauauucaugaccgccacgccgccuggaagccgcgacccguuuccucagucuaacgcgcccaucaucgacgaggagcgggagaucccagagcguucuuggaacuccgggcaugaauggguuacagauuuuaaggggaagaccgugugguucgugccguccauaaaagccggaaacgauaucgccgccugccuccggaaaaacggcaaaaaggucauccaacucagucgcaagaccuucgauagcgaguacgucaagacccggaccaacgacugggauuucguuguaaccacagacaucuccgagaugggggccaacuuuaaagcagagcgggucaucgauccccggcgcuguaugaagccggugauucugacggacggcgaagaacgagucauccuggcggggcccaugccagugacucacucguccgccgcgcaacgccggggcaggaucgggcgcaaucccaagaacgagaacgaccaguacauuuacaugggagagccgcucgagaacgaugaggauugcgcccacuggaaggaggcgaagaugcuucuggacaacaucaacaccccugagggcaucaucccgucaauguucgagccagagcgggagaaaguugacgccauagacggggaguacagacuuagaggggaggcccgcaagaccuucguugaccugaugcggcgcggggacuugccggugugguuggccuaccggguggccgcggaaggcauaaauuaugccgaccggcgguggugcuuugacggggucaagaauaaccagauccuggaggagaacguagagguggaaauauggacgaaggaaggggagcggaagaagcugaagccgcggugguuggacgcccguauuuacuccgaccccuuggcucugaaggaguucaaagaguucgcggccggccgaaagucccucacccugaaucugaucacggaaaugggucgacuccccaccuuuaugacacagaaagcgcgggacgcgcuggacaaccuggccguacuccacaccgcggaggcaggcgggcgcgcauacaaccacgcgcuguccgagcugccagagacgcucgaaacccuccugcuccuaacccugcuagcaacggucaccggcggcaucuucuuauuccuuaugagcggaaagggcguggguaagaugacauuaggcaugugcugcaucaucacugccuccauacugcuuugguacgcccagauacagccucacuggaucgccgcgucuaucauucucgaauuuuuccucaucguauuacucaucccugaaccagagaagcagcgcacgccccaggauaaccagcugaccuacguuguaaucgcaauucugaccgucguagcggcaaccauggcaaacgaaaugggguucuuggagaaaacgaaaaaggaccugggccuggggagcaucgccacgcaggagccugaguccaacauucucgacauagacuugagacccgccucggcguggacccuguaugccguggccaccacguucgugacccccaugcuccggcauuccaucgagaauagcuccgugaaugucagccuuacagcaauugcgaaccaggccacgguguuaauggggcucgggaagggguggccauuguccaaaauggacauuggcgucccacugcuagcgaucggguguuacucucaggucaaccccauaacgcugacagccgcgcugcuuucgcugaucgcgcacuacgcaaucauagggcccggacuacaggccaaggcgacacgcgaggcccagaagcgggcggccgccgguaucaugaaaaauccaaccguagacggcaucaccgugauagaccucgauccgaucccauacgauccuaaguuugagaagcagcucggacaagucaugcuguugaucuugugugugacucaaguguuaaugaugcgcaccaccugggcccuuugcgaggcccugacgcuggcgaccggucccauuucaacccucugggaggguaacccgggccgcuucuggaauaccacgaucgcgguuagcauggccaacaucuuccgggggucguaccuagcaggagcuggccuccucuucuccaucaugaaaaacaccacaaacacucgcagagggacgggcaacauuggagagacucugggagagaaauggaagagucgccucaacgcucucggcaaguccgaguuccagauauacaagaaguccgggauccaggagguggaccggacgcuagccaaggaaggcaucaagagaggggaaaccgaccaccacgccguguccaggggcagcgccaagcuacgcugguucguggagcguaacauggugacgccugaaggcaaaguggucgacuuagggugcggacgcgggggcugguccuacuacugugggggucugaagaacguaagggagguuaagggccugaccaagggcggccccgggcacgaggagcccaucccgaugucuaccuacgguuggaaccucguccgucugcagagcggggucgacguguucuucacaccgcccgagaagugcgacacgcugcuuugugacaucggggaguccagccccaaccccaccaucgaggcuggacggacccuccguguacugucccucguugagaacugguugaacaacgauacgcaguucugcauaaaggugcugaaccccuacaugcccucagucauugaaaagauggagacccuccaacggaaguacgggggcgcccuuguacgcaacccgcucagucggaacagcacgcacgaaauguacuggguaucuaaugccaccgguaauaucgucagcucaguuaacaugaucucuagaaugcucaucaaccgguucaccaugaagcacaagaaagccaccuacgaacccgacguugacuuaggguccgggacgcgaaacauagggauagagucggagauccccaaccuggauaucaucggcaagcguaucgagaagauaaaacaagagcacgagaccuccuggcacuacgaucaagaccaccccuauaagaccugggcauaccacggcucauaugaaaccaagcagacgggcuccgcaagcucuauggugaacgggguggugagacugcuuaccaaacccugggacguugugcccauggucacccagauggcaaugaccgacacuacccccuucggacagcagagagucuucaaggagaagguggacacccggacccaagagcccaaggagggcacgaagaaacugaugaaaaucaccgccgaguggcucuggaaagaacucggcaaaaagaagaccccucgcaugugcacccgcgaagaguucacucgcaaggugagaucaaaugccgcccuuggcgcgaucuucaccgacgagaacaaguggaaguccgcgcgugaagccguagaggacucacgguucugggaguuaguggacaaagagaggaacuuacaccuugaagggaagugugagaccugcguuuauaauaugaugggcaaacgggagaagaaguuaggugaguucggcaaagcgaagggaagccgcgcgauuugguacaugugguugggagcccgguuucuggaguucgaggcacugggcuuccucaaugaggaucacugguucucccgcgagaauagcuuaucuggggucgagggcgaggggcugcauaagcucggcuauaucuuacgggaugugucuaaaaaggagggcggagccauguacgccgaugauacggcggguugggacacaagaauaacacuggaggacuugaagaacgaagagauggucaccaaccacauggaaggggagcacaagcgucuggccgaggccauuuucaaguugaccuaccagaacaaggucguucgcguacagcggcccacccccaggggaacagugauggacauuaucuccagacgcgaccaacgcggaagcggccagguuggcacuuacggguuaaacaccuucacgaauauggaggcccaguuuauccgucaaauggagggcgagggaaucuucaaguccauucagcaccucacggucaccgaggagauagcgguucagaacuggcuggcccgcgugggccgggaacggcuaucgaggauggccaucuccggggacgacugcguugugaaacccuuggacgaccgcuucgccucagcucuuacugcccugaacgacauggggaaggugcgcaaggauauccagcagugggagccuucaaagggcuggaacgacuggacacagguccccuucugcagccaccauuuucacgaacucauaaugaaagacgggaggguacugguuguuccgugccggaaccaggacgagcucaucgguagagcgaggaucucccagggugcaggcuggagccugaaggagacagccugccuggggaagaguuaugcacagauguggaguuugauguacuuucaccgccgggaucuccggcucgcagccaaugcgauuuguuccgccgugcccucccacugggugccgacuagccggaccacuuggaguauccacgccaaacacgaauggaugacgaccgaagacauguugaccguuuggaacagaguguggauccaggagaaccccuggauggaagacaagacccccguugagaguugggaggagguccccuacuuagggaagcgagaagaccaguggugcggcuccuugaucgggcucacgucucgcgcgaccugggccaagaacauccaaaccgcuaucaaccaggugcggucucuaauugggaacgaggaguacaccgacuacaugccgagcaugaagcguuuccgccgggaggaagaagaggccggcguguugugguaa

SEQ ID NO: 25457 - RNA, 9876 nt, Artificial Sequence
  derived and/or modified CDS sequence (opt11) from DENV-2__FM210242__SS-prME
uccgcggggaugauuaucaugcugauucccacagugauggccuuccaucucaccacccgcaauggggagccccacaugaucguaggcauccaagagaaagggaagucgcuucuguuuaaaaccgaagacggggugaauaugugcacccuuauggcgauggaccugggcgagcuuugcgaggacaccaucacuuacaaguguccccucuuacgccaaaacgagcccgaggacaucgauuguuggugcaacaguaccucaaccugggugaccuaugggaccuguacuaccaccggcgagcaucgccgggagaagaggagcgucgcccuggugccccacguggggaugggccucgagaccaggaccgaaacuuggaugucgagcgagggggcuuggaaacacgcccaacgcauugagaccuggauccuuagacacccgggcuucacuauuauggccgcgauucuggccuacaccauagggaccacccacuuccagcgcguguuaaucuucauccugcugacugccgucgcccccuccaugaccaugcggugcaucggcaucagcaaccgggacuuuguagagggcgucucugggggcagcuggguagacauaguacuggagcauggaucuugcgucaccacuauggcaaagaauaagcccacguuggacuucgaacugaucaagacggaggccaagcagcccgcuacccuccgcaaguacugcaucgaggccaagcugaccaauacaaccaccgaaagucgcuguccgacccagggggagcccucgcugaaggaggagcaggacaagcgguuugugugcaagcacagcaugguggaucgcggguggggcaauggcugcggccuguucggcaagggugggaucgucacgugcgccauguuuacgugcaagaaaaacauggagggcaaaaucgugcaacccgaaaaccuggaauauaccaucguggucacgccucauuccggggaggagcacgcaguagguaacgacacggggaaacauggaaaggagauaaaaguaacgccucagucuuccaucacagaagcagagcugaccggauauggaacugucacuauggagugcagcccacggaccggccucgacuuuaacgaaaugguucugcugcagauggagaauaaggccuggcucguacaccgccaaugguuuuuggaccugccccucccaugguuaccuggggcagacaaacaggaguccaacuggauccagaaagagacgcuggucaccuucaagaacccccacgccaagaagcaagacguggucguguugggcucgcaggagggggcgaugcacaccgcuuugaccggugccaccgaaauacagaugagcucuggaaaccucuuauucacggggcaucuuaagugccguuuaaggauggacaaacuacagcugaaaggcaugucguacuccaugugcaccgggaaguucaaggugguuaaggagauugcggagacccagcacggcacuaucguaauccggguccaguaugagggggacgguagccccugcaagaucccauucgagauaauggaccuagaaaaacguuacguguugggaaggcuuaucaccgugaacccuauugugacggaaaaggacagucccgucaacaucgaggccgagccacccuucggggacagcuacaucaucauaggcguugagccagggcagcugaagcucaacugguucaaaaagggcuccucgauagggcagauguucgaaacgaccaugcgcggugcaaagcgcauggcgauccugggagacaccgcaugggacuucgggucccuuggugggguguucacgagcaucggcaaggcacuccaccaggucuucggggcgauauacggagcugcuuuuucgggcgugagcuggacgaugaagauccugaucggggucauuauaaccuggauuggcaugaacucccgaucuacaucccucagcgucagucuggugcucgugggcaucgucacgcuuuaccuggguguaauggugcaggcugauagcgggugcgucgugucguggaaaaacaaggaacucaaaugcgguuccggcaucuucauuaccgacaacguccacaccuggacugagcaguacaaguuccagcccgaaucgcccuccaaguuggccuccgcgauucagaaggcccaggaggagggcauaugcggcauaaggucagucacacggcuggagaaccucauguggaagcagaucacacccgaacuuaaccacauccuggccgaaaacgagguaaaauuaacaaucaugaccggggacauaaagggcaucaugcaggccgggaagcgaucucugcguccacagcccacugagcugaaguacuccuggaaaaccuggggcaaagcaaagaugcucagcaccgagucuuacaaucagaccuuccugaucgacggcccagagacggcagagugcccgaacacgaaucgcgcauggaacucgcuagaaguugaggacuauggauucggagucuucaccacaaacaucuggcucaagcugaaggagaagcaggaugccuucugcgacuccaaacuaaugagcgccgcaauuaaagacaaucgagcggugcacgccgacaugggguauuggaucgaguccgcgcucaacgauacuuggaagaucgagaaggccagcuucaucgagguuaagaacugucacuggccuaagucucauacauuaugguccaauggcguccuggaaucggagaugaucauuccaaaaaaccuagccggcccggucagccagcacaauuaccguccagguuaccacacucagaucgcgggccccuggcaccuggggaagcuugagauggacuuugauuuuugcgaugguacgacaguaaucgucacggaagacugcgggaaucggggcccaucgcucagaacaacgacagcuagcggcaagcugaucacggaguggugcugucgaagcugcacguugccuccacuccgguaccggggggaagacgggugcugguacgguauggagauccgcccacucaaagagaaggaggagaaucuggugaacucgcucgucaccgccgggcacggacagguugacaacuuuagccuaggugugcuagggauggccuuauucuuggaggaaauguugcgaacccgcgugggaacaaagcacgcgauccucuuggucgccguguccuucgugaccuugauuacuggcaacaugagcuuuaaggaccuugggcgcgucgugguaaugguuggggcaaccauggcagacgacaucgggaugggcguaacguaucuggcccuguuggcggccuucaaagugcgccccaccuucgcggccggccugcuuuugcguaagcugaccaguaaggaacugaugaugaccacgaucggaauuguccuccugagucagaguacaaucccugagaccgugcucgaacucaccgacgcccuggcguuagggaugaugguucucaaaaucguacgcaacauggaaaaguaucagcucgccgugacgaucauggccauacuaugcgucccgaaugcaguggugcuccagaacgccuggaaggucagcuguacaauauuggcgguaguuagugucagcccgcugcuccugaccuccagccagcaaaagacagacuggauaccccuggcacugacgauaaaaggacugaacccuaccgccauuuuccugacuacguuaucccgaaccaacaaaaaacguagcuggccgcugaaugaggcgaucauggccgugggcaugguguccauccuggcuuccucucuacugaagaacgauauccccaugaccggccccuugguggccggaggccuccugacuguguguuacgugcugaccggacgcagcgcagaccucgagcucgagcgagccacagacguuaagugggaggaccaggcggaaaucuccggcagcagccccaucuuaagcaucacuaucucagaggacgggucuaugagcaucaagaacgaagaagaggagcagacccuuacaauucugauccgcacaggccuacucgucaucucaggccuguucccgaucagcauaccgauaacugcagccgccugguaucugugggaagugaagaagcagcgggccggggugcucugggacguacccagcccgccgcccaugggaaaggcggaacuugaggacggagcguaccguauuaaacagaaggggauccucggguacagccagaucggagccggcguauacaaggaggguaccuuccacaccauguggcacguuacgcggggugccguccucaugcacaaagggaagaggauugaacccuccugggcagacgucaagaaggaccugaucagcuauggcgggggcuggaagcuggagggcgaguggaaagagggggaggagguccaggugcucgcccuugagcccggcaaaaacccccgggccguacaaacgaaacccgggcuguucaagaccaacacgggcaccaucggugcagucucccuggacuucucgcccggcacgaguggcagccccauaauugacaagaagggcaaggugguaggccuguacgggaacggaguugugacucgguccggcgccuacgugagcgccaucgcccagaccgagaaguccaucgaggacaacccagagaucgaggacgacauauucagaaagcgccggcugaccaucauggaccuacacccgggagccgggaagaccaaaagauacuuaccagccaucguccgggaagccaucaaacgagggcugcgaaccuugauccucgcgccaacgcgcgugguggcugccgagauggaggaagcacugcgcgggcugcccauacgguaccagacccccgccauaaaggcggaacacacgggucgggaaauaguugaccucaugugucacgccaccuucaccaugaggcugcugagccccgugcgcguuccgaauuacaaucucaucaucauggacgaagcgcacuucaccgaccccgccuccaucgcggcucggggguacaucucgacucgugucgagaugggggaggccgccgggauauucaugaccgccacgccgcccggcagcagagauccguucccccaguccaacgcacccaucaucgacgaggagcgcgagauccccgaacggagcuggaauagcgggcacgagugggugaccgauuucaagggcaaaacgguaugguucguaccgagcauaaaggcggggaaugacaucgcggccugccugcgaaagaacggcaagaaggugauucagcugucucggaagacguucgacuccgaauaugugaagaccagaaccaacgacugggacuucgucgucacgacagacaucuccgagaugggagcgaauuucaaggcagagcggguaauugacccccgcagaugcaugaagccagugaucuuaaccgacggggaagagcgggugauacucgccggccccaugccggugacccacagcuccgcggcucagcgccgcgggcgcauaggcaggaaucccaagaacgagaacgaccaguacaucuauaugggggaaccacuugagaaugacgaggacugcgcccacuggaaggaggcuaagaugcuccuggauaacaucaauacgcccgagggcaucauucccuccauguucgaacccgagagagaaaagguugacgccaucgacggugaguacagacuucgcggggaggcccgcaaaacauucguggaccucaugaggcggggcgaccugccgguguggcuggccuacaaagucgccgcggaggggaucaacuacgccgaccgccgguggugcuuugacggcaucaaaaauaaccagauccuugaggagaacguggaggucgagaucuggaccaaggaaggagaaagaaagaaacucaagccgcgguggcuagaugcacguauuuauuccgacccucucgcccugaaggaauucaaggaguucgcugcgggcagaaagagccugacgcucaacuugaucacggaaaugggcaggcuacccaccuucaugacccaaaagacccgggacgcucucgauaaucuggccgugcugcacaccgccgaagccggcgggagagcauacaaucaugcacucucggagcucccagaaacccuggagacuuugcucuuacucacgcucuuagcgaccgugaccggggggaucuuccucuucuuaaugucuggcagagguauaggcaagaugacgcuggggauguguugcaucaucaccgcuuccauccugcugugguacgcgcagauccagccacauuggaucgcggcgucgaucauccuggaauucuuccucaucguccuguuaauccccgagcccgagaagcagcggacgccccaggauaaccagcugacuuauguagugaucgccauacugaccguuguugccgcgacgauggcgaacgagaugggcuuucuagagaaaaccaagaaggaccucgguuuaggcuccaucgcgacccagcagccagagucgaacauccuggauaucgaccuccggcccgccucugcuuggacgcuguaugcgguggccacgacauucguaacgcccaugcugcggcacagcaucgagaacucuucagugaacgugagccucacggccauagcgaaucaggccaccgucuugaugggccuggguaaaggcuggccucucaguaagauggacaucggagugccguugcuggcgaucgguugcuacagccaggucaacccgauuacccucaccgcugcccugcuacuccugguagcucauuaugcgaucaucgggcccgggcugcaagccaaggcaaccagggaggcccagaaacgcgccgccgcaggcaucaugaagaauccgacaguggacggcaucacggugauugaccucgacccaauucccuacgaccccaaguuugagaagcagcugggccaggugaugcugcucauucuguguguaacccaagugcuaaugaugcgaacgaccugggcccucugcgaggcccugacacuugccaccgggccgaucucaacauuaugggagggcaacccagggcgcuuuuggaacacgaccaucgcugucagcauggcaaacaucuuccggggcuccuacuuggccggagccggacuccucuuuagcaucaugaagaacacgacaaacacucgccggggaaccgggaauaucggugaaacguuaggcgaaaaguggaagucccgccugaacgcacucgggaagucugaguuccagaucuauaagaagagcgggauccaggaggucgaccgcacccuggcaaaagagggaaucaagaggggcgagacggaccaccacgcggucagcagaggaagcgcgaaacugcggugguucguagagcgcaacaugguuacccccgaggggaagguuguggaccucgggugcgggcggggaggauggucuuacuacugcggcggucugaagucuguucgagaggugaagggccugacgaagggcggacccggacacgaggagcccauccccaugagcaccuacgguuggaaucucguacgucugcaguccggcguggauguguucuuuaucccgccagagaagugcgauacgcuacucugcgacaucggggaaaguucucccaauccgaccgucgaagcaggacgcacccugaggguacugaaucucguugaaaacuggcugaauaacaauacccaauucugcauaaaaguccugaaccccuacaugccuucugugauagagaagauggaggcgcugcagcggaaguacggcggagcgcuuguacggaauccgcuuagucgcaacagcacccacgaaauguacugggugagcaacgcauccggcaauauuguuuccucgguaaauaugaucagccguaugcuaauuaaccgcuucaccaugcggcacaaaaaagcuaccuaugagccggacgucgaccuuggguccggcacgagaaauaucggcaucgaaucagagaucccaaaccuggacaucaucggcaagcggaucgagaaaaucaagcaagaacaugaaaccuccuggcacuacgaucaggaccauccguacaagaccugggcauaccaugggagcuacgagacaaagcagacgggcucggccucaucuaugguaaacggcgucguacgauuacuuaccaaaccaugggacgugcuucccaccguuacccagauggccaugacugauacuacacccuuuggucagcagcgagucuucaaggagaagguggacacccgcacgcaggagcccaaggagggcaccaagaagcugaugaagaucaccgcagaguggcuguggaaggaauuagggaagaagaagacaccccgcauguguacgcgugaggaguucacccgcaagguacggagcaacgccgcacugggggcuaucuucaccgacgagaacaaguggaaauccgcgcgugaggcgguagaagacuccagguucugggagcuuguagacaaggagcgcaaccugcaccuggaggguaagugugaaaccugcguguacaacaugauggggaaaagagagaagaagcucggagaguucgggaaagcaaaaggcucccgcgccaucugguacaugugguuaggcgcgcgguucuuggaauucgaggcccucggauuccugaacgaggaccacugguucagcagggagaauucuuuaucugggguggaaggggaaggacugcauaagcuaggguacauccugcgagacguaaguaagaaggagggcggugccauguacgcagaugacacggcggggugggauacacgcauuacccucgaggaucugaaaaacgaggagauggucaccaaccacauggagggagagcacaaaaaguuggccgaggcgaucuucaagcucacguaccagaacaagguagugcgcguccaacgcccuacucccagaggcaccgugauggacauaauuucucgacgggaccaacgcgguuccggccaggugggcaccuacggcuuaaacaccuucacaaauauggaggcucaguugauucggcagauggagggggagggcgucuucaagaacauccagcauuugaccguaaccgaagagguggcuguccaaaacuggcuugcgcgugugggucgagaaagguugucgcgaauggccaucucaggcgacgacugcguugucaagccucucgaugaucgcuucgcuaacgcacucacggcacuuaacgacauggggaagauccgcaaggacauccagcagugggagcccuccaagggguggaacgacuggacccagguacccuucugcagccaccacuuucacgagcuaauuaugaaagacggcagaguauuagucgugccaugccguaaucaggacgagcugauagggagggcccgcaucucccaaggcgccgguuggagccuccgggagaccgcuugucuggguaaauccuacgcucaaauguggagccucauguacuuccaccgcagggaccuucgcuuagccgccaacgcuauaugcuccgccgugccaagccauugggugccaacgucccguacgaccugguccauccaugcaaaacaugaauggaugacgaccgaggauauguugacaguguggaaccgaguuuggauacgggagaaccccuggauggaggacaagacccccguugaguccugggaggagauccccuaccucggcaaaagagaggaccagugguguggaucccugauuggguugaccucccgggccaccugggcgaagaacauacaggccgcgaucaaucagguccguagcuuaaucgggaacgaagaguauacggauuauaugccgagcaugaagcgguuccgccgggaagaagaagaggcuggcgugcugugguga

SEQ ID NO: 25458 - RNA, 9876 nt, Artificial Sequence
  derived and/or modified CDS sequence (opt11) from DENV-2__FM210243__SS-prME
accgcuggcgugauuaucauguuaauccccacagcgauggcguuccaccucaccacccgcaacggggaaccccacaugauugucgggcggcaggagaaagggaagagucugcuguucaagacugaggauggcgugaacaugugcacccucauggccaucgaccucggggagcugugugaggacacaaucaccuacaaaugcccccuccugcggcaaaaugaacccgaggacauagauugcugguguaacagcacgagcacgugggugaccuacgggaccugcaccacgacgggcgagcaccgccgcgagaagcggagcgucgcccuuguaccacacguugggaugggcuuagaaacaaggaccgagacauggaugaguuccgagggggcguggaagcaugcucaacggaucgaaaccuggaucuuacggcauccuggcuucacuauuauggcggccauuuuggcguacacagucgggacuacccauuuccagagggcacucaucuucauccugcuagcggccguggcccccucaaugaccaugcgcugcaucgguaucuccaaccgugacuuuguggagggcgucucagggggcuccuggguagauauuguguuggagcacgggucuugcgucacgaccauggccaagaacaagcccacucuagacuuugagcuuaucaagaccgaggccaaacagccagccacgcuccgcaaguauugcauugaggccaagcugacgaacacuaccaccgagucccggugcccgacccaaggagagcccucucugaacgaggagcaagacaaacguuucguaugcaagcacuccaugguggaucggggcugggggaauggguguggguuauuuggcaagggcgggaucgucacaugcgcaauguucaccugcaagaagaacauggagggaaagaucgugcaaccagagaaucuggaguauaccaucgugaucacaccucacagcggcgaggagcaugccgugggcaacgacacgggaaaacacggcaaggagaucaagaucaccccgcagaguucaaucaccgaggccgagcugacgggguaugggaccgugacuauggagugcagcccucgcacaggucucgacuucaacgagaugguguuauugcagauggaggacaaagcguggcucgugcaccgucagugguuucuggaccugccccugcccuggcugccaggggccgacacccagggaagcaacuggauucagaaggaaacccuggugacguucaagaacccccacgcuaagaagcaagacgugguuguguuagggucccaggaaggcgcuaugcauaccgcccugacgggcgcgaccgagauucagaugagcagcggaaaccuccuuuucacgggucacuuaaaaugccgguuacggauggauaagcuccagcugaaaggcauguccuacagcaugugcaccgggaaguucaaaauagucaaggagaucgccgagacacagcacgggaccauugugauacgcgugcaguaugagggcgacggcagucccugcaaaaucccauucgagaucauggaccuggagaaacgucacguccuuggacgccugauuacggugaacccgaucguuaccgaaaaagauucacccgucaauaucgaagcugagccgcccuucggcgauuccuacauuauaaucggaguugaaccuggccaacugaaauuaaacugguucaagaagggaaguuccaucggccaaauguucgaaaccaccaugcgcggcgccaagcggauggcuauacugggggacacugcgugggacuucggcagccucgguggggucuucaccuccaucgggaaggcgcuccaccaggucuuuggcgccaucuacggcgccgcguucucgggggugucuuggaccaugaaaauccugaucggcgugaucauaaccuggauaggaaugaacucccggaguacgucucuguccguaucccuggugcucguaggcaucaucacucucuaccuaggggcgaugguccaggccgacucgggcuguguugugaguuggaaaaauaaggagcuaaagugcggcucagggaucuucauuaccgauaauguccacaccuggacggagcaguauaaguuccaacccgagagucccucaaaacuagcaucagccauccagaaggcgcacgaagagggaauauguggaauacggagcgugacuaggcucgaaaaccucauguggaagcaaauaacccccgagcugaaccacauccugucagaaaaugaggugaaguugaccaucaugacuggcgacaucaaggggaucaugcaggccgguaaacggagccucagaccacagcccaccgagcugaaguacuccuggaaaaccugggguaaggcgaaaaugcucuccacggagucccacaaccagacuuuucugauugacggacccgagaccgccgaauguccgaacaccaaucgggccuggaacucgcuggaggucgaggacuacgguuucgggguuuucaccacgaauaucuggcucaaacuuagagaaaagcaggauguauucugcgacagcaagcugaugagcgcggccaucaaggacaaccgugcuguccacgccgacauggguuacuggauagaguccgccuugaacgauaccuggaagauggagaaggcgagcuucauugaagugaaguccugccacuggccgaagagucacacccuguggaguaauggcguacuggagagcgagaugaucauccccaaguccuucgccgggcccgugagccagcauaacuaccgcccuggcuacuacacccaaaccgcaggucccuggcaucuagggaagcuggagauggacuuugauuucugcgaggggacgacgguggucgucaccgaagauugcggcaaccgcggacccucacugcguaccacgacggccuccgggaaauuaauuaccgaguggugcugcagaagcugcacccugcccccgcugcgcuaccggggcgaagacgggugcugguacggcauggagauccggccccucaaagagaaggaggagaaccuggugaauucucuagugacugcuggccauggacagaucgacaauuucagccucggcguccugggaauggcucuguuccucgaagagauguugaggacaagagugggcaccaagcacgccaucuuauuggugaccgucuccuucgugacucuuauaaccgggaacauguccuuccgggaccuaggucguguuaugguuauggugggggccgccaugaccgacgacaucgguaugggcguaaccuaccucgcucugcuggcggccuucaagguccguccuacguucgccgccggguugcuccugcgcaaacucacgaguaaggagcucaugauggcgacaaucgguaucgcccugcucagccaguccaccauccccgaaacaauucuggagcugaccgacgcccucgcucugggaaugaugguucucaagaucguacgaaacauggagaaauaccagcuagccgucacaaucauggcaauuagcugcgugccgaacgccguaauacugcagaacgcuuggaaggucucgugcacgauccuggccgcgguuucggucuucccccuccugcucacguccagccaacaaaaagccgacuggaucccgcucgcacuaaccaucaagggcuuaaaccccacagccaucuuccuaaccacgcuaucacggaccagcaagaagaggagcuggccucugaacgaggccauuauggcggugggcauggugaguauucucgcgucgagccugcugaagaacgacauacccaugacugggccacuugucgccggcgggcugcugaccguaugcuaugugcucacgggucguucggccgaccuugagcuugagagggcuacugaugugaagugggaggaccaggcggagaucuccgggagcucucccauccucucaauuaccaucgccgaggauggcuccauguccaucaagaaugaggaggaggaacagacucugacgauccugauccgaacaggccuauuaguaauuuccggccuguuccccgugagcauccccaucaccgcggccgccugguaccucugggaggucaaaaagcagcgggcgggcguacugugggaugugcccaguccgccuccaguggggaaggccgagcuggaagacggcgcuuaccggaucaagcaaaaagggauccucggcuacucgcaaaucggggccgggguguacaaagagggcaccuuccacacaauguggcacgucacgcgaggggcggugcucaugcaucggggcaaacggauagagcccuccugggcggacguaaagaaggaccugauaucauacgggggcggcuggaagcuggagggagaguggaaggagggcgaggaggugcagguccucgcucuggagcccggaaaaaaccccagagccguccagaccaagcccggacucuucaaaacuaacaccgggacgauuggggccguauccuuagauuucagucccggcaccagugggagccccaucguugaucgcaagggcaaaguugucgggcuguacggcaacggggucgugacccgguccggugcauaugugucggccaucgcccagaccgagaaguccaucgaggacaacccugagaucgaggacgacaucuuccgcaagaagagauuaacgaucauggaccuucaccccggcgcgggcaagaccaagcgcuacuuacccgcaauaguccgggaagcgaucaagcgcggccuucggacucucauauuagcacccacacgcguggucgccgccgagauggaggaggcccugcgcgggcuucccauacgcuaccaaacgcccgcgauccgcgccgagcacaccgggcgcgagaucgucgaccugaugugccaugccaccuucaccaugagacuguugagccccguacggguuccgaauuacaacuugaucaucauggaugaggcccacuucacagaccccgccagcauagcggcccggggcuacaucaguacccgugucgagaugggcgaggccgccggcauauucaugacugccacgccgccuggaagccgcgacccauucccacaauccaacgccccgauaauggacgaggagcgugagauacccgagcgcagcuggaacagcggccacgagugggugacugacuucaaagguaagaccguaugguucguccccagcaucaaggccggcaacgacaucgccgccugucugcgcaagaauggcaagaaagugauccaauugucgcgcaaaacauuugacagcgaguacgugaagacgcggacgaaugacugggacuucgucguaaccacggacauauccgagaugggggcgaacuucaaagcggagcgcgugaucgacccccgccgcuguaugaaaccggucaucuuaaccgacggugaggaacgggucauccuagcagggcccaugccggugacccacuccuccgccgcucagaggagggggcgcauagggcgcaacccuaagaacgagaaugaccaauacauauauaugggcgaaccccucgagaacgaugaagacugcgcgcacuggaaggaggccaagaugcugcuggauaacaucaacacucccgaaggcauuaucccuagcauguucgagccggaaagggagaagguugacgccaucgacggggaguaccgccuccggggagaggcccgcaagaccuucguggaucugaugcggcgcggggaucugcccguauggcuagccuacagagucgcggccgagggcaucaauuacgccgaccgccggugguguuucgacggagugaagaacaaucagauccuggaggagaacguggagguagagaucuggacaaaggaaggcgaacgcaagaaacuaaagccacgguggcucgacgcacgcaucuacuccgacccccuggcccugaaggaguuuaaggaauuugcugccggccguaagucccucacucugaaccuaaucacugagauggggcgucuaccuaccuucaugacccagaaggcccgggaugcacuggacaaucuagcaguacuccauacagccgaggccggcggucgugccuauaaccacgcccuguccgagcugcccgagacgcuggagaccuugcuucugcugacgcugcuugcgacgguaacuggcggcaucuuucuuuuccugaugucuggaaagggugucgggaaaaugacccugggcaugugcugcaucauuaccgccucgauccugcuaugguacgcccagauucaaccgcacuggauugccgcuucgaucauccuggaguucuuuuuaaucgugcuucucaucccugagcccgagaagcagcggacgccccaagacaaccagcugacuuacguggugauugcuauccugacuguggucgccgccaccauggcgaacgagaugggguuccucgagaagacaaaaaaggaucugggucucggcuccauugccacucaggagcccgaaagcaacauccucgauaucgaccugcgcccugcgagcgccuggacccuuuacgccguggccacaaccuucgugacgcccaugcuacggcacuccauugagaacagcuccgucaaugugucacugacugcgaucgccaaccaggccaccgugcugaugggucucggaaaggguuggcccuuguccaagauggauaucggcgucccccugcucgccaucgggugcuacagccaagugaaccccaucacccucacagccgcgcugcuucuguugguugcucacuacgccaucaucggcccuggacuccaagcaaaggccaccagggaggcgcagaagcgugccgccgccgggaucaugaaaaaccccaccgucgacggcaucaccgugaucgaccuagacccgauccccuacgaucccaaguucgagaagcaguugggucaggucaugcuccugauccugugugucacccagguguugaugaugcgcaccaccugggcacugugcgaggcgcugacccucgccacgggccccaucucaacuuugugggaagguaacccuggccgcuucuggaacacuaccaucgccgucucgauggcgaacaucuuucgggguagcuaucuagcgggggcaggucucuuguuuagcaucaugaagaacacgaccaacaccagacgugggaccgggaacaucggcgagacgcugggcgagaaguggaaaucccgcuugaaugcccugggcaagagugaguuccagaucuacaagaaguccgguauccaggaggucgaccggacccuagcgaaggagggcauuaagagaggggagacggaucaccacgccguaucgcguggguccgcgaagcuucgcugguuuguggagcggaacauggucacucccgagggaaaggucguagaccuggggugcggccgcgggggguggucuuacuacugugggggccucaagaacguccgggaggucaagggguugacuaagggcggccccggccacgaggaaccgauaccgaugucgacuuacggauggaaccuggugcgccugcaaagcggcguagacguguucuucacgccgcccgaaaagugcgacacccuccuuugugacauuggcgagucgucacccaauccgacaauagaagccggccggacccugcguguucucagccugguggaaaauuggcuaaacaacgacacccaguuuugcaucaagguguuaaaucccuacaugcccuccgucauugagaaaauggaaacccugcagcguaaguaugggggagcccuagucaggaauccgcugagccggaacuccacccacgagauguauugggugagcaacgccacggggaacauuguaucgagcguaaacaugauaagucgcauguuaauaaaucgguucacaaugaagcacaagaaggccaccuacgagcccgauguagacuugggcucgggcacccggaacaucggaaucgaguccgagauccccaaccuggacaucauugguaagcggauagagaagaucaagcaagagcaugagacgucguggcacuacgaccaggaccauccguacaagacaugggcguaccacgggucauacgaaacgaagcagaccggcagcgccuccaguaugguuaacggagucguccggcuccugacgaaaccgugggacguaguaccgaugguuacccagauggcuaugacagauacuacgccguucggccagcagagaguguucaaggaaaagguugauacccggacacaggagccgaaagagggcaccaagaaacuaaugaagauaacagcggaguggcucuggaaagaauuggggaaaaagaagaccccucgcaugugcacccgggaggaauucacucgcaaaguuagguccaaugccgcauuaggcgcaaucuucacggacgaaaacaaauggaagagugcccgcgaggcaguggaagauucccgauuuugggaauuagucgacaaagagcgcaacuuacaccuggaggggaaaugcgagacuugcguuuacaacaugaugggcaaacgggagaagaagcuaggggaauuuggcaaggcgaagggcucacgagccaucugguacaugugguuaggugcgcgguuccuggaguucgaggcucuaggcuuccugaacgaggaccauugguucucccgcgagaacucucugagcgggguggagggugaagggcuccacaagcuuggcuacaucuugcgggacgucucuaagaaggagggaggggccauguacgcggacgacaccgcagggugggauacacgcaucacgcucgaggaccugaagaacgaggaaauggugacaaaccauauggagggugagcacaagaagcuggccgaggcaaucuucaagcucaccuaucagaacaaggucgugaggguacaacgcccgacgcccagaggaacaguuauggacaucauuucgcgcagggaccaaaggggcuccggacagguugggaccuacgguuuaaauaccuucaccaacauggaggcccagcuaauccgacaaauggagggcgaggggauauuuaagaguauccagcacuuaacuguaaccgaggagaucgcaguccagaacuggcuggcucgaguaggaagggagagguuaucccggauggcgauuucgggggaugacugcguagucaagccacucgacgaucgguucgcuucggcccugacagcucugaacgacauggggaaggugagaaaagacauucaacagugggaaccuagccgggguuggaacgacuggacccaggugcccuucugcucccaccacuuccacgaacugauaaugaaggacgggcgggucuuggugguaccuugccggaaccaagacgagcuuaucggucgcgcccggaucagccagggggccggauggucacucaaggagacagcuugccugggaaagagcuacgcucaaauguggaguuugauguacuuucaccgucgggacuugcgccuggcggcuaacgcgaucugcagcgcgguccccagccacuggguaccgacaagccgaaccacuugguccauccaugcuaagcacgaguggaugacgacggaagacaugcugacaguguggaaccggguuuggauccaggagaaccccuggauggaagacaagacuccgguggagucgugggaggaggugccguaccucggcaagcgcgaagaccaauggugcggcagccugauuggacugaccagucgugccacuugggcuaagaacauccaaacggccauaaaccagguaagaagcuugaucggcaacgaggaauacaccgacuacaugccguccaugaagcgcuuccgccgggaagaggaggaagccggggugcucugguaa

SEQ ID NO: 25459 - RNA, 9876 nt, Artificial Sequence
  derived and/or modified CDS sequence (opt11) from DENV-2__FM210244__SS-prME
accgccggcgugaucaucaugcugauacccacugcuauggcauuccaccucaccacgcgcaauggggagccucacaugaucgucggccgccaggaaaaaggcaagagccugcuauucaaaaccgaagacggcgucaacaugugcacccucauggcgaucgaccugggugagcugugcgaggacaccaucaccuacaagugcccccuccugcgccagaaugagcccgaggauaucgauuguuggugcaacaguacuagcaccugggugaccuacgggaccugcacgaccaccggcgagcaccgccgcgagaagcgguccguugccuuagucccccacgugggcauggggcucgagacccgcacggagaccuggaugaguuccgaaggggccuggaagcaugcccagcggaucgaaaccuggaucuuacgccauccgggcuucaccaucauggcggccauccuggcuuacaccgucgggaccacccauuuucagcgggcacucaucuucauccuccuggcggccguggcgcccagcaugaccaugcgcugcauuggcaucucuaaccgggacuucguggagggcguuagcggcggcuccuggguggacaucgugcucgagcacgggagcugcgucaccaccauggccaagaacaagcccacucuggacuucgaguugauuaagaccgaagcgaagcagcccgcaacucuacgcaaguacuguaucgaggccaaguuaaccaacacgacgaccgagucccggugcccgacccagggugaacccagccugaaugaagagcaggacaagcgcuucgugugcaagcacuccaugguagaccggggcuggggcaacgggugugggcuguucggcaagggcgguauugucacgugcgccauguucacgugcaagaagaacauggagggcaagaucgugcagcccgaaaauuuggaguauaccaucgugaucacgccccacagcggggaagagcacgccgucggcaaugauacggguaaacacggcaaggagauuaaaaucaccccgcagucccccaucaccgaggccgagcugaccggguauggcaccgugacgauggagugcagccccaggaccggccucgacuucaacgagauggugcugcuccagauggaagacaaggcauggcuugugcaccggcagugguuccuggaccuuccccucccgugguuaccgggcgccgacacucagggcucuaauuggauacaaaaggagacacuagucacguucaagaacccccacgcuaagaagcaggacguggucgugcucgggagccaagagggcgccaugcacaccgcccugaccggggcgacagagauccagauguccuccggcaaccucuuguucacgggacaccugaagugcagacugcggauggacaagcuccagcugaaggggaugagcuacuccauguguaccggcaaguucaagauugucaaggaaaucgccgagacccagcacgguaccaucgugauccgcguccaauacgagggcgacgguagccccuguaagauuccguucgagauaauggaucuggaaaagaggcacguuuuggggcgccuaaucacugugaacccuaucguuacagagaaggacucccccgucaacaucgaggcggagcccccguucggcgacagcuacauaaucaucgggguggagccgggccagcugaaguuaaacugguucaaaaaggggucaagcaucggccagauguucgagaccaccaugcguggugccaaacgcauggccauccugggcgacacggcgugggacuucggcucccucggcgggguguucaccaguauugggaaggcccuccaccaggucuucggugccaucuauggugccgcauucucuggggugagcuggaccaugaagauccugaucggcgugauuaucaccuggauagggaugaacagucgcagcacgucgcucucuguaucccuggugcuagugggcgugaucacccuguaccugggggccaugguacaggccgacucuggcuguguagucuccuggaagaacaaggaguugaaauguggaagcgggaucuuuaucacggacaacgugcacacauggacagaacaauacaaguuucagcccgaguccccgagcaaacuggccagcgccauccaaaaggcacacgaagaaggcaucugugggauucgcuccgugacccgccuggagaaccucauguggaaacaaauaaccccggagcugaaccacauccucagcgagaacgagguaaaguuaaccaucaugaccggcgacaucaaggggauaaugcaggccggcaagcggucgcuccgcccacagcccaccgagcugaaguacagcuggaagaccuggggcaaggcaaagaugcucuccaccgagucccacaaccagacguuccuaaucgacgguccggagaccgccgagugcccaaacaccaaccgagccuggaacagccuggagguggaggacuacggauucgggguguucaccacgaacaucuggcucaagcugcgcgagaagcaggacgucuucugugacagcaagcugauguccgcggccauuaaggacaaccgggccgugcacgccgacaugggcuacuggaucgagagcgcccugaacgauaccuggaagauggagaaggcguccuucauagaggucaagagcugucacuggcccaagucccacacacuguggagcaacggcgugcuggaguccgagaugaucauaccuaagaguuuugcugggccggugucccagcauaauuaccgcccaggcuacuacacucagacugcagggcccuggcaccuaggaaaacuggagauggauuucgauuucugcgaggggacgacggucguaguuaccgaggacugcggcaaccggggccccagccugcgcacgacgacagccagcggaaagcucaucaccgaauggugcuguagaucuugcacccugccgccccugcgcuaccggggcgaggaugggugcugguacgguauggagauacgcccgcucaaggagaaagaagagaaccuggugaacagccuagucacggcggggcauggucagaucgacaacuucagccucggcgugcucgggauggcccuguuccuagaggagaugcugcggacucgcgugggcaccaagcacgccauccuguuggucgccgugagcuucgugacguugaucacgggcaauaugucauuucgggaccugggccgcgucauggucauggugggggccgcuaugaccgacgacauuggcaucggcgucaccuaucucgcccugcucgccgccuucaaggugcgccccacauucgccgcgggcuugcuguuacggaagcucacgagcaaagaauugaugauggcgacuaucggcaucgcccuucucagucagagcacgaucccggagaccauacuggagcugacggacgcccucgcccuggggaugauggugcugaagaucguccgcaacauggagaaguaccaauuggcggugacaaucauggccaucuccugcgucccuaacgcggucauccugcagaacgccuggaaggugagcugcaccauccuggccacaguguccgucucuccccuccugcucacgaguagccagcagaaggccgacuggauaccccucgcccugaccaucaagggccugaacccgaccgcaaucuuccucacaacgcugucacggaccuccaaaaagcgauccuggccccugaaugaggccaucauggcggugggcauggugagcauccucgccuccagccugcuuaagaacgacauccccaugaccggccccuugguggccggcggucugcugaccgugugcuacguccucacuggccggagcgccgaccuggagcuggagcgcgccaccgaugugaagugggaggaccaagcggagaucuccgggagcucuccuauucugucgaucaccaucgccgaggacggcuccaugagcaucaagaacgaagaagaggaacagacccugacgauccugauccguaccgggcucuuggugaucuccggacuguuccccgucagcaucccuauuaccgcagccgccugguaccucugggaggugaagaagcagcgugcgggcgugcugugggacguucccuccccgccgcccguggggaaggccgagcuggaggacggcgcuuaccggaucaagcagaaggggauuuugggguacagccagaucggcgccgggguauacaaggaaggcaccuuucacacuauguggcacgucacgagaggagccguccugaugcacaggggcaagcgcaucgagccguccugggcggaugugaagaaggaccugaucagcuacggcggcggcuggaagcucgagggggaguggaaggagggcgaggaaguccaagugcuggcgcucgagcccgggaagaacccgcgggccgugcagaccaagccugggcucuucaagacuaauacuggaacgauuggcgccgucucccucgacuucagcccgggcaccagcgggagccccaucguggaccgcaagggcaagguggucggccuauacggcaacggcguggugacccgguccggggccuacgucagcgccauugcccagacugagaaguccaucgaggacaacccugagaucgaagacgauauuuuccgcaagaagagguugacgaucauggaccuccaccccggcgcaggaaagaccaaaagauaccugccggccaucguccgugaggcgaucaagcgcgggcugcggaccuuaauucuggcccccaccagaguggucgccgcggagauggaggaggcccugcgcgggcuccccauucgguaccagacgcccgcgauccgcgccgagcacaccggccgugaaaucguggaccugaugugccaugcuaccuucaccaugcgccugcugagcccggugcguguccccaacuauaaccugaucaucauggacgaggcccacuucacggaccccgccagcaucgcggcccgcggcuacauauccacccggguagagaugggugaggccgccggcauauucaugaccgcgacgccgcccgggucgaaagaccccuucccccaguccaacgcccccaucauggacgaagagcgcgagauccccgagcggagcuggaacuccggccaugagugggugacggauuucaaagggaagaccgucugguucgugcccucgauaaaggccggcaacgacaucgccgcaugucugcggaaaaacggcaagaaagucauccagcugucccggaagaccuuugacagcgaguacgucaagacgcgcacgaaugauugggacuucgugguaaccaccgacaucucugagaugggggccaacuucaaggcggagcggguuaucgacccccgccgaugcaugaagcccgugauacugaccgacggcgaagagcgcgucauccuagcugggccgaugcccgucacucacagcuccgccgcccagcggcgcggccggaucgggcgcaaccccaagaacgagaaugaccaguacauauauaugggcgagccccucgagaacgacgaggacugcgcgcauuggaaggaagcuaaaaugcugcuggacaauaucaacacccccgagggcauaauccccagcauguucgaacccgaacgcgagaagguggaugccaucgacggggaguaccggcucaggggugaggcccggaaaaccuucguagaccuuaugcgccgcggggacuuaccggucuggcucgcuuaccgcgucgcggccgagggcaucaacuaugcggacaggcgcuggugcuucgacggggugaagaauaaccaaauauuagaggagaacguagagguggagaucuggaccaaggagggcgagcggaagaagcuaaagccccgcuggcucgacgcgcggaucuauagugauccccucgcccugaaggaguucaaggaguucgccgccgguagaaagagccugacucugaaccugaucaccgagauggggcggcucccaaccuucaugacccagaaggcgcgagacgcacuggacaaccuggcggugcugcacacggcagaggccggggggaaggcguauaaccacgcccuguccgagcugccggagaccuuggagacucuguuguugcugacccugcucgcgacagucacuggcggcaucuuucuguuccugaugagcgggaaaggcguggggaagaugacccucggcaugugcugcaucaucacggccucaauccugcuguggcacgcccagauccagccacacuggaucgcugccaguaucauccucgaguucuuucugaucguccuguugaucccggagccagagaaacagcggaccccgcaggacaaccagcugacguacguggugaucgcaauucugacagucguggccgccaccauggccaacgagaugggguuccucgagaagaccaagaaggaccugggucugggcucaaucgccacgcaggagcccgagagcaacauccucgacaucgaccugcgccccgcgagcgccuggacccucuacgcuguggccaccaccuucgucacgccgauguuacgacacuccaucgagaacagcuccgugaacgucagccucacagcgaucgccaaccaggccaccguccugauggggcucggcaagggguggccgcuguccaagauggacaucggagugccccugcucgccaucgguuguuacagccaggugaauccgaucacgcugacugccgcgcugcuccugcucgucgcccacuacgccaucaucggucccggccuccaggccaaagccacaagagaggcgcagaaacgggccgccgccgggaucaugaagaacccgaccguagacggcaucaccgugaucgaccuagaucccauccccuaugaccccaaauucgagaagcagcuagggcaggucaugcuccugauccugugcgugacccagguccucaugaugcgcaccacuugggcccugugcgaggcgcugacccucgccacgggcccgaucuccacccugugggaggggaaccccggacgguucuggaacaccacaauagccgucagcauggcgaacaucuuucgcggcaguuacuuagcgggggcgggcuuacuguucagcauuaugaagaacacaaccaacaccagacggggcaccggcaacaucggcgagacgcugggggagaaguggaagucccgcuugaacgcccugggcaagagcgaguuccagaucuacaagaaguccgggauccaggaagucgaucguacccuugccaaggagggcaucaaacggggggagaccgaccaccaugccgucucuagaggcuccgcgaagcuccgcugguucguggaacggaacauggucacccccgaaggcaagguagucgaccuagguugcggcagagggggcuggagcuacuacugcgggggccugaagaacgugcgggagguuaagggccucaccaagggcggcccagggcacgaggagccgauccccauguccacuuacggcuggaaccugguccgccugcagagcggcguggacguguucuucacgccgcccgaaaaaugugacacccuccugugcgacaucggcgaguccagcccgaaccccacgaucgaggcgggccgaacucugaggguacucagccugguggagaacuggcugaacaacgacacacaguucugcaucaagguucucaaccccuauaugccgagcguaaucgagaaaauggagacgcugcagcgaaaguacgggggcgcccugguacgcaacccccugucuaggaacucgacccacgaaauguauuggguaagcaacgccaccgggaauaucgucucgagcgugaauaugaucucccgcauguugauuaacagguucaccaugaagcacaagaaagccaccuacgaacccgacgucgaucugggcagcgggacccgcaauaucgggaucgaguccgagaugcccaaucuggacaucauuggcaagcguauagagaagaucaagcaggagcacgagacaucguggcacuaugaccaggaccacccauacaagaccugggcauaccauggcuccuacgagaccaaacagaccggcagugccaguagcauggucaacgggguggugcgccuccugacgaagcccugggacgucguucccauggugacccagauggccaugaccgacaccacuccguucggccagcagcgugucuucaaggaaaaaguagauacucggacccaggagccgaaggagggcaccaagaagcugaugaagaucacggcagaguggcucuggaaggaguuggggaagaaaaagacgccccguaugugcacccgggaggaguuuacccgcaaggugcguuccaacgcugcccugggggccauauucacggacgagaacaaguggaagucggcccgcgaggccgucgaggacagccgguucugggagcuuguggacaaggagcgcaaucugcaccuggagggaaagugcgagaccugcguguacaacaugaugggcaagcgggaaaagaaguuaggcgaguucggcaaagcgaagggcagccgcgccauuugguacauguggcugggugcccgguuucuggaguucgaggcccucggauuccugaaugaggaucacugguucucccgcgaaaacagccuuagcggggucgaaggggaagggcuccacaagcugggguacauccugcgggacguauccaaaaaggagggcggggcgauguacgcggacgacacugccggcugggacacccgcauuacgcucgaagaccuuaagaaugaggagaugguuacaaaccacauggaaggggagcacaagaaacuugccgaggccaucuucaagcuuaccuaccagaacaagguggugcggguccagcgccccacuccccggggcacggugauggacauuauaucacgccgggaccagagaggguccggccaggugggcaccuacgggcugaacaccuucaccaauauggaggcccagcugauccggcaaauggagggcgagggaaucuucaagagcauccagcaccuuacggucaccgaggaaaucgcggugcagaacuggcuggcccgcgugggccgcgagcggcugucccgcauggcuaucagcggggacgacugcguuguaaagccgcucgacgaccgguucgccuccgcccugacagcgcugaacgacauggguaagguucgcaaggacauccagcagugggagcccagucggggguggaacgacuggacccaggucccauucugcucgcaucacuuccaugagcucaucaugaaggacgggcgcgugcuuguggucccaugucggaaccaggacgagcugauuggccgagcucggaucagccagggggccggcuggucccucaaggagacggccuguuuaggcaaaagcuaugcccagauguggucacugauguacuuccaccgucgggaucuccgccuggcggccaacgccaucugcagcgccguaccgucacauugggugcccaccagcagaaccaccugguccauccacgcgaaacacgaguggaugacuacggaggacaugcugaccgucuggaaccgcguguggauccaagagaaccccuggauggaggacaagacccccguggagagcugggaggaggucccguaccuugggaagcgggaggaccaguggugcggcagccugaucggguugacuucuagggccacgugggccaaaaauauacaaaccgccaucaaccaggugcgaagccucaucggcaacgaggaauacaccgacuacaugcccuccaugaagcgcuuccggcgcgaggaagaagaggccgggguacugugguga

SEQ ID NO: 25460 - RNA, 9876 nt, Artificial Sequence
  derived and/or modified CDS sequence (opt11) from DENV-2__FM210234__SS-prME
accgccggaguaaucaucaugcugauccccaccgccauggcguuccaccucacgacccggaauggugagccccacaugauugucgggcggcaggagaagggcaagagcuugcuguucaagaccgaggacggggugaacaugugcacucucauggccaucgaccugggggagcugugcgaggauacgaucaccuauaagugccccuugcugcggcagaacgagccugaggauaucgacugcuggugcaacagcacgagcacuugggugacguacgggacgugcacaaccacgggcgaacaccgccgcgagaaacgguccgucgcccucgucccccauguggggauggggcucgaaacccgcaccgagaccuggaugagcuccgagggggccuggaaacacgcgcagcggauagagacauggaucuugaggcacccaggauucaccaucauggcggcuauccuggccuacacugucgggacuacccacuuccagcgggcgcucauuuucauccugcuggcggccguggcccccagcaugaccaugcgcuguauaggaaucuccaaccgggacuucguagagggggucagcgggggcuccuggguggauaucgugcucgagcacgggagcugcgucaccacuauggccaagaacaagcccacgcucgacuucgagcugaucaagacggaggccaagcagcccgccacccuccgcaaauauugcaucgaagccaagcugacgaauacgaccacugagucccgguguccgacacagggcgagccaagccugaacgaggagcaggacaagcgcuucgucuguaagcacuccaugguagaccggggcugggggaauggaugcggccuguuuggaaagggcgggaucgucacgugcgccauguucacgugcaagaagaacauggaaggcaagaucgugcagcccgaaaaccuggaguacaccaucgugaucacaccccacagcggggaagaacaugcagucggcaacgauacgggaaagcacggcaaggagauaaagaucaccccgcagucccccauaaccgaggccgagcugaccggcuacggcacagugacgauggaaugcagcccucgcacuggccucgauuucaacgagaugguacuacugcagauggaggacaaagccuggcucguccaccggcagugguuucuggaccugccccugccguggcuccccggggccgacacccagggcuccaacuggauccagaaggagacgcuggucacguucaagaacccccacgccaagaagcaggauguggucgugcucgguagccaggagggcgcaaugcacaccgcucuaacaggggccaccgaaauccagauguccagcggcaaccuccucuuuacgggccaccugaagugcaggcugcggauggacaagcugcagcugaaggggaugucguacuccaugugcaccggcaaguucaagauagucaaagagauagccgagacccagcacgggacaaucguaauccgcgugcaguacgagggcgacggcucgcccugcaagauaccguuugaaaucauggaccuggagaagcgucacguccucgggcgccugaucacggugaaccccaucgugaccgguaaagacucccccgucaacauagaggccgaaccaccguucggggacagcuauaucauaaucggcguggagccggggcagcugaagcucaacugguucaagaaaggcuccucaauuggccagauguuugagaccaccaugagaggggccaagcgcauggcgauuuugggcgacacggcgugggacuucgggucucugggaggggucuucaccagcaucggcaaggcacuacaccagguauuuggcgccaucuacggagccgcguucuccggcguguccuggaccaugaagaucuuaaucggaguaaucaucaccuggaucggcaugaacuccaggagcacgucccugagcgucagucuggugcucgugggaguuaucacucuguaccugggugccauggugcaggccgacuccggaugcgugguguccuggaaaaacaaggaguuaaagugcggguccggcaucuuuaucaccgacaacgugcacaccuggacggagcaguacaaguuccaaccugagagucccagcaagcuagcuagcgcgauccagaaggcgcacgaggaggggauuugcggcauccggagcgugacccgccuagagaaucucauguggaagcaaaucaccccagagcugaaccacauacugagcgagaacgaggucaagcucacuaucaugacgggcgacaucaagggcaucaugcaggccggcaaacggucgcugcgcccccaacccaccgagcucaaguacagcuggaagaccugggggaaggccaagauguuauccaccgaaagccacaaccagacguuccucauugacggcccggagacggcggagugccccaacaccaaccgggcuuggaacucccuggaggucgaagacuacggguuuggcguuuucacgacgaacaucuggcucaagcuacgagagaagcaggacguguuuugugauagcaaguuaauguccgcggcgaucaaggacaacagggccgugcacgcagacauggguuacuggauugagagcgcccucaacgacaccuggaagauggagaaggcguccuucaucgaggugaaaagcugucacuggccgaagucccacacccuguggaguaacggggugcuggagagcgagaugauaaucccuaaaaguuucgcgggcccggugucccagcacaauuaccgcccgggguacuacacccagaccgccgguccuuggcaccucgggaagcucgagauggacuucgacuucugcgagggcacgaccguagucgugaccgaggacugcggcaaccgggggcccagccugcgcaccaccacagccagcggcaagcucaucaccgaguggugcugccgguccugcacuuuaccgccccugcgcuacagaggggaagacggcugcugguaugguauggagauucgccccuugaaagaaaaagaggagaaccuggugaacucucuggucacagcuggccacggccagaucgacaacuuuagccucgggguccugggcaucgcccuuuuccucgaggagaugcugaggacgcgcguagggaccaagcacgccauacuguuagucgccgugagcuucgucacuuugaucacuggcaacauguccuuucgcgaccuggggcgcguaauggugauggugggcgccgcaaugacggacgacaucgggaugggagucacguacuuagcccugcuggcugccuucaaggugcgccccaccuucgcagcgggccucuugcugaggaagcucacaucuaaagagcugaugauggcaaccauugggauugcgcuucucucccaaagcaccauaccagagaccauacuggagcugacugacgcccuggcccucggcaugauggugcuaaagauaguccgcaacauggagaaguaccaacucgcggugacuauuauggccaucuccugcgugcccaacgcggucauccuccagaacgcuuggaaagugagcuguacaaucuuggccacagucuccgucagcccccuccuacugacguccagccagcagaaggccgauuggauuccccucgcccugaccauuaagggccugaacccgacggcaauuuucuugaccacccuguccagaaccucaaagaaaagguccuggccccugaacgaggcuauaauggcggugggcaugguaucuauccucgccuccagccuacugaaaaacgacauccccaugaccggcccccucguugcagggggccugcugaccguguguuacguccucacggggcguagcgcagaccuagagcuggagcgcgccaccgacgugaagugggaggaucaagcggagaucucaggauccuccccgauccucagcauuaccaucgccgaagacggcuccaugagcaucaaaaacgaggaggaggagcagacucucacgaucuuaauccggacuggccuccuggugauauccggacuguuucccgucagcauccccaucacggcugccgcgugguaccucugggaggugaagaaacagcgagcgggugugcugugggacguacccuccccuccaccugugggaaaggccgagcuugaagacggggcauaccggaucaaacaaaaaggcaucuugggcuacucccagaucggggccggaguauauaaggaggggaccuuccacaccauguggcacgugacccgaggcgccgugcugaugcaccggggcaagcgcaucgagccgaguugggcagacgugaagaaggaccugaucucguacggaggcggcuggaaacucgagggugaguggaaggagggggaggagguccagguguuggccuuagaacccggcaaaaacccucgggccgugcagaccaaacccggucuguucaagacaaacaccggcacgaucggagccgucucccuggacuucagcccggggaccuccggcucacccaucguugaccgcaagggaaaggugguaggccuguacggcaacgggguuguaacccgaucuggcgcguacgucagcgcgauagcccagaccgaaaaguccaucgaggauaacccagaaaucgaggacgacauauuucgcaagaagcggcucacgaucauggaccuacacccgggggccggcaagaccaagcgcuaccugccggcgauagugagagaagcgaucaagagaggucugagaacccucauucuggcccccacccgcguggucgccgcggagauggaggaggcacugcgcggccuucccauccguuaucaaacucccgcuaucagggcugagcacaccggccgggagaucguggaccugaugugccacgcaaccuucaccaugcgccuauuaucgccggugcgggucccaaauuauaaccugaucauaauggacgaggcccacuucacagacccugccagcaucgcggcccgcggguacaucuccacccggguggagaugggcgaggccgccgggaucuucaugaccgccacgccucccggcagccgagaucccuucccccaauccaacgcccccaucauggacgaggagcgggagauccccgagcgcagcuggaacucaggacacgagugggugacggauuucaagggcaaaacagucugguucguccccucaaucaaggccggcaaugacauugccgccugccugcggaagaacgggaagaagguaauccaacugucccgcaagaccuucgauagcgaguacguuaaaacccggacgaaugauugggacuucgucgucaccaccgauaucuccgagaugggugccaacuuuaaggccgagcgagucaucgaccccagacgcugcaugaagcccgugauccugacggacggcgaggagagggugauauuggccggaccgaugccgguuacgcacagcagcgcagcgcagcgcagggggaggauaggccgcaaccccaagaacgagaacgaucaguacaucuacaugggcgagccgcucgagaacgacgaggacugcgcgcacuggaaggaggcgaagaugcuguuagacaacaucaacacuccggaggggauuaucccauccauguucgagccggagcgggaaaaggucgacgccauagacggcgaguacaggcuucgcggggaggcccgcaaaaccuucgucgaccugaugcggcgcggcgaccugccugucugguuagcuuaccggguggccgccgaggggaucaacuacgcugaccgccgguggugcuucgacggcguuaaaaacaaccagauuuuagaggagaacgucgagguggagauuuggaccaaagagggugagcgcaagaaacugaagccccgguggcuggacgcacgaaucuacuccgacccccuggcauugaaagaguucaaggaguucgccgccgggcgaaagucacucacgcugaacuugaucaccgagauggggaggcucccuacuuucaugacccaaaaggcacgggacgcccuggacaaucuggcggugcuccauacggccgaggccgggggccgugcguacaaccacgcccuuuccgagcugccggaaacccuggagacccugcugcuguuaacccugcucgcuacggucaccggcgggauauuccucuuccugaugagcggcaagggggugggcaagaugacccucgggaugugcugcaucaucaccgccucuauccugcuguggcacgcacagauccagccacacuggaucgcggcaagcaucauccucgaguuuuuccugaucguacuauugaucccugagcccgagaagcagcggaccccgcaggacaaccagcugacguacgugguaaucgccauucugaccgucguggcugcaaccauggcaaacgaaaugggcuuccucgagaagaccaagaaggaucugggccucgggucgauugccacucaagagcccgagagcaacauacucgacaucgaccuacgccccgcgagcgccuggacacucuacgccguggcgaccaccuucgucacuccaaugcuccggcauucgauagagaacagcuccgugaacgugucccugaccgcgaucgccaaucaggcuacaguccugaugggccucgggaagggauggccccuguccaagauggacaucggggucccccugcucgccaucggaugcuacagccagguuaaccccaucacucuuacggccgcgcuacuccuauuagucgcccauuacgccaucaucggccccgggcugcaagcuaaggcaacccgcgaggcccagaaacgggcagccgccgguaucaugaagaaccccacaguggacggcauaaccgugauugaccuggaccccauccccuacgacccaaaguucgaaaagcaacuggggcagguaaugcuccugauuuuaugcguuacucaggugcugaugaugcgcaccaccugggcccuaugugaagcgcugacccucgccacggggccgaucuccaccuugugggagggcaaccccggacgcuucuggaacaccaccauagccguuucuauggccaacaucuuucgcggauccuaccuggcgggagcggggcuccuguucagcaucaugaaaaacacgaccaauacccgccggggcacaggcaacaucggggagacgcugggcgagaaauggaagucccgucucaaugcucugggcaagagcgaguuccagaucuacaagaaaucuggcauccaggaggucgaucggacccuggccaaggaggguaucaagcgcggcgaaaccgaucaccacgccgucucacgcgggucugcgaagcuccgcugguucguugagcggaauauggugaccccggaggggaaggugguagaccucggcuguggucgcggcggcuggagcuacuacugcggcggccugaagaacguucgagaggugaaggggcucacaaagggcgggccgggccacgaggaaccgauccccauguccaccuacgguuggaaccucguccgccugcagagcggcguagacguguucuucacgcccccugagaagugcgauacccuccugugcgacauaggcgaguccagcccgaauccuacgauagaggccggccguacccugcgcguccucagccuaguggaaaacugguuaaacaaugauacccaguucugcaucaaggugcugaaccccuacaugccuucugucaucgagaagauggaaacccugcagcgcaaguacggcggggcccugguacgcaaccccuuaucacguaacaguacccaugagauguacugggugucaaacgccacgggaaauaucgucuccucgguuaacaugaucucccggaugcucaucaaccgguuuacuaugaagcacaagaaagccacguacgaacccgacguggaccugggcagcggcacccgaaacauaggcaucgaguccgagaucccaaacuuagacaucauugggaagcgcaucgagaagauuaaacaggagcaugagacgagcuggcauuaugaccaggaccacccuuacaagacuugggcguaucauggcuccuacgaaaccaaacagaccggcagcgccuccagcauggucaauggcgucguacggcucuugacgaagcccugggacgucgugcccauggugacccagauggccaugaccgacaccacgcccuucggacagcagcgcgucuuuaaggagaagguggacacucggacgcaggagcccaaggaggggaccaagaaguuaaugaagauuacggccgaguggcucuggaaggagcugggcaagaagaagacuccucggaugugcacccgggaggaguucacccgcaaggugcggaguaacgccgcucucggcgccaucuucacggacgagaacaaguggaagucggcaagagaggccguugaagauucccgguuuugggaguugguggacaaggagcggaaccugcaccuggagggaaagugcgagaccugcguguacaacaugauggggaagcgcgagaagaagcucggcgaguucggcaaggcgaaggggagccgcgccaucugguacaugugguugggugcccgguuucuggaguucgaggcacucggguuccugaacgaggaccacugguucucccgggagaacagcuuguccggcgucgagggggaaggucuccacaaacuuggauacauccugcgagacgugaguaagaaggagggcggggcgauguacgcggacgacaccgccgggugggauacccgcaucacgcucgaggaccugaagaacgaggagauggucacaaaccacauggagggcgagcacaagaagcucgccgaggcuaucuucaagcucacauaccagaacaaggugguucgaguccagcgccccacuccccgggguacggucauggacaucauuucgcgccgggaccagagaggcuccggccaaguuggcaccuauggcuuaaacaccuucaccaacauggaagcccagcugaucaggcagauggagggugaggguauauucaagagcauccaacaccucacggucaccgaggaaaucgcagugcagaacuggcuggcccgggugggccgcgagcggcucucccgcauggccauuagcggcgacgacugcgucgugaagccguuagacgaucgguuugcauccgcccuaaccgcccugaacgacaugggcaaagugcgcaaggacauacagcaaugggagcccagccggggguggaacgacuggacccaggucccguucugcucccaccauuuccacgagcucaucaugaaggacggccgcguccuagugguccccugccggaaccaagacgaacugaucggucgcgcccgaauuagccagggugcaggguggucccugaaggagacggccugccuaggaaaguccuacgcccagauguggucccugauguacuuccaucgccgggaccuccgccucgcggccaacgccaucugcagcgccgugccgagccacuggguaccuacaucgcggacgaccugguccauccacgcaaagcacgaguggaugacuacggaagauaugcugaccgucuggaaccgcguuuggauccaggagaaucccuggauggaggauaagacccccguagagagcugggaggaggucccguaccucggcaagcgggaggaccaguggugcgggucacugaucggccucaccagucgcgcuaccugggccaagaacauccagacugccaucaaccaggugcggucucucauugggaacgaggaguauaccgacuacaugccgagcaugaagcgcuuccgccgugaggaggaggaggccggcguccugugguga

SEQ ID NO: 25461 - RNA, 9876 nt, Artificial Sequence
  derived and/or modified CDS sequence (opt11) from DENV-2__FM210213__SS-prME
accgccggcgugaucaucaugcugauccccaccgccauggcguuccaccucacgaccagaaacggagaaccccacaugauuguuggccgccaggaaaagggcaagagccugcuguucaagaccgaggauggggugaacaugugcaccuugauggcaaucgaccugggggagcugugcgaggacaccaucaccuacaagugcccccuccugcgccagaacgaaccagaggacaucgacugcuggugcaacagcaccuccaccugggugaccuacgggaccugcaccaccacaggcgagcaucggcgcgaaaagaggucggucgcccuggugccccacguggggaugggccucgagacccgaacagagaccuggaugagcuccgagggggccuggaagcacgcccagcgcaucgagacauggauacugaggcacccgggcuuuaccaucauggcggccauccuggcguacaccgucgggacuacacacuuccagcgggcccuuaucuucauccugcuggcggccgucgcgccgagcaugaccaugcguugcauuggcaucucgaaccgggacuucguggagggcgucagcggcggcuccuggguggacaucguauuagagcacgggagcugcgucacgaccauggccaagaacaagcccacgcuugacuucgagcugauuaagaccgaagcgaagcaaccugcaacacuccgcaaguacugcaucgaagccaagcugacgaacacgacaaccgaguccagaugcccgacccagggcgagcccagccugaacgaggagcaagauaagcgcuucguaugcaaacacucgaugguggaccggggguggggaaacggcugcgggcuuuucgguaagggcgguauagucacaugcgccauguucacgugcaagaaaaacauggagggcaagaucguucaacccgaaaaccuggaguacaccaucgugauaacgccucacagcggggaggagcacgcagucggcaacgauacgggcaagcacggcaaagagauaaagaucaccccacaguccccaaucaccgaggccgagcugaccggguacggcacagucacgauggagugcagcccacgaaccggccucgacuuuaacgagauggugcugcugcagauggaggacaaagcauggcucguccaccgccagugguuccuggaccugccccucccguggcugccgggggccgacacacagggcuccaauuggauacaaaaggagacccuuguuacguucaagaauccccacgccaagaagcaggacguggucgugcucgggagccaggagggagccaugcacaccgcccugaccggggcgacggagauccagauguccagcggcaaccuccuguucacgggacaccugaaaugucgccugcgcauggacaagcuccagcucaaggggaugagcuacuccaugugcaccgguaaguucaagaucgucaaagagauugcagagacccagcacgggacuaucgugauccgcgugcaauacgagggggauggcagccccugcaagaucccguucgagauuauggaccuggaaaaacggcacguccucgggcggcugaucacagugaaccccaucgugaccgagaaggauuccccugucaacaucgaggccgagcccccguucggcgauucuuauaucaucaucgggguugagcccggccagcugaagcugaacugguucaaaaagggguccagcauuggccagauguucgagaccaccaugcguggcgcaaagcggauggccauuuuaggggauacagcgugggacuuuggcucacucggcgggguguucaccagcaucgggaaggcccuccaccagguauucggggccaucuauggcgccgcguucuccggggugagcuggacaaugaagauccucaucggcguuaucauuacuuggaucgggaugaacucccgcagcacgucccugagcgucucacugguccucgugggcguaaucacccuguaccugggggccaugguacaggcugacagcggcugcguggucucuuggaagaacaaggaacucaagugcggcagugggaucuucaucacagacaacgugcacacguggaccgagcaguacaaguuccagcccgagucccccagcaagcuggccagcgccauccagaaggcgcacgaggagggcaucugcgggauccggucggucacucgccuggagaaccucauguggaagcagaucaccccggaacuuaaccacauacucagcgagaacgaagucaagcucacuauuaugacgggcgacaucaaggggaucaugcaagccggaaagcggucccugcgcccccagcccaccgagcugaaguacagcuggaaaaccuggggcaaggcuaagaugcucuccacagagucccacaaccagacguuccugaucgacgggccagagacggccgaauguccuaacaccaaucgugccuggaacucgcuggagguagaagacuacggcuucggaguuuucaccacuaacaucuggcucaagcuccgcgaaaagcaggacgucuuuugcgacagcaaacugauguccgcggccaucaaggacaaccgggccgugcacgccgauaugggcuacuggaucgaguccgcccucaacgacaccuggaaaauggagaaggcguccuuuaucgaggucaagucuugccacuggcccaagucccacacccuguggagcaacggcgugcuggaauccgagaugauaauacccaagagcuuugccgggccuguuucucagcacaacuaccgucccggcuacuauacccagaccgccgggccuuggcaccucgguaagcuggagauggauuucgacuucugcgagggaaccaccgucguggugaccgaggacugcggcaaucggggcccgagccugcgcaccacgaccgcaucugggaaacuuaucaccgaguggugcugccgaucgugcacgcugccgccccuacgcuaccggggcgaagacgguugcugguacggcauggagaucaggccccucaaagagaaggaggagaaccugguuaacagccuggucacggccgggcacggccagauagacaacuucucccucggcgucuuggggauggcccucuuucucgaggagaugcuccggacgcgcguaggcacaaagcacgcgauccugcucguugccgugagcuucgugaccuuaaucacggggaacauguccuuccgggaccuggggcgugucauggugauggugggggccgcgaugaccgacgauauaggcaugggcgugacauaccucgcccugcuggcagccuucaaggugcgcccuaccuucgcugcggggcuccugcugcgcaagcuaacaagcaaagaacugaugauggccaccauuggcaucgcccugcucucacagagcacaaucccggagacaauccuggaguugacggacgccuuagcgcuggggaugaugguguugaaaaucguccggaacauggagaaguaccagcucgcggugaccaucauggccaucucaugcgugcccaacgccgucaucuuacagaacgccuggaagguuuccugcaccauuuuagcgacggucuccgucaguccacuccugcugacguccagccaacagaaggccgacuggaucccccucgcgcuaaccaucaagggccugaacccgaccgcgauauuccucaccacucugucccggaccagcaagaagcgcuccuggccucugaaugaggccaucauggcgguggguauggucagcaucuuagccuccagucugcugaagaacgacauccccaugaccgggccccucguggccggcgggcugcuuaccguaugcuacguccucacgggucggagcgcggaccuggagcuggagcgcgccaccgacgugaagugggaggaucaggcagagaucucggggagcaguccgauccucuccaucaccaucgccgaggauggcuccaugagcaucaagaacgaggaggaggaacagacccugacgauccucaucaggaccggacuccucgugaucuccgggcuguuccccguuagcauccccaucaccgccgccgccugguaucucugggaggugaagaagcagagggcgggcgugcugugggacguccccagcccgccgccgguggggaaggccgagcuggaagacggcgccuaucggaucaagcaaaaggggauacucggguacagucagaucggcgccgggguguauaaggagggcacuuuucacaccauguggcacgugacgcgcggggcagugcugaugcaccguggcaagcgcauagagccauccugggcggacgugaagaaggaccugaucagcuaugggggcggcuggaagcucgagggggaguggaaggaaggcgaagagguacaagugcucgcccuggaacccgggaagaaccccagggccgugcagaccaaacccggccuuuuuaagaccaacaccgggacgaucggcgcugucucccuggacuuuagcccgggcaccuccgggagccccaucguggaccgcaagggcaagguggucgggcuguauggcaauggcgucgugacccgguccggggcguacgucagcgccaucgcucagacagagaaguccaucgaggacaaccccgagaucgaagaugacaucuuccgcaagaaacggcucacgaucauggaucugcaccccggcgccggaaaaaccaaacgcuaccuaccagccauugugcgggaggcgaucaagcgcggcuuaagaacuuuaauccuggcccccacccgcgugguagccgcggagauggaagaggcacugcgcggguugcccauccgguaccagacgcccgcgauucgcgcggagcacaccggccgugagaucguggaucugaugugccacgccaccuucacuaugcgccugcucagcccggugcggguccccaauuacaaccugaucaucauggacgaggcucauuucacggacccugccagcaucgcggcccgcgguuacaucuccacccggguggagaugggggaggccgccgggaucuucaugaccgcgacgccgcccggcagccgcgaccccuucccccagucgaacgcccccaucauggaugaggagcgggagauccccgaacgcagcuggaacucgggccacgagugggugacagauuucaaggggaagaccguaugguuuguucccagcauuaaggcugggaacgacaucgccgcaugccuaagaaagaauggcaagaaggugauccagcuaagucgcaaaaccuucgauucggaguacguuaagacccggacgaacgauugggacuucguggugaccacagacaucuccgagaugggggcgaacuucaaggcugaacgcgugaucgacccaaggcgcugcaugaagccugugauccugaccgacggcgaggagcgggugauccuggccggccccaugccugucacgcacagcuccgccgcucagagacguggccguauagggcgcaaccccaagaacgagaaugaccaguauaucuauaugggcgagccccucgagaacgacgaggacugugcgcacuggaaagaggccaagaugcugcuggacaacauuaacaccccugagggcaucauuccaagcauguucgagcccgagcgggagaagguggacgccaucgauggggaguaccgccuacggggcgaggcaaggaagaccuuuguggaccugaugcggcgcggggaucugccggucuggcucgccuaccggguggcggccgagggcaucaacuacgccgaccgccgcugguguuucgacggggugaagaacaaucagauccuggaggagaacguagagguggagauuuggaccaaagagggcgagcgcaagaaacugaagccccguuggcucgaugcucgcaucuacuccgacccccuggcacugaaagaguucaaggaguucgccgcaggccguaagucucucacguuaaaccugaucaccgagaugggccgccucccgaccuucaugacccagaaggcgcgaaacgcccuggacaaccuggcggugcuccacacggccgaggccggaggacgcgccuacaaccacgcccuguccgagcugccggagacccucgagacccugcugcucuugacccuguuagcgacggucacaggcggcauauuccuguuccugaugucggggaagggcguggggaagaugacccucggcaugugcuguaucaucacagccagcaucuugcuuuggcacgcccagauacagccccauuggauagcggccagcaucauucucgaguucuuucuuaucguccuucucauccccgagcccgagaagcagcggacgccgcaggacaaccaguugacguacguggugaucgcgauacugaccgucguggccgccaccauggccaacgagaugggauuccucgagaagaccaagaaggaccugggcuugggguccaucgccacgcaggagcccgaaagcaacauccucgacauugaccugcgcccugcgagcgccuggacgcucuacgcggucgccaccaccuucguuacgcccaugcuacggcacucgauugagaacagcuccgugaacgugagccugaccgccaucgccaaccaggccaccguccugauggggcuggguaagggguggccgcuauccaaaauggacaucggggugccccugcucgccauagggugcuauagccaggugaacccuaucacccuaacggcagcgcugcucuuacuggucgcccacuacgccauuauuggucccggccuccaggccaaagccacgcgcgaggcacagaagcgggccgccgcugguaucaugaagaauccgaccguggacggaauaaccgugaucgaucuagaucccauacccuacgaucccaaguucgagaagcagcuuggacaggucauguuacucauccuguguguuacccaggugcucaugaugcgcaccaccugggcccugugcgaagcauuaacccucgccacaggaccgaucaguacccugugggaggggaaccccggacgcuucuggaacaccacaaucgccguaagcauggcaaacauauuccggggcuccuaccuggcuggggccggucuccuguucagcaucaugaagaacacgacaaacacccgccgagggaccggcaacaucggugagacccugggugagaaguggaagucccgccucaaugcguugggcaagagcgaguuucaaaucuacaagaaguccgggauccaggaaguggaccgcacacuggccaaggaaggcaucaagcgcggggagacugaccaccacgccgugagccggggcuccgcgaaacuccgcugguucgucgaacggaacauggugacccccgaaggcaagguagucgaucucgggugcggccgcgggggcuggagcuacuauuguggaggcuuaaagaacgugcgggaggugaagggccucacgaagggcggccccgggcacgaggagccuauccccauguccaccuauggcuggaaccuugucaggcugcagagcggcguagacguguucuucacuccgcccgagaagugcgacacccuccugugcgacaucggcgagaguagcccgaacccaacgaucgaggccgggcggacgcugcgugugcucagccugguggagaacuggcugaacaacgacacccaauucuguaucaagguguugaaucccuacaugccguccgucaucgagaaaauggagacccugcagcgaaaguacggaggggccuuagugcgaaacccccugagccguaacucgacccacgaaauguacugggucagcaacgccacuggcaacaucgucaguagcgugaacaugaucucccgcauguuaauuaaccgguucaccaugaagcauaagaaggccacguacgagcccgauguugaccugggcagcgggacccgcaacaucggcaucgaguccgaaauucccaaccuggacauuaucggcaagcgcaucgagaagaucaaacaggagcacgagacgagcuggcacuacgaccaggaccacccguacaagaccugggccuaccacggguccuacgagaccaagcagaccggaagugcguccagcauggucaaugggguggugcgacuccugacgaagccgugggacgucgugcccauggucacgcagauggccaugaccgacaccacaccguucggucagcagcgcgucuuuaaggagaaggucgacacccggacacaggagccgaaggagggaacaaagaaacugaugaagaucacagccgaguggcucuggaaggaguuggggaagaagaagacgccccggaugugcacucgagaggaguucacgcgcaaggugagguccaacgccgcgcugggcgccauauucacggacgagaacaaguggaaguccgccagggaggccgucgaggacucccguuucugggagcucguggacaaggagcgcaaccugcacuuagaagggaagugcgagaccugcguguacaauaugaugggcaagcgggagaagaaguuaggggaguucgguaaggcgaagggcagccgcgccaucugguacauguggcugggggcacguuuccuagaguucgaggcccucggcuuccugaacgaggaccauugguucucccgcgagaacagccugagcggggucgagggcgaggggcuccauaagcugggcuacauccugcgggauguguccaaaaaggagggcggggccauguacgcggacgacaccgcuggcugggacacccgcaucaccuuggaggaccugaagaacgaggagauggucacaaaucacauggagggcgagcacaagaagcuggccgaagccaucuucaagcucacauaccagaacaagguggugcgcguccagcggccgacgccucgggggacugugauggacaucauuagccgccgggaccagcgcggguccggccagguggggaccuacggccugaauaccuucacgaacauggaagcccagcugauacgccaaauggagggcgagggaaucuucaaaagcauccagcacuugacggucaccgaggagaucgcgguacagaacuggcuggcccgggugggccgcgagcggcuuucgcgcauggccaucagcggcgaugacugcgucgugaagccgcucgacgaccgguuugcguccgcccugaccgcgcugaacgacauggggaaggugcgcaaggacauccaacagugggagcccagccgcggcuggaacgauuggacccagguaccauucugcucccaucacuuucacgagcucauaaugaaggacggucgcgugcuuguggugcccugccggaaccaggaugagcugaucggccgcgcacggaucucgcagggggcggguuggucccugaaggagacggccugucugggcaagagcuacgcacagauguggagucugauguacuuccaccgccgggaccuccgccuggcggcaaacgccaucugcucugccgugccuucccacugggugcccaccagccggaccaccugguccauccacgcuaagcacgaguggaugaccacggaggauaugcugaccgucuggaaccgcguguggauccaggagaaccccuggauggaggacaagaccccgguggagagcugggaagaagucccguacuuagggaagcgggaggaccaguggugcgguagccuuaucgggcugaccucccgggcaacgugggccaagaacauccagacugcuaucaaccaggugcggagcuuaaucggcaacgaggaguacaccgacuacaugcccuccaugaagcgcuuccgccgcgaggaggaggaggcggggguacucugguga

SEQ ID NO: 25462 - RNA, 9876 nt, Artificial Sequence
  derived and/or modified CDS sequence (opt11) from DENV-2__FM210235__SS-prME
acagcaggcgugaucaucaugcugauccccaccgccauggcguuucaccucaccacgcggaacggggagccccacaugauuguaggccggcaggagaagggcaagagccuccuguucaagaccgaagacggcgugaacaugugcaccuugauggccaucgaccugggggagcugugcgaggauaccaucacuuacaagugcccacuccuucgccagaacgagccugaggacaucgacugcuggugcaacucgacuuccacgugggugaccuauggcaccuguaccaccacgggggaacaccggcgcgagaagcguuccgucgcccuagugccacauguggguaugggccuggagacucgcacggagaccuggaugagcagcgaaggugccuggaagcaugcccagagaaucgaaaccuggauccuacgccaccccggcuuuacaauaauggccgcgauccuggcguacacagucgggacgacccacuuccagcgggcgcucauuuuuauccuucucgcggccguggcgcccucaaugaccaugcgcuguaucggcauuagcaaccgcgacuucguggagggagucagcgggggcuccuggguagacaucgugcucgagcacggcagcugugucacgaccauggccaagaacaagcccacauuagacuucgaguuaaucaagacagaggccaaacagcccgccacccugcgcaaguacugcaucgaggccaagcugacuaacacgaccacggagucccggugcccgacccaaggcgagccgagcuugaaugaagaacaggacaagcgguucguuugcaggcacuccaugguagaccgcggcugggggaacggcugcgggcuguucggcaaaggcgggaucgucaccugcgccauguucacaugcaagaaaaauauggagggcaaaauagugcagccagagaaccuggaguauaccaucgugauuacaccucacagcggcgaggagcacgcugucggcaacgacacugguaagcacggcaaggagauuaagauaacgccgcaaucucccaucacggaggcggagcugaccggguacggcaccgugaccauggaaugcagcccccggacggggcucgacuucaacgagauggugcuacugcagauggaggauaaggcgugguugguccaccgucagugguuccuggaucugccacucccauggcugcccggggccgauacccagggcuccaauuggauucagaaggaaacacugguaacguucaagaacccccaugcaaagaagcaggacgugguuguucucgggagccaggagggcgcuaugcauaccgcccucacaggggcgaccgagauccaaauguccagcgggaaccuucuguucacgggccaccugaagugcaggcugcggauggacaaguugcagcugaaagguaugucguacaguaugugcaccggcaaguuuaagaucguaaaggaaaucgcugagacacaacacgggacuaucgugauccggguccaguacgaaggcgacggcagccccugcaagauuccguuugagauuauggaccuggaaaaacgacauguccucggacgccugaucacggugaacccgauagucaccgagaaggacucccccgucaacauagaggccgagcccccguucggagauucauauaucauaaucgggguggaacccggccaacugaagcucaacugguucaagaagggcuccagcaucgggcagauguucgaaaccacaaugcgcggcgccaagcgcauggcgauccugggugacacggcgugggacuucggcucccucggcgggguguuuacuuccaucgggaaagcgcuacaucaggucuucggggccaucuacggcgcagcuuucuccggggucagcuggaccaugaagauccugaucggcguaaucaucacuuggauugggaugaauucccgcaguacgucacugucugucucuuuagugcucguggggguuaucacccuguaccugggcgccauggugcaggcggauagcggcugugucguguccuggaagaacaaggagcucaagugcggcagcgggaucuucauuaccgacaacgugcacacauggacggagcaguacaaguuccagcccgaaucgcccagcaagcuggccagcgccauucaaaaagcgcacgaggagggcaucugugggauccgauccgugacucggcuugagaaccuaauguggaagcagaucacgccggagcugaaccacauacucucugagaacgaggucaagcugaccauuaugacgggcgacaucaaggggaucaugcaggccgguaagcgcucccugcggccccagcccacggagcugaaguauucauggaagaccuggggcaaggccaagauguuauccaccgagagccauaaucagacuuuccugaucgacgguccugagaccgcagaguguccaaacaccaaccgggccuggaacagccuggagguugaggacuacgguuucgguguguucaccacgaacaucuggcucaaacugcgggaaaaacaagacgucuucugcgacagcaagcugauguccgcggccaucaaggacaacagagccgugcacgcggacaugggcuacuggaucgagagcgccuuaaacgacaccuggaaaauggaaaaggcguccuucaucgagguaaagagcugccauuggcccaagucucacacccuguggaguaacggcguccuggaguccgagaugaucauaccuaagagcuucgccgggccggugucccagcauaacuaccggcccggcuacuacacccagaccgcugggccuuggcaccucggcaagcuugagauggacuuugacuuuugcgaggggacuaccguggucguuaccgaggacuguggcaacagagggcccagccugaggacaacgacugccuccggcaaacucaucaccgaauggugcugccgcucuugcacgcugccgcccuugcgguacaggggcgaagacggguguugguauggcauggagauccggccccuuaaggagaaagaggagaaccuggugaacagccuggucacggcggggcacggccagaucgacaauuucagccucggaguguuagggauggcccuguuccucgaggaaaugcugcgcacgcggguaggcaccaagcacgccauccuacucgugaccgucucauuugugacccucaucacgggaaacaugagcuuucgcgaccuggggcgcguaauggugauggucggagccgccaugaccgacgauaucggaaugggcgucaccuauuuggcgcugcuggccgccuucaaggugcggcccacguucgcugcuggccucuuacugcgaaagcucacgucaaaagaacugaugauggcuaccaucggcauugcuuugcucucccagucgaccaucccggagacgauccuggaacugaccgacgcucuugcccugggcaugauggugcugaagaucguccggaacauggagaaguaccagcuagccgucacaauuauggcgaucagcugcgugcccaacgccguaaucuuacagaacgccuggaaggugagcugcacgauccuggccgcagugucgguaucaccucuccugcuaacaaguagucaacagaaggccgacuggauuccgcucgagugguccaucaaggggcugaauccgaccgccaucuuccugacgacccucaguagaacguccaagaagcgcagcuggccgcugaaugaagccauaauggcggugggcauggucuccauccuggccagcucucuccugaagaaugacauccccaugaccgggccccugguugccggcggccucuuaaccgugugcuauguccugaccgggcgcagcgcugaucucgaguuagagagggcaacagacgugaagugggaggaccaggccgagaucagcgggucaagcccgauccuuucaaucaccaucgcggaggacggcagcauguccaucaagaaugaagaggaagagcagacucucaccaucuuaauccgcacgggccugcucgugauuagcgggcuguuucccgucucaauccccauaaccgcggccgccugguaccuaugggagguaaaaaagcagcgggccggcguccucugggacgucccgucgccuccaccgguggggaaggcggagcuggaggauggcgccuaccgcaucaagcaaaaggggauccuaggcuacucccagaucggagccgggguuuacaaagagggcaccuuucacacaauguggcacgucacgcgaggcgccgugcucaugcaccgcggcaagcggaucgagccgagcugggccgacgugaagaaggacuugaucuccuacggcggaggauggaaguuggaaggggaguggaaagaaggcgaggagguccaggugcuugcauuagagcccgggaagaacccgcgcgccgugcaaacgaagcccgggcuguucaagaccaacaccgggaccaucggcgccguaucgcucgauuuuuccccgggcacgagcgggucccccaucguggaccggaaaggcaagguggucgggcuguacggcaacggcguagucaccagaagcggugcuuaugucuccgccauugcccaaacagagaagucgaucgaggacaacccugagaucgaggacgacaucuuccggaagaagcgccuaaccaucauggaccuccacccuggcgcaggaaaaacgaagcgauaucugccggccauagugcgggaagccaucaaaaggggccugcgcacccugaucuuagcuccuaccagaguagucgccgcggagauggaggaagcccuccguggccugccgauccgcuaccaaaccccugccaucagggcugaacacacgggccgcgaaaucguggaccuuaugugccacgccacuuucaccaugcggcugcugagcccggugcgcguccccaacuauaaccucaucauaauggacgaagcucacuucaccgaccccgccuccauugccgcgcgggguuauaucagcacgcgcguggagaugggagaagccgcuggcaucuucaugaccgccacgccccccgggucccgggaccccuucccccagucaaacgcgcccaucauggacgaggagcgcgagauccccgaacgauccuggaacagcggccacgaaugggugaccgacuucaaggggaaaacggucugguucguccccuccauaaaagccgggaaugacaucgcggcuugccugcgcaagaacggcaagaagguuauccagcugucacggaagaccuuugauuccgaguacgugaagacccguaccaaugacugggacuucguagugaccacagacauuagcgagaugggggccaacuucaaggcggagcgggucauagacccccgccguugcaugaagcccgugaucuugaccgauggagaagagcgagugauccuggcugggccaaugcccgucacccacuccagugccgcccaacggcgcggcagaaucgggcggaacccuaagaacgagaaugaucaguacaucuacaugggcgagccccuggagaaugacgaggauugcgcacacuggaaggaggcgaagaugcuccuggacaacaucaacacuccggagggcauuauaccguccauguuugaaccggagcgcgagaagguggaugccaucgauggggaguauagacugcgcggggaggcaagaaaaacauucguggaccugaugcgccgcggugaucuccccgucuggcucgccuaccgcguggccgcagaagggauaaacuacgccgaccggcgcuggugcuucgacggggugaagaauaaccagaucuuagaggaaaacguggagguagagauauggacaaaggagggcgagcggaagaagcugaagccacgcuggcuggacgcccggauauacuccgacccccucgcccugaaagaguucaaggaauucgcggccggccgcaagucccugacccucaaccugauuacggagaugggucgauuaccuaccuucaugacgcagaaggcccgcgacgcccucgacaaccucgccgugcugcacaccgcggaggccggcggccgggcuuauaaccacgcccucucggaacugccggaaacacuggaaacccuccugcuuuugacacugcuggccacagucacggguggcauuuuccuauuccugauguccgguaagggcgucgggaagaugacucuggguauguguugcauaaucacggccagcauucuccugugguacgcccagauacagccccacuggaucgccgcgaguauuauacuggaauucuuccucaucguucugcugauccccgagccggagaagcagcgcaccccgcaggacaaccagcucaccuacguggugaucgccaucuugacggucguagcggcaacaauggcaaaugagaugggguuccuugagaagaccaaaaaagaucucggccugggcaguaucgccacgcgugagcccgagagcaauaucuuggacauagaccuucgaccggccagugcguggacguuguacgcaguggccaccacuuucgucaccccaaugcugcggcacucuauugagaacuccucaguaaacgucucccuuacggccaucgcuaaucaggccacuguccuaauggggcugggcaagggauggccgcucagcaaaauggacaucggcgugccucugcuagcuaucggguguuacucccaggugaaccccaucacccucacggccgcguuacugcuccucguugcgcacuacgccaucaucgggcccggacugcaggccaaagcgacgcgugaggcacagaagcgcgcagcagccggaaucaugaagaauccuaccguagacggcgugacugucaucgaucucgaccccaucccauacgaucccaaguucgagaaacagcugggccaggugaugcugcucauacugugcgucacccagguccugaugaugcggaccaccugggcccucugugaggcccucaccuuggcuaccgguccgaucagcacgcucugggaggggaaccccggccgauucuggaacaccaccaucgcagucucuauggccaacaucuuccgggggagcuaucuggccggugcuggccuccuguucucaaucaugaagaacaccacgaacacuagacgggggaccggcaacaucggagaaacgcucggggagaaguggaaaucccgccuuaaugcuuuaggcaagucugaguuccaaaucuacaagaaguccgggauccaggagguggaccggacgcuagccaaggaggggaucaagcgcggggagaccgaccaccaugcagucucccguggcagugcuaaauugcgcugguucgucgagcgaaauauggugacccccgaggggaaggucgucgacuuggggugcggccgcgggggcuggucauacuacugcgggggccugaaaaauguucgggagguuaagggacugacaaagggugggccggggcacgaggagccuauuccuaugagcaccuauggcuggaaccucgugcgacugcaguccggggucgacgucuucuuuacgccccccgagaagugcgauacccugcucugcgacaucggcgagagcagcccgaaucccacgaucgaggcgggccgaacguuacgugugcugucccucguggagaacuggcuuaacaacgacacccaguucugcaucaaggugcugaauccuuacaugccgagcguuaucgagaagauggagacccuccagcggaaguacgguggcgcccuggugcgcaacccgcuauccagaaacucuacccaugaaauguacuggguaaguaacgccaccgggaacaucgugagcuccgucaacaugaucagccgcaugcugauuaaccgguuuaccaugaagcacaagaaggcgaccuacgagccagacgucgaucucggcuccgguacccgcaauaucggcaucgaaucggagauaccaaaucuggauaucaucggcaagcgcaucgagaagauaaagcaggaacaugaaacuuccuggcacuaugaccaggaccacccguauaagacgugggccuaccaugggagcuacgaaaccaagcagaccggauccgcgagcagcauggugaacggggugguccggcuacucaccaagccgugggacguagugcccauggucacgcagauggccaugaccgacaccacccccuucggccaacagagaguguuuaaggagaagguggauacccggacccaagagccgaaggagggcacgaaaaagcugaugaaaaucaccgcggaguggcuguggaaggagcuggggaagaagaagacgccccgcaugugcacccgggaggaguucacccguaagguacguuccaacgccgcccuaggagcgauauucaccgacgaaaacaaguggaagagugcgcgcgaagccguggaggacagccgguucugggagcuuguggacaaggagagaaaucugcaccuggagggcaagugcgagacgugcgucuacaacaugaugggcaagagggagaagaagcugggugaauucggcaaagcuaagggcucccgcgcgaucugguacauguggcucggggcccgguucuuggaguuugaggcccuaggcuuccucaacgaggaccauugguucucacgcgaaaacagccugagugggguggagggugagggcuugcauaagcucgguuacauccugagggacgugagcaagaaggaagggggggcgauguaugccgacgauaccgcaggcugggauacccguaucacccuggaggaucuaaagaaugaggaaaugguaaccaaccacauggaaggggaacacaagaagcuggccgaagcaaucuuuaagcugaccuaccaaaacaaggugguucgggugcaacgacccacgccccgggggaccgugauggacaucaucagccgaagggaccaacgcgggagcggccaggucggcacguacgggcucaacaccuucaccaacauggaggcccagcuuauacgccagauggagggcgaagggguguucaaguccauccaaagacucacagugacagaggaaauugccguccagaauuggcuggcacgcgugggccgcgaacgcuuaagccguauggccauuucuggcgaugacugcguggucaagccgcuggacgaccgcuucgccagugcucucacagccuugaacgacauggggaagguuaggaaggauauucagcagugggagcccagcagaggcuggaacgacuggacccaagugccauuuugcucgcaucauuuccacgagcugauuaugaaagacgggcggguucucguggugccuugucguaaccaggacgagcugaucggccgggcccgcaucucccagggggcaggcuggagccugaaggaaaccgcaugccucggcaaguccuacgcucagauguggagucugauguacuuucaucggcgcgaucugcggcuggccgcuaacgccaucugcagcgccgucccgucacacugggugcccacgucgcgcaccacuuggucuauccaugcaaaacacgaguggaugaccacagaggacaugcugacgguuuggaaucgggucuggauucaggagaaccccuggauggaggacaagacccccguggaaagcugggaggaagugccguauuuggggaaacgcgaggaccagugguguggcuccuuaaucggucugaccucaagagcuacuugggccaagaacauccaaacggcaauuaaccagguccguucccugaucggcaacgaggaguacaccgacuacaugcccagcaugaagcgcuuucggcgcgaagaggaggaggccgggguccucugguga

SEQ ID NO: 25463 - RNA, 9876 nt, Artificial Sequence
  derived and/or modified CDS sequence (opt11) from DENV-2__FM210205__SS-prME
agcgcggggaugaucauuaugcugauccccacagugauggccuuucaccucacaacccggaacggggagccccacaugauaguuggcauccaggagaagggaaaaucccugcuguucaagacugaggacggugugaacaugugcacccucauggccauggaccugggggaacugugcgaggacacaaucaccuacaaguguccccucuuacggcagaacgagcccgaggacaucgacugcugguguaauagcaccuccaccugggugacauacgggaccugcaccaccacgggcgagcaccggcgugaaaaacgcucugucgcacuggucccccaugugggaauggggcucgagacccggaccgagaccuggauguccagcgaaggggcauggaagcacgcccagcgcaucgagaccuggauucugcggcacccgggcuucacuauaauggcagcuauccuggccuauaccauagggaccacccacuuccagcgcguccugaucuucauacugcugacggccguggcccccuccaugaccaugcggugcaucggcaucaguaaccgagacuucguggagggcguuuccgggggcucuuggguggacauagugcucgagcacggguccugcgucaccaccauggccaagaacaagccaacgcucgacuucgagcugaucaagaccgaggcgaagcagccagccacccuccggaaguacugcauagaagcuaagcugaccaauacaaccaccgagucacgcugccccacccaaggagagccauccuugaaggaagagcaggauaagcgguucgugugcaaacacagcaugguggaccgcggcugggggaacggcugcggccuuuucggcaagggcgguauagucacgugugccauguucacgugcaagaagaacauggagggcaagaucgugcagccagagaaccuggaauacaccaucguggucacgccccacuccggcgaggagcacgcggugggcaacgacacugggaagcacggcaaagagaucaaggucaccccccagagcucaaucacagaggccgagcuaaccggauauggaaccgucacgauggagugcucuccccggacuggccucgacuucaaugagauggugcugcugcagauggaaaauaaggccuggcucgugcaccgucagugguucuuagaccugccccuccccuggcugccgggagccgacaagcaggaguccaauuggauccagaaggagacccucgucacauucaaaaauccccacgccaagaagcaagacguggucgugcucggaagccaagagggugcgaugcacacggcccugaccggugccaccgagauucagaugaguuccggcaaccucuuguucaccggccacuuaaagugucggcugcgcauggacaagcuucagcugaagggcaugagcuauuccaugugcaccggcaaguucaagguugucaaggaaaucgcagagacgcagcacggcacaaucgucauacgggugcaguacgagggggacggcagccccuguaagaucccguucgaaaucauggaccuagagaagcgcuacguccugggccggcugauuacugugaacccgaucgugacggagaaggacucuccagucaacaucgaggccgagccacccuucggagacucguacauaauuauaggcguggaaccggggcagcugaagcucaauugguucaagaagggcuccagcaucggucaaauguucgagacaaccaugcgcggcgcgaagcgcauggccauccugggcgacaccgccugggauuucgggucccugggagggguguucacgaguaucggcaaggccuugcaccagguauucggggcgaucuacggcgcggccuucagcggcgucagcuggaccaugaagauccuaaucggggucauuaucacuuggaucggcaugaauuccaggagcaccucccuguccgucagccuggugcucgugggcaucgucacgcuguaccuuggugucaugguccaggcagacuccgggugcgucgugagcuggaagaauaaggagcuuaaaugcggcagcggcaucuucauuacugauaacgugcacaccuggaccgagcaguauaaguuccagcccgaaagcccgucaaaacuggcuagcgcgauccagaaagcccaggaggaggggaucugcgguauccgaaguguaacacgcuuagagaaccucauguggaagcaaauaaccccggaauugaaccacauucuggccgagaacgagguuaaacucaccaucaugacuggggacaucaagggcauuaugcaggccgggaagcgcagccugaggccacaacccacggagcugaaguacuccuggaaaaccuggggcaaggcgaagaugcucagcaccgaauccuacaaccagaccuuccugauagauggcccagaaacggccgagugcccgaacaccaaccgcgccuggaacagccuggagguggaggacuacggguuuggugucuucacaacaaacauaugguuaaaguuaaaggaaaagcaggacgccuucugugacuccaaacugaugagcgcagccaucaaggacaaccgagcggugcacgccgauaugggguauuggauagaguccgcccucaacgacacguggaagaucgagaaagccagcuuuaucgaggugaaaaacugccauuggcccaagucccacacccuguggagcaacggcguccuagaguccgaaaugaucauccccaagaaccuugccggaccagugagccagcauaauuaccguccgggguaccacacucaaaucgcgggccccuggcacuuagggaaacuagaaauggacuuugacuucugcgauggcacuaccgugauagucacggaggauugcgggaaccggggucccucccugcgcaccacaaccgccucuggcaagcugaucacggaguggugcugccguucuugcacacuucccccacuccgcuaccgcggggaggacggcugcugguauggaauggaaauucgcccgcugaaggagaaagaagagaaccugguuaacucccucgucacagccggccacgggcaagucgacaacuucagccuuggcgugcugggaauggcgcucuuccuggaagaaaugcugcguacacgcguggggacgaagcaugcaauccuccuggucgcaguuuccuucgugacacuuaucacugggaacaugagcuucaaggaccuuggccgggucgugguaauggucggcgcuacgauggcagacgauaucgggaugggggugacguaccuggcccugcucgcggccuucaagguccgaccuacauucgcggccggacuguuacucaagaagcugaccuccaaggagcugaugaugaccacgaucgggaucguccuccugagccaguccacuauccccgagaccguccuggaguugaccgacgcccuagcgcucggcaugaugguguuaaagaucguccggaacauggagaaguaccagcuggccguuacgaucauggccauacugugcgucccgaacgcaguuaucuugcagaaugccuggaaggugucgugcaccaucuuagcggucgugucagucuccccucugcuccugaccuccagccaacaaaagacagacuggaucccccuggcucucacgaucaagggccugaaccccaccgcgaucuuccuuaccacccucagucggacaaacaagaagagaucuuggccccuaaaugaggcuauuauggcggucgguaugguguccauauuggcgagcucccuccuuaaaaacgauauccccaugaccggccccuuagucgccggggggcuccugaccgucuguuacguguugaccggucggagcgcugaccuagagcuggaacgcgccacagacgugaagugggaggaccaggcggagauaaguggcucgucaccaauccugagcaucaccaucagcgaggacgguuccaugagcaucaagaaugaggaggaggagcagacccucacuauucucauccggacgggcuuacucguaaucucaggccuguucccgaucagcauccccaucaccgccgcagccugguaccugugggaggugaagaagcagcgggccggggugcucugggacguccccagcccaccgcccauggguaaagcagagcuggaggacggggcguaccggauuaaacagaagggcauccugggauauagccagaucggcgcggguguguacaaggaagggaccuuccacacgauguggcaugugacccgcggagccguccugaugcacaagggaaagcggaucgagcccuccugggccgacgugaagaaggaucugauaagcuacggcgggggcuggaaguuagagggagaguggaaagagggggaggaaguucagguucuagcccuggagcccggcaagaacccccgcgccguucaaacgaagcccggauuguucaagaccaacaccggcaccaucggggccgugucccucgacuucagccccggcacgagcggcagccccaucaucgacaagaaggggaaggucgugggccuguaugggaacggcguggucacccgguccggcgccuacgugagcgccaucgcgcagaccgagaagagcaucgaggacaaccccgagaucgaggacgacaucuuccgcaagcggcgccugaccaucauggaccugcaccccggggccggcaaaacgaagagguaccuccccgcgauugugcgagaagccaucaagcgggggcugcgcacgcugauucuugcaccaacccgcgucguggccgccgagauggaggaggcauuacgcggcuugcccauccgguaccagaccccggccauucgcgcggagcacacaggacgggaaaucgucgaucucaugugccacgccaccuucaccaugcgccugcugucacccguacgcgugccgaauuacaaccucaucaucauggacgaggcucacuucaccgaucccgcguccauagcagcgcggggcuacaucagcacgcgcguugagaugggcgaggccgccgggauuuucaugaccgccacgccgccugguucccgggauccguucccccagagcaaugcucccaucauagaugaagagcgcgagauccccgagagaagcuggaauuccgggcacgaguggguuaccgacuucaagggcaagacagugugguucguaccgucuaucaaagcggggaaugacaucgcggcaugccugcguaagaacggcaaaaaggucauccaguugucccguaagaccuucgacucugaguacgugaagaccaggaccaacgacugggauuucgucguuacgaccgacaucucggagaugggcgccaauuucaaggcggagcgggugaucgacccccgccggugcaugaaacccgugauccucacugacggggaggagcgcgucauccuagcuggucccaugcccgugacccacagcuccgccgcccagcggagaggucgaaucggccgcaaccccaagaacgagaacgaccaguacauuuacaugggggagccguuagagaacgacgaggacugcgcccauuggaaggaagcgaagaugcuccuugacaacaucaauacgccggagggaaucaucccgagcauguuugaacccgagcgggagaagguggacgccaucgacggcgaguaccgccugcgcggggaggcacgcaagacauuugucgaccuuaugcgaagaggcgaccugccgguguggcuggccuauaagguugcugcugaagggaucaacuaugccgaccgccgguggugcuucgauggcaucaagaauaaccagauucucgaggagaacguggagguggagaucuggaccaaggagggggagcgaaagaagcugaagccgcgguggcucgacgcccgcaucuacuccgauccccuagcacugaaagaguucaaagaguucgcggcgggcagaaagucccugaccuuaaaccugaucacggagaugggccgccuccccaccuuuaugacccagaaaacgcgagacgcccuugacaaccuggcuguucuccacacagccgaggcuggaggacgcgcguacaaccacgcucucuccgagcugcccgaaaccuuagagacuuuacugcugcucacccuucuggccacggugaccgggggcauuuucuuguucuuaaugagcggccgggggaucggcaagaugacccuggggaugugcugcaucaucaccgcauccauccuccugugguaugcgcagauccagccgcacuggaucgccgcgucgaucauccucgaguucuuccugauugugcuguuaauccccgagcccgagaagcagagaacgccgcaggacaaucagcugacguaugucgugauagcaauccugaccgugguugccgcgaccauggccaacgaaaugggcuuucuggaaaaaacaaagaaggacuuugggcucggcucaaucgccacgcagcagccggaaucaaacauccuugacaucgaccugagaccggccuccgccuggacccucuaugcgguugccaccaccuucgucacgcccauguugcgccacucuaucgagaacagcuccgucaacguuagccuaaccgccauugcuaaccaagccaccguucucaugggacuuggcaagggcuggccccuauccaagauggacauaggagucccgcuccuggcgauaggcugcuacagccagguuaacccaaucacacugacggccgcucuccuguuacucguggcgcacuaugcgauuauugguccgggccugcaagccaaggccacccgugaggcacagaagcgagcugcggccgguaucaugaagaaccccacagucgauggaaucacggugaucgaccuggacccgaucccuuaugaccccaaguucgaaaagcagcucggccagguuaugcuacuuauccuuugcgucacccaagugcugaugaugagaaccaccugggcccucugcgaggcccucacacuggccacggggcccaucucaaccuugugggagggcaauccgggacgcuuuuggaacaccaccaucgcugugagcauggccaacaucuuucgcgguuccuaucuugccggcgccgggcugcuguucagcaucaugaaaaacacaaccaauacacgccggggcaccgggaacaucggggagacgcucggcgaaaaguggaagucacgccugaacgcguugggcaagagugaguuccagaucuacaagaaguccggcauccaggaggucgaccgcaccuuagcgaaggaggggauuaagcggggcgaaacugaccaucacgccgugagcaggggguccgccaaguuaaggugguucguggagcgcaacauggugaccccggagggcaagguuguggaucugggcugcgggcgaggcggguggagcuauuacugcggagggcucaagaacguccgcgaggugaagggccugacgaagggcgggcccggccaugaggaaccuaucccgauguccaccuacggguggaaccuugugcgucuccagagcggcgucgacguguucuucauacccccggagaaaugcgacaccuugcuaugcgacaucggggaguccagccccaacccgaccguugaggccggucgcacgcuccggguccugaaccuugucgagaacuggcucaacaacaacacccaguucuguaucaagguucugaacccguacaugccguccgucauugagaagauggaggcacugcagcgcaaguacggcggcgcccuagugcggaacccacucucgcggaacagcacccaugagauguacugggugagcaacgccucggggaauaucgucuccagcgugaacaugaucagucggaugcugaucaaccgcuuuaccaugcggcacaaaaaggccaccuacgagcccgauguggaccuugggagcggcacgcgaaacaucgggaucgagagugagauccccaaucuagauaucauaggaaagcggaucgagaaaaucaagcaggagcaugagaccagcuggcacuacgaccaggaccauccauauaagacgugggccuaccauggcuccuacgagaccaagcagacggggagugcgagcucgauggucaacggcguugugcgccugcugaccaagccgugggacguacuccccaccgugacccaaauggcgaugacggacaccacccccuuuggccagcagcgcguguucaaggaaaaggucgauacccgcacgcaggaacccaaggaaggcaccaaaaaguugaugaagaucaccgccgaguggcuguggaaggagcucggaaagaaaaagaccccgcgcaugugcacgcgggaggaguuuacgaggaaggugcggucgaacgcugcccugggggccaucuuuaccgacgagaacaaauggaaguccgcccgcgaggccguggaggacucccgguucugggaguuaguugacaaggagcgcaaucuccaccuugagggaaagugcgagaccugcguguacaacaugaugggaaaacgugagaaaaagcucggagaguucgggaaggccaagggcagccgcgccaucugguacauguggcugggcgcgcgauuucucgaguucgaagcccucggguuccuaaacgaggaccacugguucucgagagagaauucucugagcggagucgagggggaggggcuacacaaacucggguauauccugcgggacguuagcaagaaggaggguggcgccauguacgcugacgauacggccgggugggacaccagaaucacccuggaggaccucaagaacgaggagauggucaccaaccacauggagggggagcacaagaagcuggccgaggccaucuucaagcucacguaccaaaacaagguggugcgcgugcagcggcccacaccccgggggaccgucauggacauuaucagcagacgggaucagcgcggcuccggccaggucggcaccuauggccucaacacuuucaccaacauggaggcccagcugaucaggcagauggagggagagggcguguucaagaacauccagcaccucacggucaccgaggagguggcagugcagaauugguuagcccgcgucgggcgggagcgccugagccgcauggccaucuccggggacgacugcguagugaagccgcuugacgaucgguucgccaaugcccucacggcccugaacgacaugggcaagauucgcaaggacauccagcaaugggagccauccaagggauggaacgacuggacccaaguacccuucugcucccaccacuuccacgagcugaucaugaaggacggccgggugcugguggucccaugcaggaaccaggacgagcugaucgggcgagcgcgcauuucucaaggggccggguggucccuccgggaaacagccugcuugggcaagaguuacgcccagauguggucccugauguacuuccaccgccgggaccugcgccuagccgcgaaugccaucugcagugccgugcccagucauugggugccaaccagccggacuaccuggucaauccaugccaagcacgaguggaugaccaccgaggacaugcugaccguuuggaacagaguuuggauccgggagaaucccuggauggaagacaagacgccaguggaaagcugggaggagauuccauaccugggcaagcgcgaggaccaguggugcgggucucucaucggccugaccucgcgggccaccugggcgaagaacauccaggccgcaaucaaucagguccgcucccugaucgggaacgaggaguauacggacuacaugccgagcaugaagcgauuccgccgggaggaggaggaagcaggcgugcugugguga

SEQ ID NO: 25464 - RNA, 9876 nt, Artificial Sequence
  derived and/or modified CDS sequence (opt11) from DENV-2__FM210206__SS-prME
agcgcgggaaugaucaucaugcugauccccaccgugauggccuuccaccucacuacccgcaacggggagccgcacaugauagucggcauacaggagaaggggaagucccugcuguucaagaccgaggauggggugaacauguguacccuaauggcgauggaccugggggagcucugcgaggacaccaucaccuacaaguguccucuccugcggcagaacgagcccgaggacauugacugcuggugcaacagcaccuccaccugggugacuuacgguacgugcaccaccacuggagagcaccgccgggagaaacgcagcgucgcccuggugccccacguggggaugggccucgaaacccggacugagacuuggauguccagcgaaggggccuggaagcaugcccagcgcaucgagacuuggauacugcggcacccgggauucacgcugauggcggcaauccucgccuacaccaucgguaccacccacuuccagcgaguccugaucuucauccugcugacggccguggcccccuccaugaccaugcggugcaucggcaucagcaaccgcgacuucguggagggaguaucaggcggaagcuggguagacaucgugcuggagcacggguccugcgucaccaccauggcgaagaauaagcccacgcuggacuucgaguuaaucaagaccgaggccaagcagcccgcaacccugcggaaguacuguauagaagcaaagcugacgaacacgacuaccgagagccgcuguccgacccagggcgagcccucccucaaggaggagcaggauaaacgguucguguguaagcacagcaugguggaccgcgguuggggaaacggcugugggcuguucggcaagggcgggauagucacgugcgccauguuuacgugcaagaaaaacauggagggcaaaaucgugcagcccgagaaucucgaguacaccaucgugguuacgccccacuccggggaggagcacgcagugggcaaugacacggggaagcacggcaaggagaucaaggugaccccgcagagcuccaucaccgaggccgagcucaccggguacggcaccguuacgauggagugcagcccacggaccggccuggacuucaacgagauggugcugcuacagauggagaacaaggccuggcugguccaccgccagugguuucuggaccucccgcugcccuggcugccaggggccgacaagcaggaauccaacuggauacaaaaggaaacgcucguaaccuuuaagaacccccacgccaagaagcaggacguggucgugcuugggagccaggaaggggcgaugcacacggcccugaccggugccacagaaauccaaaugagcuccgggaacuuacucuucaccggccaccugaagugccgguugcgcauggauaagcugcagcugaagggcaugagcuacuccaugugcacugggaaguuuaagguggucaaggagaucgcagagacccagcacggcaccaucgugauucgggugcaauaugagggggauggcagccccugcaagauccccuucgaaaucauggaccucgagaagcgcuacguccugggccgauuaauaaccgugaacccgaucgugacggaaaaggacucccccgucaacaucgaggccgagccgcccuucggggacagcuacaucaucaucggcguggagccggggcagcugaagcuuaacugguucaagaaaggcuccagcaucgggcagauguucgagaccacgaugcgcggagcgaagcgcauggccaucuuaggcgacaccgccugggacuucggcucccucggggggguguuuaccagcaucggaaaggcccuccaccaaguuuucggggccaucuauggcgcggccuucuccggcgugagcuggaccaugaagauacugaucggggugaucaucaccuggaucggaaugaacuccagaagcaccucccugagcgucucccucgugcugguagggaucgucacgcuuuaucugggcgugauggugcaggccgacagcgguugcgucguaucguggaagaacaaggagcugaagugcggcucggguaucuuuaucaccgacaacgugcacaccuggacugagcaguauaaguuucagcccgagagccccucuaagcuggcaucagcgauccagaaggcccaggaggaggggaucugcgggauccgcuccgucacgcgguuggagaaccucauguggaagcagaucacgcccgaguuaaaucacauccuugccgaaaaugagguaaaguugaccaucaugaccggggacaucaagggcauaaugcaagccgggaaacgcagccugaggccgcagccuacggagcucaaauacuccuggaagacuuggggcaaggccaagaugcucagcaucgaguccuacaaccagaccuuccugauugacggcccugagacggcagagugcccgaacacgaaucgcgccuggaacagccuggagguugaggacuacggauucggcgucuucaccacgaacaucugguuaaaguuaaaagaaaagcaggacgccuucugcgacuccaagcuaaugucggccgcaauaaaggacaaccgagccgugcacgccgacaugggguauuggaucgaguccgcccugaacgacaccuggaagaucgagaaagccagcuucaucgaggugaagaacugucacuggcccaaaucccauacccuguggagcaauggcgugcucgaguccgagaugaucauaccuaagaacuuggccggccccgugucgcagcauaacuacagaccgggauaccauacccagauugcgggccccuggcaccuaggaaagcucgagauggauuucgacuucugcgacggcaccacaguaaucgucaccgaggacugcgggaaccggggccccucccugcguacgacaaccgccucuggaaagcugaucaccgaauggugcugucgguccugcacgcucccuccucuucgcuaccgcggggaggacggcugcugguacgggauggagauucgcccccugaaggagaaggaggagaaccucgugaacagucuggugaccgcgggacacgggcaaguagacaacuucucucucggcgugcucggcauggcccucuuccucgaggagaugcugcggacacgcguggggaccaagcacgcgauccugcuagucgccguguccuucgugacguuaaucaccggcaauaugagcuucaaggacuuagggcgggucgugguuauggugggcgccacgauggccgacgacaucgguaugggcgugaccuaccuagcucuccuggcggccuuuaaggugcgcccgacguucgccgccggccuguugcugcggaaacugaccucaaaggaacucaugaugacgaccaucgggauaguccuacugagccaguccacgauccccgagaccgugcucgagcuaaccgacgcucuggcccucggcaugaugguacugaagaucgugcgcaacauggagaaguaccaacuggccgugacgauuauggcaauccucugcguccccaacgccgugauacugcagaacgccuggaaggucagcugcacgaucuuggcggucguaucaguaaguccacuauuacugaccuccucucagcagaaaaccgacuggaucccccucgccuugaccaucaagggccugaacccuacggcaaucuuccucaccacccugucaaggaccaauaagaagcggagcuggccgcugaacgaagcgaucauggccgucggcauggugagcauacucgccagcucccugcugaagaacgacaucccgaugacgggcccuuugguggccgggggcuuauuaaccgucuguuacgugcucaccgggcgcagcgccgaccuggagcuggagcgggccaccgacgugaagugggaggaccaggcggaaaucuccggcagcagccccauccucucgauaaccauaagcgaggacgggaguaugagcauaaagaacgaggaggaggagcagacccugaccauccugauccgcaccggacuccuggucauuuccggccuauucccgauaagcauccccaucacggccgccgccugguaccucugggaggugaagaagcagcgggccgggguccugugggacgucccgucgccgccgccaauggggaaggcggagcuggaggacggggcguaccgcaucaagcaaaagggcauucucggauacagccagauaggcgccgggguuuacaaggaggggacuuuccacacuauguggcacgugacucggggggccguucuuaugcacaaggggaagcgcaucgagcccucgugggccgacgugaagaaggacuuaaucagcuacggcgguggcuggaaacucgagggcgaguggaaggagggggaggagguucagguccuggcgcuggagccggggaaaaacccccgggccgugcagaccaagcccggccucuuuaagacgaacacggguaccaucggggcugugagucuggacuuuucacccggcaccuccggcagccccaucaucgacaaaaaggggaagguuguggggcuauacgggaacggcguggucacgcgcuccggggccuacguuucugccaucgcucaaacggagaaguccaucgaggacaaccccgagauugaagacgacaucuuucggaagcgcaggcugaccaucauggaucuccacccgggggcgggcaagaccaagcgcuaccugcccgccauugugcgugaggccaucaagcgggggcugcggacucucauccuggcgccgacccgcgucguggcggccgagauggaggaagcccugcgaggccuccccauccgcuaccagacccccgccauccgcgcggagcacaccgggcgcgagaucguugaucugaugugccacgccacuuucaccaugcgcuuacucucacccguccgggugccgaacuacaaccugaucaucauggacgaggcccacuuuaccgaccccgcgagcaucgccgcgcgaggcuacaucagcacccggguagagaugggugaggccgcugguaucuuuaugacggcaacgccgcccggcagccgcgacccguucccccaguccaacgcccccaucaucgacgaggagcgggaaauccccgagcgcucuuggaacuccgggcaugagugggucaccgacuucaagggcaagaccguaugguucgugccgucuaucaaggcggggaaugacaucgccgccugccugcggaagaacggcaagaaggucauccaguugucccgcaagacguucgacagcgaguacgugaagacccggaccaaugacugggacuucguggucaccacagacaucucagagaugggcgcgaacuucaaggcagagagagugaucgauccccggcgcugcaugaagcccgugauccuaaccgacggagaggagcgggugauccuggcgggcccuaugccggugacccacagcuccgccgcccagaggcgggggagaaucggccggaaccccaagaacgagaacgaccaguacaucuauaugggggaaccacuggaaaacgacgaggacugcgcgcacuggaaagaggcgaagaugcuacuagauaacaucaacacccccgagggcaucauccccagcauguucgagccugagcgcgagaaaguggacgccaucgacggcgaguaccgacuccguggcgaggcccgcaagacguuuguugacuuaaugcggcgcggagaccugcccguguggcucgccuacaagguggccgccgagggcaucaacuacgccgaccggcguuggugcuucgacggcauuaagaacaaucagauucucgaggagaacguugagguggagaucuggaccaaggaaggagagcggaagaagcugaagccacgcugguuggacgcccgaaucuacuccgacccacuggcgcugaaggaguucaaggaguucgcagcaggcagaaaaagccucacccugaaucugaucacugagaugggccggcugcccaccuuuaugacccaaaagacccgugacgcccuggauaaccuggccguccuacauacggccgaggcuggggggcgggccuauaaccacgcccuguccgagcugcccgagacguuagagacccuguugcuccugacccugcucgccaccgugaccgggggcauuuuccuguuccugaugagcggccgcgggaucgguaagaugacucucgggaugugcugcaucaucaccgccucaaucuugcuuugguacgcgcagauacagccgcacuggauugccgccagcaucauccucgaauucuuccugauugugcugcucauccccgagccagagaagcagcggacuccucaggacaaccagcuuaccuacgucgugauagccauucugacaguagucgccgcgacuauggccaacgagaugggcuuccucgagaagaccaagaaggaccuuggguuagguuccaucgccacccagcagccggagagcaauauccucgacauugaccugcgccccgccuccgcguggacgcuauacgcgguggcaacgaccuucgugacgcccaugcuccggcacagcaucgagaacucauccgucaaugugucccugacggccauagccaaucaggccaccguguugaugggccucgggaagggcuggccccuguccaagauggacaucggugucccgcuucucgcgaucggcugcuacagccaggugaaucccauuacccugaccgccgcgcugcuucugcugguggcccacuacgcgaucauaggucccgggcuccaggccaaggcaacgcgcgaggcccagaagcgggcagccgccgggauuaugaagaacccuaccguagacgggaucacggugaucgaccuggacccgauccccuacgaccccaaguucgagaagcagcugggccagguuaugcuccugauccucugcgucacccaggugcucaugaugaggacgaccugggcccugugcgaggcccugacccucgccaccgggccgaucucgaccuugugggagggcaacccagggcgguucuggaacaccacgaucgcggugucgauggccaauauuuuccgcggaucguaccuggccggcgccggguuguuauucagcaucaugaaaaacaccacgaacacucggcgcgggaccgggaauaugggcgagacgcugggcgagaaguggaagucccgccucaacgcacugggcaaaagcgaguuccagaucuacaagaagucggggauccaggagguugauagaacgcucgccaaagagggcaucaaacgcggcgagaccgaccaccacgcagugagccgcggcuccgccaagcuccgcugguucguggagagaaacauggucaccccggagggcaaggucguggaccugggcugcgggcggggcggguggagcuacuacugugggggccugaaaaauguccgggagguaaagggccucaccaagggcggccccgggcaugaggagccgaucccgaugucgacguauggguggaaccuggugagguuacagucgggcgucgacguauuuuucaucccgccugagaaaugcgauacccuccuaugcgacaucggggagaguucacccaacccgaccguggaggccggccggacccugcgcguccucaaccugguggagaacuggcugaacaacaacacucaauucugcaucaaggugcugaaccccuauaugcccuccgucauugaaaagauggaagcucuccagcggaaguacggcggggcccuugugcguaacccccugagccggaauagcacccacgagauguacuggguguccaacgccagcggcaacaucgugucgagcgugaacaugaucagccgaauguuaaucaaccgguucaccaugcgccacaagaaagccaccuacgagcccgacguggaccuggggaguggcacccggaacaucgggaucgaguccgagauccccaaucuggacaucaucggcaagaggaucgagaagaucaagcaagaacacgaaacguccuggcacuacgaccaggaccaccccuacaagaccugggcuuaccacggcuccuacgagaccaagcagaccgggagcgcguccagcauggugaacggugugguacggcuccugacgaagccgugggacguccugcccaccguaacccaaauggccaugacagacacgacccccuucgggcagcagcgcguuuucaaggagaaggucgacacccgcacccaggagcccaaggaaggcacgaaaaaguuaaugaagaucacggccgaauggcuguggaaagagcugggcaaaaagaagaccccgcgcaugugcacacgcgaggaguucacgagaaaggugcgcuccaacgccgcccucggggcgaucuuuaccgaugaaaacaaguggaaguccgcccgcgaggccguggaggacucccgcuucugggagcucgucgacaaggaaagaaaccugcaucucgagggcaagugugagaccugcguguacaacaugauggguaaacgcgagaagaagcugggcgaguucggcaaggccaagggcagccgggccauaugguauauguggcugggcgcucgguuccucgaguucgaggcccuugguuuucugaacgaggaccacugguucucccgggagaacagcuuaaguggggucgagggggagggccugcacaagcugggguacauccuccgcgacgucagcaaaaaggagggcggcgccauguaugccgacgacaccgcggggugggacacgaggaucacccuggaggaccugaagaacgaggagauggugaccaaccacauggagggagagcauaagaaacucgcagaggccaucuucaagcugaccuaccagaacaagguagugcgcgugcagcgcccaacaccccgcgggaccgucauggacauuauuagucggcgcgaccagcggggauccggccagguggggacguacggccugaacacauucacgaacauggaagcacaguugauccgccagauggagggggagggcguguucaagaacauccaacaccugacggucaccgaggagguggccgugcagaacuggcuggcgcgcgucgggagggagcgacucagccggauggcaaucuccggcgacgacugcguggugaagccccuggacgaccgcuucgccaacgcccugaccgcccucaacgacaugggcaaaauccggaaggacauccagcagugggagccgagcaagggguggaacgacuggacgcaggugccauuuugcucccaccauuuccacgaguugaucaugaaagacggccguguccugguggucccaugccggaaccaagacgagcucaucgggagagcgcggaucagccagggcgcagguuggucccugcgugaaaccgccugccuaggcaagagcuacgcccagaugugguccuuaauguacuuccaccggcgcgaccugcggcuggcagcgaacgccaucugcagcgccguccccucccacugggugcccacgagccgcaccaccuggaguauccacgcaaaacacgaguggaugaccaccgaggauaugcucacugucuggaaccggguguggauccgcgagaaucccuggauggaggauaagacccccguagagagcugggaggagauacccuacuugggaaagcgggaggaccaauggugugggucccugaucggacuaacgagccgcgccaccugggcgaagaauauccaagccgccaucaaccaaguccguucccuuauugggaacgaggaguacaccgacuacaugccgucuaugaagcgcuuucggcgcgaggaggaggaagccggcguguugugguga

SEQ ID NO: 25465 - RNA, 9876 nt, Artificial Sequence
  derived and/or modified CDS sequence (opt11) from DENV-2__FM210246__SS-prME
agcgcgggcaugauaauaaugcuuauucccaccguaauggccuuucacuugaccacgcgcaauggugaaccucauaugaucgucggcauucaggagaagggcaagagccuacucuucaagacagaggauggggugaacaugugcacucucauggcgauggaccugggggagcugugcgaggacaccaucacuuacaagugcccccucuugcggcaaaaugagcccgaagacaucgacugcuggugcaacaguacgagcaccugggucaccuaugggaccugcaccaccacgggcgagcaccgccgggagaaacgcucagucgcccuggugccgcacgugggcaugggccucgagacccggacagagaccuggaugagcagugaaggggcauggaagcacgcgcagcguaucgagacauggauacugcgucacccgggcuucacgaucauggccgcgauucuggccuacaccaucgguaccacucacuuccaacgcguucucaucuuuauccugcuaacggcuguggcccccuccaugaccaugcguuguaucgguauuagcaaccgugacuucguggaaggcguguccgggggcucuugggucgacauuguguuagagcacggguccugcgucacaaccauggcgaagaacaaaccuacgcucgacuucgagcugaucaaaaccgaggccaagcagccggccacccuccggaaguauugcauagaagccaagcugacaaacacgaccaccgagaguaggugccccacacagggcgaacccucccucaaagaggagcaagacaagcgguuuguuugcaagcacagcaugguugaccgcggcugggguaacggcugcggccuuuuugggaagggaggcaucguaacaugcgcaauguucaccuguaagaagaauauggagggcaagaucgugcaacccgagaaucucgaauauacgauaguggucacgccccacuccggggaagaacacgcaguggguaaugacacggggaagcacggcaaggaaaucaaggucaccccgcagagcucaaucaccgaggcugaacugacaggguauggcacagucacaauggaaugcagcccccggaccggccucgacuucaacgagaugguacugcugcaaauggagaacaaggccugguuagugcaucgccagugguuucuggaccuaccauuaccauggcugcccggcgccgacaagcaggaauccaacuggauccagaaggaaacccuggucacauucaagaacccccacgccaagaagcaggacguggucguucucgguucccaggaaggggcgaugcacacggcccugacuggcgccacagaaauccagaugagcuccgggaacuugcuguuuaccggacaccuaaaaugccggcuccgcauggauaagcuccaacugaaagguaugagcuacuccauguguacggggaaguucaagguggucaaggagaucgccgagacccagcacggaacgauuguuauccgugugcaguacgagggggacggcagccccuguaagaucccguucgagaucauggacuuagagaaacgcuacguuuuaggucggcugaucaccgugaacccaauugugacggaaaaggacucccccgugaacauagaggcugaaccgccuuuuggggauagcuacaucaucauaggcguggagcccgggcagcugaagcucaacugguucaagaagggcuccagcauuggucagauguuugagaccacuaugcgaggcgcaaagcgcauggcaauuuugggcgauaccgccugggacuuugggucgcugggcgggguguucacuagcaucggcaaggccuuacaccaggucuucggggccaucuacggcgcggcuuucuccggcguaagcuggaccaugaagauccugauuggggugauaauaaccuggaucggcaugaacucccgcagcaccucccuuucggugucacugguguuaguagggaucgucacgcuguaccugggcguuauggugcaagccgacagcgggugcguaguuuccuggaaaaauaaggaguugaagugcggaucugguaucuucaucaccgacaacgugcacaccuggaccgagcaguacaaguuccagcccgagagcccuuccaagcuggccagugcgauccagaaggcccaggaagaaggcaucugcgggauccgcuccgucacgcggcuggagaaucuuauguggaaacagauuaccccugaguugaaccacaucuuggcagagaacgaggugaagcuaacgaucaugaccggggacaucaagggcaucaugcaggcggggaagcgcagcuugcgcccgcagcccacggaacugaaauacuccuggaagaccuggggcaaagccaagaugcucagcacugagucguucaaccagaccuuccugauagauggccccgagaccgcggagugcccgaacacuaaccgggcauggaacagccuggaggucgaggacuacggguucggcguuuucacgaccaacaucuggcucaagcugaaggaaaagcaggacgcuuucugcgacuccaagcugaugagcgccgccaucaaggauaaccgggcggugcacgcagacaugggguacuggaucgaauccgcccucaacgacacguggaagaucgaaaaggccucauucaucgaaguuaagaauugccauuggcccaagucccacacguuauggucuaauggcguccuugaauccgagaugauuauucccaagaaccucgcuggcccagucagccaacacaauuaccgcccgggguaccacacccagaucgcgggccccuggcaccuugggaagcuggagauggacuucgauuucugcgacgguacgaccgucaucgucacagaagacugcgggaaucggggcccuucccuccgcacaaccaccgccagcgguaaacucaucacggaaugguguugccggagcugcacccugccuccgcuccgguaccgaggagaggacggcugcugguacggcauggagauucgcccccugaaggagaaggaggaaaacuuaguaaauucccucgugacagccgggcacggucagguggacaacuucagccugggugugcuggggauggcccucuuccuggaagagaugcugcggacccgcgugggaacgaagcacgcaauccuccuagucgccgucagcuucgugacccuuauuaccggcaacaugagcuucaaggaccucgggcgugucgugguuauggucggggcaaccauggccgaugauauugggaugggcgucacguacuuagccuuacucgcggccuucaaggugcggcccaccuucgccgcaggccuacugcuccguaagcugacuuccaaggagcugaugaugacgaccauagggaucguacuccugagucaguccaccauccccgagaccguccuagagcugacagacgcccuggcgcugggcaugauggugcucaagaucguccgcaacauggagaaguaccaacuggccgugacgauuauggccaucuuaugcguaccgaacgccgugauucuacaaaacgcguggaaggugucuugcaccauccuugcggucgugagcguaagcccccugcuccugaccuccucccagcagaagacugacuggaucccucuagcccucaccaucaagggccugaaccccacggccaucuucuuaacuacuuuaagucgcacgaacaaaaagcggagcuggccccugaacgaggccaucauggccgucggaauggucagcauucuagccagcaguuuacuaaagaacgacauuccuaugacagggccucuuguggccggagggcuccugacugugugcuauguuuugaccggucgcagugccgaccucgagcucgagcgggccacggauguaaagugggaggaccaggcggagaucaguggcagcagcccuauccucuccaucaccaucuccgaggauggcuccaugucaaucaagaacgaggaggaggagcagacccucacaauacugauacgcacggguuugcucgucauaucgggccuauucccgauuagcaucccaauuacagcagccgcgugguaccugugggagguuaagaagcagcgggccgggguccucugggacguccccagcccgccgcccaugggaaaggcggagcuggaggacggagccuaccggaucaagcagaagggcauccugggcuauagccaaaucggagccgggguuuacaaggaggggacguuccacacaauguggcacgugaccagaggggccguccucaugcauaagggcaagcggaucgagccuagcugggccgacgugaagaaagaucugauuaguuacggcgggggcuggaaauuggagggggaguggaaagaaggugaggaggugcagguccucgcgcuggagcccggcaaaaauccccgggccguucagacaaagccugggcuauucaagaccaauacugggaccaucggggcggugucgcucgauuucagcccagguacaaguggcagccccaucaucgacaagaaaggcaagguaguaggccuguacggaaacggggucgucacucguucuggcgcuuaugugagcgccaucgcgcagacggagaagaguauugaggauaacccggagaucgaagacgacaucuuucgaaagcgccggcugaccaucauggaccugcaccccggcgccggcaagacgaagcgauaccuccccgcaaucguucgggaagccaucaagcgcggucugcggacccugauccucgcaccuacccgcgucguggccgccgagauggaagaggcccugaggggucugcccauuagguaucagacccccgccauccgggcggagcacacgggucgagagaucgucgacuuaaugugccaugcgaccuucacuaugagacuacugucgccaguacgggugccgaauuacaaucucauaaucauggacgaggcgcacuucaccgaccccgcuuccaucgccgcgcgcgguuacaucuccacgcggguggaaaugggcgaggccgcggggauuuucaugaccgccacgccgcccggcucccgugacccuuucccccaguccaacgcccccaucaucgacgaggagagggagauccccgagcgcagcuggaacucuggucacgagugggucacagauuucaagggcaagacagugugguucgugccgagcaucaaggcgggaaaugauauagcugccugccugcggaagaauggcaagaaggucauccagcugucacgaaagaccuucgacagcgaguacgugaagaccagaaccaaugacugggacuucguggucacgacggacaucuccgaaaugggagccaacuucaaggcggagcgcgucauugacccgcggcgcuguaugaagccuguaaucuugacagacggggaagaacggguaauacuagccggccccaugccggucacccauucgagugccgcccaacgccgggggcgcaucggccggaaucccaagaacgagaaugaccaguacaucuacaugggggaaccacuugagaaugacgaagacugcgcucacuggaaagaggcgaagaugcuccuggacaauauuaacacgccugaggguauaaucccuagcauguucgagcccgagcgcgaaaagguggaugccaucgacggcgaguaccggcucagaggggaagcccgcaagaccuucguagaccugaugcggcgcggcgaucugcccguguggcuggccuacaaagucgcagcggaagguauuaauuacgccgaucggcgcuggugcuucgacggaaucaagaacaaccagauacucgaagagaauguggagguggagaucuggaccaaggagggggagcggaagaaacuuaagccccgcuggcuggacgcgagaaucuacuccgauccccucgcccuaaaggaguucaaggaguuugccgcgggccgcaagucucuaacuuugaaccugauuacggagaugggccggcugcccaccuucaugacccagaaaacccgcgacgcccucgacaaccuggccguucugcacacggccgaggccggugggcgggcuuacaaccacgcccucuccgagcugcccgagacccuggagacacuccugcugcucaccuuacuagcaacggugaccggaggaaucuuccucuuccugaugagcggcagaggcauagguaaaaugacccuggggauguguugcaucaucaccgccaguauccuccugugguacgcgcagauccagccgcacuggaucgccgccagcaucauccuggaguucuuccucauagugcugcugauccccgagcccgagaagcagaggacaccucaggacaaccagcucacguacgucgugauugcuauccugaccgucgucgcagcgaccauggccaacgagaugggcuuccuggagaagaccaagaaagaccucgggcuuggauccauagccacgcagcagcccgagucuaacauccuggacaucgaccuccguccagccagcgcuuggacccuauaugcaguagcgaccaccuucgugacgcccauguuaaggcacaguaucgagaacaguuccgugaaugucucucucacugcaaucgccaaccaggccacggugcugaugggucuagggaagggcuggccccucuccaagauggacaucggggucccgcugcuagcgaucggcugcuacagccaaguaaaccccaucacccuuacagcggcccugcugcuccucguggcccauuacgcgauuaucgggcccggccugcaggccaaggccacccgugaagcccagaagcgggccgcggccggcaucaugaaaaaccccaccgucgacgggaucaccgugaucgaccuggacccgauccccuacgacccuaaguucgagaagcagcugggccaagugaugcugcucauccuuugcgucacccagguuuugaugaugcgcaccacuugggcucucugcgaggccuugacacuggccacgggacccaucucgacucuuugggagggaaacccagggcgguucuggaacaccaccaucgcggugagcauggcgaacauauuccgcgguuccuaccuggcuggcgccgggcuccuguuuagcaucaugaagaacacuaccaacacccggaggggcacgggcaacaugggagaaacccuuggcgagaaguggaaaagccgccuuaacgcacucgguaagagcgaguuccagauuuacaagaagaguggcauccaggagguagacaggacccuggccaaggagggaaucaagcgcggcgagacagaccaccacgccgugagccgcggcuccgccaagcugcgaugguucgucgagcggaacauggucacacccgaaggcaagguggucgaccucggaugcgggcgcggcggguggagcuacuauugcggcggucugaaaaauguccgggaggugaaaggccugacgaaaggggguccgggccacgaggaacccauucccaugucgaccuacggcuggaaccucguaagacuacaaagcggcgucgauguguucuuuauuccgcccgaaaagugcgauacccugcucugugacauaggagagucgagcccaaacccgaccguggaagccggaaggacgcugcgaguacugaaccucguggagaauuggcugaacaacaauacccaauucuguauaaaggugcucaacccuuacaugcccagugucaucgagaagauggaggcgcugcagcggaaguacggcggggcgcucgugcgcaauccguuaagccggaacaguacccacgagauguauugggucucuaaugccagugguaacaucguuucuagcgucaacaugauaucgcgaaugcucauaaaccguuucaccaugcgccacaagaaggcuaccuaugagccagacguggaucucgggaguggcacgcggaacaucggaaucgaaucggagauucccaaucuggacaucaucggcaagcggaucgagaagaucaaacaggagcacgagaccucauggcauuacgaucaggaccacccuuacaagaccugggccuaucauggcuccuacgagacuaagcagacggggagcgcgucuagcauggucaacggagugguacgucugcucacuaagccgugggacguucugcccaccguaacccaaauggccaugacggacacaacccccuucggacagcagcgcguauuuaaggagaaaguugacacccguacgcaggagcccaaggagggcaccaagaagcucaugaagauuacugccgaguggcucuggaaggaguugggcaagaaaaagaccccgcggaugugcacgagagaggaguucacccggaaggugcgcucgaaugcagcccugggggccaucuuuaccgacgagaacaaguggaaaucugcucgggaggccguggaggacucccgcuuuugggaguuaguggacaaagagcgaaaccugcaucuugaggguaagugcgagacgugcguauacaacaugauggggaagcgcgagaagaagcugggcgaguucgggaaggccaagggaagccgcgcaaucugguacauguggcugggcgcgcgguuccuggaguucgaagcccucggauuucugaacgaggaccauugguuuucacgcgagaacagccuguccggcguggagggggagggccugcacaagcugggguacauacuccgcgacgugagcaaaaaggagggcggggccauguacgcagacgacacggcugguugggauacccguaucacguuagaggaccugaaaaacgaggagauggugacaaaucauauggagggcgagcacaagaagcuggcugaagcuaucuucaagcucaccuaucagaacaagguggugcgcgugcagcggcccacgccccgggggaccguuauggacauaaucagccggagggaccaacggggcucuggccaggucgggaccuacggguuaaacacguucaccaacauggaggcccagcugaucaggcaaauggagggagagggcguauucaagaauauccagcacuugaccgugaccgaggagguggccgugaaaaacuggcuggcgcggguagggcgggagcggcugagucggauggccauauccggcgacgacugcguugugaaaccucuagacgaccgcuucgcaaacgcccucacggcccugaaugacaugggcaagaucaggaaggacauucagcaaugggagccgaguaagggguggaaugacuggacccagguccccuucugcagccaccacuuucacgagcucaucaugaaagacggccgcgucuugguugucccgugucggaaccaagacgagcucauaggacgcgcuaggaucagccaaggcgccggguggucccuccgugagaccgccugccuggggaaaagcuacgcacagauguggucccugauguacuuccacaggcgcgaccuccgguuggcagcgaacgcgaucugcuccgccguuccaucacacugggugccgacaagucgcacgacuuggucgauccacgccaagcacgaguggaugacaaccgaggacaugcugaccgucuggaaccggguauggauccgcgagaaccccuggauggaggauaaaacgcccgucgagucaugggaggagauuccguaccucggcaagcgggaagaccaguggugcgggucccugaucggccuuacuagccgcgcuacgugggcaaagaacauccaggccgccaucaaucagguacggucccuaauugguaacgaggaguacacggauuauaugccgaguaugaagcgcuuucggcgcgaggaggaagaggccggcgugcugugguga

SEQ ID NO: 25466 - RNA, 9876 nt, Artificial Sequence
  derived and/or modified CDS sequence (opt11) from DENV-2__FM210207__SS-prME
agcgcggggaugaucaucaugcugaucccaaccgugauggccuuucaucucaccacccguaauggggagccccauaugaucgucggcauucaggagaaggggaagucccuacuguucaagaccgaggacggcgugaacaugugcacacucauggcgauggaucugggcgagcugugugaggacacuaucaccuacaagugcccccuccugcggcaaaacgagcccgaggacaucgacugcuggugcaacagcaccaguacauggguuacauaugggaccugcacaaccacuggugagcacaggcgggaaaagcgcucgguagcccuugugccccacguggguaugggccuugagacccggacugaaaccuggauguccagcgagggggccuggaaacacgcucagcgcauugagaccuggauucugagacacccuggcuuuacgaucauggccgcgauacucgccuacacaauugggaccacccauuuccagcgcguccucauauucaucuuacugacggccguggcccccuccaugacgaugcggugcaucgguaucucuaaccgcgacuucgucgaaggcgucuccggggguagcuggguggacaucguucucgagcacggcuccugcgucacaaccauggcgaaaaacaagcccacgcuagacuucgaauugaucaaaacggaggcuaaacagcccgcaacccuccggaaguacugcaucgaggccaagcucaccaacacgacgaccgagagccguugcccgacccagggagagcccucacucaaggaggagcaggacaagagguucgucugcaagcacuccaugguggacaggggcuggggcaacggcugcggccuauuuggcaaaggcgggaucgucacgugugcaauguucacgugcaagaaaaacauggagggcaagaucgugcaacccgagaaccuggaguauaccaucguggucacgccccacaguggggaggagcacgcagugggcaacgacacggggaagcacggcaaggagauaaaggugaccccccagucuaguaucacggaggccgaacugacaggguacggcaccgucaccauggagugcagccccaggacgggucucgacuucaacgagauggugcugcuccaaauggagaacaaggccugguuagugcaccgucagugguucuuggaccugccacugcccuggcucccgggggccgacaagcaagaguccaacuggauacagaaggagacccuggucaccuucaaaaacccccacgcaaaaaaacaagacguggucguguuaggcagccaagaaggggcgaugcacacggcccuaacaggcgccaccgagauccagaugucguccgggaaccuccuguucaccggccaccugaagugccgguuacgcauggacaaguuacaacugaagggaauguccuacuccaugugcacugggaaguucaaggugguaaaggagaucgcagaaacccagcacggcacuauuguaauccgggugcaguacgagggagacggcagccccugcaaaauacccuucgagaucauggaccuggagaagcguuacguccucggucggcugaucaccguuaauccgaucgugacggagaaggacucacccgucaauauagaggccgagccacccuucggggacucauacaucauuauuggcguggaaccggggcagcuuaagcucaacugguucaagaagggguccagcauagggcaaauguuugagaccaccaugcgcggcgcgaagcgcauggccauccucggggacaccgccugggacuucgggucccugggcgggguguucacgagcaucggcaaggcccuccaccaggucuucggggccaucuacggcgcggccuucuccggcgugagcuggaccaugaaaauccuaaucggugugauaaucaccuggaucggcaugaacucucggagcaccucccugagcguuucacugguccucguggggaucgucacgcuguauuuaggugugauggugcaggccgauagcgggugcgucguguccuggaagaacaaggaguuaaagugcggcucaggcaucuucaucaccgacaaugugcacaccuggacggagcaguacaaauuccagcccgagagccccagcaaacucgccagcgcgauccagaaggcccaagaggaggggaucugcggcauacguuccgucacgcgucuggagaaccucauguggaagcagaucacccccgaacugaaucacauccuggccgagaacgagguuaagcucaccaucaugaccggggacaucaaggguaucaugcaggccggcaagcgaucacuucggccgcaacccacggaguuaaaauauuccuggaagaccuggggcaaggccaagaugcucucaaccgaguccuacaaccagaccuuccugaucgauggccccgagacggcggaaugcccuaacaccaaucgagccuggaacagccuggaaguugaggauuauggguucggcguguucaccacuaacaucuggcucaaguugaaagagaagcaggacgccuucugcgacuccaaauugaugucggccgccaucaaggacaaccgugcggugcacgccgacaugggguacuggaucgagucggcgcucaaugacacguggaagaucgagaaggccagcuuuaucgagguuaagaacugccacuggcccaaaucgcauacccuguggagcaacgguguccuggaguccgagaugaucauccccaagaaucucgcgggccccgugucgcaacacaacuaucgccccggguaccacacccagaucgcuggccccuggcaccuggggaagcuggaaauggacuucgauuucugcgacggaaccacuguaauagucacagaggacugcggaaaccggggccccucccuccgcaccaccaccgcgagcggcaaacucaucacggaguggugcugccggagcugcacucugcccccgcuuagguaccgcggggaggacgguugcugguacgggauggagauccgucccuuaaaggagaaagaggagaaccugguaaacuccuuggugacagccggccacgggcaggucgacaauuucagccugggcguguuagguauggcccucuuccuugaagaaauguugcggacccgcgucgggacgaagcacgcgauacuccugguagccguguccuucgugaccuugaucaccggcaacaugagcuucaaggaccucgggcggguagugguuauggucggagccacuauggccgacgacaucgggaugggggugacuuaccuggcucuguuggcggcauuuaagguaagacccaccuuugccgccggccugcugcugcggaagcugaccagcaaggagcugaugaugaccacgauugggaucgugcuccugagccagucgaccauucccgaaaccguguuggaacucaccgacgcccuggcgcugggcaugauggugcucaagauaguccgcaacauggaaaaguaucaguuggccgucacgaucauggccaucuuaugcgucccgaaugccgugauccuccagaacgcuuggaaggugagcugcaccauccuggcggucguguccgugagcccccugcuccugaccuccagccagcagaaaaccgacuggauccccuuggcccucacgaucaaagggcugaacccgacugcgauuuuucugaccacccugucccguacuaacaagaagaggagcuggccacugaaugaagcuauuauggcggucggaaugguaaguauccuugccagcucucucuuaaagaaugauauccccaugaccggcccccugguggccgguggccuccugaccguuugcuacguucugacggggcgcagcgccgaccucgaacuggagcgggccacagacgugaagugggaagaccaggccgagaucuccggcaguagcccuauccuguccaucaccauuucggaggacggguccaugaguauaaagaacgaagaggaggagcaaacucuaacuauacugauccgcacggggcugcucgucauuucuggccuguucccgaucuccauccccaucaccgcagccgcgugguaccugugggaaguaaagaagcagcgggccggggugcucugggacguucccagcccaccacccaugggcaaggcggagcuggaggacggggccuaccgaaucaagcaaaagggcauccugggguauagucagauaggggccggagucuacaaggaggggaccuuccauaccauguggcacguaacccguggcgccgugcugaugcacaaagggaagcgcaucgagcccucuugggccgacgugaagaaagaccugaucagcuacggcggaggguggaagcuggagggcgaguggaaggagggggaggagguccaggugcucgcgcuggagccuggcaagaacccccgcgcagugcagacaaaacccgggcuguucaaaaccaacaccggcaccaucggggccgugucccucgacuucagccccggaacgucaggcagccccaucaucgacaagaaggggaagguagugggucuguacgggaaugggguggucacccgcuccggcgccuacgugagcgccaucgcgcagaccgagaaguccaucgaggacaaccccgagaucgaggaugacaucuuccguaagcgucggcugaccaucauggaccugcacccaggggccggcaaaaccaaacgcuaccuccccgccauugugagggaggccauuaagcgcgggcucaggacccugauccuugcgccgacccgcgugguggcugccgaaauggaggaagcccugaggggccugccuauccgcuaccagacucccgcgaucagagcggaacacacggggcgcgagaucguagaccucaugugccacgccaccuuuacaaugcgccugcugagccccguccgggugccgaauuacaaccucaucaucauggacgaagcccacuucacagacccagccuccaucgccgcgcgcggcuacauaagcacgcggguggagaugggcgaggccgcggguaucuucaugacugcuacgccucccggcagccgcgauccauucccgcagagcaacgcccccaucaucgacgaagagcgagagaucccugagcgcagcuggaauucugggcacgaaugggugaccgacuucaagggaaagacaguaugguuugugccgagcaucaaagccgggaacgacaucgcugcaugccugcgaaagaacggcaagaaggugauccagcuuagucgaaagacuuucgacuccgaguacgugaagacccggacgaacgacugggacuucgugguaacaacagacaucuccgagaugggcgccaacuucaaagcggaacgcgugaucgauccaagacgcugcaugaagcccgugauccucaccgacggggaggaacgggucauccuggccggcccgaugccggugacccacagcuccgcggcccagcggcgggggcgcaucggccgaaaccccaaaaacgaaaacgaccaguacauauacaugggggaaccguuagagaacgacgaagacugcgcccauuggaaggaagcgaagaugcuccuggacaacaucaacacgcccgagggcaucaucccuucgauguucgaacccgagcgagagaaaguggacgccaucgacggggaauaucgguugcgcggggaggcacgcaaaaccuucgucgaccucaugcgacgcggcgaucugcccguguggcuggccuacaagguggcugcagaagggaucaacuacgcggaccggcgcuggugcuucgacgguaucaagaacaaccagauucucgaggaaaacguagagguagagaucuggaccaaggagggggagcggaagaaacuuaagccgcguuggcucgacgcacggauuuacuccgacccccucgcccugaaagaguucaaggaguuugcugcgggccgcaagagccugaccuuaaaccugaucacggagaugggccggcuucccacauucaugacccagaaaacucgcgaugcccucgacaaccuggccgugcuccacacagccgaagcgggcgggcgggccuacaaccacgcgcucuccgaguuacccgaaacgcuggaaacuuugcugcugcugacccuucuggcuacggugaccgggggcaucuuccucuuccugaugagcggccgcggcaucggaaagaugacacugggaaugugcugcauuaucacagccaguauccuccugugguacgcgcagauccagccgcacuggaucgccgcaaguaucaucuuagaauucuuccucaucguacugcuuauccccgagcccgagaagcagaggacgccccaggacaaucagcucacguacguagugauugcgauauuaacuguggucgcagcgacgauggccaaugagaugggcuuccuggaaaagacuaagaaggaccucgggcuggguucaaucgccacucagcagccggagagcaacauucuggauaucgaccuacgcccagccuccgccuggacccuauaugcgguagccaccaccuucgugacgcccauguuaagacacucuaucgagaauaguuccgucaacgugagccucaccgccaucgccaaucaggcaaccgugcugauggggcuggggaagggcuggccccucuccaagauggacaucgggguuccgcugcuugcgaucggguguuacagccaggugaaccccaucacccucacggcagccuuacugcuccucgucgcccauuacgcgaucaucggacccggccugcaggcgaaagcuacccgcgaggcgcagaagcgggccgcagccggcaucaugaagaaccccaccguagacggcaucacagugaucgaccucgacccgauccccuaugaucccaaauuugagaagcagcugggccagguuaugcugcucauccugugcgucacccaggugcugaugaugcgcaccacuugggcccucugugaggcacugacgcuggcaacggggccuaucuccacccucugggagggcaauccagggcgguucuggaacaccaccaucgcugugagcauggccaauaucuuccggggcuccuauuuagccggcgccgggcuccucuucucgaucaugaagaacacgaccaacacccggcgcggcaccgguaauaugggcgagacgcucggggagaaguggaagucccgccugaaugcucugggcaagaacgaguuccaaauauacaaaaaguccggcauccaggaggucgacaggacccuggcgaaggaggguaucaaacgcggagagacggaucaccacgccgugucccgggggagcgcuaaacugcgcugguucguggagcgaaacauggucacccccgaaggcaagguggucgaucucgguugcggucguggcggguggucauacuacugcggcgggcugaagaacguccgagaggugaagggccugacgaagggcgggcccggccacgaggagcccaucccgaugucgaccuacggguggaaccucgugcgccuucaguccggcgucgauguguucuucaucccgcccgagaagugcgacacccugcucugcgacaucggagagagcuccccuaacccgaccguagaggcuggccggacccuucgaguccuaaaccucguagagaacuggcugaacaacaacacgcaguuuugcauaaaggugcugaaccccuacaugcccagcgugaucgaaaagauggaggcgcugcagcggaaauauggcggggccuuagugcggaacccucugucccggaacagcacacacgagauguacugggugucgaaugcguccggcaacaucguaucaucggugaacaugauaagccgcaugcuuauuaaucgguucaccaugcgccacaaaaaggccaccuacgagcccgacguggaucucgggucuggcacucgaaacaucgggaucgaauccgagauccccaaccuggacauuauuggcaagcggaucgagaagauaaaacaggagcacgagacguccuggcacuacgaccaggaccaucccuacaaaacgugggccuaccacggcagcuacgagaccaagcagacgggguccgcgagcuccauggucaacggagugguacggcugcucaccaagccgugggacguucugcccaccgugacccagauggccaugacggacacuacuccuuucgggcaacagcgcguuuuuaaggaaaaggucgacacccgcacucaggagcccaaggaaggcacgaagaaguugaugaagauuaccgcugaguggcucuggaaagagcugggaaagaagaaaacccccagaauguguacgcgggaggaguucacacggaaggugcgcagcaacgcggcccugggggcgauauucaccgacgagaacaaguggaaauccgcccgggaggccgucgaggauagccgcuucugggagcucgucgacaaagagcggaaccuacauuuggagggcaagugugagacgugcguguacaacaugauggggaagcgcgagaagaagcucggcgaguucggcaaagccaaaggcucccgggccaucugguacauguggcugggagcgcgcuuccuggaguuugaagcccucgguuuccugaaugaggaucacugguuuagccgggagaacucgcuaagcggcguugagggggagggccuccauaagcugggguacauucugcgcgacguuucaaaaaaagaggguggcgcgauguacgcugaugacacggcggggugggacacccggaucacccucgaggaccugaagaacgaggaaauggugaccaaccacauggaaggcgagcacaagaagcuggccgaggccaucuuuaaacucacauaccagaacaagguggugcgcgugcaacggcccacgccucgugggacagucauggacaucauuagccggcgagaccagcgggguagcggccaggucgggaccuacggccugaacacguucaccaacauggaggcgcagcugauccgccagauggaaggagagggaguguucaagaacauccagcaccuuaccgucaccgaggagguggccgugcagaauuggcuagcgcgggucgggcgcgagcgccuaucccggauggccaucucuggcgacgacugcguggugaagccucucgacgaccgcuucgccaacgcccugacggcccugaacgacauggguaagauccggaaggauauccagcagugggagccguccaagggguggaaugauuggacccaggucccauucugcagccaccacuuccacgagcugaucaugaaggacggacgcguacuggugguacccugccggaaccaggacgagcugauuggccgcgccagaauaucucagggagccggguggagccucagggagaccgcaugccugggcaaguccuacgcccagauguggagccugauguauuuucaucggcgcgaccuccggcuggccgcgaacgccaucugcuccgccgugcccagccacuggguucccaccuccaggacuaccuggagcaugcacgcgaagcacgaauggaugaccacagaggacaugcugaccguuuggaacagaguguggauccgcgagaauccuuggauggaagacaagacgcccguggaaucaugggaggagauucccuaccucggcaagcgggaggaccaguggugcgguuccuuaaucggccugacuucccgcgccacaugggcgaagaacauccaggccgccaucaaccagguccggagccucaucggaaacgaggaauacaccgacuauaugccguccaugaagcgcuuccggcgcgaggaggaggaggccggagugcucugguga

SEQ ID NO: 25467 - RNA, 9876 nt, Artificial Sequence
  derived and/or modified CDS sequence (opt11) from DENV-2__FM210238__SS-prME
acggccggcaugaucaucaugcuaauccccaccgccauggcguuucaccucaccacccgcaacggggagccccacaugaucgugggccggcaggaaaagggcaagagccuccuguucaagaccgaagacggagugaacauguguacgcucauggccauagaccugggggaguuaugcgaggacaccauaacauacaaaugccccuuacugcgacagaacgaaccugaggacaucgacugcuggugcaacagcaccagcaccugggugacauacgggacuugcaccaccacgggugagcaucggcgcgagaagcggucaguagcccuggugccccacguggggauggggcucgagacgcgcaccgagaccuggaugagcagcgagggggccuggaagcaugcccagcggauugagaccuggaucuuacgacacccgggcuucaccaucauggcggcaauccuggccuacaccguagggaccacucacuuucagcgggcccucaucuucauucugcuggccgcggucgccccuagcaugacuaugcgcugcauaggaaucuccaacagggauuucgucgagggcgugagcgggggcuccugggucgacaucgugcucgagcaugggucgugcgugaccaccauggccaaaaauaagcccacgcuggacuucgagcugauaaagaccgaagccaagcagcccgccacccuccgcaaguacugcaucgaggcaaagcugaccaacacgaccaccgagucccggugcccgacucagggcgagccuagccuaaacgaggagcaagacaagagguuugucuguaagcacaguaugguggaccggggcugggggaacggcugcgggcuguucggcaagggcgggaucgugacgugugccauguucacauguaagaagaacauggagggcaagaucguccagcccgaaaaccuggaguacacgaucguuauuaccccccauagcggcgaggagcacgccguaggcaacgacacggggaagcacggaaaggaaaucaagaucaccccgcaguccccgaucaccgaggcggagcugaccggguacggaaccgugaccauggaguguucaccccgaacgggcuuggacuuuaaugaaauggugcugcugcaaauggaggacaaggcguggcugguucaucggcagugguuccuggaccugccccucccgugguugcccggagcugacacucagggcaguaacuggauccaaaaggagacccuuguuacguucaaaaacccccacgcgaaaaagcaggaugucguaguccucgguagccaggagggcgcgaugcauacggcccugaccggggcgacugagauccagauguccagcggcaaucucuuguucacgggccaccugaagugccgccuucguauggacaagcuccaacugaaggggaugagcuacaguaugugcaccggcaaguucaaaauagugaaggagaucgccgagacccagcacggcaccaucgucaucagagugcaguacgagggcgacggcucacccugcaagaucccguuugagauaauggaccucgaaaagcggcacguucucgggcgccugaucacggucaaccccauugugaccgagaaggacagucccgugaacaucgaggccgaaccaccguucggcgauagcuacaucauaaucggggucgagcccggccagcugaagcucaacugguuuaagaaggggucuagcaucggccagauguucgagaccaccaugagaggagccaagcggauggccauccugggugacaccgccugggacuucggcucccucggggggguguucacgagcaucgguaaggcccuccaccagguauuuggggccaucuacggugcagcauucuccggggucagcuggacgaugaaaaucuuaaucggcgugauuauuaccuggauagggaugaacucccgcagcacgucccugucggugucacugguccuugugggggugauuacccuguaccuuggggccaugguucaggccgacagugggugcguaguguccuggaagaacaaagagcucaagugcgguagugguauauucaucacggacaacguccauaccuggacggagcaguacaaguuccagcccgagagucccagcaagcuggccucugccauucagaaggcucacgaggaagggaucugcgggauccggucugugacccgccuggagaaucucauguggaagcagaucaccccggagcucaaccacauccuaagcgagaaugaggugaagcucaccauuaugaccggagacaucaaggggaucaugcaggccggcaagcggucccugaggccccagcccaccgagcugaaauacagcuggaagaccuggggcaaggccaagaugcucuccaccgagucacacaaccagacguuccugaucgacgguccggagaccgccgaguguccgaacaccaaccgggcauggaacagucuggaggucgaggacuaugguuucggaguguucaccacaaacaucuggcucaagcugcgcgagaagcaggacguguuuugcgacuccaaguugaugagugcggccauaaaagacaaucgagcaguccacgccgacaugggcuacuggauugaaagugccuugaacgacaccuggaagauggagaaggcgaguuuuaucgagguaaagagcugccacuggcccaagucccacacccuguggagcaacggcguguuggaguccgagaugaucauccccaagucuuucgcugggcccgugucccaacauaauuaccgucccggcuacuacacccagaccgcggggcccuggcaccucggaaaauuagaaauggacuucgacuucugcgaggggacgaccgugguggucaccgaggacugcggcaaucggggcccuucacugcguacgacgacagccagcgggaaacuuaucaccgaguggugcugccggaguugcacccuacccccccugcgcuaucgcggcgaggacgggugcugguacggcauggaaauacgcccccucaaggaaaaggaggagaaccuggugaacagccuggugaccgcggggcacggccaaaucgacaacuucucccucggcguccuggggauggcccuguuucucgaggagaugcugagaacccgcgugggcaccaagcacgccauacugcucgugaccgucagcuucgugacgcugaucacggggaacauguccuucagagaucugggccgcgugaugguuauggugggggccgccaugaccgacgacaucggcaugggcgugaccuaccucgcgcugcucgcggcauucaaaguccgccccacguucgccgccggccuccugcugcggaagcucacaucaaaggaacucaugauggccaccaucgguaucgcccugcucucccagagcaccaucccggaaacaauccuggaguuaacagacgcccucgcccuggggaugaugguccuuaaaauuguccgcaauauggagaaguaucagcucgccgucacuauuauggcgaucuccugugugcccaacgcagugaucuugcaaaaugcauggaagguaagcugcaccauccuggccgcgguguccgugagcccucuacugcugacuucuagccagcagaaggccgacuggaucccgcucgcccugaccaucaagggucugaauccgaccgcaauauuccucaccacgcugaguaggaccagcaaaaagcgcuccuggccccugaacgaggccaucauggcgguugguaugguguccauacuagcuucuucacugcugaaaaacgacauccccaugacggggccgcucgucgccggcggucuuuuaaccguguguuacguauugacgggccggagcgccgaccuggagcuggagcgcgccaccgacgucaagugggaggaccaggcggagaucuccgggagcucaccgaucuuaaguaucacaaucgccgaggacggcucaaugagcauaaagaacgaggaggaggagcagacccuaacgauccuaauccggaccggccuccuggugaucuccgggcuguuccccgucagcauccccaucaccgccgccgccugguaccucugggaggucaagaagcagcgcgcgggcguauugugggacguccccucgccgccccccgucgggaaggccgagcuggaggacggcgccuaccggaucaaacagaaggggauacuaggcuacagccagaucggcgccggggucuauaaggagggcaccuuccacaccauguggcacguaacgcgcggagcgguucugaugcaccgugggaagcgcaucgagccgaguugggcggacgucaaaaaggaccugaucagcuacggaggcggcuggaaacuagagggggaauggaaggagggcgaggaggugcagguacuggcccuggagcccgggaagaacccucgggccgugcagaccaaacccggguuguuuaagaccaacacugggacaauaggcgccgugucccuagauuucaguccggguaccuccgggagccccaucgucgacagaaaggggaaagucguggggcuguacggcaacggcguugucacacgguccggggcguacgugagcgccaucgcacagaccgagaagucuauagaggacaaccccgagaucgaggacgacauuuuccgcaagaagcggcucacgaucauggaccuccaucccggagccgggaagaccaaacgguaccugccugccaucgugcgggaggcgauuaagcgcgggcugcggaccuuaauccuggcccccacgcgcgugguggccgccgagauggaggaggcccugcgaggacuccccauccgguaccaaaccccugcgaucagggcggagcacacgggccgggaaaucgucgacuugaugugccacgcuaccuuuaccaugcgccugcuuagcccggugcggguucccaacuauaauuugaucaucauggacgaggcccauuucacggaccccgccagcaucgcggccagagguuauaucuccacucgggucgagaugggggaggccgccggcauauucaugaccgccacgccucccgggagccgcgaccccuucccccaguccaacgcccccaucauggacgaggaacgggaaauccccgagcgcagcuggaacuccggccacgaauggguuaccgacuucaaggggaagaccgugugguucguuccguccauaaaggccgguaaugacaucgcugcgugucugcggaagaacggcaaaaaagugauccaacucucccgaaagaccuucgacagcgaguaugugaaaacccggacgaacgacugggacuucgucgugaccaccgacaucucagagaugggggcaaacuucaaagccgagcgcgucauugauccccggcgcugcaugaagcccgucauacugaccgacggcgaagaacgggugauucuggcggguccgaugccugugacgcacucaagugccgcccagcgcaggggccgcauugggcgcaauccaaagaacgagaacgaccaguacaucuacaugggcgagccccucgagaaugacgaggacugcgcgcacuggaaggaggccaagaugcugcuggauaauaucaauaccccggaagggauuauucccagcauguucgagccagagcgggagaaagucgacgccaucgacggugaguaccgccuccggggagaggcccgcaagacauucguggaccugaugcggcgcggugaccugccgguguggcucgcuuacagagucgcggccgagggcaucaacuacgccgaccgccgguggugcuucgauggggugaagaacgaccagauccuggaagagaacguggaggucgagaucuggacgaaggaaggcgagcgcaaaaagcugaagccucgguggcucgacgcccgcaucuacuccgacccccuggcucugaaggaguucaaggaguucgccgccggccgcaagucgcugacgcugaaccuaaucaccgagauggggcgccuacccaccuucaugacccagaaggccagggacgcccuggauaaucuugccgugcuccacacggccgaggcgggcgggcgcgccuacaaccacgcauugagcgagcugccagagaccuuggaaacccuccugcuccugacccugcucgccacgguuaccggcggcaucuucuuguuucuaaugagcgguaagggcgucgggaaaaugacccucggcaugugcuguaucaucaccgcauccauccugcugugguacgcccagauccaaccccacuggauagccgccagcaucauccuugaguucuuccucaucgugcugcucauccccgagccggaaaagcaacggaccccgcaggacaaccagcuaaccuacgucgucaucgcgauccuuacgguugucgcagcuacuauggcgaacgagauggguuuccucgagaagacuaagaaggaccugggcuuaggcuccaucgccacgcaggagcccgaaaguaacauacucgauaucgaccugcgccccgcgagcgccuggaccuuguacgccguggcaaccaccuuugugacgcccaugcugcggcacuccaucgaaaacucuuccgucaacgugucucugacagcgauugccaaucaagcaaccgugcuaaugggguugggcaagggcuggccgcuguccaagauggauaucggcguuccucugcucgccaucgggugcuacagccaggugaaccccaucacccuuacggccgcacuucuccugcugguggcccacuacgccauuaucggccccggccuccaggccaaggccacccgugaggcgcagaaacgggccgccgccgggaucaugaagaacccgacugucgacggcaucaccgugauagaccuggauccuauccccuacgacccuaaguucgagaagcagcugggucagguuaugcuccugauccugugugucacacaagugcucaugaugcgaaccaccugggcucugugugaggcucucaccuuggccacgggaccaauauccacucugugggaggggaaucccggccgcuuuuggaacaccaccauagccgugagcauggcaaacauuuuucggggcucuuaccuggcgggugccggccuccuguucagcaucaugaagaacacgaccaacacgcgccggggcaccggaaacauaggagaaacgcuuggggagaaauggaagucccgucuuaacgcguugggcaagagcgaguuucaaauuuacaagaagucagggauccaggaggucgaucggacccuggcuaaagaggguaucaaacgcggugaaaccgaccaccaugcuguaucgcggggcagcgcgaagcuccgcugguucguggagcgaaacauggucacucccgagggcaaggucguggaccuggggugcggccgcgggggcuggagcuacuauugcgggggccugaagaacguccgggaggugaagggccucacgaagggcgggcccgggcacgaggagccgaucccuauguccaccuacggauggaaccuggugcgccugcagagcggcgucgacguguucuucacgccgccggagaaaugcgacacccuguuaugcgacauaggcgaaucuagcccgaacccgaccaucgaggcuggccggacccugcgcgugcuaagccugguugagaacuggcugaacaacgauacucaauucuguauaaaaguauugaaucccuacaugccgucagucaucgagaagauggagacacugcagcggaaauacgggggcgcacugguccgcaauccccugucccggaacuccacccacgagauguacugggugagcaacgccacugggaauaucgugucuagcgucaacaugaucuccaggaugcucaucaaccgguucaccaugaagcauaagaaagccaccuacgaaccagauguggaccugggcagcgggacccggaacauagguauugaauccgagaucccuaaccucgacauaaucggcaaacgcaucgagaaaauaaagcaggagcacgagacgagcuggcauuaugaucaggaccacccguacaagacuugggcuuaccauggguccuacgagacaaagcaaaccgguuccgccucaagcauggugaaugggguggugcggcuccugacgaaaccaugggacguggucccgaugguaacccaaauggcuaugaccgacaccacgcccuucggccagcagcgcguguuuaaggagaagguagauacccgcacucaggaaccgaaggaaggcaccaaaaagcugaugaagauaacggcggaguggcucuggaaagagcuggggaagaagaagacgccucggaugugcacccgggaggaguucacccgcaagguacggucuaacgccgcgcucggcgccaucuucacggacgaaaacaaguggaagagugcccgcgaggccguggaggacucccgguucugggaacuugucgacaaggagcgcaaccuccacuuggaggggaagugcgagacgugcguauacaacaugaugggcaaacgggagaaaaagcucggggaguucggcaaagcgaagggcagccgugccauaugguacauguggcugggggcacgguuccuggaauucgaggcccugggcuuccugaacgaagaccacugguucucccgcgagaacucgcuaagcgggguggagggcgaggggcuccacaaacugggcuacauccuucgggacgucuccaagaaagagggcggggcgauguacgcggacgauaccgccggcugggacacacgcaucacucucgaggaccugaagaaugaggagauggugaccaaccacauggagggugagcacaaaaagcuggccgaagcaaucuucaagcucacauaccaaaacaaggucgucagggugcagcgcccuacgccucggggcacggucauggauaucaucaguagacgggaccagcgcgguuccgggcaagucggcacuuacgggcugaacaccuuuaccaacauggaggcccagcugaucagacaaauggagggcgagggaguuuucaagucuauccagcggcuaaccgucacagaggagauugcggugcagaacugguuagcccgcgugggccgggagcgccugucccggauggccaucagcggcgacgacugugucgugaagccacuggacgaccgcuucgccuccgcccucaccgcgcugaacgacauggggaaaguucggaaggacauccagcagugggagcccagccgaggauggaacgacuggacccagguccccuucugcucccaccacuuccacgaguugaucaugaaggacggacgagugcuggugguccccugccgcaaccaggacgagcugaucggccgggcccgcauuagccagggggcuggguggucccucaaggagaccgccuguuugggcaagagcuacgcccagauguggucucugauguacuuccaucggcgcgaccuccggcuggcggcgaacgcgaucugcagcgcggugccgagccacugggugccgaccagccgcaccacuugguccauccaugcgaagcacgaguggaugaccacggaggacaugcugaccguuuggaaccggguguggauucaggagaaccccuggauggaggacaagacccccguugaaucaugggaggaggucccuuauuuggguaagcgcgaggaccaguggugcgguagccuuaucgggcugaccucacgggccacgugggccaaaaacauccaaaccgccaucaaccaagugcgcagccuuauaggcaaugaggaauacaccgacuacaugcccuccaugaagcgcuuccggagggaagaggaggaggccggggugcugugguga

SEQ ID NO: 25468 - RNA, 9876 nt, Artificial Sequence
  derived and/or modified CDS sequence (opt11) from DENV-2__FM210224__SS-prME
accgcgggcgugaucaucaugcugauccccaccgccauggcauuccaccucaccacacgcaacggcgagccccacaugauaguaggacggcaggagaaggggaagucccuacuguucaagaccgaggacggcgugaauauguguacccucauggccaucgaccugggggagcugugcgaagacacaaucaccuauaagugcccccuccugaggcagaaugaacccgaggacauagacugcuggugcaacagcaccagcacuugggugacuuacgggaccugcacuacuacgggcgagcaccggagagagaagcggagugucgcccuggugccccacguggggauggggcucgagacccggaccgagacuuggaugagcuccgagggagccuggaagcaugcgcagcggauugaaacauggauucugcgccaccccggcuucaccaucauggcggcgauccuggccuauaccaucggcaccacgcacuuccagcgggcucucaucuucauccugcuuaccgcgguggcgcccagcaugacaaugcgcugcaucggaaucucuaaccgggacuucguggagggcgugucugggggcuccugggucgacauagugcucgagcacgggagcugugugaccacgauggccaagaauaagccuacccuggacuucgagcucaucaaaacagaagcgaagcagccugcaaccuugaggaaguacuguaucgaggcgaaguuaacgaacaccacaaccgagucccgcuguccgacgcagggcgagcccagccugaacgaggagcaggacaaaagauucguuugcaagcauuccaugguagaccgcggaugggggaacgguugcggauuauucggcaagggcggcaucguaaccugugccauguucacgugcaagaagaacauggagggcaagaucguucaacccgagaaccuggaauauacaaucgucauaacgccucacagcggggaagagcacgccgugggaaacgacacugggaagcacggcaaggaaauuaagaucaccccgcaguccagcaucacggaggcugagcugaccggguacggcaccgucaccauggagugcaguccccgaaccggccuugacuuuaacgaaaugguacugcuacagauggaggacaaggccuggcucguccaccggcagugguucuuggaccugccccuuccguggcuaccgggggcggauacucagggcaguaacuggauccagaaggagacgcugguuacguuuaagaacccucacgccaagaagcaggacguggugguguuagggucacaagagggggcaaugcauaccgcgcugacuggcgccacagagauccagaugagcagcggcaaccuccuguucaccggccaccugaagugccgccugcggauggacaagcuccaacugaaagggauguccuauuccaugugcacugggaaguucaagaucgugaaggagaucgcggagacgcagcacgggacuaucgucauccgcguacaguacgagggggacgguucccccugcaagauccccuucgagaucauggaccuggagaagcggcauguccucggacgccugauaaccguuaacccgauugugacugagaaggauagccccgugaacaucgaggcagagccgcccuucggcgacuccuauaucauaaucggggucgagccaggccagcugaagcucaacugguucaagaaggggagcuccaucggccagauguuugagaccacgaugcgcggcgcaaagaggauggccauccugggggacaccgccugggacuucggcagcuuaggcgggguguucaccucgaucgggaaggcguugcaucaaguuuucggggcuaucuacggcgccgcguucuccgguguaaguuggaccaugaagauccugaucggcgcgaucaucacguggaucgguaugaacaguagaagcaccagccuguccguaagcuugguucucguuggugugauuacccuguaccuaggggccauggugcaggccgacuccggaugugucgucaguuggaagaauaaggagcucaaguguggcagcgggaucuucauuaccgacaacguucauacuuggacugagcaguauaaguuccagcccgagucacccagcaaguuggccuccgccauccaaaaggcgcacgaagagggcaucugcggaauacggagcgucacccgcuuggagaacuuaauguggaagcagaucacacccgagcugaaccacauccuguccgagaaugaggugaaguugaccaucaugaccggcgacaucaaaggaaucaugcaggccggcaagcgaagccugcgcccucaacccaccgagcugaaguacucauggaagacguggggaaaggccaagaugcuuucgacagaaucucacaaccagaccuuucuuauugacgggcccgagacagccgaauguccgaacaccaaccgagcuuggaacucucuggagguggaggacuacggcuucggggucuuuacgaccaacaucuggcugaagcugcgcgagaagcaggacgucuucugugacuccaaacuaaugagcgcggccaucaaggacaaccgcgccgugcacgccgacaugggauauuggaucgaguccgcccucaacgacaccuggaagauggagaaggcgagcuucauugaggucaaaucuugccacuggcccaagagccacacgcuauggagcaacggcguucuggagagcgaaaugaucauccccaaguccuuugccggaccggugagucagcacaacuaccgcccggguuauuacacacagacggccgggcccuggcaccucggcaagcuggagauggacuuugacuucugcgaggggacgaccguuguggugaccgaagauugcggcaaccggggccccagucugaggacaaccaccgcuuccgggaaguugaucaccgaaugguguugccgauccugcacguugcccccgcugcgcuaccggggcgaggaugggugcugguacggcauggaaauccgcccccucaaggagaaggaggagaaccucguaaacuccuuagugaccgcugggcauggucagaucgacaacuucagccucggcguccuggggauggcccucuuccucgaggagaugcuucggacccgcgucggcacuaaacaugccaucuuauuaguagcgguguccuucgugacucugaucacggggaauaugagcuuccgggaccuaggacgcgugauggugauggucggugccacuaugaccgaugacaucggcaugggcguaacguaccuagcgcuguuagcagcguucaaggugcgcccaaccuuugcggcggggcuccugcugcggaagcucaccucaaaggagcuaaugauggcuaccaucggcaucgcgcuucucagucaguccacgauccccgagaccauccucgaacuaaccgacgcccucgcacuggggaugaugguccugaagaucguucgcaacauggagaaguaccagcucgccgucaccaucauggccaucagcugcgucccuaacgcagugaucuuacaaaacgccuggaagguguccugcacgauccuggccgcggucucagucagcccccuucugcugaccagcagccagcagaaggccgacuggaucccgcucgcccugacuauuaagggacugaacccuaccgccaucuuccucacgacccugagcagaacaagcaaaaagcgcucuuggccucugaaugaagccaucauggcggugggcauggucucaaucuuagccagcucucuguugaagaacgauauccccaugaccgggccccugguggccggcggacugcucacggugugcuacgugcucaccggccggucggcggaccuggaguuagagcgcgccacagacgugaagugggaagaccaggcggagaucagcggguccagcccuauccucuccauaaccaucagcgaggacgguuccaugagcaucaaaaacgaagaggaggagcaaacgcugacgauccugauccgaaccggccuccuggucauaucggggcuguucccgguuucaauccccaucacugcggcggcaugguaucucugggaggugaagaagcagcgcgcaggcguccugugggacgugcccagcccaccgccuguugggaaggcggaacuggaggacggcgccuaccgaaucaagcagaaggguaucuugggcuacucacagaucggggccggugucuauaaggagggcaccuuccacacaauguggcacgugacccgcggggccgugcugaugcaccggggcaagcgcauagagcccaguugggccgaugucaaaaaggaccugauaagcuacgggggcggcuggaagcucgagggggaguggaaggaaggcgaggagguccaagugcuggcucuggagccggggaaaaacccgcgggcaguccagaccaagcccggccucuucaaaaccaacacagggacaaucggcgccguaucccuggacuuuaguccgggaacgucuggaucaccgauuguggacagaaaaggcaaagucgugggguuguaugggaacggcgugguaacccgguccggcgccuaugugagcgcgauagcgcagacugagaaguccaucgaggacaaccccgagaucgaggacgacaucuuccgcaagaaacggcucacgaucauggaucugcaccccggcgccgggaagaccaagcgcuaccugcccgccauugugcgggaggccauaaagcggggccugcgaacgcucauucuggcgccgacgcgcgucguugccgccgagauggaagaggcacugcgagggcuccccaucagguaccaaacccccgccauccgcgcagagcauaccggccgcgagaucguagaccugaugugucaugccaccuucacgaugcgcuuacucucgcccgugcgggugccgaacuacaaucugaucaucauggacgaagcccacuuuaccgacccggccagcaucgccgcucgcggcuacaucuccacccgaguggagaugggggaggccgcgggcaucuucaugaccgccacuccgcccggcagccgcgacccguucccccaguccaacgcgcccaucaucgacgaggagcgggagaucccugagagaagcuggaacucgggccacgaguggguaaccgacuucaaggggaagacagugugguucgugccgaguaucaaggccgggaacgacauagccgccugccugcggaaaaacgguaagaaggucauccagcucucccgcaagacauucgacagcgaguacgucaagacccggacaaaugacugggacuucguggucaccaccgacaucuccgagaugggggccaacuucaaggcggagcgcguaauugacccacgucgcugcaugaagcccgugauacugacggacggcgaagaacgggucauucuggcagggcccaugccggucacccauuccagcgcagcgcaacgccggggacgcaucggccgcaaccccaaaaaugagaacgaccaguacauauacaugggcgaaccucucgagaaugacgaggacugcgcccacuggaaggaagcuaagaugcugcuggacaacaucaauacaccugagggcaucauacccagcauguucgagcccgagagggagaaagucgacgccaucgacggggaguaccggcuccggggagaggcucgcaagaccuucgucgaucugaugcggcgcggggaucugcccguguggcuggccuaucggguggccgcggagggcaucaacuacgcagaccguagauggugcuucgacggggccaagaacaaccagauccuggaggaaaacgucgagguggaaaucuggacaaaagagggggagcggaagaagcugaagccccggugguuagacgcgcguaucuacuccgacccccucgcgcuaaaggaguucaaggaguucgccgcuggccggaagagucugacccugaaccugaucaccgagauggggcgccuccccaccuuuaugacccagaaggcccgagacgcgcuggacaacuuagcggugcuccacacagccgaggccggcgggcgcgccuacaaccacgcccuguccgagcucccugagacccucgagacccugcuucuccugacgcuguuagcgaccguuaccggcggcauauuccuguuccugaugagcgggaagggcgugggcaagaugacccuuggcaugugcugcaucaucaccgccagcauccuccugugguacgcccagauccagccgcacuggauugccgccagcaucauauuggaguucuuccugaucgugcuacucauucccgagccugagaagcaacgaacgccccaggauaaucaguugacauacguugugauagcgauacugaccgucgucgccgccaccauggcgaacgagaugggguuucucgaaaaaacuaaaaaggaccugggccuaggcagcaucgccacccaggaaccggaguccaacauccucgacaucgaccugcgaccagcgagcgcguggacccuguacgccguggccacaacauucgucacccccaugcuccggcacuccaucgagaacagcuccguuaacgugagcuugaccgcgauugcaaaccaggccaccguccuaaugggauugggcaagggauggcccuuauccaagauggacaucggcgugccgcugcucgccaucgggugcuauagccaagucaacccuaucacucugaccgccgcauugcuccugcugaucgcccacuacgccaucaucggccccggucuacaggccaaggccacccgcgaggcgcagaagcgggccgccgccgggauuaugaagaaucccacgguugacggcaucacggugaucgaccuugacccgauccccuacgaccccaaguucgagaagcagcugggccaggugaugcuccuuauccugugcguuacccaagugcucaugaugcggaccaccugggcacuaugcgaggcgcugacgcuagccacgggccccaucuccacccugugggaggguaacccgggccgcuucuggaacaccacgauagccguuagcauggcuaacaucuuccgcgguuccuaucuugcgggagccgggcuccuguuuucaauuaugaagaacaccacuaacaccaggcgaggaaccggcaacaucggagagacccugggggagaaauggaaguccagacucaacgcccugggcaagagugaguuccagaucuacaagaaguccgggauccaggaggucgaucggacccuggcaaaggagggcauaaagcgcggggagaccgaccaccacgcggugagccggggcuccgcgaagcuccgcugguuuguggagcggaacauggucacgcccgagggcaagguggucgaucugggcugcgguagggggggcuggucguacuacugcgguggccugaagaauguccgggagguuaagggacuuaccaagggaggccccgggcacgaggagcccaucccgauguccaccuacggcuggaaucuggugcgacugcagagcggcgucgacguguucuucacgccgcccgagaagugugauacguugcuuugcgauaucggagagagcucgccuaacccaacuaucgaggccggcagaacucugcgagugcugagccugguugagaacuggcugaacaacgauacgcaauucugcaucaaaguccucaaccccuacaugcccuccgugaucgagaaaauggagacccuccagcgaaaguacggcggcgcacugguccgcaauccgcugagccggaacuccacccacgagauguacugggugagcaacgccacuggaaacaucgucuccagugucaacaugaucucccgcaugcucauuaaccgguucacuaugaagcacaaaaaagccaccuacgagcccgaugucgacuugggcagcgggacgcgcaacauagggaucgaguccgagauccccaaccuggacaucaucggcaagcgcaucgagaaaaucaagcaggagcacgagaccagcuggcacuaugaccaggaccaucccuacaagaccugggcguaccacggauccuacgagaccaaacaaacgggcagcgccucgucgauggugaacgggguaguaagacugcuuacaaagccaugggacgucguccccauggugacccagauggcaaugaccgacacgaccccauucggccagcagcgcguguucaaggagaaggucgacacucggacucaggagcccaaagagggcacgaagaagcugaugaagaucaccgccgaguggcuuuggaaggaauuagguaaaaagaagacaccucgcaugugcacccgcgaggaauucacgcgcaaagugagauccaacgccgcgcugggugccauuuucaccgacgagaacaaauggaagagugcucgcgaggccguggaggacagucgauucugggagcucgucgauaaggagcgcaaccugcaccuggaggggaagugcgagaccuguguguacaauaugaugggcaagcgggaaaagaaacugggggaguucggcaaggcgaagggcagccgagcgaucugguacauguggcugggugcccgguuccuggaguucgaggccuugggcuuccugaaugaggaccacugguuuagccgcgagaacucccugagcgggguggaaggcgaaggguuacacaaacucggcuacauccugcgggacgucuccaaaaaggaaggcggggccauguacgcggaugacaccgccggaugggacacgcgcaucacuuuggaggaccugaagaaugaagagauggugaccaaccacauggaaggggagcauaaacggcuggcagaggccauuuuuaaguugacguaucagaacaaggugguccgcguccagcggcccacaccccgcggcacggucauggacauuauuucuagaagagaucagcguggguccggccagguaggcaccuacgggcucaauaccuucaccaacauggaggcccaacuaauucgccaaauggagggagaagguaucuucaagucaauccagcaccuaaccgugaccgaggaaaucgcaguccaaaacuggcucgcgcgcgugggccgggagcgccugucccggauggccauaagcggcgacgacugcguugucaagccgcuggacgaucguuucgccuccgcccugaccgcccugaacgauauggggaaggugcggaaggauauccagcagugggaaccgaguaagggcuggaacgacuggacccaagugcccuucugcucacaccacuuccacgagcucaucaugaaggauggccgcgucuugguagugcccugccggaaucaggacgagcuaaucggcagagcccggaucagccaaggcgccggguggucccuuaaggagacagccugccugggcaagaguuaugcccagauguggucacugauguacuuccaccgcagagaucuccgccuagcggccaacgccaucugcagcgcugugcccucccacugggugccgaccucacgaaccaccuggagcauccacgcgaagcacgaguggaugacgaccgaggacaugcugaccguguggaaccgcgucuggauccaagagaaccccuggauggaggacaagacccccguggagucuugggaagaggugcccuaccucgggaaacgcgaggaccaauggugcggcagccugaucgggcugacgucccgggccaccugggcaaagaauauccagaccgcgaucaaucagguccggagccuuaucggcaaugaggaguauaccgauuauaugcccuccaugaagcgcuuccgccgggaggaggaggaggccggcguccugugguga

SEQ ID NO: 25469 - RNA, 9876 nt, Artificial Sequence
  derived and/or modified CDS sequence (opt11) from DENV-2__FM210225__SS-prME
accgccggcgugaucaucaugcugauacccaccgcgauggcguuccaucucaccacccgcaacggggagccccacaugauugugggccggcaggagaaggggaagagccugcuguucaagaccgaggacggcgugaacaugugcacccucauggccaucgaccugggggagcugugcgaggacaccauaacuuacaagugcccccuccugcgccagaaugaacccgaggacaucgacugcuggugcaacagcaccagcacuugggugacguacgggaccugcaccaccacgggcgagcaccggcgcgagaagcguagugucgcccugguaccgcacguggggaugggccucgagacccgcaccgagaccuggaugagcuccgagggagccuggaagcacgcccaacgaauugagacguggaucuuacgccaccccggcuucaccaucauggccgccauccuggccuacaccaucgggaccacgcacuuccagcgggcccucauauucauccugcugaccgcggucgcccccagcaugaccaugcgcugcaucggcauuuccaaccgcgacuuuguggagggcguaaguggaggcucaugggucgacauagugcuagagcacgggagcugcgugaccacgauggcgaagaacaagcccacccuggacuuugagcugauaaagaccgaagcaaagcagcccgccacccuccgcaaguacugcaucgaggcgaagcugacgaacaccaccacagaaucccggugcccgacgcagggcgagcccagccugaacgaggagcaggacaagcgcuucgucugcaaacacuccaugguggaccggggaugggggaauggcugcgggcuguucggaaagggugggaucgugacuugcgccauguucacgugcaaaaagaacauggagggcaagaucguccagcccgagaaccuggaguauaccauagugaucaccccacacagcggggaagagcacgccgugggcaacgacaccggcaagcacggcaaagagaucaagaucaccccgcagucgagcaucaccgaggccgagcugacgggguacggcacgguuaccauggagugcucgccccgcaccggccucgacuucaacgagauggugcugcugcagauggaggacaaggccuggcucgugcaccggcagugguuccuggaucugccccuccccuggcugcccggggcagacacccagggcagcaauuggauacagaaagagacauuagucacauucaagaauccccacgccaagaagcaggacguggugguacucgggucccaggagggcgcgaugcauaccgcccugaccggugccacggaaauccagaugagcagcggcaaucucuuguucacgggccaccugaagugccgccugcggauggauaagcuccaacugaaggggauguccuauucgauguguaccggcaaguucaagaucgugaaggagaucgcggagacccagcacgggacgaucgucauccgcgugcaguacgagggcgacggcucccccugcaagauucccuucgaaaucauggaccuggagaagcggcacgugcuugggcgccugaucaccgucaacccgauagugaccgagaaagacagccccgugaacaucgaggccgaaccgcccuuuggcgacucguacaucaucauaggugucgagcccggccagcucaagcucaacugguucaagaagggaagcuccaucgggcagauguucgagaccacgaugcgcggcgccaagcgaauggccauccuuggagacaccgccugggacuucggcucauuagggggcgucuucaccuccaucgggaaggcgcuccaccagguguucggcgccaucuacggcgccgccuucagcggcgucuccuggaccaugaagauccugaucggcgcgaucauaacguggaucgggaugaacagccgcuccaccagccuauccguuagccuggugcucgucggcgugaucacccuguaccugggggccauggugcaagcggacuccggcugcguugugucguggaagaacaaggaacucaagugcggcagugggaucuucaucacagauaacgugcauacguggaccgagcaguacaaguuucagccugagaguccaagcaagcuugcuucugccauccaaaaggcgcacgaggaggguaucugcgggauccggagcgugaccagacuggagaaccucauguggaagcaaaucaccccugagcugaaccacauccugagcgagaacgaggugaagcucacaaucaugacuggcgacaucaaagguaucaugcaagccggcaagcggagccugagaccacagcccacggagcugaaguacuccuggaagaccuggggcaaggcuaagaugcucagcacugagucccacaaccagaccuuccugaucgacggcccagagacagcugagugcccaaacaccaaccgggccuggaacagccuggagguggaggacuauggauucgggguuuucacgaccaacaucuggcucaaacugcgcgaaaagcaggacguguucugcgacucuaagcugaugagcgcggccaucaaggauaaccgggccgugcacgccgacaugggcuacuggaucgaguccgccuugaacgacaccuggaagauggagaaggcgagcuucaucgaggucaaguccugccauuggcccaaaagccacacucuguggucgaacggagugcuggagagcgaaaugaucauccccaaauccuucgccgggccgguaucccagcacaacuaccguccgggcuacuacacccagacggccgggcccuggcaccucggcaagcuggagauggauuucgauuucugcgaagggaccaccgucgugguaaccgaggacuguggcaaccggggccccagccugcgcacgaccaccgccuccgggaagcucaucaccgaguggugcugccggucgugcacgcugccgccgcugcgcuaccggggcgaggacgggugcugguauggcauggagauccggccacucaaagagaaggaggagaaccuggucaacucccuggugaccgcggggcacggccagaucgacaacuucagccuaggcgugcuggggauggcauuguuucucgaggagaugcugcggacccgcgucggaaccaagcacgccauucugcucguggccguguccuucgucacgcugaucaccgguaacaugucguuccgcgaccuggggcgcgugauggugauggucggggccaccaugaccgacgacaucggcaugggcgucacguaucucgcgcugcuugcagccuucaaagugagacccaccuucgccgccgggcuccuucugcggaagcucaccuccaaagagcugaugauggcuacuauuggaaucgcccugcucagccaguccacgauccccgagaccauccuugagcugaccgacgcucucgcccuagggaugauggucuugaagauagugcgcaacauggagaaauaucagcucgccgugaccaucauggcuauuagcugcguccccaacgccguuauccugcaaaacgcuuggaaggugaguuguacgauccuggccgcggucagcgugagcccccuccuguugaccagcucccagcagaaggccgacuggaucccacucgcccugaccauaaagggccugaaucccaccgcgaucuuccucacgacacugagccggaccucuaagaagcgcagcuggccgcugaacgaggccaucauggcggugggcaugguguccauccucgccucuagcuuacugaagaaugacaucccgaugaccgguccccuaguggccggcgggcugcugacggucugcuacgugcucaccggccggagugccgaccucgagcuggagcgcgccaccgaugugaagugggaagaccaggcugagaucucgggcuccucccccauccucuccauaaccaucagcgaggacggcuccaugucaaucaagaacgaagaggaggagcagacgcugaccauccucauccggaccggccucuuaguaaucuccgggcuguuuccggugaguaucccuaucacugcggccgccugguaccucugggaggugaagaagcagcgugcuggcguccugugggacguacccagcccgccgcccguggggaaggcggagcuggaggauggcgcuuaccggaucaagcagaaggggauccucgguuacagucagaucggcgcgggggucuacaaggaaggcaccuuccacacgauguggcaugugacccgcggggccguccugaugcaccggggcaagcgcaucgagcccuccugggccgacgucaagaaggaccugaucagcuacgggggcggcuggaagcucgagggagaguggaaggagggcgaggagguccagguccuagcacuggagccugggaagaacccccgggccguccaaacuaagcccggccucuucaagacuaacacggggaccaucggcgccgugucccuggacuucagcccaggcaccuccgggagccccaucguggaccgcaagggcaaggucgugggccuguacggcaacggcgugguaacgcgguccggggccuacgugagcgcgaucgcccagaccgagaaguccaucgaggacaaccccgagaucgaggacgauaucuuccgcaagaaacggcucaccaucauggaucugcaccccggcgccgggaagaccaagagauaccugcccgccaucgugcgggaggcgaucaagcgcggccugcggacccucauccuggcgccgacgcgcguuguggccgccgagauggaggaggcccuacgcggucuccccaucagguaccagacccccgccauccgcgcggagcacaccggacgggagaucguggaccuuaugugccacgccaccuuuacgaugcgccugcucucgccgguacgagugccgaacuacaacuuaauaaucauggacgaagcccacuucaccgaccccgccagcaucgccgcgcgugguuacaucuccacucggguagagaugggggaggcagccggcaucuucaugaccgccacgccgcccgggucaagggauccguucccccaguccaacgcgcccaucaucgacgaggagcgggagauccccgagcgcagcuggaacuccggccacgagugggucaccgacuucaaagggaagacugugugguuugucccuucuauaaaggccgguaacgacauugcugccugccugcggaaaaacgggaagaaggucauccagcucucccgcaagaccuucgacagcgaguacgugaaaacgcggaccaacgacugggauuucguugucaccaccgacaucuccgagaugggggccaauuucaaagcugagcgcgugauugacccccgccgcuguaugaagcccgugauccugacugauggcgaggagcgggucauacuggccgggcccaugccggugacccacagcuccgccgcccagcgccggggccgcaucgggcgcaaccccaagaacgagaacgaccaguacauuuacaugggcgagccccucgagaaugaugaggacugcgcccacuggaaggaggcgaagaugcugcuugacaacauuaauacccccgagggcaucaucccaagcauguucgagcccgaacgggagaagguggacgccaucgacggggaguaccgccuccggggggaggcccgcaagaccuucgucgaccucaugcggcggggugaccugcccguguggcucgccuaccggguagccgcggagggcaucaacuaugccgacaggcgguggugcuucgacggugucaagaacaaccagauccuggaggagaacguggagguggaaaucuggaccaaggaaggcgagagaaagaagcuuaagccccgguggcucgacgcgcgcaucuacuccgacccccuggcccugaaggaguucaaggaguucgcggccggccggaagucacucacccugaacuugaucaccgagauggggcggcuccccaccuucaugacgcagaaggcccgggacgccuuggacaacuuggccguacuccacaccgcggaggccggagggcgcgcuuacaaccacgcccuguccgagcugcccgagacacucgagacccuguugcuccugacgcugcucgcuaccgugaccgggggcaucuuccuguuccugaugagcgggaagggcguggggaagaugacacucggcaugugcugcaucaucaccgccucuauccuccugugguacgcccaaauccaaccgcacuggaucgccgccagcaucauccucgaguucuuccugaucguccugcucauccccgagccugagaagcagcggacgccccaggacaaccaacugacguacguggucaucgccauccuuaccgugguugcggccaccauggccaacgaaauggguuucuuagagaagacgaagaaggaccugggacuuggcucuaucgccacccaagagccggagaguaacaucuuagauaucgaccugcgccccgccagcgcuuggacccuguacgccgucgccacuacguucgugaccccgaugcuccggcacuccaucgagaacagcuccgugaacgucagccugacugccauagcgaaccaggcgaccgugcuuaugggccucggcaagggguggccccuguccaagauggauaucggcgugccgcugcucgccaucgggugcuacagccaggucaaccccauaacgcugaccgccgcccugcuccugcugauugcgcacuacgcuaucaucggccccggccuccaggccaaggccacccgcgaggcgcagaaacgggcggccgccgggauaaugaagaaccccaccguugauggcaucaccgugaucgaccuggauccgaucccguaugaccccaaguucgagaagcagcugggccaggucauguugcugauacugugcgugacccagguacucaugaugcgaaccaccugggcccugugcgaggcccugacgcucgcgaccggccccaucuccacccugugggaggggaacccgggccgcuucuggaacaccacgaucgccgucagcauggccaacaucuuucggggaagcuaccuggcuggggcaggacuccuguucagcaucaugaagaacacaaccaacacccgccgggggacggggaacauaggugagacgcugggggagaaguggaagucccgccucaacgcacugggcaagagcgaguuucagaucuauaagaagucuggcauccaggagguggaucggacccuggcuaaggagggcaucaagcguggcgagacagaccaccacgccgugagccggggauccgcaaagcuccgcugguucgucgagaggaacauggucacgcccgagggcaagguggucgaucuggggugcggccgcggaggcuggagcuacuacugcggcggucugaagaacguacgggaggugaagggauuaaccaaaggcggcccggggcacgaggaacccaucccgauguccaccuacggcuggaaccugguccgccugcagagcgggguggacguguucuucacgccgcccgagaagugcgacacgcuccugugcgacaucggcgagucaucccccaacccgaccaucgaggcgggccguacccugcgcguccucagccugguggagaacuggcugaacaacgacacccaguucugcaucaagguccugaaccccuacaugcccuccguaaucgagaagauggagacccuacaacggaaguacgggggcgcccuggugagaaacccgcugagccggaacuccacccacgagauguacugggugagcaacgccaccgggaacauagucuccagcgucaacaugauaucccgcauguuaaucaaccgguucaccaugaagcacaagaaggccaccuacgaacccgacguggaucugggcagcgggaccagaaacauagggauagaguccgagauacccaaccuggacaucaucggcaagcgcaucgagaagaucaagcaggagcacgagacaagcuggcacuaugaccaggaccaucccuacaagaccugggccuaccauggguccuacgagaccaagcagacgggaagcgcguccagcauggucaacgggguggugcggcuccugaccaagccgugggaugucguucccauggugacccaaauggccaugaccgacacgacccccuucggucagcagcgggucuucaaagagaagguggacacccggacccaagagcccaaggaaggaacgaagaagcucaugaaaaucaccgccgaguggcuuuggaaggagcuggggaagaagaagaccccucgcauguguacccgcgaggaguucacccgcaaggugcgguccaacgccgcccuuggagcgaucuucacagacgagaacaaguggaaguccgccagggaggccgucgaggacucccgguuuugggagcucguagacaaggagcgcaaccugcaccuggaggguaagugcgagaccuguguauacaacaugaugggcaagcgggagaagaagcucggggaguucggcaaggccaaaggaagccgcgcgaucugguacauguggcugggagcccgguuucuggaguucgaggcgcugggcuuccugaacgaggaccacugguuuagccgcgaaaacucccugagcggggucgagggcgaggggcuccacaagcugggcuacauccugcgggacguguccaagaaggagggcggggccauguacgccgacgacacagcgggcugggacacacgcauuacccucgaggaccuuaagaacgaggaaauggugacuaaccacauggagggggagcacaagcggcuggccgaggccaucuucaagcucaccuaccagaacaaagucgugcgcguccagcggcccacgccccgagguaccgugauggacaucaucagcagacgcgaccagcgcgggucaggacaaguggguacauacgggcugaacaccuucacgaacauggaggcacagcugauucggcagauggagggcgaagggauuuuuaaaagcauccagcaccucaccgucaccgaggagaucgccgugcagaacuggcuggcgcgagugggccgggagcgccugagccguauggccaucagcggcgacgacuguguugugaagccccuagacgaccguuucgccuccgcccuaaccgcccugaacgacauggggaaggugcggaaggacauccagcagugggagccgagcaagggcuggaaugacuggacacaaguccccuucugcucccaccacuuccacgagcugaucaugaaggacgggagggugcuggugguccccuguaggaaccaggacgagcugaucggccgcgcgcggaucagccagggggccggcuggucacucaaggagaccgccugccugggcaagagcuacgcccagauguggucccuaauguacuuucaccgcagagaccuccgccuggccgcgaacgccaucugcagcgccguucccucccacugggugcccaccagccggaccaccuggagcauccacgccaagcacgaguggaugacgaccgaggacaugcugacagucuggaaucgcguguggauccaggagaaccccuggauggaggacaaaacccccguggaguccugggaggaaguccccuaucucgguaaacgggaggaccaguggugcgggagccugaucgggcugacgucccgcgcgaccugggccaagaacauccagaccgccaucaaccagguucggagccucaucggcaaugaggaguacaccgacuacaugccauccaugaagcgcuucagacgggaggaggaggaagccggggugcugugguag

SEQ ID NO: 25470 - RNA, 9876 nt, Artificial Sequence
  derived and/or modified CDS sequence (opt11) from DENV-2__FM210226__SS-prME
acugccggcguaaucaucauguugauccccacggccauggcguuccaucuaacgacccgcaauggggagccccauaugauuguaggccgccaggaaaagggcaagucccuccuguuuaagaccgaggacggcgugaacaugugcacccucauggccaucgaccugggggaacugugugaagacaccaucaccuacaagugcccccuccugcgccagaaugagcccgaggacaucgauugcuggugcaacagcaccagcaccugggugaccuacgggacuugcaccaccacgggcgagcaccggcgcgaaaagcggucggucgcacugguuccacauguggggaugggccuugagacccgcacugagaccuggaugagcuccgagggggccuggaagcacgcccagcggaucgagaccuggauccuacgccaccccggcuucaccaucauggcggcuauccuggcauacaccgucgggaccacccacuuccagcgggcucucauuuucauacugcuggcggccguugcccccagcaugaccaugcgcugcauaggcaucuccaaucgggacuucgucgagggggucuccggaggcucuuggguggacaucguacucgagcaugggagcuguguaaccaccauggcgaagaacaagccgacgcuggacuucgaguuaaucaagaccgaggccaagcagcccgcgacccuccgcaaguauugcauagaggcaaaacugaccaacacgaccaccgagucaagaugcccgacccagggcgaacccagccugaacgaggagcaagacaagcgcuucgugugcaagcacuccaugguggaccgggggugggggaacggcugugggcuguucggcaagggcgggaucgucacgugcgcaauguucacguguaagaagaacauggagggcaagauagugcagcccgaaaaccuggaguauacuaucgugaucacgccccacagcggggaagaacacgccgucggcaaugacacgggaaagcacggcaaggagaucaaaauaaccccucagucccccaucaccgaagccgaguuaacggguuauggaaccguaacgauggagugcucaccccgcacagguuuagacuucaacgagaugguacugcugcagauggaggacaaggcauggcucguacaccggcagugguuccuggauuuaccccucccgugguuacccggggccgacacccagggaagcaauuggauccagaaggagacccucgugacguucaaaaacccccacgccaagaagcaggacgugguugugcucgggagccaggagggagccaugcacaccgcccuuacuggggcgaccgaaauccagauguccagcggcaaucuguuguucacgggccaccugaagugcagacuccggauggauaagcuccagcugaagggcaugagcuacucaaugugcaccggcaaguuuaagaucgucaaggaaaucgcugaaacccagcaugggacaaucgucauccgcgugcaguacgaaggugacggcagccccugcaagaucccguucgagaucauggaucuggagaaacgucacguccucgggcgcuugaucacggugaaccccauagugacagagaaggauucccccgucaauaucgaggccgagcccccguucggcgacagcuacauaaucaucggaguggagcccggccagcugaaacucaacugguucaagaagggguccagcaucgggcagauguucgagaccaccaugcgcggcgccaagcggauggccauccugggcgacacggcgugggauuucggcucccucggcgggguguuuaccagcaucgggaaagcccuccaccaggucuucggggcaaucuacggcgccgccuucuccgggguaagcuggaccaugaagauauuaaucggcguaauaaucaccuggaucgggaugaacucucgcagcacgucccuuagcgucagccugguacucgugggcgucaucacccuauaccuaggggccauggugcaggcugacagcggcugcguggucuccuggaagaacaaggagcucaagugcggcucggggaucuucaucaccgacaaugugcacaccuggacagagcaguacaaguuccagcccgaaucccccaguaagcuggccagcgccauacagaaagcgcacgaggaggguaucugcgggauucgcuccguaacccgccuggagaaccuaauguggaagcagaucacuccggagcugaaccacauacuaagugagaacgaggucaaacucaccaucaugacgggcgacauuaaggggaucaugcaggccggcaagcggucccugcgcccccagcccaccgagcugaaguacagcuggaagacauggggcaaggccaagaugcucuccaccgagagccacaaccaaacguuccucaucgacgggccggagacagccgagugccccaauaccaaccgcgccuggaacucucuggaggucgaggacuacggcuucgggguguucacuacaaacaucuggcucaaacucagagagaagcaggacguuuucugcgacagcaagcugaugucagcggccauaaaggacaaccgggcaguccacgccgacaugggcuacuggaucgagagcgcccucaacgacacguggaagauggagaaggccuccuucaucgaggugaaaagcugccacuggccgaagagucacacccuauggagcaacggcgugcuggaguccgaaaugaucauucccaagagcuuugcggggccggugucccagcacaacuauagacccggguauuauacccagaccgcaggacccuggcaccugggaaagcuggagauggauuucgacuucugcgaggggacaaccguugucgugaccgaggacugcggcaaccggggccccagccugcgcaccacgacagccagcgggaagcucaucacugaauggugcugccgguccugcacccugccgccucugagguaccggggcgaagacgggugcugguacggcauggaaauccgcccccuaaaggagaaggaggagaaccuggugaacagccucgucacugcggggcacggccagaucgacaacuucucccugggagugcuggggauggcccuguuccucgaggagauguuacggacccgggugggaaccaagcacgccauccugcucgucgcggugagcuucgugacccugauaaccgggaacauguccuucagggaccugggucgcgucauggucauggugggugccgcgaugaccgacgacaucggcauaggcgucaccuaucucgcccugcuugccgccuucaaggugaggccgacauucgccgcgggccuucugcugcggaaguugacgagcaaggagcugaugauggcgaccaucggcauagcccugcucucccagagcaccaucccggagacaauacuggagcugacggacgcgcuagcccuggggaugauggugcugaagaucguccgcaacauggaaaaguaucagcucgcggugaccaucauggccauuuccugcgugcccaacgccgucauccugcaaaaugccuggaaggugagcugcaccauucuggcgacaguguccgucaguccgcucuugcugacguccagccagcagaaggcggacuggaucccccucgcccugaccaucaaaggacugaacccgacagccaucuuccucacgacguugucccggaccagcaaaaagcgcuccuggccccugaacgaagccaucauggccgucggcaugguuagcauccucgccuccucacugcuuaagaacgacaucccaaugaccgguccgcucguggccggcgggcugcuaaccgugugcuacguucucacaggccgguccgcggaucuggagcuggagcgcgccaccgacgugaaaugggaggaccaggcggagaucuccggguccuccccgauccuuuccaucaccaucgccgaggacggaucgaugagcaucaaaaacgaggaagaggaacaaacucugacaauccugauccggaccggccuccuggugaucucugggcuguucccuguaagcauccccaucacggccgccgccugguaccucugggaggucaagaagcagcgcgcgggcgugcugugggacguccccagcccgcccccaguugguaaggccgagcuggaggacggcgcguacagaaucaagcagaaggggauucucggcuacagccagauaggcgccggcguguacaaggagggcaccuuccauaccauguggcacgucacgcgcggagccgugcugaugcaucggggcaagagaaucgaaccguccugggcugacgugaagaaggaccugaucagcuacgggggcggguggaagcucgagggcgaguggaaggagggggaggagguacaggugcuggcauuagagccggggaagaaucccagagccguccagaccaagccuggccucuucaagaccaacaccgggacgaucggggccgucucccuggacuucuccccggguaccuccgggagccccauaguagaucguaagggcaagguagucggacuguacggcaacgguguggugacccgguccggggcguacgucucggccauugcgcagaccgagaaguccaucgaggacaaccccgagauagaggacgauaucuucaggaagaagcggcucacuauuauggaccugcaccccggcgccgggaagaccaagcgcuaccugccggccaucgugcgggaggcgaucaagcgaggccuucggacacuuauccuggcccccacccgcguagucgcggccgagauggaggaggcccugcgcgggcuccccauccgcuaccagacacccgcgauucgcgcagagcacaccggccgggagaucguggaucugaugugucacgccaccuucaccaugcgccugcuuagcccggugcgggucccuaacuacaaccugauaauaauggacgaggcccacuucacggaccccgccaguaucgcggcccgcggauacaucucgacccgggucgagaugggggaggcugcaggcaucuucaugaccgcgacgccgcccgggagcagggaccccuucccccaguccaacgccccuauaauggacgaagagagagagauccccgagcggagcuggaacuccggccaugagugggugacggacuucaaggggaagacugucugguuugugcccagcauaaaggccggcaacgacaucgcagccugucuccgcaagaauggcaaaaaggugauucagcuuucccguaagaccuucgacucggaguacgugaaaaccagaacgaacgacugggacuucguggugaccaccgacaucuccgagaugggggcgaacuucaaggccgagcgcgucaucgaccccaggcgcugcaugaaacccgugaucuuaaccgacggcgaggagcgggugauccuggccgggccgaugcccgucacgcacagcucagccgcccagcgccggggccggauagggcgcaaccccaagaacgagaacgaccaguauaucuacaugggcgagcccuuagagaaugacgaggacugcgcgcacuggaaggaggccaagaugcugcuggacaauaucaauacgccagaaggcaucauccccagcauguucgagcccgaacgggaaaagguugacgccaucgacggggaguacaggcuucggggcgaggcucgcaagaccuucguagaccugaugcggcgcggggaucucccgguauggcuugcguaccggguggcggccgagggcaucaauuacgccgaccgccggugguguuucgacggggugaagaacaaccagauacuggaggagaacgucgagguggagaucuggaccaaggagggcgagcgaaagaaacucaagcccagauggcucgacgcacgcaucuacuccgauccccuggcgcugaaggaguucaaggaguucgccgcuggccgcaagagccucacgcuaaaucugaucaccgaaaugggccgccuccccaccuucaugacccaaaaggcccgggacgcccuggacaacuuggcggugcuccacacggcggaggccggagggcgcgccuacaaccaugcccugagcgaacugcccgagacccucgagacucuguuacuucugacccugcucgcuacggucacaggcggcaucuucuuauuccugaugucugggaagggcguggguaagaugacgcucggcaugugcugcaucaucaccgccuccauccugcucuggcacgcccagauccagccccacuggauagccgcaagcaucauccucgaguucuuccugaucguccuccucauucccgagcccgagaagcagcggaccccgcaggacaaccagcugacguacguggugaucgcgauacugaccgucguggccgcgaccauggcgaacgagaugggguuccucgaaaagaccaagaaagaccugggccugggcuccaucgccacgcaggaacccgaguccaacauucucgacauugaccugcgccccgcgucggccuggacccuguacgccguggccaccacguucgucacgcccaugcuccggcacuccauugagaauagcuccgugaacguuagccugacggcgaucgccaaccaggcaacgguacugauggggcucggcaaaggguggccgcuguccaagauggacaucggcgugccccuccucgccaucgggugcuacagccaagugaaccccaucacccugacggccgcacugcuccugcuggucgcccacuacgccaucaucggccccgggcuccaggccaaggccaccagggaagcacagaagcgggccgccgccgggaucaugaaaaacccgaccguugacggaaucacggugaucgacuuagaucccauccccuacgaccccaaguucgagaagcagcuggggcaggucaugcuccugauccuaugcguaacccaggugcucaugaugcgcaccaccugggcccugugcgaggcguugacccucgcaacggguccgauuaguacguugugggaagggaauccggggcgcuucuggaacaccaccaucgccguauccauggccaacauuuuucggggcuccuaccuggcgggggcaggccucuuauucagcauuaugaaaaacacgaccaacacccgcagggggacaggcaacaucggugagacgcugggggagaaguggaagucccgccuuaacgcacugggcaaguccgaguuccagaucuacaagaaguccgggauccaggagguggaccggacccuggccaaggaggguaucaagcgcggggagacggaccaccacgccgugucgcggggcuccgcgaagcuccggugguucguugagcggaacaugguuacccccgagggcaagguagucgaucuggggugcgggcgcgggggauggagcuacuacugcgggggacugaaaaauguacgagaggucaagggccucacgaaaggcggccccggucacgaggagccgguccccauguccaccuauggcuggaaucuggugcgccuccagucagggguggacgucuucuucacaccgcccgagaaaugcgacacgcuccugugcgacauuggcgaguccucaccgaaccccacgaucgaagccggccggacccuccgcgugcugagccuggucgagaacugguugaacaacgacacccaguuuugcauaaagguauugaaccccuacaugccguccguuaucgaaaagauggagacccugcagcggaaguacgggggcgcccuggugcgcaacccccugagccgcaacuccacccacgagauguacugggucagcaacgcuacggggaauauagucuccuccgugaacaugaucucccgcaugcucauaaauagauucacgaugaaacacaagaaggccaccuacgaacccgacgucgaccuaggaucuggcacucgcaacauuggcauagaguccgaaauccccaaccuggacauaauaggcaagcgaauugaaaagaucaaacaggagcacgagacgagcuggcacuacgaccaagaccacccauacaagaccugggcuuaucacggguccuacgagaccaagcaaaccggcagcgccuccagcauggugaacgggguuguccgguuacucacgaagcccugggacgugguacccauggucacacagauggccaugaccgacaccacgcccuucggccagcaacgcguguucaaggagaaaguggacaccaggacccaggagccgaaggaaggcaccaagaaacucaugaagaucacggccgaguggcucuggaaggaacuggggaaaaagaagacgccccggaugugcacgcgcgaggaguucacacgcaagguccgguccaacgcugcgcugggcgccaucuucacggaugagaacaaguggaaauccgcccgcgaggccguugaagacucacgguucugggagcuuguggacaaggagcgcaacuugcaccuggaggggaagugcgagaccugcguguacaacaugaugggcaagcgggagaagaaguugggagaguucggcaaggcgaaaggcagccgcgcgaucugguacauguggcugggcgcccgcuuccuggaguuugaggcccucggguuccugaaugaggaccauugguucucccgcgagaacagcuugagcgggguggagggcgaagggcuccacaaacugggcuacauccuacgugacgucucaaagaaggagggaggggccauguaugcggacgauaccgcgggcugggacacccgcaucacgcucgaggaccugaagaacgaggagauggugaccaaccacauggagggagagcauaagaagcuagccgaggccaucuucaaacuuaccuaccagaacaagguugucagagugcaacgccccacgccccggggcacggugauggauaucaucucgcgccgggaccagcgugggucgggucaggucggaaccuacgggcugaacaccuucaccaacauggaagcccagcugauccgccagauggagggcgaggggaucuucaagagcauccagcaccucacggugaccgaggagaucgcggugcagaacuggcucgcccgggucggucgcgagcggcuaucccggauggccaucagcggcgacgacugcguggucaagccgcucgacgaccgguucgccuccgcccugaccgcgcuaaacgauaugggaaagguucgaaaggacauccagcagugggagccuagcaggggcuggaacgacuggacacaggugcccuucugcucccaucacuuucaugagcucaucaugaaggacgggcgcguguugguugugcccugccggaaccaggacgagcugaucggccgcgccaggaucucccagggggcgggcuggucccuaaaggaaacugcgugccugggcaaaagcuacgcccagauguggucuuuaauguacuuccaccgccgugacuuacgccuggcggcuaacgccaucugcagcgccgugccgucccacugggucccaaccagccggaccaccugguccauccacgcgaagcacgaguggaugacgacugaagacaugcugaccguguggaaccgcguguggauacaggagaacccguggauggaggacaagacccccgucgaaagcugggaggaggugccguaccucgguaagcgugaggaccaguggugcgguagccugauuggucugaccucccgggccacgugggcgaagaacauccagaccgcaaucaaccagguccggagccucaucggcaacgaggaguacaccgacuacaugccuucgaugaagcgcuuccgucgggaggaggaggaggccgggguccugugguga

SEQ ID NO: 25471 - RNA, 9876 nt, Artificial Sequence
  derived and/or modified CDS sequence (opt11) from DENV-2__FM210227__SS-prME
accgcuggcgugaucauaaugcugauccccaccgccauggcauuucaccucacuacgaggaacggagagccccacaugaucguaggccggcaggaaaaagggaagucccugcuguucaaaaccgaagacggggugaacaugugcacccuaauggccaucgaccucggggagcugugcgaggauaccaucacguacaaguguccccucuuaagacagaacgaacccgaggacauagacugcuggugcaacaguaccuccaccugggucaccuacgguacgugcaccaccacuggcgagcaccggcgcgagaagcguuccguggcucucgugccccacguagguaugggccuagaaacgcgcaccgaaacauggaugucuagcgaaggcgcuuggaagcacgcccagcggaucgagacauggauccugcgccauccgggguucaccaucauggcggcuauccuggccuacaccaucgggacuacccauuuccagcgugccuugaucuuuauccuauuaaccgccgucgcgcccaguaugaccaugcgguguaucgguauauccaaccgggacuucguggaaggcgugucaggugggucuugggucgacauagugcuagaacacggaagcugugugacuacgauggccaagaacaaaccaacucuugacuuugagcugaucaagaccgaggcuaaacaaccagccacacuacgcaaguacugcaucgaggcgaagcuaacaaauaccacaaccgagagccggugcccgacacagggggagcccagccuuaaugaagaacaggacaagcgcuucguauguaagcauucaaugguggaccgaggcugggggaacggaugugggcuauucgguaagggcgggauugugaccugcgcaauguuuacgugcaagaaaaacauggagggcaaaaucguacagccggagaaccucgaguacacgaucgugaucacgccucacucgggggaggagcacgcagugggcaacgacacaggcaaacacggcaaggaaauuaagauuaccccacaguccucggucacagaggcagagcugaccggcuaugggaccgugaccauggagugcagcccccguaccggccucgauuucaacgagaugguacugcugcagauggaggacaaggccuggcucguccaucggcaaugguuuuuagaucugccccuccccugguugccuggugcggacacccaaggguccaauuggauccagaaagaaacgcuggugacguucaagaacccccacgcgaagaagcaggacguggucguacucgggucccaggaaggcgcgaugcauaccgcccuaacgggggccacggaaauccaaauguccagcggcaaccugcuguucaccggccaccuuaaaugucgccuccggauggacaaacuccagcugaaggggauguccuacagcaugugcaccggcaaauucaaaaucgucaaggagaucgccgaaacccagcauggcacgauagugauccguguucaauacgaaggcgacggcucccccugcaagauccccuucgagauuauggaccuugaaaagaggcacguacucgggcgcuuaaucaccguuaaccccauagucaccgagaaggauagccccgucaacauagaagcggagccgcccuuuggcgacuccuacaucauaaucggcguggagccggggcagcugaaguuaaacugguucaaaaaggggaguuccaucggccagauguuugagacgacaaugcgaggcgcuaagaggauggccauacucggggacacugccugggacuuuggcagccucggcggggucuucacgaguauuggcaaagcccuccaccagguuuucggugcgaucuacggcgccgccuucagcggggucuccuggaccaugaagauauugauaggagcgaucauaacuuggauagggaugaacagucgguccacgucacuguccgugucgcuaguccucguuggcgucauuacccuguaccucggggccauggugcaggccgauuccggaugcgucguuucuuggaagaacaaggagcucaagugcgguucuggcaucuucauaaccgauaacguccauaccuggaccgaacaguacaaguuccagccagagucacccucuaaauuagcaagcgccauccaaaaggcgcaugaggaagguaucugcgggauccgcagcgugacccgccuagagaaccucauguggaaacaaaucacgcccgaacugaaccacauccuuucggaaaaugaggucaagcucacgaucaugacaggugacaucaaggggaucaugcaagccggcaagcggagccuucgcccgcagccgacugagcugaaguacagcuggaagaccuggggaaaggcaaagaugcucagcacugaaucgcacaaccaaacuuucuugauagaugggccugaaaccgccgagugcccgaacaccaaucgggcguggaauagucuggaagucgaagacuauggcuucggaguuuucaccaccaacauuuggcuaaaacugcgcgagaagcaggacguguucugcgacuccaaguugaugagugcggccauaaaggacaacagggccguccaugcugauaugggauacuggaucgaguccaccuuaaaugacacuuggaagauggagaaggcuagcuucaucgaggugaaauccugucacuggcccaagucucacacccuaugguccaacggaguccuggagucagagaugauaauccccaaauccuucgcggggccggucagccaacauaacuauagacccggcuaccauacccagaccgccgggccguggcaccucggcaagcuggagauggauuucgauuucugcgaggggacgaccgugguuguaacagaagauugcgggaaccgggggccuagccugcggacuaccaccgccucugggaaguuaaucacggaguggugcugcagaagcuguaccuugccaccguuacgcuaccggggcgaggacggguguugguacggcauggagaucagaccccugaaggaaaaggaggagaaccucgugaacucccugguuacagcagggcacggucagaucgacaacuucaguuuaggcguccucgggauggcgcuguuccucgaagaaaugcuacggacccgcgucgggacgaagcacgccauacugcucguggccgucuccuuugugacuuuaaucaccgggaacaugucguucagagaccuaggccgagugaugguaauggugggggccacgaugacggaugacaucggaaugggcgugaccuaccuagcccuguuagcagcauucaaggugcgcccaaccuuugccgcugggcuccugcugcgaaaguuaaccuccaaggaguuaaugauggcuacgaucggcaucgcgcugcucucgcagagcaccauccccgaaaccauccuagagcugaccgacgcccuagccuuagguaugaugauccugaaaauugugcgcaacauggagaaguaccagcuagccgugacgaucauggcaauuucgugcguuccgaacgccgugauucugcaaaacgcauggaaggucucaugcacuaucuuagccgccgucucaguguccccgcuacuguuaacgucaucccagcagaaagcggacuggaucccucuggcucugacuaucaagggacugaaccccacagcaaucuuccucaccaccuuaagccggaccuccaaaaagcguagcuggccgcugaaugaggccauaauggccgucggcauggucuccauccucgcgagcagucugcugaagaacgacaucccaaugacggggccgcucguggcuggcggacuucugaccgucuguuacgucuuaacagguagauccgccgaccuggagcucgaacgcgccaccgacgugaagugggaggaccaggcggaaaucucuggguccucucccauccucuccaucaccaucagcgaagacggaucgaugucuaucaagaacgaggaagaggagcaaacccugaccauccuaauccgaacugggcuacuggucaucuccggucuguucccgguguccauccccaucacugcggcugccugguaccucugggaggugaagaaacagcgcgcuggagugcugugggacgugccaucgccgccgcccgucgguaaggcugagcuggaggauggcgcguaucggaucaaacagaaagggauccucggcuauucgcagauaggugccggagucuacaaagagggcaccuuucauaccauguggcacguuacccgcggggccgugcucaugcaccggggcaagcgcaucgagcccuccugggccgacgucaagaaggaccucaucucuuacgggggcggcuggaagcuugagggugaguggaaggagggggaggagguacaagugcuggcucuggaacccgggaagaacccucgggcuguucagacuaagccggguuuguuuaaaacuaauaccgguaccaucggggccgucucgcuagacuucagccccggcaccuccgggucaccaauuguggacagaaaaggaaaggucguaggcuuguaugggaacgguguugucacccggucgggggcauauguuagcgcgaucgcacagacagagaaguccaucgaggacaaccccgagauugaggacgacauuuuccgcaagaagcgucuuacaauuauggaccugcaccccggugccggcaagaccaagagguaccugccugcgaucgugagggaggcgaucaagcguggccuacgcacgcucauccuagccccaacccgcguaguggcggcggagauggaggaggcccugcgcggucuccccauacgguaccagacacccgcgauucgcgcugaacacaccggccgggagauuguggauuuaaugugccacgccacauuuacaaugcgcuugcucagccccguucgcguccccaacuacaaccugauaauaauggacgaggcccacuucacugaccccgccucaaucgcagcccgcggcuacaucucuacccggguggagaugggagaagcagccgggaucuuuaugacggccacuccgccagggagcagagaccccuucccccagucgaacgccccuauaauggaugaagagcgugagauccccgaacgcagcuggaacuucggccaugagugggucaccgacuucaaagggaaaaccgugugguucgugccgaguauuaaggcgggcaacgacaucgcagccugcuuacggaaaaauggcaagaaagucauccaguuaucucgcaagacuuucgacagugaguacgugaaaacaaggacgaaugauugggauuucguggucaccacggacauuucugagaugggugccaauuuuaaggccgagcgcgugauugaccccaggagaugcaugaagccaguuauucugaccgacggggaggagaggguuaucuuagcggggccaaugccggugacccauuccagugccgcccaacgccgcggccgaauagggagaaacccuaagaaugaaaacgaucaguauauuuacaugggggaaccgcucgagaacgacgaggacugcgcccacuggaaggaggcuaagaugcugcuggauaacauaaacacucccgagggcauaaucccguccauguuugagcccgagcgugagaaaguggacgcaaucgacggggaauaccggcucagaggcgaagcccgaaagacguucgucgaucugaugcggcggggagaccugcccguguggcuggccuaccggguggccgcggaaggcaucaacuacgcggaccgucgguggugcuucgaugguguuaagaacaaucaaaucuuggaagagaauguggagguggagauuuggaccaaggagggcgagcgcaaaaaguugaagccgagauggcucgacgcucggaucuacagcgacccucuggcacugaaggaguucaaggaguucgccgcaggccgaaagucccucacccugaaccugauuacugagauggggcgccuucccacuuucaugacccagaaggcgcgggacgcccuggacaaccuggccguccuccauaccgcugaggcgggugggcgggccuacaaccacgcccugagcgaacugcccgagacccuagagacgcuucugcugcuaacauuacucgcuaccgugaccggaggcauauucuuauuccugauguccgggaagggcgugggcaaaaugaccuuaggcaugugcugcaucauuacggcgaguauauugcugugguacgcgcagauccagccgcauuggaucgccgcuuccaucauccuugaguucuuccucaucguauuauuaauacccgagcccgagaagcagcggacgccccaggacaaccagcucaccuacguggucauagccauccugaccgucguggccgcgacaauggccaacgagaugggcuuucuagagaagaccaaaaaggaccugggccuuggcagcgucgcaacccaggagccggagagcaacauccucgacaucgaccugaggcccgcaucagccuggacucuguacgcgguggcuacgaccuucgucacgccuaugcugcgacauucaauagaaaauuccagcgucaauguaagucugaccgccaucgccaaccaagcgacaguguugauggggcucggcaagggguggccccugucaaagauggauaucggcgucccgcugcuggcaauugggugcuacucccaaguaaaccccaucaccuugacagcggcccugcuccuguugguggcccacuaugccauaauagggcccggcuuacaggcaaaggccacccgugaagcgcagaagcgugccgcggccggaaucaugaaaaaccccacagucgacggaauaaccguaauagaccuggauccaauccccuacgaccccaaguucgagaagcagcugggccaggugaugcuccugaucuugugcguaacgcaggugcucaugaugcgcaccacgugggcccucugcgaggcccugacucucgccacgggccccaucagcacgcugugggagggcaacccgggccgcuucuggaauacgacuauugcggugucaauggcgaacaucuuucguggcucauaccucgcgggggcuggccuccuauuuuccauuaugaagaacacuaccaacacgcgccgggggacagguaacaucggggagaccuuaggcgagaaguggaaaucccgccuaaacgcgcugggcaaaagugaauuccagaucuauaagaagucgggaauucaagaggucgaccggacccuagcuaaggagggcaucaagcguggcgaaacggaccaccaugcggugucccggggcagcgcgaaauuacgcugguuuguggagcgaaacauggucacaccggaggguaagguggucgaucuggggugcggucgugggggcuggagcuacuauugcggaggccucaagaacgugcgggaggugaagggcuuaacgaagggggggcccgggcacgaggagccuaucccgaugucaaccuacggauggaaccuggugagacugcagaguggggucgacgucuucuuuaccccgcccgagaaaugcgacacccuacugugcgauaucggcgaaaguagccccaacccgaccaucgaggcgggcaggacccugagagugcucucccuugucgagaauuggcugaacaacgacacccaguuuugcauuaaggugcucaaucccuacaugcccagcguuauagagaagauggagacgcuucagcgaaaguacgggggggcgcuggucaggaacccgcucucaagaaauucaacccacgagauguacuggguguccaacgcaaccgggaauauaguuaguuccgucaacaugaucagccgcauguuaaucaaccgcuucacgaugaagcauaagaaagcuacauacgagccagacguggaccugggaagcgggacgcgaaacaucggcaucgagucugagaucccuaaccuugacaucauagggaaacguaucgagaagaucaagcaggagcaugagacaucauggcacuaugaccaagaucaucccuauaagacaugggccuaccacgggucuuacgagaccaagcagaccggcucggcuucauccaugguuaacggggucgugcgguuauugaccaagccaugggacguggugcccauggugacgcagauggcgaugacggacaccacccccuucggucagcaaagaguguucaaggaaaagguggacaccaggacgcaggagcccaaggaggggacaaaaaaguugaugaagauuaccgcagagugguuguggaaggaguugggaaagaagaagaccccgcgcaugugcacgcgugaggaauucacgcgcaaggugcggagcaaugccgcccuaggagcuauuuucacggacgagaacaaguggaaguccgcgcgagaggcaguugaggacucucgguucugggagcuuguugacaaagagcggaaccuacaccuggaggggaagugcgagacaugcguguacaacaugaugggcaagcgagagaagaagcuaggggaguuuggcaaagccaaggggucccgcgccaucugguacauguggcugggagccagauuccuugaauuugaggcccucggcuuccugaacgaagaccacugguucucaagggagaauucccugucugggguugagggugaggggcugcauaagcugggcuacauccuucgggacgucagcaagaaggagggcggggcaauguacgcugaugacacagccggcugggacacccguaucacccucgaggaucugaaaaacgaggagaugguaaccaaccacaugggcggcgagcacaagaggcuggcggaggcaauauuuaagcucacguaucagaacaagguugugagggugcaacggccgaccccccgcgggaccgucauggacauaaucucccgacgugaccagcgcgguagcggccaggucgggacguacggccuaaacacguucaccaauauggaagcucaacuuauccggcagauggagggagagggcauauuuaaguccauccaacaccugacugugaccgaggagauugcgguacagaacuggcuggcccgcguuggccgggagcgucuaagucguauggcgaucaguggggacgacugcguggugaagccccuugacgaccgcuuugccagcgcucugaccgcccugaacgacaugggcaaggugcggaaggacauccagcaaugggagcccucgaagggguggaaugauuggacccaggucccguucugcucucaucauuuccaugacuuaaucaugaaagacggcaggguccugguuguuccaugccguaaccaggacgaacugauugggcgggccaggauaucccagggcgcgggcuggaguuuaaaggagaccgcaugccugggaaaguccuacgcccaaauguggagccuaauguacuuucacagacgggaccuacgccuugcggccaaugcgaucugcuccgccguucccagccacugggucccgaccagccgaaccacgugguccauacacgccaagcacgaguggaugaccaccgaggacaugcugacuguguggaaccgcguuuggauccaggagaaucccuggauggaagacaaaacuccuguggagagcugggaggagguccccuaccucggaaagcgggaagaccaguggugcggcagccugaucggccuuacaucgcgagcgacgugggcgaagaacauacaaacggcuaucaaccaggugcggucccucauugggaacgaggaguacacggauuacaugcccaguaugaaacgcuuccgccgcgaggaggaagaggccggcguguuaugguag

SEQ ID NO: 25472 - RNA, 9876 nt, Artificial Sequence
  derived and/or modified CDS sequence (opt11) from DENV-2__FM210204__SS-prME
acugcgggcgugaucaucaugcucauccccacugcgauggcguuucaucucaccacccggaacggagagccacacaugaucgugggccggcaagagaaaggcaagucccugcuguuuaagaccgaagacggagugaacaugugcacccuuauggccaucgaccugggggagcugugcgaggacacgaucaccuacaagugcccccuccugcggcaaaacgagcccgaggacaucgacugcugguguaacuccacguccaccugggucacuuacgguacgugcaccaccaccggcgagcaucggcgcgagaaaagauccgucgcccuggucccccacgugggcaugggccuggagacccgcacugagaccuggaugagcuccgagggggccuggaagcacgcacagaggaucgagacguggauacugcggcacccaggcuucaccaucauggcggccauccuggccuacacgaucgggaccacgcacuuccagcgggcacucaucuucauucuccugaccgcggucgcccccagcaugaccaugcggugcaucgggaucuccaaccgagacuucguagagggaguaagcgggggcuccugggucgauaucgugcucgagcaugggaguugcgugaccaccauggcgaagaacaagcccacucuggacuucgagcuaaucaaaaccgaggcuaagcagccggccacccuccgcaaguacuguaucgaggcaaagcugacgaauaccaccacugagucccgaugcccuacucagggcgagccuagccugaacgaggaacaggacaagcgcuucguguguaaacacuccaugguggaccgaggcugggggaacggcugugggcuguucggcaaaggcgggaucgugacuugcgccauguucacgugcaagaaaaacauggagggcaaaaucgugcaacccgagaaccuggaauacacuauugugauaacuccgcacagcggggaggaacacgccgugggcaacgacacugggaagcacgguaaggagaucaagauaacgccccaguccagcgugaccgaggcugaguuaaccggauauggaaccgugaccauggaaugcagcccucggacaggcuuggacuucaacgaaaugguacugcugcagauggaggacaaggcuuggcucguccaccggcagugguuccuggaccugccuuuacccuggcugccuggggcggacacacaaggauccaacuggauccagaaagaaacgcuggugaccuuuaaaaacccucacgccaagaagcaggacguggucgugcucgggucccaggaaggcgcaaugcacaccgccuuaaccggggccacagagauccaaaugagcagcgggaaccugcuguucacaggccaccugaaaugccgccuacggauggacaagcuccagcugaagggcauguccuacagcaugugcaccggcaaguucaagaucgucaaggagaucgcggagacgcagcaugggacuaucgugauccgcgugcaguacgagggagacggcagucccugcaagauccccuuugaaaucauggaccuugagaagcggcacguccuggggcgccugaucacugugaacccgaucguuacggagaaagacagcccggugaacauugaggccgagccgcccuuuggcgacuccuauaucauuauagggguggagccgggccagcugaagcucaauugguucaagaaggguuccuccauuggacagauguucgaaaccacgaugcgcggagccaagcggauggccauacugggggacaccgccugggacuucggaagccugggcgggguguucaccagcaucgggaaggcccuccaccaggucuucggggccaucuacggcgccgccuucagcggugugucuuggaccaugaagauccugauuggcgcgaucauuacguggauagggaugaacucacgcucuaccagcuuguccgugucucuggucuuaguuggcgugaucacccuguaccugggggccaugguccaggcggacuccggcugcguagucagcuggaagaacaaggagcucaaaugcggauccgggauauucaucaccgacaacguccacacguggaccgagcaguacaaguuccagcccgagucucccagcaagcuggcuuccgcaauacagaaggcguacgaggagggaaucugugguauccggagcgucacucgccuggagaaccuuauguggaagcagaucacccccgaguuaaaccacauccuuuccgagaaugagguaaaacucacaaucaugaccggugacaucaaagggaucaugcaggccggcaagcggagccugcgcccgcagccaaccgagcugaaguacucuuggaaaaccuggggcaaggccaagaugcucagcacggagucgcacaaucagacguuccuaauagacggacuggagacagcagaaugucccaacacgaaccgggcguggaacagccucgaggucgaagacuacggcuuugggguguucacaaccaacaucuggcugaaguuacgcgagaagcaggacguguucugcgacuccaagcugaugagcgcggccauuaaggacaaccgggccguccacgccgacaugggcuacuggaucgaguccgcccugaacgacaccuggaagauggagaaggcgagcuucauugaggugaagagcugucacuggccgaagagccacacccuguggaguaacggcguguuggagagcgagaugauuaucccgaagucuuucgccgggccagucagccagcacaauuaccgccccggcuaccacacccagacugcaggaccauggcaucugggcaagcuggaaauggauuuugacuuuugcgaggggaccaccgugguggucaccgaagacugcgguaaccguggcccgucacuccgcacgaccaccgccuccgguaagcugaucaccgaaugguguugccggagcugcacacuaccgccacuccgcuacagaggcgaggacgggugcugguacgggauggagauccgcccgcugaaggagaaggaagaaaaccucgugaacagccucgucaccgcgggccacggccagaucgauaacuucagccugggggugcuggggauggcuuuguuucuggaagaaaugcugcggacucgcguggggacgaagcacgcgauccuauuaguggcugucuccuucgucacccugauaaccgggaauaugagcuucaaggaucucggacgggugauggucauggugggggccacaaugaccgacgacaucggcaugggcgucaccuaccuugcgcuucucgccgccuucaagguccgccccaccuuugcggccgggcugcugcuccggaagcugaccuccaaggagcugaugauggcgaccauaggcaucgcccuccuuagccaguccacgauucccgagaccauccuagagcuuacggaugcccuggcccuggggaugauggugcuuaaaaucgugcgaaacauggagaaguaccagcuggccgucaccaucauggcuaucaguugcguucccaacgccgucauccugcaaaacgccuggaaagucuccugcacgauucucgccgcggucagcguuuccccgcuccugcucaccagcucgcagcagaaggccgacuggaucccccuugcccuaaccaucaagggccucaaccccacagccaucuuccugacgacccuuagccgcaccuccaagaaacggagcuggccccucaacgaggcgaucauggcgguagggaugguauccauucuggccagcagccugcucaagaacgacaucccgaugaccgggccccuggucgccggcgggcugcucacggugugcuacguacugaccggccgcuccgccgaucuggagcucgagcgggccacagacgucaagugggaggaccaggcggagaucucaggguccagccccauucuguccaucacgaucagcgaggacggauccaugagcaucaagaacgaggaagaggagcagacucucaccauccucauccguaccgggcuucuggugaucuccggcuuguuucccgugucaauacccaucaccgcggccgccugguaccugugggaggugaagaaacagcgggccgggguccuaugggacgugcccaguccaccgcccgucggcaaggcugagcucgaggacggcgcauaccgcauaaagcagaaggguauccuggguuacagccagauuggcgcagggguguacaaggagggcaccuuccacacgauguggcacgugacgcguggagccguucugaugcaccgcggcaagcggauagagcccuccugggccgacgugaagaaggaccucaucucauacggggggggcuggaagcuggagggugaguggaaggaaggcgaagaggugcaggugcuggcacucgagcccgggaagaacccccgcgccgugcaaaccaagccaggauuauucaagacuaacacggggacaaucggcgcggugucacuagacuucagucccggcaccucagggagcccuaucguagaccggaagggcaagguggugggacuguacggcaacggcgucgugacccgcuccggggccuacgucagcgcaaucgcacaaacggagaaguccaucgaggacaaucccgagaucgaagacgauaucuuccggaagaagcgcuugaccaucauggaucugcaucccggcgccgggaagaccaagagauaccugcccgccaucguccgcgaagccauuaagcgagggcuccgcacauuaauccuggcgcccacgcgagugguagccgcggaaauggaagaggcacugcggggguugccgauccgauaccaaaccccggccauucgcgcggagcacaccggucgcgagaucgucgaccugaugugucaugccaccuucacuaugcggcuccugagcccggugcgugugcccaacuacaaccugaucauuauggacgaggcccacuucaccgauccggccagcaucgcugcgcgugguuauaucuccacgcgcgucgaaaugggcgaggccgcaggcaucuuuaugaccgccacgccccccgggagcagggaccccuucccgcaguccaacgcuccaaucauggacgaggagcgcgagauccccgagcggagcuggaacuccggccacgagugggugaccgacuucaagggcaagacagugugguucguccccuccauuaaggccggcaacgacaucgccgccugccuccgcaagaacggcaaaaaggugauccaacugucccggaaaacuuucgacuccgaauaugugaagacgcgcacaaacgacugggauuucguggugaccaccgacaucuccgaaaugggggcgaacuuuaaagccgagcgggugaucgacccucgccggugcaugaaacccgucauucugacggauggcgaagagcgugucauacucgccggacccaugccuguaacccacuccucggccgcccagagacgcggcaggaucgggcgcaacccgaagaacgagaacgaccaguauaucuacaugggagagccccucgagaacgaugaggacugcgcccacuggaaggaagcgaagaugcuacucgacaacaucaauacccccgagggcaucauccccagcauguucgagcccgaacgcgagaaggucgacgccaucgacggugaguaccgccugcgaggcgaagcccggaagaccuucguugaccugaugcgccgcggggaccuccccguguggcuggccuaccgcgucgcggcggagggcaucaacuacgccgaccggcgcuggugcuucgacggggugaaaaacaaccagauccuagaggagaacguggaaguggagauuuggacgaaggagggugagcggaagaagcucaaaccacgcuggcuggacgccagaauuuacucagacccccuggcuuugaaggaguucaaggaauucgcggccggccgaaagagccugacccucaaccucauaaccgagauggggcgucugcccaccuucaugacgcagaaggcacgggacgcccuggacaaccucgccgugcugcacaccgcggaagcuggcgggcgggccuauaaccaugcacugucggaauugcccgagacccuggagaccuugcuccuucuaacgcuccuggcaaccguaaccggcggcaucuuccuguuccucaugagcgggaagggcgucgggaagaugacccugggcaugugcugcaucaucacagcguccauuuuacugugguacgcccagauccagccgcauuggaucgccgccagcaucauccuggaguuuuuccucaucguacuccugauuccugaacccgagaagcagcggacgccucaggacaaccagcugaccuacgucgugaucgccauccucaccguagucgcggccaccauggccaacgagaugggauuuuuagaaaagacgaaaaaggaccugggccucggcagcguggccacacaagaacccgaguccaacauccuggacauugauuugcggccggccagcgccuggacccucuacgccguggccaccacauucgucacccccaugcuacgccauuccaucgagaacagcaguguuaacguuagccugacagcgaucgcgaaccaggccaccguucucauggggcugggcaagggguggccuuuguccaagauggacauuggcguaccccuccuugccaucgggugcuacucacaggugaacccgaucacguuaaccgccgcccucuugcugcucguagcucacuacgccauaauuggucccggcuugcaggccaaggccacccgggaggcccagaagcgcgcggcggccggcaucaugaagaauccuacuguggacggcaucaccgugauugacuuggacccaaucccuuaugaccccaaauucgagaagcagcucgggcaggucaugcuguugauccucugcgugacccagguguuaaugaugcggaccacuugggcgcugugcgaggcccugacccuagcgaccggccccaucuccaccuugugggaggggaaucccggcagauucuggaacaccacgaucgccgucagcauggcuaacaucuucaggggcucauaccucgccggggcuggccugcucuucagcauuaugaagaacaccaccaacacccgacgcgggacgggcaacaucggcgaaacccucggggagaaguggaagucccgacugaacgcccuggggaagucggaguuccagauuuacaaaaagucugggauacaggaaguagaccgcacccucgcgaaagagggaauaaagcgcggggagacagaccaccacgcuguaagccgcggcuccgccaagcugcggugguucgucgagcgcaacauggugacgccggagggcaagguggucgaccucgggugcggccgagggggauggagcuacuacugcggcggucucaaaaaugugcgcgaggugaagggccugaccaagggcggacccggccacgaggagcccauccccauguccaccuauggauggaaccuggugaggcuccagagcgggguggacguguucuucacgccgccagagaagugcgacacgcugcuaugcgacaucggcgagagcuccccaaacccuaccaucgaggcaggccgcacucuccgggugcugagccuggucgagaauuggcucaacaacgacacacaguucugcauaaaggugcugaacccguacaugccgcccguaauagagaaaauggaaacacugcagcgcaaguaugggggugcccuagugcggaacccgcucagucgcaacagcacgcaugagauguauugggugagcaaugcgaccgggaacaucgucagcuccgugaauaugaucagccgaaugcugaucaacagauuuaccaugaagcacaagaaggccacguacgaacccgacguggaccugggcuccgggacgcgcaacauaggcaucgaguccgagauccccaaccucgauauaauuggcaagcgcauagaaaagauuaagcaggagcacgagacuucuuggcacuacgaccaggaccaucccuacaagaccugggcuuaccacgggucguacgagaccaagcagacgggcagugcaagcuccauggucaacgggguagugcgccugcugaccaagcccugggacgucgugccuauggugacccaaauggccaugacggacacuacucccuucggccagcagcgcgucuucaaggagaagguagacacccgcacccaggagcccaaagaaggaacgaaaaagcuaaugaagaucacagcggaguggcuguggaaggagcuggggaagaagaagaccccgcguaugugcacgcgcgaagaguucacgcgcaagguucggucgaacgccgcccucggcgcgaucuucaccgacgaaaacaaguggaaguccgcccgggaagccguagaggacagcagauucugggaacugguggacaaggagcgcaaccuacaucucgaagggaagugcgaaacaugcguguacaacaugaugggcaagcgcgagaagaagcugggggaguucggcaaggccaagggaucacgggcgaucugguacauguggcuuggggccagauuccucgaguuugaggcucuaggcuuccugaaugaggaccacugguuuagccgggagaacucguuauccgggguggaaggcgagggccugcacaaguugggcuacauccuccgcgaugugaguaagaaggagggcggggcgauguacgccgacgauacggcgggcugggacacccggaucacccucgaggaccugaagaacgaggagauggucaccaaccacauggaaggggagcacaagcgcuuagccgaggccaucuucaagcugacuuaccagaacaagguagugcggguucagcgaccgacgccucgcggcaccgugauggacaucaucagucgacgggaccagcgcgggagcggucagguggggaccuacggucugaacaccuucacgaacauggaggcccagcucauacgccagauggagggcgaggggauauuuaaguccauacagcaccugaccguuacagaagagaucgccgugcagaacugguuggcucgggugggccgcgagaggcuaucccgcauggccaucuccggcgacgacugcgucgucaagccccuggacgaccgguucgccagcgcccugaccgcacucaaugacauggguaaggugcgcaaggauauucagcagugggagccguccaagggcuggaacgauuggacgcaggugcccuucugcagccaccauuuucacgacuugaucaugaaagacggacggguacuggugguccccugcaggaaccaagacgaguuaaucggccgugcgcgaaucucccaaggggccggauggucucugaaggagaccgccugucuggggaaaucauacgcucagauguggagccuaauguacuuccaccggcgugaccugcgccuggccgcuaacgccaucuguagugccgugcccucacacuggguuccgacgagucguaccaccuggagcauacacgccaaacacgaguggaugacuaccgaggacaugcucaccgucuggaaccggguuuggauccaggaaaacccuuggauggaggacaagacccccguggaaucuugggaggaagucccauaccugggaaagagggaggaucaguggugcggcucccugaucggacucacgagcagggcaaccugggcuaagaauauccagaccgcgaucaaccaggugcgcagcuuaaucggcaaugaggaguacaccgauuacaugccgucuaugaagcgguuccgccgcgaggaggaggaggccggugugcugugguga
